United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 182

SEQ ID NO: 7589082 - DNA, 22 bp, Homo sapiens
tagatgtgagcccaggctgctt

SEQ ID NO: 7589083 - DNA, 22 bp, Homo sapiens
tagatgtgagcccaggctgctt

SEQ ID NO: 7589084 - DNA, 22 bp, Homo sapiens
tagatgtgagcccaggctgctt

SEQ ID NO: 7589085 - DNA, 22 bp, Homo sapiens
tagcaagacaacttttctcagt

SEQ ID NO: 7589086 - DNA, 22 bp, Homo sapiens
tagcaagaagggagatggggtt

SEQ ID NO: 7589087 - DNA, 22 bp, Homo sapiens
tagcaagaagtagctctggatt

SEQ ID NO: 7589088 - DNA, 22 bp, Homo sapiens
tagcaaaagccacgattacttt

SEQ ID NO: 7589089 - DNA, 22 bp, Homo sapiens
tagcaaaagccacgattacttt

SEQ ID NO: 7589090 - DNA, 22 bp, Homo sapiens
tagcaaaagccacgattacttt

SEQ ID NO: 7589091 - DNA, 22 bp, Homo sapiens
tagcaaaagccacgattacttt

SEQ ID NO: 7589092 - DNA, 22 bp, Homo sapiens
tagcaaaagccacgattacttt

SEQ ID NO: 7589093 - DNA, 22 bp, Homo sapiens
tagcaaaagccacgattacttt

SEQ ID NO: 7589094 - DNA, 22 bp, Homo sapiens
tagcaaaaactgcagttacttt

SEQ ID NO: 7589095 - DNA, 22 bp, Homo sapiens
tagattttttggagactctctg

SEQ ID NO: 7589096 - DNA, 22 bp, Homo sapiens
tagcaaaaactgcagttacttt

SEQ ID NO: 7589097 - DNA, 22 bp, Homo sapiens
tagcaaaaactgcagttacttt

SEQ ID NO: 7589098 - DNA, 22 bp, Homo sapiens
tagcaaaaactgcagttacttt

SEQ ID NO: 7589099 - DNA, 22 bp, Homo sapiens
tagcaaaaactgcagttacttt

SEQ ID NO: 7589100 - DNA, 22 bp, Homo sapiens
tagcaaaaaaactggcatctcc

SEQ ID NO: 7589101 - DNA, 22 bp, Homo sapiens
tagcaaaaaaactggcatctcc

SEQ ID NO: 7589102 - DNA, 22 bp, Homo sapiens
tagcaaaaaaactggcatctcc

SEQ ID NO: 7589103 - DNA, 22 bp, Homo sapiens
tagcaaaaaaactggcatctcc

SEQ ID NO: 7589104 - DNA, 22 bp, Homo sapiens
tagcaaaaactgcagttacttt

SEQ ID NO: 7589105 - DNA, 22 bp, Homo sapiens
tagcaaaaactgcagttacttt

SEQ ID NO: 7589106 - DNA, 22 bp, Homo sapiens
tagcaagaggtgaaggtttcat

SEQ ID NO: 7589107 - DNA, 22 bp, Homo sapiens
tagcaagaggaaacaaggggcc

SEQ ID NO: 7589108 - DNA, 17 bp, Homo sapiens
tagcacaaagcaggatt

SEQ ID NO: 7589109 - DNA, 22 bp, Homo sapiens
tagcacaaagtcttgccctttt

SEQ ID NO: 7589110 - DNA, 22 bp, Homo sapiens
tagcaagacaacttttctcagt

SEQ ID NO: 7589111 - DNA, 22 bp, Homo sapiens
tagcaagaccaatatgtagata

SEQ ID NO: 7589112 - DNA, 22 bp, Homo sapiens
tagcaagaccaatatgtagata

SEQ ID NO: 7589113 - DNA, 22 bp, Homo sapiens
tagcaagaccaatatgtagata

SEQ ID NO: 7589114 - DNA, 22 bp, Homo sapiens
tagcaagaggaaacaaggggcc

SEQ ID NO: 7589115 - DNA, 22 bp, Homo sapiens
tagcacaagcaactactgaagt

SEQ ID NO: 7589116 - DNA, 22 bp, Homo sapiens
tagcacaagcaactactgaagt

SEQ ID NO: 7589117 - DNA, 22 bp, Homo sapiens
tagcacaagaagtacacataga

SEQ ID NO: 7589118 - DNA, 22 bp, Homo sapiens
tagcacaagaagtacacataga

SEQ ID NO: 7589119 - DNA, 22 bp, Homo sapiens
tagcacaagcaactactgaagt

SEQ ID NO: 7589120 - DNA, 22 bp, Homo sapiens
tagcacaagtatctgcttttcc

SEQ ID NO: 7589121 - DNA, 22 bp, Homo sapiens
tagcacaagtatctgcttttcc

SEQ ID NO: 7589122 - DNA, 22 bp, Homo sapiens
tagcacaatatcatgtctgtga

SEQ ID NO: 7589123 - DNA, 22 bp, Homo sapiens
tagcacaatatcatgtctgtga

SEQ ID NO: 7589124 - DNA, 22 bp, Homo sapiens
tagcacacactgcatctacaaa

SEQ ID NO: 7589125 - DNA, 22 bp, Homo sapiens
tagcacagcttcttgatgtcac

SEQ ID NO: 7589126 - DNA, 22 bp, Homo sapiens
tagcacagggctcctcaaccca

SEQ ID NO: 7589127 - DNA, 22 bp, Homo sapiens
tagcacagggcatatgcggtgg

SEQ ID NO: 7589128 - DNA, 22 bp, Homo sapiens
tagcacaggtcttgttgccatt

SEQ ID NO: 7589129 - DNA, 22 bp, Homo sapiens
tagcacaggtcttgttgccatt

SEQ ID NO: 7589130 - DNA, 22 bp, Homo sapiens
tagcacaggtcttgttgccatt

SEQ ID NO: 7589131 - DNA, 22 bp, Homo sapiens
tagcacagtgttcacaacagtg

SEQ ID NO: 7589132 - DNA, 17 bp, Homo sapiens
tagcacagtgcctggta

SEQ ID NO: 7589133 - DNA, 22 bp, Homo sapiens
tagcacagtgttcacaacagtg

SEQ ID NO: 7589134 - DNA, 17 bp, Homo sapiens
tagcacagtgcctggta

SEQ ID NO: 7589135 - DNA, 22 bp, Homo sapiens
tagcacagtatttctcaactgg

SEQ ID NO: 7589136 - DNA, 22 bp, Homo sapiens
tagcacagtatttctcaactgg

SEQ ID NO: 7589137 - DNA, 18 bp, Homo sapiens
tagcacagagcaggatgt

SEQ ID NO: 7589138 - DNA, 22 bp, Homo sapiens
tagcacagacagaatggtcata

SEQ ID NO: 7589139 - DNA, 22 bp, Homo sapiens
tagcacagacagaatggtcata

SEQ ID NO: 7589140 - DNA, 22 bp, Homo sapiens
tagcacagacagaatggtcata

SEQ ID NO: 7589141 - DNA, 22 bp, Homo sapiens
tagcacacactgcatctacaaa

SEQ ID NO: 7589142 - DNA, 22 bp, Homo sapiens
tagcacactgcatatgaagatt

SEQ ID NO: 7589143 - DNA, 21 bp, Homo sapiens
tagcacagctgtagacagttt

SEQ ID NO: 7589144 - DNA, 21 bp, Homo sapiens
tagcacagctgtagacagttt

SEQ ID NO: 7589145 - DNA, 22 bp, Homo sapiens
tagcacagcttcttgatgtcac

SEQ ID NO: 7589146 - DNA, 22 bp, Homo sapiens
tagcacagcttcttgatgtcac

SEQ ID NO: 7589147 - DNA, 22 bp, Homo sapiens
tagcacagcttcttgatgtcac

SEQ ID NO: 7589148 - DNA, 18 bp, Homo sapiens
tagcacagagcaggatgt

SEQ ID NO: 7589149 - DNA, 18 bp, Homo sapiens
tagcacagagcaggatgt

SEQ ID NO: 7589150 - DNA, 18 bp, Homo sapiens
tagcacagagcaggatgt

SEQ ID NO: 7589151 - DNA, 21 bp, Homo sapiens
tagcacagctgtagacagttt

SEQ ID NO: 7589152 - DNA, 21 bp, Homo sapiens
tagcacagctgtagacagttt

SEQ ID NO: 7589153 - DNA, 22 bp, Homo sapiens
tagcacagagcttttaaacttc

SEQ ID NO: 7589154 - DNA, 22 bp, Homo sapiens
taggttccatgagggaggcaaa

SEQ ID NO: 7589155 - DNA, 22 bp, Homo sapiens
taggttcatgaaattttcagga

SEQ ID NO: 7589156 - DNA, 22 bp, Homo sapiens
taggttccatgagggaggcaaa

SEQ ID NO: 7589157 - DNA, 22 bp, Homo sapiens
taggttccatttaaacaaagaa

SEQ ID NO: 7589158 - DNA, 22 bp, Homo sapiens
taggtttactgaattagtggaa

SEQ ID NO: 7589159 - DNA, 22 bp, Homo sapiens
taggtttactgaattagtggaa

SEQ ID NO: 7589160 - DNA, 22 bp, Homo sapiens
taggttcatattctagaatcat

SEQ ID NO: 7589161 - DNA, 22 bp, Homo sapiens
taggttcagtgtcttgttctgc

SEQ ID NO: 7589162 - DNA, 22 bp, Homo sapiens
taggttcaggagatattgcaca

SEQ ID NO: 7589163 - DNA, 22 bp, Homo sapiens
taggttcagctttcatcctgaa

SEQ ID NO: 7589164 - DNA, 22 bp, Homo sapiens
taggttcacttagctgtgggaa

SEQ ID NO: 7589165 - DNA, 22 bp, Homo sapiens
taggttcagagaactgaaaata

SEQ ID NO: 7589166 - DNA, 22 bp, Homo sapiens
taggttcagcttccactgccta

SEQ ID NO: 7589167 - DNA, 22 bp, Homo sapiens
taggttcactgtcttgaggagc

SEQ ID NO: 7589168 - DNA, 22 bp, Homo sapiens
taggttcacacatcttccagat

SEQ ID NO: 7589169 - DNA, 22 bp, Homo sapiens
taggttcacacatcttccagat

SEQ ID NO: 7589170 - DNA, 22 bp, Homo sapiens
taggttcaagttcaggctctat

SEQ ID NO: 7589171 - DNA, 22 bp, Homo sapiens
taggttcaagttcaggctctat

SEQ ID NO: 7589172 - DNA, 18 bp, Homo sapiens
taggttacagccagccag

SEQ ID NO: 7589173 - DNA, 20 bp, Homo sapiens
taggtgtctttgccagcttt

SEQ ID NO: 7589174 - DNA, 22 bp, Homo sapiens
taggtgtgggctcaggaatgtg

SEQ ID NO: 7589175 - DNA, 22 bp, Homo sapiens
taggtgtgattcgaagagcaaa

SEQ ID NO: 7589176 - DNA, 22 bp, Homo sapiens
taggctgggaagaaagattctc

SEQ ID NO: 7589177 - DNA, 22 bp, Homo sapiens
taggctgggaagaaagattctc

SEQ ID NO: 7589178 - DNA, 22 bp, Homo sapiens
taggctgggagcctgaggctag

SEQ ID NO: 7589179 - DNA, 22 bp, Homo sapiens
taggctgggagcctgaggctag

SEQ ID NO: 7589180 - DNA, 22 bp, Homo sapiens
taggctgggagcctgaggctag

SEQ ID NO: 7589181 - DNA, 22 bp, Homo sapiens
taggctgggagcctgaggctag

SEQ ID NO: 7589182 - DNA, 22 bp, Homo sapiens
taggctgggagcctgaggctag

SEQ ID NO: 7589183 - DNA, 22 bp, Homo sapiens
taggctgggagcctgaggctag

SEQ ID NO: 7589184 - DNA, 22 bp, Homo sapiens
taggctgggaagaaagattctc

SEQ ID NO: 7589185 - DNA, 22 bp, Homo sapiens
taggctgggaagaaagattctc

SEQ ID NO: 7589186 - DNA, 22 bp, Homo sapiens
taggctggaggaagcagtgcct

SEQ ID NO: 7589187 - DNA, 22 bp, Homo sapiens
taggctggaggaagcagtgcct

SEQ ID NO: 7589188 - DNA, 22 bp, Homo sapiens
taggctggaggaagcagtgcct

SEQ ID NO: 7589189 - DNA, 22 bp, Homo sapiens
taggctggaggaagcagtgcct

SEQ ID NO: 7589190 - DNA, 22 bp, Homo sapiens
taggctggaggaagcagtgcct

SEQ ID NO: 7589191 - DNA, 22 bp, Homo sapiens
taggctggaggaagcagtgcct

SEQ ID NO: 7589192 - DNA, 22 bp, Homo sapiens
taggctggaggaagcagtgcct

SEQ ID NO: 7589193 - DNA, 22 bp, Homo sapiens
taggctggaggaagcagtgcct

SEQ ID NO: 7589194 - DNA, 22 bp, Homo sapiens
taggctggaacttaggcagagg

SEQ ID NO: 7589195 - DNA, 22 bp, Homo sapiens
taggctggaacttaggcagagg

SEQ ID NO: 7589196 - DNA, 22 bp, Homo sapiens
taggctggaacttaggcagagg

SEQ ID NO: 7589197 - DNA, 22 bp, Homo sapiens
taggctggaacttaggcagagg

SEQ ID NO: 7589198 - DNA, 22 bp, Homo sapiens
taggctgaggttgatgccaggg

SEQ ID NO: 7589199 - DNA, 22 bp, Homo sapiens
taggctgctcaccaggctcaga

SEQ ID NO: 7589200 - DNA, 22 bp, Homo sapiens
taggctgcaagcatagaacaaa

SEQ ID NO: 7589201 - DNA, 22 bp, Homo sapiens
taggctgcaagcatagaacaaa

SEQ ID NO: 7589202 - DNA, 22 bp, Homo sapiens
taggctgaggttgatgccaggg

SEQ ID NO: 7589203 - DNA, 22 bp, Homo sapiens
taggctgagcttgtagatcgta

SEQ ID NO: 7589204 - DNA, 22 bp, Homo sapiens
taggctggaacttaggcagagg

SEQ ID NO: 7589205 - DNA, 22 bp, Homo sapiens
taggctggaacttaggcagagg

SEQ ID NO: 7589206 - DNA, 22 bp, Homo sapiens
taggctgaggttgatgccaggg

SEQ ID NO: 7589207 - DNA, 22 bp, Homo sapiens
taggctggaacttaggcagagg

SEQ ID NO: 7589208 - DNA, 22 bp, Homo sapiens
taggctgctcaccaggctcaga

SEQ ID NO: 7589209 - DNA, 22 bp, Homo sapiens
taggctggaacttaggcagagg

SEQ ID NO: 7589210 - DNA, 22 bp, Homo sapiens
taggctgacttgtttcataaag

SEQ ID NO: 7589211 - DNA, 22 bp, Homo sapiens
taggctgaaaggagaggtgaag

SEQ ID NO: 7589212 - DNA, 22 bp, Homo sapiens
taggctgacttgtttcataaag

SEQ ID NO: 7589213 - DNA, 22 bp, Homo sapiens
taggctgagcttgtagatcgta

SEQ ID NO: 7589214 - DNA, 22 bp, Homo sapiens
taggctgagctaagagagctta

SEQ ID NO: 7589215 - DNA, 22 bp, Homo sapiens
taggctgagctaagagagctta

SEQ ID NO: 7589216 - DNA, 22 bp, Homo sapiens
taggctgagctaagagagctta

SEQ ID NO: 7589217 - DNA, 22 bp, Homo sapiens
tagtactacgttttctactatc

SEQ ID NO: 7589218 - DNA, 22 bp, Homo sapiens
tagtacagtttactttcagcgc

SEQ ID NO: 7589219 - DNA, 22 bp, Homo sapiens
tagtacagttttggcacatgga

SEQ ID NO: 7589220 - DNA, 22 bp, Homo sapiens
tagtagaatccaaaccaacagt

SEQ ID NO: 7589221 - DNA, 22 bp, Homo sapiens
tagtactacgttttctactatc

SEQ ID NO: 7589222 - DNA, 22 bp, Homo sapiens
tagtacttatctctgtcattgt

SEQ ID NO: 7589223 - DNA, 22 bp, Homo sapiens
tagtacttatctctgtcattgt

SEQ ID NO: 7589224 - DNA, 22 bp, Homo sapiens
tagtagtgagtctttataaata

SEQ ID NO: 7589225 - DNA, 19 bp, Homo sapiens
tagtagtagaaaacaatac

SEQ ID NO: 7589226 - DNA, 22 bp, Homo sapiens
tagtagcaccagtcatatttga

SEQ ID NO: 7589227 - DNA, 22 bp, Homo sapiens
tagtagtaattgttatcttatt

SEQ ID NO: 7589228 - DNA, 22 bp, Homo sapiens
tagtagcaaaactcatctcttt

SEQ ID NO: 7589229 - DNA, 22 bp, Homo sapiens
tagtagcaaaactcatctcttt

SEQ ID NO: 7589230 - DNA, 22 bp, Homo sapiens
tagtagaaaaatgttaatccct

SEQ ID NO: 7589231 - DNA, 22 bp, Homo sapiens
tagtagcaggaatctgaaggta

SEQ ID NO: 7589232 - DNA, 22 bp, Homo sapiens
tagtagcagggggtacctctca

SEQ ID NO: 7589233 - DNA, 22 bp, Homo sapiens
tagtatatgtctatggttgtag

SEQ ID NO: 7589234 - DNA, 22 bp, Homo sapiens
tagtatatctttagtacatagt

SEQ ID NO: 7589235 - DNA, 22 bp, Homo sapiens
tagtatatctttagtacatagt

SEQ ID NO: 7589236 - DNA, 22 bp, Homo sapiens
tagtatatctttagtacatagt

SEQ ID NO: 7589237 - DNA, 22 bp, Homo sapiens
tagtatatctttagtacatagt

SEQ ID NO: 7589238 - DNA, 22 bp, Homo sapiens
tagtatagattgaagcagatca

SEQ ID NO: 7589239 - DNA, 22 bp, Homo sapiens
tagtatagattgaagcagatca

SEQ ID NO: 7589240 - DNA, 22 bp, Homo sapiens
tagtatagattgaagcagatca

SEQ ID NO: 7589241 - DNA, 22 bp, Homo sapiens
tagtatagattgaagcagatca

SEQ ID NO: 7589242 - DNA, 22 bp, Homo sapiens
tagtatagattgaagcagatca

SEQ ID NO: 7589243 - DNA, 22 bp, Homo sapiens
tagtataattgttctggaatca

SEQ ID NO: 7589244 - DNA, 22 bp, Homo sapiens
tagtatagattgaagcagatca

SEQ ID NO: 7589245 - DNA, 22 bp, Homo sapiens
tagtatagattgaagcagatca

SEQ ID NO: 7589246 - DNA, 22 bp, Homo sapiens
tagtataattgttctggaatca

SEQ ID NO: 7589247 - DNA, 22 bp, Homo sapiens
tagtataattgttctggaatca

SEQ ID NO: 7589248 - DNA, 22 bp, Homo sapiens
tagtaaaaagcaatggtgagta

SEQ ID NO: 7589249 - DNA, 22 bp, Homo sapiens
tagtaaaaagcaatggtgagta

SEQ ID NO: 7589250 - DNA, 22 bp, Homo sapiens
tagtaaaaggtcttcctttgtt

SEQ ID NO: 7589251 - DNA, 22 bp, Homo sapiens
taggttttcctaaaattctggt

SEQ ID NO: 7589252 - DNA, 22 bp, Homo sapiens
taggtttcagaggtgccgggaa

SEQ ID NO: 7589253 - DNA, 22 bp, Homo sapiens
taggtttcagaggtgccgggaa

SEQ ID NO: 7589254 - DNA, 22 bp, Homo sapiens
taggtttaggagtgaaggtgaa

SEQ ID NO: 7589255 - DNA, 22 bp, Homo sapiens
taggtttcagaggtgccgggaa

SEQ ID NO: 7589256 - DNA, 22 bp, Homo sapiens
taggtttcagaggtgccgggaa

SEQ ID NO: 7589257 - DNA, 22 bp, Homo sapiens
taggtttaggagtgaaggtgaa

SEQ ID NO: 7589258 - DNA, 22 bp, Homo sapiens
taggtttactgaattagtggaa

SEQ ID NO: 7589259 - DNA, 22 bp, Homo sapiens
taggtttactgaattagtggaa

SEQ ID NO: 7589260 - DNA, 22 bp, Homo sapiens
taggtttaggagtgaaggtgaa

SEQ ID NO: 7589261 - DNA, 22 bp, Homo sapiens
tagtaaaagtttagttgaaagt

SEQ ID NO: 7589262 - DNA, 22 bp, Homo sapiens
tagtaaacagctctgccacaat

SEQ ID NO: 7589263 - DNA, 22 bp, Homo sapiens
tagtaaaagtttagttgaaagt

SEQ ID NO: 7589264 - DNA, 22 bp, Homo sapiens
tagtaaaagtttagttgaaagt

SEQ ID NO: 7589265 - DNA, 22 bp, Homo sapiens
tagtaaaagtttagttgaaagt

SEQ ID NO: 7589266 - DNA, 22 bp, Homo sapiens
tagtaaaagtttagttgaaagt

SEQ ID NO: 7589267 - DNA, 22 bp, Homo sapiens
tagtaaaaggtcttcctttgtt

SEQ ID NO: 7589268 - DNA, 22 bp, Homo sapiens
tagtacagtttaaatattaata

SEQ ID NO: 7589269 - DNA, 22 bp, Homo sapiens
tagtacagtttaaatattaata

SEQ ID NO: 7589270 - DNA, 22 bp, Homo sapiens
tagtaaagtgtcttaacacata

SEQ ID NO: 7589271 - DNA, 22 bp, Homo sapiens
tagtacagtttaaatattaata

SEQ ID NO: 7589272 - DNA, 22 bp, Homo sapiens
tagtaaagtgtcttaacacata

SEQ ID NO: 7589273 - DNA, 22 bp, Homo sapiens
tagtaaagtgtcttaacacata

SEQ ID NO: 7589274 - DNA, 22 bp, Homo sapiens
tagtaaagtgtcttaacacata

SEQ ID NO: 7589275 - DNA, 22 bp, Homo sapiens
tagtaaagtgtcttaacacata

SEQ ID NO: 7589276 - DNA, 22 bp, Homo sapiens
tagtaaagtgtcttaacacata

SEQ ID NO: 7589277 - DNA, 22 bp, Homo sapiens
tagtaaacaggcaagggaccac

SEQ ID NO: 7589278 - DNA, 22 bp, Homo sapiens
tagtaaaagtttagttgaaagt

SEQ ID NO: 7589279 - DNA, 22 bp, Homo sapiens
tagtaaacccatgaggcttaaa

SEQ ID NO: 7589280 - DNA, 22 bp, Homo sapiens
tagtccagccttgggtgtagcc

SEQ ID NO: 7589281 - DNA, 22 bp, Homo sapiens
tagtccacagactctacagcat

SEQ ID NO: 7589282 - DNA, 22 bp, Homo sapiens
tagtccacagactctacagcat

SEQ ID NO: 7589283 - DNA, 22 bp, Homo sapiens
tagtccagaaactgagcttata

SEQ ID NO: 7589284 - DNA, 20 bp, Homo sapiens
tagtccaatacttagtccat

SEQ ID NO: 7589285 - DNA, 22 bp, Homo sapiens
tagtccacaaaaagtcttgacc

SEQ ID NO: 7589286 - DNA, 22 bp, Homo sapiens
tagtccagaaactgagcttata

SEQ ID NO: 7589287 - DNA, 22 bp, Homo sapiens
tagtcatctgggtaatgttcaa

SEQ ID NO: 7589288 - DNA, 22 bp, Homo sapiens
tagtcatttttccactaagtta

SEQ ID NO: 7589289 - DNA, 22 bp, Homo sapiens
tagtcattctccttacaaagcc

SEQ ID NO: 7589290 - DNA, 22 bp, Homo sapiens
tagtcagacccaagagagccat

SEQ ID NO: 7589291 - DNA, 22 bp, Homo sapiens
tagtcagagtcttctctgttgt

SEQ ID NO: 7589292 - DNA, 22 bp, Homo sapiens
tagtcagatatatgacttacgt

SEQ ID NO: 7589293 - DNA, 22 bp, Homo sapiens
tagtcagggatgcaattatgtg

SEQ ID NO: 7589294 - DNA, 22 bp, Homo sapiens
tagtcacatgatcacaggatcg

SEQ ID NO: 7589295 - DNA, 22 bp, Homo sapiens
tagtcaccagctacaggacagc

SEQ ID NO: 7589296 - DNA, 22 bp, Homo sapiens
tagtcacatgatcacaggatcg

SEQ ID NO: 7589297 - DNA, 22 bp, Homo sapiens
tagtcacagtacaggataaaga

SEQ ID NO: 7589298 - DNA, 22 bp, Homo sapiens
tagtcacatgatcacaggatcg

SEQ ID NO: 7589299 - DNA, 22 bp, Homo sapiens
tagtcacatgatcacaggatcg

SEQ ID NO: 7589300 - DNA, 22 bp, Homo sapiens
tagtcacctctttaaatgtcct

SEQ ID NO: 7589301 - DNA, 22 bp, Homo sapiens
tagtcacctttggcacctgcaa

SEQ ID NO: 7589302 - DNA, 22 bp, Homo sapiens
tagtcacaggaagtttcaatgt

SEQ ID NO: 7589303 - DNA, 22 bp, Homo sapiens
tagtcacaggaagtttcaatgt

SEQ ID NO: 7589304 - DNA, 22 bp, Homo sapiens
tagtcacagtacaggataaaga

SEQ ID NO: 7589305 - DNA, 22 bp, Homo sapiens
tagtcacaggaagtttcaatgt

SEQ ID NO: 7589306 - DNA, 22 bp, Homo sapiens
tagtcacacaattgtgtacatt

SEQ ID NO: 7589307 - DNA, 22 bp, Homo sapiens
tagtcaatcagtatgtattgga

SEQ ID NO: 7589308 - DNA, 22 bp, Homo sapiens
tagtcacacaattgtgtacatt

SEQ ID NO: 7589309 - DNA, 22 bp, Homo sapiens
tagtcacacaattgtgtacatt

SEQ ID NO: 7589310 - DNA, 22 bp, Homo sapiens
tagtatttcctgtaagctatag

SEQ ID NO: 7589311 - DNA, 22 bp, Homo sapiens
tagtatttcctgtaagctatag

SEQ ID NO: 7589312 - DNA, 22 bp, Homo sapiens
tagtatttcctgtaagctatag

SEQ ID NO: 7589313 - DNA, 22 bp, Homo sapiens
tagtatttcctgtaagctatag

SEQ ID NO: 7589314 - DNA, 22 bp, Homo sapiens
tagtatttcctgtaagctatag

SEQ ID NO: 7589315 - DNA, 22 bp, Homo sapiens
tagtatttcctgtaagctatag

SEQ ID NO: 7589316 - DNA, 22 bp, Homo sapiens
tagtatttaatcacttttgtct

SEQ ID NO: 7589317 - DNA, 22 bp, Homo sapiens
tagtatttataatcatgcttaa

SEQ ID NO: 7589318 - DNA, 22 bp, Homo sapiens
tagtatttataatcatgcttaa

SEQ ID NO: 7589319 - DNA, 22 bp, Homo sapiens
tagtatttataatcatgcttaa

SEQ ID NO: 7589320 - DNA, 22 bp, Homo sapiens
tagtatttataatcatgcttaa

SEQ ID NO: 7589321 - DNA, 22 bp, Homo sapiens
tagtatggtttcatttgagtaa

SEQ ID NO: 7589322 - DNA, 22 bp, Homo sapiens
tagtatttaatcacttttgtct

SEQ ID NO: 7589323 - DNA, 22 bp, Homo sapiens
tagtatttaatcacttttgtct

SEQ ID NO: 7589324 - DNA, 22 bp, Homo sapiens
tagtatttaatcacttttgtct

SEQ ID NO: 7589325 - DNA, 22 bp, Homo sapiens
tagtatttaatcacttttgtct

SEQ ID NO: 7589326 - DNA, 22 bp, Homo sapiens
tagtatgttgtctgatgttacc

SEQ ID NO: 7589327 - DNA, 22 bp, Homo sapiens
tagtatgtcttactctaataca

SEQ ID NO: 7589328 - DNA, 22 bp, Homo sapiens
tagtatgttgtctgatgttacc

SEQ ID NO: 7589329 - DNA, 22 bp, Homo sapiens
tagtattcagcttctcaggcaa

SEQ ID NO: 7589330 - DNA, 22 bp, Homo sapiens
tagtatctattagtaacaagag

SEQ ID NO: 7589331 - DNA, 22 bp, Homo sapiens
tagtatctttctatatttccca

SEQ ID NO: 7589332 - DNA, 22 bp, Homo sapiens
tagtatgggaagaactttgtag

SEQ ID NO: 7589333 - DNA, 22 bp, Homo sapiens
tagtattttagaaaaccatgaa

SEQ ID NO: 7589334 - DNA, 22 bp, Homo sapiens
tagtattttagaaaaccatgaa

SEQ ID NO: 7589335 - DNA, 20 bp, Homo sapiens
tagtatttgcataaggatag

SEQ ID NO: 7589336 - DNA, 20 bp, Homo sapiens
tagtatttgcataaggatag

SEQ ID NO: 7589337 - DNA, 20 bp, Homo sapiens
tagtatttgcataaggatag

SEQ ID NO: 7589338 - DNA, 20 bp, Homo sapiens
tagtatttgcataaggatag

SEQ ID NO: 7589339 - DNA, 22 bp, Homo sapiens
tagtatttgcagatttgtgtca

SEQ ID NO: 7589340 - DNA, 22 bp, Homo sapiens
tagtatttgcagatttgtgtca

SEQ ID NO: 7589341 - DNA, 22 bp, Homo sapiens
tagtcaagattggaataatgta

SEQ ID NO: 7589342 - DNA, 22 bp, Homo sapiens
tagtcaaacctcagaatacccc

SEQ ID NO: 7589343 - DNA, 22 bp, Homo sapiens
tagtcacaaccttcaagttgtc

SEQ ID NO: 7589344 - DNA, 22 bp, Homo sapiens
tagtcacaaccttcaagttgtc

SEQ ID NO: 7589345 - DNA, 22 bp, Homo sapiens
tagtcaatcagtatgtattgga

SEQ ID NO: 7589346 - DNA, 22 bp, Homo sapiens
tagtcaactagtgagcatatgg

SEQ ID NO: 7589347 - DNA, 22 bp, Homo sapiens
tagtcaaacctcagaatacccc

SEQ ID NO: 7589348 - DNA, 22 bp, Homo sapiens
tagtcaaacctcagaatacccc

SEQ ID NO: 7589349 - DNA, 22 bp, Homo sapiens
tagtccagtaaaacagctaacg

SEQ ID NO: 7589350 - DNA, 22 bp, Homo sapiens
tagtccaggtttccatctccac

SEQ ID NO: 7589351 - DNA, 22 bp, Homo sapiens
tagtccagtaaaacagctaacg

SEQ ID NO: 7589352 - DNA, 22 bp, Homo sapiens
tagtccagtaaaacagctaacg

SEQ ID NO: 7589353 - DNA, 20 bp, Homo sapiens
tagtccagtaggggggcttt

SEQ ID NO: 7589354 - DNA, 20 bp, Homo sapiens
tagtccagtaggggggcttt

SEQ ID NO: 7589355 - DNA, 23 bp, Homo sapiens
tagtccagtatggcaatgctatg

SEQ ID NO: 7589356 - DNA, 22 bp, Homo sapiens
tagtccaggacaatcttcatat

SEQ ID NO: 7589357 - DNA, 22 bp, Homo sapiens
tagtccaggaaggtggggcaga

SEQ ID NO: 7589358 - DNA, 22 bp, Homo sapiens
tagtccaggaaggtggggcaga

SEQ ID NO: 7589359 - DNA, 22 bp, Homo sapiens
tagtccaggttaatccctgcct

SEQ ID NO: 7589360 - DNA, 22 bp, Homo sapiens
tagtccaggttaatccctgcct

SEQ ID NO: 7589361 - DNA, 22 bp, Homo sapiens
tagtccagccttgggtgtagcc

SEQ ID NO: 7589362 - DNA, 22 bp, Homo sapiens
tagtccaggaaggtggggcaga

SEQ ID NO: 7589363 - DNA, 22 bp, Homo sapiens
tagtccattgattagctcattt

SEQ ID NO: 7589364 - DNA, 22 bp, Homo sapiens
tagtcccggaactccttcaggt

SEQ ID NO: 7589365 - DNA, 22 bp, Homo sapiens
tagtccattttcacactgctga

SEQ ID NO: 7589366 - DNA, 22 bp, Homo sapiens
tagtcccattttgaggtatttg

SEQ ID NO: 7589367 - DNA, 22 bp, Homo sapiens
tagtcctaaaattcagctatat

SEQ ID NO: 7589368 - DNA, 22 bp, Homo sapiens
tagtcctgaccagctggatgtt

SEQ ID NO: 7589369 - DNA, 22 bp, Homo sapiens
tagtcctgaccagctggatgtt

SEQ ID NO: 7589370 - DNA, 22 bp, Homo sapiens
tagtcctgaccttgccaccagc

SEQ ID NO: 7589371 - DNA, 22 bp, Homo sapiens
tagtcctgaccttgccaccagc

SEQ ID NO: 7589372 - DNA, 22 bp, Homo sapiens
tagtcctggattggtggaggca

SEQ ID NO: 7589373 - DNA, 22 bp, Homo sapiens
tagtcctggcagccctcctggc

SEQ ID NO: 7589374 - DNA, 22 bp, Homo sapiens
tagtccttacttactagaataa

SEQ ID NO: 7589375 - DNA, 22 bp, Homo sapiens
tagtcctttatcaaacatttat

SEQ ID NO: 7589376 - DNA, 22 bp, Homo sapiens
tagtccttggtaaaattctatg

SEQ ID NO: 7589377 - DNA, 22 bp, Homo sapiens
tagtccttgctgggcacagagt

SEQ ID NO: 7589378 - DNA, 22 bp, Homo sapiens
tagtgggtggaggccagggatg

SEQ ID NO: 7589379 - DNA, 22 bp, Homo sapiens
tagtgggtgatttgatgaggaa

SEQ ID NO: 7589380 - DNA, 22 bp, Homo sapiens
tagtgggtagaggccagggacg

SEQ ID NO: 7589381 - DNA, 22 bp, Homo sapiens
tagtggggaaggaggacaagaa

SEQ ID NO: 7589382 - DNA, 22 bp, Homo sapiens
tagtggggcctgggagggttcc

SEQ ID NO: 7589383 - DNA, 22 bp, Homo sapiens
tagtggggcctgggagggttcc

SEQ ID NO: 7589384 - DNA, 22 bp, Homo sapiens
tagtgtaatgacatttagacga

SEQ ID NO: 7589385 - DNA, 23 bp, Homo sapiens
tagtgtatatcaacatttgtccc

SEQ ID NO: 7589386 - DNA, 23 bp, Homo sapiens
tagtgtatatcaacatttgtccc

SEQ ID NO: 7589387 - DNA, 22 bp, Homo sapiens
tagtctaagaaatctttacttt

SEQ ID NO: 7589388 - DNA, 22 bp, Homo sapiens
tagtctctaggaggggaaaaga

SEQ ID NO: 7589389 - DNA, 22 bp, Homo sapiens
tagtggatgggtaaagtatttt

SEQ ID NO: 7589390 - DNA, 22 bp, Homo sapiens
tagtggatgggtaaagtatttt

SEQ ID NO: 7589391 - DNA, 19 bp, Homo sapiens
tagtggagtgacaagttct

SEQ ID NO: 7589392 - DNA, 22 bp, Homo sapiens
tagtggcattgttgtgaggatt

SEQ ID NO: 7589393 - DNA, 22 bp, Homo sapiens
tagtggcattgttgtgaggatt

SEQ ID NO: 7589394 - DNA, 17 bp, Homo sapiens
tagtggcaggaaatgaa

SEQ ID NO: 7589395 - DNA, 17 bp, Homo sapiens
tagtggcaggaaatgaa

SEQ ID NO: 7589396 - DNA, 22 bp, Homo sapiens
tagtggcaaaagcattttgggt

SEQ ID NO: 7589397 - DNA, 22 bp, Homo sapiens
tagtggatgttcagagatttga

SEQ ID NO: 7589398 - DNA, 22 bp, Homo sapiens
tagtggggaaggaggacaagaa

SEQ ID NO: 7589399 - DNA, 22 bp, Homo sapiens
tagtggggaaggaggacaagaa

SEQ ID NO: 7589400 - DNA, 22 bp, Homo sapiens
tagtggctgcttcattggtgag

SEQ ID NO: 7589401 - DNA, 22 bp, Homo sapiens
tagtggctgcttcattggtgag

SEQ ID NO: 7589402 - DNA, 22 bp, Homo sapiens
tagtggcattgttgtgaggatt

SEQ ID NO: 7589403 - DNA, 22 bp, Homo sapiens
tagtggctgcagggctgtttga

SEQ ID NO: 7589404 - DNA, 19 bp, Homo sapiens
taggccctagctctgcagt

SEQ ID NO: 7589405 - DNA, 22 bp, Homo sapiens
taggcccctagtgccacgtggc

SEQ ID NO: 7589406 - DNA, 19 bp, Homo sapiens
taggccctagctctgcagt

SEQ ID NO: 7589407 - DNA, 22 bp, Homo sapiens
taggcctcaggaccccagggct

SEQ ID NO: 7589408 - DNA, 22 bp, Homo sapiens
taggcctcaggaccccagggct

SEQ ID NO: 7589409 - DNA, 22 bp, Homo sapiens
taggcctcaggaccccagggct

SEQ ID NO: 7589410 - DNA, 23 bp, Homo sapiens
taggcctccctggagcacccagc

SEQ ID NO: 7589411 - DNA, 22 bp, Homo sapiens
taggcctggatctctgggagca

SEQ ID NO: 7589412 - DNA, 22 bp, Homo sapiens
taggcctggatctctgggagca

SEQ ID NO: 7589413 - DNA, 22 bp, Homo sapiens
taggcctggatctctgggagca

SEQ ID NO: 7589414 - DNA, 22 bp, Homo sapiens
taggcctggatctctgggagca

SEQ ID NO: 7589415 - DNA, 20 bp, Homo sapiens
taggacagggcctggcttct

SEQ ID NO: 7589416 - DNA, 22 bp, Homo sapiens
taggacagggacatctttttga

SEQ ID NO: 7589417 - DNA, 22 bp, Homo sapiens
taggacagggacatctttttga

SEQ ID NO: 7589418 - DNA, 20 bp, Homo sapiens
taggacagggcctggcttct

SEQ ID NO: 7589419 - DNA, 22 bp, Homo sapiens
taggacaggtgaggggctgtgg

SEQ ID NO: 7589420 - DNA, 20 bp, Homo sapiens
taggacagggcctggcttct

SEQ ID NO: 7589421 - DNA, 22 bp, Homo sapiens
taggcccagttccgcctcccgg

SEQ ID NO: 7589422 - DNA, 22 bp, Homo sapiens
taggacaggatcatgatgctgg

SEQ ID NO: 7589423 - DNA, 21 bp, Homo sapiens
taggacagcccccctgccctc

SEQ ID NO: 7589424 - DNA, 22 bp, Homo sapiens
taggacaggatcatgatgctgg

SEQ ID NO: 7589425 - DNA, 22 bp, Homo sapiens
taggacaggatcatgatgctgg

SEQ ID NO: 7589426 - DNA, 21 bp, Homo sapiens
taggacagcccccctgccctc

SEQ ID NO: 7589427 - DNA, 22 bp, Homo sapiens
taggacagagttccctgatggc

SEQ ID NO: 7589428 - DNA, 22 bp, Homo sapiens
taggacagagttccctgatggc

SEQ ID NO: 7589429 - DNA, 22 bp, Homo sapiens
taggacagagttccctgatggc

SEQ ID NO: 7589430 - DNA, 22 bp, Homo sapiens
taggacagagctggttacaatg

SEQ ID NO: 7589431 - DNA, 22 bp, Homo sapiens
taggacagagttccctgatggc

SEQ ID NO: 7589432 - DNA, 22 bp, Homo sapiens
taggacaggctaaaagggataa

SEQ ID NO: 7589433 - DNA, 20 bp, Homo sapiens
taggacaggcagccgagggg

SEQ ID NO: 7589434 - DNA, 22 bp, Homo sapiens
taggacaggctaaaagggataa

SEQ ID NO: 7589435 - DNA, 22 bp, Homo sapiens
taggacaggctaaaagggataa

SEQ ID NO: 7589436 - DNA, 22 bp, Homo sapiens
taggacaggctaaaagggataa

SEQ ID NO: 7589437 - DNA, 22 bp, Homo sapiens
taggacaggctaaaagggataa

SEQ ID NO: 7589438 - DNA, 22 bp, Homo sapiens
taggacaggatcatgatgctgg

SEQ ID NO: 7589439 - DNA, 20 bp, Homo sapiens
taggacaggcagccgagggg

SEQ ID NO: 7589440 - DNA, 20 bp, Homo sapiens
taggacaggcagccgagggg

SEQ ID NO: 7589441 - DNA, 22 bp, Homo sapiens
taggacaggatcatgatgctgg

SEQ ID NO: 7589442 - DNA, 22 bp, Homo sapiens
taggacaggatcatgatgctgg

SEQ ID NO: 7589443 - DNA, 22 bp, Homo sapiens
taggctcacatagcactaagtg

SEQ ID NO: 7589444 - DNA, 22 bp, Homo sapiens
taggctaggctgaaggttttgg

SEQ ID NO: 7589445 - DNA, 22 bp, Homo sapiens
taggctcagggctgggtgacgg

SEQ ID NO: 7589446 - DNA, 22 bp, Homo sapiens
taggctcagggctgggtgacgg

SEQ ID NO: 7589447 - DNA, 22 bp, Homo sapiens
taggctcagggtctcagaggct

SEQ ID NO: 7589448 - DNA, 22 bp, Homo sapiens
taggctcagaaggcactgaaaa

SEQ ID NO: 7589449 - DNA, 22 bp, Homo sapiens
taggctcagaggcagaggctga

SEQ ID NO: 7589450 - DNA, 22 bp, Homo sapiens
taggctcagaggcagaggctga

SEQ ID NO: 7589451 - DNA, 22 bp, Homo sapiens
taggctcacatagcactaagtg

SEQ ID NO: 7589452 - DNA, 19 bp, Homo sapiens
taggccctagctctgcagt

SEQ ID NO: 7589453 - DNA, 23 bp, Homo sapiens
taggccttagcgatcactgtcag

SEQ ID NO: 7589454 - DNA, 22 bp, Homo sapiens
taggcctggtactgtgttaata

SEQ ID NO: 7589455 - DNA, 22 bp, Homo sapiens
taggccttagaggaccaggatt

SEQ ID NO: 7589456 - DNA, 22 bp, Homo sapiens
taggccttcggtgtgtgcttgg

SEQ ID NO: 7589457 - DNA, 22 bp, Homo sapiens
taggccttcggtgtgtgcttgg

SEQ ID NO: 7589458 - DNA, 22 bp, Homo sapiens
taggccttctgaggtgacctgc

SEQ ID NO: 7589459 - DNA, 22 bp, Homo sapiens
taggccttgaaagtagctctgc

SEQ ID NO: 7589460 - DNA, 22 bp, Homo sapiens
taggccttgaattgagggatgt

SEQ ID NO: 7589461 - DNA, 22 bp, Homo sapiens
taggccttgcctggcttcacac

SEQ ID NO: 7589462 - DNA, 22 bp, Homo sapiens
taggccttgtcacaggaataca

SEQ ID NO: 7589463 - DNA, 22 bp, Homo sapiens
taggccttttctcgtttctcca

SEQ ID NO: 7589464 - DNA, 22 bp, Homo sapiens
taggccttttgaattggtttcc

SEQ ID NO: 7589465 - DNA, 22 bp, Homo sapiens
taggccttttgcatgcaatgtt

SEQ ID NO: 7589466 - DNA, 22 bp, Homo sapiens
taggctcctgagtccacagcac

SEQ ID NO: 7589467 - DNA, 22 bp, Homo sapiens
taggctctccaagcccaggacc

SEQ ID NO: 7589468 - DNA, 22 bp, Homo sapiens
taggctctagatgtggtctttg

SEQ ID NO: 7589469 - DNA, 23 bp, Homo sapiens
taggctctgtaggtagagatggg

SEQ ID NO: 7589470 - DNA, 23 bp, Homo sapiens
taggctctgtaggtagagatggg

SEQ ID NO: 7589471 - DNA, 23 bp, Homo sapiens
taggctctgtaggtagagatggg

SEQ ID NO: 7589472 - DNA, 22 bp, Homo sapiens
taggctcttggtaaacaaaatt

SEQ ID NO: 7589473 - DNA, 22 bp, Homo sapiens
taggctgaaaggagaggtgaag

SEQ ID NO: 7589474 - DNA, 22 bp, Homo sapiens
taggctcttggtaaacaaaatt

SEQ ID NO: 7589475 - DNA, 22 bp, Homo sapiens
taggctgaaaggagaggtgaag

SEQ ID NO: 7589476 - DNA, 22 bp, Homo sapiens
taggctcattaagtccccaggg

SEQ ID NO: 7589477 - DNA, 22 bp, Homo sapiens
taggctcagtgagtagggagtt

SEQ ID NO: 7589478 - DNA, 22 bp, Homo sapiens
taggctcagtgagtagggagtt

SEQ ID NO: 7589479 - DNA, 22 bp, Homo sapiens
taggctcattttttaagtggtt

SEQ ID NO: 7589480 - DNA, 22 bp, Homo sapiens
taggaagggctcagggctcggt

SEQ ID NO: 7589481 - DNA, 22 bp, Homo sapiens
taggaagggctcagggctcggt

SEQ ID NO: 7589482 - DNA, 22 bp, Homo sapiens
taggaagggctcagggctcggt

SEQ ID NO: 7589483 - DNA, 22 bp, Homo sapiens
taggaagggctcagggctcggt

SEQ ID NO: 7589484 - DNA, 22 bp, Homo sapiens
taggaagggctcagggctcggt

SEQ ID NO: 7589485 - DNA, 22 bp, Homo sapiens
taggaaggtccatgtcttatct

SEQ ID NO: 7589486 - DNA, 22 bp, Homo sapiens
taggaaggtccatgtcttatct

SEQ ID NO: 7589487 - DNA, 22 bp, Homo sapiens
taggaaggtgtttttaaggagc

SEQ ID NO: 7589488 - DNA, 22 bp, Homo sapiens
taggaaggtgtttttaaggagc

SEQ ID NO: 7589489 - DNA, 22 bp, Homo sapiens
taggaaggtgtttttaaggagc

SEQ ID NO: 7589490 - DNA, 22 bp, Homo sapiens
taggaaggtgtttttaaggagc

SEQ ID NO: 7589491 - DNA, 22 bp, Homo sapiens
taggaaggtgtttttaaggagc

SEQ ID NO: 7589492 - DNA, 22 bp, Homo sapiens
taggaagggaaaggcttcaact

SEQ ID NO: 7589493 - DNA, 22 bp, Homo sapiens
taggaagggaaaggcttcaact

SEQ ID NO: 7589494 - DNA, 22 bp, Homo sapiens
taggaaggcctgtcactacttg

SEQ ID NO: 7589495 - DNA, 22 bp, Homo sapiens
taggaaggcctgtcactacttg

SEQ ID NO: 7589496 - DNA, 22 bp, Homo sapiens
taggaaggcctgtcactacttg

SEQ ID NO: 7589497 - DNA, 22 bp, Homo sapiens
taggaaggcctgtcactacttg

SEQ ID NO: 7589498 - DNA, 22 bp, Homo sapiens
taggaaggaggccatcttggcg

SEQ ID NO: 7589499 - DNA, 22 bp, Homo sapiens
taggaaggaggccatcttggcg

SEQ ID NO: 7589500 - DNA, 22 bp, Homo sapiens
taggaaggaggccatcttggcg

SEQ ID NO: 7589501 - DNA, 22 bp, Homo sapiens
taggaatgattggaattccagg

SEQ ID NO: 7589502 - DNA, 22 bp, Homo sapiens
taggaatgatgtatttttctct

SEQ ID NO: 7589503 - DNA, 22 bp, Homo sapiens
taggaatgatgtatttttctct

SEQ ID NO: 7589504 - DNA, 22 bp, Homo sapiens
taggaatgataatagtaaagag

SEQ ID NO: 7589505 - DNA, 22 bp, Homo sapiens
taggaatgagagggtgaggatt

SEQ ID NO: 7589506 - DNA, 22 bp, Homo sapiens
taggaatgagaaagaattagat

SEQ ID NO: 7589507 - DNA, 22 bp, Homo sapiens
taggaatgaaggataaggtgtg

SEQ ID NO: 7589508 - DNA, 22 bp, Homo sapiens
taggaatgagaaagaattagat

SEQ ID NO: 7589509 - DNA, 22 bp, Homo sapiens
taggaatgaagaagtatgatat

SEQ ID NO: 7589510 - DNA, 22 bp, Homo sapiens
taggaatgaagaagtatgatat

SEQ ID NO: 7589511 - DNA, 22 bp, Homo sapiens
taggaatgaaagtgttttgaaa

SEQ ID NO: 7589512 - DNA, 22 bp, Homo sapiens
taggaatgaaaatggccataga

SEQ ID NO: 7589513 - DNA, 22 bp, Homo sapiens
taggaagtagataggttgttct

SEQ ID NO: 7589514 - DNA, 22 bp, Homo sapiens
taggaagtccaagaccaaagtg

SEQ ID NO: 7589515 - DNA, 22 bp, Homo sapiens
taggaagtctgtgatgttgttt

SEQ ID NO: 7589516 - DNA, 22 bp, Homo sapiens
taggaagtttatattattctga

SEQ ID NO: 7589517 - DNA, 22 bp, Homo sapiens
taggaagtttatattattctga

SEQ ID NO: 7589518 - DNA, 22 bp, Homo sapiens
taggacagagctggttacaatg

SEQ ID NO: 7589519 - DNA, 22 bp, Homo sapiens
taggacagagctggttacaatg

SEQ ID NO: 7589520 - DNA, 22 bp, Homo sapiens
taggacagagatttgttttatg

SEQ ID NO: 7589521 - DNA, 22 bp, Homo sapiens
taggacagagctggttacaatg

SEQ ID NO: 7589522 - DNA, 22 bp, Homo sapiens
taggacagagatttgttttatg

SEQ ID NO: 7589523 - DNA, 23 bp, Homo sapiens
taggacagaatgcagaaaaatac

SEQ ID NO: 7589524 - DNA, 23 bp, Homo sapiens
taggacagaatgcagaaaaatac

SEQ ID NO: 7589525 - DNA, 22 bp, Homo sapiens
taggaatttttgtaatggtact

SEQ ID NO: 7589526 - DNA, 22 bp, Homo sapiens
taggacaattatcaactaggct

SEQ ID NO: 7589527 - DNA, 22 bp, Homo sapiens
taggacaattatcaactaggct

SEQ ID NO: 7589528 - DNA, 22 bp, Homo sapiens
taggaatgtttttatcaactta

SEQ ID NO: 7589529 - DNA, 22 bp, Homo sapiens
taggaatgtggcaggcagaaca

SEQ ID NO: 7589530 - DNA, 22 bp, Homo sapiens
taggaatgtttttatcaactta

SEQ ID NO: 7589531 - DNA, 22 bp, Homo sapiens
taggaatgtggcaggcagaaca

SEQ ID NO: 7589532 - DNA, 22 bp, Homo sapiens
taggaatgtctatgcagtgagg

SEQ ID NO: 7589533 - DNA, 22 bp, Homo sapiens
taggaattatgatgctatcaag

SEQ ID NO: 7589534 - DNA, 22 bp, Homo sapiens
taggaattgaaaagtggtctga

SEQ ID NO: 7589535 - DNA, 22 bp, Homo sapiens
taggaattgcccgtggggtcct

SEQ ID NO: 7589536 - DNA, 22 bp, Homo sapiens
taggaattttgcatgggaattt

SEQ ID NO: 7589537 - DNA, 22 bp, Homo sapiens
taggaatgtaatctctgttatg

SEQ ID NO: 7589538 - DNA, 22 bp, Homo sapiens
taggaatgtaatctctgttatg

SEQ ID NO: 7589539 - DNA, 19 bp, Homo sapiens
taggaatgtagaatcctag

SEQ ID NO: 7589540 - DNA, 22 bp, Homo sapiens
taggaatgtctatgcagtgagg

SEQ ID NO: 7589541 - DNA, 19 bp, Homo sapiens
taggaatgtagaatcctag

SEQ ID NO: 7589542 - DNA, 22 bp, Homo sapiens
taggaatgggctatcccaagct

SEQ ID NO: 7589543 - DNA, 22 bp, Homo sapiens
taggaatggtgctcagcagaaa

SEQ ID NO: 7589544 - DNA, 22 bp, Homo sapiens
taggaatgggcaagacaaagaa

SEQ ID NO: 7589545 - DNA, 22 bp, Homo sapiens
taggaatgggcaagacaaagaa

SEQ ID NO: 7589546 - DNA, 22 bp, Homo sapiens
taggaatggcagcagccggggg

SEQ ID NO: 7589547 - DNA, 22 bp, Homo sapiens
taggaatggaacactttgattt

SEQ ID NO: 7589548 - DNA, 22 bp, Homo sapiens
taggaatgcatgggggattctg

SEQ ID NO: 7589549 - DNA, 22 bp, Homo sapiens
taggaatgcagtgagacacaga

SEQ ID NO: 7589550 - DNA, 22 bp, Homo sapiens
taggaatgcagatgcataataa

SEQ ID NO: 7589551 - DNA, 22 bp, Homo sapiens
taggaatgcagatgcataataa

SEQ ID NO: 7589552 - DNA, 22 bp, Homo sapiens
taggaatgattggaattccagg

SEQ ID NO: 7589553 - DNA, 22 bp, Homo sapiens
taggaaatggctcagttactgc

SEQ ID NO: 7589554 - DNA, 22 bp, Homo sapiens
taggaaatggctcagttactgc

SEQ ID NO: 7589555 - DNA, 22 bp, Homo sapiens
taggaaatggctcagttactgc

SEQ ID NO: 7589556 - DNA, 22 bp, Homo sapiens
taggaaatggctcagttactgc

SEQ ID NO: 7589557 - DNA, 22 bp, Homo sapiens
taggaactagactcatgactca

SEQ ID NO: 7589558 - DNA, 22 bp, Homo sapiens
taggaactagtagatgtgtaaa

SEQ ID NO: 7589559 - DNA, 21 bp, Homo sapiens
taggaactgttctgagtggtc

SEQ ID NO: 7589560 - DNA, 22 bp, Homo sapiens
taggaactagtagatgtgtaaa

SEQ ID NO: 7589561 - DNA, 22 bp, Homo sapiens
taggaacttagatgaacacatg

SEQ ID NO: 7589562 - DNA, 23 bp, Homo sapiens
taggaactttatatttgttagtc

SEQ ID NO: 7589563 - DNA, 22 bp, Homo sapiens
taggaagaaactttccctgcag

SEQ ID NO: 7589564 - DNA, 22 bp, Homo sapiens
taggaagaaactttccctgcag

SEQ ID NO: 7589565 - DNA, 22 bp, Homo sapiens
taggaagaagcagccttgctta

SEQ ID NO: 7589566 - DNA, 22 bp, Homo sapiens
taggaagaagcagccttgctta

SEQ ID NO: 7589567 - DNA, 22 bp, Homo sapiens
taggaagaagcagccttgctta

SEQ ID NO: 7589568 - DNA, 22 bp, Homo sapiens
taggaagaaactttccctgcag

SEQ ID NO: 7589569 - DNA, 22 bp, Homo sapiens
taggaagaagcagccttgctta

SEQ ID NO: 7589570 - DNA, 23 bp, Homo sapiens
taggaagacagcaaaagaatgga

SEQ ID NO: 7589571 - DNA, 23 bp, Homo sapiens
taggaagacagcaaaagaatgga

SEQ ID NO: 7589572 - DNA, 23 bp, Homo sapiens
taggaagacagcaaaagaatgga

SEQ ID NO: 7589573 - DNA, 23 bp, Homo sapiens
taggaagacagcaaaagaatgga

SEQ ID NO: 7589574 - DNA, 23 bp, Homo sapiens
taggaagacagcaaaagaatgga

SEQ ID NO: 7589575 - DNA, 22 bp, Homo sapiens
taggaaatgctccattgcataa

SEQ ID NO: 7589576 - DNA, 22 bp, Homo sapiens
taggaaatgctgtcttattgta

SEQ ID NO: 7589577 - DNA, 22 bp, Homo sapiens
taggaaatgctgtcttattgta

SEQ ID NO: 7589578 - DNA, 22 bp, Homo sapiens
taggaaatgctgtcttattgta

SEQ ID NO: 7589579 - DNA, 22 bp, Homo sapiens
taggaaatgctgtcttattgta

SEQ ID NO: 7589580 - DNA, 22 bp, Homo sapiens
taggaaatgctgtcttattgta

SEQ ID NO: 7589581 - DNA, 22 bp, Homo sapiens
taggaaatgctgtcttattgta

SEQ ID NO: 7589582 - DNA, 22 bp, Homo sapiens
taggaaatgctgtcttattgta

SEQ ID NO: 7589583 - DNA, 22 bp, Homo sapiens
taggaaatggctcagttactgc

SEQ ID NO: 7589584 - DNA, 22 bp, Homo sapiens
taggaaatggctcagttactgc

SEQ ID NO: 7589585 - DNA, 22 bp, Homo sapiens
taggaaatggctcagttactgc

SEQ ID NO: 7589586 - DNA, 22 bp, Homo sapiens
taggaaatggctcagttactgc

SEQ ID NO: 7589587 - DNA, 22 bp, Homo sapiens
taggaaatggctcagttactgc

SEQ ID NO: 7589588 - DNA, 22 bp, Homo sapiens
taggaaatgaggccaacatgtg

SEQ ID NO: 7589589 - DNA, 22 bp, Homo sapiens
taggaaatgaggccaacatgtg

SEQ ID NO: 7589590 - DNA, 22 bp, Homo sapiens
taggaaatgaggccaacatgtg

SEQ ID NO: 7589591 - DNA, 22 bp, Homo sapiens
taggaaatgaggccaacatgtg

SEQ ID NO: 7589592 - DNA, 22 bp, Homo sapiens
taggaaatgaggccaacatgtg

SEQ ID NO: 7589593 - DNA, 22 bp, Homo sapiens
taggaaatgccagccttcctcc

SEQ ID NO: 7589594 - DNA, 22 bp, Homo sapiens
taggaaatgccagccttcctcc

SEQ ID NO: 7589595 - DNA, 22 bp, Homo sapiens
taggaaatgccagccttcctcc

SEQ ID NO: 7589596 - DNA, 22 bp, Homo sapiens
taggaaatgctccattgcataa

SEQ ID NO: 7589597 - DNA, 22 bp, Homo sapiens
taggaaatgctccattgcataa

SEQ ID NO: 7589598 - DNA, 22 bp, Homo sapiens
taggaaatgctccattgcataa

SEQ ID NO: 7589599 - DNA, 22 bp, Homo sapiens
taggaaatgctccattgcataa

SEQ ID NO: 7589600 - DNA, 22 bp, Homo sapiens
taggaaatgctccattgcataa

SEQ ID NO: 7589601 - DNA, 22 bp, Homo sapiens
taggaaggaagagcctcagatt

SEQ ID NO: 7589602 - DNA, 22 bp, Homo sapiens
taggaaggaggccatcttggcg

SEQ ID NO: 7589603 - DNA, 22 bp, Homo sapiens
taggaaggaagagcctcagatt

SEQ ID NO: 7589604 - DNA, 22 bp, Homo sapiens
taggaagctctttgttttgtga

SEQ ID NO: 7589605 - DNA, 18 bp, Homo sapiens
taggaagcttaatgtttt

SEQ ID NO: 7589606 - DNA, 22 bp, Homo sapiens
taggaagcatttaaagagatgg

SEQ ID NO: 7589607 - DNA, 22 bp, Homo sapiens
taggaagcattatcatcactga

SEQ ID NO: 7589608 - DNA, 22 bp, Homo sapiens
taggaagcctgctgtgcacagc

SEQ ID NO: 7589609 - DNA, 22 bp, Homo sapiens
taggaagcctaaattaagtggt

SEQ ID NO: 7589610 - DNA, 23 bp, Homo sapiens
taggaagacagcaaaagaatgga

SEQ ID NO: 7589611 - DNA, 23 bp, Homo sapiens
taggaagacagcaaaagaatgga

SEQ ID NO: 7589612 - DNA, 23 bp, Homo sapiens
taggaagacagcaaaagaatgga

SEQ ID NO: 7589613 - DNA, 23 bp, Homo sapiens
taggaagacagcaaaagaatgga

SEQ ID NO: 7589614 - DNA, 22 bp, Homo sapiens
taggaagagctataggtcccca

SEQ ID NO: 7589615 - DNA, 22 bp, Homo sapiens
taggaagagctataggtcccca

SEQ ID NO: 7589616 - DNA, 22 bp, Homo sapiens
taggaagagctataggtcccca

SEQ ID NO: 7589617 - DNA, 22 bp, Homo sapiens
taggaagagctataggtcccca

SEQ ID NO: 7589618 - DNA, 22 bp, Homo sapiens
taggaagataaacatttgtatg

SEQ ID NO: 7589619 - DNA, 22 bp, Homo sapiens
taggaagagctataggtcccca

SEQ ID NO: 7589620 - DNA, 22 bp, Homo sapiens
taggaagataaacatttgtatg

SEQ ID NO: 7589621 - DNA, 22 bp, Homo sapiens
taggaagagctataggtcccca

SEQ ID NO: 7589622 - DNA, 22 bp, Homo sapiens
taggaagataaacatttgtatg

SEQ ID NO: 7589623 - DNA, 22 bp, Homo sapiens
taggaagataaacatttgtatg

SEQ ID NO: 7589624 - DNA, 22 bp, Homo sapiens
taggaagataaacatttgtatg

SEQ ID NO: 7589625 - DNA, 22 bp, Homo sapiens
taggaagatcaagtttatctca

SEQ ID NO: 7589626 - DNA, 22 bp, Homo sapiens
taggaagatcaagtttatctca

SEQ ID NO: 7589627 - DNA, 22 bp, Homo sapiens
taggaagatcaagtttatctca

SEQ ID NO: 7589628 - DNA, 22 bp, Homo sapiens
taggaagatcaagtttatctca

SEQ ID NO: 7589629 - DNA, 22 bp, Homo sapiens
taggaagatgagtatcaacttg

SEQ ID NO: 7589630 - DNA, 22 bp, Homo sapiens
taggaagatgagtatcaacttg

SEQ ID NO: 7589631 - DNA, 22 bp, Homo sapiens
taggaagatgagtatcaacttg

SEQ ID NO: 7589632 - DNA, 22 bp, Homo sapiens
taggaagatgagtatcaacttg

SEQ ID NO: 7589633 - DNA, 22 bp, Homo sapiens
tagcccagatgattgaaccatg

SEQ ID NO: 7589634 - DNA, 22 bp, Homo sapiens
tagcccagcatgagcagagctg

SEQ ID NO: 7589635 - DNA, 22 bp, Homo sapiens
tagcccagatgattgaaccatg

SEQ ID NO: 7589636 - DNA, 22 bp, Homo sapiens
tagcccagatgattgaaccatg

SEQ ID NO: 7589637 - DNA, 22 bp, Homo sapiens
tagcccagatacaaatcatgat

SEQ ID NO: 7589638 - DNA, 22 bp, Homo sapiens
tagcccagatacaaatcatgat

SEQ ID NO: 7589639 - DNA, 22 bp, Homo sapiens
tagcccagagtcccaattccag

SEQ ID NO: 7589640 - DNA, 22 bp, Homo sapiens
tagcccagagtcccaattccag

SEQ ID NO: 7589641 - DNA, 16 bp, Homo sapiens
taggaaactgcatgtg

SEQ ID NO: 7589642 - DNA, 22 bp, Homo sapiens
taggaaactctcagctggtcat

SEQ ID NO: 7589643 - DNA, 22 bp, Homo sapiens
tagcccagatgattgaaccatg

SEQ ID NO: 7589644 - DNA, 22 bp, Homo sapiens
taggaaagaaatgagtagtgat

SEQ ID NO: 7589645 - DNA, 22 bp, Homo sapiens
taggaaagaaatgagtagtgat

SEQ ID NO: 7589646 - DNA, 22 bp, Homo sapiens
taggaaagaaatgagtagtgat

SEQ ID NO: 7589647 - DNA, 22 bp, Homo sapiens
taggaaagaaatgagtagtgat

SEQ ID NO: 7589648 - DNA, 22 bp, Homo sapiens
taggaaagaaatgagtagtgat

SEQ ID NO: 7589649 - DNA, 19 bp, Homo sapiens
tagcccagagcctggctac

SEQ ID NO: 7589650 - DNA, 19 bp, Homo sapiens
tagcccagagcctggctac

SEQ ID NO: 7589651 - DNA, 19 bp, Homo sapiens
tagcccagagcctggctac

SEQ ID NO: 7589652 - DNA, 19 bp, Homo sapiens
tagcccagagcctggctac

SEQ ID NO: 7589653 - DNA, 19 bp, Homo sapiens
tagcccagagcctggctac

SEQ ID NO: 7589654 - DNA, 19 bp, Homo sapiens
tagcccagagcctggctac

SEQ ID NO: 7589655 - DNA, 22 bp, Homo sapiens
tagcccagagagccaggggctt

SEQ ID NO: 7589656 - DNA, 22 bp, Homo sapiens
tagcccagagagccaggggctt

SEQ ID NO: 7589657 - DNA, 22 bp, Homo sapiens
tagcccagagagccaggggctt

SEQ ID NO: 7589658 - DNA, 22 bp, Homo sapiens
tagccattgacttaaagcttat

SEQ ID NO: 7589659 - DNA, 22 bp, Homo sapiens
tagccatttttattaatgctgg

SEQ ID NO: 7589660 - DNA, 22 bp, Homo sapiens
tagcccagaagagggaagcaac

SEQ ID NO: 7589661 - DNA, 22 bp, Homo sapiens
tagcccagaagagggaagcaac

SEQ ID NO: 7589662 - DNA, 22 bp, Homo sapiens
tagcccagaagagggaagcaac

SEQ ID NO: 7589663 - DNA, 22 bp, Homo sapiens
tagcccagaagagggaagcaac

SEQ ID NO: 7589664 - DNA, 22 bp, Homo sapiens
tagcccagaaagcaaatgtctc

SEQ ID NO: 7589665 - DNA, 22 bp, Homo sapiens
taggaaatatttgaacatagga

SEQ ID NO: 7589666 - DNA, 22 bp, Homo sapiens
taggaaatatttgaacatagga

SEQ ID NO: 7589667 - DNA, 22 bp, Homo sapiens
taggaaatatttgaacatagga

SEQ ID NO: 7589668 - DNA, 22 bp, Homo sapiens
taggaaatatttgaacatagga

SEQ ID NO: 7589669 - DNA, 22 bp, Homo sapiens
taggaaatatttgaacatagga

SEQ ID NO: 7589670 - DNA, 22 bp, Homo sapiens
taggaaatatttgaacatagga

SEQ ID NO: 7589671 - DNA, 22 bp, Homo sapiens
taggaaatatttgaacatagga

SEQ ID NO: 7589672 - DNA, 22 bp, Homo sapiens
taggaaatatttgaacatagga

SEQ ID NO: 7589673 - DNA, 22 bp, Homo sapiens
taggaaatattgatttcagtca

SEQ ID NO: 7589674 - DNA, 22 bp, Homo sapiens
taggaaatattgatttcagtca

SEQ ID NO: 7589675 - DNA, 22 bp, Homo sapiens
taggaaatattgatttcagtca

SEQ ID NO: 7589676 - DNA, 22 bp, Homo sapiens
taggaaatattgatttcagtca

SEQ ID NO: 7589677 - DNA, 22 bp, Homo sapiens
taggaaatattgatttcagtca

SEQ ID NO: 7589678 - DNA, 22 bp, Homo sapiens
taggaaatatttgaacatagga

SEQ ID NO: 7589679 - DNA, 22 bp, Homo sapiens
taggaaatcagagaaagaggtg

SEQ ID NO: 7589680 - DNA, 22 bp, Homo sapiens
taggaaatcagagaaagaggtg

SEQ ID NO: 7589681 - DNA, 22 bp, Homo sapiens
taggaaatcagagaaagaggtg

SEQ ID NO: 7589682 - DNA, 22 bp, Homo sapiens
taggaaatgaatgcaggctccc

SEQ ID NO: 7589683 - DNA, 22 bp, Homo sapiens
taggaaatgaatgcaggctccc

SEQ ID NO: 7589684 - DNA, 22 bp, Homo sapiens
taggaaatgaatgcaggctccc

SEQ ID NO: 7589685 - DNA, 22 bp, Homo sapiens
taggaaatgaatgcaggctccc

SEQ ID NO: 7589686 - DNA, 20 bp, Homo sapiens
taggaaatcgaggcagggtg

SEQ ID NO: 7589687 - DNA, 20 bp, Homo sapiens
taggaaatcgaggcagggtg

SEQ ID NO: 7589688 - DNA, 20 bp, Homo sapiens
taggaaatcgaggcagggtg

SEQ ID NO: 7589689 - DNA, 22 bp, Homo sapiens
taggaaatactgtaagtttggg

SEQ ID NO: 7589690 - DNA, 22 bp, Homo sapiens
taggaaatactgtaagtttggg

SEQ ID NO: 7589691 - DNA, 22 bp, Homo sapiens
taggaaatactgtaagtttggg

SEQ ID NO: 7589692 - DNA, 22 bp, Homo sapiens
taggaaatactgtaagtttggg

SEQ ID NO: 7589693 - DNA, 18 bp, Homo sapiens
taggaaatagggctgtga

SEQ ID NO: 7589694 - DNA, 18 bp, Homo sapiens
taggaaatagggctgtga

SEQ ID NO: 7589695 - DNA, 18 bp, Homo sapiens
taggaaatagggctgtga

SEQ ID NO: 7589696 - DNA, 20 bp, Homo sapiens
taggaaatatgtttttaccc

SEQ ID NO: 7589697 - DNA, 20 bp, Homo sapiens
taggaaatatgtttttaccc

SEQ ID NO: 7589698 - DNA, 20 bp, Homo sapiens
taggaaatatgtttttaccc

SEQ ID NO: 7589699 - DNA, 20 bp, Homo sapiens
taggaaatatgtttttaccc

SEQ ID NO: 7589700 - DNA, 20 bp, Homo sapiens
taggaaatatgtttttaccc

SEQ ID NO: 7589701 - DNA, 22 bp, Homo sapiens
taggaaagcagtagagccagga

SEQ ID NO: 7589702 - DNA, 22 bp, Homo sapiens
taggaaagcagtagagccagga

SEQ ID NO: 7589703 - DNA, 22 bp, Homo sapiens
taggaaagaaatgagtagtgat

SEQ ID NO: 7589704 - DNA, 22 bp, Homo sapiens
taggaaagcagtagagccagga

SEQ ID NO: 7589705 - DNA, 22 bp, Homo sapiens
taggaaagcagtagagccagga

SEQ ID NO: 7589706 - DNA, 22 bp, Homo sapiens
taggaaataaatacttatggtt

SEQ ID NO: 7589707 - DNA, 22 bp, Homo sapiens
taggaaataaatacttatggtt

SEQ ID NO: 7589708 - DNA, 22 bp, Homo sapiens
taggaaataaatacttatggtt

SEQ ID NO: 7589709 - DNA, 22 bp, Homo sapiens
taggaaataaatacttatggtt

SEQ ID NO: 7589710 - DNA, 22 bp, Homo sapiens
taggaaataattcactctggct

SEQ ID NO: 7589711 - DNA, 22 bp, Homo sapiens
taggaaataattcactctggct

SEQ ID NO: 7589712 - DNA, 22 bp, Homo sapiens
tatgcactggtactattcgtgt

SEQ ID NO: 7589713 - DNA, 22 bp, Homo sapiens
tatgcactgaaaattaacagtt

SEQ ID NO: 7589714 - DNA, 22 bp, Homo sapiens
tatgcactgaaaattaacagtt

SEQ ID NO: 7589715 - DNA, 22 bp, Homo sapiens
tatgcacattggtttcctcatt

SEQ ID NO: 7589716 - DNA, 22 bp, Homo sapiens
tatgcactccacacggcctcca

SEQ ID NO: 7589717 - DNA, 22 bp, Homo sapiens
tatgcagaagtagggattggag

SEQ ID NO: 7589718 - DNA, 22 bp, Homo sapiens
tatgcagagcatgactgtacca

SEQ ID NO: 7589719 - DNA, 22 bp, Homo sapiens
tatgcagagcatgactgtacca

SEQ ID NO: 7589720 - DNA, 22 bp, Homo sapiens
tatgcagcatgagatcatcata

SEQ ID NO: 7589721 - DNA, 22 bp, Homo sapiens
tatgcagcatgagatcatcata

SEQ ID NO: 7589722 - DNA, 22 bp, Homo sapiens
tatgcagctggttaagaacaca

SEQ ID NO: 7589723 - DNA, 22 bp, Homo sapiens
tatgcagctggttaagaacaca

SEQ ID NO: 7589724 - DNA, 20 bp, Homo sapiens
tatgcagtatgtgtgtataa

SEQ ID NO: 7589725 - DNA, 22 bp, Homo sapiens
tatgcagggtgggttctctgag

SEQ ID NO: 7589726 - DNA, 22 bp, Homo sapiens
tatgcagggtgggttctctgag

SEQ ID NO: 7589727 - DNA, 22 bp, Homo sapiens
tatgatatgcactttatcagaa

SEQ ID NO: 7589728 - DNA, 22 bp, Homo sapiens
tatgcacatataacctgcactg

SEQ ID NO: 7589729 - DNA, 22 bp, Homo sapiens
tatgcacatataacctgcactg

SEQ ID NO: 7589730 - DNA, 22 bp, Homo sapiens
tatgcacatataacctgcactg

SEQ ID NO: 7589731 - DNA, 22 bp, Homo sapiens
tatgcacattatctaatccatt

SEQ ID NO: 7589732 - DNA, 22 bp, Homo sapiens
tatgcacattatctaatccatt

SEQ ID NO: 7589733 - DNA, 22 bp, Homo sapiens
tatgcacattatctaatccatt

SEQ ID NO: 7589734 - DNA, 22 bp, Homo sapiens
tatgcacattatctaatccatt

SEQ ID NO: 7589735 - DNA, 22 bp, Homo sapiens
tatgcacattcacacaaaaatg

SEQ ID NO: 7589736 - DNA, 22 bp, Homo sapiens
tatgcacattcacacaaaaatg

SEQ ID NO: 7589737 - DNA, 22 bp, Homo sapiens
tatgcacattcacacaaaaatg

SEQ ID NO: 7589738 - DNA, 22 bp, Homo sapiens
tatgcacattctttgtgggagc

SEQ ID NO: 7589739 - DNA, 22 bp, Homo sapiens
tatgcacattctttgtgggagc

SEQ ID NO: 7589740 - DNA, 22 bp, Homo sapiens
tatgcacattggtttcctcatt

SEQ ID NO: 7589741 - DNA, 22 bp, Homo sapiens
tatgcacgtctatttatgaaga

SEQ ID NO: 7589742 - DNA, 23 bp, Homo sapiens
tatgataccataatgtggaatgt

SEQ ID NO: 7589743 - DNA, 20 bp, Homo sapiens
tatgataattacaaaatagt

SEQ ID NO: 7589744 - DNA, 20 bp, Homo sapiens
tatgataattacaaaatagt

SEQ ID NO: 7589745 - DNA, 20 bp, Homo sapiens
tatgataattacaaaatagt

SEQ ID NO: 7589746 - DNA, 20 bp, Homo sapiens
tatgataattacaaaatagt

SEQ ID NO: 7589747 - DNA, 22 bp, Homo sapiens
tatgataacctgttgtagtttg

SEQ ID NO: 7589748 - DNA, 22 bp, Homo sapiens
tatgagtttaaggctaaaatag

SEQ ID NO: 7589749 - DNA, 22 bp, Homo sapiens
tatgagtttaaggctaaaatag

SEQ ID NO: 7589750 - DNA, 22 bp, Homo sapiens
tatctttgcaaatatctctaag

SEQ ID NO: 7589751 - DNA, 22 bp, Homo sapiens
tatctttgtatcaatctccatt

SEQ ID NO: 7589752 - DNA, 22 bp, Homo sapiens
tatctttgtatcaatctccatt

SEQ ID NO: 7589753 - DNA, 22 bp, Homo sapiens
tatctttgcaaatatctctaag

SEQ ID NO: 7589754 - DNA, 22 bp, Homo sapiens
tatctttgcaaatatctctaag

SEQ ID NO: 7589755 - DNA, 22 bp, Homo sapiens
tatctttgtatcaatctccatt

SEQ ID NO: 7589756 - DNA, 22 bp, Homo sapiens
tatgagttgtggcttagtcaca

SEQ ID NO: 7589757 - DNA, 22 bp, Homo sapiens
tatgagttgtggcttagtcaca

SEQ ID NO: 7589758 - DNA, 22 bp, Homo sapiens
tatgcatagtgatttagaacag

SEQ ID NO: 7589759 - DNA, 22 bp, Homo sapiens
tatgcatagtggaattagcaaa

SEQ ID NO: 7589760 - DNA, 22 bp, Homo sapiens
tatgcatagtgatttagaacag

SEQ ID NO: 7589761 - DNA, 22 bp, Homo sapiens
tatgcatagatattatcagcca

SEQ ID NO: 7589762 - DNA, 22 bp, Homo sapiens
tatgcatagatattatcagcca

SEQ ID NO: 7589763 - DNA, 22 bp, Homo sapiens
tatgcatacaatgagatattcc

SEQ ID NO: 7589764 - DNA, 22 bp, Homo sapiens
tatgcatacaatgagatattcc

SEQ ID NO: 7589765 - DNA, 22 bp, Homo sapiens
tatgcataggtatctatactca

SEQ ID NO: 7589766 - DNA, 22 bp, Homo sapiens
tatgcataggtatctatactca

SEQ ID NO: 7589767 - DNA, 22 bp, Homo sapiens
tatgcataggtatctatactca

SEQ ID NO: 7589768 - DNA, 22 bp, Homo sapiens
tatgcataattggataagtaga

SEQ ID NO: 7589769 - DNA, 22 bp, Homo sapiens
tatgcataattggataagtaga

SEQ ID NO: 7589770 - DNA, 22 bp, Homo sapiens
tatgcataattggataagtaga

SEQ ID NO: 7589771 - DNA, 22 bp, Homo sapiens
tatgcataattggataagtaga

SEQ ID NO: 7589772 - DNA, 22 bp, Homo sapiens
tatgcagtgtacgatgtttagt

SEQ ID NO: 7589773 - DNA, 22 bp, Homo sapiens
tatgcagtggtatcattttaaa

SEQ ID NO: 7589774 - DNA, 21 bp, Homo sapiens
tatgcagtttacttaggtatt

SEQ ID NO: 7589775 - DNA, 22 bp, Homo sapiens
tatgcatgttcatcagctcatt

SEQ ID NO: 7589776 - DNA, 22 bp, Homo sapiens
tatgcattatacattaatttct

SEQ ID NO: 7589777 - DNA, 22 bp, Homo sapiens
tatgcatgtggtatatgcttat

SEQ ID NO: 7589778 - DNA, 22 bp, Homo sapiens
tatgcatgtggtatatgcttat

SEQ ID NO: 7589779 - DNA, 19 bp, Homo sapiens
tatgcatatgttttcccag

SEQ ID NO: 7589780 - DNA, 22 bp, Homo sapiens
tatgcatatgtgttcattggag

SEQ ID NO: 7589781 - DNA, 22 bp, Homo sapiens
tatgcatgtctttgcacacaaa

SEQ ID NO: 7589782 - DNA, 22 bp, Homo sapiens
tatgcatatattttcccatctt

SEQ ID NO: 7589783 - DNA, 22 bp, Homo sapiens
tatgcatatatcacgtgcatgc

SEQ ID NO: 7589784 - DNA, 22 bp, Homo sapiens
tatgcatataaatgtgtgaatt

SEQ ID NO: 7589785 - DNA, 22 bp, Homo sapiens
tatgcatatagatgcacacaca

SEQ ID NO: 7589786 - DNA, 22 bp, Homo sapiens
tatgcatatagatgcacacaca

SEQ ID NO: 7589787 - DNA, 22 bp, Homo sapiens
tatgcatatgaccccaagcttg

SEQ ID NO: 7589788 - DNA, 22 bp, Homo sapiens
tatgcatatgaccccaagcttg

SEQ ID NO: 7589789 - DNA, 22 bp, Homo sapiens
tatgcatatgtgttcattggag

SEQ ID NO: 7589790 - DNA, 22 bp, Homo sapiens
tatgccactgctctccatccta

SEQ ID NO: 7589791 - DNA, 22 bp, Homo sapiens
tatgccaaggatcaatatgtat

SEQ ID NO: 7589792 - DNA, 22 bp, Homo sapiens
tatgccactgctctccatccta

SEQ ID NO: 7589793 - DNA, 22 bp, Homo sapiens
tatgccactgctctccatccta

SEQ ID NO: 7589794 - DNA, 22 bp, Homo sapiens
tatgccactgctctccatccta

SEQ ID NO: 7589795 - DNA, 22 bp, Homo sapiens
tatgcattcagaggttgggtgt

SEQ ID NO: 7589796 - DNA, 23 bp, Homo sapiens
tatgccaaaatggaaagtgtata

SEQ ID NO: 7589797 - DNA, 22 bp, Homo sapiens
tatctttattatgtctatctgc

SEQ ID NO: 7589798 - DNA, 22 bp, Homo sapiens
tatctttattatgtctatctgc

SEQ ID NO: 7589799 - DNA, 22 bp, Homo sapiens
tatctttattatgtctatctgc

SEQ ID NO: 7589800 - DNA, 22 bp, Homo sapiens
tatctttattatgtctatctgc

SEQ ID NO: 7589801 - DNA, 22 bp, Homo sapiens
tatctttattatgtctatctgc

SEQ ID NO: 7589802 - DNA, 19 bp, Homo sapiens
tatctttatgcagtggtgg

SEQ ID NO: 7589803 - DNA, 19 bp, Homo sapiens
tatctttatgcagtggtgg

SEQ ID NO: 7589804 - DNA, 22 bp, Homo sapiens
tatctttgatgccagatgttac

SEQ ID NO: 7589805 - DNA, 22 bp, Homo sapiens
tatctttctgtcctagattctg

SEQ ID NO: 7589806 - DNA, 22 bp, Homo sapiens
tatctttctgtcctagattctg

SEQ ID NO: 7589807 - DNA, 22 bp, Homo sapiens
tatctttattatgtctatctgc

SEQ ID NO: 7589808 - DNA, 22 bp, Homo sapiens
tatctttagaggaagagaatct

SEQ ID NO: 7589809 - DNA, 22 bp, Homo sapiens
tatctttagaggaagagaatct

SEQ ID NO: 7589810 - DNA, 22 bp, Homo sapiens
tatctttagaggaagagaatct

SEQ ID NO: 7589811 - DNA, 22 bp, Homo sapiens
tatctttagaggaagagaatct

SEQ ID NO: 7589812 - DNA, 19 bp, Homo sapiens
tatctttatgcagtggtgg

SEQ ID NO: 7589813 - DNA, 22 bp, Homo sapiens
tatctttagaggaagagaatct

SEQ ID NO: 7589814 - DNA, 22 bp, Homo sapiens
tatctttagaggaagagaatct

SEQ ID NO: 7589815 - DNA, 22 bp, Homo sapiens
tatctttagaggaagagaatct

SEQ ID NO: 7589816 - DNA, 21 bp, Homo sapiens
tatcttgggctctgtgcttga

SEQ ID NO: 7589817 - DNA, 22 bp, Homo sapiens
tatcttgagagacaacacagca

SEQ ID NO: 7589818 - DNA, 22 bp, Homo sapiens
tatcttgatcaagtagaagagg

SEQ ID NO: 7589819 - DNA, 22 bp, Homo sapiens
tatcttggactctttgcagtgc

SEQ ID NO: 7589820 - DNA, 22 bp, Homo sapiens
tatcttgcctttaactgctcat

SEQ ID NO: 7589821 - DNA, 22 bp, Homo sapiens
tatcttgcctttaactgctcat

SEQ ID NO: 7589822 - DNA, 22 bp, Homo sapiens
tatctttaacttgcagtattta

SEQ ID NO: 7589823 - DNA, 22 bp, Homo sapiens
tatctttaacttgcagtattta

SEQ ID NO: 7589824 - DNA, 22 bp, Homo sapiens
tatcttgttttggcctccaggg

SEQ ID NO: 7589825 - DNA, 22 bp, Homo sapiens
tatctttaacttgcagtattta

SEQ ID NO: 7589826 - DNA, 22 bp, Homo sapiens
tatctttagaggaagagaatct

SEQ ID NO: 7589827 - DNA, 22 bp, Homo sapiens
tatctttagaggaagagaatct

SEQ ID NO: 7589828 - DNA, 22 bp, Homo sapiens
tatctttagaggaagagaatct

SEQ ID NO: 7589829 - DNA, 22 bp, Homo sapiens
tatctttaatgcttggaggtta

SEQ ID NO: 7589830 - DNA, 22 bp, Homo sapiens
tatctttaacttgcagtattta

SEQ ID NO: 7589831 - DNA, 22 bp, Homo sapiens
tatctttaacttgcagtattta

SEQ ID NO: 7589832 - DNA, 22 bp, Homo sapiens
tatctttaacttgcagtattta

SEQ ID NO: 7589833 - DNA, 22 bp, Homo sapiens
tatctgttcttagctatagatg

SEQ ID NO: 7589834 - DNA, 22 bp, Homo sapiens
tatcttaaatgcatgatagaca

SEQ ID NO: 7589835 - DNA, 22 bp, Homo sapiens
tatcttaaatgcatgatagaca

SEQ ID NO: 7589836 - DNA, 22 bp, Homo sapiens
tatcttctcagtatatgggatg

SEQ ID NO: 7589837 - DNA, 22 bp, Homo sapiens
tatcttcttgccaggctggtgt

SEQ ID NO: 7589838 - DNA, 22 bp, Homo sapiens
tatcttctcagtatatgggatg

SEQ ID NO: 7589839 - DNA, 22 bp, Homo sapiens
tatcttcatagatttttacacc

SEQ ID NO: 7589840 - DNA, 22 bp, Homo sapiens
tatcttcatagatttttacacc

SEQ ID NO: 7589841 - DNA, 22 bp, Homo sapiens
tatcttcatagatttttacacc

SEQ ID NO: 7589842 - DNA, 22 bp, Homo sapiens
tatcttcatagatttttacacc

SEQ ID NO: 7589843 - DNA, 22 bp, Homo sapiens
tatcttcagctgaagcagagtc

SEQ ID NO: 7589844 - DNA, 22 bp, Homo sapiens
tatcttcagcacagatcctgtg

SEQ ID NO: 7589845 - DNA, 22 bp, Homo sapiens
tatcttcagctgaagcagagtc

SEQ ID NO: 7589846 - DNA, 22 bp, Homo sapiens
tatcttcagcacagatcctgtg

SEQ ID NO: 7589847 - DNA, 22 bp, Homo sapiens
tatcttcagcacagatcctgtg

SEQ ID NO: 7589848 - DNA, 22 bp, Homo sapiens
tatcttcagcacagatcctgtg

SEQ ID NO: 7589849 - DNA, 22 bp, Homo sapiens
tatcttcaatttattcaaggag

SEQ ID NO: 7589850 - DNA, 22 bp, Homo sapiens
tatcttcaatttattcaaggag

SEQ ID NO: 7589851 - DNA, 22 bp, Homo sapiens
tatcttcacttatatctttctt

SEQ ID NO: 7589852 - DNA, 22 bp, Homo sapiens
tatcttcaatttattcaaggag

SEQ ID NO: 7589853 - DNA, 22 bp, Homo sapiens
tatcttcaactaggattcattt

SEQ ID NO: 7589854 - DNA, 22 bp, Homo sapiens
tatcttcaactaggattcattt

SEQ ID NO: 7589855 - DNA, 22 bp, Homo sapiens
tatcttagggaattaactaaaa

SEQ ID NO: 7589856 - DNA, 20 bp, Homo sapiens
tatcttactttagtcatttg

SEQ ID NO: 7589857 - DNA, 20 bp, Homo sapiens
tatcttactttagtcatttg

SEQ ID NO: 7589858 - DNA, 23 bp, Homo sapiens
tatcttacctcccttctttcctg

SEQ ID NO: 7589859 - DNA, 22 bp, Homo sapiens
tatcttacagactgaatgttgg

SEQ ID NO: 7589860 - DNA, 22 bp, Homo sapiens
tatcttacttatgctgatgtcc

SEQ ID NO: 7589861 - DNA, 22 bp, Homo sapiens
tatctataatgttttacttcct

SEQ ID NO: 7589862 - DNA, 22 bp, Homo sapiens
tatctgtcacctgtagggtagg

SEQ ID NO: 7589863 - DNA, 22 bp, Homo sapiens
tatctgtcgcatacatacttgg

SEQ ID NO: 7589864 - DNA, 22 bp, Homo sapiens
tatctgtcgcatacatacttgg

SEQ ID NO: 7589865 - DNA, 22 bp, Homo sapiens
tatctgtgaaatgtgtttgtat

SEQ ID NO: 7589866 - DNA, 17 bp, Homo sapiens
tatctgtgttcctggct

SEQ ID NO: 7589867 - DNA, 22 bp, Homo sapiens
tatctgtctaatgggcagcaga

SEQ ID NO: 7589868 - DNA, 22 bp, Homo sapiens
tatctgtctaatgggcagcaga

SEQ ID NO: 7589869 - DNA, 22 bp, Homo sapiens
tatctgtcgggagtcttccgga

SEQ ID NO: 7589870 - DNA, 22 bp, Homo sapiens
tatctgtcacctgtagggtagg

SEQ ID NO: 7589871 - DNA, 22 bp, Homo sapiens
tatctgtcttgacatgttggtt

SEQ ID NO: 7589872 - DNA, 22 bp, Homo sapiens
tatctgtcttgacatgttggtt

SEQ ID NO: 7589873 - DNA, 22 bp, Homo sapiens
tatctgtctttatcaggattta

SEQ ID NO: 7589874 - DNA, 22 bp, Homo sapiens
tatctgtctttatcaggattta

SEQ ID NO: 7589875 - DNA, 22 bp, Homo sapiens
tatctagatggattttagtgaa

SEQ ID NO: 7589876 - DNA, 22 bp, Homo sapiens
tatctagatggattttagtgaa

SEQ ID NO: 7589877 - DNA, 22 bp, Homo sapiens
tatctagatttctttctctgtg

SEQ ID NO: 7589878 - DNA, 22 bp, Homo sapiens
tatctagatttctttctctgtg

SEQ ID NO: 7589879 - DNA, 22 bp, Homo sapiens
tatctataagtactaacatggt

SEQ ID NO: 7589880 - DNA, 22 bp, Homo sapiens
tatctgttaggatcagagctgg

SEQ ID NO: 7589881 - DNA, 22 bp, Homo sapiens
tatctgttaggatcagagctgg

SEQ ID NO: 7589882 - DNA, 22 bp, Homo sapiens
tatctgttcatgtttatatgtc

SEQ ID NO: 7589883 - DNA, 22 bp, Homo sapiens
tatctgttctgcttgattttga

SEQ ID NO: 7589884 - DNA, 22 bp, Homo sapiens
tatctgttccaggcactcagct

SEQ ID NO: 7589885 - DNA, 22 bp, Homo sapiens
tatctgttcttagctatagatg

SEQ ID NO: 7589886 - DNA, 22 bp, Homo sapiens
tatctgttggctcctagttgta

SEQ ID NO: 7589887 - DNA, 22 bp, Homo sapiens
tatctgttctgcttgattttga

SEQ ID NO: 7589888 - DNA, 22 bp, Homo sapiens
tatcaacattaatattttctgg

SEQ ID NO: 7589889 - DNA, 22 bp, Homo sapiens
tatcaacaaaggccttgtgttt

SEQ ID NO: 7589890 - DNA, 22 bp, Homo sapiens
tatcaacaatagccagtgttta

SEQ ID NO: 7589891 - DNA, 22 bp, Homo sapiens
tatcaacattaatattttctgg

SEQ ID NO: 7589892 - DNA, 22 bp, Homo sapiens
tatcaacattaatattttctgg

SEQ ID NO: 7589893 - DNA, 22 bp, Homo sapiens
tatcaagagtctctacattaat

SEQ ID NO: 7589894 - DNA, 22 bp, Homo sapiens
tatcaactgagattaaatattt

SEQ ID NO: 7589895 - DNA, 22 bp, Homo sapiens
tatcaacgatagcctctgtcca

SEQ ID NO: 7589896 - DNA, 22 bp, Homo sapiens
tatcaactgagattaaatattt

SEQ ID NO: 7589897 - DNA, 17 bp, Homo sapiens
tatcaagaagtctggcc

SEQ ID NO: 7589898 - DNA, 22 bp, Homo sapiens
tatcaatacatgttatcagtgt

SEQ ID NO: 7589899 - DNA, 22 bp, Homo sapiens
tatcaatacatgttatcagtgt

SEQ ID NO: 7589900 - DNA, 22 bp, Homo sapiens
tatcaatacatgttatcagtgt

SEQ ID NO: 7589901 - DNA, 22 bp, Homo sapiens
tatcaatacatgttatcagtgt

SEQ ID NO: 7589902 - DNA, 22 bp, Homo sapiens
tatcaatacatgttatcagtgt

SEQ ID NO: 7589903 - DNA, 22 bp, Homo sapiens
tatcaatacatgttatcagtgt

SEQ ID NO: 7589904 - DNA, 22 bp, Homo sapiens
tatcaatacatgttatcagtgt

SEQ ID NO: 7589905 - DNA, 21 bp, Homo sapiens
tatcaagatgttatggttgaa

SEQ ID NO: 7589906 - DNA, 22 bp, Homo sapiens
tatcaatacatgttatcagtgt

SEQ ID NO: 7589907 - DNA, 22 bp, Homo sapiens
tatcaatacatgttatcagtgt

SEQ ID NO: 7589908 - DNA, 22 bp, Homo sapiens
tatcaatatctcagtgtgcttc

SEQ ID NO: 7589909 - DNA, 20 bp, Homo sapiens
tatcaatcagaaagaagact

SEQ ID NO: 7589910 - DNA, 22 bp, Homo sapiens
tatcaattgggccaaatggtac

SEQ ID NO: 7589911 - DNA, 22 bp, Homo sapiens
tatcaattgggccaaatggtac

SEQ ID NO: 7589912 - DNA, 22 bp, Homo sapiens
tatcaatatctcagtgtgcttc

SEQ ID NO: 7589913 - DNA, 22 bp, Homo sapiens
tatcaatatctcagtgtgcttc

SEQ ID NO: 7589914 - DNA, 19 bp, Homo sapiens
tatcaatcacggcatcttt

SEQ ID NO: 7589915 - DNA, 22 bp, Homo sapiens
tatcacactcggaaatctagga

SEQ ID NO: 7589916 - DNA, 22 bp, Homo sapiens
tatcacactcggaaatctagga

SEQ ID NO: 7589917 - DNA, 22 bp, Homo sapiens
tatctagatatttggataaatg

SEQ ID NO: 7589918 - DNA, 22 bp, Homo sapiens
tatcacactgttttaattactt

SEQ ID NO: 7589919 - DNA, 22 bp, Homo sapiens
tatcacagccttttggtgaggg

SEQ ID NO: 7589920 - DNA, 22 bp, Homo sapiens
tatcacaattcctatagtttgt

SEQ ID NO: 7589921 - DNA, 22 bp, Homo sapiens
tatcacaattcctatagtttgt

SEQ ID NO: 7589922 - DNA, 22 bp, Homo sapiens
tatcacaattcctatagtttgt

SEQ ID NO: 7589923 - DNA, 22 bp, Homo sapiens
tatcacacgccttgcttcattt

SEQ ID NO: 7589924 - DNA, 22 bp, Homo sapiens
tatcacactagcctatagtgga

SEQ ID NO: 7589925 - DNA, 22 bp, Homo sapiens
tatcaaaaggagttgaaagggg

SEQ ID NO: 7589926 - DNA, 22 bp, Homo sapiens
tatcaaaaggagttgaaagggg

SEQ ID NO: 7589927 - DNA, 22 bp, Homo sapiens
tatcaaaaggagttgaaagggg

SEQ ID NO: 7589928 - DNA, 22 bp, Homo sapiens
tatcaaaaggagttgaaagggg

SEQ ID NO: 7589929 - DNA, 20 bp, Homo sapiens
tatattttctctttggcctt

SEQ ID NO: 7589930 - DNA, 20 bp, Homo sapiens
tatattttctctttggcctt

SEQ ID NO: 7589931 - DNA, 20 bp, Homo sapiens
tatattttctctttggcctt

SEQ ID NO: 7589932 - DNA, 22 bp, Homo sapiens
tatcaaaaggagttgaaagggg

SEQ ID NO: 7589933 - DNA, 20 bp, Homo sapiens
tatattttctctttggcctt

SEQ ID NO: 7589934 - DNA, 20 bp, Homo sapiens
tatattttctctttggcctt

SEQ ID NO: 7589935 - DNA, 22 bp, Homo sapiens
tatcaacaaaggccttgtgttt

SEQ ID NO: 7589936 - DNA, 22 bp, Homo sapiens
tatcaaattgaggcagctgggg

SEQ ID NO: 7589937 - DNA, 22 bp, Homo sapiens
tatcaaattgaggcagctgggg

SEQ ID NO: 7589938 - DNA, 22 bp, Homo sapiens
tatcaaaaggagttgaaagggg

SEQ ID NO: 7589939 - DNA, 22 bp, Homo sapiens
tatcaaacttgttttttggtgt

SEQ ID NO: 7589940 - DNA, 22 bp, Homo sapiens
tatcaaaggctatgtgattttt

SEQ ID NO: 7589941 - DNA, 22 bp, Homo sapiens
tatcaaagttgtcctgtgaagt

SEQ ID NO: 7589942 - DNA, 20 bp, Homo sapiens
tatattttctctttggcctt

SEQ ID NO: 7589943 - DNA, 20 bp, Homo sapiens
tatattttctctttggcctt

SEQ ID NO: 7589944 - DNA, 22 bp, Homo sapiens
tatattttagacaccctcacgc

SEQ ID NO: 7589945 - DNA, 20 bp, Homo sapiens
tatattttctctttggcctt

SEQ ID NO: 7589946 - DNA, 20 bp, Homo sapiens
tatattttctctttggcctt

SEQ ID NO: 7589947 - DNA, 20 bp, Homo sapiens
tatattttctctttggcctt

SEQ ID NO: 7589948 - DNA, 22 bp, Homo sapiens
tatattttagacaccctcacgc

SEQ ID NO: 7589949 - DNA, 22 bp, Homo sapiens
tatattttagacaccctcacgc

SEQ ID NO: 7589950 - DNA, 22 bp, Homo sapiens
tatattttagacaccctcacgc

SEQ ID NO: 7589951 - DNA, 22 bp, Homo sapiens
tatattttagacaccctcacgc

SEQ ID NO: 7589952 - DNA, 22 bp, Homo sapiens
tatattttagacaccctcacgc

SEQ ID NO: 7589953 - DNA, 22 bp, Homo sapiens
tatattttagacaccctcacgc

SEQ ID NO: 7589954 - DNA, 19 bp, Homo sapiens
tatatttgttgaataaaaa

SEQ ID NO: 7589955 - DNA, 19 bp, Homo sapiens
tatatttgttgaataaaaa

SEQ ID NO: 7589956 - DNA, 22 bp, Homo sapiens
tatatttgtgtgtgatttatga

SEQ ID NO: 7589957 - DNA, 19 bp, Homo sapiens
tatatttgttgaataaaaa

SEQ ID NO: 7589958 - DNA, 19 bp, Homo sapiens
tatatttgttgaataaaaa

SEQ ID NO: 7589959 - DNA, 22 bp, Homo sapiens
tatattttagacaccctcacgc

SEQ ID NO: 7589960 - DNA, 22 bp, Homo sapiens
tatattttagacaccctcacgc

SEQ ID NO: 7589961 - DNA, 22 bp, Homo sapiens
tatattttagacaccctcacgc

SEQ ID NO: 7589962 - DNA, 22 bp, Homo sapiens
tatattttagacaccctcacgc

SEQ ID NO: 7589963 - DNA, 22 bp, Homo sapiens
tatattttagacaccctcacgc

SEQ ID NO: 7589964 - DNA, 22 bp, Homo sapiens
tatatttaattagttgctggat

SEQ ID NO: 7589965 - DNA, 22 bp, Homo sapiens
tatatttaattagttgctggat

SEQ ID NO: 7589966 - DNA, 22 bp, Homo sapiens
tatatttaattagttgctggat

SEQ ID NO: 7589967 - DNA, 22 bp, Homo sapiens
tatatttaatcctagagccatt

SEQ ID NO: 7589968 - DNA, 22 bp, Homo sapiens
tatatttaatcctagagccatt

SEQ ID NO: 7589969 - DNA, 22 bp, Homo sapiens
tatatttaatcctagagccatt

SEQ ID NO: 7589970 - DNA, 22 bp, Homo sapiens
tatatttaatcctagagccatt

SEQ ID NO: 7589971 - DNA, 22 bp, Homo sapiens
tatatttaatcctagagccatt

SEQ ID NO: 7589972 - DNA, 22 bp, Homo sapiens
tatatttaaatccaggttgaaa

SEQ ID NO: 7589973 - DNA, 22 bp, Homo sapiens
tatatttaaatccaggttgaaa

SEQ ID NO: 7589974 - DNA, 22 bp, Homo sapiens
tatatttaatcctagagccatt

SEQ ID NO: 7589975 - DNA, 22 bp, Homo sapiens
tatatttaaatccaggttgaaa

SEQ ID NO: 7589976 - DNA, 22 bp, Homo sapiens
tatattcaacaggctaatgtca

SEQ ID NO: 7589977 - DNA, 22 bp, Homo sapiens
tatattcaacaggctaatgtca

SEQ ID NO: 7589978 - DNA, 22 bp, Homo sapiens
tatattcaacaggctaatgtca

SEQ ID NO: 7589979 - DNA, 22 bp, Homo sapiens
tatattcaacaggctaatgtca

SEQ ID NO: 7589980 - DNA, 18 bp, Homo sapiens
tatatttcacacatattc

SEQ ID NO: 7589981 - DNA, 18 bp, Homo sapiens
tatatttcacacatattc

SEQ ID NO: 7589982 - DNA, 18 bp, Homo sapiens
tatatttcacacatattc

SEQ ID NO: 7589983 - DNA, 18 bp, Homo sapiens
tatatttcacacatattc

SEQ ID NO: 7589984 - DNA, 18 bp, Homo sapiens
tatatttcacacatattc

SEQ ID NO: 7589985 - DNA, 19 bp, Homo sapiens
tatatttgagtgtgcatgc

SEQ ID NO: 7589986 - DNA, 22 bp, Homo sapiens
tatatttgctaaatgtgtgcaa

SEQ ID NO: 7589987 - DNA, 19 bp, Homo sapiens
tatatttgagtgtgcatgc

SEQ ID NO: 7589988 - DNA, 22 bp, Homo sapiens
tatatttgctaaatgtgtgcaa

SEQ ID NO: 7589989 - DNA, 22 bp, Homo sapiens
tatatttgtgtgtgatttatga

SEQ ID NO: 7589990 - DNA, 22 bp, Homo sapiens
tatatttgtgtgtgatttatga

SEQ ID NO: 7589991 - DNA, 22 bp, Homo sapiens
tatatttgtgtgtgatttatga

SEQ ID NO: 7589992 - DNA, 22 bp, Homo sapiens
tatatttgtgtgtgatttatga

SEQ ID NO: 7589993 - DNA, 22 bp, Homo sapiens
tagttaattctttaagaacaag

SEQ ID NO: 7589994 - DNA, 22 bp, Homo sapiens
tagttaattctttaagaacaag

SEQ ID NO: 7589995 - DNA, 22 bp, Homo sapiens
tagttaatgctaattaacaaat

SEQ ID NO: 7589996 - DNA, 22 bp, Homo sapiens
tagttaatgctaattaacaaat

SEQ ID NO: 7589997 - DNA, 22 bp, Homo sapiens
tagttaatgctaattaacaaat

SEQ ID NO: 7589998 - DNA, 22 bp, Homo sapiens
tagttaaggccacttgcctaag

SEQ ID NO: 7589999 - DNA, 22 bp, Homo sapiens
tagttaaggccacttgcctaag

SEQ ID NO: 7590000 - DNA, 22 bp, Homo sapiens
tagttaactcttggtaataggt

SEQ ID NO: 7590001 - DNA, 22 bp, Homo sapiens
tagttaagaggccagtgtaata

SEQ ID NO: 7590002 - DNA, 21 bp, Homo sapiens
tatacagaggggaacaggaga

SEQ ID NO: 7590003 - DNA, 21 bp, Homo sapiens
tatacagaggggaacaggaga

SEQ ID NO: 7590004 - DNA, 21 bp, Homo sapiens
tatacagaggggaacaggaga

SEQ ID NO: 7590005 - DNA, 21 bp, Homo sapiens
tatacagaggggaacaggaga

SEQ ID NO: 7590006 - DNA, 22 bp, Homo sapiens
tatacagaaccgcctgaagtct

SEQ ID NO: 7590007 - DNA, 22 bp, Homo sapiens
tatacagaaccgcctgaagtct

SEQ ID NO: 7590008 - DNA, 22 bp, Homo sapiens
tatacagaaccgcctgaagtct

SEQ ID NO: 7590009 - DNA, 22 bp, Homo sapiens
tatacagaactgcacgtgcacg

SEQ ID NO: 7590010 - DNA, 22 bp, Homo sapiens
tagttaaagccctaaattgata

SEQ ID NO: 7590011 - DNA, 22 bp, Homo sapiens
tagttaaagccctaaattgata

SEQ ID NO: 7590012 - DNA, 22 bp, Homo sapiens
tagttaactcttggtaataggt

SEQ ID NO: 7590013 - DNA, 22 bp, Homo sapiens
tagttaaagccctaaattgata

SEQ ID NO: 7590014 - DNA, 22 bp, Homo sapiens
tagttaaagccctaaattgata

SEQ ID NO: 7590015 - DNA, 22 bp, Homo sapiens
tagttaaagccctaaattgata

SEQ ID NO: 7590016 - DNA, 22 bp, Homo sapiens
tagttaaagccctaaattgata

SEQ ID NO: 7590017 - DNA, 22 bp, Homo sapiens
tagttaaaccaccattctggta

SEQ ID NO: 7590018 - DNA, 22 bp, Homo sapiens
tagttaaaataatggagatgtt

SEQ ID NO: 7590019 - DNA, 22 bp, Homo sapiens
tagttaaaccaccattctggta

SEQ ID NO: 7590020 - DNA, 22 bp, Homo sapiens
tagttaaagagatccacattcc

SEQ ID NO: 7590021 - DNA, 22 bp, Homo sapiens
tagttaaagattctgttaagag

SEQ ID NO: 7590022 - DNA, 22 bp, Homo sapiens
tagttaaagattctgttaagag

SEQ ID NO: 7590023 - DNA, 22 bp, Homo sapiens
tagttaaagattctgttaagag

SEQ ID NO: 7590024 - DNA, 22 bp, Homo sapiens
tagttaaagattctgttaagag

SEQ ID NO: 7590025 - DNA, 22 bp, Homo sapiens
tagtgttttctagaatggtttt

SEQ ID NO: 7590026 - DNA, 22 bp, Homo sapiens
tagtgttttctagaatggtttt

SEQ ID NO: 7590027 - DNA, 19 bp, Homo sapiens
tagtgtttttctggagcag

SEQ ID NO: 7590028 - DNA, 22 bp, Homo sapiens
tagttaaaataatggagatgtt

SEQ ID NO: 7590029 - DNA, 22 bp, Homo sapiens
tagtgtctagtgagtttgatgc

SEQ ID NO: 7590030 - DNA, 22 bp, Homo sapiens
tagtgtcatttcagtggagttt

SEQ ID NO: 7590031 - DNA, 22 bp, Homo sapiens
tagtgtctagtgagtttgatgc

SEQ ID NO: 7590032 - DNA, 22 bp, Homo sapiens
tagtgtttagtacatatgcata

SEQ ID NO: 7590033 - DNA, 22 bp, Homo sapiens
tagtgtttagtacatatgcata

SEQ ID NO: 7590034 - DNA, 22 bp, Homo sapiens
tagtgtttagtacatatgcata

SEQ ID NO: 7590035 - DNA, 22 bp, Homo sapiens
tagtgtcatcgttgcagctgag

SEQ ID NO: 7590036 - DNA, 22 bp, Homo sapiens
tagtgtcatgaaaagtacacta

SEQ ID NO: 7590037 - DNA, 22 bp, Homo sapiens
tagtgtcatgaaaagtacacta

SEQ ID NO: 7590038 - DNA, 22 bp, Homo sapiens
tagtgtcatgaaaagtacacta

SEQ ID NO: 7590039 - DNA, 22 bp, Homo sapiens
tagtgtcatttcagtggagttt

SEQ ID NO: 7590040 - DNA, 22 bp, Homo sapiens
tagtgtcagggagtgataaatg

SEQ ID NO: 7590041 - DNA, 22 bp, Homo sapiens
tagtgtcaggagggaaatgcaa

SEQ ID NO: 7590042 - DNA, 22 bp, Homo sapiens
tagtgtcaggagggaaatgcaa

SEQ ID NO: 7590043 - DNA, 22 bp, Homo sapiens
tagtgtcatcgttgcagctgag

SEQ ID NO: 7590044 - DNA, 23 bp, Homo sapiens
tagtgtcatcctcagcttctgtt

SEQ ID NO: 7590045 - DNA, 19 bp, Homo sapiens
tagtgtcaaggaggagggt

SEQ ID NO: 7590046 - DNA, 19 bp, Homo sapiens
tagtgtcaaggaggagggt

SEQ ID NO: 7590047 - DNA, 22 bp, Homo sapiens
tagtgtcagagaatcttggttt

SEQ ID NO: 7590048 - DNA, 22 bp, Homo sapiens
tagtgtcagcatctcattgagc

SEQ ID NO: 7590049 - DNA, 22 bp, Homo sapiens
tagtgtcaggagggaaatgcaa

SEQ ID NO: 7590050 - DNA, 22 bp, Homo sapiens
tagtgtatgttcagcttatatg

SEQ ID NO: 7590051 - DNA, 22 bp, Homo sapiens
tagtgtatgttcagcttatatg

SEQ ID NO: 7590052 - DNA, 22 bp, Homo sapiens
tagtgtatgttcagcttatatg

SEQ ID NO: 7590053 - DNA, 22 bp, Homo sapiens
tagtgtatgttcagcttatatg

SEQ ID NO: 7590054 - DNA, 22 bp, Homo sapiens
tagtgtcaaacagggattagaa

SEQ ID NO: 7590055 - DNA, 22 bp, Homo sapiens
tagtgtcaaacagggattagaa

SEQ ID NO: 7590056 - DNA, 22 bp, Homo sapiens
tagtgtcaaatagcctgagctt

SEQ ID NO: 7590057 - DNA, 23 bp, Homo sapiens
tagtgtcaagagggagtgtaatt

SEQ ID NO: 7590058 - DNA, 23 bp, Homo sapiens
tagtgtcaagagggagtgtaatt

SEQ ID NO: 7590059 - DNA, 22 bp, Homo sapiens
tataccaaaaaaattcttgtct

SEQ ID NO: 7590060 - DNA, 22 bp, Homo sapiens
tatacatgttttacataagtga

SEQ ID NO: 7590061 - DNA, 22 bp, Homo sapiens
tatacatgttttacataagtga

SEQ ID NO: 7590062 - DNA, 22 bp, Homo sapiens
tatacatgttttacataagtga

SEQ ID NO: 7590063 - DNA, 22 bp, Homo sapiens
tataccaaaatatcagaaaggg

SEQ ID NO: 7590064 - DNA, 22 bp, Homo sapiens
tataccaaaatatcagaaaggg

SEQ ID NO: 7590065 - DNA, 22 bp, Homo sapiens
tataccaaaaaaattcttgtct

SEQ ID NO: 7590066 - DNA, 22 bp, Homo sapiens
tatacagatatctaagatgtaa

SEQ ID NO: 7590067 - DNA, 22 bp, Homo sapiens
tatacagatatctaagatgtaa

SEQ ID NO: 7590068 - DNA, 21 bp, Homo sapiens
tatacatgtgtgcatacgtgt

SEQ ID NO: 7590069 - DNA, 22 bp, Homo sapiens
tatacatgttttacataagtga

SEQ ID NO: 7590070 - DNA, 22 bp, Homo sapiens
tatacatgttttacataagtga

SEQ ID NO: 7590071 - DNA, 22 bp, Homo sapiens
tatacagataatgaagaccaag

SEQ ID NO: 7590072 - DNA, 22 bp, Homo sapiens
tatacagataatgaagaccaag

SEQ ID NO: 7590073 - DNA, 22 bp, Homo sapiens
tatacagataatgaagaccaag

SEQ ID NO: 7590074 - DNA, 22 bp, Homo sapiens
tatacagataatgaagaccaag

SEQ ID NO: 7590075 - DNA, 22 bp, Homo sapiens
tatacagatatctaagatgtaa

SEQ ID NO: 7590076 - DNA, 22 bp, Homo sapiens
tatacagatatctaagatgtaa

SEQ ID NO: 7590077 - DNA, 22 bp, Homo sapiens
tatacagatatctaagatgtaa

SEQ ID NO: 7590078 - DNA, 22 bp, Homo sapiens
tatacagataatgaagaccaag

SEQ ID NO: 7590079 - DNA, 22 bp, Homo sapiens
tatactatgcttctgatccaat

SEQ ID NO: 7590080 - DNA, 22 bp, Homo sapiens
tatactatgcttctgatccaat

SEQ ID NO: 7590081 - DNA, 22 bp, Homo sapiens
tatactacgcaccaaacaaagg

SEQ ID NO: 7590082 - DNA, 21 bp, Homo sapiens
tataccacagccatcaaatat

SEQ ID NO: 7590083 - DNA, 20 bp, Homo sapiens
tatactaacatatatctgtt

SEQ ID NO: 7590084 - DNA, 22 bp, Homo sapiens
tataccatgtgtgcacactccc

SEQ ID NO: 7590085 - DNA, 20 bp, Homo sapiens
tatactaacatatatctgtt

SEQ ID NO: 7590086 - DNA, 20 bp, Homo sapiens
tatactaacatatatctgtt

SEQ ID NO: 7590087 - DNA, 20 bp, Homo sapiens
tatactaacatatatctgtt

SEQ ID NO: 7590088 - DNA, 20 bp, Homo sapiens
tatactaacatatatctgtt

SEQ ID NO: 7590089 - DNA, 22 bp, Homo sapiens
tatactgtcgcattacactcac

SEQ ID NO: 7590090 - DNA, 22 bp, Homo sapiens
tatactgtcgcattacactcac

SEQ ID NO: 7590091 - DNA, 22 bp, Homo sapiens
tatacttatgctaaaaaatgtt

SEQ ID NO: 7590092 - DNA, 22 bp, Homo sapiens
tatacttatgctaaaaaatgtt

SEQ ID NO: 7590093 - DNA, 22 bp, Homo sapiens
tatactgatttgtctatactct

SEQ ID NO: 7590094 - DNA, 22 bp, Homo sapiens
tatactgatttgtctatactct

SEQ ID NO: 7590095 - DNA, 22 bp, Homo sapiens
tatactgtaggtgcagaaagaa

SEQ ID NO: 7590096 - DNA, 22 bp, Homo sapiens
tatactgatttgtctatactct

SEQ ID NO: 7590097 - DNA, 22 bp, Homo sapiens
tatactctgagaaacgtgtcac

SEQ ID NO: 7590098 - DNA, 22 bp, Homo sapiens
tatactgagagcaaatacattc

SEQ ID NO: 7590099 - DNA, 22 bp, Homo sapiens
tatactgatcactgaggtcatc

SEQ ID NO: 7590100 - DNA, 22 bp, Homo sapiens
tatactgatcactgaggtcatc

SEQ ID NO: 7590101 - DNA, 22 bp, Homo sapiens
tatactgagtgtgttaatgatg

SEQ ID NO: 7590102 - DNA, 22 bp, Homo sapiens
tatactgagagcaaatacattc

SEQ ID NO: 7590103 - DNA, 22 bp, Homo sapiens
tatactgagtgtgttaatgatg

SEQ ID NO: 7590104 - DNA, 22 bp, Homo sapiens
tatactgagagcaaatacattc

SEQ ID NO: 7590105 - DNA, 22 bp, Homo sapiens
tatactttcctgcaactttgat

SEQ ID NO: 7590106 - DNA, 22 bp, Homo sapiens
tatacttatgctaaaaaatgtt

SEQ ID NO: 7590107 - DNA, 22 bp, Homo sapiens
tatacttccctgcagagtaaag

SEQ ID NO: 7590108 - DNA, 22 bp, Homo sapiens
tatacttatgctaaaaaatgtt

SEQ ID NO: 7590109 - DNA, 22 bp, Homo sapiens
tatactttcctgcaactttgat

SEQ ID NO: 7590110 - DNA, 22 bp, Homo sapiens
tatactttcctgcaactttgat

SEQ ID NO: 7590111 - DNA, 22 bp, Homo sapiens
tatactttcctgcaactttgat

SEQ ID NO: 7590112 - DNA, 22 bp, Homo sapiens
tatactttcctgcaactttgat

SEQ ID NO: 7590113 - DNA, 22 bp, Homo sapiens
tatactttcctgcaactttgat

SEQ ID NO: 7590114 - DNA, 22 bp, Homo sapiens
tatagaagtaagcattgtgatg

SEQ ID NO: 7590115 - DNA, 22 bp, Homo sapiens
tatagaagtaagcattgtgatg

SEQ ID NO: 7590116 - DNA, 22 bp, Homo sapiens
tatagaagtaagcattgtgatg

SEQ ID NO: 7590117 - DNA, 22 bp, Homo sapiens
tatagaagtaagcattgtgatg

SEQ ID NO: 7590118 - DNA, 22 bp, Homo sapiens
tatagaagagacatgtgcatag

SEQ ID NO: 7590119 - DNA, 22 bp, Homo sapiens
tatactttcctgcaactttgat

SEQ ID NO: 7590120 - DNA, 22 bp, Homo sapiens
tatagaacaagttatttatgct

SEQ ID NO: 7590121 - DNA, 22 bp, Homo sapiens
tatagaagagacatgtgcatag

SEQ ID NO: 7590122 - DNA, 22 bp, Homo sapiens
tatatgctaatggtgccattcc

SEQ ID NO: 7590123 - DNA, 22 bp, Homo sapiens
tatatgcatgcccatgtataca

SEQ ID NO: 7590124 - DNA, 22 bp, Homo sapiens
tatatgcatgcccatgtataca

SEQ ID NO: 7590125 - DNA, 22 bp, Homo sapiens
tatatgctctgggatcctgaaa

SEQ ID NO: 7590126 - DNA, 22 bp, Homo sapiens
tatatgcttgggaaatggtaga

SEQ ID NO: 7590127 - DNA, 22 bp, Homo sapiens
tatatgcttgggaaatggtaga

SEQ ID NO: 7590128 - DNA, 22 bp, Homo sapiens
tatatgcagtgtgtcattcaag

SEQ ID NO: 7590129 - DNA, 22 bp, Homo sapiens
tatatgcaatgaggtgggagta

SEQ ID NO: 7590130 - DNA, 22 bp, Homo sapiens
tatatgcatgcccatgtataca

SEQ ID NO: 7590131 - DNA, 22 bp, Homo sapiens
tatatgcatgcccatgtataca

SEQ ID NO: 7590132 - DNA, 22 bp, Homo sapiens
tatatgcatgcccatgtataca

SEQ ID NO: 7590133 - DNA, 22 bp, Homo sapiens
tatatgcatgcccatgtataca

SEQ ID NO: 7590134 - DNA, 22 bp, Homo sapiens
tatatgcttgtgcatgtctttg

SEQ ID NO: 7590135 - DNA, 22 bp, Homo sapiens
tatatgcttgtgcatgtctttg

SEQ ID NO: 7590136 - DNA, 22 bp, Homo sapiens
tatatggatagtgatcataaga

SEQ ID NO: 7590137 - DNA, 22 bp, Homo sapiens
tatatgtaaataagtctaatgt

SEQ ID NO: 7590138 - DNA, 22 bp, Homo sapiens
tatatgtaagctatgtaagagt

SEQ ID NO: 7590139 - DNA, 22 bp, Homo sapiens
tatatgtaaataagtctaatgt

SEQ ID NO: 7590140 - DNA, 22 bp, Homo sapiens
tatatgtaagctatgtaagagt

SEQ ID NO: 7590141 - DNA, 22 bp, Homo sapiens
tatatgtaagctatgtaagagt

SEQ ID NO: 7590142 - DNA, 22 bp, Homo sapiens
tatatgtagtcagtcagagtaa

SEQ ID NO: 7590143 - DNA, 22 bp, Homo sapiens
tatatgtagtcagtcagagtaa

SEQ ID NO: 7590144 - DNA, 22 bp, Homo sapiens
tatatgtagattgtaccaatgt

SEQ ID NO: 7590145 - DNA, 22 bp, Homo sapiens
tatatgtaagctatgtaagagt

SEQ ID NO: 7590146 - DNA, 22 bp, Homo sapiens
tatatgtagattgtaccaatgt

SEQ ID NO: 7590147 - DNA, 22 bp, Homo sapiens
tatatgtagattgtaccaatgt

SEQ ID NO: 7590148 - DNA, 22 bp, Homo sapiens
tatatgtagattgtaccaatgt

SEQ ID NO: 7590149 - DNA, 17 bp, Homo sapiens
tatatgtatgcctctcc

SEQ ID NO: 7590150 - DNA, 22 bp, Homo sapiens
tatatgtctgctactgtataaa

SEQ ID NO: 7590151 - DNA, 20 bp, Homo sapiens
tatatgtgtacatacacaca

SEQ ID NO: 7590152 - DNA, 22 bp, Homo sapiens
tatatgtctgctactgtataaa

SEQ ID NO: 7590153 - DNA, 22 bp, Homo sapiens
tatatgtctgtaactttgtcta

SEQ ID NO: 7590154 - DNA, 22 bp, Homo sapiens
tatatgtagtcagtcagagtaa

SEQ ID NO: 7590155 - DNA, 22 bp, Homo sapiens
tatatgtagtcagtcagagtaa

SEQ ID NO: 7590156 - DNA, 22 bp, Homo sapiens
tatatgtagtcagtcagagtaa

SEQ ID NO: 7590157 - DNA, 17 bp, Homo sapiens
tatatgtatgcctctcc

SEQ ID NO: 7590158 - DNA, 17 bp, Homo sapiens
tatatgtatgcctctcc

SEQ ID NO: 7590159 - DNA, 22 bp, Homo sapiens
tatatgtagtcagtcagagtaa

SEQ ID NO: 7590160 - DNA, 22 bp, Homo sapiens
tatagatagactgacgatacag

SEQ ID NO: 7590161 - DNA, 22 bp, Homo sapiens
tatagatagactgacgatacag

SEQ ID NO: 7590162 - DNA, 22 bp, Homo sapiens
tatagaggtggaaactgaggtt

SEQ ID NO: 7590163 - DNA, 22 bp, Homo sapiens
tatagaggatgaacatctatta

SEQ ID NO: 7590164 - DNA, 22 bp, Homo sapiens
tatagagtcatgtttactctaa

SEQ ID NO: 7590165 - DNA, 22 bp, Homo sapiens
tatagaggccaccaacatgaaa

SEQ ID NO: 7590166 - DNA, 22 bp, Homo sapiens
tatagatcttgctatttaagga

SEQ ID NO: 7590167 - DNA, 22 bp, Homo sapiens
tatagatcccccgtatgtgtga

SEQ ID NO: 7590168 - DNA, 20 bp, Homo sapiens
tatagatcacatcttctagc

SEQ ID NO: 7590169 - DNA, 22 bp, Homo sapiens
tatagacaagcgtaacaagaag

SEQ ID NO: 7590170 - DNA, 22 bp, Homo sapiens
tatagactagcagcagaattta

SEQ ID NO: 7590171 - DNA, 22 bp, Homo sapiens
tatagaggccaccaacatgaaa

SEQ ID NO: 7590172 - DNA, 22 bp, Homo sapiens
tatagaggatgaacatctatta

SEQ ID NO: 7590173 - DNA, 22 bp, Homo sapiens
tatagactgtgaaatttaggca

SEQ ID NO: 7590174 - DNA, 22 bp, Homo sapiens
tatagacttggcatgcatgttc

SEQ ID NO: 7590175 - DNA, 22 bp, Homo sapiens
tatatgcaattttttagtgcaa

SEQ ID NO: 7590176 - DNA, 22 bp, Homo sapiens
tatatgcagattttcatcatcg

SEQ ID NO: 7590177 - DNA, 22 bp, Homo sapiens
tatatgcagattttcatcatcg

SEQ ID NO: 7590178 - DNA, 22 bp, Homo sapiens
tatatgcagattttcatcatcg

SEQ ID NO: 7590179 - DNA, 22 bp, Homo sapiens
tatatgcagattttcatcatcg

SEQ ID NO: 7590180 - DNA, 20 bp, Homo sapiens
tatatgcagccaacactccc

SEQ ID NO: 7590181 - DNA, 22 bp, Homo sapiens
tatatgcaattttttagtgcaa

SEQ ID NO: 7590182 - DNA, 22 bp, Homo sapiens
tatatgatgccaaataacctgt

SEQ ID NO: 7590183 - DNA, 22 bp, Homo sapiens
tatagcaaggacataatatgct

SEQ ID NO: 7590184 - DNA, 22 bp, Homo sapiens
tatagcaaggacataatatgct

SEQ ID NO: 7590185 - DNA, 22 bp, Homo sapiens
tatagcaagctctttgtaacca

SEQ ID NO: 7590186 - DNA, 22 bp, Homo sapiens
tatagcaactccaaagagactt

SEQ ID NO: 7590187 - DNA, 22 bp, Homo sapiens
tatagcaactccaaagagactt

SEQ ID NO: 7590188 - DNA, 22 bp, Homo sapiens
tatagcaagcaggacagtctca

SEQ ID NO: 7590189 - DNA, 22 bp, Homo sapiens
tatagcaagcaggacagtctca

SEQ ID NO: 7590190 - DNA, 22 bp, Homo sapiens
tatagcaagcaggacagtctca

SEQ ID NO: 7590191 - DNA, 22 bp, Homo sapiens
tatagcaagcaggacagtctca

SEQ ID NO: 7590192 - DNA, 22 bp, Homo sapiens
tatattaaatgaccagttttaa

SEQ ID NO: 7590193 - DNA, 22 bp, Homo sapiens
tatattaaatgaccagttttaa

SEQ ID NO: 7590194 - DNA, 22 bp, Homo sapiens
tatattaaatgaccagttttaa

SEQ ID NO: 7590195 - DNA, 22 bp, Homo sapiens
tatattaaatgaccagttttaa

SEQ ID NO: 7590196 - DNA, 22 bp, Homo sapiens
tatattaaagtgctttgcagtg

SEQ ID NO: 7590197 - DNA, 22 bp, Homo sapiens
tatattaaagtgctttgcagtg

SEQ ID NO: 7590198 - DNA, 22 bp, Homo sapiens
tatattaaagtgctttgcagtg

SEQ ID NO: 7590199 - DNA, 22 bp, Homo sapiens
tatattaaagtgctttgcagtg

SEQ ID NO: 7590200 - DNA, 22 bp, Homo sapiens
tatattaaagtgctttgcagtg

SEQ ID NO: 7590201 - DNA, 22 bp, Homo sapiens
tatattaaatgaccagttttaa

SEQ ID NO: 7590202 - DNA, 22 bp, Homo sapiens
tatattaaatgaccagttttaa

SEQ ID NO: 7590203 - DNA, 22 bp, Homo sapiens
tatattaaatgaccagttttaa

SEQ ID NO: 7590204 - DNA, 22 bp, Homo sapiens
tatattaaatgaccagttttaa

SEQ ID NO: 7590205 - DNA, 22 bp, Homo sapiens
tatattaaatgaccagttttaa

SEQ ID NO: 7590206 - DNA, 22 bp, Homo sapiens
tatattaaatgaccagttttaa

SEQ ID NO: 7590207 - DNA, 22 bp, Homo sapiens
tatattaaaccctctctgtagg

SEQ ID NO: 7590208 - DNA, 22 bp, Homo sapiens
tatattaaaccctctctgtagg

SEQ ID NO: 7590209 - DNA, 22 bp, Homo sapiens
tatattaaaccctctctgtagg

SEQ ID NO: 7590210 - DNA, 22 bp, Homo sapiens
tatattaaagtgctttgcagtg

SEQ ID NO: 7590211 - DNA, 22 bp, Homo sapiens
tatattaaagtgctttgcagtg

SEQ ID NO: 7590212 - DNA, 22 bp, Homo sapiens
tatattaaagtgctttgcagtg

SEQ ID NO: 7590213 - DNA, 22 bp, Homo sapiens
tatattaaaccctctctgtagg

SEQ ID NO: 7590214 - DNA, 22 bp, Homo sapiens
tatattaaaccctctctgtagg

SEQ ID NO: 7590215 - DNA, 22 bp, Homo sapiens
tatattaaaccctctctgtagg

SEQ ID NO: 7590216 - DNA, 22 bp, Homo sapiens
tatattaaaccctctctgtagg

SEQ ID NO: 7590217 - DNA, 22 bp, Homo sapiens
tatattaaaccctctctgtagg

SEQ ID NO: 7590218 - DNA, 22 bp, Homo sapiens
tatattaaaccctctctgtagg

SEQ ID NO: 7590219 - DNA, 22 bp, Homo sapiens
tatattaaaccctctctgtagg

SEQ ID NO: 7590220 - DNA, 20 bp, Homo sapiens
tatatgtgtacatacacaca

SEQ ID NO: 7590221 - DNA, 22 bp, Homo sapiens
tatatgtgtggattcttgtaga

SEQ ID NO: 7590222 - DNA, 22 bp, Homo sapiens
tatatgtgtggattcttgtaga

SEQ ID NO: 7590223 - DNA, 22 bp, Homo sapiens
tatatgttgatactaattctgg

SEQ ID NO: 7590224 - DNA, 22 bp, Homo sapiens
tatatgtttcttacaaaatatt

SEQ ID NO: 7590225 - DNA, 22 bp, Homo sapiens
tatatgtttcttacaaaatatt

SEQ ID NO: 7590226 - DNA, 22 bp, Homo sapiens
tatatgtttcttacaaaatatt

SEQ ID NO: 7590227 - DNA, 22 bp, Homo sapiens
tatatgtttcttacaaaatatt

SEQ ID NO: 7590228 - DNA, 22 bp, Homo sapiens
tatatgttgatactaattctgg

SEQ ID NO: 7590229 - DNA, 22 bp, Homo sapiens
tatatgtgtggattcttgtaga

SEQ ID NO: 7590230 - DNA, 22 bp, Homo sapiens
tatattatcataaaaccattca

SEQ ID NO: 7590231 - DNA, 22 bp, Homo sapiens
tatattatcataaaaccattca

SEQ ID NO: 7590232 - DNA, 22 bp, Homo sapiens
tatattatcataaaaccattca

SEQ ID NO: 7590233 - DNA, 22 bp, Homo sapiens
tatattataagccctttcagaa

SEQ ID NO: 7590234 - DNA, 22 bp, Homo sapiens
tatattataagccctttcagaa

SEQ ID NO: 7590235 - DNA, 22 bp, Homo sapiens
tatattagtgagatttatccat

SEQ ID NO: 7590236 - DNA, 22 bp, Homo sapiens
tatattacctgcctgatctata

SEQ ID NO: 7590237 - DNA, 22 bp, Homo sapiens
tatattacctgcctgatctata

SEQ ID NO: 7590238 - DNA, 22 bp, Homo sapiens
tatattacctgcctgatctata

SEQ ID NO: 7590239 - DNA, 22 bp, Homo sapiens
tatattacctgcctgatctata

SEQ ID NO: 7590240 - DNA, 22 bp, Homo sapiens
tatattacctgcctgatctata

SEQ ID NO: 7590241 - DNA, 22 bp, Homo sapiens
tatattacctgcctgatctata

SEQ ID NO: 7590242 - DNA, 22 bp, Homo sapiens
tatattaacacccacttgcctc

SEQ ID NO: 7590243 - DNA, 22 bp, Homo sapiens
tatattaacacccacttgcctc

SEQ ID NO: 7590244 - DNA, 22 bp, Homo sapiens
tatattaacacccacttgcctc

SEQ ID NO: 7590245 - DNA, 22 bp, Homo sapiens
tatattaacacccacttgcctc

SEQ ID NO: 7590246 - DNA, 22 bp, Homo sapiens
tatattaacacccacttgcctc

SEQ ID NO: 7590247 - DNA, 22 bp, Homo sapiens
tatattaaccatagggttctag

SEQ ID NO: 7590248 - DNA, 22 bp, Homo sapiens
tatattaaccatagggttctag

SEQ ID NO: 7590249 - DNA, 22 bp, Homo sapiens
tatattaacacccacttgcctc

SEQ ID NO: 7590250 - DNA, 22 bp, Homo sapiens
tatattaaccatagggttctag

SEQ ID NO: 7590251 - DNA, 22 bp, Homo sapiens
tatattaaccatagggttctag

SEQ ID NO: 7590252 - DNA, 22 bp, Homo sapiens
tatattacatagtgtttgagat

SEQ ID NO: 7590253 - DNA, 22 bp, Homo sapiens
tatattacctgcctgatctata

SEQ ID NO: 7590254 - DNA, 22 bp, Homo sapiens
tatattacatagtgtttgagat

SEQ ID NO: 7590255 - DNA, 22 bp, Homo sapiens
tatattaacttgtgatcctgga

SEQ ID NO: 7590256 - DNA, 22 bp, Homo sapiens
tatattaacttgtgatcctgga

SEQ ID NO: 7590257 - DNA, 22 bp, Homo sapiens
tatattaacttgtgatcctgga

SEQ ID NO: 7590258 - DNA, 22 bp, Homo sapiens
tatattaacttgtgatcctgga

SEQ ID NO: 7590259 - DNA, 22 bp, Homo sapiens
tatattaacttgtgatcctgga

SEQ ID NO: 7590260 - DNA, 22 bp, Homo sapiens
tatattaacttgtgatcctgga

SEQ ID NO: 7590261 - DNA, 22 bp, Homo sapiens
tatattaacttgtgatcctgga

SEQ ID NO: 7590262 - DNA, 22 bp, Homo sapiens
tatattaacttgtgatcctgga

SEQ ID NO: 7590263 - DNA, 22 bp, Homo sapiens
tatttggagtgatggaaatgtt

SEQ ID NO: 7590264 - DNA, 22 bp, Homo sapiens
tatttggagtgatggaaatgtt

SEQ ID NO: 7590265 - DNA, 22 bp, Homo sapiens
tatttggagtgatggaaatgtt

SEQ ID NO: 7590266 - DNA, 22 bp, Homo sapiens
tatttggaggccactgttgagt

SEQ ID NO: 7590267 - DNA, 22 bp, Homo sapiens
tatttggagctgtgtgagctca

SEQ ID NO: 7590268 - DNA, 22 bp, Homo sapiens
tatttggaggccactgttgagt

SEQ ID NO: 7590269 - DNA, 22 bp, Homo sapiens
tatttctaagctgtaagtctga

SEQ ID NO: 7590270 - DNA, 22 bp, Homo sapiens
tatttctaagctgtaagtctga

SEQ ID NO: 7590271 - DNA, 22 bp, Homo sapiens
tatttctaagctgtaagtctga

SEQ ID NO: 7590272 - DNA, 22 bp, Homo sapiens
tatttctaagctgtaagtctga

SEQ ID NO: 7590273 - DNA, 22 bp, Homo sapiens
tatttctaagctgtaagtctga

SEQ ID NO: 7590274 - DNA, 22 bp, Homo sapiens
tatttggatacaatcatttgct

SEQ ID NO: 7590275 - DNA, 22 bp, Homo sapiens
tatttggatacaatcatttgct

SEQ ID NO: 7590276 - DNA, 22 bp, Homo sapiens
tatttggatagacagggagatg

SEQ ID NO: 7590277 - DNA, 22 bp, Homo sapiens
tatttggtatcagtgacagctg

SEQ ID NO: 7590278 - DNA, 22 bp, Homo sapiens
tatttggttcttcttctgtgta

SEQ ID NO: 7590279 - DNA, 22 bp, Homo sapiens
tatttgtagaatggattaaggg

SEQ ID NO: 7590280 - DNA, 22 bp, Homo sapiens
tatttggttcttcttctgtgta

SEQ ID NO: 7590281 - DNA, 22 bp, Homo sapiens
tatttgtagaatggattaaggg

SEQ ID NO: 7590282 - DNA, 22 bp, Homo sapiens
tatttgtagaatggattaaggg

SEQ ID NO: 7590283 - DNA, 22 bp, Homo sapiens
tatttgtatgtgtgtacatata

SEQ ID NO: 7590284 - DNA, 22 bp, Homo sapiens
tatttgtagcttcccaaagctt

SEQ ID NO: 7590285 - DNA, 22 bp, Homo sapiens
tatttgtatgtgtgtacatata

SEQ ID NO: 7590286 - DNA, 22 bp, Homo sapiens
tatttgtatgtgtgtacatata

SEQ ID NO: 7590287 - DNA, 22 bp, Homo sapiens
tatttgtatgtgtgtacatata

SEQ ID NO: 7590288 - DNA, 22 bp, Homo sapiens
tatttgtatgtgtgtacatata

SEQ ID NO: 7590289 - DNA, 22 bp, Homo sapiens
tatttgtatgtgtgtacatata

SEQ ID NO: 7590290 - DNA, 22 bp, Homo sapiens
tatttgtatgtgtgtacatata

SEQ ID NO: 7590291 - DNA, 22 bp, Homo sapiens
tatttgtatgtgtgtacatata

SEQ ID NO: 7590292 - DNA, 22 bp, Homo sapiens
tatttgtatttcatgcagtaaa

SEQ ID NO: 7590293 - DNA, 22 bp, Homo sapiens
tatttgtatttcatgcagtaaa

SEQ ID NO: 7590294 - DNA, 22 bp, Homo sapiens
tatttgtatttcatgcagtaaa

SEQ ID NO: 7590295 - DNA, 22 bp, Homo sapiens
tatttgtatgtgtgtacatata

SEQ ID NO: 7590296 - DNA, 22 bp, Homo sapiens
tatttgtatgtgtgtacatata

SEQ ID NO: 7590297 - DNA, 22 bp, Homo sapiens
tatttgtatgtgtgtacatata

SEQ ID NO: 7590298 - DNA, 22 bp, Homo sapiens
tatttgtatgtgtgtacatata

SEQ ID NO: 7590299 - DNA, 22 bp, Homo sapiens
tatttcagggagaataaatttg

SEQ ID NO: 7590300 - DNA, 22 bp, Homo sapiens
tatttcagggggtacaagaaga

SEQ ID NO: 7590301 - DNA, 22 bp, Homo sapiens
tatttcagggggtacaagaaga

SEQ ID NO: 7590302 - DNA, 22 bp, Homo sapiens
tatttcagggggtacaagaaga

SEQ ID NO: 7590303 - DNA, 22 bp, Homo sapiens
tatttccagcagtaagaagaca

SEQ ID NO: 7590304 - DNA, 22 bp, Homo sapiens
tatttccagcagtaagaagaca

SEQ ID NO: 7590305 - DNA, 22 bp, Homo sapiens
tatttccatgttagaactaagt

SEQ ID NO: 7590306 - DNA, 18 bp, Homo sapiens
tatttcccaatggaaaca

SEQ ID NO: 7590307 - DNA, 18 bp, Homo sapiens
tatttcccaatggaaaca

SEQ ID NO: 7590308 - DNA, 18 bp, Homo sapiens
tatttcccaatggaaaca

SEQ ID NO: 7590309 - DNA, 22 bp, Homo sapiens
tatttccaggccccactctaga

SEQ ID NO: 7590310 - DNA, 22 bp, Homo sapiens
tatttccatgttagaactaagt

SEQ ID NO: 7590311 - DNA, 22 bp, Homo sapiens
tatttccatgttagaactaagt

SEQ ID NO: 7590312 - DNA, 22 bp, Homo sapiens
tatttccatgttagaactaagt

SEQ ID NO: 7590313 - DNA, 22 bp, Homo sapiens
tatttctaagagatatctgtac

SEQ ID NO: 7590314 - DNA, 22 bp, Homo sapiens
tatttctaagagatatctgtac

SEQ ID NO: 7590315 - DNA, 22 bp, Homo sapiens
tatttctaagagatatctgtac

SEQ ID NO: 7590316 - DNA, 22 bp, Homo sapiens
tatttctaagagatatctgtac

SEQ ID NO: 7590317 - DNA, 22 bp, Homo sapiens
tatttctaagagatatctgtac

SEQ ID NO: 7590318 - DNA, 22 bp, Homo sapiens
tatttcctgcatggtgatgtaa

SEQ ID NO: 7590319 - DNA, 22 bp, Homo sapiens
tatttcccagggagcaacaagc

SEQ ID NO: 7590320 - DNA, 22 bp, Homo sapiens
tatttcccagggagcaacaagc

SEQ ID NO: 7590321 - DNA, 22 bp, Homo sapiens
tatttcctgcatggtgatgtaa

SEQ ID NO: 7590322 - DNA, 22 bp, Homo sapiens
tatttcctgtggatacttttag

SEQ ID NO: 7590323 - DNA, 22 bp, Homo sapiens
tatttcctgtggatacttttag

SEQ ID NO: 7590324 - DNA, 22 bp, Homo sapiens
tatttcctgtggatacttttag

SEQ ID NO: 7590325 - DNA, 22 bp, Homo sapiens
tatttcctgtggatacttttag

SEQ ID NO: 7590326 - DNA, 22 bp, Homo sapiens
tatttccttgagacggagtctc

SEQ ID NO: 7590327 - DNA, 22 bp, Homo sapiens
tatttcctgtggatacttttag

SEQ ID NO: 7590328 - DNA, 22 bp, Homo sapiens
tatttcctgtggatacttttag

SEQ ID NO: 7590329 - DNA, 22 bp, Homo sapiens
tattttcaccttctctggatat

SEQ ID NO: 7590330 - DNA, 22 bp, Homo sapiens
tattttcaccttctctggatat

SEQ ID NO: 7590331 - DNA, 22 bp, Homo sapiens
tattttcaccttctctggatat

SEQ ID NO: 7590332 - DNA, 22 bp, Homo sapiens
tattttcaccttctctggatat

SEQ ID NO: 7590333 - DNA, 22 bp, Homo sapiens
tattttcaccttctctggatat

SEQ ID NO: 7590334 - DNA, 22 bp, Homo sapiens
tatttgttgcgggaattgctat

SEQ ID NO: 7590335 - DNA, 22 bp, Homo sapiens
tatttgttgcgggaattgctat

SEQ ID NO: 7590336 - DNA, 22 bp, Homo sapiens
tatttgttgcgggaattgctat

SEQ ID NO: 7590337 - DNA, 22 bp, Homo sapiens
tatttgttgcgggaattgctat

SEQ ID NO: 7590338 - DNA, 22 bp, Homo sapiens
tattttcaccatgtatccctgt

SEQ ID NO: 7590339 - DNA, 22 bp, Homo sapiens
tattttcaccatgtatccctgt

SEQ ID NO: 7590340 - DNA, 22 bp, Homo sapiens
tattttcaccatgtatccctgt

SEQ ID NO: 7590341 - DNA, 22 bp, Homo sapiens
tatttgtttctagtggcagcaa

SEQ ID NO: 7590342 - DNA, 22 bp, Homo sapiens
tattttcattctgtgtgactgt

SEQ ID NO: 7590343 - DNA, 22 bp, Homo sapiens
tattttcattctgtgtgactgt

SEQ ID NO: 7590344 - DNA, 22 bp, Homo sapiens
tattttcattctgtgtgactgt

SEQ ID NO: 7590345 - DNA, 22 bp, Homo sapiens
tattttcattctgtgtgactgt

SEQ ID NO: 7590346 - DNA, 22 bp, Homo sapiens
tattttcattctgtgtgactgt

SEQ ID NO: 7590347 - DNA, 22 bp, Homo sapiens
tattttcattctgtgtgactgt

SEQ ID NO: 7590348 - DNA, 22 bp, Homo sapiens
tattttcattctgtgtgactgt

SEQ ID NO: 7590349 - DNA, 22 bp, Homo sapiens
tattttcattctgtgtgactgt

SEQ ID NO: 7590350 - DNA, 22 bp, Homo sapiens
tattttcattctgtgtgactgt

SEQ ID NO: 7590351 - DNA, 22 bp, Homo sapiens
tattttcattctgtgtgactgt

SEQ ID NO: 7590352 - DNA, 22 bp, Homo sapiens
tattttcaccttctctggatat

SEQ ID NO: 7590353 - DNA, 22 bp, Homo sapiens
tattttcatcttgtccttggat

SEQ ID NO: 7590354 - DNA, 22 bp, Homo sapiens
tattttcatcttgtccttggat

SEQ ID NO: 7590355 - DNA, 22 bp, Homo sapiens
tattttcatcttgtccttggat

SEQ ID NO: 7590356 - DNA, 22 bp, Homo sapiens
tattttcatcttgtccttggat

SEQ ID NO: 7590357 - DNA, 22 bp, Homo sapiens
tattttcatcttgtccttggat

SEQ ID NO: 7590358 - DNA, 22 bp, Homo sapiens
tatttgtctaagaggctgacag

SEQ ID NO: 7590359 - DNA, 22 bp, Homo sapiens
tatttgtctggtctaaggaggg

SEQ ID NO: 7590360 - DNA, 23 bp, Homo sapiens
tatttgtctcttaccactgctgt

SEQ ID NO: 7590361 - DNA, 22 bp, Homo sapiens
tatttgtcactgcacttgaaat

SEQ ID NO: 7590362 - DNA, 22 bp, Homo sapiens
tatttgtcacctatggctgtcc

SEQ ID NO: 7590363 - DNA, 22 bp, Homo sapiens
tatttgtcactagaaagggtaa

SEQ ID NO: 7590364 - DNA, 22 bp, Homo sapiens
tatttgtccaggtaaatttcag

SEQ ID NO: 7590365 - DNA, 22 bp, Homo sapiens
tatttgtcagctgttgagttca

SEQ ID NO: 7590366 - DNA, 22 bp, Homo sapiens
tatttgtcacctatggctgtcc

SEQ ID NO: 7590367 - DNA, 22 bp, Homo sapiens
tatttgtcaagagagggggata

SEQ ID NO: 7590368 - DNA, 22 bp, Homo sapiens
tatttgtatttcatgcagtaaa

SEQ ID NO: 7590369 - DNA, 22 bp, Homo sapiens
tatttgtatttcatgcagtaaa

SEQ ID NO: 7590370 - DNA, 22 bp, Homo sapiens
tatttgtatttcatgcagtaaa

SEQ ID NO: 7590371 - DNA, 22 bp, Homo sapiens
tatttgtatttcatgcagtaaa

SEQ ID NO: 7590372 - DNA, 22 bp, Homo sapiens
tatttgtatttcatgcagtaaa

SEQ ID NO: 7590373 - DNA, 22 bp, Homo sapiens
tatttgtgtgggtatctatata

SEQ ID NO: 7590374 - DNA, 22 bp, Homo sapiens
tatttgtgagactgactgaagt

SEQ ID NO: 7590375 - DNA, 22 bp, Homo sapiens
tatttgtgtgggtatctatata

SEQ ID NO: 7590376 - DNA, 22 bp, Homo sapiens
tatttgttccagagataaaaat

SEQ ID NO: 7590377 - DNA, 22 bp, Homo sapiens
tatttgttccagagataaaaat

SEQ ID NO: 7590378 - DNA, 22 bp, Homo sapiens
tatttgttccagagataaaaat

SEQ ID NO: 7590379 - DNA, 22 bp, Homo sapiens
tatttgttccagagataaaaat

SEQ ID NO: 7590380 - DNA, 22 bp, Homo sapiens
tatttgttgagttgttatgtct

SEQ ID NO: 7590381 - DNA, 22 bp, Homo sapiens
tatttgttgagttgttatgtct

SEQ ID NO: 7590382 - DNA, 22 bp, Homo sapiens
tatttgttgaatacccctgtct

SEQ ID NO: 7590383 - DNA, 22 bp, Homo sapiens
tatttgttgagttgttatgtct

SEQ ID NO: 7590384 - DNA, 22 bp, Homo sapiens
tatttgttgagttgttatgtct

SEQ ID NO: 7590385 - DNA, 22 bp, Homo sapiens
tatttgttgagttgttatgtct

SEQ ID NO: 7590386 - DNA, 22 bp, Homo sapiens
tattggtatctgagacagagtt

SEQ ID NO: 7590387 - DNA, 22 bp, Homo sapiens
tattggtagaaataggttctgg

SEQ ID NO: 7590388 - DNA, 22 bp, Homo sapiens
tattggtgatgacttgaggcca

SEQ ID NO: 7590389 - DNA, 22 bp, Homo sapiens
tattggtgatgacttgaggcca

SEQ ID NO: 7590390 - DNA, 22 bp, Homo sapiens
tattggtcttctgttccctatt

SEQ ID NO: 7590391 - DNA, 22 bp, Homo sapiens
tattggtgatgacttgaggcca

SEQ ID NO: 7590392 - DNA, 22 bp, Homo sapiens
tattggtctgcttaagtggatt

SEQ ID NO: 7590393 - DNA, 22 bp, Homo sapiens
tattggtcaagttgaggaccct

SEQ ID NO: 7590394 - DNA, 22 bp, Homo sapiens
tattggtcaatttcaccttgat

SEQ ID NO: 7590395 - DNA, 22 bp, Homo sapiens
tattggtcttctgttccctatt

SEQ ID NO: 7590396 - DNA, 22 bp, Homo sapiens
tattggtcttggaaggttttgt

SEQ ID NO: 7590397 - DNA, 22 bp, Homo sapiens
tattgggtaaagatccagtttt

SEQ ID NO: 7590398 - DNA, 22 bp, Homo sapiens
tattgggtaaagatccagtttt

SEQ ID NO: 7590399 - DNA, 22 bp, Homo sapiens
tattgggtaaagatccagtttt

SEQ ID NO: 7590400 - DNA, 22 bp, Homo sapiens
tattgggtaaagatccagtttt

SEQ ID NO: 7590401 - DNA, 22 bp, Homo sapiens
tattgggtaaagatccagtttt

SEQ ID NO: 7590402 - DNA, 22 bp, Homo sapiens
tattgcattatggtaggaaagg

SEQ ID NO: 7590403 - DNA, 22 bp, Homo sapiens
tattgcattatggtaggaaagg

SEQ ID NO: 7590404 - DNA, 22 bp, Homo sapiens
tattgcatcttagtgtaagtca

SEQ ID NO: 7590405 - DNA, 22 bp, Homo sapiens
tattgggtaaagatccagtttt

SEQ ID NO: 7590406 - DNA, 22 bp, Homo sapiens
tattgcatgtgatagaggcagg

SEQ ID NO: 7590407 - DNA, 22 bp, Homo sapiens
tattgcatcttagtgtaagtca

SEQ ID NO: 7590408 - DNA, 22 bp, Homo sapiens
tattgtacatttcaaagtagct

SEQ ID NO: 7590409 - DNA, 22 bp, Homo sapiens
tattgtacatttcaaagtagct

SEQ ID NO: 7590410 - DNA, 22 bp, Homo sapiens
tattgtacatttcaaagtagct

SEQ ID NO: 7590411 - DNA, 22 bp, Homo sapiens
tattgtacatttcaaagtagct

SEQ ID NO: 7590412 - DNA, 22 bp, Homo sapiens
tattgtacatttcaaagtagct

SEQ ID NO: 7590413 - DNA, 22 bp, Homo sapiens
tattgtacatttcaaagtagct

SEQ ID NO: 7590414 - DNA, 22 bp, Homo sapiens
tattgtacatttcaaagtagct

SEQ ID NO: 7590415 - DNA, 22 bp, Homo sapiens
tattgtacatttcaaagtagct

SEQ ID NO: 7590416 - DNA, 22 bp, Homo sapiens
tattgtactgaggaataaagct

SEQ ID NO: 7590417 - DNA, 22 bp, Homo sapiens
tattgtactgaggaataaagct

SEQ ID NO: 7590418 - DNA, 22 bp, Homo sapiens
tattgtacatttccaaattgct

SEQ ID NO: 7590419 - DNA, 22 bp, Homo sapiens
tattgtactgaggaataaagct

SEQ ID NO: 7590420 - DNA, 22 bp, Homo sapiens
tattgtactgaggaataaagct

SEQ ID NO: 7590421 - DNA, 22 bp, Homo sapiens
tattgtacatttcaaagtagct

SEQ ID NO: 7590422 - DNA, 22 bp, Homo sapiens
tattgtacatttccaaattgct

SEQ ID NO: 7590423 - DNA, 22 bp, Homo sapiens
tattgtacatttccaaattgct

SEQ ID NO: 7590424 - DNA, 22 bp, Homo sapiens
tattgtacatttccaaattgct

SEQ ID NO: 7590425 - DNA, 22 bp, Homo sapiens
tattggtgggggcagagagaga

SEQ ID NO: 7590426 - DNA, 22 bp, Homo sapiens
tattggtttattgtgtatgaga

SEQ ID NO: 7590427 - DNA, 22 bp, Homo sapiens
tattgtacagagagagaggttt

SEQ ID NO: 7590428 - DNA, 22 bp, Homo sapiens
tattgtacagagagagaggttt

SEQ ID NO: 7590429 - DNA, 22 bp, Homo sapiens
tattgtacatggttatgcagga

SEQ ID NO: 7590430 - DNA, 22 bp, Homo sapiens
tattgtacatttcaaaattgct

SEQ ID NO: 7590431 - DNA, 22 bp, Homo sapiens
tattgtacatttcaaaattgct

SEQ ID NO: 7590432 - DNA, 22 bp, Homo sapiens
tattgtacatttcaaaattgct

SEQ ID NO: 7590433 - DNA, 22 bp, Homo sapiens
tattgtacatggttatgcagga

SEQ ID NO: 7590434 - DNA, 22 bp, Homo sapiens
tattgtacatggttatgcagga

SEQ ID NO: 7590435 - DNA, 22 bp, Homo sapiens
tattgtacatggttatgcagga

SEQ ID NO: 7590436 - DNA, 22 bp, Homo sapiens
tattgtacatggttatgcagga

SEQ ID NO: 7590437 - DNA, 23 bp, Homo sapiens
tattgcacaaagagatgcacagg

SEQ ID NO: 7590438 - DNA, 22 bp, Homo sapiens
tattgcacaatgagctgtgtat

SEQ ID NO: 7590439 - DNA, 23 bp, Homo sapiens
tattgcacacatagaaacataga

SEQ ID NO: 7590440 - DNA, 23 bp, Homo sapiens
tattgcacaaagagatgcacagg

SEQ ID NO: 7590441 - DNA, 23 bp, Homo sapiens
tattgcacaaagagatgcacagg

SEQ ID NO: 7590442 - DNA, 22 bp, Homo sapiens
tattgcacatgcgctagaacca

SEQ ID NO: 7590443 - DNA, 23 bp, Homo sapiens
tattgcacacatagaaacataga

SEQ ID NO: 7590444 - DNA, 22 bp, Homo sapiens
tattgcacatgcgctagaacca

SEQ ID NO: 7590445 - DNA, 22 bp, Homo sapiens
tattgcacgatagtgtgggctt

SEQ ID NO: 7590446 - DNA, 22 bp, Homo sapiens
tattgcacgatagtgtgggctt

SEQ ID NO: 7590447 - DNA, 22 bp, Homo sapiens
tattgcaagcaattccaaaagg

SEQ ID NO: 7590448 - DNA, 22 bp, Homo sapiens
tattgcaagtggcataaaattt

SEQ ID NO: 7590449 - DNA, 22 bp, Homo sapiens
tattgattctgtcccaagttga

SEQ ID NO: 7590450 - DNA, 22 bp, Homo sapiens
tattgattctgtcccaagttga

SEQ ID NO: 7590451 - DNA, 21 bp, Homo sapiens
tattgattcaatttcttgagt

SEQ ID NO: 7590452 - DNA, 22 bp, Homo sapiens
tattgattcctgctttctgctc

SEQ ID NO: 7590453 - DNA, 21 bp, Homo sapiens
tattgcataccatgaatctga

SEQ ID NO: 7590454 - DNA, 21 bp, Homo sapiens
tattgcataccatgaatctga

SEQ ID NO: 7590455 - DNA, 21 bp, Homo sapiens
tattgcataacaaattaccct

SEQ ID NO: 7590456 - DNA, 22 bp, Homo sapiens
tattgcagaatgtgagttggca

SEQ ID NO: 7590457 - DNA, 22 bp, Homo sapiens
tattgcagacaaaatgagctac

SEQ ID NO: 7590458 - DNA, 22 bp, Homo sapiens
tattgcatctcttcatatctgt

SEQ ID NO: 7590459 - DNA, 22 bp, Homo sapiens
tattgcatcatcctgcaggggt

SEQ ID NO: 7590460 - DNA, 22 bp, Homo sapiens
tattgcatattgtacttgaatg

SEQ ID NO: 7590461 - DNA, 22 bp, Homo sapiens
tattgcatattattctagtggc

SEQ ID NO: 7590462 - DNA, 22 bp, Homo sapiens
tattgcatagaaggaaggagtt

SEQ ID NO: 7590463 - DNA, 22 bp, Homo sapiens
tattgcatattgtacttgaatg

SEQ ID NO: 7590464 - DNA, 22 bp, Homo sapiens
tattgcatcagtaatttagtgt

SEQ ID NO: 7590465 - DNA, 22 bp, Homo sapiens
tattgcatattgtacttgaatg

SEQ ID NO: 7590466 - DNA, 22 bp, Homo sapiens
tatttcagcaagaagaatgtgg

SEQ ID NO: 7590467 - DNA, 22 bp, Homo sapiens
tatttcagcaagaagaatgtgg

SEQ ID NO: 7590468 - DNA, 22 bp, Homo sapiens
tatttcagcacatgggataggt

SEQ ID NO: 7590469 - DNA, 22 bp, Homo sapiens
tatttcagcaagaagaatgtgg

SEQ ID NO: 7590470 - DNA, 22 bp, Homo sapiens
tatttcagccctactacttggc

SEQ ID NO: 7590471 - DNA, 22 bp, Homo sapiens
tatttcagccctactacttggc

SEQ ID NO: 7590472 - DNA, 22 bp, Homo sapiens
tatttcagctctttggattatc

SEQ ID NO: 7590473 - DNA, 22 bp, Homo sapiens
tatttcagctctttggattatc

SEQ ID NO: 7590474 - DNA, 22 bp, Homo sapiens
tatttcagggagaataaatttg

SEQ ID NO: 7590475 - DNA, 22 bp, Homo sapiens
tatttcagggagaataaatttg

SEQ ID NO: 7590476 - DNA, 19 bp, Homo sapiens
tatttcaggctcagagtct

SEQ ID NO: 7590477 - DNA, 22 bp, Homo sapiens
tatttcagggagaataaatttg

SEQ ID NO: 7590478 - DNA, 22 bp, Homo sapiens
tatttcagggagaataaatttg

SEQ ID NO: 7590479 - DNA, 22 bp, Homo sapiens
tatttcagggagaataaatttg

SEQ ID NO: 7590480 - DNA, 22 bp, Homo sapiens
tatttcaggctatatttcttgt

SEQ ID NO: 7590481 - DNA, 22 bp, Homo sapiens
tatttcaggctatatttcttgt

SEQ ID NO: 7590482 - DNA, 22 bp, Homo sapiens
tatttcaggctatatttcttgt

SEQ ID NO: 7590483 - DNA, 22 bp, Homo sapiens
tatttcactattctctgtaact

SEQ ID NO: 7590484 - DNA, 22 bp, Homo sapiens
tatttcactattctctgtaact

SEQ ID NO: 7590485 - DNA, 22 bp, Homo sapiens
tatttcactattctctgtaact

SEQ ID NO: 7590486 - DNA, 22 bp, Homo sapiens
tatttcaccttactaagctgtg

SEQ ID NO: 7590487 - DNA, 22 bp, Homo sapiens
tatttcaccttactaagctgtg

SEQ ID NO: 7590488 - DNA, 22 bp, Homo sapiens
tatttcactcagtataccatag

SEQ ID NO: 7590489 - DNA, 22 bp, Homo sapiens
tatttcactccgagactctatg

SEQ ID NO: 7590490 - DNA, 22 bp, Homo sapiens
tatttcactccgagactctatg

SEQ ID NO: 7590491 - DNA, 20 bp, Homo sapiens
tatttcactctccagatggc

SEQ ID NO: 7590492 - DNA, 20 bp, Homo sapiens
tatttcactctccagatggc

SEQ ID NO: 7590493 - DNA, 22 bp, Homo sapiens
tatttcagacactgatcttgca

SEQ ID NO: 7590494 - DNA, 22 bp, Homo sapiens
tatttcagacactgatcttgca

SEQ ID NO: 7590495 - DNA, 22 bp, Homo sapiens
tatttcagagttgttttctgtc

SEQ ID NO: 7590496 - DNA, 21 bp, Homo sapiens
tatttcagaagagtctcagag

SEQ ID NO: 7590497 - DNA, 22 bp, Homo sapiens
tatttcaagaacttctatccat

SEQ ID NO: 7590498 - DNA, 20 bp, Homo sapiens
tatttcactctccagatggc

SEQ ID NO: 7590499 - DNA, 17 bp, Homo sapiens
tatttcactggctcccc

SEQ ID NO: 7590500 - DNA, 18 bp, Homo sapiens
tatttcacttttgggcat

SEQ ID NO: 7590501 - DNA, 18 bp, Homo sapiens
tatttcacttttgggcat

SEQ ID NO: 7590502 - DNA, 22 bp, Homo sapiens
tatttcaacgtatgaaaagctg

SEQ ID NO: 7590503 - DNA, 22 bp, Homo sapiens
tatttcaacgtatgaaaagctg

SEQ ID NO: 7590504 - DNA, 22 bp, Homo sapiens
tatttcaacgtatgaaaagctg

SEQ ID NO: 7590505 - DNA, 22 bp, Homo sapiens
tattgtatcttaccacatgtat

SEQ ID NO: 7590506 - DNA, 22 bp, Homo sapiens
tattgtatcttaccacatgtat

SEQ ID NO: 7590507 - DNA, 22 bp, Homo sapiens
tattgtatcttaccacatgtat

SEQ ID NO: 7590508 - DNA, 22 bp, Homo sapiens
tattgtatcttaccacatgtat

SEQ ID NO: 7590509 - DNA, 22 bp, Homo sapiens
tattgtatcttaccacatgtat

SEQ ID NO: 7590510 - DNA, 22 bp, Homo sapiens
tatttcaagaacttctatccat

SEQ ID NO: 7590511 - DNA, 22 bp, Homo sapiens
tatttcaagaacttctatccat

SEQ ID NO: 7590512 - DNA, 22 bp, Homo sapiens
tatttcaagaacttctatccat

SEQ ID NO: 7590513 - DNA, 22 bp, Homo sapiens
tatttcaagaacttctatccat

SEQ ID NO: 7590514 - DNA, 22 bp, Homo sapiens
tatttcaacgtatgaaaagctg

SEQ ID NO: 7590515 - DNA, 22 bp, Homo sapiens
tatttcaacgtatgaaaagctg

SEQ ID NO: 7590516 - DNA, 22 bp, Homo sapiens
tatttcaagaacttctatccat

SEQ ID NO: 7590517 - DNA, 22 bp, Homo sapiens
tatttcaagaacttctatccat

SEQ ID NO: 7590518 - DNA, 22 bp, Homo sapiens
tatttcaagaacttctatccat

SEQ ID NO: 7590519 - DNA, 22 bp, Homo sapiens
tatttcacagcagctcatttaa

SEQ ID NO: 7590520 - DNA, 22 bp, Homo sapiens
tatttcacagcagctcatttaa

SEQ ID NO: 7590521 - DNA, 22 bp, Homo sapiens
tatttcacaagatgctgatgct

SEQ ID NO: 7590522 - DNA, 22 bp, Homo sapiens
tatttcacagcagctcatttaa

SEQ ID NO: 7590523 - DNA, 22 bp, Homo sapiens
tatttcacagcagctcatttaa

SEQ ID NO: 7590524 - DNA, 22 bp, Homo sapiens
tatttcacataccacagagtgt

SEQ ID NO: 7590525 - DNA, 22 bp, Homo sapiens
tatttcacagcagctcatttaa

SEQ ID NO: 7590526 - DNA, 22 bp, Homo sapiens
tatttcacataccacagagtgt

SEQ ID NO: 7590527 - DNA, 22 bp, Homo sapiens
tatttcaccttactaagctgtg

SEQ ID NO: 7590528 - DNA, 22 bp, Homo sapiens
tatttcacctaaaagtgtcaaa

SEQ ID NO: 7590529 - DNA, 22 bp, Homo sapiens
tatttcacctcacccaggagaa

SEQ ID NO: 7590530 - DNA, 22 bp, Homo sapiens
tatttcaccatgttttccccat

SEQ ID NO: 7590531 - DNA, 22 bp, Homo sapiens
tatttcacatctatgaagtgag

SEQ ID NO: 7590532 - DNA, 22 bp, Homo sapiens
tatttcacatctatgaagtgag

SEQ ID NO: 7590533 - DNA, 22 bp, Homo sapiens
tatttcacattagataggtctg

SEQ ID NO: 7590534 - DNA, 22 bp, Homo sapiens
tattgaggtgcttagctggggg

SEQ ID NO: 7590535 - DNA, 20 bp, Homo sapiens
tattgagtacctactgtata

SEQ ID NO: 7590536 - DNA, 22 bp, Homo sapiens
tattgagttacagaaaatactt

SEQ ID NO: 7590537 - DNA, 22 bp, Homo sapiens
tattgataaaatgctcactatg

SEQ ID NO: 7590538 - DNA, 22 bp, Homo sapiens
tattgataaaatgctcactatg

SEQ ID NO: 7590539 - DNA, 21 bp, Homo sapiens
tattgattcaatttcttgagt

SEQ ID NO: 7590540 - DNA, 21 bp, Homo sapiens
tattgattcaatttcttgagt

SEQ ID NO: 7590541 - DNA, 21 bp, Homo sapiens
tattgattcaatttcttgagt

SEQ ID NO: 7590542 - DNA, 22 bp, Homo sapiens
tattgatgtatttctaggtgct

SEQ ID NO: 7590543 - DNA, 22 bp, Homo sapiens
tattgatgcagagccaaattgc

SEQ ID NO: 7590544 - DNA, 22 bp, Homo sapiens
tattgatgcttggattgggcca

SEQ ID NO: 7590545 - DNA, 22 bp, Homo sapiens
tattgatgaaagggattttgga

SEQ ID NO: 7590546 - DNA, 22 bp, Homo sapiens
tattgatctggatatttagaca

SEQ ID NO: 7590547 - DNA, 22 bp, Homo sapiens
tattgatatgcagaactgactt

SEQ ID NO: 7590548 - DNA, 22 bp, Homo sapiens
tattgatatgcagaactgactt

SEQ ID NO: 7590549 - DNA, 22 bp, Homo sapiens
tattgaggaaacagagcaggca

SEQ ID NO: 7590550 - DNA, 22 bp, Homo sapiens
tattgagacttccagtatatga

SEQ ID NO: 7590551 - DNA, 22 bp, Homo sapiens
tattgagaccagtgcttgctta

SEQ ID NO: 7590552 - DNA, 22 bp, Homo sapiens
tattgagacttccagtatatga

SEQ ID NO: 7590553 - DNA, 22 bp, Homo sapiens
tattgagacttccagtatatga

SEQ ID NO: 7590554 - DNA, 22 bp, Homo sapiens
tattgacttgggcattgagaga

SEQ ID NO: 7590555 - DNA, 17 bp, Homo sapiens
tattgacctttgtatgt

SEQ ID NO: 7590556 - DNA, 17 bp, Homo sapiens
tattgacctttgtatgt

SEQ ID NO: 7590557 - DNA, 22 bp, Homo sapiens
tattgactaaattggaaagaat

SEQ ID NO: 7590558 - DNA, 22 bp, Homo sapiens
tattgaccagactgacacacat

SEQ ID NO: 7590559 - DNA, 22 bp, Homo sapiens
tattgacatttttatagcttga

SEQ ID NO: 7590560 - DNA, 22 bp, Homo sapiens
tattgaccagactgacacacat

SEQ ID NO: 7590561 - DNA, 22 bp, Homo sapiens
tattcatattgtaaaagaagtg

SEQ ID NO: 7590562 - DNA, 22 bp, Homo sapiens
tattcatattgtaaaagaagtg

SEQ ID NO: 7590563 - DNA, 22 bp, Homo sapiens
tattcatcttcatagtcacagt

SEQ ID NO: 7590564 - DNA, 22 bp, Homo sapiens
tattcatcttcatagtcacagt

SEQ ID NO: 7590565 - DNA, 22 bp, Homo sapiens
tattcatgacattgcatatgca

SEQ ID NO: 7590566 - DNA, 22 bp, Homo sapiens
tattcacattctcaggcctggt

SEQ ID NO: 7590567 - DNA, 22 bp, Homo sapiens
tattcacattctcaggcctggt

SEQ ID NO: 7590568 - DNA, 22 bp, Homo sapiens
tattcacattctcaggcctggt

SEQ ID NO: 7590569 - DNA, 22 bp, Homo sapiens
tattcacattctcaggcctggt

SEQ ID NO: 7590570 - DNA, 22 bp, Homo sapiens
tattcactgtaactcagcaata

SEQ ID NO: 7590571 - DNA, 22 bp, Homo sapiens
tattcactgtaactcagcaata

SEQ ID NO: 7590572 - DNA, 22 bp, Homo sapiens
tattcaccctgcctcctagttg

SEQ ID NO: 7590573 - DNA, 22 bp, Homo sapiens
tattcaccagatcccatatctt

SEQ ID NO: 7590574 - DNA, 22 bp, Homo sapiens
tattcagaaaataaattggatt

SEQ ID NO: 7590575 - DNA, 22 bp, Homo sapiens
tattcagaaaataaattggatt

SEQ ID NO: 7590576 - DNA, 22 bp, Homo sapiens
tattcagaaaataaattggatt

SEQ ID NO: 7590577 - DNA, 22 bp, Homo sapiens
tattcagaaaataaattggatt

SEQ ID NO: 7590578 - DNA, 22 bp, Homo sapiens
tattcagaaaactgagcgatga

SEQ ID NO: 7590579 - DNA, 22 bp, Homo sapiens
tattcactgtaactcagcaata

SEQ ID NO: 7590580 - DNA, 22 bp, Homo sapiens
tattcactttgggagagccatt

SEQ ID NO: 7590581 - DNA, 22 bp, Homo sapiens
tattcagaataaagactacatt

SEQ ID NO: 7590582 - DNA, 22 bp, Homo sapiens
tattcagaataaagactacatt

SEQ ID NO: 7590583 - DNA, 22 bp, Homo sapiens
tattcagaaaataaattggatt

SEQ ID NO: 7590584 - DNA, 17 bp, Homo sapiens
tattcagaggagtattt

SEQ ID NO: 7590585 - DNA, 22 bp, Homo sapiens
tattcagagggttgaattttta

SEQ ID NO: 7590586 - DNA, 22 bp, Homo sapiens
tattcagagggttgaattttta

SEQ ID NO: 7590587 - DNA, 17 bp, Homo sapiens
tattcagaggagtattt

SEQ ID NO: 7590588 - DNA, 17 bp, Homo sapiens
tattcagaggagtattt

SEQ ID NO: 7590589 - DNA, 22 bp, Homo sapiens
tattcagaggtgaagtagggag

SEQ ID NO: 7590590 - DNA, 22 bp, Homo sapiens
tattcagagggttgaattttta

SEQ ID NO: 7590591 - DNA, 22 bp, Homo sapiens
tattcagagggttgaattttta

SEQ ID NO: 7590592 - DNA, 22 bp, Homo sapiens
tattcagaggtgaagtagggag

SEQ ID NO: 7590593 - DNA, 22 bp, Homo sapiens
tattcagaaaactgagcgatga

SEQ ID NO: 7590594 - DNA, 22 bp, Homo sapiens
tattcagaggtgaagtagggag

SEQ ID NO: 7590595 - DNA, 22 bp, Homo sapiens
tattcagagtattccatgaggt

SEQ ID NO: 7590596 - DNA, 22 bp, Homo sapiens
tattcagagtattccatgaggt

SEQ ID NO: 7590597 - DNA, 22 bp, Homo sapiens
tattcagagtgtagcaaataga

SEQ ID NO: 7590598 - DNA, 22 bp, Homo sapiens
tattcagagtgtagcaaataga

SEQ ID NO: 7590599 - DNA, 22 bp, Homo sapiens
tattcagagtgtagcaaataga

SEQ ID NO: 7590600 - DNA, 22 bp, Homo sapiens
tattcagagtattccatgaggt

SEQ ID NO: 7590601 - DNA, 22 bp, Homo sapiens
tattcagattacttgtgcctgc

SEQ ID NO: 7590602 - DNA, 22 bp, Homo sapiens
tattcagattacttgtgcctgc

SEQ ID NO: 7590603 - DNA, 19 bp, Homo sapiens
tattcaggatgatggcaca

SEQ ID NO: 7590604 - DNA, 22 bp, Homo sapiens
tattcatagtaaacaaaagtgg

SEQ ID NO: 7590605 - DNA, 22 bp, Homo sapiens
tattcagtggaaaatgtgttga

SEQ ID NO: 7590606 - DNA, 22 bp, Homo sapiens
tattcatagtaaacaaaagtgg

SEQ ID NO: 7590607 - DNA, 22 bp, Homo sapiens
tattcatagtaaacaaaagtgg

SEQ ID NO: 7590608 - DNA, 22 bp, Homo sapiens
tattcagtgacagggtattatg

SEQ ID NO: 7590609 - DNA, 22 bp, Homo sapiens
tattcagtgcgggaactcagcc

SEQ ID NO: 7590610 - DNA, 22 bp, Homo sapiens
tattcagtgcgggaactcagcc

SEQ ID NO: 7590611 - DNA, 22 bp, Homo sapiens
tattcagtgacagggtattatg

SEQ ID NO: 7590612 - DNA, 22 bp, Homo sapiens
tattcagtgacagggtattatg

SEQ ID NO: 7590613 - DNA, 21 bp, Homo sapiens
tattcagtccattgatgttta

SEQ ID NO: 7590614 - DNA, 21 bp, Homo sapiens
tattcagtccattgatgttta

SEQ ID NO: 7590615 - DNA, 22 bp, Homo sapiens
tattcaagattgaactggcaga

SEQ ID NO: 7590616 - DNA, 20 bp, Homo sapiens
tattcaactttaaaaactta

SEQ ID NO: 7590617 - DNA, 20 bp, Homo sapiens
tattcaactttaaaaactta

SEQ ID NO: 7590618 - DNA, 22 bp, Homo sapiens
tattcaagattgaactggcaga

SEQ ID NO: 7590619 - DNA, 22 bp, Homo sapiens
tattcaagattgaactggcaga

SEQ ID NO: 7590620 - DNA, 22 bp, Homo sapiens
tattcaaagtgcgaggtcaggg

SEQ ID NO: 7590621 - DNA, 22 bp, Homo sapiens
tattcaaagtgcgaggtcaggg

SEQ ID NO: 7590622 - DNA, 22 bp, Homo sapiens
tattcaaagtgcgaggtcaggg

SEQ ID NO: 7590623 - DNA, 22 bp, Homo sapiens
tattcaaagtgcgaggtcaggg

SEQ ID NO: 7590624 - DNA, 22 bp, Homo sapiens
tatgtttatactttgatgtact

SEQ ID NO: 7590625 - DNA, 22 bp, Homo sapiens
tatgtttatactttgatgtact

SEQ ID NO: 7590626 - DNA, 22 bp, Homo sapiens
tatgtttatactttgatgtact

SEQ ID NO: 7590627 - DNA, 22 bp, Homo sapiens
tatgtttatactttgatgtact

SEQ ID NO: 7590628 - DNA, 22 bp, Homo sapiens
tatgtttatactttgatgtact

SEQ ID NO: 7590629 - DNA, 22 bp, Homo sapiens
tatgtttatactttgatgtact

SEQ ID NO: 7590630 - DNA, 22 bp, Homo sapiens
tatgtttagtatccattttcag

SEQ ID NO: 7590631 - DNA, 22 bp, Homo sapiens
tattcacaaaatgaggtcctca

SEQ ID NO: 7590632 - DNA, 22 bp, Homo sapiens
tattcacaaaatgaggtcctca

SEQ ID NO: 7590633 - DNA, 22 bp, Homo sapiens
tattcacaaaatgaggtcctca

SEQ ID NO: 7590634 - DNA, 22 bp, Homo sapiens
tattcacaaaatgaggtcctca

SEQ ID NO: 7590635 - DNA, 22 bp, Homo sapiens
tattcacagctgccgcactcag

SEQ ID NO: 7590636 - DNA, 22 bp, Homo sapiens
tattcacagctgccgcactcag

SEQ ID NO: 7590637 - DNA, 22 bp, Homo sapiens
tattcacagctgccgcactcag

SEQ ID NO: 7590638 - DNA, 22 bp, Homo sapiens
tattcacagctgccgcactcag

SEQ ID NO: 7590639 - DNA, 22 bp, Homo sapiens
tattcacaggcacgaaatattg

SEQ ID NO: 7590640 - DNA, 22 bp, Homo sapiens
tattcacaggcacgaaatattg

SEQ ID NO: 7590641 - DNA, 22 bp, Homo sapiens
tattcacaggcacgaaatattg

SEQ ID NO: 7590642 - DNA, 22 bp, Homo sapiens
tattcacaggcacgaaatattg

SEQ ID NO: 7590643 - DNA, 22 bp, Homo sapiens
tattcacaggcacgaaatattg

SEQ ID NO: 7590644 - DNA, 22 bp, Homo sapiens
tattcacaggcacgaaatattg

SEQ ID NO: 7590645 - DNA, 22 bp, Homo sapiens
tattcacaggctggagtgatgt

SEQ ID NO: 7590646 - DNA, 22 bp, Homo sapiens
tattcacatgtacatatgctca

SEQ ID NO: 7590647 - DNA, 22 bp, Homo sapiens
tattcacatgtacatatgctca

SEQ ID NO: 7590648 - DNA, 22 bp, Homo sapiens
tattcacattaataagtcttca

SEQ ID NO: 7590649 - DNA, 22 bp, Homo sapiens
tattcacatgtacatatgctca

SEQ ID NO: 7590650 - DNA, 22 bp, Homo sapiens
tattcacattaataagtcttca

SEQ ID NO: 7590651 - DNA, 22 bp, Homo sapiens
tattcacatgtacatatgctca

SEQ ID NO: 7590652 - DNA, 22 bp, Homo sapiens
tattcacatgtacatatgctca

SEQ ID NO: 7590653 - DNA, 22 bp, Homo sapiens
tattcacatgtacatatgctca

SEQ ID NO: 7590654 - DNA, 22 bp, Homo sapiens
tattcacatgtacatatgctca

SEQ ID NO: 7590655 - DNA, 22 bp, Homo sapiens
tattcacatgtacatatgctca

SEQ ID NO: 7590656 - DNA, 22 bp, Homo sapiens
tattcacatgaaaacaaatttt

SEQ ID NO: 7590657 - DNA, 22 bp, Homo sapiens
tattcacatgaaaacaaatttt

SEQ ID NO: 7590658 - DNA, 22 bp, Homo sapiens
tattcacatgaaaacaaatttt

SEQ ID NO: 7590659 - DNA, 22 bp, Homo sapiens
tattcacatgaaaacaaatttt

SEQ ID NO: 7590660 - DNA, 22 bp, Homo sapiens
tattcacagttgatttacagtt

SEQ ID NO: 7590661 - DNA, 22 bp, Homo sapiens
tattcacagttgatttacagtt

SEQ ID NO: 7590662 - DNA, 22 bp, Homo sapiens
tattcacatgaaaacaaatttt

SEQ ID NO: 7590663 - DNA, 22 bp, Homo sapiens
tattcacatgaaaacaaatttt

SEQ ID NO: 7590664 - DNA, 22 bp, Homo sapiens
tattcacagttgatttacagtt

SEQ ID NO: 7590665 - DNA, 22 bp, Homo sapiens
tattcacagttgatttacagtt

SEQ ID NO: 7590666 - DNA, 22 bp, Homo sapiens
tattcacagttgatttacagtt

SEQ ID NO: 7590667 - DNA, 22 bp, Homo sapiens
tattcacagttgatttacagtt

SEQ ID NO: 7590668 - DNA, 22 bp, Homo sapiens
tattcacagttgatttacagtt

SEQ ID NO: 7590669 - DNA, 22 bp, Homo sapiens
tattcacaggttctggggatca

SEQ ID NO: 7590670 - DNA, 22 bp, Homo sapiens
tattcacaggttctggggatca

SEQ ID NO: 7590671 - DNA, 22 bp, Homo sapiens
tattcacaggttccggagatta

SEQ ID NO: 7590672 - DNA, 22 bp, Homo sapiens
tattcacaggttctggggatca

SEQ ID NO: 7590673 - DNA, 22 bp, Homo sapiens
tattcacaggttctggggatca

SEQ ID NO: 7590674 - DNA, 22 bp, Homo sapiens
tattcacaggttctggggatca

SEQ ID NO: 7590675 - DNA, 22 bp, Homo sapiens
tattcacaggttccggagatta

SEQ ID NO: 7590676 - DNA, 22 bp, Homo sapiens
tattcacaggctggagtgatgt

SEQ ID NO: 7590677 - DNA, 22 bp, Homo sapiens
tattcacaggctggagtgatgt

SEQ ID NO: 7590678 - DNA, 22 bp, Homo sapiens
tattcacaggctggagtgatgt

SEQ ID NO: 7590679 - DNA, 22 bp, Homo sapiens
tatgttctgactctacatggga

SEQ ID NO: 7590680 - DNA, 22 bp, Homo sapiens
tatgttctgactctacatggga

SEQ ID NO: 7590681 - DNA, 22 bp, Homo sapiens
tatgttctctgctctaggatgt

SEQ ID NO: 7590682 - DNA, 22 bp, Homo sapiens
tatgttctctgctctaggatgt

SEQ ID NO: 7590683 - DNA, 22 bp, Homo sapiens
tatgttctgactctacatggga

SEQ ID NO: 7590684 - DNA, 22 bp, Homo sapiens
tatgttctgtctgtacagattt

SEQ ID NO: 7590685 - DNA, 22 bp, Homo sapiens
tatgttctgtctgtacagattt

SEQ ID NO: 7590686 - DNA, 22 bp, Homo sapiens
tatgttctgtctgtacagattt

SEQ ID NO: 7590687 - DNA, 22 bp, Homo sapiens
tatgttgcaccaacctaataat

SEQ ID NO: 7590688 - DNA, 22 bp, Homo sapiens
tatgttgcaccaacctaataat

SEQ ID NO: 7590689 - DNA, 22 bp, Homo sapiens
tatgttgcaccaacctaataat

SEQ ID NO: 7590690 - DNA, 22 bp, Homo sapiens
tatgttgagtgaaagaagctag

SEQ ID NO: 7590691 - DNA, 22 bp, Homo sapiens
tatgttgatcataggtaaaaga

SEQ ID NO: 7590692 - DNA, 22 bp, Homo sapiens
tatgttgaatagatgaatggca

SEQ ID NO: 7590693 - DNA, 22 bp, Homo sapiens
tatgttgagcattcagtgatct

SEQ ID NO: 7590694 - DNA, 22 bp, Homo sapiens
tatgtttaaatgtatgtgtatg

SEQ ID NO: 7590695 - DNA, 22 bp, Homo sapiens
tatgtttaaatgtatgtgtatg

SEQ ID NO: 7590696 - DNA, 22 bp, Homo sapiens
tatgtttaaatgtatgtgtatg

SEQ ID NO: 7590697 - DNA, 22 bp, Homo sapiens
tatgtttaaatgtatgtgtatg

SEQ ID NO: 7590698 - DNA, 22 bp, Homo sapiens
tatgtttaaatgtatgtgtatg

SEQ ID NO: 7590699 - DNA, 22 bp, Homo sapiens
tatgtttaaatgtatgtgtatg

SEQ ID NO: 7590700 - DNA, 22 bp, Homo sapiens
tatgtttacgctggtagaatta

SEQ ID NO: 7590701 - DNA, 22 bp, Homo sapiens
tatgtttacgctggtagaatta

SEQ ID NO: 7590702 - DNA, 22 bp, Homo sapiens
tatgtttacgctggtagaatta

SEQ ID NO: 7590703 - DNA, 22 bp, Homo sapiens
tatgtttacgctggtagaatta

SEQ ID NO: 7590704 - DNA, 22 bp, Homo sapiens
tatgtttagtatccattttcag

SEQ ID NO: 7590705 - DNA, 22 bp, Homo sapiens
tatgtttagtatccattttcag

SEQ ID NO: 7590706 - DNA, 22 bp, Homo sapiens
tatgtttagtatccattttcag

SEQ ID NO: 7590707 - DNA, 22 bp, Homo sapiens
tatgtttagtatccattttcag

SEQ ID NO: 7590708 - DNA, 22 bp, Homo sapiens
tatgtttagtatccattttcag

SEQ ID NO: 7590709 - DNA, 22 bp, Homo sapiens
tatgtttacgctggtagaatta

SEQ ID NO: 7590710 - DNA, 22 bp, Homo sapiens
tatgtttacgctggtagaatta

SEQ ID NO: 7590711 - DNA, 22 bp, Homo sapiens
tatgttaagtgggataatcaaa

SEQ ID NO: 7590712 - DNA, 22 bp, Homo sapiens
tatgttaagtgggataatcaaa

SEQ ID NO: 7590713 - DNA, 22 bp, Homo sapiens
tatgttaagtgggataatcaaa

SEQ ID NO: 7590714 - DNA, 22 bp, Homo sapiens
tatgttaagtgggataatcaaa

SEQ ID NO: 7590715 - DNA, 22 bp, Homo sapiens
tatgttaagtgggataatcaaa

SEQ ID NO: 7590716 - DNA, 22 bp, Homo sapiens
tatgttaagtgggataatcaaa

SEQ ID NO: 7590717 - DNA, 22 bp, Homo sapiens
tatgttaagtgggataatcaaa

SEQ ID NO: 7590718 - DNA, 22 bp, Homo sapiens
tatgttacaaagtttttctaaa

SEQ ID NO: 7590719 - DNA, 22 bp, Homo sapiens
tatgttacaaagtttttctaaa

SEQ ID NO: 7590720 - DNA, 22 bp, Homo sapiens
tatgttacaaagtttttctaaa

SEQ ID NO: 7590721 - DNA, 22 bp, Homo sapiens
tatgttacaaagtttttctaaa

SEQ ID NO: 7590722 - DNA, 22 bp, Homo sapiens
tatgttactcacatgttcttgc

SEQ ID NO: 7590723 - DNA, 22 bp, Homo sapiens
tatgttatattttgtcaattgt

SEQ ID NO: 7590724 - DNA, 22 bp, Homo sapiens
tatgttacttctgtatctgctt

SEQ ID NO: 7590725 - DNA, 22 bp, Homo sapiens
tatgttacttctgtatctgctt

SEQ ID NO: 7590726 - DNA, 22 bp, Homo sapiens
tatgttactcacatgttcttgc

SEQ ID NO: 7590727 - DNA, 22 bp, Homo sapiens
tatgttactcacatgttcttgc

SEQ ID NO: 7590728 - DNA, 19 bp, Homo sapiens
tatgttatgttgtttactc

SEQ ID NO: 7590729 - DNA, 19 bp, Homo sapiens
tatgttatgttgtttactc

SEQ ID NO: 7590730 - DNA, 22 bp, Homo sapiens
tatgttattttcatacaacaga

SEQ ID NO: 7590731 - DNA, 22 bp, Homo sapiens
tatgttattttcatacaacaga

SEQ ID NO: 7590732 - DNA, 22 bp, Homo sapiens
tatgttattttcatacaacaga

SEQ ID NO: 7590733 - DNA, 22 bp, Homo sapiens
tatgttattttcatacaacaga

SEQ ID NO: 7590734 - DNA, 22 bp, Homo sapiens
tatgttcatctggtgcatcagt

SEQ ID NO: 7590735 - DNA, 22 bp, Homo sapiens
tatgttcagaagaagaatgggg

SEQ ID NO: 7590736 - DNA, 22 bp, Homo sapiens
tatgttcatagaaatcatgacc

SEQ ID NO: 7590737 - DNA, 22 bp, Homo sapiens
tatgttcatagaaatcatgacc

SEQ ID NO: 7590738 - DNA, 22 bp, Homo sapiens
tatgttcatagaaatcatgacc

SEQ ID NO: 7590739 - DNA, 22 bp, Homo sapiens
tatgttcatagaaatcatgacc

SEQ ID NO: 7590740 - DNA, 22 bp, Homo sapiens
tatgttcagaagaagaatgggg

SEQ ID NO: 7590741 - DNA, 22 bp, Homo sapiens
tatgttcagaagaagaatgggg

SEQ ID NO: 7590742 - DNA, 22 bp, Homo sapiens
tatgttctaggaatggttgatg

SEQ ID NO: 7590743 - DNA, 22 bp, Homo sapiens
tatgttctagacttttgctgtg

SEQ ID NO: 7590744 - DNA, 22 bp, Homo sapiens
tatgttctaaccttgtctttcc

SEQ ID NO: 7590745 - DNA, 22 bp, Homo sapiens
tatgttcatgtcaaacaaatgc

SEQ ID NO: 7590746 - DNA, 22 bp, Homo sapiens
tatgttcatctggtgcatcagt

SEQ ID NO: 7590747 - DNA, 22 bp, Homo sapiens
tatgttcatctggtgcatcagt

SEQ ID NO: 7590748 - DNA, 22 bp, Homo sapiens
tatgttcatgcttatgcagaat

SEQ ID NO: 7590749 - DNA, 22 bp, Homo sapiens
tatgccagcacttagatgagat

SEQ ID NO: 7590750 - DNA, 22 bp, Homo sapiens
tatgccactgctctccatccta

SEQ ID NO: 7590751 - DNA, 22 bp, Homo sapiens
tatgccagactgtgagcttctt

SEQ ID NO: 7590752 - DNA, 22 bp, Homo sapiens
tatgccactgctctccatccta

SEQ ID NO: 7590753 - DNA, 22 bp, Homo sapiens
tatgccagactgtgagcttctt

SEQ ID NO: 7590754 - DNA, 22 bp, Homo sapiens
tatgcccttcttggtggctcag

SEQ ID NO: 7590755 - DNA, 22 bp, Homo sapiens
tatgcccttcttggtggctcag

SEQ ID NO: 7590756 - DNA, 22 bp, Homo sapiens
tatgcccttacaatgagcacaa

SEQ ID NO: 7590757 - DNA, 22 bp, Homo sapiens
tatgcccagcttaaagtacaca

SEQ ID NO: 7590758 - DNA, 22 bp, Homo sapiens
tatgccagggactgtttcacca

SEQ ID NO: 7590759 - DNA, 22 bp, Homo sapiens
tatgcctggaacctttctcttt

SEQ ID NO: 7590760 - DNA, 22 bp, Homo sapiens
tatgcctggggtgctcaggcca

SEQ ID NO: 7590761 - DNA, 22 bp, Homo sapiens
tatgccgcagccggatttcccc

SEQ ID NO: 7590762 - DNA, 22 bp, Homo sapiens
tatgcctacctccaaaatatat

SEQ ID NO: 7590763 - DNA, 22 bp, Homo sapiens
tatgcctatatgtgtgtttata

SEQ ID NO: 7590764 - DNA, 22 bp, Homo sapiens
tatgctacatcctgggggatgt

SEQ ID NO: 7590765 - DNA, 22 bp, Homo sapiens
tatgctaaatatgttcacattg

SEQ ID NO: 7590766 - DNA, 22 bp, Homo sapiens
tatgcgtatatgtatgtgcagt

SEQ ID NO: 7590767 - DNA, 22 bp, Homo sapiens
tatgcgtgcctctgtctgtctg

SEQ ID NO: 7590768 - DNA, 22 bp, Homo sapiens
tatgctgaatttggtttgctat

SEQ ID NO: 7590769 - DNA, 22 bp, Homo sapiens
tatgctgagtatataaaacaga

SEQ ID NO: 7590770 - DNA, 22 bp, Homo sapiens
tatgctactagaaataaaatgg

SEQ ID NO: 7590771 - DNA, 22 bp, Homo sapiens
tatgctctgagacctttgtgca

SEQ ID NO: 7590772 - DNA, 22 bp, Homo sapiens
tatgctattcttcagagtgttc

SEQ ID NO: 7590773 - DNA, 22 bp, Homo sapiens
tatgctattttaatgaagatgt

SEQ ID NO: 7590774 - DNA, 22 bp, Homo sapiens
tatgctccaaagacatgttgcc

SEQ ID NO: 7590775 - DNA, 22 bp, Homo sapiens
tatgctttaacattaaacaaca

SEQ ID NO: 7590776 - DNA, 22 bp, Homo sapiens
tatgctgtggaaaatacaaaga

SEQ ID NO: 7590777 - DNA, 22 bp, Homo sapiens
tatgctgtattctgtatgttag

SEQ ID NO: 7590778 - DNA, 22 bp, Homo sapiens
tatgctgtgctagatacaatat

SEQ ID NO: 7590779 - DNA, 22 bp, Homo sapiens
tatgctttaacattaaacaaca

SEQ ID NO: 7590780 - DNA, 22 bp, Homo sapiens
tatgctttaacattaaacaaca

SEQ ID NO: 7590781 - DNA, 22 bp, Homo sapiens
tatgctttaacattaaacaaca

SEQ ID NO: 7590782 - DNA, 22 bp, Homo sapiens
tatgctttaacattaaacaaca

SEQ ID NO: 7590783 - DNA, 19 bp, Homo sapiens
tatgtgtgtgtatttacat

SEQ ID NO: 7590784 - DNA, 16 bp, Homo sapiens
tatgtgtgtgggagtg

SEQ ID NO: 7590785 - DNA, 17 bp, Homo sapiens
tatgtgtgtgtttatac

SEQ ID NO: 7590786 - DNA, 17 bp, Homo sapiens
tatgtgtgtgtttatac

SEQ ID NO: 7590787 - DNA, 22 bp, Homo sapiens
tatgtgtgtttcagtggaaatg

SEQ ID NO: 7590788 - DNA, 17 bp, Homo sapiens
tatgtgtgtgtttatac

SEQ ID NO: 7590789 - DNA, 17 bp, Homo sapiens
tatgtgtgtttgcagca

SEQ ID NO: 7590790 - DNA, 22 bp, Homo sapiens
tatgtgttgtatatgtgcagag

SEQ ID NO: 7590791 - DNA, 22 bp, Homo sapiens
tatgtgttgaatttgaacgtta

SEQ ID NO: 7590792 - DNA, 22 bp, Homo sapiens
tatgtgtttgacaccctgcaag

SEQ ID NO: 7590793 - DNA, 22 bp, Homo sapiens
tatgtgttgaatttgaacgtta

SEQ ID NO: 7590794 - DNA, 22 bp, Homo sapiens
tatgtgttatttggtatacatt

SEQ ID NO: 7590795 - DNA, 22 bp, Homo sapiens
tatgttaaatgtttgatgttta

SEQ ID NO: 7590796 - DNA, 22 bp, Homo sapiens
tatgttaaatgtttgatgttta

SEQ ID NO: 7590797 - DNA, 22 bp, Homo sapiens
tatgttaaatgtttgatgttta

SEQ ID NO: 7590798 - DNA, 22 bp, Homo sapiens
tatgttaacatgttaggaactg

SEQ ID NO: 7590799 - DNA, 22 bp, Homo sapiens
tatgttaagtgggataatcaaa

SEQ ID NO: 7590800 - DNA, 22 bp, Homo sapiens
tatgttaagtgggataatcaaa

SEQ ID NO: 7590801 - DNA, 22 bp, Homo sapiens
tatgttaagtgggataatcaaa

SEQ ID NO: 7590802 - DNA, 22 bp, Homo sapiens
tatgtgtttcctgtggctgcca

SEQ ID NO: 7590803 - DNA, 22 bp, Homo sapiens
tatgtgtttgacaccctgcaag

SEQ ID NO: 7590804 - DNA, 22 bp, Homo sapiens
tatgtgtttgacaccctgcaag

SEQ ID NO: 7590805 - DNA, 22 bp, Homo sapiens
tatgtgtttgacaccctgcaag

SEQ ID NO: 7590806 - DNA, 22 bp, Homo sapiens
tatgtgtttgacaccctgcaag

SEQ ID NO: 7590807 - DNA, 22 bp, Homo sapiens
gtagcaaagggacggctctaga

SEQ ID NO: 7590808 - DNA, 18 bp, Homo sapiens
gtagcaaaggagttactt

SEQ ID NO: 7590809 - DNA, 18 bp, Homo sapiens
gtagcaaaggagttactt

SEQ ID NO: 7590810 - DNA, 18 bp, Homo sapiens
gtagcaaaggagttactt

SEQ ID NO: 7590811 - DNA, 17 bp, Homo sapiens
gtagcaaaccttttagg

SEQ ID NO: 7590812 - DNA, 21 bp, Homo sapiens
gtagatttggcccaaagccat

SEQ ID NO: 7590813 - DNA, 22 bp, Homo sapiens
gtagattcttggaattcaagtc

SEQ ID NO: 7590814 - DNA, 22 bp, Homo sapiens
gtagattccagtggtctgtgtc

SEQ ID NO: 7590815 - DNA, 22 bp, Homo sapiens
gtagcaatgttgaacactgcgt

SEQ ID NO: 7590816 - DNA, 22 bp, Homo sapiens
gtagcacatgattttgatatgt

SEQ ID NO: 7590817 - DNA, 22 bp, Homo sapiens
gtagcaccagtgctcttctcaa

SEQ ID NO: 7590818 - DNA, 22 bp, Homo sapiens
gtagcacccactacttttcgct

SEQ ID NO: 7590819 - DNA, 22 bp, Homo sapiens
gtagcaccgcgagacttggggc

SEQ ID NO: 7590820 - DNA, 22 bp, Homo sapiens
gtagcagagctgagagtggaac

SEQ ID NO: 7590821 - DNA, 22 bp, Homo sapiens
gtagcagagctgagagtggaac

SEQ ID NO: 7590822 - DNA, 22 bp, Homo sapiens
gtagcagaatcagtgctacaga

SEQ ID NO: 7590823 - DNA, 22 bp, Homo sapiens
gtagcagagggcccaggtaact

SEQ ID NO: 7590824 - DNA, 22 bp, Homo sapiens
gtagcagcagagcaggtcctcc

SEQ ID NO: 7590825 - DNA, 22 bp, Homo sapiens
gtagcagctctgagcatgctgc

SEQ ID NO: 7590826 - DNA, 22 bp, Homo sapiens
gtagcagctctccagggttcac

SEQ ID NO: 7590827 - DNA, 22 bp, Homo sapiens
gtagcagctctgagcatgctgc

SEQ ID NO: 7590828 - DNA, 22 bp, Homo sapiens
gtagcagcagagcaggtcctcc

SEQ ID NO: 7590829 - DNA, 22 bp, Homo sapiens
gtagcagctctccagggttcac

SEQ ID NO: 7590830 - DNA, 22 bp, Homo sapiens
gtagccagatctgctgtgtctg

SEQ ID NO: 7590831 - DNA, 22 bp, Homo sapiens
gtagccagatctgctgtgtctg

SEQ ID NO: 7590832 - DNA, 22 bp, Homo sapiens
gtagcaggtattctggtgtgag

SEQ ID NO: 7590833 - DNA, 22 bp, Homo sapiens
gtagcaggtattctggtgtgag

SEQ ID NO: 7590834 - DNA, 22 bp, Homo sapiens
gtagcagcttcagcccaaatta

SEQ ID NO: 7590835 - DNA, 22 bp, Homo sapiens
gtagcagctctgagcatgctgc

SEQ ID NO: 7590836 - DNA, 22 bp, Homo sapiens
gtagcagcttcagcccaaatta

SEQ ID NO: 7590837 - DNA, 22 bp, Homo sapiens
gtagcccacctggggagggcga

SEQ ID NO: 7590838 - DNA, 22 bp, Homo sapiens
gtagcccacctggggagggcga

SEQ ID NO: 7590839 - DNA, 22 bp, Homo sapiens
gtagcccacctggggagggcga

SEQ ID NO: 7590840 - DNA, 22 bp, Homo sapiens
gtagcccacctggggagggcga

SEQ ID NO: 7590841 - DNA, 22 bp, Homo sapiens
gtagctagtagttcagagaaca

SEQ ID NO: 7590842 - DNA, 22 bp, Homo sapiens
gtagatatggctcaaaggcatg

SEQ ID NO: 7590843 - DNA, 22 bp, Homo sapiens
gtagatgagctcacatgacctt

SEQ ID NO: 7590844 - DNA, 22 bp, Homo sapiens
gtagatcatgagaatgtttttg

SEQ ID NO: 7590845 - DNA, 22 bp, Homo sapiens
gtagatcatgagaatgtttttg

SEQ ID NO: 7590846 - DNA, 22 bp, Homo sapiens
gtagatgagctcacatgacctt

SEQ ID NO: 7590847 - DNA, 22 bp, Homo sapiens
gtagatgagctcacatgacctt

SEQ ID NO: 7590848 - DNA, 22 bp, Homo sapiens
gtagatgtcttcaaactgattt

SEQ ID NO: 7590849 - DNA, 22 bp, Homo sapiens
gtagatgtcttcaaactgattt

SEQ ID NO: 7590850 - DNA, 22 bp, Homo sapiens
gtagatggaggggctgcagggc

SEQ ID NO: 7590851 - DNA, 22 bp, Homo sapiens
gtagataaggattgatttttat

SEQ ID NO: 7590852 - DNA, 22 bp, Homo sapiens
gtagatattaaaaatggcagtg

SEQ ID NO: 7590853 - DNA, 21 bp, Homo sapiens
gtagataaagcattttcatta

SEQ ID NO: 7590854 - DNA, 21 bp, Homo sapiens
gtagataaagcattttcatta

SEQ ID NO: 7590855 - DNA, 22 bp, Homo sapiens
gtagaggtagacttccttgtct

SEQ ID NO: 7590856 - DNA, 22 bp, Homo sapiens
gtagataaggattgatttttat

SEQ ID NO: 7590857 - DNA, 22 bp, Homo sapiens
gtagaggtagacttccttgtct

SEQ ID NO: 7590858 - DNA, 22 bp, Homo sapiens
gtagagtttaatgaaaaatctg

SEQ ID NO: 7590859 - DNA, 22 bp, Homo sapiens
gtagaggggtgattctgtgaga

SEQ ID NO: 7590860 - DNA, 22 bp, Homo sapiens
gtagaggctcagagagccgcag

SEQ ID NO: 7590861 - DNA, 22 bp, Homo sapiens
gtagaggacatttgacatgatg

SEQ ID NO: 7590862 - DNA, 22 bp, Homo sapiens
gtagaggacatttgacatgatg

SEQ ID NO: 7590863 - DNA, 22 bp, Homo sapiens
gtagaggacatttgacatgatg

SEQ ID NO: 7590864 - DNA, 22 bp, Homo sapiens
gtagaggacatttgacatgatg

SEQ ID NO: 7590865 - DNA, 22 bp, Homo sapiens
gtagaggacatttgacatgatg

SEQ ID NO: 7590866 - DNA, 22 bp, Homo sapiens
gtagaggacatttgacatgatg

SEQ ID NO: 7590867 - DNA, 22 bp, Homo sapiens
gtagaggacatttgacatgatg

SEQ ID NO: 7590868 - DNA, 22 bp, Homo sapiens
gtagagcaggacttgagatgtt

SEQ ID NO: 7590869 - DNA, 22 bp, Homo sapiens
gtagagcaggacttgagatgtt

SEQ ID NO: 7590870 - DNA, 22 bp, Homo sapiens
gtagaccatttatctggggagt

SEQ ID NO: 7590871 - DNA, 22 bp, Homo sapiens
gtagaccatttatctggggagt

SEQ ID NO: 7590872 - DNA, 22 bp, Homo sapiens
gtagaccatttatctggggagt

SEQ ID NO: 7590873 - DNA, 22 bp, Homo sapiens
gtagaccatttatctggggagt

SEQ ID NO: 7590874 - DNA, 22 bp, Homo sapiens
gtagaccatttatctggggagt

SEQ ID NO: 7590875 - DNA, 22 bp, Homo sapiens
gtagacagtttgggccgaaatt

SEQ ID NO: 7590876 - DNA, 22 bp, Homo sapiens
gtagacagtttgggccgaaatt

SEQ ID NO: 7590877 - DNA, 22 bp, Homo sapiens
gtagacatctagatttatgtgt

SEQ ID NO: 7590878 - DNA, 22 bp, Homo sapiens
gtagacatctagatttatgtgt

SEQ ID NO: 7590879 - DNA, 22 bp, Homo sapiens
gtaatgatgtctgagaagtatg

SEQ ID NO: 7590880 - DNA, 22 bp, Homo sapiens
gtagctgatattagcaatgagt

SEQ ID NO: 7590881 - DNA, 22 bp, Homo sapiens
gtagctctgtttaaagttcttt

SEQ ID NO: 7590882 - DNA, 22 bp, Homo sapiens
gtagctctgtttaaagttcttt

SEQ ID NO: 7590883 - DNA, 22 bp, Homo sapiens
gtagcggttatgtctgcaggga

SEQ ID NO: 7590884 - DNA, 22 bp, Homo sapiens
gtagctatttatgatactcatg

SEQ ID NO: 7590885 - DNA, 22 bp, Homo sapiens
gtagctatttatgatactcatg

SEQ ID NO: 7590886 - DNA, 22 bp, Homo sapiens
gtagctatttatgatactcatg

SEQ ID NO: 7590887 - DNA, 22 bp, Homo sapiens
gtagctgcctttctggcccagg

SEQ ID NO: 7590888 - DNA, 22 bp, Homo sapiens
gtagcttattagggataatagt

SEQ ID NO: 7590889 - DNA, 22 bp, Homo sapiens
gtagcttattagggataatagt

SEQ ID NO: 7590890 - DNA, 22 bp, Homo sapiens
gtagcttcaagtactctccctg

SEQ ID NO: 7590891 - DNA, 22 bp, Homo sapiens
gtagctgcatattttcttagaa

SEQ ID NO: 7590892 - DNA, 22 bp, Homo sapiens
gtagctgcctttctggcccagg

SEQ ID NO: 7590893 - DNA, 22 bp, Homo sapiens
gtagctgatcctgaggacaggg

SEQ ID NO: 7590894 - DNA, 22 bp, Homo sapiens
gtagctgatcctgaggacaggg

SEQ ID NO: 7590895 - DNA, 22 bp, Homo sapiens
gtaggaaagtaaatgaaataca

SEQ ID NO: 7590896 - DNA, 22 bp, Homo sapiens
gtaggaaagggagtgaagggaa

SEQ ID NO: 7590897 - DNA, 22 bp, Homo sapiens
gtaggaaagggagtgaagggaa

SEQ ID NO: 7590898 - DNA, 22 bp, Homo sapiens
gtaggaaagggagtgaagggaa

SEQ ID NO: 7590899 - DNA, 22 bp, Homo sapiens
gtaggaaagggagtgaagggaa

SEQ ID NO: 7590900 - DNA, 22 bp, Homo sapiens
gtagcttccagaaagtgtcttt

SEQ ID NO: 7590901 - DNA, 22 bp, Homo sapiens
gtagcttccagaaagtgtcttt

SEQ ID NO: 7590902 - DNA, 22 bp, Homo sapiens
gtagcttccagaaagtgtcttt

SEQ ID NO: 7590903 - DNA, 22 bp, Homo sapiens
gtcaacaattccagtttttact

SEQ ID NO: 7590904 - DNA, 22 bp, Homo sapiens
gtcaacaagtagttttcttcca

SEQ ID NO: 7590905 - DNA, 22 bp, Homo sapiens
gtcaacaagtagttttcttcca

SEQ ID NO: 7590906 - DNA, 22 bp, Homo sapiens
gtcaacaagtagttttcttcca

SEQ ID NO: 7590907 - DNA, 22 bp, Homo sapiens
gtcaacaagtagttttcttcca

SEQ ID NO: 7590908 - DNA, 22 bp, Homo sapiens
gtcaacaagtggttattgggat

SEQ ID NO: 7590909 - DNA, 22 bp, Homo sapiens
gtcaacaattccagtttttact

SEQ ID NO: 7590910 - DNA, 22 bp, Homo sapiens
gtcaacaattccagtttttact

SEQ ID NO: 7590911 - DNA, 22 bp, Homo sapiens
gtaggaagctctgaggctagtt

SEQ ID NO: 7590912 - DNA, 22 bp, Homo sapiens
gtaggaaagtaaatgaaataca

SEQ ID NO: 7590913 - DNA, 22 bp, Homo sapiens
gtaggaagctctgaggctagtt

SEQ ID NO: 7590914 - DNA, 22 bp, Homo sapiens
gtaggaagctctgaggctagtt

SEQ ID NO: 7590915 - DNA, 22 bp, Homo sapiens
gtaggaagctctgaggctagtt

SEQ ID NO: 7590916 - DNA, 22 bp, Homo sapiens
gtcaacaaggtttgcttatctt

SEQ ID NO: 7590917 - DNA, 22 bp, Homo sapiens
gtcaaggcatctctagagcaat

SEQ ID NO: 7590918 - DNA, 22 bp, Homo sapiens
gtcaaggcatctctagagcaat

SEQ ID NO: 7590919 - DNA, 22 bp, Homo sapiens
gtcaaggctactgagtgccctg

SEQ ID NO: 7590920 - DNA, 22 bp, Homo sapiens
gtcaagggtacagcacgcttct

SEQ ID NO: 7590921 - DNA, 22 bp, Homo sapiens
gtcaaggcactgacagcctgag

SEQ ID NO: 7590922 - DNA, 22 bp, Homo sapiens
gtcaaggcactgacagcctgag

SEQ ID NO: 7590923 - DNA, 22 bp, Homo sapiens
gtcaaggcagcagggcctgtgg

SEQ ID NO: 7590924 - DNA, 22 bp, Homo sapiens
gtcaagtacaactcagaaaggt

SEQ ID NO: 7590925 - DNA, 22 bp, Homo sapiens
gtcaagtacaactcagaaaggt

SEQ ID NO: 7590926 - DNA, 22 bp, Homo sapiens
gtcaagtcatgactcaaaggaa

SEQ ID NO: 7590927 - DNA, 20 bp, Homo sapiens
gtcaagtccctggggcagct

SEQ ID NO: 7590928 - DNA, 22 bp, Homo sapiens
gtcaagtcatgactcaaaggaa

SEQ ID NO: 7590929 - DNA, 22 bp, Homo sapiens
gtcaagtttatccgctcattca

SEQ ID NO: 7590930 - DNA, 22 bp, Homo sapiens
gtcaagttaagataaggtcatg

SEQ ID NO: 7590931 - DNA, 22 bp, Homo sapiens
gtcaataagtttgtaactggat

SEQ ID NO: 7590932 - DNA, 22 bp, Homo sapiens
gtcaataattgatagatattgg

SEQ ID NO: 7590933 - DNA, 22 bp, Homo sapiens
gtcaagttaagataaggtcatg

SEQ ID NO: 7590934 - DNA, 22 bp, Homo sapiens
gtcaagtttatccgctcattca

SEQ ID NO: 7590935 - DNA, 19 bp, Homo sapiens
gtcaataaaagttaggggt

SEQ ID NO: 7590936 - DNA, 22 bp, Homo sapiens
gtcaagtttatccgctcattca

SEQ ID NO: 7590937 - DNA, 22 bp, Homo sapiens
gtcaataattttatggagagaa

SEQ ID NO: 7590938 - DNA, 22 bp, Homo sapiens
gtcaataattttatggagagaa

SEQ ID NO: 7590939 - DNA, 22 bp, Homo sapiens
gtcaataattttatggagagaa

SEQ ID NO: 7590940 - DNA, 22 bp, Homo sapiens
gtcaataattgatagatattgg

SEQ ID NO: 7590941 - DNA, 22 bp, Homo sapiens
gtcaataattgatagatattgg

SEQ ID NO: 7590942 - DNA, 22 bp, Homo sapiens
gtcaacataggcctcagtgagg

SEQ ID NO: 7590943 - DNA, 17 bp, Homo sapiens
gtcaacaggatttcttt

SEQ ID NO: 7590944 - DNA, 22 bp, Homo sapiens
gtcaacagtattaggacatttg

SEQ ID NO: 7590945 - DNA, 21 bp, Homo sapiens
gtcaactggaagggcagggat

SEQ ID NO: 7590946 - DNA, 22 bp, Homo sapiens
gtcaacttatctctttatctgt

SEQ ID NO: 7590947 - DNA, 22 bp, Homo sapiens
gtcaacataggcctcagtgagg

SEQ ID NO: 7590948 - DNA, 22 bp, Homo sapiens
gtcaacatcggaaagcgtgtaa

SEQ ID NO: 7590949 - DNA, 22 bp, Homo sapiens
gtcaacatttactgccctggcc

SEQ ID NO: 7590950 - DNA, 22 bp, Homo sapiens
gtcaactttaagatgatctttt

SEQ ID NO: 7590951 - DNA, 22 bp, Homo sapiens
gtcaacttatctctttatctgt

SEQ ID NO: 7590952 - DNA, 22 bp, Homo sapiens
gtcaagcagaagataatttaaa

SEQ ID NO: 7590953 - DNA, 22 bp, Homo sapiens
gtcaagatgagaattcttttta

SEQ ID NO: 7590954 - DNA, 22 bp, Homo sapiens
gtaagttactcttgggctattt

SEQ ID NO: 7590955 - DNA, 22 bp, Homo sapiens
gtaagtaataagtgctcaataa

SEQ ID NO: 7590956 - DNA, 22 bp, Homo sapiens
gtaagtctgagtgtaattcaca

SEQ ID NO: 7590957 - DNA, 22 bp, Homo sapiens
gtaagttatattaaaatttcag

SEQ ID NO: 7590958 - DNA, 22 bp, Homo sapiens
gtaagttatattaaaatttcag

SEQ ID NO: 7590959 - DNA, 22 bp, Homo sapiens
gtaagttagttcctgtgttagt

SEQ ID NO: 7590960 - DNA, 22 bp, Homo sapiens
gtaagttttgtataggcatggg

SEQ ID NO: 7590961 - DNA, 22 bp, Homo sapiens
gtaagtttttccctagatgtag

SEQ ID NO: 7590962 - DNA, 22 bp, Homo sapiens
gtaaggctttgtgcttattcca

SEQ ID NO: 7590963 - DNA, 22 bp, Homo sapiens
gtaaggctttttagaagcacat

SEQ ID NO: 7590964 - DNA, 22 bp, Homo sapiens
gtaagggcctaataggacgcag

SEQ ID NO: 7590965 - DNA, 19 bp, Homo sapiens
gtaagggctaatggactat

SEQ ID NO: 7590966 - DNA, 22 bp, Homo sapiens
gtaaggctttttagaagcacat

SEQ ID NO: 7590967 - DNA, 22 bp, Homo sapiens
gtaacattattcatgagataca

SEQ ID NO: 7590968 - DNA, 17 bp, Homo sapiens
gtaaggcttgcagatgc

SEQ ID NO: 7590969 - DNA, 22 bp, Homo sapiens
gtaacattattcatgagataca

SEQ ID NO: 7590970 - DNA, 22 bp, Homo sapiens
gtaacatagtttgtgcttcatc

SEQ ID NO: 7590971 - DNA, 22 bp, Homo sapiens
gtaacattattcatgagataca

SEQ ID NO: 7590972 - DNA, 22 bp, Homo sapiens
gtaacagtttgggttccaattg

SEQ ID NO: 7590973 - DNA, 22 bp, Homo sapiens
gtaacagtttgggttccaattg

SEQ ID NO: 7590974 - DNA, 19 bp, Homo sapiens
gtaacagtggacattttag

SEQ ID NO: 7590975 - DNA, 19 bp, Homo sapiens
gtaacagtggacattttag

SEQ ID NO: 7590976 - DNA, 22 bp, Homo sapiens
gtaacactggcaccgtctcaca

SEQ ID NO: 7590977 - DNA, 22 bp, Homo sapiens
gtaacactctaaagggatgcac

SEQ ID NO: 7590978 - DNA, 22 bp, Homo sapiens
gtaacactagctctgtcacttt

SEQ ID NO: 7590979 - DNA, 22 bp, Homo sapiens
gtaacactagctctgtcacttt

SEQ ID NO: 7590980 - DNA, 22 bp, Homo sapiens
gtaacaaagtttctaggtgctg

SEQ ID NO: 7590981 - DNA, 22 bp, Homo sapiens
gtaacacagaaatgaaattcca

SEQ ID NO: 7590982 - DNA, 22 bp, Homo sapiens
gtaacaaagtttctaggtgctg

SEQ ID NO: 7590983 - DNA, 22 bp, Homo sapiens
gtaacaaagtttctaggtgctg

SEQ ID NO: 7590984 - DNA, 22 bp, Homo sapiens
gtaacaaaggataacttggttt

SEQ ID NO: 7590985 - DNA, 22 bp, Homo sapiens
gtaacacttggctgcaacctgg

SEQ ID NO: 7590986 - DNA, 22 bp, Homo sapiens
gtaacactggcaccgtctcaca

SEQ ID NO: 7590987 - DNA, 22 bp, Homo sapiens
gtaacacttggctgcaacctgg

SEQ ID NO: 7590988 - DNA, 22 bp, Homo sapiens
gtaacagaaagtcatgctcatt

SEQ ID NO: 7590989 - DNA, 22 bp, Homo sapiens
gtaacagaaagtcatgctcatt

SEQ ID NO: 7590990 - DNA, 22 bp, Homo sapiens
gtaacagaaagtcatgctcatt

SEQ ID NO: 7590991 - DNA, 19 bp, Homo sapiens
gtaacagtggacattttag

SEQ ID NO: 7590992 - DNA, 22 bp, Homo sapiens
gtaacaggcaatacaactctct

SEQ ID NO: 7590993 - DNA, 22 bp, Homo sapiens
gtaacagagggtttgcagatat

SEQ ID NO: 7590994 - DNA, 22 bp, Homo sapiens
gtaacagagaactcaggtgtta

SEQ ID NO: 7590995 - DNA, 22 bp, Homo sapiens
gtaatacttgaagaattcagag

SEQ ID NO: 7590996 - DNA, 22 bp, Homo sapiens
gtaatagtctcaaactcctgga

SEQ ID NO: 7590997 - DNA, 17 bp, Homo sapiens
gtaatataataagcctt

SEQ ID NO: 7590998 - DNA, 17 bp, Homo sapiens
gtaatataataagcctt

SEQ ID NO: 7590999 - DNA, 22 bp, Homo sapiens
gtaataatactagtcagccttg

SEQ ID NO: 7591000 - DNA, 22 bp, Homo sapiens
gtaataatactagtcagccttg

SEQ ID NO: 7591001 - DNA, 22 bp, Homo sapiens
gtaatacaagctccctgggttc

SEQ ID NO: 7591002 - DNA, 22 bp, Homo sapiens
gtaatacaagctccctgggttc

SEQ ID NO: 7591003 - DNA, 22 bp, Homo sapiens
gtaataatttgctacctggtgg

SEQ ID NO: 7591004 - DNA, 22 bp, Homo sapiens
gtaataatttgctacctggtgg

SEQ ID NO: 7591005 - DNA, 22 bp, Homo sapiens
gtaatctcagctacttgggagg

SEQ ID NO: 7591006 - DNA, 22 bp, Homo sapiens
gtaatctcagctacttgggagg

SEQ ID NO: 7591007 - DNA, 22 bp, Homo sapiens
gtaatctcagctacttgggagg

SEQ ID NO: 7591008 - DNA, 22 bp, Homo sapiens
gtaatccaaagtaacattaaac

SEQ ID NO: 7591009 - DNA, 22 bp, Homo sapiens
gtaatctcagctacttgggagg

SEQ ID NO: 7591010 - DNA, 22 bp, Homo sapiens
gtaatctcagctacttgggagg

SEQ ID NO: 7591011 - DNA, 22 bp, Homo sapiens
gtaatctcagctacttgggagg

SEQ ID NO: 7591012 - DNA, 22 bp, Homo sapiens
gtaatcgtggtggttaattcca

SEQ ID NO: 7591013 - DNA, 20 bp, Homo sapiens
gtaatgaatgtaaacagtaa

SEQ ID NO: 7591014 - DNA, 20 bp, Homo sapiens
gtaatgaatgtaaacagtaa

SEQ ID NO: 7591015 - DNA, 22 bp, Homo sapiens
gtaatgaatcaacattaatgat

SEQ ID NO: 7591016 - DNA, 22 bp, Homo sapiens
gtaatgataagcagccattcac

SEQ ID NO: 7591017 - DNA, 20 bp, Homo sapiens
gtaatgaatgtaaacagtaa

SEQ ID NO: 7591018 - DNA, 22 bp, Homo sapiens
gtaatgaatcaacattaatgat

SEQ ID NO: 7591019 - DNA, 22 bp, Homo sapiens
gtaatgaatagatggtggcagg

SEQ ID NO: 7591020 - DNA, 22 bp, Homo sapiens
gtaatctcagctacttgggagg

SEQ ID NO: 7591021 - DNA, 22 bp, Homo sapiens
gtaatctcagctacttgggagg

SEQ ID NO: 7591022 - DNA, 22 bp, Homo sapiens
gtaatctcagctacttgggagg

SEQ ID NO: 7591023 - DNA, 22 bp, Homo sapiens
gtaaattatttcaagatcatct

SEQ ID NO: 7591024 - DNA, 22 bp, Homo sapiens
gtaaattatttcaagatcatct

SEQ ID NO: 7591025 - DNA, 22 bp, Homo sapiens
gtaaattatttcaagatcatct

SEQ ID NO: 7591026 - DNA, 22 bp, Homo sapiens
gtaaattatttcaagatcatct

SEQ ID NO: 7591027 - DNA, 22 bp, Homo sapiens
gtaaattatttcaagatcatct

SEQ ID NO: 7591028 - DNA, 22 bp, Homo sapiens
gtaaattatttcaagatcatct

SEQ ID NO: 7591029 - DNA, 22 bp, Homo sapiens
gtaaattatttcaagatcatct

SEQ ID NO: 7591030 - DNA, 22 bp, Homo sapiens
gtaaattatttcaagatcatct

SEQ ID NO: 7591031 - DNA, 22 bp, Homo sapiens
gtaaatgtttgctgatgattct

SEQ ID NO: 7591032 - DNA, 22 bp, Homo sapiens
gtaacaaacggttccaagatgc

SEQ ID NO: 7591033 - DNA, 22 bp, Homo sapiens
gtaaatttcccgggccatttaa

SEQ ID NO: 7591034 - DNA, 22 bp, Homo sapiens
gtaaatttcccgggccatttaa

SEQ ID NO: 7591035 - DNA, 22 bp, Homo sapiens
gtaacaaaggataacttggttt

SEQ ID NO: 7591036 - DNA, 22 bp, Homo sapiens
gtaacaaacggttccaagatgc

SEQ ID NO: 7591037 - DNA, 22 bp, Homo sapiens
gtaacaaaggataacttggttt

SEQ ID NO: 7591038 - DNA, 22 bp, Homo sapiens
gtaacaaacggttccaagatgc

SEQ ID NO: 7591039 - DNA, 22 bp, Homo sapiens
gtaacaaaggataacttggttt

SEQ ID NO: 7591040 - DNA, 22 bp, Homo sapiens
gtaacaaaggataacttggttt

SEQ ID NO: 7591041 - DNA, 22 bp, Homo sapiens
gtaacaaaggataacttggttt

SEQ ID NO: 7591042 - DNA, 22 bp, Homo sapiens
gtaaatcatggtcagaataaat

SEQ ID NO: 7591043 - DNA, 22 bp, Homo sapiens
gtaaatcagtgtcattttagaa

SEQ ID NO: 7591044 - DNA, 22 bp, Homo sapiens
gtaaatcatggtcagaataaat

SEQ ID NO: 7591045 - DNA, 22 bp, Homo sapiens
gtaaatcataaaatttgagctc

SEQ ID NO: 7591046 - DNA, 22 bp, Homo sapiens
gtaaatcccatcctttctctgg

SEQ ID NO: 7591047 - DNA, 22 bp, Homo sapiens
gtaaatcatggtcagaataaat

SEQ ID NO: 7591048 - DNA, 22 bp, Homo sapiens
gtaaatcatggtcagaataaat

SEQ ID NO: 7591049 - DNA, 22 bp, Homo sapiens
gtaaatgccacttaatgtaaag

SEQ ID NO: 7591050 - DNA, 22 bp, Homo sapiens
gtaaatgagtcaaatgggggaa

SEQ ID NO: 7591051 - DNA, 22 bp, Homo sapiens
gtaaatgtgaatgtcatttagc

SEQ ID NO: 7591052 - DNA, 22 bp, Homo sapiens
gtaaatgtcctgctacagagtg

SEQ ID NO: 7591053 - DNA, 22 bp, Homo sapiens
gtaaatgctagccctttaaagt

SEQ ID NO: 7591054 - DNA, 22 bp, Homo sapiens
gtaaatgtgctaaaatgtgtcg

SEQ ID NO: 7591055 - DNA, 22 bp, Homo sapiens
gtaaatgtgctaaaatgtgtcg

SEQ ID NO: 7591056 - DNA, 22 bp, Homo sapiens
gtaaatgtgactccacctgagt

SEQ ID NO: 7591057 - DNA, 22 bp, Homo sapiens
gtaaatgtgcttcttttaactt

SEQ ID NO: 7591058 - DNA, 22 bp, Homo sapiens
gtaaatgttgcatttatgggta

SEQ ID NO: 7591059 - DNA, 22 bp, Homo sapiens
ggtgggcagctcttggcaggca

SEQ ID NO: 7591060 - DNA, 22 bp, Homo sapiens
ggtgggcagctcttggcaggca

SEQ ID NO: 7591061 - DNA, 22 bp, Homo sapiens
ggtgggcagctcttggcaggca

SEQ ID NO: 7591062 - DNA, 22 bp, Homo sapiens
ggtgggcagctcttggcaggca

SEQ ID NO: 7591063 - DNA, 22 bp, Homo sapiens
ggtgggcaggcgaggcccaggt

SEQ ID NO: 7591064 - DNA, 22 bp, Homo sapiens
ggtgggcaggcgaggcccaggt

SEQ ID NO: 7591065 - DNA, 22 bp, Homo sapiens
ggtgggcaggcgaggcccaggt

SEQ ID NO: 7591066 - DNA, 22 bp, Homo sapiens
gtaaatcagtgtcattttagaa

SEQ ID NO: 7591067 - DNA, 22 bp, Homo sapiens
gtaaatattccctcggttccta

SEQ ID NO: 7591068 - DNA, 22 bp, Homo sapiens
gtaaatattccctcggttccta

SEQ ID NO: 7591069 - DNA, 22 bp, Homo sapiens
gtaaatattccctcggttccta

SEQ ID NO: 7591070 - DNA, 22 bp, Homo sapiens
ggtgggcaggcgaggcccaggt

SEQ ID NO: 7591071 - DNA, 22 bp, Homo sapiens
gtaaatattccctcggttccta

SEQ ID NO: 7591072 - DNA, 22 bp, Homo sapiens
gtaaatattccctcggttccta

SEQ ID NO: 7591073 - DNA, 22 bp, Homo sapiens
ggtgggcaggcgaggcccaggt

SEQ ID NO: 7591074 - DNA, 22 bp, Homo sapiens
ggtgggcacccgagactggatc

SEQ ID NO: 7591075 - DNA, 22 bp, Homo sapiens
ggtgggcagctcttggcaggca

SEQ ID NO: 7591076 - DNA, 22 bp, Homo sapiens
ggtgggcagctcttggcaggca

SEQ ID NO: 7591077 - DNA, 22 bp, Homo sapiens
ggtgggcagctcttggcaggca

SEQ ID NO: 7591078 - DNA, 22 bp, Homo sapiens
ggtgggcagctcttggcaggca

SEQ ID NO: 7591079 - DNA, 21 bp, Homo sapiens
ggtgggcacaggagagcagag

SEQ ID NO: 7591080 - DNA, 22 bp, Homo sapiens
ggtgggcacattcagtctctgt

SEQ ID NO: 7591081 - DNA, 22 bp, Homo sapiens
ggtgggcacattcagtctctgt

SEQ ID NO: 7591082 - DNA, 22 bp, Homo sapiens
ggtgggcacccgagactggatc

SEQ ID NO: 7591083 - DNA, 22 bp, Homo sapiens
ggtgggcacccgagactggatc

SEQ ID NO: 7591084 - DNA, 22 bp, Homo sapiens
ggtgggcacccgagactggatc

SEQ ID NO: 7591085 - DNA, 22 bp, Homo sapiens
ggtgggcacccgagactggatc

SEQ ID NO: 7591086 - DNA, 22 bp, Homo sapiens
gtctcccatcgtttgtgaggaa

SEQ ID NO: 7591087 - DNA, 23 bp, Homo sapiens
gtctcccatagcgctcccaggct

SEQ ID NO: 7591088 - DNA, 23 bp, Homo sapiens
gtctcccatagcgctcccaggct

SEQ ID NO: 7591089 - DNA, 22 bp, Homo sapiens
gtctcccatcgtttgtgaggaa

SEQ ID NO: 7591090 - DNA, 22 bp, Homo sapiens
gtctcccatcgtttgtgaggaa

SEQ ID NO: 7591091 - DNA, 22 bp, Homo sapiens
gtctcccatcgtttgtgaggaa

SEQ ID NO: 7591092 - DNA, 22 bp, Homo sapiens
gtcctctgcttcatgccctgat

SEQ ID NO: 7591093 - DNA, 22 bp, Homo sapiens
gtcctctgcttcatgccctgat

SEQ ID NO: 7591094 - DNA, 22 bp, Homo sapiens
gtcctctgcttcatgccctgat

SEQ ID NO: 7591095 - DNA, 22 bp, Homo sapiens
gtcctctgcttcatgccctgat

SEQ ID NO: 7591096 - DNA, 22 bp, Homo sapiens
gtctcccaatccgggacagcct

SEQ ID NO: 7591097 - DNA, 22 bp, Homo sapiens
gtctcccactttctggcctctt

SEQ ID NO: 7591098 - DNA, 22 bp, Homo sapiens
gtctcccactttctggcctctt

SEQ ID NO: 7591099 - DNA, 22 bp, Homo sapiens
gtctcccactttctggcctctt

SEQ ID NO: 7591100 - DNA, 22 bp, Homo sapiens
gtcctctgcttcatgccctgat

SEQ ID NO: 7591101 - DNA, 22 bp, Homo sapiens
gtctcccactttctggcctctt

SEQ ID NO: 7591102 - DNA, 22 bp, Homo sapiens
gtctcccactttctggcctctt

SEQ ID NO: 7591103 - DNA, 22 bp, Homo sapiens
gtctcccactttctggcctctt

SEQ ID NO: 7591104 - DNA, 22 bp, Homo sapiens
gtctcctatagctgcactgaat

SEQ ID NO: 7591105 - DNA, 22 bp, Homo sapiens
gtctcccgcccaacaagcaagg

SEQ ID NO: 7591106 - DNA, 22 bp, Homo sapiens
gtctcccgcccaacaagcaagg

SEQ ID NO: 7591107 - DNA, 22 bp, Homo sapiens
gtctcccatgtccctgtccagt

SEQ ID NO: 7591108 - DNA, 22 bp, Homo sapiens
gtctcccatgtccctgtccagt

SEQ ID NO: 7591109 - DNA, 22 bp, Homo sapiens
gtctcccatgtccctgtccagt

SEQ ID NO: 7591110 - DNA, 22 bp, Homo sapiens
gtctcccatgtccctgtccagt

SEQ ID NO: 7591111 - DNA, 22 bp, Homo sapiens
gtctccccagggccctcttcat

SEQ ID NO: 7591112 - DNA, 22 bp, Homo sapiens
gtctccccagggccctcttcat

SEQ ID NO: 7591113 - DNA, 20 bp, Homo sapiens
gtctcctctttgcattccta

SEQ ID NO: 7591114 - DNA, 22 bp, Homo sapiens
gtctcctcttcatatacctgtt

SEQ ID NO: 7591115 - DNA, 22 bp, Homo sapiens
gtctcctcttcatatacctgtt

SEQ ID NO: 7591116 - DNA, 20 bp, Homo sapiens
gtctcctctttgcattccta

SEQ ID NO: 7591117 - DNA, 20 bp, Homo sapiens
gtctcctctttgcattccta

SEQ ID NO: 7591118 - DNA, 22 bp, Homo sapiens
gtctcctcttcatatacctgtt

SEQ ID NO: 7591119 - DNA, 22 bp, Homo sapiens
gtctcctccctttcattcacct

SEQ ID NO: 7591120 - DNA, 22 bp, Homo sapiens
gtctcctccctttcattcacct

SEQ ID NO: 7591121 - DNA, 22 bp, Homo sapiens
gtctcctccctttcattcacct

SEQ ID NO: 7591122 - DNA, 22 bp, Homo sapiens
gtctcctccatggagatggtat

SEQ ID NO: 7591123 - DNA, 22 bp, Homo sapiens
gtctcctccatggagatggtat

SEQ ID NO: 7591124 - DNA, 22 bp, Homo sapiens
gtctcctccatggagatggtat

SEQ ID NO: 7591125 - DNA, 22 bp, Homo sapiens
gtctcctatagctgcactgaat

SEQ ID NO: 7591126 - DNA, 22 bp, Homo sapiens
gtctcctccagtaggaagtggc

SEQ ID NO: 7591127 - DNA, 22 bp, Homo sapiens
gtctcctccagtaggaagtggc

SEQ ID NO: 7591128 - DNA, 22 bp, Homo sapiens
gtctcctccagtaggaagtggc

SEQ ID NO: 7591129 - DNA, 22 bp, Homo sapiens
gtcctctccaggaggctctgat

SEQ ID NO: 7591130 - DNA, 22 bp, Homo sapiens
gtcctctccaggaggctctgat

SEQ ID NO: 7591131 - DNA, 22 bp, Homo sapiens
gtcctctccaggaggctctgat

SEQ ID NO: 7591132 - DNA, 22 bp, Homo sapiens
gtcctctccaggaggctctgat

SEQ ID NO: 7591133 - DNA, 22 bp, Homo sapiens
gtcctctgaagttgtgcaatgc

SEQ ID NO: 7591134 - DNA, 22 bp, Homo sapiens
gtcctctgaagttgtgcaatgc

SEQ ID NO: 7591135 - DNA, 22 bp, Homo sapiens
gtcctctccaggaggctctgat

SEQ ID NO: 7591136 - DNA, 22 bp, Homo sapiens
gtcctctccaggaggctctgat

SEQ ID NO: 7591137 - DNA, 22 bp, Homo sapiens
gtcctctagggtgtccagttga

SEQ ID NO: 7591138 - DNA, 22 bp, Homo sapiens
gtcctcagtcagtttggtgggg

SEQ ID NO: 7591139 - DNA, 22 bp, Homo sapiens
gtcctccatggtcttgaagtaa

SEQ ID NO: 7591140 - DNA, 22 bp, Homo sapiens
gtcctcagtcagtttggtgggg

SEQ ID NO: 7591141 - DNA, 22 bp, Homo sapiens
gtcctctgatttctaggtatat

SEQ ID NO: 7591142 - DNA, 22 bp, Homo sapiens
gtcctctgcccaggtcaaggtt

SEQ ID NO: 7591143 - DNA, 22 bp, Homo sapiens
gtcctctgcccaggtcaaggtt

SEQ ID NO: 7591144 - DNA, 22 bp, Homo sapiens
gtcctctgcccaggtcaaggtt

SEQ ID NO: 7591145 - DNA, 22 bp, Homo sapiens
gtcctctgcccaggtcaaggtt

SEQ ID NO: 7591146 - DNA, 22 bp, Homo sapiens
gtcctctgcccaggtcaaggtt

SEQ ID NO: 7591147 - DNA, 22 bp, Homo sapiens
gtcctctgagggggctgcacgc

SEQ ID NO: 7591148 - DNA, 22 bp, Homo sapiens
gtcctctgagggggctgcacgc

SEQ ID NO: 7591149 - DNA, 22 bp, Homo sapiens
gtcctctgagggggctgcacgc

SEQ ID NO: 7591150 - DNA, 22 bp, Homo sapiens
gtcctctgagggggctgcacgc

SEQ ID NO: 7591151 - DNA, 22 bp, Homo sapiens
gtcctctgagggggctgcacgc

SEQ ID NO: 7591152 - DNA, 22 bp, Homo sapiens
gtcctctgactcagccttggga

SEQ ID NO: 7591153 - DNA, 22 bp, Homo sapiens
gtcctctgactcagccttggga

SEQ ID NO: 7591154 - DNA, 22 bp, Homo sapiens
gtcctctgactcagccttggga

SEQ ID NO: 7591155 - DNA, 22 bp, Homo sapiens
gtcctcaggaaggctttctgac

SEQ ID NO: 7591156 - DNA, 22 bp, Homo sapiens
gtcctcaggaaggctttctgac

SEQ ID NO: 7591157 - DNA, 22 bp, Homo sapiens
gtcctcaggaaggctttctgac

SEQ ID NO: 7591158 - DNA, 22 bp, Homo sapiens
gtcctcaggcttgagtgtttat

SEQ ID NO: 7591159 - DNA, 22 bp, Homo sapiens
gtcctcaggaaagcagataaca

SEQ ID NO: 7591160 - DNA, 21 bp, Homo sapiens
gtcctcagctgatgggagctg

SEQ ID NO: 7591161 - DNA, 21 bp, Homo sapiens
gtcctcagctgatgggagctg

SEQ ID NO: 7591162 - DNA, 21 bp, Homo sapiens
gtcctcagctgatgggagctg

SEQ ID NO: 7591163 - DNA, 22 bp, Homo sapiens
gtcctcaggaaggctttctgac

SEQ ID NO: 7591164 - DNA, 22 bp, Homo sapiens
gtcctcagggaatgtggcgggt

SEQ ID NO: 7591165 - DNA, 22 bp, Homo sapiens
gtcctcagggaatgtggcgggt

SEQ ID NO: 7591166 - DNA, 22 bp, Homo sapiens
gtcctcagggaatgtggcgggt

SEQ ID NO: 7591167 - DNA, 22 bp, Homo sapiens
gtcctcagggaatgtggcgggt

SEQ ID NO: 7591168 - DNA, 22 bp, Homo sapiens
gtcctcagtaagagggcctctg

SEQ ID NO: 7591169 - DNA, 22 bp, Homo sapiens
gtcctcagtaagagggcctctg

SEQ ID NO: 7591170 - DNA, 22 bp, Homo sapiens
gtcctcagggagtcccagtcat

SEQ ID NO: 7591171 - DNA, 22 bp, Homo sapiens
gtcctcagcaccagaactaggg

SEQ ID NO: 7591172 - DNA, 21 bp, Homo sapiens
gtcctcagctgatgggagctg

SEQ ID NO: 7591173 - DNA, 21 bp, Homo sapiens
gtcctcagctgatgggagctg

SEQ ID NO: 7591174 - DNA, 21 bp, Homo sapiens
gtcctcagctgatgggagctg

SEQ ID NO: 7591175 - DNA, 22 bp, Homo sapiens
gtcctcagcaccagaactaggg

SEQ ID NO: 7591176 - DNA, 22 bp, Homo sapiens
gtcctcagcaccagaactaggg

SEQ ID NO: 7591177 - DNA, 22 bp, Homo sapiens
gtcctcagcaccagaactaggg

SEQ ID NO: 7591178 - DNA, 22 bp, Homo sapiens
gtcctcagatgctgctgaaatg

SEQ ID NO: 7591179 - DNA, 22 bp, Homo sapiens
gtcctcagatgctgctgaaatg

SEQ ID NO: 7591180 - DNA, 22 bp, Homo sapiens
gtcctcagatgctgctgaaatg

SEQ ID NO: 7591181 - DNA, 22 bp, Homo sapiens
gtcctcagagtgggcaggtcct

SEQ ID NO: 7591182 - DNA, 22 bp, Homo sapiens
gtcctcagagtgggcaggtcct

SEQ ID NO: 7591183 - DNA, 22 bp, Homo sapiens
gtcctcagaagcctgcttagct

SEQ ID NO: 7591184 - DNA, 22 bp, Homo sapiens
gtcctcagagtgggcaggtcct

SEQ ID NO: 7591185 - DNA, 22 bp, Homo sapiens
gtcctcagagtgggcaggtcct

SEQ ID NO: 7591186 - DNA, 22 bp, Homo sapiens
gtcctcagaagcctgcttagct

SEQ ID NO: 7591187 - DNA, 22 bp, Homo sapiens
gtcctcagaagcctgcttagct

SEQ ID NO: 7591188 - DNA, 22 bp, Homo sapiens
gtcctcagaagcctgcttagct

SEQ ID NO: 7591189 - DNA, 21 bp, Homo sapiens
gtcctcacgctccggcctccc

SEQ ID NO: 7591190 - DNA, 22 bp, Homo sapiens
gtccctggatctgggacagctg

SEQ ID NO: 7591191 - DNA, 22 bp, Homo sapiens
gtccctggatctgggacagctg

SEQ ID NO: 7591192 - DNA, 22 bp, Homo sapiens
gtccctggagctgagcagtgct

SEQ ID NO: 7591193 - DNA, 22 bp, Homo sapiens
gtccctggagctgagcagtgct

SEQ ID NO: 7591194 - DNA, 22 bp, Homo sapiens
gtccctggatctgggacagctg

SEQ ID NO: 7591195 - DNA, 22 bp, Homo sapiens
gtcattttatgggaacagattt

SEQ ID NO: 7591196 - DNA, 22 bp, Homo sapiens
gtcattttatgggaacagattt

SEQ ID NO: 7591197 - DNA, 22 bp, Homo sapiens
gtcattttatgggaacagattt

SEQ ID NO: 7591198 - DNA, 22 bp, Homo sapiens
gtcattttatgggaacagattt

SEQ ID NO: 7591199 - DNA, 22 bp, Homo sapiens
gtccctggagctgagcagtgct

SEQ ID NO: 7591200 - DNA, 22 bp, Homo sapiens
gtccctggagctgagcagtgct

SEQ ID NO: 7591201 - DNA, 22 bp, Homo sapiens
gtccctggagctgagcagtgct

SEQ ID NO: 7591202 - DNA, 22 bp, Homo sapiens
gtccctggagctgagcagtgct

SEQ ID NO: 7591203 - DNA, 22 bp, Homo sapiens
gtccctggagctgagcagtgct

SEQ ID NO: 7591204 - DNA, 22 bp, Homo sapiens
gtcattgcagtggcaaatcaca

SEQ ID NO: 7591205 - DNA, 22 bp, Homo sapiens
gtcattgggggccatctcagag

SEQ ID NO: 7591206 - DNA, 22 bp, Homo sapiens
gtcattgtaatattctcattta

SEQ ID NO: 7591207 - DNA, 22 bp, Homo sapiens
gtcatttaggtctgtcagaaat

SEQ ID NO: 7591208 - DNA, 22 bp, Homo sapiens
gtcatttaaagaccattgtggg

SEQ ID NO: 7591209 - DNA, 22 bp, Homo sapiens
gtcatttaaagaccattgtggg

SEQ ID NO: 7591210 - DNA, 22 bp, Homo sapiens
gtcatttaaaagggaacacatg

SEQ ID NO: 7591211 - DNA, 22 bp, Homo sapiens
gtcattgtgtggacatggagaa

SEQ ID NO: 7591212 - DNA, 22 bp, Homo sapiens
gtcatttattctggtcaattca

SEQ ID NO: 7591213 - DNA, 22 bp, Homo sapiens
gtcatttatcttcagaatttct

SEQ ID NO: 7591214 - DNA, 22 bp, Homo sapiens
gtcatttatcttcagaatttct

SEQ ID NO: 7591215 - DNA, 22 bp, Homo sapiens
gtcatttatcttcagaatttct

SEQ ID NO: 7591216 - DNA, 22 bp, Homo sapiens
gtcatttatcatcagaagtcat

SEQ ID NO: 7591217 - DNA, 22 bp, Homo sapiens
gtcatttaggtctgtcagaaat

SEQ ID NO: 7591218 - DNA, 22 bp, Homo sapiens
gtcatttatcatcagaagtcat

SEQ ID NO: 7591219 - DNA, 22 bp, Homo sapiens
gtcatttatcatcagaagtcat

SEQ ID NO: 7591220 - DNA, 22 bp, Homo sapiens
gtcatttatcatcagaagtcat

SEQ ID NO: 7591221 - DNA, 22 bp, Homo sapiens
gtcaccagcaccaatgccacat

SEQ ID NO: 7591222 - DNA, 22 bp, Homo sapiens
gtcaccaggtctgatgcagcca

SEQ ID NO: 7591223 - DNA, 22 bp, Homo sapiens
gtcaccagcaccaatgccacat

SEQ ID NO: 7591224 - DNA, 19 bp, Homo sapiens
gtcacatttgtctcccagg

SEQ ID NO: 7591225 - DNA, 22 bp, Homo sapiens
gtcaccaggtctgatgcagcca

SEQ ID NO: 7591226 - DNA, 22 bp, Homo sapiens
gtcaccaggtctgatgcagcca

SEQ ID NO: 7591227 - DNA, 22 bp, Homo sapiens
gtcaggctggggctgctgccag

SEQ ID NO: 7591228 - DNA, 22 bp, Homo sapiens
gtcaccagtgctaagaggtgga

SEQ ID NO: 7591229 - DNA, 22 bp, Homo sapiens
gtcaccaggtctgatgcagcca

SEQ ID NO: 7591230 - DNA, 22 bp, Homo sapiens
gtcaccagtcccagctcctgaa

SEQ ID NO: 7591231 - DNA, 22 bp, Homo sapiens
gtcagggctccactcaccctcc

SEQ ID NO: 7591232 - DNA, 23 bp, Homo sapiens
gtcagggcagctcccagcccaac

SEQ ID NO: 7591233 - DNA, 22 bp, Homo sapiens
gtcagggctccactcaccctcc

SEQ ID NO: 7591234 - DNA, 23 bp, Homo sapiens
gtcagggctggggtcagagtgac

SEQ ID NO: 7591235 - DNA, 22 bp, Homo sapiens
gtcagggcacagtgacagctcc

SEQ ID NO: 7591236 - DNA, 21 bp, Homo sapiens
gtcagggattcaagtgctcac

SEQ ID NO: 7591237 - DNA, 22 bp, Homo sapiens
gtcagggatccactgctcttct

SEQ ID NO: 7591238 - DNA, 21 bp, Homo sapiens
gtcagggattcaagtgctcac

SEQ ID NO: 7591239 - DNA, 22 bp, Homo sapiens
gtcagggatccactgctcttct

SEQ ID NO: 7591240 - DNA, 21 bp, Homo sapiens
gtcagggattcaagtgctcac

SEQ ID NO: 7591241 - DNA, 22 bp, Homo sapiens
gtcacattcatgcagaatcaaa

SEQ ID NO: 7591242 - DNA, 22 bp, Homo sapiens
gtcacattcatgcagaatcaaa

SEQ ID NO: 7591243 - DNA, 22 bp, Homo sapiens
gtcaccagcaccaatgccacat

SEQ ID NO: 7591244 - DNA, 22 bp, Homo sapiens
gtcacattcatgcagaatcaaa

SEQ ID NO: 7591245 - DNA, 22 bp, Homo sapiens
gtcacatggaattgactagagt

SEQ ID NO: 7591246 - DNA, 22 bp, Homo sapiens
gtcacatgccagtgcacacagg

SEQ ID NO: 7591247 - DNA, 22 bp, Homo sapiens
gtcacatgccagtgcacacagg

SEQ ID NO: 7591248 - DNA, 22 bp, Homo sapiens
gtcacatgccagtgcacacagg

SEQ ID NO: 7591249 - DNA, 22 bp, Homo sapiens
gtcacagtgtatctcttcagct

SEQ ID NO: 7591250 - DNA, 23 bp, Homo sapiens
gtcacagtgggtggtgcctacat

SEQ ID NO: 7591251 - DNA, 22 bp, Homo sapiens
gtcacagtgtatctcttcagct

SEQ ID NO: 7591252 - DNA, 22 bp, Homo sapiens
gtcacagtggggtcacagtgtg

SEQ ID NO: 7591253 - DNA, 22 bp, Homo sapiens
gtcacagtggggtcacagtgtg

SEQ ID NO: 7591254 - DNA, 22 bp, Homo sapiens
gtcacagtgctcccaaagtttg

SEQ ID NO: 7591255 - DNA, 22 bp, Homo sapiens
gtcacagtgctcccaaagtttg

SEQ ID NO: 7591256 - DNA, 22 bp, Homo sapiens
gtcacagtggggtcacagtgtg

SEQ ID NO: 7591257 - DNA, 22 bp, Homo sapiens
gtcacagtggggtcacagtgtg

SEQ ID NO: 7591258 - DNA, 22 bp, Homo sapiens
gtcacagtgctcccaaagtttg

SEQ ID NO: 7591259 - DNA, 22 bp, Homo sapiens
gtcacagtgcctgaagctctga

SEQ ID NO: 7591260 - DNA, 22 bp, Homo sapiens
gtcacagtgcctgccactcaga

SEQ ID NO: 7591261 - DNA, 22 bp, Homo sapiens
gtcacagtgcctgccactcaga

SEQ ID NO: 7591262 - DNA, 22 bp, Homo sapiens
gtcacagtcaaggccatgggca

SEQ ID NO: 7591263 - DNA, 22 bp, Homo sapiens
gtcacagtcaaggccatgggca

SEQ ID NO: 7591264 - DNA, 22 bp, Homo sapiens
gtcacagtgccctggtggtgtt

SEQ ID NO: 7591265 - DNA, 22 bp, Homo sapiens
gtcacagtgacagagatgttag

SEQ ID NO: 7591266 - DNA, 22 bp, Homo sapiens
gtcacagtgacagagatgttag

SEQ ID NO: 7591267 - DNA, 22 bp, Homo sapiens
gtcacagtatcatgtttgaatg

SEQ ID NO: 7591268 - DNA, 22 bp, Homo sapiens
gtcacagtatcatgtttgaatg

SEQ ID NO: 7591269 - DNA, 22 bp, Homo sapiens
gtcacagtatcatgtttgaatg

SEQ ID NO: 7591270 - DNA, 22 bp, Homo sapiens
gtcacaggtgtggaggtgctgg

SEQ ID NO: 7591271 - DNA, 22 bp, Homo sapiens
gtcacaggtgtggaggtgctgg

SEQ ID NO: 7591272 - DNA, 22 bp, Homo sapiens
gtcacaggtgtggaggtgctgg

SEQ ID NO: 7591273 - DNA, 22 bp, Homo sapiens
gtcacaggtgtggaggtgctgg

SEQ ID NO: 7591274 - DNA, 22 bp, Homo sapiens
gtcacaggtgtggaggtgctgg

SEQ ID NO: 7591275 - DNA, 22 bp, Homo sapiens
gtcacaaaggtgagggacatga

SEQ ID NO: 7591276 - DNA, 22 bp, Homo sapiens
gtcacaaatcccctcagcaact

SEQ ID NO: 7591277 - DNA, 22 bp, Homo sapiens
gtcaattagctaaaatttggta

SEQ ID NO: 7591278 - DNA, 22 bp, Homo sapiens
gtcaattagtggcaatttcata

SEQ ID NO: 7591279 - DNA, 22 bp, Homo sapiens
gtcaattagtggcaatttcata

SEQ ID NO: 7591280 - DNA, 22 bp, Homo sapiens
gtcaattagctaaaatttggta

SEQ ID NO: 7591281 - DNA, 17 bp, Homo sapiens
gtcaatattgttgacag

SEQ ID NO: 7591282 - DNA, 22 bp, Homo sapiens
gtcaatatcttggttgtactat

SEQ ID NO: 7591283 - DNA, 22 bp, Homo sapiens
gtcaatatcttggttgtactat

SEQ ID NO: 7591284 - DNA, 21 bp, Homo sapiens
gtcaatacataggtgaagagg

SEQ ID NO: 7591285 - DNA, 22 bp, Homo sapiens
gtcaatatagatcaatgcacag

SEQ ID NO: 7591286 - DNA, 22 bp, Homo sapiens
gtcaatatagatcaatgcacag

SEQ ID NO: 7591287 - DNA, 22 bp, Homo sapiens
gtcaatatagatcaatgcacag

SEQ ID NO: 7591288 - DNA, 22 bp, Homo sapiens
gtcaatataggtttcaaacatg

SEQ ID NO: 7591289 - DNA, 22 bp, Homo sapiens
gtcaatataggtttcaaacatg

SEQ ID NO: 7591290 - DNA, 22 bp, Homo sapiens
gtcaatatcgccaagtgtctct

SEQ ID NO: 7591291 - DNA, 22 bp, Homo sapiens
gtcaatatcgccaagtgtctct

SEQ ID NO: 7591292 - DNA, 22 bp, Homo sapiens
gtcaatatcgccaagtgtctct

SEQ ID NO: 7591293 - DNA, 22 bp, Homo sapiens
gtcaatatattctgtctctttg

SEQ ID NO: 7591294 - DNA, 17 bp, Homo sapiens
gtcattctcagaaaatg

SEQ ID NO: 7591295 - DNA, 22 bp, Homo sapiens
gtcattgagtcgtcagagtctt

SEQ ID NO: 7591296 - DNA, 22 bp, Homo sapiens
gtcattcagagatgcaggtaga

SEQ ID NO: 7591297 - DNA, 22 bp, Homo sapiens
gtcattcagagatgcaggtaga

SEQ ID NO: 7591298 - DNA, 22 bp, Homo sapiens
gtcattcctatccatttgatac

SEQ ID NO: 7591299 - DNA, 22 bp, Homo sapiens
gtcataaagacagaaacattcc

SEQ ID NO: 7591300 - DNA, 22 bp, Homo sapiens
gtcataaagacagaaacattcc

SEQ ID NO: 7591301 - DNA, 22 bp, Homo sapiens
gtcattcaaactgtatcacttg

SEQ ID NO: 7591302 - DNA, 22 bp, Homo sapiens
gtcattcaaactgtatcacttg

SEQ ID NO: 7591303 - DNA, 22 bp, Homo sapiens
gtcattcagagatgcaggtaga

SEQ ID NO: 7591304 - DNA, 22 bp, Homo sapiens
gtcattcaactgcacattaggt

SEQ ID NO: 7591305 - DNA, 20 bp, Homo sapiens
gtcagtgtcttcagtagtga

SEQ ID NO: 7591306 - DNA, 22 bp, Homo sapiens
gtcagtgtgagataatcttgga

SEQ ID NO: 7591307 - DNA, 22 bp, Homo sapiens
gtcagtgtgagataatcttgga

SEQ ID NO: 7591308 - DNA, 22 bp, Homo sapiens
gtcagtgtgagttgattccata

SEQ ID NO: 7591309 - DNA, 22 bp, Homo sapiens
gtcagttattcaattggtttaa

SEQ ID NO: 7591310 - DNA, 22 bp, Homo sapiens
gtcagtgtttaacaaccagctc

SEQ ID NO: 7591311 - DNA, 22 bp, Homo sapiens
gtcagtgtggttgctggcttgg

SEQ ID NO: 7591312 - DNA, 22 bp, Homo sapiens
gtcagtgtggttgctggcttgg

SEQ ID NO: 7591313 - DNA, 22 bp, Homo sapiens
gtcagtgttataagtttagcca

SEQ ID NO: 7591314 - DNA, 22 bp, Homo sapiens
gtcagtttgactcagtgttata

SEQ ID NO: 7591315 - DNA, 22 bp, Homo sapiens
gtcagtttgactcagtgttata

SEQ ID NO: 7591316 - DNA, 22 bp, Homo sapiens
gtcagttcattagcacttccaa

SEQ ID NO: 7591317 - DNA, 22 bp, Homo sapiens
gtcagttcactaccactccatt

SEQ ID NO: 7591318 - DNA, 22 bp, Homo sapiens
gtcagttcactaccactccatt

SEQ ID NO: 7591319 - DNA, 22 bp, Homo sapiens
gtcagtttgactcagtgttata

SEQ ID NO: 7591320 - DNA, 22 bp, Homo sapiens
gtcagtttgactcagtgttata

SEQ ID NO: 7591321 - DNA, 22 bp, Homo sapiens
gtcagttcattagcacttccaa

SEQ ID NO: 7591322 - DNA, 22 bp, Homo sapiens
gtcagtttgactcagtgttata

SEQ ID NO: 7591323 - DNA, 18 bp, Homo sapiens
gtcagttttgaagccaga

SEQ ID NO: 7591324 - DNA, 18 bp, Homo sapiens
gtcagttttgaagccaga

SEQ ID NO: 7591325 - DNA, 18 bp, Homo sapiens
gtcagttttgaagccaga

SEQ ID NO: 7591326 - DNA, 22 bp, Homo sapiens
gtcataaaaggaccacctattg

SEQ ID NO: 7591327 - DNA, 22 bp, Homo sapiens
gtcagttttgctacagttgctg

SEQ ID NO: 7591328 - DNA, 22 bp, Homo sapiens
gtcataaaaggaccacctattg

SEQ ID NO: 7591329 - DNA, 23 bp, Homo sapiens
gtcagtgctttagttcaggatgg

SEQ ID NO: 7591330 - DNA, 22 bp, Homo sapiens
gtcagtgtaggttcatcagtgg

SEQ ID NO: 7591331 - DNA, 22 bp, Homo sapiens
gtcagtgtaggttcatcagtgg

SEQ ID NO: 7591332 - DNA, 22 bp, Homo sapiens
gtcagtgtagcaggtgcaagcc

SEQ ID NO: 7591333 - DNA, 22 bp, Homo sapiens
gtcagtgtagcaggtgcaagcc

SEQ ID NO: 7591334 - DNA, 20 bp, Homo sapiens
gtcagtgtcttcagtagtga

SEQ ID NO: 7591335 - DNA, 22 bp, Homo sapiens
gtcagtgtcttaacagagatta

SEQ ID NO: 7591336 - DNA, 22 bp, Homo sapiens
gtcagtgtcttaacagagatta

SEQ ID NO: 7591337 - DNA, 22 bp, Homo sapiens
gtcagtgtcttaacagagatta

SEQ ID NO: 7591338 - DNA, 22 bp, Homo sapiens
gtcagtgcttgaagggcagaga

SEQ ID NO: 7591339 - DNA, 21 bp, Homo sapiens
gtcagtgctgaaacaccttcc

SEQ ID NO: 7591340 - DNA, 22 bp, Homo sapiens
gtcagtctgcctgagcttgttt

SEQ ID NO: 7591341 - DNA, 22 bp, Homo sapiens
gtcagtgccaccagccactgcc

SEQ ID NO: 7591342 - DNA, 22 bp, Homo sapiens
gtcagtgccaccagccactgcc

SEQ ID NO: 7591343 - DNA, 17 bp, Homo sapiens
gtcagtctcccactgcc

SEQ ID NO: 7591344 - DNA, 22 bp, Homo sapiens
gtcagtctcctgccttttggac

SEQ ID NO: 7591345 - DNA, 22 bp, Homo sapiens
gtcagtctgcctgagcttgttt

SEQ ID NO: 7591346 - DNA, 22 bp, Homo sapiens
gtcagtcatattgtacagatat

SEQ ID NO: 7591347 - DNA, 22 bp, Homo sapiens
gtcagtcatattgtacagatat

SEQ ID NO: 7591348 - DNA, 22 bp, Homo sapiens
gtcagtaggaacctagggtcaa

SEQ ID NO: 7591349 - DNA, 22 bp, Homo sapiens
gtcaggggccatgggccaagga

SEQ ID NO: 7591350 - DNA, 22 bp, Homo sapiens
gtcaggggccatgggccaagga

SEQ ID NO: 7591351 - DNA, 22 bp, Homo sapiens
gtcaggggccatgggccaagga

SEQ ID NO: 7591352 - DNA, 22 bp, Homo sapiens
gtcaggggatgtgctggtggcc

SEQ ID NO: 7591353 - DNA, 22 bp, Homo sapiens
gtcagggcacagtgacagctcc

SEQ ID NO: 7591354 - DNA, 22 bp, Homo sapiens
gtcaggggatgtgctggtggcc

SEQ ID NO: 7591355 - DNA, 23 bp, Homo sapiens
gtcagggctggggtcagagtgac

SEQ ID NO: 7591356 - DNA, 22 bp, Homo sapiens
gtcaggggatgtgctggtggcc

SEQ ID NO: 7591357 - DNA, 22 bp, Homo sapiens
gtcaggggatgtgctggtggcc

SEQ ID NO: 7591358 - DNA, 23 bp, Homo sapiens
gtcagggctggggtcagagtgac

SEQ ID NO: 7591359 - DNA, 23 bp, Homo sapiens
gtcagggctggggtcagagtgac

SEQ ID NO: 7591360 - DNA, 22 bp, Homo sapiens
gtcaggtcttggaagataggct

SEQ ID NO: 7591361 - DNA, 22 bp, Homo sapiens
gtcagtaaatcttgttatgaag

SEQ ID NO: 7591362 - DNA, 21 bp, Homo sapiens
gtcaggttttgtatcaatatt

SEQ ID NO: 7591363 - DNA, 22 bp, Homo sapiens
gtcttagatttcaccgataatg

SEQ ID NO: 7591364 - DNA, 22 bp, Homo sapiens
gtctggtttatgaagatcccgt

SEQ ID NO: 7591365 - DNA, 22 bp, Homo sapiens
gtcttagatttcaccgataatg

SEQ ID NO: 7591366 - DNA, 22 bp, Homo sapiens
gtcttagatttcaccgataatg

SEQ ID NO: 7591367 - DNA, 22 bp, Homo sapiens
gtcttatagtacaatttgaagt

SEQ ID NO: 7591368 - DNA, 22 bp, Homo sapiens
gtcttagatttcaccgataatg

SEQ ID NO: 7591369 - DNA, 22 bp, Homo sapiens
gtcttagatttcaccgataatg

SEQ ID NO: 7591370 - DNA, 22 bp, Homo sapiens
gtcttatagtacaatttgaagt

SEQ ID NO: 7591371 - DNA, 22 bp, Homo sapiens
gtcttatagtacaatttgaagt

SEQ ID NO: 7591372 - DNA, 22 bp, Homo sapiens
gtcttattaaaaatctaatccc

SEQ ID NO: 7591373 - DNA, 22 bp, Homo sapiens
gtctggggtgaggcccgggatt

SEQ ID NO: 7591374 - DNA, 22 bp, Homo sapiens
gtctggggtgaggcccgggatt

SEQ ID NO: 7591375 - DNA, 22 bp, Homo sapiens
gtctgggttaagtcctgataat

SEQ ID NO: 7591376 - DNA, 22 bp, Homo sapiens
gtctggtcctcttcacagtggc

SEQ ID NO: 7591377 - DNA, 22 bp, Homo sapiens
gtctggtgggattccaagtggc

SEQ ID NO: 7591378 - DNA, 22 bp, Homo sapiens
gtctggtgggattccaagtggc

SEQ ID NO: 7591379 - DNA, 22 bp, Homo sapiens
gtctggtgggattccaagtggc

SEQ ID NO: 7591380 - DNA, 22 bp, Homo sapiens
gtctggtgggattccaagtggc

SEQ ID NO: 7591381 - DNA, 22 bp, Homo sapiens
gtctgggtttcatgggcactgg

SEQ ID NO: 7591382 - DNA, 22 bp, Homo sapiens
gtcttattaaaatgcagtttct

SEQ ID NO: 7591383 - DNA, 22 bp, Homo sapiens
gtcttattaaaaatctaatccc

SEQ ID NO: 7591384 - DNA, 22 bp, Homo sapiens
gtcttatcacgtggctagctca

SEQ ID NO: 7591385 - DNA, 22 bp, Homo sapiens
gtcttattatgaggttagactt

SEQ ID NO: 7591386 - DNA, 22 bp, Homo sapiens
gtcttattaggttaaccctgct

SEQ ID NO: 7591387 - DNA, 22 bp, Homo sapiens
gtcttattgcgtatgtatacaa

SEQ ID NO: 7591388 - DNA, 22 bp, Homo sapiens
gtcttattgcgtatgtatacaa

SEQ ID NO: 7591389 - DNA, 22 bp, Homo sapiens
gtcttattgggtccaaggtggc

SEQ ID NO: 7591390 - DNA, 22 bp, Homo sapiens
gtcttatttaaagagatcatac

SEQ ID NO: 7591391 - DNA, 22 bp, Homo sapiens
gtcttatttaaagagatcatac

SEQ ID NO: 7591392 - DNA, 22 bp, Homo sapiens
gtcttatttaaagagatcatac

SEQ ID NO: 7591393 - DNA, 22 bp, Homo sapiens
gtcttatttaacctaaatttct

SEQ ID NO: 7591394 - DNA, 20 bp, Homo sapiens
gtcttatttaacacatgact

SEQ ID NO: 7591395 - DNA, 22 bp, Homo sapiens
gtcttatttaaggacaagaaga

SEQ ID NO: 7591396 - DNA, 22 bp, Homo sapiens
gtcttatttaaggacaagaaga

SEQ ID NO: 7591397 - DNA, 22 bp, Homo sapiens
gtcttatttaaggcttatacaa

SEQ ID NO: 7591398 - DNA, 22 bp, Homo sapiens
gtcttatttaaggcttatacaa

SEQ ID NO: 7591399 - DNA, 22 bp, Homo sapiens
gtcttcaactggactccaggga

SEQ ID NO: 7591400 - DNA, 22 bp, Homo sapiens
gtcttcaacaataactaccact

SEQ ID NO: 7591401 - DNA, 22 bp, Homo sapiens
gtcttcaacaataactaccact

SEQ ID NO: 7591402 - DNA, 21 bp, Homo sapiens
gtcttcaaaggcagtgggcag

SEQ ID NO: 7591403 - DNA, 22 bp, Homo sapiens
gtcttcaacaaatggtagggtc

SEQ ID NO: 7591404 - DNA, 22 bp, Homo sapiens
gtcttattttctgtctactaaa

SEQ ID NO: 7591405 - DNA, 22 bp, Homo sapiens
gtcttattttctgtctactaaa

SEQ ID NO: 7591406 - DNA, 22 bp, Homo sapiens
gtcttctgcccaggcagacgga

SEQ ID NO: 7591407 - DNA, 22 bp, Homo sapiens
gtcttctgatctggttagccat

SEQ ID NO: 7591408 - DNA, 22 bp, Homo sapiens
gtcttctgcaactgcacctgcc

SEQ ID NO: 7591409 - DNA, 19 bp, Homo sapiens
gtcttctgaatgtggctgc

SEQ ID NO: 7591410 - DNA, 22 bp, Homo sapiens
gtcttctgatctggttagccat

SEQ ID NO: 7591411 - DNA, 22 bp, Homo sapiens
gtcttctgatctggttagccat

SEQ ID NO: 7591412 - DNA, 19 bp, Homo sapiens
gtcttctgaatgtggctgc

SEQ ID NO: 7591413 - DNA, 20 bp, Homo sapiens
gtcttctattcccagaaagt

SEQ ID NO: 7591414 - DNA, 22 bp, Homo sapiens
gtcttcctaatttgctattagg

SEQ ID NO: 7591415 - DNA, 22 bp, Homo sapiens
gtcttccacatttcaagaggct

SEQ ID NO: 7591416 - DNA, 22 bp, Homo sapiens
gtcttcattcaacaaatattca

SEQ ID NO: 7591417 - DNA, 20 bp, Homo sapiens
gtcttcataatgaccttatt

SEQ ID NO: 7591418 - DNA, 22 bp, Homo sapiens
gtcttcagtggcaaatggatct

SEQ ID NO: 7591419 - DNA, 22 bp, Homo sapiens
gtcttcagtggcaaatggatct

SEQ ID NO: 7591420 - DNA, 22 bp, Homo sapiens
gtcttcaggacccggaattttg

SEQ ID NO: 7591421 - DNA, 22 bp, Homo sapiens
gtcttcaggacccggaattttg

SEQ ID NO: 7591422 - DNA, 22 bp, Homo sapiens
gtcttcaatagagcctcaattt

SEQ ID NO: 7591423 - DNA, 22 bp, Homo sapiens
gtcttcaggacctggaattttg

SEQ ID NO: 7591424 - DNA, 22 bp, Homo sapiens
gtcttcaggacctggaattttg

SEQ ID NO: 7591425 - DNA, 22 bp, Homo sapiens
gtctctatcatagctgaaccct

SEQ ID NO: 7591426 - DNA, 22 bp, Homo sapiens
gtctctatcatagctgaaccct

SEQ ID NO: 7591427 - DNA, 22 bp, Homo sapiens
gtctctatcatagctgaaccct

SEQ ID NO: 7591428 - DNA, 22 bp, Homo sapiens
gtctccttgtggatctcaagga

SEQ ID NO: 7591429 - DNA, 22 bp, Homo sapiens
gtctcgctgagcccccattcta

SEQ ID NO: 7591430 - DNA, 22 bp, Homo sapiens
gtctcgtcaatggcaggttccc

SEQ ID NO: 7591431 - DNA, 22 bp, Homo sapiens
gtctcgtcaatggcaggttccc

SEQ ID NO: 7591432 - DNA, 22 bp, Homo sapiens
gtctcgttgctttataaataga

SEQ ID NO: 7591433 - DNA, 23 bp, Homo sapiens
gtctctagagtgtggagcaaaga

SEQ ID NO: 7591434 - DNA, 22 bp, Homo sapiens
gtctcctgtcctgcaggatgga

SEQ ID NO: 7591435 - DNA, 22 bp, Homo sapiens
gtctcctggcttttgtcccagt

SEQ ID NO: 7591436 - DNA, 22 bp, Homo sapiens
gtctcctgtcctgcaggatgga

SEQ ID NO: 7591437 - DNA, 22 bp, Homo sapiens
gtctccttgtggatctcaagga

SEQ ID NO: 7591438 - DNA, 22 bp, Homo sapiens
gtctcctgtcctgcaggatgga

SEQ ID NO: 7591439 - DNA, 22 bp, Homo sapiens
gtctccttgtggatctcaagga

SEQ ID NO: 7591440 - DNA, 22 bp, Homo sapiens
gtctcctgtcctgcaggatgga

SEQ ID NO: 7591441 - DNA, 22 bp, Homo sapiens
gtctcctgtcctgcaggatgga

SEQ ID NO: 7591442 - DNA, 22 bp, Homo sapiens
gtctctctgactggtccacacc

SEQ ID NO: 7591443 - DNA, 22 bp, Homo sapiens
gtctctctgctaggcctccagt

SEQ ID NO: 7591444 - DNA, 22 bp, Homo sapiens
gtctctctgactggtccacacc

SEQ ID NO: 7591445 - DNA, 22 bp, Homo sapiens
gtctctatcatagctgaaccct

SEQ ID NO: 7591446 - DNA, 22 bp, Homo sapiens
gtctctatcatagctgaaccct

SEQ ID NO: 7591447 - DNA, 22 bp, Homo sapiens
gtctctatcatagctgaaccct

SEQ ID NO: 7591448 - DNA, 22 bp, Homo sapiens
gtctctctcccaagattggcta

SEQ ID NO: 7591449 - DNA, 22 bp, Homo sapiens
gtctctcaaaactagaagagaa

SEQ ID NO: 7591450 - DNA, 22 bp, Homo sapiens
gtctggggtccttttggcttta

SEQ ID NO: 7591451 - DNA, 22 bp, Homo sapiens
gtctggggtccttttggcttta

SEQ ID NO: 7591452 - DNA, 22 bp, Homo sapiens
gtctggggtactttcatctgat

SEQ ID NO: 7591453 - DNA, 22 bp, Homo sapiens
gtctggggtactttcatctgat

SEQ ID NO: 7591454 - DNA, 22 bp, Homo sapiens
gtctctgacctgcgtccctcct

SEQ ID NO: 7591455 - DNA, 22 bp, Homo sapiens
gtctctctgctaggcctccagt

SEQ ID NO: 7591456 - DNA, 22 bp, Homo sapiens
gtctctgaagtcagtttttcta

SEQ ID NO: 7591457 - DNA, 22 bp, Homo sapiens
gtctcctgagccttgactgcaa

SEQ ID NO: 7591458 - DNA, 22 bp, Homo sapiens
gtctcctgaggcatccattgaa

SEQ ID NO: 7591459 - DNA, 22 bp, Homo sapiens
gtctcctgaggcatccattgaa

SEQ ID NO: 7591460 - DNA, 22 bp, Homo sapiens
gtctcctgaggcatccattgaa

SEQ ID NO: 7591461 - DNA, 22 bp, Homo sapiens
gtctcctgccacactcagtccc

SEQ ID NO: 7591462 - DNA, 22 bp, Homo sapiens
gtctcctgccacactcagtccc

SEQ ID NO: 7591463 - DNA, 22 bp, Homo sapiens
gtctcctgaggcatccattgaa

SEQ ID NO: 7591464 - DNA, 22 bp, Homo sapiens
gtctcctgaggcatccattgaa

SEQ ID NO: 7591465 - DNA, 22 bp, Homo sapiens
gtctcctgagactgcagtcacc

SEQ ID NO: 7591466 - DNA, 22 bp, Homo sapiens
gtctcctgagactgcagtcacc

SEQ ID NO: 7591467 - DNA, 20 bp, Homo sapiens
gtctcctctttgcattccta

SEQ ID NO: 7591468 - DNA, 22 bp, Homo sapiens
gtctcctgagactgcagtcacc

SEQ ID NO: 7591469 - DNA, 22 bp, Homo sapiens
gtctcctgagccttgactgcaa

SEQ ID NO: 7591470 - DNA, 22 bp, Homo sapiens
gtctcctgagccttgactgcaa

SEQ ID NO: 7591471 - DNA, 22 bp, Homo sapiens
gtctcctgagccttgactgcaa

SEQ ID NO: 7591472 - DNA, 22 bp, Homo sapiens
gtctcctgcccccggtgcttgg

SEQ ID NO: 7591473 - DNA, 22 bp, Homo sapiens
gtctcctgcccccggtgcttgg

SEQ ID NO: 7591474 - DNA, 22 bp, Homo sapiens
gtctcctgcccccggtgcttgg

SEQ ID NO: 7591475 - DNA, 22 bp, Homo sapiens
gtctcctgcccccggtgcttgg

SEQ ID NO: 7591476 - DNA, 22 bp, Homo sapiens
gtctcctgctagcaagcaccac

SEQ ID NO: 7591477 - DNA, 22 bp, Homo sapiens
gtctcctgctagcaagcaccac

SEQ ID NO: 7591478 - DNA, 22 bp, Homo sapiens
gtctcctggaaatatgcccata

SEQ ID NO: 7591479 - DNA, 22 bp, Homo sapiens
gtctcctggaaatatgcccata

SEQ ID NO: 7591480 - DNA, 22 bp, Homo sapiens
gtctcctggctgcagctaagac

SEQ ID NO: 7591481 - DNA, 22 bp, Homo sapiens
gtctcctggcctccagtttctc

SEQ ID NO: 7591482 - DNA, 22 bp, Homo sapiens
gtctcctggctgcagctaagac

SEQ ID NO: 7591483 - DNA, 22 bp, Homo sapiens
gtctcctggctgcagctaagac

SEQ ID NO: 7591484 - DNA, 22 bp, Homo sapiens
gtctcctggctgcagctaagac

SEQ ID NO: 7591485 - DNA, 22 bp, Homo sapiens
gtctcctggaaatatgcccata

SEQ ID NO: 7591486 - DNA, 22 bp, Homo sapiens
gtctcctggcctccagtttctc

SEQ ID NO: 7591487 - DNA, 22 bp, Homo sapiens
gtctcctggcctccagtttctc

SEQ ID NO: 7591488 - DNA, 22 bp, Homo sapiens
gtctcctggcctccagtttctc

SEQ ID NO: 7591489 - DNA, 22 bp, Homo sapiens
gtgagtgtcagtcaaaggtttt

SEQ ID NO: 7591490 - DNA, 22 bp, Homo sapiens
gtgagtgttaacccactgcttc

SEQ ID NO: 7591491 - DNA, 22 bp, Homo sapiens
gtgagtgccaggtgaagtatgt

SEQ ID NO: 7591492 - DNA, 22 bp, Homo sapiens
gtgagttactctggttctcatt

SEQ ID NO: 7591493 - DNA, 22 bp, Homo sapiens
gtgagtttatgccctgccctat

SEQ ID NO: 7591494 - DNA, 22 bp, Homo sapiens
gtgataaaatagaaacagtggt

SEQ ID NO: 7591495 - DNA, 22 bp, Homo sapiens
gtgataaaatagaaacagtggt

SEQ ID NO: 7591496 - DNA, 22 bp, Homo sapiens
gtgataaaattcaaatagctct

SEQ ID NO: 7591497 - DNA, 22 bp, Homo sapiens
gtgataaaattcaaatagctct

SEQ ID NO: 7591498 - DNA, 22 bp, Homo sapiens
gtgataaaattcaaatagctct

SEQ ID NO: 7591499 - DNA, 22 bp, Homo sapiens
gtgataaaatagaaacagtggt

SEQ ID NO: 7591500 - DNA, 22 bp, Homo sapiens
gtgataaaatagaaacagtggt

SEQ ID NO: 7591501 - DNA, 22 bp, Homo sapiens
gtgataaagacgtgtcataatt

SEQ ID NO: 7591502 - DNA, 22 bp, Homo sapiens
gtgagtcttaagcaccaccttt

SEQ ID NO: 7591503 - DNA, 22 bp, Homo sapiens
gtgagtcttaagcaccaccttt

SEQ ID NO: 7591504 - DNA, 23 bp, Homo sapiens
gtgagtcttgcctttgctgtgga

SEQ ID NO: 7591505 - DNA, 22 bp, Homo sapiens
gtgagtctgtgggtgggaactg

SEQ ID NO: 7591506 - DNA, 22 bp, Homo sapiens
gtgagtgtcagtcaaaggtttt

SEQ ID NO: 7591507 - DNA, 22 bp, Homo sapiens
gtgagtctttggagacagttca

SEQ ID NO: 7591508 - DNA, 22 bp, Homo sapiens
gtgagtctttggagacagttca

SEQ ID NO: 7591509 - DNA, 22 bp, Homo sapiens
gtgagtcaatgtattgcagcaa

SEQ ID NO: 7591510 - DNA, 22 bp, Homo sapiens
gtgagtcaatgtattgcagcaa

SEQ ID NO: 7591511 - DNA, 22 bp, Homo sapiens
gtgagtctgcctagcacatcac

SEQ ID NO: 7591512 - DNA, 22 bp, Homo sapiens
gtgagtaaaggttcattgaatt

SEQ ID NO: 7591513 - DNA, 22 bp, Homo sapiens
gtgagtaaaggttcattgaatt

SEQ ID NO: 7591514 - DNA, 22 bp, Homo sapiens
gtgagtcaagcagaaacgtgga

SEQ ID NO: 7591515 - DNA, 22 bp, Homo sapiens
gtgagtcaatgtattgcagcaa

SEQ ID NO: 7591516 - DNA, 22 bp, Homo sapiens
gtgagtaaaggttcattgaatt

SEQ ID NO: 7591517 - DNA, 22 bp, Homo sapiens
gtgaggtggtacaatattaact

SEQ ID NO: 7591518 - DNA, 22 bp, Homo sapiens
gtgaggtggtacaatattaact

SEQ ID NO: 7591519 - DNA, 22 bp, Homo sapiens
gtgataagacagtaggcacaag

SEQ ID NO: 7591520 - DNA, 22 bp, Homo sapiens
gtgataactcaggcagagaata

SEQ ID NO: 7591521 - DNA, 22 bp, Homo sapiens
gtgataagacagtaggcacaag

SEQ ID NO: 7591522 - DNA, 22 bp, Homo sapiens
gtgataattgcagagaaaggag

SEQ ID NO: 7591523 - DNA, 22 bp, Homo sapiens
gtgatacaaataaacatatgct

SEQ ID NO: 7591524 - DNA, 22 bp, Homo sapiens
gtgatacaaataaacatatgct

SEQ ID NO: 7591525 - DNA, 22 bp, Homo sapiens
gtgatacaggatggtgataaat

SEQ ID NO: 7591526 - DNA, 22 bp, Homo sapiens
gtgataggcatttaactctaag

SEQ ID NO: 7591527 - DNA, 22 bp, Homo sapiens
gtgataggtttacacctgagca

SEQ ID NO: 7591528 - DNA, 22 bp, Homo sapiens
gtgataggtttacacctgagca

SEQ ID NO: 7591529 - DNA, 23 bp, Homo sapiens
gtgatattaaggatagagacaag

SEQ ID NO: 7591530 - DNA, 22 bp, Homo sapiens
gtgatgagagaaccaggacctt

SEQ ID NO: 7591531 - DNA, 22 bp, Homo sapiens
gtgatgcacaactaatatttca

SEQ ID NO: 7591532 - DNA, 22 bp, Homo sapiens
gtgatctgccagcctcagcctc

SEQ ID NO: 7591533 - DNA, 22 bp, Homo sapiens
gtgatcttgtaattgggcaatg

SEQ ID NO: 7591534 - DNA, 22 bp, Homo sapiens
gtgatcctataaagtgagcaca

SEQ ID NO: 7591535 - DNA, 22 bp, Homo sapiens
gtgatcactgcttcttccacca

SEQ ID NO: 7591536 - DNA, 23 bp, Homo sapiens
gtgatattaaggatagagacaag

SEQ ID NO: 7591537 - DNA, 22 bp, Homo sapiens
gtgatgtcacacccttgataga

SEQ ID NO: 7591538 - DNA, 22 bp, Homo sapiens
gtgatgtcacacccttgataga

SEQ ID NO: 7591539 - DNA, 22 bp, Homo sapiens
gtgatgtagccctaattctgca

SEQ ID NO: 7591540 - DNA, 22 bp, Homo sapiens
gtgatgggtaactgtttaggga

SEQ ID NO: 7591541 - DNA, 22 bp, Homo sapiens
gtgatggatgtgtatcttttta

SEQ ID NO: 7591542 - DNA, 22 bp, Homo sapiens
gtgatggaataatccaagattt

SEQ ID NO: 7591543 - DNA, 20 bp, Homo sapiens
gtgatgcatgataacatcaa

SEQ ID NO: 7591544 - DNA, 22 bp, Homo sapiens
gtgatggagtcaaggctagaac

SEQ ID NO: 7591545 - DNA, 22 bp, Homo sapiens
gtgatgggtaactgtttaggga

SEQ ID NO: 7591546 - DNA, 22 bp, Homo sapiens
gtgatgtggggaccgtcctggc

SEQ ID NO: 7591547 - DNA, 22 bp, Homo sapiens
gtgatgtcttgtacatatgatt

SEQ ID NO: 7591548 - DNA, 22 bp, Homo sapiens
gtgatgtcttgtacatatgatt

SEQ ID NO: 7591549 - DNA, 22 bp, Homo sapiens
gtgatgttatgaagatgaatgt

SEQ ID NO: 7591550 - DNA, 22 bp, Homo sapiens
gtgattaactgcagttagagct

SEQ ID NO: 7591551 - DNA, 22 bp, Homo sapiens
gtgatgtcacagaataagtgat

SEQ ID NO: 7591552 - DNA, 22 bp, Homo sapiens
gtgatgtcacagaataagtgat

SEQ ID NO: 7591553 - DNA, 22 bp, Homo sapiens
gtgatgtcacagaataagtgat

SEQ ID NO: 7591554 - DNA, 22 bp, Homo sapiens
gtgatgtcagacatctggtatt

SEQ ID NO: 7591555 - DNA, 22 bp, Homo sapiens
gtgatgtcagcaagaataggaa

SEQ ID NO: 7591556 - DNA, 22 bp, Homo sapiens
gtgatgtcagcaagaataggaa

SEQ ID NO: 7591557 - DNA, 22 bp, Homo sapiens
gtcttctggaagagagccagct

SEQ ID NO: 7591558 - DNA, 22 bp, Homo sapiens
gtcttctgcctccattagagtt

SEQ ID NO: 7591559 - DNA, 22 bp, Homo sapiens
gtcttctgcccaggcagacgga

SEQ ID NO: 7591560 - DNA, 22 bp, Homo sapiens
gtcttctggggccaggcccgct

SEQ ID NO: 7591561 - DNA, 22 bp, Homo sapiens
gtcttctggggccaggcccgct

SEQ ID NO: 7591562 - DNA, 22 bp, Homo sapiens
gtcttctggaagagagccagct

SEQ ID NO: 7591563 - DNA, 22 bp, Homo sapiens
gtcttctggaagagagccagct

SEQ ID NO: 7591564 - DNA, 22 bp, Homo sapiens
gtcttctgtctgtctggcatgt

SEQ ID NO: 7591565 - DNA, 22 bp, Homo sapiens
gtcttctgtctgtctggcatgt

SEQ ID NO: 7591566 - DNA, 22 bp, Homo sapiens
gtcttctgtaagatgaggtccc

SEQ ID NO: 7591567 - DNA, 22 bp, Homo sapiens
gtcttctgtaagatgaggtccc

SEQ ID NO: 7591568 - DNA, 22 bp, Homo sapiens
gtcttctgtaagatgaggtccc

SEQ ID NO: 7591569 - DNA, 22 bp, Homo sapiens
gtcttctgttctgtgaggcttc

SEQ ID NO: 7591570 - DNA, 22 bp, Homo sapiens
gtcttctgttctgtgaggcttc

SEQ ID NO: 7591571 - DNA, 22 bp, Homo sapiens
gtcttctgttctgtgaggcttc

SEQ ID NO: 7591572 - DNA, 22 bp, Homo sapiens
gtcttctgttctgtgaggcttc

SEQ ID NO: 7591573 - DNA, 22 bp, Homo sapiens
gtcttcttttcagtctgcttgt

SEQ ID NO: 7591574 - DNA, 22 bp, Homo sapiens
gtcttcttttcagtctgcttgt

SEQ ID NO: 7591575 - DNA, 22 bp, Homo sapiens
gtcttcttttcagtctgcttgt

SEQ ID NO: 7591576 - DNA, 22 bp, Homo sapiens
gtcttgaaaagtggccagtttg

SEQ ID NO: 7591577 - DNA, 22 bp, Homo sapiens
gtgaggcagggaaagaggataa

SEQ ID NO: 7591578 - DNA, 22 bp, Homo sapiens
gtgaggcagggaaagaggataa

SEQ ID NO: 7591579 - DNA, 22 bp, Homo sapiens
gtcttcttgtgttgcctgtctt

SEQ ID NO: 7591580 - DNA, 22 bp, Homo sapiens
gtcttctgttctgtgaggcttc

SEQ ID NO: 7591581 - DNA, 22 bp, Homo sapiens
gtcttctgttctgtgaggcttc

SEQ ID NO: 7591582 - DNA, 22 bp, Homo sapiens
gtcttctgtttactttgaagtt

SEQ ID NO: 7591583 - DNA, 22 bp, Homo sapiens
gtcttctgtttactttgaagtt

SEQ ID NO: 7591584 - DNA, 22 bp, Homo sapiens
gtgaggtcctccctgctgggag

SEQ ID NO: 7591585 - DNA, 22 bp, Homo sapiens
gtgaggtccatgttaatgggtt

SEQ ID NO: 7591586 - DNA, 22 bp, Homo sapiens
gtgaggtcctccctgctgggag

SEQ ID NO: 7591587 - DNA, 22 bp, Homo sapiens
gtgaggtcctgagaggcttgtg

SEQ ID NO: 7591588 - DNA, 19 bp, Homo sapiens
gtgaggtctttccttttgt

SEQ ID NO: 7591589 - DNA, 22 bp, Homo sapiens
gtgaggtgactagcaggtgggg

SEQ ID NO: 7591590 - DNA, 22 bp, Homo sapiens
gtgaggtgactagcaggtgggg

SEQ ID NO: 7591591 - DNA, 22 bp, Homo sapiens
gtgaggtctttgggaggtgatt

SEQ ID NO: 7591592 - DNA, 22 bp, Homo sapiens
gtgaggtgggctgggctctatg

SEQ ID NO: 7591593 - DNA, 22 bp, Homo sapiens
gtgaggtgggctggccagagac

SEQ ID NO: 7591594 - DNA, 22 bp, Homo sapiens
gtgaggtggtacaatattaact

SEQ ID NO: 7591595 - DNA, 22 bp, Homo sapiens
gtgaggtgggctgggctctatg

SEQ ID NO: 7591596 - DNA, 22 bp, Homo sapiens
gtgaggtgggctggccagagac

SEQ ID NO: 7591597 - DNA, 22 bp, Homo sapiens
gtgaggtgggctggccagagac

SEQ ID NO: 7591598 - DNA, 22 bp, Homo sapiens
gtgaggtgggctggccagagac

SEQ ID NO: 7591599 - DNA, 22 bp, Homo sapiens
gtgaggtgcctaataccgtgac

SEQ ID NO: 7591600 - DNA, 22 bp, Homo sapiens
gtgaggtgagtagtgagaagcc

SEQ ID NO: 7591601 - DNA, 22 bp, Homo sapiens
gtgaggtgagtagtgagaagcc

SEQ ID NO: 7591602 - DNA, 22 bp, Homo sapiens
gtgaggtcctaatagacatcga

SEQ ID NO: 7591603 - DNA, 22 bp, Homo sapiens
gtgaggtccagtaacttgtcca

SEQ ID NO: 7591604 - DNA, 22 bp, Homo sapiens
gtgaggtccatgttaatgggtt

SEQ ID NO: 7591605 - DNA, 22 bp, Homo sapiens
gtgaggtcatatagcgaactcc

SEQ ID NO: 7591606 - DNA, 16 bp, Homo sapiens
gtgagggacatagctt

SEQ ID NO: 7591607 - DNA, 16 bp, Homo sapiens
gtgagggacatagctt

SEQ ID NO: 7591608 - DNA, 22 bp, Homo sapiens
gtgagggaggtagatttcatca

SEQ ID NO: 7591609 - DNA, 22 bp, Homo sapiens
gtgaggcattgaagaccggaat

SEQ ID NO: 7591610 - DNA, 22 bp, Homo sapiens
gtgaggcagggaaagaggataa

SEQ ID NO: 7591611 - DNA, 22 bp, Homo sapiens
gtgaggcagggaaagaggataa

SEQ ID NO: 7591612 - DNA, 22 bp, Homo sapiens
gtgaggctactcagctgtccga

SEQ ID NO: 7591613 - DNA, 22 bp, Homo sapiens
gtgaggctactcagctgtccga

SEQ ID NO: 7591614 - DNA, 22 bp, Homo sapiens
gtgaggccgcacgccccggagt

SEQ ID NO: 7591615 - DNA, 22 bp, Homo sapiens
gtgaggccgcacgccccggagt

SEQ ID NO: 7591616 - DNA, 22 bp, Homo sapiens
gtgaggccgcacgccccggagt

SEQ ID NO: 7591617 - DNA, 22 bp, Homo sapiens
gtgcccaggtgtccctgagaag

SEQ ID NO: 7591618 - DNA, 22 bp, Homo sapiens
gtgcccaggtgtccctgagaag

SEQ ID NO: 7591619 - DNA, 22 bp, Homo sapiens
gtgcccaggtgtccctgagaag

SEQ ID NO: 7591620 - DNA, 22 bp, Homo sapiens
gtgcccaggtgtccctgagaag

SEQ ID NO: 7591621 - DNA, 22 bp, Homo sapiens
gtgcccaggtgtccctgagaag

SEQ ID NO: 7591622 - DNA, 22 bp, Homo sapiens
gtgcccaggggccagctgccgg

SEQ ID NO: 7591623 - DNA, 22 bp, Homo sapiens
gtgcccaggtgtccctgagaag

SEQ ID NO: 7591624 - DNA, 22 bp, Homo sapiens
gtgccctgaggtcttcactttg

SEQ ID NO: 7591625 - DNA, 22 bp, Homo sapiens
gtgccctgagcttatgcattct

SEQ ID NO: 7591626 - DNA, 22 bp, Homo sapiens
gtgccctgagcttatgcattct

SEQ ID NO: 7591627 - DNA, 22 bp, Homo sapiens
gtgccctgagcttatgcattct

SEQ ID NO: 7591628 - DNA, 22 bp, Homo sapiens
gtgcccaggggccagctgccgg

SEQ ID NO: 7591629 - DNA, 22 bp, Homo sapiens
gtgcccaggggccagctgccgg

SEQ ID NO: 7591630 - DNA, 22 bp, Homo sapiens
gtgcccaggggccagctgccgg

SEQ ID NO: 7591631 - DNA, 22 bp, Homo sapiens
gtgcccaggggccagctgccgg

SEQ ID NO: 7591632 - DNA, 22 bp, Homo sapiens
gtgcccaggggccagctgccgg

SEQ ID NO: 7591633 - DNA, 22 bp, Homo sapiens
gtgcacagaaattggtaagact

SEQ ID NO: 7591634 - DNA, 22 bp, Homo sapiens
gtgcacagaaacatacaatgtg

SEQ ID NO: 7591635 - DNA, 22 bp, Homo sapiens
gtgcacagaaacatacaatgtg

SEQ ID NO: 7591636 - DNA, 22 bp, Homo sapiens
gtgccctgatgcaattgtctca

SEQ ID NO: 7591637 - DNA, 22 bp, Homo sapiens
gtgccctgatgcaattgtctca

SEQ ID NO: 7591638 - DNA, 22 bp, Homo sapiens
gtgccctgatgcaattgtctca

SEQ ID NO: 7591639 - DNA, 22 bp, Homo sapiens
gtgccctgcatgccccgggtat

SEQ ID NO: 7591640 - DNA, 22 bp, Homo sapiens
gtgccctggatgactttggtct

SEQ ID NO: 7591641 - DNA, 22 bp, Homo sapiens
gtgccctggaggggttgaaggg

SEQ ID NO: 7591642 - DNA, 22 bp, Homo sapiens
gtgccctgcatgccccgggtat

SEQ ID NO: 7591643 - DNA, 22 bp, Homo sapiens
gtgccctggaggggttgaaggg

SEQ ID NO: 7591644 - DNA, 22 bp, Homo sapiens
gtgccctgatcgctaggctccc

SEQ ID NO: 7591645 - DNA, 22 bp, Homo sapiens
gtgccctgatcgctaggctccc

SEQ ID NO: 7591646 - DNA, 22 bp, Homo sapiens
gtgccctgatgcaattgtctca

SEQ ID NO: 7591647 - DNA, 22 bp, Homo sapiens
gtgccctgatcgctaggctccc

SEQ ID NO: 7591648 - DNA, 22 bp, Homo sapiens
gtgccctgagtgggtaggagag

SEQ ID NO: 7591649 - DNA, 22 bp, Homo sapiens
gtgccctgagtgggtaggagag

SEQ ID NO: 7591650 - DNA, 22 bp, Homo sapiens
gtgccctgagtgggtaggagag

SEQ ID NO: 7591651 - DNA, 22 bp, Homo sapiens
gtgcacacatacatgaacgctg

SEQ ID NO: 7591652 - DNA, 22 bp, Homo sapiens
gtgcacacatacatgaacgctg

SEQ ID NO: 7591653 - DNA, 22 bp, Homo sapiens
gtgcacacaagcaatgcactta

SEQ ID NO: 7591654 - DNA, 22 bp, Homo sapiens
gtgcacactcttggggcacttt

SEQ ID NO: 7591655 - DNA, 22 bp, Homo sapiens
gtgcacactcttggggcacttt

SEQ ID NO: 7591656 - DNA, 22 bp, Homo sapiens
gtgcacactcttggggcacttt

SEQ ID NO: 7591657 - DNA, 22 bp, Homo sapiens
gtgcacactcttggggcacttt

SEQ ID NO: 7591658 - DNA, 22 bp, Homo sapiens
gtgcacacaagcaatgcactta

SEQ ID NO: 7591659 - DNA, 22 bp, Homo sapiens
gtgcacacaagcaatgcactta

SEQ ID NO: 7591660 - DNA, 22 bp, Homo sapiens
gtgcaattcactgttatgtctg

SEQ ID NO: 7591661 - DNA, 22 bp, Homo sapiens
gtgcaatgtctgtgatatgaaa

SEQ ID NO: 7591662 - DNA, 22 bp, Homo sapiens
gtgcaattcactgttatgtctg

SEQ ID NO: 7591663 - DNA, 22 bp, Homo sapiens
gtgcaattcactgttatgtctg

SEQ ID NO: 7591664 - DNA, 22 bp, Homo sapiens
gtgcaatctgttgactggactt

SEQ ID NO: 7591665 - DNA, 22 bp, Homo sapiens
gtgcaatctgttgactggactt

SEQ ID NO: 7591666 - DNA, 22 bp, Homo sapiens
gtgcaatcctcatagaactcat

SEQ ID NO: 7591667 - DNA, 18 bp, Homo sapiens
gtgcaatgaatagcagag

SEQ ID NO: 7591668 - DNA, 20 bp, Homo sapiens
gtgcaatggcaccatctcag

SEQ ID NO: 7591669 - DNA, 20 bp, Homo sapiens
gtgcaatggcgcaatctcgg

SEQ ID NO: 7591670 - DNA, 20 bp, Homo sapiens
gtgcaatggcgcaatctcgg

SEQ ID NO: 7591671 - DNA, 20 bp, Homo sapiens
gtgcaatggctcagtctcag

SEQ ID NO: 7591672 - DNA, 22 bp, Homo sapiens
gtgcaatggggcaatatcagct

SEQ ID NO: 7591673 - DNA, 22 bp, Homo sapiens
gtgcaatgtatgtctcaatgat

SEQ ID NO: 7591674 - DNA, 22 bp, Homo sapiens
gtgcaatgtctgtgatatgaaa

SEQ ID NO: 7591675 - DNA, 22 bp, Homo sapiens
gtgcaaccatcaccactgactc

SEQ ID NO: 7591676 - DNA, 22 bp, Homo sapiens
gtgcaacctcgtcagagcacct

SEQ ID NO: 7591677 - DNA, 22 bp, Homo sapiens
gtgcaactaaaaccattgatca

SEQ ID NO: 7591678 - DNA, 22 bp, Homo sapiens
gtgcaagaaggggagactgggt

SEQ ID NO: 7591679 - DNA, 17 bp, Homo sapiens
gtgcaactactggaaga

SEQ ID NO: 7591680 - DNA, 22 bp, Homo sapiens
gtgcaagaaggggagactgggt

SEQ ID NO: 7591681 - DNA, 22 bp, Homo sapiens
gtgcaaattccactggaaagct

SEQ ID NO: 7591682 - DNA, 22 bp, Homo sapiens
gtgcaaattccactggaaagct

SEQ ID NO: 7591683 - DNA, 22 bp, Homo sapiens
gtgcaaatgtaattgtggtttt

SEQ ID NO: 7591684 - DNA, 22 bp, Homo sapiens
gtgcaaatgtaattgtggtttt

SEQ ID NO: 7591685 - DNA, 22 bp, Homo sapiens
gtgcaaatgtaattgtgatttt

SEQ ID NO: 7591686 - DNA, 22 bp, Homo sapiens
gtgcaaattccactggaaagct

SEQ ID NO: 7591687 - DNA, 22 bp, Homo sapiens
gtgcaatattgccatgttcttg

SEQ ID NO: 7591688 - DNA, 22 bp, Homo sapiens
gtgcaagtccagaaagaactct

SEQ ID NO: 7591689 - DNA, 22 bp, Homo sapiens
gtgcaagtccagaaagaactct

SEQ ID NO: 7591690 - DNA, 22 bp, Homo sapiens
gtgcaataaataaatagattgt

SEQ ID NO: 7591691 - DNA, 22 bp, Homo sapiens
gtgcaagtccagaaagaactct

SEQ ID NO: 7591692 - DNA, 22 bp, Homo sapiens
gtgcaagaggacagtaagggtg

SEQ ID NO: 7591693 - DNA, 22 bp, Homo sapiens
gtgcaagcagtacactcaaagc

SEQ ID NO: 7591694 - DNA, 22 bp, Homo sapiens
gtgcaaggtacatccttgatgt

SEQ ID NO: 7591695 - DNA, 22 bp, Homo sapiens
gtgcaagacttcctaagcaata

SEQ ID NO: 7591696 - DNA, 22 bp, Homo sapiens
gtgcaagaggacagtaagggtg

SEQ ID NO: 7591697 - DNA, 22 bp, Homo sapiens
gtgcaaaagtaatggcagtttt

SEQ ID NO: 7591698 - DNA, 22 bp, Homo sapiens
gtgcaaatgtaattgtgatttt

SEQ ID NO: 7591699 - DNA, 22 bp, Homo sapiens
gtgcaaatgtaattgtgatttt

SEQ ID NO: 7591700 - DNA, 22 bp, Homo sapiens
gtgcaaatgtaattgccattga

SEQ ID NO: 7591701 - DNA, 22 bp, Homo sapiens
gtgcaaaagtaactgtggtttt

SEQ ID NO: 7591702 - DNA, 22 bp, Homo sapiens
gtgcaaaagtaactgtggtttt

SEQ ID NO: 7591703 - DNA, 22 bp, Homo sapiens
gtgcaaaagtaactgtggtttt

SEQ ID NO: 7591704 - DNA, 22 bp, Homo sapiens
gtgcaaaagtaaatgtggtttt

SEQ ID NO: 7591705 - DNA, 22 bp, Homo sapiens
gtgcaaaagtaaatgtggtttt

SEQ ID NO: 7591706 - DNA, 22 bp, Homo sapiens
gtgcaaaagtaaatgtggtttt

SEQ ID NO: 7591707 - DNA, 22 bp, Homo sapiens
gtgcaaaaggcattgtggtttt

SEQ ID NO: 7591708 - DNA, 22 bp, Homo sapiens
gtgcaaaaggcattgtggtttt

SEQ ID NO: 7591709 - DNA, 22 bp, Homo sapiens
gtgcaaaaggcattgtggtttt

SEQ ID NO: 7591710 - DNA, 22 bp, Homo sapiens
gtgcaaaagcagttgtggtttt

SEQ ID NO: 7591711 - DNA, 22 bp, Homo sapiens
gtgcaaaagcagttgtggtttt

SEQ ID NO: 7591712 - DNA, 22 bp, Homo sapiens
gtgcaaaagcagttggattttt

SEQ ID NO: 7591713 - DNA, 22 bp, Homo sapiens
gtgcaaaagcagttgtggtttt

SEQ ID NO: 7591714 - DNA, 22 bp, Homo sapiens
gtgcaaaagcagttggattttt

SEQ ID NO: 7591715 - DNA, 22 bp, Homo sapiens
gtgcaaaagcagttggattttt

SEQ ID NO: 7591716 - DNA, 22 bp, Homo sapiens
gtgcaaaagcagttggattttt

SEQ ID NO: 7591717 - DNA, 22 bp, Homo sapiens
gtgcaaaagcaattgcagtttt

SEQ ID NO: 7591718 - DNA, 22 bp, Homo sapiens
gtgcaaaagcaattgcagtttt

SEQ ID NO: 7591719 - DNA, 22 bp, Homo sapiens
gtgcaaaagcaattgcagtttt

SEQ ID NO: 7591720 - DNA, 22 bp, Homo sapiens
gtgcaaaagcaattgcagtttt

SEQ ID NO: 7591721 - DNA, 22 bp, Homo sapiens
gtgcaaaaatctatcaccagca

SEQ ID NO: 7591722 - DNA, 22 bp, Homo sapiens
gtgcaaaaataattgtggtttt

SEQ ID NO: 7591723 - DNA, 22 bp, Homo sapiens
gtgcaaaaataattgtggtttt

SEQ ID NO: 7591724 - DNA, 22 bp, Homo sapiens
gtgcaaaaataattgtggtttt

SEQ ID NO: 7591725 - DNA, 22 bp, Homo sapiens
gtgattttgagacctatatagt

SEQ ID NO: 7591726 - DNA, 22 bp, Homo sapiens
gtgattttgagacctatatagt

SEQ ID NO: 7591727 - DNA, 22 bp, Homo sapiens
gtgatttcaggtttttcatact

SEQ ID NO: 7591728 - DNA, 22 bp, Homo sapiens
gtgattttgagacctatatagt

SEQ ID NO: 7591729 - DNA, 22 bp, Homo sapiens
gtgattttctcctcctagaagt

SEQ ID NO: 7591730 - DNA, 22 bp, Homo sapiens
gtgattctcatgttcctgaagt

SEQ ID NO: 7591731 - DNA, 22 bp, Homo sapiens
gtgattctcaaattgtgatatc

SEQ ID NO: 7591732 - DNA, 22 bp, Homo sapiens
gtgattctcactctagtgcttg

SEQ ID NO: 7591733 - DNA, 22 bp, Homo sapiens
gtgattcatcctggcattcatt

SEQ ID NO: 7591734 - DNA, 22 bp, Homo sapiens
gtgattcattcgattagtattt

SEQ ID NO: 7591735 - DNA, 22 bp, Homo sapiens
gtgattctcaaattgtgatatc

SEQ ID NO: 7591736 - DNA, 22 bp, Homo sapiens
gtgattcctattagtacatgca

SEQ ID NO: 7591737 - DNA, 22 bp, Homo sapiens
gtgattctaaagctttgagcag

SEQ ID NO: 7591738 - DNA, 22 bp, Homo sapiens
gtgattctgatatagctaaagt

SEQ ID NO: 7591739 - DNA, 22 bp, Homo sapiens
gtgattctgaccttcagggagt

SEQ ID NO: 7591740 - DNA, 22 bp, Homo sapiens
gtgattctgaaatattagaaaa

SEQ ID NO: 7591741 - DNA, 22 bp, Homo sapiens
gtgattctgaccttcagggagt

SEQ ID NO: 7591742 - DNA, 22 bp, Homo sapiens
gtgattctgaaatattagaaaa

SEQ ID NO: 7591743 - DNA, 22 bp, Homo sapiens
gtgattctcaaattgtgatatc

SEQ ID NO: 7591744 - DNA, 22 bp, Homo sapiens
gtgattctgaaatattagaaaa

SEQ ID NO: 7591745 - DNA, 23 bp, Homo sapiens
gtgattctctctgtgtgggcagg

SEQ ID NO: 7591746 - DNA, 21 bp, Homo sapiens
gtgattctctgagttttgggg

SEQ ID NO: 7591747 - DNA, 22 bp, Homo sapiens
gtgattatatttctatgtgaat

SEQ ID NO: 7591748 - DNA, 22 bp, Homo sapiens
gtgattatatttctatgtgaat

SEQ ID NO: 7591749 - DNA, 22 bp, Homo sapiens
gtgattatgttatattaaggca

SEQ ID NO: 7591750 - DNA, 22 bp, Homo sapiens
gtgattatttgtgattaaggag

SEQ ID NO: 7591751 - DNA, 22 bp, Homo sapiens
gtgattatatttctatgtgaat

SEQ ID NO: 7591752 - DNA, 22 bp, Homo sapiens
gtgattcaaatgtaactaatta

SEQ ID NO: 7591753 - DNA, 22 bp, Homo sapiens
gtgattcacatctcagatgggc

SEQ ID NO: 7591754 - DNA, 22 bp, Homo sapiens
gtgattcacatctcagatgggc

SEQ ID NO: 7591755 - DNA, 22 bp, Homo sapiens
gtgattcataaaacactagatg

SEQ ID NO: 7591756 - DNA, 22 bp, Homo sapiens
gtgattaagcatttcagaattt

SEQ ID NO: 7591757 - DNA, 15 bp, Homo sapiens
gtgattaagtgcgtt

SEQ ID NO: 7591758 - DNA, 22 bp, Homo sapiens
gtgattaataatggccatgcat

SEQ ID NO: 7591759 - DNA, 22 bp, Homo sapiens
gtgattaatgccaatgggcctt

SEQ ID NO: 7591760 - DNA, 22 bp, Homo sapiens
gtgattaatgctgttggagata

SEQ ID NO: 7591761 - DNA, 22 bp, Homo sapiens
gtgattatagaatgctacaaag

SEQ ID NO: 7591762 - DNA, 22 bp, Homo sapiens
gtgatttcaaatatagagtgag

SEQ ID NO: 7591763 - DNA, 23 bp, Homo sapiens
gtgatttcagggaacagaatcag

SEQ ID NO: 7591764 - DNA, 22 bp, Homo sapiens
gtgatttctaatcatctgaatg

SEQ ID NO: 7591765 - DNA, 22 bp, Homo sapiens
gtgatttctaatcatctgaatg

SEQ ID NO: 7591766 - DNA, 22 bp, Homo sapiens
gtgattgagcaaaggaacagaa

SEQ ID NO: 7591767 - DNA, 22 bp, Homo sapiens
gtgattgatgagaaaggcatag

SEQ ID NO: 7591768 - DNA, 22 bp, Homo sapiens
gtgattgtgaaaacattaagaa

SEQ ID NO: 7591769 - DNA, 22 bp, Homo sapiens
gtgatttagtgagaggcagctg

SEQ ID NO: 7591770 - DNA, 22 bp, Homo sapiens
gtgattctttgatctatgaaag

SEQ ID NO: 7591771 - DNA, 22 bp, Homo sapiens
gtgattcttcctgctggcatac

SEQ ID NO: 7591772 - DNA, 22 bp, Homo sapiens
gtgattcttcctgctggcatac

SEQ ID NO: 7591773 - DNA, 22 bp, Homo sapiens
gtgattctttgatctatgaaag

SEQ ID NO: 7591774 - DNA, 22 bp, Homo sapiens
gtgattcttcctgctggcatac

SEQ ID NO: 7591775 - DNA, 18 bp, Homo sapiens
gtgattcttatttgtaca

SEQ ID NO: 7591776 - DNA, 22 bp, Homo sapiens
gtgattctgtgtgtaaatttta

SEQ ID NO: 7591777 - DNA, 22 bp, Homo sapiens
gtgattctgttctggtgctgcc

SEQ ID NO: 7591778 - DNA, 22 bp, Homo sapiens
gtgattctggcaggcagaaggg

SEQ ID NO: 7591779 - DNA, 22 bp, Homo sapiens
gtgattctggcaggcagaaggg

SEQ ID NO: 7591780 - DNA, 22 bp, Homo sapiens
gtgattctggcaggcagaaggg

SEQ ID NO: 7591781 - DNA, 22 bp, Homo sapiens
gtgattctgcacgtcattcctg

SEQ ID NO: 7591782 - DNA, 22 bp, Homo sapiens
gtgattctgcctggaaggtcct

SEQ ID NO: 7591783 - DNA, 22 bp, Homo sapiens
gtgattctgatatagctaaagt

SEQ ID NO: 7591784 - DNA, 22 bp, Homo sapiens
gtgattctgcacgtcattcctg

SEQ ID NO: 7591785 - DNA, 22 bp, Homo sapiens
gtgcttgcagtgagatgagatg

SEQ ID NO: 7591786 - DNA, 23 bp, Homo sapiens
gtgcttgaaagatgcagaattaa

SEQ ID NO: 7591787 - DNA, 22 bp, Homo sapiens
gtgcttgatctcacctgatctc

SEQ ID NO: 7591788 - DNA, 22 bp, Homo sapiens
gtgcttgggggaagtaacagac

SEQ ID NO: 7591789 - DNA, 22 bp, Homo sapiens
gtgcttggaccaggtcatcttc

SEQ ID NO: 7591790 - DNA, 23 bp, Homo sapiens
gtgcttgaaagatgcagaattaa

SEQ ID NO: 7591791 - DNA, 22 bp, Homo sapiens
gtgctgtatcagaatctgctct

SEQ ID NO: 7591792 - DNA, 22 bp, Homo sapiens
gtgctgtattgagacaaggtcg

SEQ ID NO: 7591793 - DNA, 22 bp, Homo sapiens
gtgctgtattgagacaaggtcg

SEQ ID NO: 7591794 - DNA, 22 bp, Homo sapiens
gtgctgtattgagacaaggtcg

SEQ ID NO: 7591795 - DNA, 22 bp, Homo sapiens
gtgctgtattgagacaaggtcg

SEQ ID NO: 7591796 - DNA, 22 bp, Homo sapiens
gtgctgtcaattgctttcagta

SEQ ID NO: 7591797 - DNA, 22 bp, Homo sapiens
gtgctgtcattagcatctagag

SEQ ID NO: 7591798 - DNA, 22 bp, Homo sapiens
gtgctgtcactggtaaatgcgg

SEQ ID NO: 7591799 - DNA, 22 bp, Homo sapiens
gtgctgtcactggtaaatgcgg

SEQ ID NO: 7591800 - DNA, 22 bp, Homo sapiens
gtgctgtcactggtaaatgcgg

SEQ ID NO: 7591801 - DNA, 22 bp, Homo sapiens
gtgctgtctcaagaaggattct

SEQ ID NO: 7591802 - DNA, 22 bp, Homo sapiens
gtgctgtctccctctcctgagt

SEQ ID NO: 7591803 - DNA, 22 bp, Homo sapiens
gtgctgtattgagacaaggtcg

SEQ ID NO: 7591804 - DNA, 22 bp, Homo sapiens
gtgctgtcattagcatctagag

SEQ ID NO: 7591805 - DNA, 22 bp, Homo sapiens
gtgctgtcgtggaactgggctg

SEQ ID NO: 7591806 - DNA, 22 bp, Homo sapiens
gtgctgtatcagaatctgctct

SEQ ID NO: 7591807 - DNA, 22 bp, Homo sapiens
gtgctgtatcagaatctgctct

SEQ ID NO: 7591808 - DNA, 22 bp, Homo sapiens
gtgctgtatatgcaagaggaag

SEQ ID NO: 7591809 - DNA, 22 bp, Homo sapiens
gtgctgtatatgcaagaggaag

SEQ ID NO: 7591810 - DNA, 22 bp, Homo sapiens
gtgctgtacttctgtgttgaag

SEQ ID NO: 7591811 - DNA, 22 bp, Homo sapiens
gtgctgtaacaacagagtgtct

SEQ ID NO: 7591812 - DNA, 22 bp, Homo sapiens
gtgctgtaacaacagagtgtct

SEQ ID NO: 7591813 - DNA, 22 bp, Homo sapiens
gtgctgggtgctgcagacaggt

SEQ ID NO: 7591814 - DNA, 22 bp, Homo sapiens
gtgctgggtgctgcagacaggt

SEQ ID NO: 7591815 - DNA, 22 bp, Homo sapiens
gtgctgggtgctgcagacaggt

SEQ ID NO: 7591816 - DNA, 22 bp, Homo sapiens
gtgctgggtgctgcagacaggt

SEQ ID NO: 7591817 - DNA, 22 bp, Homo sapiens
gtgctgggggtttctgtaggtc

SEQ ID NO: 7591818 - DNA, 22 bp, Homo sapiens
gtgctgggtgctgcagacaggt

SEQ ID NO: 7591819 - DNA, 22 bp, Homo sapiens
gtgctgggggtttctgtaggtc

SEQ ID NO: 7591820 - DNA, 22 bp, Homo sapiens
gtgctgggggtttctgtaggtc

SEQ ID NO: 7591821 - DNA, 22 bp, Homo sapiens
gtgctgggggtttctgtaggtc

SEQ ID NO: 7591822 - DNA, 22 bp, Homo sapiens
gtgctgggggtttctgtaggtc

SEQ ID NO: 7591823 - DNA, 22 bp, Homo sapiens
gtgctgggtgctgcagacaggt

SEQ ID NO: 7591824 - DNA, 22 bp, Homo sapiens
gtgctgggtgctgcagacaggt

SEQ ID NO: 7591825 - DNA, 22 bp, Homo sapiens
gtgctgggtgctgcagacaggt

SEQ ID NO: 7591826 - DNA, 22 bp, Homo sapiens
gtgctgggtgctgcagacaggt

SEQ ID NO: 7591827 - DNA, 22 bp, Homo sapiens
gtgctgggtgctgcagacaggt

SEQ ID NO: 7591828 - DNA, 22 bp, Homo sapiens
gtgctgggctccaccccagagg

SEQ ID NO: 7591829 - DNA, 22 bp, Homo sapiens
gtgctgggctccaccccagagg

SEQ ID NO: 7591830 - DNA, 22 bp, Homo sapiens
gtgctgggctccaccccagagg

SEQ ID NO: 7591831 - DNA, 22 bp, Homo sapiens
gtgctgggctccaccccagagg

SEQ ID NO: 7591832 - DNA, 22 bp, Homo sapiens
gtgctgggctccaccccagagg

SEQ ID NO: 7591833 - DNA, 22 bp, Homo sapiens
gtgctgggccctgagaccaggg

SEQ ID NO: 7591834 - DNA, 22 bp, Homo sapiens
gtgctgggccctgagaccaggg

SEQ ID NO: 7591835 - DNA, 22 bp, Homo sapiens
gtgctgggccctgagaccaggg

SEQ ID NO: 7591836 - DNA, 22 bp, Homo sapiens
gtgctgggccctgagaccaggg

SEQ ID NO: 7591837 - DNA, 22 bp, Homo sapiens
gtgctgggccctgagaccaggg

SEQ ID NO: 7591838 - DNA, 22 bp, Homo sapiens
gtgctgggccctgagaccaggg

SEQ ID NO: 7591839 - DNA, 22 bp, Homo sapiens
gtgctgggattacaggtgtgag

SEQ ID NO: 7591840 - DNA, 22 bp, Homo sapiens
gtgctgggattacaggtgtgag

SEQ ID NO: 7591841 - DNA, 22 bp, Homo sapiens
gtgctgggattacaggtgtgag

SEQ ID NO: 7591842 - DNA, 22 bp, Homo sapiens
gtgctgggattacaggtgtgag

SEQ ID NO: 7591843 - DNA, 22 bp, Homo sapiens
gtgctgggattacaggtgtgag

SEQ ID NO: 7591844 - DNA, 22 bp, Homo sapiens
gtgctgggattacaggtgtgag

SEQ ID NO: 7591845 - DNA, 22 bp, Homo sapiens
gtgctgggggtttctgtaggtc

SEQ ID NO: 7591846 - DNA, 22 bp, Homo sapiens
gtgctgggggtttctgtaggtc

SEQ ID NO: 7591847 - DNA, 22 bp, Homo sapiens
gtgctgggggtttctgtaggtc

SEQ ID NO: 7591848 - DNA, 22 bp, Homo sapiens
gtgctgggggtttctgtaggtc

SEQ ID NO: 7591849 - DNA, 22 bp, Homo sapiens
gtgctgggggtttctgtaggtc

SEQ ID NO: 7591850 - DNA, 22 bp, Homo sapiens
gtgctgggggtttctgtaggtc

SEQ ID NO: 7591851 - DNA, 22 bp, Homo sapiens
gtgctgggggtttctgtaggtc

SEQ ID NO: 7591852 - DNA, 22 bp, Homo sapiens
gtgctgggggtttctgtaggtc

SEQ ID NO: 7591853 - DNA, 22 bp, Homo sapiens
gtgctgggggtttctgtaggtc

SEQ ID NO: 7591854 - DNA, 22 bp, Homo sapiens
gtgctggggagataggaagaga

SEQ ID NO: 7591855 - DNA, 22 bp, Homo sapiens
gtgctggggagataggaagaga

SEQ ID NO: 7591856 - DNA, 22 bp, Homo sapiens
gtgctggggagataggaagaga

SEQ ID NO: 7591857 - DNA, 22 bp, Homo sapiens
gtgctggggagataggaagaga

SEQ ID NO: 7591858 - DNA, 22 bp, Homo sapiens
gtgctggggagataggaagaga

SEQ ID NO: 7591859 - DNA, 22 bp, Homo sapiens
gtgctggggagataggaagaga

SEQ ID NO: 7591860 - DNA, 22 bp, Homo sapiens
gtgctggggagataggaagaga

SEQ ID NO: 7591861 - DNA, 22 bp, Homo sapiens
gtgcctccatcagtgcctccaa

SEQ ID NO: 7591862 - DNA, 22 bp, Homo sapiens
gtgcctccatcagtgcctccaa

SEQ ID NO: 7591863 - DNA, 22 bp, Homo sapiens
gtgcctccatcagtgcctccaa

SEQ ID NO: 7591864 - DNA, 22 bp, Homo sapiens
gtgcctccaggctcgactagtc

SEQ ID NO: 7591865 - DNA, 22 bp, Homo sapiens
gtgcctccatcagtgcctccaa

SEQ ID NO: 7591866 - DNA, 22 bp, Homo sapiens
gtgcctcccgggaccatgcact

SEQ ID NO: 7591867 - DNA, 22 bp, Homo sapiens
gtgcctcccgggaccatgcact

SEQ ID NO: 7591868 - DNA, 22 bp, Homo sapiens
gtgcctcccgggaccatgcact

SEQ ID NO: 7591869 - DNA, 22 bp, Homo sapiens
gtgcctcccgggaccatgcact

SEQ ID NO: 7591870 - DNA, 22 bp, Homo sapiens
gtgcctccaggctcgactagtc

SEQ ID NO: 7591871 - DNA, 22 bp, Homo sapiens
gtgcctcagcaccgcctgcagc

SEQ ID NO: 7591872 - DNA, 22 bp, Homo sapiens
gtgcctcagcaccgcctgcagc

SEQ ID NO: 7591873 - DNA, 22 bp, Homo sapiens
gtgcctcagcaccgcctgcagc

SEQ ID NO: 7591874 - DNA, 22 bp, Homo sapiens
gtgcctcagcaccgcctgcagc

SEQ ID NO: 7591875 - DNA, 22 bp, Homo sapiens
gtgccgtgggccttagtgatct

SEQ ID NO: 7591876 - DNA, 22 bp, Homo sapiens
gtgcctatgcctgttaatgtct

SEQ ID NO: 7591877 - DNA, 22 bp, Homo sapiens
gtgccgtgggccttagtgatct

SEQ ID NO: 7591878 - DNA, 22 bp, Homo sapiens
gtgccgcgacgcagtcggtgcc

SEQ ID NO: 7591879 - DNA, 22 bp, Homo sapiens
gtgccgcgacgcagtcggtgcc

SEQ ID NO: 7591880 - DNA, 22 bp, Homo sapiens
gtgccgctggagctggaattga

SEQ ID NO: 7591881 - DNA, 22 bp, Homo sapiens
gtgcctgaaagccatgctcact

SEQ ID NO: 7591882 - DNA, 22 bp, Homo sapiens
gtgcctgaaagccatgctcact

SEQ ID NO: 7591883 - DNA, 22 bp, Homo sapiens
gtgcctgagccagctgcagctc

SEQ ID NO: 7591884 - DNA, 22 bp, Homo sapiens
gtgctgggattacaggtgtgag

SEQ ID NO: 7591885 - DNA, 22 bp, Homo sapiens
gtgcctctgagctctgctacag

SEQ ID NO: 7591886 - DNA, 22 bp, Homo sapiens
gtgcctctgaccggagaccagg

SEQ ID NO: 7591887 - DNA, 22 bp, Homo sapiens
gtgcctgaaagccatgctcact

SEQ ID NO: 7591888 - DNA, 22 bp, Homo sapiens
gtgcctcttcacctatgtggtt

SEQ ID NO: 7591889 - DNA, 22 bp, Homo sapiens
gtgcctccttaaattctgcacc

SEQ ID NO: 7591890 - DNA, 22 bp, Homo sapiens
gtgcctccttaaattctgcacc

SEQ ID NO: 7591891 - DNA, 22 bp, Homo sapiens
gtgcctccctgttgactagggt

SEQ ID NO: 7591892 - DNA, 22 bp, Homo sapiens
gtgcctccttaaattctgcacc

SEQ ID NO: 7591893 - DNA, 22 bp, Homo sapiens
gtgcctctcattggctgagccc

SEQ ID NO: 7591894 - DNA, 22 bp, Homo sapiens
gtgcctcccggggctcttcctt

SEQ ID NO: 7591895 - DNA, 22 bp, Homo sapiens
gtgcctcccggggctcttcctt

SEQ ID NO: 7591896 - DNA, 22 bp, Homo sapiens
gtgcctcccggggctcttcctt

SEQ ID NO: 7591897 - DNA, 22 bp, Homo sapiens
gtgcctcccggggctcttcctt

SEQ ID NO: 7591898 - DNA, 22 bp, Homo sapiens
gtgcctcccggggctcttcctt

SEQ ID NO: 7591899 - DNA, 22 bp, Homo sapiens
gtgcctccctgttgactagggt

SEQ ID NO: 7591900 - DNA, 22 bp, Homo sapiens
gtgcctccctgttgactagggt

SEQ ID NO: 7591901 - DNA, 22 bp, Homo sapiens
gtgccctggctcacagtgtctc

SEQ ID NO: 7591902 - DNA, 22 bp, Homo sapiens
gtgccctggctcacagtgtctc

SEQ ID NO: 7591903 - DNA, 22 bp, Homo sapiens
gtgccctggctcacagtgtctc

SEQ ID NO: 7591904 - DNA, 22 bp, Homo sapiens
gtgccctggctcacagtgtctc

SEQ ID NO: 7591905 - DNA, 22 bp, Homo sapiens
gtgccctggctcacagtgtctc

SEQ ID NO: 7591906 - DNA, 22 bp, Homo sapiens
gtgccctggctcacagtgtctc

SEQ ID NO: 7591907 - DNA, 22 bp, Homo sapiens
gtgccctgggccttcagggcca

SEQ ID NO: 7591908 - DNA, 22 bp, Homo sapiens
gtgccctgggccttcagggcca

SEQ ID NO: 7591909 - DNA, 22 bp, Homo sapiens
gtgccctgggccttcagggcca

SEQ ID NO: 7591910 - DNA, 22 bp, Homo sapiens
gtgccctggggtgaacccctgg

SEQ ID NO: 7591911 - DNA, 22 bp, Homo sapiens
gtgccctggggtgaacccctgg

SEQ ID NO: 7591912 - DNA, 22 bp, Homo sapiens
gtgccctggggtgaacccctgg

SEQ ID NO: 7591913 - DNA, 22 bp, Homo sapiens
gtgccctgggccttcagggcca

SEQ ID NO: 7591914 - DNA, 22 bp, Homo sapiens
gtgccctggtccccagcatata

SEQ ID NO: 7591915 - DNA, 22 bp, Homo sapiens
gtgccctggtccccagcatata

SEQ ID NO: 7591916 - DNA, 22 bp, Homo sapiens
gtgccctggtccccagcatata

SEQ ID NO: 7591917 - DNA, 22 bp, Homo sapiens
gtgccctggtccccagcatata

SEQ ID NO: 7591918 - DNA, 21 bp, Homo sapiens
gtgccctgttcccacatgccc

SEQ ID NO: 7591919 - DNA, 22 bp, Homo sapiens
gtgccctgttgcacacttgagg

SEQ ID NO: 7591920 - DNA, 21 bp, Homo sapiens
gtgccctgttcccacatgccc

SEQ ID NO: 7591921 - DNA, 21 bp, Homo sapiens
gtgccctgttcccacatgccc

SEQ ID NO: 7591922 - DNA, 21 bp, Homo sapiens
gtgccctgttcccacatgccc

SEQ ID NO: 7591923 - DNA, 21 bp, Homo sapiens
gtgccctgttcccacatgccc

SEQ ID NO: 7591924 - DNA, 22 bp, Homo sapiens
gtgcccttcagcggcctcatct

SEQ ID NO: 7591925 - DNA, 22 bp, Homo sapiens
gtgcccttcagcggcctcatct

SEQ ID NO: 7591926 - DNA, 22 bp, Homo sapiens
gtgccctgttgcacacttgagg

SEQ ID NO: 7591927 - DNA, 22 bp, Homo sapiens
gtgcccttataatagagaccca

SEQ ID NO: 7591928 - DNA, 22 bp, Homo sapiens
gtgcccttattagatgtcatca

SEQ ID NO: 7591929 - DNA, 22 bp, Homo sapiens
gtgccctgttcatttctctccc

SEQ ID NO: 7591930 - DNA, 22 bp, Homo sapiens
gtgccctgttcatttctctccc

SEQ ID NO: 7591931 - DNA, 20 bp, Homo sapiens
gtgccctgtgggctattttc

SEQ ID NO: 7591932 - DNA, 20 bp, Homo sapiens
gtgccctgtgggctattttc

SEQ ID NO: 7591933 - DNA, 22 bp, Homo sapiens
gtgccctgtctcttgtctccag

SEQ ID NO: 7591934 - DNA, 22 bp, Homo sapiens
gtgccctgtctcttgtctccag

SEQ ID NO: 7591935 - DNA, 22 bp, Homo sapiens
gtgccctgtctcttgtctccag

SEQ ID NO: 7591936 - DNA, 22 bp, Homo sapiens
gtgccctgtgaactgtaaggaa

SEQ ID NO: 7591937 - DNA, 22 bp, Homo sapiens
gtgccctgtgaactgtaaggaa

SEQ ID NO: 7591938 - DNA, 23 bp, Homo sapiens
gggggccgtcctggggattatag

SEQ ID NO: 7591939 - DNA, 23 bp, Homo sapiens
gggggccgtcctggggattatag

SEQ ID NO: 7591940 - DNA, 23 bp, Homo sapiens
gggggccgtcctggggattatag

SEQ ID NO: 7591941 - DNA, 23 bp, Homo sapiens
gggggccgtcctggggattatag

SEQ ID NO: 7591942 - DNA, 22 bp, Homo sapiens
gggggccagtgtctcttccttg

SEQ ID NO: 7591943 - DNA, 22 bp, Homo sapiens
gggggccatcttcaaggatgtg

SEQ ID NO: 7591944 - DNA, 23 bp, Homo sapiens
gggggccgtcctggggattatag

SEQ ID NO: 7591945 - DNA, 23 bp, Homo sapiens
gggggccgtcctggggattatag

SEQ ID NO: 7591946 - DNA, 22 bp, Homo sapiens
gggggccttgttagtggatgga

SEQ ID NO: 7591947 - DNA, 22 bp, Homo sapiens
gggggccttgttagtggatgga

SEQ ID NO: 7591948 - DNA, 22 bp, Homo sapiens
gggggcgcacagtcaccacaaa

SEQ ID NO: 7591949 - DNA, 22 bp, Homo sapiens
gggggccttgttagtggatgga

SEQ ID NO: 7591950 - DNA, 22 bp, Homo sapiens
gggggccttattcatctgccag

SEQ ID NO: 7591951 - DNA, 22 bp, Homo sapiens
gggggccttattcatctgccag

SEQ ID NO: 7591952 - DNA, 22 bp, Homo sapiens
gggggcgccccatggaggtgag

SEQ ID NO: 7591953 - DNA, 22 bp, Homo sapiens
gggggcgccccatggaggtgag

SEQ ID NO: 7591954 - DNA, 22 bp, Homo sapiens
gggggcgccccatggaggtgag

SEQ ID NO: 7591955 - DNA, 22 bp, Homo sapiens
gggggcgccgccgctcatctca

SEQ ID NO: 7591956 - DNA, 22 bp, Homo sapiens
gggggcggagcacgtgaccacg

SEQ ID NO: 7591957 - DNA, 22 bp, Homo sapiens
gggggcggagcacgtgaccacg

SEQ ID NO: 7591958 - DNA, 22 bp, Homo sapiens
gggggcggagcacgtgaccacg

SEQ ID NO: 7591959 - DNA, 22 bp, Homo sapiens
gggggagctagtccagctgagg

SEQ ID NO: 7591960 - DNA, 22 bp, Homo sapiens
gggggagctagtccagctgagg

SEQ ID NO: 7591961 - DNA, 22 bp, Homo sapiens
gggggagctacaggtcccttgg

SEQ ID NO: 7591962 - DNA, 22 bp, Homo sapiens
gggggagctacaggtcccttgg

SEQ ID NO: 7591963 - DNA, 22 bp, Homo sapiens
gggggagctacaggtcccttgg

SEQ ID NO: 7591964 - DNA, 22 bp, Homo sapiens
gggggagagacgagcggctctg

SEQ ID NO: 7591965 - DNA, 22 bp, Homo sapiens
gggggagagacgagcggctctg

SEQ ID NO: 7591966 - DNA, 22 bp, Homo sapiens
gggggagagacgagcggctctg

SEQ ID NO: 7591967 - DNA, 22 bp, Homo sapiens
gggggagaagattctgctgctt

SEQ ID NO: 7591968 - DNA, 22 bp, Homo sapiens
gggggagagacgagcggctctg

SEQ ID NO: 7591969 - DNA, 22 bp, Homo sapiens
gggggcagtaaggatatggaaa

SEQ ID NO: 7591970 - DNA, 22 bp, Homo sapiens
gggggcagtaaggatatggaaa

SEQ ID NO: 7591971 - DNA, 22 bp, Homo sapiens
gggggcagtaaggatatggaaa

SEQ ID NO: 7591972 - DNA, 22 bp, Homo sapiens
gggggcagtaaggatatggaaa

SEQ ID NO: 7591973 - DNA, 22 bp, Homo sapiens
gggggccagtcatctcccaaga

SEQ ID NO: 7591974 - DNA, 22 bp, Homo sapiens
gggggccagtcatctcccaaga

SEQ ID NO: 7591975 - DNA, 22 bp, Homo sapiens
gggggcgggagacagcagtgac

SEQ ID NO: 7591976 - DNA, 22 bp, Homo sapiens
gggggcgggagacagcagtgac

SEQ ID NO: 7591977 - DNA, 23 bp, Homo sapiens
gggggcgtgtcatggagggccac

SEQ ID NO: 7591978 - DNA, 23 bp, Homo sapiens
gggggcgtgtcatggagggccac

SEQ ID NO: 7591979 - DNA, 23 bp, Homo sapiens
gggggcgtgtcatggagggccac

SEQ ID NO: 7591980 - DNA, 22 bp, Homo sapiens
gggggcggagcacgtgaccacg

SEQ ID NO: 7591981 - DNA, 22 bp, Homo sapiens
gggggcggagcacgtgaccacg

SEQ ID NO: 7591982 - DNA, 22 bp, Homo sapiens
gggggcggagcacgtgaccacg

SEQ ID NO: 7591983 - DNA, 22 bp, Homo sapiens
gggggcgggagacagcagtgac

SEQ ID NO: 7591984 - DNA, 22 bp, Homo sapiens
gggggcggagcacgtgaccacg

SEQ ID NO: 7591985 - DNA, 22 bp, Homo sapiens
gggggcgggagacagcagtgac

SEQ ID NO: 7591986 - DNA, 22 bp, Homo sapiens
gggggcgggagacagcagtgac

SEQ ID NO: 7591987 - DNA, 22 bp, Homo sapiens
gggggcgggagacagcagtgac

SEQ ID NO: 7591988 - DNA, 18 bp, Homo sapiens
gggtatccagaactggtc

SEQ ID NO: 7591989 - DNA, 22 bp, Homo sapiens
gggggctaccgtctctggagct

SEQ ID NO: 7591990 - DNA, 23 bp, Homo sapiens
gggggcgtgtcatggagggccac

SEQ ID NO: 7591991 - DNA, 22 bp, Homo sapiens
gggtatgagatataggtgaata

SEQ ID NO: 7591992 - DNA, 22 bp, Homo sapiens
gggtatgagatataggtgaata

SEQ ID NO: 7591993 - DNA, 23 bp, Homo sapiens
gggtatccattatcattactttt

SEQ ID NO: 7591994 - DNA, 22 bp, Homo sapiens
gggtatgatagggaggtgaaat

SEQ ID NO: 7591995 - DNA, 22 bp, Homo sapiens
gggtatgatagggaggtgaaat

SEQ ID NO: 7591996 - DNA, 22 bp, Homo sapiens
gggtcagagcaagactggggtc

SEQ ID NO: 7591997 - DNA, 22 bp, Homo sapiens
gggtcagagcaagactggggtc

SEQ ID NO: 7591998 - DNA, 15 bp, Homo sapiens
gggtatggatgtggt

SEQ ID NO: 7591999 - DNA, 22 bp, Homo sapiens
gggtcaattctgaggtccgttt

SEQ ID NO: 7592000 - DNA, 22 bp, Homo sapiens
gggtcaagccgttgcccaaggc

SEQ ID NO: 7592001 - DNA, 22 bp, Homo sapiens
gggtatttgacaaactgacact

SEQ ID NO: 7592002 - DNA, 22 bp, Homo sapiens
gggtcaagccgttgcccaaggc

SEQ ID NO: 7592003 - DNA, 22 bp, Homo sapiens
gggtcaaggctacatggagacc

SEQ ID NO: 7592004 - DNA, 22 bp, Homo sapiens
gggtcaaggctacatggagacc

SEQ ID NO: 7592005 - DNA, 22 bp, Homo sapiens
gggtcagcgatttcaggggcag

SEQ ID NO: 7592006 - DNA, 22 bp, Homo sapiens
gggtcagctccctccccagggc

SEQ ID NO: 7592007 - DNA, 22 bp, Homo sapiens
gggtcagctccctccccagggc

SEQ ID NO: 7592008 - DNA, 22 bp, Homo sapiens
gggtcagcgatttcaggggcag

SEQ ID NO: 7592009 - DNA, 22 bp, Homo sapiens
gggtcagctgctgggggctgac

SEQ ID NO: 7592010 - DNA, 22 bp, Homo sapiens
gggtcagagtaagcaaggacaa

SEQ ID NO: 7592011 - DNA, 22 bp, Homo sapiens
gggtcagagccgtaacaggact

SEQ ID NO: 7592012 - DNA, 22 bp, Homo sapiens
gggtcagagttcaggtcgaggg

SEQ ID NO: 7592013 - DNA, 22 bp, Homo sapiens
gggtcagagttcaggtcgaggg

SEQ ID NO: 7592014 - DNA, 22 bp, Homo sapiens
ggggcaggagcccttcttcagc

SEQ ID NO: 7592015 - DNA, 22 bp, Homo sapiens
ggggcaggagcccttcttcagc

SEQ ID NO: 7592016 - DNA, 22 bp, Homo sapiens
ggggcaggagcccttcttcagc

SEQ ID NO: 7592017 - DNA, 22 bp, Homo sapiens
ggggcaggagcccttcttcagc

SEQ ID NO: 7592018 - DNA, 22 bp, Homo sapiens
ggggcaggagcccttcttcagc

SEQ ID NO: 7592019 - DNA, 22 bp, Homo sapiens
ggggcaggagcccttcttcagc

SEQ ID NO: 7592020 - DNA, 22 bp, Homo sapiens
ggggcaggagcccttcttcagc

SEQ ID NO: 7592021 - DNA, 22 bp, Homo sapiens
ggggcaggagcccttcttcagc

SEQ ID NO: 7592022 - DNA, 22 bp, Homo sapiens
ggggcaggagcccttcttcagc

SEQ ID NO: 7592023 - DNA, 22 bp, Homo sapiens
ggggcaggagcccttcttcagc

SEQ ID NO: 7592024 - DNA, 22 bp, Homo sapiens
ggggcagctcccgagggcagga

SEQ ID NO: 7592025 - DNA, 22 bp, Homo sapiens
ggggcagctcccgagggcagga

SEQ ID NO: 7592026 - DNA, 22 bp, Homo sapiens
ggggcagctcccgagggcagga

SEQ ID NO: 7592027 - DNA, 22 bp, Homo sapiens
ggggcagctcccgagggcagga

SEQ ID NO: 7592028 - DNA, 22 bp, Homo sapiens
ggggctgtttttggaatggctg

SEQ ID NO: 7592029 - DNA, 22 bp, Homo sapiens
ggggctgtttttggaatggctg

SEQ ID NO: 7592030 - DNA, 22 bp, Homo sapiens
ggggcaggaggtgttctctttt

SEQ ID NO: 7592031 - DNA, 22 bp, Homo sapiens
ggggcaggaggtgttctctttt

SEQ ID NO: 7592032 - DNA, 22 bp, Homo sapiens
ggggcaggaggtgttctctttt

SEQ ID NO: 7592033 - DNA, 22 bp, Homo sapiens
ggggcaggaggtgttctctttt

SEQ ID NO: 7592034 - DNA, 22 bp, Homo sapiens
ggggcaggaggtgttctctttt

SEQ ID NO: 7592035 - DNA, 22 bp, Homo sapiens
ggggcaggaggtgttctctttt

SEQ ID NO: 7592036 - DNA, 22 bp, Homo sapiens
ggggcttttgcacgtgggaggc

SEQ ID NO: 7592037 - DNA, 22 bp, Homo sapiens
ggggcttttgcacgtgggaggc

SEQ ID NO: 7592038 - DNA, 22 bp, Homo sapiens
ggggcttctttctgccaccgac

SEQ ID NO: 7592039 - DNA, 22 bp, Homo sapiens
ggggcttccagcgcccgccggt

SEQ ID NO: 7592040 - DNA, 22 bp, Homo sapiens
gggggaagactgggctagtgat

SEQ ID NO: 7592041 - DNA, 22 bp, Homo sapiens
gggggaagactgggctagtgat

SEQ ID NO: 7592042 - DNA, 22 bp, Homo sapiens
gggggaagactgggctagtgat

SEQ ID NO: 7592043 - DNA, 22 bp, Homo sapiens
gggggaagactgggctagtgat

SEQ ID NO: 7592044 - DNA, 22 bp, Homo sapiens
gggggaagactgggctagtgat

SEQ ID NO: 7592045 - DNA, 22 bp, Homo sapiens
gggggaagactgggctagtgat

SEQ ID NO: 7592046 - DNA, 22 bp, Homo sapiens
gggggaagactgggctagtgat

SEQ ID NO: 7592047 - DNA, 22 bp, Homo sapiens
gggggaagactgggctagtgat

SEQ ID NO: 7592048 - DNA, 22 bp, Homo sapiens
gggggaagactgggctagtgat

SEQ ID NO: 7592049 - DNA, 22 bp, Homo sapiens
gggggaagaaagaacatggcat

SEQ ID NO: 7592050 - DNA, 22 bp, Homo sapiens
gggggaagaaagaacatggcat

SEQ ID NO: 7592051 - DNA, 22 bp, Homo sapiens
gggggaagaaagaacatggcat

SEQ ID NO: 7592052 - DNA, 22 bp, Homo sapiens
gggggaagaaagaacatggcat

SEQ ID NO: 7592053 - DNA, 22 bp, Homo sapiens
gggggaagaaagaacatggcat

SEQ ID NO: 7592054 - DNA, 22 bp, Homo sapiens
gggggaagaaagaacatggcat

SEQ ID NO: 7592055 - DNA, 22 bp, Homo sapiens
gggggaagaaagaacatggcat

SEQ ID NO: 7592056 - DNA, 22 bp, Homo sapiens
gggggaagaaagaacatggcat

SEQ ID NO: 7592057 - DNA, 21 bp, Homo sapiens
gggggaagaggagttgctagt

SEQ ID NO: 7592058 - DNA, 21 bp, Homo sapiens
gggggaagaggagttgctagt

SEQ ID NO: 7592059 - DNA, 21 bp, Homo sapiens
gggggaagaggagttgctagt

SEQ ID NO: 7592060 - DNA, 21 bp, Homo sapiens
gggggaagaggagttgctagt

SEQ ID NO: 7592061 - DNA, 21 bp, Homo sapiens
gggggaagaggagttgctagt

SEQ ID NO: 7592062 - DNA, 22 bp, Homo sapiens
gggggaagaggcatgaagtcct

SEQ ID NO: 7592063 - DNA, 22 bp, Homo sapiens
gggggaagaggcatgaagtcct

SEQ ID NO: 7592064 - DNA, 22 bp, Homo sapiens
gggggaagaggcatgaagtcct

SEQ ID NO: 7592065 - DNA, 22 bp, Homo sapiens
gggggaagtaattataaaccaa

SEQ ID NO: 7592066 - DNA, 22 bp, Homo sapiens
gggggaagaggcatgaagtcct

SEQ ID NO: 7592067 - DNA, 22 bp, Homo sapiens
gggggactggaccgtcctgggt

SEQ ID NO: 7592068 - DNA, 22 bp, Homo sapiens
gggggactaactggatcctgga

SEQ ID NO: 7592069 - DNA, 22 bp, Homo sapiens
gggggagaagattctgctgctt

SEQ ID NO: 7592070 - DNA, 22 bp, Homo sapiens
gggggactggaccgtcctgggt

SEQ ID NO: 7592071 - DNA, 22 bp, Homo sapiens
gggggagaagattctgctgctt

SEQ ID NO: 7592072 - DNA, 22 bp, Homo sapiens
gggggagaagattctgctgctt

SEQ ID NO: 7592073 - DNA, 22 bp, Homo sapiens
gggggacaggatgaatatctgt

SEQ ID NO: 7592074 - DNA, 22 bp, Homo sapiens
gggggaagtaattataaaccaa

SEQ ID NO: 7592075 - DNA, 22 bp, Homo sapiens
gggggaagtaattataaaccaa

SEQ ID NO: 7592076 - DNA, 22 bp, Homo sapiens
gggggaagtaattataaaccaa

SEQ ID NO: 7592077 - DNA, 22 bp, Homo sapiens
gggggactaactggatcctgga

SEQ ID NO: 7592078 - DNA, 22 bp, Homo sapiens
ggggcagaaagcccacagagtg

SEQ ID NO: 7592079 - DNA, 22 bp, Homo sapiens
ggggcagaaagcccacagagtg

SEQ ID NO: 7592080 - DNA, 22 bp, Homo sapiens
ggggcagaaagcccacagagtg

SEQ ID NO: 7592081 - DNA, 22 bp, Homo sapiens
ggggcagaagtagtgcccctga

SEQ ID NO: 7592082 - DNA, 22 bp, Homo sapiens
ggggcagaaagcccacagagtg

SEQ ID NO: 7592083 - DNA, 22 bp, Homo sapiens
ggggcagaaagcccacagagtg

SEQ ID NO: 7592084 - DNA, 22 bp, Homo sapiens
ggggcagaaagcccacagagtg

SEQ ID NO: 7592085 - DNA, 22 bp, Homo sapiens
ggggcagaaagcccacagagtg

SEQ ID NO: 7592086 - DNA, 22 bp, Homo sapiens
ggggcagaaagcccacagagtg

SEQ ID NO: 7592087 - DNA, 22 bp, Homo sapiens
ggggcagaaagcccacagagtg

SEQ ID NO: 7592088 - DNA, 22 bp, Homo sapiens
ggggcagctaccggaagtaggg

SEQ ID NO: 7592089 - DNA, 22 bp, Homo sapiens
ggggcagctcccgagggcagga

SEQ ID NO: 7592090 - DNA, 22 bp, Homo sapiens
ggggcagctcccgagggcagga

SEQ ID NO: 7592091 - DNA, 22 bp, Homo sapiens
ggggcagctcccgagggcagga

SEQ ID NO: 7592092 - DNA, 22 bp, Homo sapiens
ggggcagctcccgagggcagga

SEQ ID NO: 7592093 - DNA, 22 bp, Homo sapiens
ggggcagctaccggaagtaggg

SEQ ID NO: 7592094 - DNA, 22 bp, Homo sapiens
ggggcagctaccggaagtaggg

SEQ ID NO: 7592095 - DNA, 22 bp, Homo sapiens
ggggcagaagtagtgcccctga

SEQ ID NO: 7592096 - DNA, 22 bp, Homo sapiens
ggggcagaagtagtgcccctga

SEQ ID NO: 7592097 - DNA, 22 bp, Homo sapiens
ggggcacacttttggtagatat

SEQ ID NO: 7592098 - DNA, 22 bp, Homo sapiens
ggggcacacttttggtagatat

SEQ ID NO: 7592099 - DNA, 22 bp, Homo sapiens
ggggcacacttttggtagatat

SEQ ID NO: 7592100 - DNA, 22 bp, Homo sapiens
ggggcacacttttggtagatat

SEQ ID NO: 7592101 - DNA, 22 bp, Homo sapiens
ggggcaaagggagagtccctac

SEQ ID NO: 7592102 - DNA, 22 bp, Homo sapiens
ggggatggtgggaaggcaatct

SEQ ID NO: 7592103 - DNA, 22 bp, Homo sapiens
ggggcaaagggagagtccctac

SEQ ID NO: 7592104 - DNA, 22 bp, Homo sapiens
ggggatggtgggaaggcaatct

SEQ ID NO: 7592105 - DNA, 22 bp, Homo sapiens
ggggcacttccaggctgaggct

SEQ ID NO: 7592106 - DNA, 22 bp, Homo sapiens
ggggcacttccaggctgaggct

SEQ ID NO: 7592107 - DNA, 22 bp, Homo sapiens
ggggcactttactgcctcatct

SEQ ID NO: 7592108 - DNA, 22 bp, Homo sapiens
ggggcactttactgcctcatct

SEQ ID NO: 7592109 - DNA, 22 bp, Homo sapiens
ggggcactttactgcctcatct

SEQ ID NO: 7592110 - DNA, 22 bp, Homo sapiens
ggggcacttggcacctctgcag

SEQ ID NO: 7592111 - DNA, 22 bp, Homo sapiens
ggggcacctcctcttggcaatt

SEQ ID NO: 7592112 - DNA, 22 bp, Homo sapiens
ggggcacacttttggtagatat

SEQ ID NO: 7592113 - DNA, 22 bp, Homo sapiens
ggggcacttccaggctgaggct

SEQ ID NO: 7592114 - DNA, 22 bp, Homo sapiens
ggggcacttccaggctgaggct

SEQ ID NO: 7592115 - DNA, 22 bp, Homo sapiens
ggggatggtggcatttgtaaaa

SEQ ID NO: 7592116 - DNA, 22 bp, Homo sapiens
ggggatggtgggaaggcaatct

SEQ ID NO: 7592117 - DNA, 22 bp, Homo sapiens
ggggatggtgggaaggcaatct

SEQ ID NO: 7592118 - DNA, 22 bp, Homo sapiens
ggggatggtgggaaggcaatct

SEQ ID NO: 7592119 - DNA, 22 bp, Homo sapiens
ggggatggtagaccggtgacgt

SEQ ID NO: 7592120 - DNA, 22 bp, Homo sapiens
ggggatggtagaccggtgacgt

SEQ ID NO: 7592121 - DNA, 22 bp, Homo sapiens
ggggatggtagaccggtgacgt

SEQ ID NO: 7592122 - DNA, 22 bp, Homo sapiens
ggggatggattccgggtccctg

SEQ ID NO: 7592123 - DNA, 22 bp, Homo sapiens
ggggatggattccgggtccctg

SEQ ID NO: 7592124 - DNA, 22 bp, Homo sapiens
ggggatggattccgggtccctg

SEQ ID NO: 7592125 - DNA, 22 bp, Homo sapiens
ggggatggattccgggtccctg

SEQ ID NO: 7592126 - DNA, 22 bp, Homo sapiens
ggggatggtagaccggtgacgt

SEQ ID NO: 7592127 - DNA, 22 bp, Homo sapiens
ggggatggtagaccggtgacgt

SEQ ID NO: 7592128 - DNA, 22 bp, Homo sapiens
ggggatggtagaccggtgacgt

SEQ ID NO: 7592129 - DNA, 22 bp, Homo sapiens
ggggatggtagaccggtgacgt

SEQ ID NO: 7592130 - DNA, 22 bp, Homo sapiens
ggggatggattccgggtccctg

SEQ ID NO: 7592131 - DNA, 22 bp, Homo sapiens
ggggatggaatgtagtagtgat

SEQ ID NO: 7592132 - DNA, 22 bp, Homo sapiens
ggggatggaggcgtgtggtcct

SEQ ID NO: 7592133 - DNA, 22 bp, Homo sapiens
ggggatggaggcgtgtggtcct

SEQ ID NO: 7592134 - DNA, 22 bp, Homo sapiens
ggggatggaggcgtgtggtcct

SEQ ID NO: 7592135 - DNA, 22 bp, Homo sapiens
ggggatggaggcgtgtggtcct

SEQ ID NO: 7592136 - DNA, 22 bp, Homo sapiens
ggggatggaggcgtgtggtcct

SEQ ID NO: 7592137 - DNA, 22 bp, Homo sapiens
ggggatggaggcgtgtggtcct

SEQ ID NO: 7592138 - DNA, 22 bp, Homo sapiens
ggggatggaggcgtgtggtcct

SEQ ID NO: 7592139 - DNA, 22 bp, Homo sapiens
ggggatggaggcgtgtggtcct

SEQ ID NO: 7592140 - DNA, 22 bp, Homo sapiens
ggggatggaatgtagtagtgat

SEQ ID NO: 7592141 - DNA, 22 bp, Homo sapiens
ggggatggaatgtagtagtgat

SEQ ID NO: 7592142 - DNA, 22 bp, Homo sapiens
ggggatggaatgtagtagtgat

SEQ ID NO: 7592143 - DNA, 22 bp, Homo sapiens
ggggatggaatgtagtagtgat

SEQ ID NO: 7592144 - DNA, 22 bp, Homo sapiens
ggggatggaatgtagtagtgat

SEQ ID NO: 7592145 - DNA, 22 bp, Homo sapiens
ggggatggaatgtagtagtgat

SEQ ID NO: 7592146 - DNA, 22 bp, Homo sapiens
ggggatggaatgtagtagtgat

SEQ ID NO: 7592147 - DNA, 22 bp, Homo sapiens
ggggatggaatgtagtagtgat

SEQ ID NO: 7592148 - DNA, 22 bp, Homo sapiens
gggctgggcatggtgttccctc

SEQ ID NO: 7592149 - DNA, 22 bp, Homo sapiens
gggctgggcatggtgttccctc

SEQ ID NO: 7592150 - DNA, 22 bp, Homo sapiens
gggctgggcatggtgttccctc

SEQ ID NO: 7592151 - DNA, 22 bp, Homo sapiens
gggctggggctcaataatttgt

SEQ ID NO: 7592152 - DNA, 22 bp, Homo sapiens
gggctgggcatggtgttccctc

SEQ ID NO: 7592153 - DNA, 22 bp, Homo sapiens
gggctgggcatggtgttccctc

SEQ ID NO: 7592154 - DNA, 22 bp, Homo sapiens
gggctgggcatggtgttccctc

SEQ ID NO: 7592155 - DNA, 22 bp, Homo sapiens
gggctgggcatggtgttccctc

SEQ ID NO: 7592156 - DNA, 22 bp, Homo sapiens
gggctgggcatggtgttccctc

SEQ ID NO: 7592157 - DNA, 22 bp, Homo sapiens
gggctgggcatggtgttccctc

SEQ ID NO: 7592158 - DNA, 22 bp, Homo sapiens
gggctggggctcaataatttgt

SEQ ID NO: 7592159 - DNA, 22 bp, Homo sapiens
gggctggggctcaataatttgt

SEQ ID NO: 7592160 - DNA, 22 bp, Homo sapiens
gggctggggctcaataatttgt

SEQ ID NO: 7592161 - DNA, 22 bp, Homo sapiens
gggctggggctcaataatttgt

SEQ ID NO: 7592162 - DNA, 22 bp, Homo sapiens
gggctggggctcaataatttgt

SEQ ID NO: 7592163 - DNA, 22 bp, Homo sapiens
gggctggggctcaataatttgt

SEQ ID NO: 7592164 - DNA, 22 bp, Homo sapiens
gggctggggctcaataatttgt

SEQ ID NO: 7592165 - DNA, 22 bp, Homo sapiens
gggctggggctcaataatttgt

SEQ ID NO: 7592166 - DNA, 16 bp, Homo sapiens
gggctgggggattctg

SEQ ID NO: 7592167 - DNA, 22 bp, Homo sapiens
gggctggggctcaataatttgt

SEQ ID NO: 7592168 - DNA, 22 bp, Homo sapiens
gggctgggattgcttgctgtga

SEQ ID NO: 7592169 - DNA, 22 bp, Homo sapiens
gggctgggattgcttgctgtga

SEQ ID NO: 7592170 - DNA, 22 bp, Homo sapiens
gggctgggattgcttgctgtga

SEQ ID NO: 7592171 - DNA, 22 bp, Homo sapiens
gggctgggattgcttgctgtga

SEQ ID NO: 7592172 - DNA, 22 bp, Homo sapiens
gggctgggattgcttgctgtga

SEQ ID NO: 7592173 - DNA, 22 bp, Homo sapiens
gggctgggattgcttgctgtga

SEQ ID NO: 7592174 - DNA, 22 bp, Homo sapiens
gggctgggattgcttgctgtga

SEQ ID NO: 7592175 - DNA, 22 bp, Homo sapiens
gggctgggattgcttgctgtga

SEQ ID NO: 7592176 - DNA, 22 bp, Homo sapiens
gggctgggattgcttgctgtga

SEQ ID NO: 7592177 - DNA, 22 bp, Homo sapiens
gggctgggcatggtgttccctc

SEQ ID NO: 7592178 - DNA, 22 bp, Homo sapiens
gggctgggattgcttgctgtga

SEQ ID NO: 7592179 - DNA, 22 bp, Homo sapiens
gggctgggattgcttgctgtga

SEQ ID NO: 7592180 - DNA, 22 bp, Homo sapiens
gggctgggattgcttgctgtga

SEQ ID NO: 7592181 - DNA, 22 bp, Homo sapiens
gggctgggcatggtgttccctc

SEQ ID NO: 7592182 - DNA, 22 bp, Homo sapiens
gggctgggcatggtgttccctc

SEQ ID NO: 7592183 - DNA, 22 bp, Homo sapiens
gggctgggcatggtgttccctc

SEQ ID NO: 7592184 - DNA, 22 bp, Homo sapiens
gggctgggcatggtgttccctc

SEQ ID NO: 7592185 - DNA, 22 bp, Homo sapiens
gggctgggcatggtgttccctc

SEQ ID NO: 7592186 - DNA, 22 bp, Homo sapiens
gggctgggcatggtgttccctc

SEQ ID NO: 7592187 - DNA, 22 bp, Homo sapiens
gggctgggattgcttgctgtga

SEQ ID NO: 7592188 - DNA, 22 bp, Homo sapiens
gggctgggatggcttgaagatt

SEQ ID NO: 7592189 - DNA, 22 bp, Homo sapiens
gggctgggatggcttgaagatt

SEQ ID NO: 7592190 - DNA, 22 bp, Homo sapiens
gggctgggatggcttgaagatt

SEQ ID NO: 7592191 - DNA, 22 bp, Homo sapiens
gggctgggatggcttgaagatt

SEQ ID NO: 7592192 - DNA, 22 bp, Homo sapiens
gggctgggatggcttgaagatt

SEQ ID NO: 7592193 - DNA, 22 bp, Homo sapiens
gggctgggatggcttgaagatt

SEQ ID NO: 7592194 - DNA, 22 bp, Homo sapiens
gggctgggatggcttgaagatt

SEQ ID NO: 7592195 - DNA, 22 bp, Homo sapiens
gggctgggaatggctaagtatg

SEQ ID NO: 7592196 - DNA, 22 bp, Homo sapiens
gggctgggaatggctaagtatg

SEQ ID NO: 7592197 - DNA, 22 bp, Homo sapiens
gggctgggaatggctaagtatg

SEQ ID NO: 7592198 - DNA, 22 bp, Homo sapiens
gggctgggaatggctaagtatg

SEQ ID NO: 7592199 - DNA, 22 bp, Homo sapiens
gggctgggatggcttgaagatt

SEQ ID NO: 7592200 - DNA, 22 bp, Homo sapiens
gggctgggatggcttgaagatt

SEQ ID NO: 7592201 - DNA, 22 bp, Homo sapiens
gggctgggatggcttgaagatt

SEQ ID NO: 7592202 - DNA, 22 bp, Homo sapiens
gggctgggatggcttgaagatt

SEQ ID NO: 7592203 - DNA, 22 bp, Homo sapiens
gggctgggatggcttgaagatt

SEQ ID NO: 7592204 - DNA, 22 bp, Homo sapiens
gggctgggaatggctaagtatg

SEQ ID NO: 7592205 - DNA, 22 bp, Homo sapiens
gggctgggaatggctaagtatg

SEQ ID NO: 7592206 - DNA, 22 bp, Homo sapiens
gggctgggaatggctaagtatg

SEQ ID NO: 7592207 - DNA, 22 bp, Homo sapiens
gggctgggaatggctaagtatg

SEQ ID NO: 7592208 - DNA, 22 bp, Homo sapiens
gggctgggaatggctaagtatg

SEQ ID NO: 7592209 - DNA, 22 bp, Homo sapiens
gggctggctgattttcctctct

SEQ ID NO: 7592210 - DNA, 22 bp, Homo sapiens
gggctgggaatggctaagtatg

SEQ ID NO: 7592211 - DNA, 22 bp, Homo sapiens
gggctggctgattttcctctct

SEQ ID NO: 7592212 - DNA, 22 bp, Homo sapiens
gggctggctgattttcctctct

SEQ ID NO: 7592213 - DNA, 22 bp, Homo sapiens
gggctggctgattttcctctct

SEQ ID NO: 7592214 - DNA, 22 bp, Homo sapiens
gggctggctgattttcctctct

SEQ ID NO: 7592215 - DNA, 22 bp, Homo sapiens
gggctggctgattttcctctct

SEQ ID NO: 7592216 - DNA, 22 bp, Homo sapiens
gggctggctctgtctagaaagg

SEQ ID NO: 7592217 - DNA, 22 bp, Homo sapiens
gggctggctctgtctagaaagg

SEQ ID NO: 7592218 - DNA, 22 bp, Homo sapiens
gggctggctcccaggtgttgaa

SEQ ID NO: 7592219 - DNA, 18 bp, Homo sapiens
gggcatcattcacaaagt

SEQ ID NO: 7592220 - DNA, 22 bp, Homo sapiens
gggcatcaccaagaaggaggac

SEQ ID NO: 7592221 - DNA, 22 bp, Homo sapiens
gggcatccagagggatgcctgg

SEQ ID NO: 7592222 - DNA, 22 bp, Homo sapiens
gggcatccagagggatgcctgg

SEQ ID NO: 7592223 - DNA, 21 bp, Homo sapiens
gggcatcctttcccaccctgc

SEQ ID NO: 7592224 - DNA, 22 bp, Homo sapiens
gggcatcttgtagccttcactt

SEQ ID NO: 7592225 - DNA, 22 bp, Homo sapiens
gggcatctggtggagcctcagg

SEQ ID NO: 7592226 - DNA, 21 bp, Homo sapiens
gggcatcctttcccaccctgc

SEQ ID NO: 7592227 - DNA, 22 bp, Homo sapiens
gggcagtgttgtggttctctat

SEQ ID NO: 7592228 - DNA, 22 bp, Homo sapiens
gggcagtgttgtggttctctat

SEQ ID NO: 7592229 - DNA, 22 bp, Homo sapiens
gggcagtgttgtggttctctat

SEQ ID NO: 7592230 - DNA, 22 bp, Homo sapiens
gggcagtttattctagatggtt

SEQ ID NO: 7592231 - DNA, 19 bp, Homo sapiens
gggcatcaaagtgctggtg

SEQ ID NO: 7592232 - DNA, 19 bp, Homo sapiens
gggcatcaaagtgctggtg

SEQ ID NO: 7592233 - DNA, 20 bp, Homo sapiens
gggcagttcaatgccactct

SEQ ID NO: 7592234 - DNA, 22 bp, Homo sapiens
gggcatgacttttggagtggga

SEQ ID NO: 7592235 - DNA, 22 bp, Homo sapiens
gggcatgagaggcaggcaagtg

SEQ ID NO: 7592236 - DNA, 22 bp, Homo sapiens
gggcatgacttttggagtggga

SEQ ID NO: 7592237 - DNA, 22 bp, Homo sapiens
gggcatgacttttggagtggga

SEQ ID NO: 7592238 - DNA, 22 bp, Homo sapiens
gggcatgagaggcaggcaagtg

SEQ ID NO: 7592239 - DNA, 20 bp, Homo sapiens
gggcatctttgctcctgttt

SEQ ID NO: 7592240 - DNA, 20 bp, Homo sapiens
gggcatctttgctcctgttt

SEQ ID NO: 7592241 - DNA, 22 bp, Homo sapiens
gggcatgacttttggagtggga

SEQ ID NO: 7592242 - DNA, 22 bp, Homo sapiens
gggcatgacttttggagtggga

SEQ ID NO: 7592243 - DNA, 22 bp, Homo sapiens
gggcatgacttttggagtggga

SEQ ID NO: 7592244 - DNA, 22 bp, Homo sapiens
gggcatgacttttggagtggga

SEQ ID NO: 7592245 - DNA, 22 bp, Homo sapiens
gggcatgagagggcagctggca

SEQ ID NO: 7592246 - DNA, 22 bp, Homo sapiens
gggcatgagagggcagctggca

SEQ ID NO: 7592247 - DNA, 22 bp, Homo sapiens
gggcatgagagggcagctggca

SEQ ID NO: 7592248 - DNA, 22 bp, Homo sapiens
gggcatgagatggtagtagctt

SEQ ID NO: 7592249 - DNA, 22 bp, Homo sapiens
gggcatgagcacatagtgtcta

SEQ ID NO: 7592250 - DNA, 22 bp, Homo sapiens
gggcatgagcacatagtgtcta

SEQ ID NO: 7592251 - DNA, 22 bp, Homo sapiens
gggcatgagcgagctgctttga

SEQ ID NO: 7592252 - DNA, 22 bp, Homo sapiens
gggcatgagcgagctgctttga

SEQ ID NO: 7592253 - DNA, 22 bp, Homo sapiens
gggcatgcctgagcctgccact

SEQ ID NO: 7592254 - DNA, 22 bp, Homo sapiens
gggcatgcctgagcctgccact

SEQ ID NO: 7592255 - DNA, 22 bp, Homo sapiens
gggcatgcctgagcctgccact

SEQ ID NO: 7592256 - DNA, 22 bp, Homo sapiens
gggcatgcaggactgtggcaga

SEQ ID NO: 7592257 - DNA, 22 bp, Homo sapiens
gggcatgcaggactgtggcaga

SEQ ID NO: 7592258 - DNA, 22 bp, Homo sapiens
gggcatgagcgagctgctttga

SEQ ID NO: 7592259 - DNA, 22 bp, Homo sapiens
gggcatgagcacatagtgtcta

SEQ ID NO: 7592260 - DNA, 22 bp, Homo sapiens
gggcatgcaggactgtggcaga

SEQ ID NO: 7592261 - DNA, 22 bp, Homo sapiens
gggcctcagctgccaacaggat

SEQ ID NO: 7592262 - DNA, 22 bp, Homo sapiens
gggcctcagctgccaacaggat

SEQ ID NO: 7592263 - DNA, 22 bp, Homo sapiens
gggcctcagctggagtctgcct

SEQ ID NO: 7592264 - DNA, 22 bp, Homo sapiens
gggcctcagctgccaacaggat

SEQ ID NO: 7592265 - DNA, 22 bp, Homo sapiens
gggcctcagctgccaacaggat

SEQ ID NO: 7592266 - DNA, 22 bp, Homo sapiens
gggcctcagctctgctctgcaa

SEQ ID NO: 7592267 - DNA, 22 bp, Homo sapiens
gggcatgcctgcgcagtgcatg

SEQ ID NO: 7592268 - DNA, 22 bp, Homo sapiens
gggcctcagctctgctctgcaa

SEQ ID NO: 7592269 - DNA, 22 bp, Homo sapiens
gggcctcagctctgctctgcaa

SEQ ID NO: 7592270 - DNA, 22 bp, Homo sapiens
gggcctcaggttctggagaagg

SEQ ID NO: 7592271 - DNA, 22 bp, Homo sapiens
gggcctcaggccttgctctgtg

SEQ ID NO: 7592272 - DNA, 22 bp, Homo sapiens
gggcctcatgatggctcaggaa

SEQ ID NO: 7592273 - DNA, 22 bp, Homo sapiens
gggcctcatgatggctcaggaa

SEQ ID NO: 7592274 - DNA, 22 bp, Homo sapiens
gggcctcagctggagtctgcct

SEQ ID NO: 7592275 - DNA, 22 bp, Homo sapiens
gggcctcatgatggctcaggaa

SEQ ID NO: 7592276 - DNA, 22 bp, Homo sapiens
gggcctcagctggagtctgcct

SEQ ID NO: 7592277 - DNA, 22 bp, Homo sapiens
gggcctcagctggagtctgcct

SEQ ID NO: 7592278 - DNA, 22 bp, Homo sapiens
gggcctcaggccttgctctgtg

SEQ ID NO: 7592279 - DNA, 22 bp, Homo sapiens
gggcctcaggccttgctctgtg

SEQ ID NO: 7592280 - DNA, 22 bp, Homo sapiens
gggcctcaggccttgctctgtg

SEQ ID NO: 7592281 - DNA, 22 bp, Homo sapiens
gggcctctccggcctttgcatc

SEQ ID NO: 7592282 - DNA, 22 bp, Homo sapiens
gggcctctccggcctttgcatc

SEQ ID NO: 7592283 - DNA, 22 bp, Homo sapiens
gggcctgaaaccttcagggctt

SEQ ID NO: 7592284 - DNA, 22 bp, Homo sapiens
gggcctgaaaccttcagggctt

SEQ ID NO: 7592285 - DNA, 22 bp, Homo sapiens
gggcctgaaaccttcagggctt

SEQ ID NO: 7592286 - DNA, 22 bp, Homo sapiens
gggcctccgtgtgctggtgctc

SEQ ID NO: 7592287 - DNA, 22 bp, Homo sapiens
gggcctccgtgtgctggtgctc

SEQ ID NO: 7592288 - DNA, 22 bp, Homo sapiens
gggcctccgtgtgctggtgctc

SEQ ID NO: 7592289 - DNA, 22 bp, Homo sapiens
gggcctccgtgtgctggtgctc

SEQ ID NO: 7592290 - DNA, 22 bp, Homo sapiens
gggcctccgtgtgctggtgctc

SEQ ID NO: 7592291 - DNA, 22 bp, Homo sapiens
gggcctccgtgtgctggtgctc

SEQ ID NO: 7592292 - DNA, 22 bp, Homo sapiens
gggcctccgtgtgctggtgctc

SEQ ID NO: 7592293 - DNA, 22 bp, Homo sapiens
gggcctcatgatggctcaggaa

SEQ ID NO: 7592294 - DNA, 22 bp, Homo sapiens
gggcctccggggtgagctgtgg

SEQ ID NO: 7592295 - DNA, 22 bp, Homo sapiens
gggcctccggggtgagctgtgg

SEQ ID NO: 7592296 - DNA, 22 bp, Homo sapiens
gggcctcatgatggctcaggaa

SEQ ID NO: 7592297 - DNA, 22 bp, Homo sapiens
gggcctgctccccatcgctgct

SEQ ID NO: 7592298 - DNA, 22 bp, Homo sapiens
gggcctgctccccatcgctgct

SEQ ID NO: 7592299 - DNA, 22 bp, Homo sapiens
gggcctgctccccatcgctgct

SEQ ID NO: 7592300 - DNA, 22 bp, Homo sapiens
gggcctgctccccatcgctgct

SEQ ID NO: 7592301 - DNA, 22 bp, Homo sapiens
gggcctgctgcaggttcaggat

SEQ ID NO: 7592302 - DNA, 22 bp, Homo sapiens
gggcctgctgcaggttcaggat

SEQ ID NO: 7592303 - DNA, 22 bp, Homo sapiens
gggcctgctccccatcgctgct

SEQ ID NO: 7592304 - DNA, 22 bp, Homo sapiens
gggcctgctgcaggttcaggat

SEQ ID NO: 7592305 - DNA, 22 bp, Homo sapiens
gggcctgctccccatcgctgct

SEQ ID NO: 7592306 - DNA, 22 bp, Homo sapiens
gggcctgccattgctgccccag

SEQ ID NO: 7592307 - DNA, 22 bp, Homo sapiens
gggcctgccattgctgccccag

SEQ ID NO: 7592308 - DNA, 22 bp, Homo sapiens
gggcctgccattgctgccccag

SEQ ID NO: 7592309 - DNA, 22 bp, Homo sapiens
gggcctggcatgcagccccgtt

SEQ ID NO: 7592310 - DNA, 22 bp, Homo sapiens
gggcctggcatgcagccccgtt

SEQ ID NO: 7592311 - DNA, 21 bp, Homo sapiens
gggcctggctgcgcaggacgg

SEQ ID NO: 7592312 - DNA, 21 bp, Homo sapiens
gggcctggctgcgcaggacgg

SEQ ID NO: 7592313 - DNA, 21 bp, Homo sapiens
gggcctggctgcgcaggacgg

SEQ ID NO: 7592314 - DNA, 21 bp, Homo sapiens
gggcctggctgcgcaggacgg

SEQ ID NO: 7592315 - DNA, 21 bp, Homo sapiens
gggcctggctgcgcaggacgg

SEQ ID NO: 7592316 - DNA, 22 bp, Homo sapiens
gggcctggcatgcagccccgtt

SEQ ID NO: 7592317 - DNA, 22 bp, Homo sapiens
gggcctggcatgcagccccgtt

SEQ ID NO: 7592318 - DNA, 22 bp, Homo sapiens
gggcctggcatgcagccccgtt

SEQ ID NO: 7592319 - DNA, 22 bp, Homo sapiens
gggcctggcatgcagccccgtt

SEQ ID NO: 7592320 - DNA, 22 bp, Homo sapiens
gggcctgctggtgcttccattg

SEQ ID NO: 7592321 - DNA, 22 bp, Homo sapiens
gggcctgctggtgcttccattg

SEQ ID NO: 7592322 - DNA, 22 bp, Homo sapiens
gggcctgctggtgcttccattg

SEQ ID NO: 7592323 - DNA, 22 bp, Homo sapiens
gggcctgcaggttctgagaggc

SEQ ID NO: 7592324 - DNA, 22 bp, Homo sapiens
gggcctgcaggttctgagaggc

SEQ ID NO: 7592325 - DNA, 22 bp, Homo sapiens
gggcctgcaggttctgagaggc

SEQ ID NO: 7592326 - DNA, 22 bp, Homo sapiens
gggcctgcaggttctgagaggc

SEQ ID NO: 7592327 - DNA, 22 bp, Homo sapiens
gggcctgcaggttctgagaggc

SEQ ID NO: 7592328 - DNA, 22 bp, Homo sapiens
gggcctgccattgctgccccag

SEQ ID NO: 7592329 - DNA, 22 bp, Homo sapiens
gggcctgccattgctgccccag

SEQ ID NO: 7592330 - DNA, 22 bp, Homo sapiens
gggcctgccaggctttcagcat

SEQ ID NO: 7592331 - DNA, 22 bp, Homo sapiens
gggcctgccaggctttcagcat

SEQ ID NO: 7592332 - DNA, 22 bp, Homo sapiens
gggcctgccaggctttcagcat

SEQ ID NO: 7592333 - DNA, 22 bp, Homo sapiens
gggcctgcaggttctgagaggc

SEQ ID NO: 7592334 - DNA, 22 bp, Homo sapiens
gggcctgcaggttctgagaggc

SEQ ID NO: 7592335 - DNA, 22 bp, Homo sapiens
gggcctgcaggttctgagaggc

SEQ ID NO: 7592336 - DNA, 22 bp, Homo sapiens
gggcctgattagcaggctagct

SEQ ID NO: 7592337 - DNA, 22 bp, Homo sapiens
gggcctgattagcaggctagct

SEQ ID NO: 7592338 - DNA, 22 bp, Homo sapiens
gggcctgaggcccagacactgg

SEQ ID NO: 7592339 - DNA, 22 bp, Homo sapiens
gggcctgagactgagggtgagg

SEQ ID NO: 7592340 - DNA, 22 bp, Homo sapiens
gggcctgagactgagggtgagg

SEQ ID NO: 7592341 - DNA, 22 bp, Homo sapiens
gggcctgactgagagctcctca

SEQ ID NO: 7592342 - DNA, 22 bp, Homo sapiens
gggcctgagactgagggtgagg

SEQ ID NO: 7592343 - DNA, 22 bp, Homo sapiens
gggcctggggacaccaccatga

SEQ ID NO: 7592344 - DNA, 22 bp, Homo sapiens
gggcctggggacaccaccatga

SEQ ID NO: 7592345 - DNA, 22 bp, Homo sapiens
gggcctggggacaccaccatga

SEQ ID NO: 7592346 - DNA, 22 bp, Homo sapiens
gggcctggggtgacgtacccct

SEQ ID NO: 7592347 - DNA, 22 bp, Homo sapiens
gggcctggggtgacgtacccct

SEQ ID NO: 7592348 - DNA, 22 bp, Homo sapiens
gggcctggggtgacgtacccct

SEQ ID NO: 7592349 - DNA, 22 bp, Homo sapiens
gggcctggtgcttctgactcct

SEQ ID NO: 7592350 - DNA, 22 bp, Homo sapiens
gggcctggtgcttctgactcct

SEQ ID NO: 7592351 - DNA, 22 bp, Homo sapiens
gggcctggggtgacgtacccct

SEQ ID NO: 7592352 - DNA, 22 bp, Homo sapiens
gggctccaaggaggccagcctg

SEQ ID NO: 7592353 - DNA, 22 bp, Homo sapiens
gggcctggtgcttctgactcct

SEQ ID NO: 7592354 - DNA, 22 bp, Homo sapiens
gggcctggtgcttctgactcct

SEQ ID NO: 7592355 - DNA, 22 bp, Homo sapiens
gggctccaaggaggccagcctg

SEQ ID NO: 7592356 - DNA, 22 bp, Homo sapiens
gggcctggtgcttctgactcct

SEQ ID NO: 7592357 - DNA, 22 bp, Homo sapiens
gggcctggtgcttctgactcct

SEQ ID NO: 7592358 - DNA, 22 bp, Homo sapiens
gggcctgggaacttgcatttag

SEQ ID NO: 7592359 - DNA, 22 bp, Homo sapiens
gggcctgggaacttgcatttag

SEQ ID NO: 7592360 - DNA, 21 bp, Homo sapiens
gggcctggctgcgcaggacgg

SEQ ID NO: 7592361 - DNA, 21 bp, Homo sapiens
gggcctggctgcgcaggacgg

SEQ ID NO: 7592362 - DNA, 22 bp, Homo sapiens
gggcctggggacaccaccatga

SEQ ID NO: 7592363 - DNA, 21 bp, Homo sapiens
gggcctggctgcgcaggacgg

SEQ ID NO: 7592364 - DNA, 21 bp, Homo sapiens
gggcctggctgcgcaggacgg

SEQ ID NO: 7592365 - DNA, 21 bp, Homo sapiens
gggcctggctgcgcaggacgg

SEQ ID NO: 7592366 - DNA, 21 bp, Homo sapiens
gggcctggctgcgcaggacgg

SEQ ID NO: 7592367 - DNA, 21 bp, Homo sapiens
gggcctggctgcgcaggacgg

SEQ ID NO: 7592368 - DNA, 21 bp, Homo sapiens
gggcctggctgcgcaggacgg

SEQ ID NO: 7592369 - DNA, 21 bp, Homo sapiens
gggcctggctgcgcaggacgg

SEQ ID NO: 7592370 - DNA, 21 bp, Homo sapiens
gggcctggctgcgcaggacgg

SEQ ID NO: 7592371 - DNA, 19 bp, Homo sapiens
gggctccttgggcctctct

SEQ ID NO: 7592372 - DNA, 19 bp, Homo sapiens
gggctccttgggcctctct

SEQ ID NO: 7592373 - DNA, 19 bp, Homo sapiens
gggctccttgggcctctct

SEQ ID NO: 7592374 - DNA, 19 bp, Homo sapiens
gggctccttgggcctctct

SEQ ID NO: 7592375 - DNA, 19 bp, Homo sapiens
gggctccttgggcctctct

SEQ ID NO: 7592376 - DNA, 19 bp, Homo sapiens
gggctccttgggcctctct

SEQ ID NO: 7592377 - DNA, 22 bp, Homo sapiens
gggctcctggcagtcatgctca

SEQ ID NO: 7592378 - DNA, 22 bp, Homo sapiens
gggctcctggcagtcatgctca

SEQ ID NO: 7592379 - DNA, 22 bp, Homo sapiens
gggctcctggcagtcatgctca

SEQ ID NO: 7592380 - DNA, 22 bp, Homo sapiens
gggctcggcatctgtggactct

SEQ ID NO: 7592381 - DNA, 22 bp, Homo sapiens
gggctcggcatctgtggactct

SEQ ID NO: 7592382 - DNA, 22 bp, Homo sapiens
gggctcgaagcgctggtggttg

SEQ ID NO: 7592383 - DNA, 22 bp, Homo sapiens
gggctcctcctctgactgtggc

SEQ ID NO: 7592384 - DNA, 22 bp, Homo sapiens
gggctcctgcctcctggcacct

SEQ ID NO: 7592385 - DNA, 22 bp, Homo sapiens
gggctcctgcctcctggcacct

SEQ ID NO: 7592386 - DNA, 22 bp, Homo sapiens
gggctcctgcctcctggcacct

SEQ ID NO: 7592387 - DNA, 22 bp, Homo sapiens
gggctcctgcctcctggcacct

SEQ ID NO: 7592388 - DNA, 22 bp, Homo sapiens
gggctctcaaggcagggcccca

SEQ ID NO: 7592389 - DNA, 22 bp, Homo sapiens
gggctctaggccaagagtcccg

SEQ ID NO: 7592390 - DNA, 22 bp, Homo sapiens
gggctctcatgagtgtgtggta

SEQ ID NO: 7592391 - DNA, 22 bp, Homo sapiens
gggctctaggatggctccagcc

SEQ ID NO: 7592392 - DNA, 22 bp, Homo sapiens
gggctctaggccaagagtcccg

SEQ ID NO: 7592393 - DNA, 19 bp, Homo sapiens
gggctctactctcagtctt

SEQ ID NO: 7592394 - DNA, 22 bp, Homo sapiens
gggctctagaggacagcctgct

SEQ ID NO: 7592395 - DNA, 22 bp, Homo sapiens
gggctctagaggacagcctgct

SEQ ID NO: 7592396 - DNA, 22 bp, Homo sapiens
gggctctcgattagaccctggg

SEQ ID NO: 7592397 - DNA, 22 bp, Homo sapiens
gggctctcgattagaccctggg

SEQ ID NO: 7592398 - DNA, 19 bp, Homo sapiens
gggctctcgagcaaccaac

SEQ ID NO: 7592399 - DNA, 21 bp, Homo sapiens
gggctctcctgaggccatgaa

SEQ ID NO: 7592400 - DNA, 22 bp, Homo sapiens
gggctctcgattagaccctggg

SEQ ID NO: 7592401 - DNA, 22 bp, Homo sapiens
gggctctcgattagaccctggg

SEQ ID NO: 7592402 - DNA, 22 bp, Homo sapiens
gggctctcccacaacgtgccag

SEQ ID NO: 7592403 - DNA, 21 bp, Homo sapiens
gggctctcctgaggccatgaa

SEQ ID NO: 7592404 - DNA, 22 bp, Homo sapiens
gggctctcatgagtgtgtggta

SEQ ID NO: 7592405 - DNA, 22 bp, Homo sapiens
gggctctcatgagtgtgtggta

SEQ ID NO: 7592406 - DNA, 21 bp, Homo sapiens
gggctctcctgaggccatgaa

SEQ ID NO: 7592407 - DNA, 21 bp, Homo sapiens
gggctctcctgaggccatgaa

SEQ ID NO: 7592408 - DNA, 21 bp, Homo sapiens
gggctctcctgaggccatgaa

SEQ ID NO: 7592409 - DNA, 22 bp, Homo sapiens
gggctctcgattagaccctggg

SEQ ID NO: 7592410 - DNA, 22 bp, Homo sapiens
gggctctgaatcccaggtctgc

SEQ ID NO: 7592411 - DNA, 22 bp, Homo sapiens
gggctctgaatcccaggtctgc

SEQ ID NO: 7592412 - DNA, 20 bp, Homo sapiens
gggctggcgcatggggaaag

SEQ ID NO: 7592413 - DNA, 22 bp, Homo sapiens
gggctctgaatcccaggtctgc

SEQ ID NO: 7592414 - DNA, 22 bp, Homo sapiens
gggctctctttttggcctgccc

SEQ ID NO: 7592415 - DNA, 22 bp, Homo sapiens
gggctggcgggaaaggcaattc

SEQ ID NO: 7592416 - DNA, 22 bp, Homo sapiens
gggctggcgggaaaggcaattc

SEQ ID NO: 7592417 - DNA, 22 bp, Homo sapiens
gggctggcgggaaaggcaattc

SEQ ID NO: 7592418 - DNA, 20 bp, Homo sapiens
gggctggcgcatggggaaag

SEQ ID NO: 7592419 - DNA, 20 bp, Homo sapiens
gggctggcgcatggggaaag

SEQ ID NO: 7592420 - DNA, 22 bp, Homo sapiens
gggctggcatcggttgctgaga

SEQ ID NO: 7592421 - DNA, 20 bp, Homo sapiens
gggctggcgcatggggaaag

SEQ ID NO: 7592422 - DNA, 20 bp, Homo sapiens
gggctggcgcatggggaaag

SEQ ID NO: 7592423 - DNA, 22 bp, Homo sapiens
gggctggctcccaggtgttgaa

SEQ ID NO: 7592424 - DNA, 22 bp, Homo sapiens
gggctggctcccaggtgttgaa

SEQ ID NO: 7592425 - DNA, 22 bp, Homo sapiens
gggctggctcccaggtgttgaa

SEQ ID NO: 7592426 - DNA, 22 bp, Homo sapiens
gggctggctcccaggtgttgaa

SEQ ID NO: 7592427 - DNA, 22 bp, Homo sapiens
gggctggctcccaggtgttgaa

SEQ ID NO: 7592428 - DNA, 22 bp, Homo sapiens
gggctggctcccaggtgttgaa

SEQ ID NO: 7592429 - DNA, 22 bp, Homo sapiens
gggctggctcccaggtgttgaa

SEQ ID NO: 7592430 - DNA, 20 bp, Homo sapiens
gggctggctcaactggatcc

SEQ ID NO: 7592431 - DNA, 20 bp, Homo sapiens
gggctggctcaactggatcc

SEQ ID NO: 7592432 - DNA, 22 bp, Homo sapiens
gggctggctaagacttttctgt

SEQ ID NO: 7592433 - DNA, 22 bp, Homo sapiens
gggctggctaagacttttctgt

SEQ ID NO: 7592434 - DNA, 22 bp, Homo sapiens
gggctggctaagacttttctgt

SEQ ID NO: 7592435 - DNA, 22 bp, Homo sapiens
gggctggcgggaaaggcaattc

SEQ ID NO: 7592436 - DNA, 22 bp, Homo sapiens
gggctccagccagctccttgtg

SEQ ID NO: 7592437 - DNA, 22 bp, Homo sapiens
gggctccagccaggtgtcccca

SEQ ID NO: 7592438 - DNA, 22 bp, Homo sapiens
gggctccagccaggtgtcccca

SEQ ID NO: 7592439 - DNA, 22 bp, Homo sapiens
gggctccagccagctccttgtg

SEQ ID NO: 7592440 - DNA, 22 bp, Homo sapiens
gggctccagccaggtgtcccca

SEQ ID NO: 7592441 - DNA, 22 bp, Homo sapiens
gggctccagcccgggaccaggt

SEQ ID NO: 7592442 - DNA, 22 bp, Homo sapiens
gggctccagcccgggaccaggt

SEQ ID NO: 7592443 - DNA, 22 bp, Homo sapiens
gggctccagcccgggaccaggt

SEQ ID NO: 7592444 - DNA, 22 bp, Homo sapiens
gggctccagccagctccttgtg

SEQ ID NO: 7592445 - DNA, 22 bp, Homo sapiens
gggctccagccagctccttgtg

SEQ ID NO: 7592446 - DNA, 22 bp, Homo sapiens
gggctccagccagctccttgtg

SEQ ID NO: 7592447 - DNA, 22 bp, Homo sapiens
gggctccagccactggctgagg

SEQ ID NO: 7592448 - DNA, 22 bp, Homo sapiens
gggctccagcagaggcagccgg

SEQ ID NO: 7592449 - DNA, 22 bp, Homo sapiens
gggctccagcagaggcagccgg

SEQ ID NO: 7592450 - DNA, 22 bp, Homo sapiens
gggctccagccactggctgagg

SEQ ID NO: 7592451 - DNA, 22 bp, Homo sapiens
gggctccagcagaggcagccgg

SEQ ID NO: 7592452 - DNA, 22 bp, Homo sapiens
gggctccagcagaggcagccgg

SEQ ID NO: 7592453 - DNA, 22 bp, Homo sapiens
gggctccagcagaggcagccgg

SEQ ID NO: 7592454 - DNA, 22 bp, Homo sapiens
gggctccaaggaggccagcctg

SEQ ID NO: 7592455 - DNA, 22 bp, Homo sapiens
gggctccacagcagtgagtgga

SEQ ID NO: 7592456 - DNA, 22 bp, Homo sapiens
gggctccacagcagtgagtgga

SEQ ID NO: 7592457 - DNA, 22 bp, Homo sapiens
gggctccacagcagtgagtgga

SEQ ID NO: 7592458 - DNA, 22 bp, Homo sapiens
gggctccacagcagtgagtgga

SEQ ID NO: 7592459 - DNA, 22 bp, Homo sapiens
gggctccacagcagtgagtgga

SEQ ID NO: 7592460 - DNA, 22 bp, Homo sapiens
gggctccacctagggacactgg

SEQ ID NO: 7592461 - DNA, 22 bp, Homo sapiens
gggctccacctagggacactgg

SEQ ID NO: 7592462 - DNA, 22 bp, Homo sapiens
gggctccacgcacgcgagaggt

SEQ ID NO: 7592463 - DNA, 22 bp, Homo sapiens
gggctccacgcacgcgagaggt

SEQ ID NO: 7592464 - DNA, 22 bp, Homo sapiens
gggctccacgcacgcgagaggt

SEQ ID NO: 7592465 - DNA, 22 bp, Homo sapiens
gggctccacgcacgcgagaggt

SEQ ID NO: 7592466 - DNA, 21 bp, Homo sapiens
gggctccagagatgtagcttc

SEQ ID NO: 7592467 - DNA, 21 bp, Homo sapiens
gggctccagagatgtagcttc

SEQ ID NO: 7592468 - DNA, 22 bp, Homo sapiens
gggctccagaggctcaccctgg

SEQ ID NO: 7592469 - DNA, 22 bp, Homo sapiens
gggctccagaggctcaccctgg

SEQ ID NO: 7592470 - DNA, 22 bp, Homo sapiens
gggctccagaggctcaccctgg

SEQ ID NO: 7592471 - DNA, 22 bp, Homo sapiens
gggctccagagtccatgttctt

SEQ ID NO: 7592472 - DNA, 22 bp, Homo sapiens
gggctccagagtccatgttctt

SEQ ID NO: 7592473 - DNA, 22 bp, Homo sapiens
gggctccagattgcagcgatca

SEQ ID NO: 7592474 - DNA, 22 bp, Homo sapiens
gggctccagattgcagcgatca

SEQ ID NO: 7592475 - DNA, 22 bp, Homo sapiens
gggctccagattgcagcgatca

SEQ ID NO: 7592476 - DNA, 22 bp, Homo sapiens
gggctccaggagccctaagaga

SEQ ID NO: 7592477 - DNA, 22 bp, Homo sapiens
gggctccaggagccctaagaga

SEQ ID NO: 7592478 - DNA, 22 bp, Homo sapiens
gggctccagctgtttgccatga

SEQ ID NO: 7592479 - DNA, 22 bp, Homo sapiens
gggctccagctgtttgccatga

SEQ ID NO: 7592480 - DNA, 20 bp, Homo sapiens
gggctccagctgtgattctt

SEQ ID NO: 7592481 - DNA, 20 bp, Homo sapiens
gggctccagctgtgattctt

SEQ ID NO: 7592482 - DNA, 22 bp, Homo sapiens
gggctccagctgtttgccatga

SEQ ID NO: 7592483 - DNA, 22 bp, Homo sapiens
gggctccaggagccctaagaga

SEQ ID NO: 7592484 - DNA, 22 bp, Homo sapiens
gggctccaggcaggcaggaaat

SEQ ID NO: 7592485 - DNA, 22 bp, Homo sapiens
gggctccaggcaggcaggaaat

SEQ ID NO: 7592486 - DNA, 22 bp, Homo sapiens
gggctccaggcaggcaggaaat

SEQ ID NO: 7592487 - DNA, 22 bp, Homo sapiens
gggctccaggcaggcaggaaat

SEQ ID NO: 7592488 - DNA, 22 bp, Homo sapiens
gggctccaggcaggcaggaaat

SEQ ID NO: 7592489 - DNA, 23 bp, Homo sapiens
gggctccagtctctgctcagttg

SEQ ID NO: 7592490 - DNA, 22 bp, Homo sapiens
gggctccagttgtccccaggat

SEQ ID NO: 7592491 - DNA, 22 bp, Homo sapiens
gggctccagttgtccccaggat

SEQ ID NO: 7592492 - DNA, 23 bp, Homo sapiens
gggctccagtctctgctcagttg

SEQ ID NO: 7592493 - DNA, 22 bp, Homo sapiens
gggctccagtttggccaggaag

SEQ ID NO: 7592494 - DNA, 22 bp, Homo sapiens
gggctccagtttggccaggaag

SEQ ID NO: 7592495 - DNA, 22 bp, Homo sapiens
gggctccagttgtccccaggat

SEQ ID NO: 7592496 - DNA, 23 bp, Homo sapiens
gggctccagtctctgctcagttg

SEQ ID NO: 7592497 - DNA, 22 bp, Homo sapiens
gggctccagggcccgagtcgtc

SEQ ID NO: 7592498 - DNA, 23 bp, Homo sapiens
gggctccagtctctgctcagttg

SEQ ID NO: 7592499 - DNA, 23 bp, Homo sapiens
gggctccagtctctgctcagttg

SEQ ID NO: 7592500 - DNA, 22 bp, Homo sapiens
gggctccagggcccgagtcgtc

SEQ ID NO: 7592501 - DNA, 22 bp, Homo sapiens
gggctccatcacaggctccatc

SEQ ID NO: 7592502 - DNA, 22 bp, Homo sapiens
gggctccatcacaggctccatc

SEQ ID NO: 7592503 - DNA, 22 bp, Homo sapiens
gggctccagtttggccaggaag

SEQ ID NO: 7592504 - DNA, 22 bp, Homo sapiens
gggctccagtttggccaggaag

SEQ ID NO: 7592505 - DNA, 22 bp, Homo sapiens
gggctccagtttggccaggaag

SEQ ID NO: 7592506 - DNA, 22 bp, Homo sapiens
gggctccagtttggccaggaag

SEQ ID NO: 7592507 - DNA, 22 bp, Homo sapiens
gggctccagtttggccaggaag

SEQ ID NO: 7592508 - DNA, 22 bp, Homo sapiens
gggctccatcacaggctccatc

SEQ ID NO: 7592509 - DNA, 22 bp, Homo sapiens
gggctccatcggacttgggttt

SEQ ID NO: 7592510 - DNA, 22 bp, Homo sapiens
gggctccatcggacttgggttt

SEQ ID NO: 7592511 - DNA, 22 bp, Homo sapiens
gggctccatcacaggctccatc

SEQ ID NO: 7592512 - DNA, 22 bp, Homo sapiens
gggctccatcacaggctccatc

SEQ ID NO: 7592513 - DNA, 17 bp, Homo sapiens
gggctcctcccctgggg

SEQ ID NO: 7592514 - DNA, 22 bp, Homo sapiens
gggctccgcccttggctgagct

SEQ ID NO: 7592515 - DNA, 17 bp, Homo sapiens
gggctcctcccctgggg

SEQ ID NO: 7592516 - DNA, 22 bp, Homo sapiens
gggctccgcccttggctgagct

SEQ ID NO: 7592517 - DNA, 22 bp, Homo sapiens
gggctcctcctctgactgtggc

SEQ ID NO: 7592518 - DNA, 22 bp, Homo sapiens
gggctcctcctctgactgtggc

SEQ ID NO: 7592519 - DNA, 18 bp, Homo sapiens
ggtcaggggcggagagaa

SEQ ID NO: 7592520 - DNA, 18 bp, Homo sapiens
ggtcaggggcggagagaa

SEQ ID NO: 7592521 - DNA, 18 bp, Homo sapiens
ggtcaggggcggagagaa

SEQ ID NO: 7592522 - DNA, 18 bp, Homo sapiens
ggtcaggggcggagagaa

SEQ ID NO: 7592523 - DNA, 18 bp, Homo sapiens
ggtcaggggcggagagaa

SEQ ID NO: 7592524 - DNA, 22 bp, Homo sapiens
ggtcagggctgggtatgaagag

SEQ ID NO: 7592525 - DNA, 22 bp, Homo sapiens
ggtcagggctgggtatgaagag

SEQ ID NO: 7592526 - DNA, 22 bp, Homo sapiens
ggtcagggctgggtatgaagag

SEQ ID NO: 7592527 - DNA, 22 bp, Homo sapiens
ggtcagggctcttccagtggct

SEQ ID NO: 7592528 - DNA, 22 bp, Homo sapiens
ggtcagggctcttccagtggct

SEQ ID NO: 7592529 - DNA, 22 bp, Homo sapiens
ggtcagggctcttccagtggct

SEQ ID NO: 7592530 - DNA, 22 bp, Homo sapiens
ggtcagggctcttccagtggct

SEQ ID NO: 7592531 - DNA, 22 bp, Homo sapiens
ggtcaggggctgctctacagag

SEQ ID NO: 7592532 - DNA, 22 bp, Homo sapiens
ggtcagggggatctgtgaggta

SEQ ID NO: 7592533 - DNA, 22 bp, Homo sapiens
ggtcaggggctgctctacagag

SEQ ID NO: 7592534 - DNA, 22 bp, Homo sapiens
ggtcaggggctgctctacagag

SEQ ID NO: 7592535 - DNA, 22 bp, Homo sapiens
ggtcaggggctgctctacagag

SEQ ID NO: 7592536 - DNA, 22 bp, Homo sapiens
ggtcaggggctgctctacagag

SEQ ID NO: 7592537 - DNA, 18 bp, Homo sapiens
ggtcaggggcggagagaa

SEQ ID NO: 7592538 - DNA, 22 bp, Homo sapiens
ggtcagggggatctgtgaggta

SEQ ID NO: 7592539 - DNA, 22 bp, Homo sapiens
ggtcagggggatctgtgaggta

SEQ ID NO: 7592540 - DNA, 21 bp, Homo sapiens
ggtcagggggtgcctccaggt

SEQ ID NO: 7592541 - DNA, 21 bp, Homo sapiens
ggtcagggggtgcctccaggt

SEQ ID NO: 7592542 - DNA, 21 bp, Homo sapiens
ggtcagggggtgcctccaggt

SEQ ID NO: 7592543 - DNA, 22 bp, Homo sapiens
ggtcaggggctgctctacagag

SEQ ID NO: 7592544 - DNA, 22 bp, Homo sapiens
ggtcagggggatctgtgaggta

SEQ ID NO: 7592545 - DNA, 22 bp, Homo sapiens
ggtcagggggatctgtgaggta

SEQ ID NO: 7592546 - DNA, 22 bp, Homo sapiens
ggtcagggggatctgtgaggta

SEQ ID NO: 7592547 - DNA, 22 bp, Homo sapiens
ggtcagggggatctgtgaggta

SEQ ID NO: 7592548 - DNA, 22 bp, Homo sapiens
ggtcagggggatctgtgaggta

SEQ ID NO: 7592549 - DNA, 21 bp, Homo sapiens
ggtcagggggtgcctccaggt

SEQ ID NO: 7592550 - DNA, 21 bp, Homo sapiens
ggtcagggggtgcctccaggt

SEQ ID NO: 7592551 - DNA, 22 bp, Homo sapiens
ggtcagggtataatcaagtgag

SEQ ID NO: 7592552 - DNA, 22 bp, Homo sapiens
ggtcagggtataatcaagtgag

SEQ ID NO: 7592553 - DNA, 22 bp, Homo sapiens
ggtcagggtataatcaagtgag

SEQ ID NO: 7592554 - DNA, 22 bp, Homo sapiens
ggtcagggttccaggtatcttc

SEQ ID NO: 7592555 - DNA, 22 bp, Homo sapiens
ggtcagggttccaggtatcttc

SEQ ID NO: 7592556 - DNA, 22 bp, Homo sapiens
ggtccaggtatgtggtgtgaat

SEQ ID NO: 7592557 - DNA, 22 bp, Homo sapiens
ggtccaggtatgtggtgtgaat

SEQ ID NO: 7592558 - DNA, 22 bp, Homo sapiens
ggtccagggggtagatatgtga

SEQ ID NO: 7592559 - DNA, 22 bp, Homo sapiens
ggtccagggggtagatatgtga

SEQ ID NO: 7592560 - DNA, 22 bp, Homo sapiens
ggtccagggaactttgaaggat

SEQ ID NO: 7592561 - DNA, 22 bp, Homo sapiens
ggtccaggatcaaggcatcacc

SEQ ID NO: 7592562 - DNA, 22 bp, Homo sapiens
ggtccaggatcaaggcatcacc

SEQ ID NO: 7592563 - DNA, 22 bp, Homo sapiens
ggtccaggatcaaggcatcacc

SEQ ID NO: 7592564 - DNA, 22 bp, Homo sapiens
ggtccaggtttgctctacttgt

SEQ ID NO: 7592565 - DNA, 22 bp, Homo sapiens
ggtccaggtcctgtgacagcag

SEQ ID NO: 7592566 - DNA, 22 bp, Homo sapiens
ggtccaggtttgctctacttgt

SEQ ID NO: 7592567 - DNA, 22 bp, Homo sapiens
ggtccagtcagatattcatgca

SEQ ID NO: 7592568 - DNA, 22 bp, Homo sapiens
ggtccagtcctgctcaccactt

SEQ ID NO: 7592569 - DNA, 22 bp, Homo sapiens
ggtccaggtatgtggtgtgaat

SEQ ID NO: 7592570 - DNA, 22 bp, Homo sapiens
ggtccaggtatgtggtgtgaat

SEQ ID NO: 7592571 - DNA, 22 bp, Homo sapiens
ggtccaggtatgtggtgtgaat

SEQ ID NO: 7592572 - DNA, 22 bp, Homo sapiens
ggtccaggtcctgtgacagcag

SEQ ID NO: 7592573 - DNA, 23 bp, Homo sapiens
ggtccaggaaaggcagcagcacc

SEQ ID NO: 7592574 - DNA, 23 bp, Homo sapiens
ggtccaggaaaggcagcagcacc

SEQ ID NO: 7592575 - DNA, 23 bp, Homo sapiens
ggtccaggaaaggcagcagcacc

SEQ ID NO: 7592576 - DNA, 22 bp, Homo sapiens
ggtccaggatcaaggcatcacc

SEQ ID NO: 7592577 - DNA, 22 bp, Homo sapiens
ggtccaggatcaaggcatcacc

SEQ ID NO: 7592578 - DNA, 22 bp, Homo sapiens
ggtccaggatcaaggcatcacc

SEQ ID NO: 7592579 - DNA, 23 bp, Homo sapiens
ggtccaggaaaggcagcagcacc

SEQ ID NO: 7592580 - DNA, 23 bp, Homo sapiens
ggtccaggaaaggcagcagcacc

SEQ ID NO: 7592581 - DNA, 22 bp, Homo sapiens
ggtccagccaggtgctcatgcc

SEQ ID NO: 7592582 - DNA, 22 bp, Homo sapiens
ggtccagagctgatggtctttt

SEQ ID NO: 7592583 - DNA, 22 bp, Homo sapiens
ggtccagagctgatggtctttt

SEQ ID NO: 7592584 - DNA, 22 bp, Homo sapiens
ggtccagagctgatggtctttt

SEQ ID NO: 7592585 - DNA, 22 bp, Homo sapiens
ggtccagcacaacactggcatg

SEQ ID NO: 7592586 - DNA, 22 bp, Homo sapiens
ggtccagcacaacactggcatg

SEQ ID NO: 7592587 - DNA, 22 bp, Homo sapiens
ggtccagagtccttgctagaga

SEQ ID NO: 7592588 - DNA, 22 bp, Homo sapiens
ggtcagggttccaggtatcttc

SEQ ID NO: 7592589 - DNA, 22 bp, Homo sapiens
ggtcagggttccaggtatcttc

SEQ ID NO: 7592590 - DNA, 19 bp, Homo sapiens
ggtccagacttcagactag

SEQ ID NO: 7592591 - DNA, 20 bp, Homo sapiens
ggtagcagctgctgtcatcc

SEQ ID NO: 7592592 - DNA, 20 bp, Homo sapiens
ggtagcagctgctgtcatcc

SEQ ID NO: 7592593 - DNA, 20 bp, Homo sapiens
ggtagcagctgctgtcatcc

SEQ ID NO: 7592594 - DNA, 20 bp, Homo sapiens
ggtagcagctgctgtcatcc

SEQ ID NO: 7592595 - DNA, 22 bp, Homo sapiens
ggtagcagggctgtgagtcaga

SEQ ID NO: 7592596 - DNA, 22 bp, Homo sapiens
ggtagcagggctgtgagtcaga

SEQ ID NO: 7592597 - DNA, 22 bp, Homo sapiens
ggtagcagggctgtgagtcaga

SEQ ID NO: 7592598 - DNA, 22 bp, Homo sapiens
ggtagactgagctccttgagga

SEQ ID NO: 7592599 - DNA, 22 bp, Homo sapiens
ggtagaattcacattcagttct

SEQ ID NO: 7592600 - DNA, 22 bp, Homo sapiens
ggtagaattcacattcagttct

SEQ ID NO: 7592601 - DNA, 23 bp, Homo sapiens
ggtagagccgcgccctgggggaa

SEQ ID NO: 7592602 - DNA, 22 bp, Homo sapiens
ggtagactgtcaaacactagcc

SEQ ID NO: 7592603 - DNA, 22 bp, Homo sapiens
ggtagcacattgcattaggaga

SEQ ID NO: 7592604 - DNA, 22 bp, Homo sapiens
ggtagataaatgcagttactgc

SEQ ID NO: 7592605 - DNA, 22 bp, Homo sapiens
ggtagctgcagcaggctggcaa

SEQ ID NO: 7592606 - DNA, 22 bp, Homo sapiens
ggtagctgcagcaggctggcaa

SEQ ID NO: 7592607 - DNA, 20 bp, Homo sapiens
ggtagctgctgcagttggta

SEQ ID NO: 7592608 - DNA, 20 bp, Homo sapiens
ggtagctgctgcagttggta

SEQ ID NO: 7592609 - DNA, 20 bp, Homo sapiens
ggtagctgctgcagttggta

SEQ ID NO: 7592610 - DNA, 20 bp, Homo sapiens
ggtagctgctgcagttggta

SEQ ID NO: 7592611 - DNA, 22 bp, Homo sapiens
ggtagctgcagcaggctggcaa

SEQ ID NO: 7592612 - DNA, 22 bp, Homo sapiens
ggtaggagtattttgcagcagt

SEQ ID NO: 7592613 - DNA, 22 bp, Homo sapiens
ggtaggagtattttgcagcagt

SEQ ID NO: 7592614 - DNA, 22 bp, Homo sapiens
ggtaggagtattttgcagcagt

SEQ ID NO: 7592615 - DNA, 22 bp, Homo sapiens
ggtaggagtattttgcagcagt

SEQ ID NO: 7592616 - DNA, 22 bp, Homo sapiens
ggtaggagtattttgcagcagt

SEQ ID NO: 7592617 - DNA, 22 bp, Homo sapiens
ggtaggaagatagagcaaagtt

SEQ ID NO: 7592618 - DNA, 18 bp, Homo sapiens
ggtaggagccaggaatgt

SEQ ID NO: 7592619 - DNA, 18 bp, Homo sapiens
ggtaggagccaggaatgt

SEQ ID NO: 7592620 - DNA, 18 bp, Homo sapiens
ggtaggagccaggaatgt

SEQ ID NO: 7592621 - DNA, 22 bp, Homo sapiens
ggtaggcaaactacagttagct

SEQ ID NO: 7592622 - DNA, 22 bp, Homo sapiens
ggtaggcaaactacagttagct

SEQ ID NO: 7592623 - DNA, 22 bp, Homo sapiens
ggtaggagtgaagacttaagat

SEQ ID NO: 7592624 - DNA, 22 bp, Homo sapiens
ggtaggcaaactacagttagct

SEQ ID NO: 7592625 - DNA, 22 bp, Homo sapiens
ggtaggagtgaagacttaagat

SEQ ID NO: 7592626 - DNA, 22 bp, Homo sapiens
ggtaggagtattttgcagcagt

SEQ ID NO: 7592627 - DNA, 22 bp, Homo sapiens
ggtaggcactggtgggaagaga

SEQ ID NO: 7592628 - DNA, 22 bp, Homo sapiens
ggtaggcactggtgggaagaga

SEQ ID NO: 7592629 - DNA, 22 bp, Homo sapiens
ggtaggcactggtgggaagaga

SEQ ID NO: 7592630 - DNA, 22 bp, Homo sapiens
ggtaggcagatcactgtctatg

SEQ ID NO: 7592631 - DNA, 22 bp, Homo sapiens
ggtcagccttggatttggtagc

SEQ ID NO: 7592632 - DNA, 20 bp, Homo sapiens
ggtcagcctggggctccagg

SEQ ID NO: 7592633 - DNA, 22 bp, Homo sapiens
ggtcagccttggatttggtagc

SEQ ID NO: 7592634 - DNA, 22 bp, Homo sapiens
ggtcagccttggatttggtagc

SEQ ID NO: 7592635 - DNA, 21 bp, Homo sapiens
ggtcagctctatccacgcctt

SEQ ID NO: 7592636 - DNA, 19 bp, Homo sapiens
ggtcagctgggctagaggc

SEQ ID NO: 7592637 - DNA, 22 bp, Homo sapiens
ggtcagctctttgggctggtgg

SEQ ID NO: 7592638 - DNA, 19 bp, Homo sapiens
ggtcagctgggctagaggc

SEQ ID NO: 7592639 - DNA, 22 bp, Homo sapiens
ggtcaggaaaagactccccaga

SEQ ID NO: 7592640 - DNA, 22 bp, Homo sapiens
ggtcaggaaaagactccccaga

SEQ ID NO: 7592641 - DNA, 22 bp, Homo sapiens
ggtcaggagcccttggccccct

SEQ ID NO: 7592642 - DNA, 22 bp, Homo sapiens
ggtcaggagcccttggccccct

SEQ ID NO: 7592643 - DNA, 19 bp, Homo sapiens
ggtcaggaatttgacaata

SEQ ID NO: 7592644 - DNA, 22 bp, Homo sapiens
ggtcaggagcccttggccccct

SEQ ID NO: 7592645 - DNA, 21 bp, Homo sapiens
ggtcaggcatgtgccctgagc

SEQ ID NO: 7592646 - DNA, 21 bp, Homo sapiens
ggtcaggcatgtgccctgagc

SEQ ID NO: 7592647 - DNA, 21 bp, Homo sapiens
ggtcaggcatgtgccctgagc

SEQ ID NO: 7592648 - DNA, 22 bp, Homo sapiens
ggtcaggatccaagtctgtgct

SEQ ID NO: 7592649 - DNA, 20 bp, Homo sapiens
ggtcagccccacctggcagc

SEQ ID NO: 7592650 - DNA, 20 bp, Homo sapiens
ggtcagccccacctggcagc

SEQ ID NO: 7592651 - DNA, 22 bp, Homo sapiens
ggtcagcatctggttgagggca

SEQ ID NO: 7592652 - DNA, 22 bp, Homo sapiens
ggtcagcatctggttgagggca

SEQ ID NO: 7592653 - DNA, 22 bp, Homo sapiens
ggtcagcccctgctcaaggccg

SEQ ID NO: 7592654 - DNA, 22 bp, Homo sapiens
ggtcagcatctggttgagggca

SEQ ID NO: 7592655 - DNA, 22 bp, Homo sapiens
ggtcagcccctgctcaaggccg

SEQ ID NO: 7592656 - DNA, 22 bp, Homo sapiens
ggtcagcagtttctttgaattt

SEQ ID NO: 7592657 - DNA, 22 bp, Homo sapiens
ggtagggatgggatttggaagt

SEQ ID NO: 7592658 - DNA, 22 bp, Homo sapiens
ggtagggatgggatttggaagt

SEQ ID NO: 7592659 - DNA, 22 bp, Homo sapiens
ggtagggatgggatttggaagt

SEQ ID NO: 7592660 - DNA, 21 bp, Homo sapiens
ggtagggaaggttcgctggtg

SEQ ID NO: 7592661 - DNA, 21 bp, Homo sapiens
ggtagggaaggttcgctggtg

SEQ ID NO: 7592662 - DNA, 21 bp, Homo sapiens
ggtagggaaggttcgctggtg

SEQ ID NO: 7592663 - DNA, 22 bp, Homo sapiens
ggtagggaaggctctgcgggga

SEQ ID NO: 7592664 - DNA, 22 bp, Homo sapiens
ggtagggaaggctctgcgggga

SEQ ID NO: 7592665 - DNA, 22 bp, Homo sapiens
ggtagggaaggtctcccacatt

SEQ ID NO: 7592666 - DNA, 22 bp, Homo sapiens
ggtagggaaggctctgcgggga

SEQ ID NO: 7592667 - DNA, 22 bp, Homo sapiens
ggtagggaaggctctgcgggga

SEQ ID NO: 7592668 - DNA, 22 bp, Homo sapiens
gggtccagagcctcagcccaga

SEQ ID NO: 7592669 - DNA, 22 bp, Homo sapiens
gggtccagagttgaagaggtta

SEQ ID NO: 7592670 - DNA, 22 bp, Homo sapiens
gggtccagagttgaagaggtta

SEQ ID NO: 7592671 - DNA, 22 bp, Homo sapiens
gggtccagagttgaagaggtta

SEQ ID NO: 7592672 - DNA, 22 bp, Homo sapiens
gggtccagagttgaagaggtta

SEQ ID NO: 7592673 - DNA, 22 bp, Homo sapiens
gggtccagagttttcccgccct

SEQ ID NO: 7592674 - DNA, 22 bp, Homo sapiens
gggtccagagttgaagaggtta

SEQ ID NO: 7592675 - DNA, 22 bp, Homo sapiens
gggtccagagttgaagaggtta

SEQ ID NO: 7592676 - DNA, 23 bp, Homo sapiens
gggtccagagacaggcatgggtg

SEQ ID NO: 7592677 - DNA, 23 bp, Homo sapiens
gggtccagagacaggcatgggtg

SEQ ID NO: 7592678 - DNA, 22 bp, Homo sapiens
gggtccagagcctcagcccaga

SEQ ID NO: 7592679 - DNA, 22 bp, Homo sapiens
gggtccagagcctcagcccaga

SEQ ID NO: 7592680 - DNA, 23 bp, Homo sapiens
gggtccagagacaggcatgggtg

SEQ ID NO: 7592681 - DNA, 23 bp, Homo sapiens
gggtccagagacaggcatgggtg

SEQ ID NO: 7592682 - DNA, 23 bp, Homo sapiens
gggtccagagaagccattagggc

SEQ ID NO: 7592683 - DNA, 23 bp, Homo sapiens
gggtccagagaagccattagggc

SEQ ID NO: 7592684 - DNA, 23 bp, Homo sapiens
gggtccagagacaggcatgggtg

SEQ ID NO: 7592685 - DNA, 22 bp, Homo sapiens
gggtcagggctggctgtcgtca

SEQ ID NO: 7592686 - DNA, 22 bp, Homo sapiens
gggtcagggctgcctgggctca

SEQ ID NO: 7592687 - DNA, 22 bp, Homo sapiens
gggtcagggctgcctgggctca

SEQ ID NO: 7592688 - DNA, 22 bp, Homo sapiens
gggtcagggctggctgtcgtca

SEQ ID NO: 7592689 - DNA, 22 bp, Homo sapiens
gggtcagggctggctgtcgtca

SEQ ID NO: 7592690 - DNA, 22 bp, Homo sapiens
gggtcagggctggctgtcgtca

SEQ ID NO: 7592691 - DNA, 22 bp, Homo sapiens
gggtccacctgagcagcagcct

SEQ ID NO: 7592692 - DNA, 22 bp, Homo sapiens
gggtcatagttattttgcaaga

SEQ ID NO: 7592693 - DNA, 22 bp, Homo sapiens
gggtcattctgaaaatgtaaac

SEQ ID NO: 7592694 - DNA, 22 bp, Homo sapiens
gggtcagtccagggcgctggga

SEQ ID NO: 7592695 - DNA, 22 bp, Homo sapiens
gggtccacctgagcagcagcct

SEQ ID NO: 7592696 - DNA, 22 bp, Homo sapiens
gggtccagacactccagaggaa

SEQ ID NO: 7592697 - DNA, 22 bp, Homo sapiens
gggtccagactatgaagaactt

SEQ ID NO: 7592698 - DNA, 22 bp, Homo sapiens
gggtccagactatgaagaactt

SEQ ID NO: 7592699 - DNA, 22 bp, Homo sapiens
gggtccagactatgaagaactt

SEQ ID NO: 7592700 - DNA, 23 bp, Homo sapiens
gggtccagagaagccattagggc

SEQ ID NO: 7592701 - DNA, 22 bp, Homo sapiens
gggtccagacactccagaggaa

SEQ ID NO: 7592702 - DNA, 22 bp, Homo sapiens
gggtccagacactccagaggaa

SEQ ID NO: 7592703 - DNA, 22 bp, Homo sapiens
gggtccagacactccagaggaa

SEQ ID NO: 7592704 - DNA, 22 bp, Homo sapiens
gggtccagacactccagaggaa

SEQ ID NO: 7592705 - DNA, 22 bp, Homo sapiens
gggtccagacactccagaggaa

SEQ ID NO: 7592706 - DNA, 22 bp, Homo sapiens
gggtccagaatgagaatgggct

SEQ ID NO: 7592707 - DNA, 22 bp, Homo sapiens
gggtccagaatgagaatgggct

SEQ ID NO: 7592708 - DNA, 22 bp, Homo sapiens
gggtccagaatgagaatgggct

SEQ ID NO: 7592709 - DNA, 22 bp, Homo sapiens
gggtcaggcctcaaggtgggct

SEQ ID NO: 7592710 - DNA, 22 bp, Homo sapiens
gggtcaggcctcaaggtgggct

SEQ ID NO: 7592711 - DNA, 22 bp, Homo sapiens
gggtcaggcctcaaggtgggct

SEQ ID NO: 7592712 - DNA, 22 bp, Homo sapiens
gggtcaggctagcccagacttc

SEQ ID NO: 7592713 - DNA, 22 bp, Homo sapiens
gggtcaggctagcccagacttc

SEQ ID NO: 7592714 - DNA, 22 bp, Homo sapiens
gggtcaggctagcccagacttc

SEQ ID NO: 7592715 - DNA, 22 bp, Homo sapiens
gggtcaggctagcccagacttc

SEQ ID NO: 7592716 - DNA, 22 bp, Homo sapiens
gggtcaggctagcccagacttc

SEQ ID NO: 7592717 - DNA, 22 bp, Homo sapiens
gggtcaggaagaattctgccaa

SEQ ID NO: 7592718 - DNA, 22 bp, Homo sapiens
gggtcaggcctcaaggtgggct

SEQ ID NO: 7592719 - DNA, 22 bp, Homo sapiens
gggtcaggaagaattctgccaa

SEQ ID NO: 7592720 - DNA, 22 bp, Homo sapiens
gggtcaggaagaattctgccaa

SEQ ID NO: 7592721 - DNA, 22 bp, Homo sapiens
gggtcaggaagaattctgccaa

SEQ ID NO: 7592722 - DNA, 22 bp, Homo sapiens
gggtcaggcctcaaggtgggct

SEQ ID NO: 7592723 - DNA, 22 bp, Homo sapiens
gggtcaggcctcaaggtgggct

SEQ ID NO: 7592724 - DNA, 22 bp, Homo sapiens
gggtcaggcctcaaggtgggct

SEQ ID NO: 7592725 - DNA, 22 bp, Homo sapiens
gggtcaggcctcaaggtgggct

SEQ ID NO: 7592726 - DNA, 22 bp, Homo sapiens
gggtcaggcctcaaggtgggct

SEQ ID NO: 7592727 - DNA, 22 bp, Homo sapiens
gggtcaggcctcaaggtgggct

SEQ ID NO: 7592728 - DNA, 22 bp, Homo sapiens
gggtcaggcctcaaggtgggct

SEQ ID NO: 7592729 - DNA, 22 bp, Homo sapiens
gggtcaggctagcccagacttc

SEQ ID NO: 7592730 - DNA, 22 bp, Homo sapiens
gggtcaggctagcccagacttc

SEQ ID NO: 7592731 - DNA, 22 bp, Homo sapiens
gggtcaggctcagcagggcagc

SEQ ID NO: 7592732 - DNA, 22 bp, Homo sapiens
gggtcaggctcagcagggcagc

SEQ ID NO: 7592733 - DNA, 22 bp, Homo sapiens
gggtcaggctcagcagggcagc

SEQ ID NO: 7592734 - DNA, 22 bp, Homo sapiens
gggtcaggctcagcagggcagc

SEQ ID NO: 7592735 - DNA, 22 bp, Homo sapiens
gggtcaggctcagcagggcagc

SEQ ID NO: 7592736 - DNA, 22 bp, Homo sapiens
gggtcaggctcagcagggcagc

SEQ ID NO: 7592737 - DNA, 22 bp, Homo sapiens
gggtcaggctcagcagggcagc

SEQ ID NO: 7592738 - DNA, 22 bp, Homo sapiens
gggtcaggctcagcagggcagc

SEQ ID NO: 7592739 - DNA, 22 bp, Homo sapiens
gggtcaggctcagcagggcagc

SEQ ID NO: 7592740 - DNA, 22 bp, Homo sapiens
gggtcaggctcagcagggcagc

SEQ ID NO: 7592741 - DNA, 22 bp, Homo sapiens
gggtcagggaggccccaccatg

SEQ ID NO: 7592742 - DNA, 22 bp, Homo sapiens
gggtcagggaggccccaccatg

SEQ ID NO: 7592743 - DNA, 22 bp, Homo sapiens
gggtcagggaggccccaccatg

SEQ ID NO: 7592744 - DNA, 22 bp, Homo sapiens
gggtcagggctgcctgggctca

SEQ ID NO: 7592745 - DNA, 22 bp, Homo sapiens
gggtcagggctgcctgggctca

SEQ ID NO: 7592746 - DNA, 22 bp, Homo sapiens
gggtcagggctgcctgggctca

SEQ ID NO: 7592747 - DNA, 22 bp, Homo sapiens
gggtcagggctgcctgggctca

SEQ ID NO: 7592748 - DNA, 22 bp, Homo sapiens
gggtcagggctgcctgggctca

SEQ ID NO: 7592749 - DNA, 22 bp, Homo sapiens
gggtcagggctgcctgggctca

SEQ ID NO: 7592750 - DNA, 22 bp, Homo sapiens
gggtcagggctgcctgggctca

SEQ ID NO: 7592751 - DNA, 22 bp, Homo sapiens
gggtcagggctgcctgggctca

SEQ ID NO: 7592752 - DNA, 22 bp, Homo sapiens
ggtaaggagctccggcttctgc

SEQ ID NO: 7592753 - DNA, 22 bp, Homo sapiens
ggtaaggagagagaaattatgc

SEQ ID NO: 7592754 - DNA, 22 bp, Homo sapiens
ggtaagcacttcatgtacatga

SEQ ID NO: 7592755 - DNA, 22 bp, Homo sapiens
ggtaacttagctcatggctgtg

SEQ ID NO: 7592756 - DNA, 22 bp, Homo sapiens
ggtaacttagctcatggctgtg

SEQ ID NO: 7592757 - DNA, 22 bp, Homo sapiens
ggtaacttagctcatggctgtg

SEQ ID NO: 7592758 - DNA, 22 bp, Homo sapiens
ggtaacttagctcatggctgtg

SEQ ID NO: 7592759 - DNA, 22 bp, Homo sapiens
ggtaacttagctcatggctgtg

SEQ ID NO: 7592760 - DNA, 22 bp, Homo sapiens
ggtaacttagctcatggctgtg

SEQ ID NO: 7592761 - DNA, 22 bp, Homo sapiens
ggtaactgaggccatattctga

SEQ ID NO: 7592762 - DNA, 22 bp, Homo sapiens
ggtaactgcacctttggcctga

SEQ ID NO: 7592763 - DNA, 22 bp, Homo sapiens
ggtaactgcagaatgtgcctca

SEQ ID NO: 7592764 - DNA, 22 bp, Homo sapiens
ggtaacagttacagtaacagta

SEQ ID NO: 7592765 - DNA, 22 bp, Homo sapiens
ggtaacagtatgtagagtaaga

SEQ ID NO: 7592766 - DNA, 22 bp, Homo sapiens
ggtaacaaggccgatagaaaca

SEQ ID NO: 7592767 - DNA, 22 bp, Homo sapiens
ggtaacaaccctacaaatccac

SEQ ID NO: 7592768 - DNA, 22 bp, Homo sapiens
ggtaacaaccctacaaatccac

SEQ ID NO: 7592769 - DNA, 22 bp, Homo sapiens
ggtaacaaggccgatagaaaca

SEQ ID NO: 7592770 - DNA, 22 bp, Homo sapiens
ggtaacacaggtgcagttttaa

SEQ ID NO: 7592771 - DNA, 22 bp, Homo sapiens
gggtccagcgacagcaggctca

SEQ ID NO: 7592772 - DNA, 22 bp, Homo sapiens
gggtccagcgacagcaggctca

SEQ ID NO: 7592773 - DNA, 22 bp, Homo sapiens
gggtccagcgacagcaggctca

SEQ ID NO: 7592774 - DNA, 19 bp, Homo sapiens
ggtaaaagtgagcttcagg

SEQ ID NO: 7592775 - DNA, 19 bp, Homo sapiens
ggtaaaagtgagcttcagg

SEQ ID NO: 7592776 - DNA, 22 bp, Homo sapiens
ggtaaaatgcagattcttagcc

SEQ ID NO: 7592777 - DNA, 22 bp, Homo sapiens
ggtaaaatgcagattcttagcc

SEQ ID NO: 7592778 - DNA, 22 bp, Homo sapiens
ggtaaattttatgtgatgaaac

SEQ ID NO: 7592779 - DNA, 22 bp, Homo sapiens
ggtaaattttatgtgatgaaac

SEQ ID NO: 7592780 - DNA, 19 bp, Homo sapiens
ggtaaatgatacatgctga

SEQ ID NO: 7592781 - DNA, 19 bp, Homo sapiens
ggtaaatgatacatgctga

SEQ ID NO: 7592782 - DNA, 22 bp, Homo sapiens
gggtccagcgacagcaggctca

SEQ ID NO: 7592783 - DNA, 22 bp, Homo sapiens
gggtccagcgacagcaggctca

SEQ ID NO: 7592784 - DNA, 22 bp, Homo sapiens
gggtccagatggtgagagttaa

SEQ ID NO: 7592785 - DNA, 22 bp, Homo sapiens
gggtccagatggtgagagttaa

SEQ ID NO: 7592786 - DNA, 22 bp, Homo sapiens
gggtccagagttttcccgccct

SEQ ID NO: 7592787 - DNA, 22 bp, Homo sapiens
gggtccagatggtgagagttaa

SEQ ID NO: 7592788 - DNA, 23 bp, Homo sapiens
gggtccagccaattccaaggaaa

SEQ ID NO: 7592789 - DNA, 23 bp, Homo sapiens
gggtccagccaattccaaggaaa

SEQ ID NO: 7592790 - DNA, 22 bp, Homo sapiens
gggtccagatggtgagagttaa

SEQ ID NO: 7592791 - DNA, 22 bp, Homo sapiens
gggtccagatggtgagagttaa

SEQ ID NO: 7592792 - DNA, 23 bp, Homo sapiens
ggtaccagcacagagtggagagg

SEQ ID NO: 7592793 - DNA, 22 bp, Homo sapiens
ggtaccaccaattcagctgcca

SEQ ID NO: 7592794 - DNA, 22 bp, Homo sapiens
ggtaccaccaattcagctgcca

SEQ ID NO: 7592795 - DNA, 22 bp, Homo sapiens
ggtacagtggcttgcactagct

SEQ ID NO: 7592796 - DNA, 21 bp, Homo sapiens
ggtaccaaagggggtgctccc

SEQ ID NO: 7592797 - DNA, 22 bp, Homo sapiens
ggtaccaaatagttgggattac

SEQ ID NO: 7592798 - DNA, 22 bp, Homo sapiens
ggtaccaagggcttgccaagtg

SEQ ID NO: 7592799 - DNA, 22 bp, Homo sapiens
ggtacatttttctgtcactttg

SEQ ID NO: 7592800 - DNA, 22 bp, Homo sapiens
ggtaccaccaattcagctgcca

SEQ ID NO: 7592801 - DNA, 22 bp, Homo sapiens
ggtagaaagatggaacgttgaa

SEQ ID NO: 7592802 - DNA, 19 bp, Homo sapiens
ggtagaagggaagtgtttt

SEQ ID NO: 7592803 - DNA, 22 bp, Homo sapiens
ggtagacaatggaatgtggcct

SEQ ID NO: 7592804 - DNA, 22 bp, Homo sapiens
ggtagacaatggaatgtggcct

SEQ ID NO: 7592805 - DNA, 22 bp, Homo sapiens
ggtaataagatctgttacatgg

SEQ ID NO: 7592806 - DNA, 22 bp, Homo sapiens
ggtaataaaattgtgtcaaaca

SEQ ID NO: 7592807 - DNA, 22 bp, Homo sapiens
ggtaataaaattgtgtcaaaca

SEQ ID NO: 7592808 - DNA, 22 bp, Homo sapiens
ggtaataaaattgtgtcaaaca

SEQ ID NO: 7592809 - DNA, 19 bp, Homo sapiens
ggtaatattgtcagtgaca

SEQ ID NO: 7592810 - DNA, 22 bp, Homo sapiens
ggtaataagatctgttacatgg

SEQ ID NO: 7592811 - DNA, 22 bp, Homo sapiens
ggtaataagatctgttacatgg

SEQ ID NO: 7592812 - DNA, 22 bp, Homo sapiens
ggtaataaaattgtgtcaaaca

SEQ ID NO: 7592813 - DNA, 22 bp, Homo sapiens
ggtaataagatctgttacatgg

SEQ ID NO: 7592814 - DNA, 22 bp, Homo sapiens
ggtaataagatctgttacatgg

SEQ ID NO: 7592815 - DNA, 22 bp, Homo sapiens
ggtaattctagtcattgcatca

SEQ ID NO: 7592816 - DNA, 22 bp, Homo sapiens
ggtaatggattcctacttttgt

SEQ ID NO: 7592817 - DNA, 22 bp, Homo sapiens
ggtaatggattcctacttttgt

SEQ ID NO: 7592818 - DNA, 22 bp, Homo sapiens
ggtaatggcttctataattcta

SEQ ID NO: 7592819 - DNA, 22 bp, Homo sapiens
ggtaatggcttctataattcta

SEQ ID NO: 7592820 - DNA, 22 bp, Homo sapiens
ggtaatactggtgatgggattt

SEQ ID NO: 7592821 - DNA, 22 bp, Homo sapiens
ggtaatggaagcacgctcagtt

SEQ ID NO: 7592822 - DNA, 22 bp, Homo sapiens
ggtaatggaagcacgctcagtt

SEQ ID NO: 7592823 - DNA, 17 bp, Homo sapiens
ggtaatggaggggaaag

SEQ ID NO: 7592824 - DNA, 17 bp, Homo sapiens
ggtaatggaggggaaag

SEQ ID NO: 7592825 - DNA, 22 bp, Homo sapiens
ggtaatggatcgtagccataga

SEQ ID NO: 7592826 - DNA, 22 bp, Homo sapiens
ggtaatggatcgtagccataga

SEQ ID NO: 7592827 - DNA, 22 bp, Homo sapiens
ggtaattagattgattaaattg

SEQ ID NO: 7592828 - DNA, 22 bp, Homo sapiens
ggtaattctagtcattgcatca

SEQ ID NO: 7592829 - DNA, 17 bp, Homo sapiens
ggtacaaacccattttt

SEQ ID NO: 7592830 - DNA, 22 bp, Homo sapiens
ggtacaaagttagatttaactt

SEQ ID NO: 7592831 - DNA, 22 bp, Homo sapiens
ggtacaaagttagatttaactt

SEQ ID NO: 7592832 - DNA, 22 bp, Homo sapiens
ggtacagacagggctgcctggg

SEQ ID NO: 7592833 - DNA, 22 bp, Homo sapiens
ggtacagggcttcctggacaag

SEQ ID NO: 7592834 - DNA, 22 bp, Homo sapiens
ggtacacattgtgactgtatta

SEQ ID NO: 7592835 - DNA, 22 bp, Homo sapiens
ggtacagaaggccaccgagtgc

SEQ ID NO: 7592836 - DNA, 22 bp, Homo sapiens
ggtacagaataaaaatcctaca

SEQ ID NO: 7592837 - DNA, 22 bp, Homo sapiens
ggtacaatgtcttacagaccca

SEQ ID NO: 7592838 - DNA, 20 bp, Homo sapiens
ggtacaacttgaatgataac

SEQ ID NO: 7592839 - DNA, 22 bp, Homo sapiens
ggtacaaggagtgaaggtttgg

SEQ ID NO: 7592840 - DNA, 22 bp, Homo sapiens
ggtacaaagttagatttaactt

SEQ ID NO: 7592841 - DNA, 22 bp, Homo sapiens
ggtgcagggagaggcaggcccc

SEQ ID NO: 7592842 - DNA, 20 bp, Homo sapiens
ggtgcaggtaacgctgtgct

SEQ ID NO: 7592843 - DNA, 22 bp, Homo sapiens
ggtgcagggagaggcaggcccc

SEQ ID NO: 7592844 - DNA, 22 bp, Homo sapiens
ggtgcagggagaggcaggcccc

SEQ ID NO: 7592845 - DNA, 22 bp, Homo sapiens
ggtgcagggagaggcaggcccc

SEQ ID NO: 7592846 - DNA, 22 bp, Homo sapiens
ggtgcagggagaggcaggcccc

SEQ ID NO: 7592847 - DNA, 22 bp, Homo sapiens
ggtgcagggagaggcaggcccc

SEQ ID NO: 7592848 - DNA, 22 bp, Homo sapiens
ggtgcagggagaggcaggcccc

SEQ ID NO: 7592849 - DNA, 22 bp, Homo sapiens
ggtgcagggagaggcaggcccc

SEQ ID NO: 7592850 - DNA, 22 bp, Homo sapiens
ggtgcagggagaggcaggcccc

SEQ ID NO: 7592851 - DNA, 22 bp, Homo sapiens
ggtgaattctaggagatctgac

SEQ ID NO: 7592852 - DNA, 22 bp, Homo sapiens
ggtgcagggagaggcaggcccc

SEQ ID NO: 7592853 - DNA, 22 bp, Homo sapiens
ggtgcagggagaggcaggcccc

SEQ ID NO: 7592854 - DNA, 22 bp, Homo sapiens
ggtgcagggagaggcaggcccc

SEQ ID NO: 7592855 - DNA, 22 bp, Homo sapiens
ggtgcaggcggtggggcaagta

SEQ ID NO: 7592856 - DNA, 22 bp, Homo sapiens
ggtgaagtatgaggaaatggag

SEQ ID NO: 7592857 - DNA, 22 bp, Homo sapiens
ggtgaagtaatgaaacagggag

SEQ ID NO: 7592858 - DNA, 22 bp, Homo sapiens
ggtgaaggtggaacgcagagca

SEQ ID NO: 7592859 - DNA, 22 bp, Homo sapiens
ggtgaataagctgaacacttgg

SEQ ID NO: 7592860 - DNA, 20 bp, Homo sapiens
ggtgcaggtaacgctgtgct

SEQ ID NO: 7592861 - DNA, 20 bp, Homo sapiens
ggtgcaggtaacgctgtgct

SEQ ID NO: 7592862 - DNA, 20 bp, Homo sapiens
ggtgcaggtaacgctgtgct

SEQ ID NO: 7592863 - DNA, 20 bp, Homo sapiens
ggtgcaggtaacgctgtgct

SEQ ID NO: 7592864 - DNA, 20 bp, Homo sapiens
ggtgcaggtaacgctgtgct

SEQ ID NO: 7592865 - DNA, 20 bp, Homo sapiens
ggtgcaggtaacgctgtgct

SEQ ID NO: 7592866 - DNA, 20 bp, Homo sapiens
ggtgcaggtaacgctgtgct

SEQ ID NO: 7592867 - DNA, 20 bp, Homo sapiens
ggtgcaggtaacgctgtgct

SEQ ID NO: 7592868 - DNA, 21 bp, Homo sapiens
ggtgcaggtaatgatgatata

SEQ ID NO: 7592869 - DNA, 21 bp, Homo sapiens
ggtgcaggtaatgatgatata

SEQ ID NO: 7592870 - DNA, 21 bp, Homo sapiens
ggtgcaggtaatgatgatata

SEQ ID NO: 7592871 - DNA, 22 bp, Homo sapiens
ggtgcagtggtgtggcaaaggg

SEQ ID NO: 7592872 - DNA, 21 bp, Homo sapiens
ggtgcaggtaatgatgatata

SEQ ID NO: 7592873 - DNA, 22 bp, Homo sapiens
ggtgcagtggtgtggcaaaggg

SEQ ID NO: 7592874 - DNA, 22 bp, Homo sapiens
ggtgcatgtgagaaagactggg

SEQ ID NO: 7592875 - DNA, 22 bp, Homo sapiens
ggtgaagggccttaggagacag

SEQ ID NO: 7592876 - DNA, 22 bp, Homo sapiens
ggtgaagggccttaggagacag

SEQ ID NO: 7592877 - DNA, 22 bp, Homo sapiens
ggtgaagggccttaggagacag

SEQ ID NO: 7592878 - DNA, 22 bp, Homo sapiens
ggtgaagggccttaggagacag

SEQ ID NO: 7592879 - DNA, 22 bp, Homo sapiens
ggtgaaggaggaagctgatgga

SEQ ID NO: 7592880 - DNA, 22 bp, Homo sapiens
ggtgaagctctaccattcccag

SEQ ID NO: 7592881 - DNA, 22 bp, Homo sapiens
ggtgaagcgtatttgtggagct

SEQ ID NO: 7592882 - DNA, 22 bp, Homo sapiens
ggtgaagcgtatttgtggagct

SEQ ID NO: 7592883 - DNA, 22 bp, Homo sapiens
ggtgaagcgtatttgtggagct

SEQ ID NO: 7592884 - DNA, 22 bp, Homo sapiens
ggtgaaggcacaagagggcaag

SEQ ID NO: 7592885 - DNA, 22 bp, Homo sapiens
ggtgaaggcacaagagggcaag

SEQ ID NO: 7592886 - DNA, 22 bp, Homo sapiens
ggtgaaggcacaagagggcaag

SEQ ID NO: 7592887 - DNA, 22 bp, Homo sapiens
ggtgaaggaggaagctgatgga

SEQ ID NO: 7592888 - DNA, 22 bp, Homo sapiens
ggtgaaggtcagagcaggaaaa

SEQ ID NO: 7592889 - DNA, 22 bp, Homo sapiens
ggtgaaggtcagagcaggaaaa

SEQ ID NO: 7592890 - DNA, 22 bp, Homo sapiens
ggtgaagggtgtcatggcattt

SEQ ID NO: 7592891 - DNA, 22 bp, Homo sapiens
ggtgaagggccttaggagacag

SEQ ID NO: 7592892 - DNA, 22 bp, Homo sapiens
ggtgaagggtgtcatggcattt

SEQ ID NO: 7592893 - DNA, 22 bp, Homo sapiens
ggtgaaggtggaacgcagagca

SEQ ID NO: 7592894 - DNA, 22 bp, Homo sapiens
ggtgaagtaataccaggtgtac

SEQ ID NO: 7592895 - DNA, 22 bp, Homo sapiens
ggtgaaggtggaacgcagagca

SEQ ID NO: 7592896 - DNA, 22 bp, Homo sapiens
ggtgaaggtctactgtgtgcca

SEQ ID NO: 7592897 - DNA, 22 bp, Homo sapiens
ggtgaaggtggaacgcagagca

SEQ ID NO: 7592898 - DNA, 22 bp, Homo sapiens
ggtgaaggtggaacgcagagca

SEQ ID NO: 7592899 - DNA, 22 bp, Homo sapiens
ggtgaaggtctactgtgtgcca

SEQ ID NO: 7592900 - DNA, 22 bp, Homo sapiens
ggtgaaggtcagagcaggaaaa

SEQ ID NO: 7592901 - DNA, 18 bp, Homo sapiens
ggtctttaggtcagtgtc

SEQ ID NO: 7592902 - DNA, 21 bp, Homo sapiens
ggtcttgggaggtgccctggg

SEQ ID NO: 7592903 - DNA, 22 bp, Homo sapiens
ggtcttgtttatataaggtggt

SEQ ID NO: 7592904 - DNA, 22 bp, Homo sapiens
ggtcttgtttatataaggtggt

SEQ ID NO: 7592905 - DNA, 22 bp, Homo sapiens
ggtcttttcacagtggtttgag

SEQ ID NO: 7592906 - DNA, 22 bp, Homo sapiens
ggtctttctttgatagtggaga

SEQ ID NO: 7592907 - DNA, 22 bp, Homo sapiens
ggtctttctttgatagtggaga

SEQ ID NO: 7592908 - DNA, 22 bp, Homo sapiens
ggtgaaatatttttgatatgtt

SEQ ID NO: 7592909 - DNA, 22 bp, Homo sapiens
ggtgaaatatttttgatatgtt

SEQ ID NO: 7592910 - DNA, 22 bp, Homo sapiens
ggtgaagcgtatttgtggagct

SEQ ID NO: 7592911 - DNA, 22 bp, Homo sapiens
ggtgaagcctctagttacattt

SEQ ID NO: 7592912 - DNA, 16 bp, Homo sapiens
ggtgaagcattatgtc

SEQ ID NO: 7592913 - DNA, 22 bp, Homo sapiens
ggtgaagccagggcatcaatat

SEQ ID NO: 7592914 - DNA, 22 bp, Homo sapiens
ggtgaacagttgtttcaaatat

SEQ ID NO: 7592915 - DNA, 22 bp, Homo sapiens
ggtgaacattgatgtggttaca

SEQ ID NO: 7592916 - DNA, 22 bp, Homo sapiens
ggtgaagcagagtctattacta

SEQ ID NO: 7592917 - DNA, 22 bp, Homo sapiens
ggtgaaatgtagtcttgtgaga

SEQ ID NO: 7592918 - DNA, 22 bp, Homo sapiens
ggtgaaattccttgtggaaagt

SEQ ID NO: 7592919 - DNA, 22 bp, Homo sapiens
ggtgaaattccttgtggaaagt

SEQ ID NO: 7592920 - DNA, 22 bp, Homo sapiens
ggtgaacattgatgtggttaca

SEQ ID NO: 7592921 - DNA, 22 bp, Homo sapiens
ggtcttctggaaagcagactgt

SEQ ID NO: 7592922 - DNA, 22 bp, Homo sapiens
ggtcttgctatgttgcccaggc

SEQ ID NO: 7592923 - DNA, 22 bp, Homo sapiens
ggtcttcctatggcggggccct

SEQ ID NO: 7592924 - DNA, 22 bp, Homo sapiens
ggtcttctctatgagctggtct

SEQ ID NO: 7592925 - DNA, 21 bp, Homo sapiens
ggtcttccaaataaggagaaa

SEQ ID NO: 7592926 - DNA, 22 bp, Homo sapiens
ggtcttcaggtctagttggtat

SEQ ID NO: 7592927 - DNA, 21 bp, Homo sapiens
ggtcttccaaataaggagaaa

SEQ ID NO: 7592928 - DNA, 22 bp, Homo sapiens
ggtcttccgagaggcctgtgct

SEQ ID NO: 7592929 - DNA, 21 bp, Homo sapiens
ggtcttcccactgtctggtga

SEQ ID NO: 7592930 - DNA, 17 bp, Homo sapiens
ggtctgtgtctagggaa

SEQ ID NO: 7592931 - DNA, 17 bp, Homo sapiens
ggtctgtgtctagggaa

SEQ ID NO: 7592932 - DNA, 22 bp, Homo sapiens
ggtctgtgtgctttgggaagtg

SEQ ID NO: 7592933 - DNA, 17 bp, Homo sapiens
ggtctgtgtctagggaa

SEQ ID NO: 7592934 - DNA, 21 bp, Homo sapiens
ggtcttcaaagcttttacgat

SEQ ID NO: 7592935 - DNA, 22 bp, Homo sapiens
ggtctgtgtgctttgggaagtg

SEQ ID NO: 7592936 - DNA, 22 bp, Homo sapiens
ggtctgtgtgctttgggaagtg

SEQ ID NO: 7592937 - DNA, 22 bp, Homo sapiens
ggtcttagccaagtttctttat

SEQ ID NO: 7592938 - DNA, 22 bp, Homo sapiens
ggtctgtgatcttatggattct

SEQ ID NO: 7592939 - DNA, 22 bp, Homo sapiens
ggtctgtgctctggagcctctg

SEQ ID NO: 7592940 - DNA, 22 bp, Homo sapiens
ggtctgtgctctggagcctctg

SEQ ID NO: 7592941 - DNA, 22 bp, Homo sapiens
ggtctgtgctctggagcctctg

SEQ ID NO: 7592942 - DNA, 22 bp, Homo sapiens
ggtctgtgctctggagcctctg

SEQ ID NO: 7592943 - DNA, 22 bp, Homo sapiens
ggtctgtgctctggagcctctg

SEQ ID NO: 7592944 - DNA, 22 bp, Homo sapiens
ggtctgtgtcataggctgagtt

SEQ ID NO: 7592945 - DNA, 22 bp, Homo sapiens
ggtctgtgatcttatggattct

SEQ ID NO: 7592946 - DNA, 22 bp, Homo sapiens
ggtctggggcaggcatctgaca

SEQ ID NO: 7592947 - DNA, 22 bp, Homo sapiens
ggtctggggcaggcatctgaca

SEQ ID NO: 7592948 - DNA, 22 bp, Homo sapiens
ggtctgggtttccccaccacac

SEQ ID NO: 7592949 - DNA, 17 bp, Homo sapiens
ggtctggggccattggc

SEQ ID NO: 7592950 - DNA, 22 bp, Homo sapiens
ggtctgtaggggaaggtctgga

SEQ ID NO: 7592951 - DNA, 22 bp, Homo sapiens
ggtctgggcttgagtccttttg

SEQ ID NO: 7592952 - DNA, 22 bp, Homo sapiens
ggtctggcctcgggcaccccca

SEQ ID NO: 7592953 - DNA, 22 bp, Homo sapiens
ggtcccacggtgaattcgtgcc

SEQ ID NO: 7592954 - DNA, 22 bp, Homo sapiens
ggtcccacggtgaattcgtgcc

SEQ ID NO: 7592955 - DNA, 22 bp, Homo sapiens
ggtcccagaattggttagcaca

SEQ ID NO: 7592956 - DNA, 22 bp, Homo sapiens
ggtcccagaattggttagcaca

SEQ ID NO: 7592957 - DNA, 22 bp, Homo sapiens
ggtcccaagtgcttttcctgca

SEQ ID NO: 7592958 - DNA, 22 bp, Homo sapiens
ggtccagttctccctctatgtc

SEQ ID NO: 7592959 - DNA, 22 bp, Homo sapiens
ggtcccaaggaggatgaggcta

SEQ ID NO: 7592960 - DNA, 22 bp, Homo sapiens
ggtcccaagcaatgcccttggc

SEQ ID NO: 7592961 - DNA, 22 bp, Homo sapiens
ggtccatgataggaagttccga

SEQ ID NO: 7592962 - DNA, 22 bp, Homo sapiens
ggtcccaagcaatgcccttggc

SEQ ID NO: 7592963 - DNA, 22 bp, Homo sapiens
ggtccatctcttgagcccacat

SEQ ID NO: 7592964 - DNA, 22 bp, Homo sapiens
ggtccatctcttgagcccacat

SEQ ID NO: 7592965 - DNA, 22 bp, Homo sapiens
ggtccagtgggttcctccaata

SEQ ID NO: 7592966 - DNA, 22 bp, Homo sapiens
ggtccaggtttgctctacttgt

SEQ ID NO: 7592967 - DNA, 22 bp, Homo sapiens
ggtccagtctttcccttctaga

SEQ ID NO: 7592968 - DNA, 22 bp, Homo sapiens
ggtgggagccaacacccttctg

SEQ ID NO: 7592969 - DNA, 22 bp, Homo sapiens
ggtgggagccaacacccttctg

SEQ ID NO: 7592970 - DNA, 23 bp, Homo sapiens
ggtgggagattatccagaattat

SEQ ID NO: 7592971 - DNA, 22 bp, Homo sapiens
ggtgggaggactgtttgaggca

SEQ ID NO: 7592972 - DNA, 22 bp, Homo sapiens
ggtgggagccaacacccttctg

SEQ ID NO: 7592973 - DNA, 22 bp, Homo sapiens
ggtgggaggcaggctgctccca

SEQ ID NO: 7592974 - DNA, 22 bp, Homo sapiens
ggtgggaggcaggctgctccca

SEQ ID NO: 7592975 - DNA, 22 bp, Homo sapiens
ggtgggaggactgtttgaggca

SEQ ID NO: 7592976 - DNA, 22 bp, Homo sapiens
ggtgggaggactgtttgaggca

SEQ ID NO: 7592977 - DNA, 22 bp, Homo sapiens
ggtgggagggctgcgttcctct

SEQ ID NO: 7592978 - DNA, 22 bp, Homo sapiens
ggtgggagggctgcgttcctct

SEQ ID NO: 7592979 - DNA, 22 bp, Homo sapiens
ggtgggagggctgcgttcctct

SEQ ID NO: 7592980 - DNA, 22 bp, Homo sapiens
ggtgggagggctgcgttcctct

SEQ ID NO: 7592981 - DNA, 22 bp, Homo sapiens
ggtgggagggctgcgttcctct

SEQ ID NO: 7592982 - DNA, 22 bp, Homo sapiens
ggtgggaggcaggctgctccca

SEQ ID NO: 7592983 - DNA, 22 bp, Homo sapiens
ggtgggaggcaggctgctccca

SEQ ID NO: 7592984 - DNA, 22 bp, Homo sapiens
ggtgggaggcaggctgctccca

SEQ ID NO: 7592985 - DNA, 22 bp, Homo sapiens
ggtgggaggcaggctgctccca

SEQ ID NO: 7592986 - DNA, 22 bp, Homo sapiens
ggtgggaggcaggctgctccca

SEQ ID NO: 7592987 - DNA, 22 bp, Homo sapiens
ggtgggaggcaggctgctccca

SEQ ID NO: 7592988 - DNA, 22 bp, Homo sapiens
ggtgggagagcttgctttgatg

SEQ ID NO: 7592989 - DNA, 22 bp, Homo sapiens
ggtgggagagcttgctttgatg

SEQ ID NO: 7592990 - DNA, 22 bp, Homo sapiens
ggtgggagagctctgtctccag

SEQ ID NO: 7592991 - DNA, 22 bp, Homo sapiens
ggtgggagagctctgtctccag

SEQ ID NO: 7592992 - DNA, 22 bp, Homo sapiens
ggtgggagagctctgtctccag

SEQ ID NO: 7592993 - DNA, 22 bp, Homo sapiens
ggtgggagagcttgctttgatg

SEQ ID NO: 7592994 - DNA, 23 bp, Homo sapiens
ggtgggagattatccagaattat

SEQ ID NO: 7592995 - DNA, 23 bp, Homo sapiens
ggtgggagattatccagaattat

SEQ ID NO: 7592996 - DNA, 22 bp, Homo sapiens
ggtgggagagcttgctttgatg

SEQ ID NO: 7592997 - DNA, 23 bp, Homo sapiens
ggtgggagattatccagaattat

SEQ ID NO: 7592998 - DNA, 23 bp, Homo sapiens
ggtgggagattatccagaattat

SEQ ID NO: 7592999 - DNA, 22 bp, Homo sapiens
ggtgggagagctctgtctccag

SEQ ID NO: 7593000 - DNA, 22 bp, Homo sapiens
ggtggctgcaccctggctaact

SEQ ID NO: 7593001 - DNA, 22 bp, Homo sapiens
ggtggctgcaatggctaacttc

SEQ ID NO: 7593002 - DNA, 22 bp, Homo sapiens
ggtggctgcaatggctaacttc

SEQ ID NO: 7593003 - DNA, 22 bp, Homo sapiens
ggtggctgaatcaaatcaggcc

SEQ ID NO: 7593004 - DNA, 22 bp, Homo sapiens
ggtggctgaatcaaatcaggcc

SEQ ID NO: 7593005 - DNA, 22 bp, Homo sapiens
ggtggctgaatcaaatcaggcc

SEQ ID NO: 7593006 - DNA, 22 bp, Homo sapiens
ggtgggcaacatttggcctgag

SEQ ID NO: 7593007 - DNA, 21 bp, Homo sapiens
ggtgggcacaggagagcagag

SEQ ID NO: 7593008 - DNA, 21 bp, Homo sapiens
ggtgggcacaggagagcagag

SEQ ID NO: 7593009 - DNA, 21 bp, Homo sapiens
ggtgggcacaggagagcagag

SEQ ID NO: 7593010 - DNA, 21 bp, Homo sapiens
ggtgggcacaggagagcagag

SEQ ID NO: 7593011 - DNA, 22 bp, Homo sapiens
ggtgggcaacatttggcctgag

SEQ ID NO: 7593012 - DNA, 22 bp, Homo sapiens
ggtgggcaacatttggcctgag

SEQ ID NO: 7593013 - DNA, 22 bp, Homo sapiens
ggtgggatggaggatcttagac

SEQ ID NO: 7593014 - DNA, 22 bp, Homo sapiens
ggtgggagtggaacgtggaaga

SEQ ID NO: 7593015 - DNA, 22 bp, Homo sapiens
ggtgggcaacatttggcctgag

SEQ ID NO: 7593016 - DNA, 22 bp, Homo sapiens
ggtgggcaacatttggcctgag

SEQ ID NO: 7593017 - DNA, 22 bp, Homo sapiens
ggtgggcaacatttggcctgag

SEQ ID NO: 7593018 - DNA, 22 bp, Homo sapiens
ggtgggcaacatttggcctgag

SEQ ID NO: 7593019 - DNA, 22 bp, Homo sapiens
ggtgggcaacatttggcctgag

SEQ ID NO: 7593020 - DNA, 22 bp, Homo sapiens
ggtgggagtgggcacagttacg

SEQ ID NO: 7593021 - DNA, 22 bp, Homo sapiens
ggtgggagtgggcacagttacg

SEQ ID NO: 7593022 - DNA, 22 bp, Homo sapiens
ggtgggatcaaagagtcattcg

SEQ ID NO: 7593023 - DNA, 22 bp, Homo sapiens
ggtgggatcaaagagtcattcg

SEQ ID NO: 7593024 - DNA, 22 bp, Homo sapiens
ggtgggatgcctctggagaagt

SEQ ID NO: 7593025 - DNA, 22 bp, Homo sapiens
ggtgggatgcctctggagaagt

SEQ ID NO: 7593026 - DNA, 22 bp, Homo sapiens
ggtgggatgcctctggagaagt

SEQ ID NO: 7593027 - DNA, 16 bp, Homo sapiens
ggtgggaggtgaggtg

SEQ ID NO: 7593028 - DNA, 16 bp, Homo sapiens
ggtgggaggtgaggtg

SEQ ID NO: 7593029 - DNA, 16 bp, Homo sapiens
ggtgggaggtgaggtg

SEQ ID NO: 7593030 - DNA, 16 bp, Homo sapiens
ggtgggaggtgaggtg

SEQ ID NO: 7593031 - DNA, 22 bp, Homo sapiens
ggtgggagggctgcgttcctct

SEQ ID NO: 7593032 - DNA, 16 bp, Homo sapiens
ggtgggaggtgaggtg

SEQ ID NO: 7593033 - DNA, 16 bp, Homo sapiens
ggtgggaggtgaggtg

SEQ ID NO: 7593034 - DNA, 16 bp, Homo sapiens
ggtgggaggtgaggtg

SEQ ID NO: 7593035 - DNA, 16 bp, Homo sapiens
ggtgggaggtgaggtg

SEQ ID NO: 7593036 - DNA, 16 bp, Homo sapiens
ggtgggaggtgaggtg

SEQ ID NO: 7593037 - DNA, 22 bp, Homo sapiens
ggtgggagtggaacgtggaaga

SEQ ID NO: 7593038 - DNA, 22 bp, Homo sapiens
ggtgggagtggaacgtggaaga

SEQ ID NO: 7593039 - DNA, 22 bp, Homo sapiens
ggtgggagtggaacgtggaaga

SEQ ID NO: 7593040 - DNA, 22 bp, Homo sapiens
ggtgggagtggaacgtggaaga

SEQ ID NO: 7593041 - DNA, 22 bp, Homo sapiens
ggtgggagtggaacgtggaaga

SEQ ID NO: 7593042 - DNA, 22 bp, Homo sapiens
ggtgggagtgggcacagttacg

SEQ ID NO: 7593043 - DNA, 22 bp, Homo sapiens
ggtgggagtggaacgtggaaga

SEQ ID NO: 7593044 - DNA, 22 bp, Homo sapiens
ggtgggagtgggcacagttacg

SEQ ID NO: 7593045 - DNA, 22 bp, Homo sapiens
ggtgggagtgggcacagttacg

SEQ ID NO: 7593046 - DNA, 22 bp, Homo sapiens
ggtgccagagtggcccaggggc

SEQ ID NO: 7593047 - DNA, 22 bp, Homo sapiens
ggtgccagagtggcccaggggc

SEQ ID NO: 7593048 - DNA, 22 bp, Homo sapiens
ggtgccagagtggcccaggggc

SEQ ID NO: 7593049 - DNA, 22 bp, Homo sapiens
ggtgccagagtggcccaggggc

SEQ ID NO: 7593050 - DNA, 22 bp, Homo sapiens
ggtgccaatttatttagccaag

SEQ ID NO: 7593051 - DNA, 22 bp, Homo sapiens
ggtgccacataaatggagagag

SEQ ID NO: 7593052 - DNA, 22 bp, Homo sapiens
ggtgccacataaatggagagag

SEQ ID NO: 7593053 - DNA, 22 bp, Homo sapiens
ggtgccactgcactctggcctg

SEQ ID NO: 7593054 - DNA, 22 bp, Homo sapiens
ggtgccaagttgcaactcgcca

SEQ ID NO: 7593055 - DNA, 18 bp, Homo sapiens
ggtgccaagtctgggatc

SEQ ID NO: 7593056 - DNA, 23 bp, Homo sapiens
ggtgccaagcttctatgtttagc

SEQ ID NO: 7593057 - DNA, 22 bp, Homo sapiens
ggtgccaagaactacaggattc

SEQ ID NO: 7593058 - DNA, 22 bp, Homo sapiens
ggtgccagcctagtgcagtggt

SEQ ID NO: 7593059 - DNA, 22 bp, Homo sapiens
ggtgccagcctagtgcagtggt

SEQ ID NO: 7593060 - DNA, 22 bp, Homo sapiens
ggtgccagcctagtgcagtggt

SEQ ID NO: 7593061 - DNA, 22 bp, Homo sapiens
ggtgccagcctagtgcagtggt

SEQ ID NO: 7593062 - DNA, 22 bp, Homo sapiens
ggtgccagatgaggcccgcgat

SEQ ID NO: 7593063 - DNA, 22 bp, Homo sapiens
ggtgccagaaaacttgaagagt

SEQ ID NO: 7593064 - DNA, 22 bp, Homo sapiens
ggtgccagatgaggcccgcgat

SEQ ID NO: 7593065 - DNA, 22 bp, Homo sapiens
ggtgccaggctcccagctcagg

SEQ ID NO: 7593066 - DNA, 22 bp, Homo sapiens
ggtgccaggctgtagtcagggt

SEQ ID NO: 7593067 - DNA, 22 bp, Homo sapiens
ggtgccaggctgtagtcagggt

SEQ ID NO: 7593068 - DNA, 22 bp, Homo sapiens
ggtgccaggctgtagtcagggt

SEQ ID NO: 7593069 - DNA, 22 bp, Homo sapiens
ggtgccaggctgtagtcagggt

SEQ ID NO: 7593070 - DNA, 22 bp, Homo sapiens
ggtgccaggctgtagtcagggt

SEQ ID NO: 7593071 - DNA, 22 bp, Homo sapiens
ggtgccaggctgtagtcagggt

SEQ ID NO: 7593072 - DNA, 22 bp, Homo sapiens
ggtgccagcctagtgcagtggt

SEQ ID NO: 7593073 - DNA, 22 bp, Homo sapiens
ggtgccaggctcccagctcagg

SEQ ID NO: 7593074 - DNA, 22 bp, Homo sapiens
ggtgccaggctcccagctcagg

SEQ ID NO: 7593075 - DNA, 22 bp, Homo sapiens
ggtgccaggctcccagctcagg

SEQ ID NO: 7593076 - DNA, 22 bp, Homo sapiens
ggtgccagtgggtctcaggata

SEQ ID NO: 7593077 - DNA, 22 bp, Homo sapiens
ggtgccagcctagtgcagtggt

SEQ ID NO: 7593078 - DNA, 22 bp, Homo sapiens
ggtgccagtgggtctcaggata

SEQ ID NO: 7593079 - DNA, 22 bp, Homo sapiens
ggtgccagtgggtctcaggata

SEQ ID NO: 7593080 - DNA, 22 bp, Homo sapiens
ggtgccaggctgtagtcagggt

SEQ ID NO: 7593081 - DNA, 22 bp, Homo sapiens
ggtggctctgttgtcaactgat

SEQ ID NO: 7593082 - DNA, 22 bp, Homo sapiens
ggtgcggagactccatgaggcc

SEQ ID NO: 7593083 - DNA, 22 bp, Homo sapiens
ggtgcggagactccatgaggcc

SEQ ID NO: 7593084 - DNA, 22 bp, Homo sapiens
ggtggctctgttgtcaactgat

SEQ ID NO: 7593085 - DNA, 22 bp, Homo sapiens
ggtgctcaaggtgacaggacat

SEQ ID NO: 7593086 - DNA, 22 bp, Homo sapiens
ggtggctctgttgtcaactgat

SEQ ID NO: 7593087 - DNA, 22 bp, Homo sapiens
ggtggctgaagcagtcttcggg

SEQ ID NO: 7593088 - DNA, 22 bp, Homo sapiens
ggtggctgaagcagtcttcggg

SEQ ID NO: 7593089 - DNA, 22 bp, Homo sapiens
ggtgccttttccgtgtggccca

SEQ ID NO: 7593090 - DNA, 22 bp, Homo sapiens
ggtgccttttccgtgtggccca

SEQ ID NO: 7593091 - DNA, 20 bp, Homo sapiens
ggtgcgaggccagagcagac

SEQ ID NO: 7593092 - DNA, 22 bp, Homo sapiens
ggtgcggagactccatgaggcc

SEQ ID NO: 7593093 - DNA, 20 bp, Homo sapiens
ggtgcgaggccagagcagac

SEQ ID NO: 7593094 - DNA, 22 bp, Homo sapiens
ggtgcctgtatttggggcacag

SEQ ID NO: 7593095 - DNA, 22 bp, Homo sapiens
ggtgcctgtatttggggcacag

SEQ ID NO: 7593096 - DNA, 22 bp, Homo sapiens
ggtgcctgtatttggggcacag

SEQ ID NO: 7593097 - DNA, 22 bp, Homo sapiens
ggtgcctttggcccctggctag

SEQ ID NO: 7593098 - DNA, 22 bp, Homo sapiens
ggtgccttcctgccagccgcaa

SEQ ID NO: 7593099 - DNA, 22 bp, Homo sapiens
ggtgccctggaagctgctgcat

SEQ ID NO: 7593100 - DNA, 22 bp, Homo sapiens
ggtgcccgccggcaaccctcgg

SEQ ID NO: 7593101 - DNA, 22 bp, Homo sapiens
ggtgccctgccaggatgtgcca

SEQ ID NO: 7593102 - DNA, 22 bp, Homo sapiens
ggtgccctgccaggatgtgcca

SEQ ID NO: 7593103 - DNA, 22 bp, Homo sapiens
ggtgccctgtaaaagccatgca

SEQ ID NO: 7593104 - DNA, 22 bp, Homo sapiens
ggtgccctggaagctgctgcat

SEQ ID NO: 7593105 - DNA, 22 bp, Homo sapiens
ggtgccctgtaaaagccatgca

SEQ ID NO: 7593106 - DNA, 22 bp, Homo sapiens
ggtgccctgtaaaagccatgca

SEQ ID NO: 7593107 - DNA, 22 bp, Homo sapiens
ggtgcccttcagacagtgggca

SEQ ID NO: 7593108 - DNA, 22 bp, Homo sapiens
ggtgcctgatggtgatgaggtc

SEQ ID NO: 7593109 - DNA, 22 bp, Homo sapiens
ggtgccgttgaggaagtaactg

SEQ ID NO: 7593110 - DNA, 22 bp, Homo sapiens
ggtgcctgtatttggggcacag

SEQ ID NO: 7593111 - DNA, 22 bp, Homo sapiens
ggtgcctgtatttggggcacag

SEQ ID NO: 7593112 - DNA, 22 bp, Homo sapiens
ggtgcctgtatttggggcacag

SEQ ID NO: 7593113 - DNA, 22 bp, Homo sapiens
ggtgcctgatggtgatgaggtc

SEQ ID NO: 7593114 - DNA, 22 bp, Homo sapiens
ggtgcccagcgaagtggctgtg

SEQ ID NO: 7593115 - DNA, 22 bp, Homo sapiens
ggtgcccagcgaagtggctgtg

SEQ ID NO: 7593116 - DNA, 22 bp, Homo sapiens
ggtgcccagcgaagtggctgtg

SEQ ID NO: 7593117 - DNA, 22 bp, Homo sapiens
ggtgcccagcaagctttcaatg

SEQ ID NO: 7593118 - DNA, 22 bp, Homo sapiens
ggtgcccagagccaggaatgag

SEQ ID NO: 7593119 - DNA, 22 bp, Homo sapiens
ggtgcccagagccaggaatgag

SEQ ID NO: 7593120 - DNA, 22 bp, Homo sapiens
ggtgcccagagccaggaatgag

SEQ ID NO: 7593121 - DNA, 22 bp, Homo sapiens
ggtgcccagagccaggaatgag

SEQ ID NO: 7593122 - DNA, 22 bp, Homo sapiens
ggtgccatattatatacagttt

SEQ ID NO: 7593123 - DNA, 22 bp, Homo sapiens
ggtgcccaaggaaggttgccgt

SEQ ID NO: 7593124 - DNA, 22 bp, Homo sapiens
ggtgcccacctgtcttcctgga

SEQ ID NO: 7593125 - DNA, 22 bp, Homo sapiens
ggtgcccacctgtcttcctgga

SEQ ID NO: 7593126 - DNA, 22 bp, Homo sapiens
ggcctggcctccagatgtgggc

SEQ ID NO: 7593127 - DNA, 22 bp, Homo sapiens
ggcctggcctccagatgtgggc

SEQ ID NO: 7593128 - DNA, 22 bp, Homo sapiens
ggcctggcctccagatgtgggc

SEQ ID NO: 7593129 - DNA, 22 bp, Homo sapiens
ggcctggcctccagatgtgggc

SEQ ID NO: 7593130 - DNA, 22 bp, Homo sapiens
ggcctggcctccagatgtgggc

SEQ ID NO: 7593131 - DNA, 22 bp, Homo sapiens
ggcctggcctccagatgtgggc

SEQ ID NO: 7593132 - DNA, 22 bp, Homo sapiens
ggcctggcctccagatgtgggc

SEQ ID NO: 7593133 - DNA, 22 bp, Homo sapiens
ggcctggcctccagatgtgggc

SEQ ID NO: 7593134 - DNA, 22 bp, Homo sapiens
ggcctggcctccagatgtgggc

SEQ ID NO: 7593135 - DNA, 22 bp, Homo sapiens
ggcctggccctcccgggttcaa

SEQ ID NO: 7593136 - DNA, 22 bp, Homo sapiens
ggcctggccctcccgggttcaa

SEQ ID NO: 7593137 - DNA, 22 bp, Homo sapiens
ggcctggccctcccgggttcaa

SEQ ID NO: 7593138 - DNA, 23 bp, Homo sapiens
ggcctggcccagggccctgatga

SEQ ID NO: 7593139 - DNA, 23 bp, Homo sapiens
ggcctggcccagggccctgatga

SEQ ID NO: 7593140 - DNA, 23 bp, Homo sapiens
ggcctggcccagggccctgatga

SEQ ID NO: 7593141 - DNA, 23 bp, Homo sapiens
ggcctggcccagggccctgatga

SEQ ID NO: 7593142 - DNA, 23 bp, Homo sapiens
ggcctggcccagggccctgatga

SEQ ID NO: 7593143 - DNA, 22 bp, Homo sapiens
ggcctggcatggggactaaggg

SEQ ID NO: 7593144 - DNA, 22 bp, Homo sapiens
ggcctggcatggggactaaggg

SEQ ID NO: 7593145 - DNA, 22 bp, Homo sapiens
ggcctggcatggggactaaggg

SEQ ID NO: 7593146 - DNA, 22 bp, Homo sapiens
ggcctggcagagcgcgcggctg

SEQ ID NO: 7593147 - DNA, 22 bp, Homo sapiens
ggcctggcagagcgcgcggctg

SEQ ID NO: 7593148 - DNA, 22 bp, Homo sapiens
ggcctggcagagcgcgcggctg

SEQ ID NO: 7593149 - DNA, 22 bp, Homo sapiens
ggcctggcagagcgcgcggctg

SEQ ID NO: 7593150 - DNA, 19 bp, Homo sapiens
ggcctggatttagggctcc

SEQ ID NO: 7593151 - DNA, 22 bp, Homo sapiens
ggcctggagtttggggaataga

SEQ ID NO: 7593152 - DNA, 22 bp, Homo sapiens
ggcctggagtttggggaataga

SEQ ID NO: 7593153 - DNA, 22 bp, Homo sapiens
ggcctggagtttggggaataga

SEQ ID NO: 7593154 - DNA, 19 bp, Homo sapiens
ggcctggatttagggctcc

SEQ ID NO: 7593155 - DNA, 22 bp, Homo sapiens
ggcctggagtttggggaataga

SEQ ID NO: 7593156 - DNA, 22 bp, Homo sapiens
ggcctggagtcagggaaagcaa

SEQ ID NO: 7593157 - DNA, 22 bp, Homo sapiens
ggcctggagtcagggaaagcaa

SEQ ID NO: 7593158 - DNA, 22 bp, Homo sapiens
ggcctggagtcagggaaagcaa

SEQ ID NO: 7593159 - DNA, 22 bp, Homo sapiens
ggcctggagtcagggaaagcaa

SEQ ID NO: 7593160 - DNA, 22 bp, Homo sapiens
ggcctggagtcagggaaagcaa

SEQ ID NO: 7593161 - DNA, 22 bp, Homo sapiens
ggcctggacacctgaggtctta

SEQ ID NO: 7593162 - DNA, 22 bp, Homo sapiens
ggcctggagaaggcccagggag

SEQ ID NO: 7593163 - DNA, 22 bp, Homo sapiens
ggcctggagaaggcccagggag

SEQ ID NO: 7593164 - DNA, 22 bp, Homo sapiens
ggcctggagaaggcccagggag

SEQ ID NO: 7593165 - DNA, 22 bp, Homo sapiens
ggcctggagcagagactaggga

SEQ ID NO: 7593166 - DNA, 22 bp, Homo sapiens
ggcctggagcagagactaggga

SEQ ID NO: 7593167 - DNA, 22 bp, Homo sapiens
ggcctggagcagagactaggga

SEQ ID NO: 7593168 - DNA, 19 bp, Homo sapiens
ggcctggctatccctgctg

SEQ ID NO: 7593169 - DNA, 19 bp, Homo sapiens
ggcctggctatccctgctg

SEQ ID NO: 7593170 - DNA, 19 bp, Homo sapiens
ggcctggctatccctgctg

SEQ ID NO: 7593171 - DNA, 22 bp, Homo sapiens
ggcctggcctcccttcctagcg

SEQ ID NO: 7593172 - DNA, 22 bp, Homo sapiens
ggcctggcctcccttcctagcg

SEQ ID NO: 7593173 - DNA, 22 bp, Homo sapiens
ggcctggcctcccttcctagcg

SEQ ID NO: 7593174 - DNA, 22 bp, Homo sapiens
ggcctggctcttgcccagcctg

SEQ ID NO: 7593175 - DNA, 22 bp, Homo sapiens
ggcctggctcttgcccagcctg

SEQ ID NO: 7593176 - DNA, 19 bp, Homo sapiens
ggcctggctatccctgctg

SEQ ID NO: 7593177 - DNA, 19 bp, Homo sapiens
ggcctggctatccctgctg

SEQ ID NO: 7593178 - DNA, 19 bp, Homo sapiens
ggcctggctatccctgctg

SEQ ID NO: 7593179 - DNA, 22 bp, Homo sapiens
ggcggggtctgagcgccgcgcc

SEQ ID NO: 7593180 - DNA, 22 bp, Homo sapiens
ggcggggtctgagcgccgcgcc

SEQ ID NO: 7593181 - DNA, 22 bp, Homo sapiens
ggcgggtgcacagacccttccc

SEQ ID NO: 7593182 - DNA, 22 bp, Homo sapiens
ggcctggctggttcagtaccct

SEQ ID NO: 7593183 - DNA, 22 bp, Homo sapiens
ggcctggctggttcagtaccct

SEQ ID NO: 7593184 - DNA, 22 bp, Homo sapiens
ggcctggctcttgcccagcctg

SEQ ID NO: 7593185 - DNA, 22 bp, Homo sapiens
ggcctggctcttgcccagcctg

SEQ ID NO: 7593186 - DNA, 22 bp, Homo sapiens
ggcctggctcttgcccagcctg

SEQ ID NO: 7593187 - DNA, 22 bp, Homo sapiens
ggcctggctcttgcccagcctg

SEQ ID NO: 7593188 - DNA, 22 bp, Homo sapiens
ggcgggtggcgaggcttctcgg

SEQ ID NO: 7593189 - DNA, 22 bp, Homo sapiens
ggcgggtggcgaggcttctcgg

SEQ ID NO: 7593190 - DNA, 22 bp, Homo sapiens
ggcgggtgtaagtaggacagcg

SEQ ID NO: 7593191 - DNA, 22 bp, Homo sapiens
ggcgggtgtaagtaggacagcg

SEQ ID NO: 7593192 - DNA, 22 bp, Homo sapiens
ggcgggtgtaagtaggacagcg

SEQ ID NO: 7593193 - DNA, 19 bp, Homo sapiens
ggcgggtggactggagccc

SEQ ID NO: 7593194 - DNA, 19 bp, Homo sapiens
ggcgggtggactggagccc

SEQ ID NO: 7593195 - DNA, 22 bp, Homo sapiens
ggcgggtgcacagacccttccc

SEQ ID NO: 7593196 - DNA, 22 bp, Homo sapiens
ggcgggtgtaagtaggacagcg

SEQ ID NO: 7593197 - DNA, 18 bp, Homo sapiens
ggcgggtgttttattcac

SEQ ID NO: 7593198 - DNA, 18 bp, Homo sapiens
ggcgggtgttttattcac

SEQ ID NO: 7593199 - DNA, 22 bp, Homo sapiens
ggcggtctcagcaccctcttgg

SEQ ID NO: 7593200 - DNA, 22 bp, Homo sapiens
ggcggtctcagcaccctcttgg

SEQ ID NO: 7593201 - DNA, 22 bp, Homo sapiens
ggcggtggcgtgaaggtggctg

SEQ ID NO: 7593202 - DNA, 22 bp, Homo sapiens
ggcctgctggggcctcagacac

SEQ ID NO: 7593203 - DNA, 22 bp, Homo sapiens
ggcctgctggggcctcagacac

SEQ ID NO: 7593204 - DNA, 22 bp, Homo sapiens
ggcctgctggctccagcgcccg

SEQ ID NO: 7593205 - DNA, 22 bp, Homo sapiens
ggcctgctggctccagcgcccg

SEQ ID NO: 7593206 - DNA, 22 bp, Homo sapiens
ggcctgctggctccagcgcccg

SEQ ID NO: 7593207 - DNA, 22 bp, Homo sapiens
ggcctgctggctccagcgcccg

SEQ ID NO: 7593208 - DNA, 22 bp, Homo sapiens
ggcctgctgggccccacagtcc

SEQ ID NO: 7593209 - DNA, 22 bp, Homo sapiens
ggcctgctgggccccacagtcc

SEQ ID NO: 7593210 - DNA, 22 bp, Homo sapiens
ggcctgctgggccccacagtcc

SEQ ID NO: 7593211 - DNA, 22 bp, Homo sapiens
ggcctgctttccgagcctgcag

SEQ ID NO: 7593212 - DNA, 22 bp, Homo sapiens
ggcctgcttctctgggctttct

SEQ ID NO: 7593213 - DNA, 22 bp, Homo sapiens
ggcctgcttctctgggctttct

SEQ ID NO: 7593214 - DNA, 22 bp, Homo sapiens
ggcctgctgtagcttttgttct

SEQ ID NO: 7593215 - DNA, 22 bp, Homo sapiens
ggcctgcttactgattgttgtt

SEQ ID NO: 7593216 - DNA, 22 bp, Homo sapiens
ggcctgcttctcagtgagcttg

SEQ ID NO: 7593217 - DNA, 22 bp, Homo sapiens
ggcctggacaaatgcaccaagg

SEQ ID NO: 7593218 - DNA, 22 bp, Homo sapiens
ggcctggacaaatgcaccaagg

SEQ ID NO: 7593219 - DNA, 22 bp, Homo sapiens
ggcctggaatgctttcctacca

SEQ ID NO: 7593220 - DNA, 22 bp, Homo sapiens
ggcctggaatgctttcctacca

SEQ ID NO: 7593221 - DNA, 22 bp, Homo sapiens
ggcctggaatgctttcctacca

SEQ ID NO: 7593222 - DNA, 22 bp, Homo sapiens
ggcctggaaggacagcgtgatg

SEQ ID NO: 7593223 - DNA, 22 bp, Homo sapiens
ggcctggacacctgaggtctta

SEQ ID NO: 7593224 - DNA, 22 bp, Homo sapiens
ggcctggacacctgaggtctta

SEQ ID NO: 7593225 - DNA, 22 bp, Homo sapiens
ggcctggacaaatgcaccaagg

SEQ ID NO: 7593226 - DNA, 22 bp, Homo sapiens
ggcctggaaggacagcgtgatg

SEQ ID NO: 7593227 - DNA, 22 bp, Homo sapiens
ggcctggaaggacagcgtgatg

SEQ ID NO: 7593228 - DNA, 22 bp, Homo sapiens
ggcctggaagaggacagagaaa

SEQ ID NO: 7593229 - DNA, 22 bp, Homo sapiens
ggcctggaaggacagcgtgatg

SEQ ID NO: 7593230 - DNA, 22 bp, Homo sapiens
ggcctggaagaggacagagaaa

SEQ ID NO: 7593231 - DNA, 22 bp, Homo sapiens
ggcctggaagaggacagagaaa

SEQ ID NO: 7593232 - DNA, 22 bp, Homo sapiens
ggcctggaagaggacagagaaa

SEQ ID NO: 7593233 - DNA, 22 bp, Homo sapiens
ggcctgctgctatgacttcctg

SEQ ID NO: 7593234 - DNA, 22 bp, Homo sapiens
ggcctgctgctatgacttcctg

SEQ ID NO: 7593235 - DNA, 22 bp, Homo sapiens
ggcctgctgctggttagatggg

SEQ ID NO: 7593236 - DNA, 22 bp, Homo sapiens
ggcctgctctgtttagaggggg

SEQ ID NO: 7593237 - DNA, 22 bp, Homo sapiens
ggcctgctgcagtgtgacagtt

SEQ ID NO: 7593238 - DNA, 22 bp, Homo sapiens
ggcctgctgcagtgtgacagtt

SEQ ID NO: 7593239 - DNA, 22 bp, Homo sapiens
ggcctgctgcagtgtgacagtt

SEQ ID NO: 7593240 - DNA, 22 bp, Homo sapiens
ggcctgctctggctgtggtcag

SEQ ID NO: 7593241 - DNA, 22 bp, Homo sapiens
ggcctgctctgcagcctctaca

SEQ ID NO: 7593242 - DNA, 22 bp, Homo sapiens
ggcctgctctgcagcctctaca

SEQ ID NO: 7593243 - DNA, 19 bp, Homo sapiens
ggcctgcccaatgtctgct

SEQ ID NO: 7593244 - DNA, 19 bp, Homo sapiens
ggcctgcccaatgtctgct

SEQ ID NO: 7593245 - DNA, 19 bp, Homo sapiens
ggcctgcccaatgtctgct

SEQ ID NO: 7593246 - DNA, 22 bp, Homo sapiens
ggcctcagaccggagctggcca

SEQ ID NO: 7593247 - DNA, 22 bp, Homo sapiens
ggcctcagaccggagctggcca

SEQ ID NO: 7593248 - DNA, 22 bp, Homo sapiens
ggcctcagaaatagagtaaaat

SEQ ID NO: 7593249 - DNA, 22 bp, Homo sapiens
ggcctgcctcacagtcagcacc

SEQ ID NO: 7593250 - DNA, 22 bp, Homo sapiens
ggcctgcctcacagtcagcacc

SEQ ID NO: 7593251 - DNA, 22 bp, Homo sapiens
ggcctgctattggtgggcagac

SEQ ID NO: 7593252 - DNA, 22 bp, Homo sapiens
ggcctgctaacctgaaacggag

SEQ ID NO: 7593253 - DNA, 22 bp, Homo sapiens
ggcctgctattggtgggcagac

SEQ ID NO: 7593254 - DNA, 22 bp, Homo sapiens
ggcctgctattggtgggcagac

SEQ ID NO: 7593255 - DNA, 22 bp, Homo sapiens
ggcctgctattggtgggcagac

SEQ ID NO: 7593256 - DNA, 22 bp, Homo sapiens
ggcctgctccgggggctgagct

SEQ ID NO: 7593257 - DNA, 22 bp, Homo sapiens
ggcctgctccgggggctgagct

SEQ ID NO: 7593258 - DNA, 22 bp, Homo sapiens
ggcctgctccgggggctgagct

SEQ ID NO: 7593259 - DNA, 22 bp, Homo sapiens
ggcctgctcagtcctctttctt

SEQ ID NO: 7593260 - DNA, 22 bp, Homo sapiens
ggcctgctcagtcctctttctt

SEQ ID NO: 7593261 - DNA, 22 bp, Homo sapiens
ggcctgctcaaacagattcctg

SEQ ID NO: 7593262 - DNA, 22 bp, Homo sapiens
ggccctgggatgctcagcagtg

SEQ ID NO: 7593263 - DNA, 22 bp, Homo sapiens
ggccctgggatgctcagcagtg

SEQ ID NO: 7593264 - DNA, 22 bp, Homo sapiens
ggccctgggatgctcagcagtg

SEQ ID NO: 7593265 - DNA, 22 bp, Homo sapiens
ggccctgggatgctcagcagtg

SEQ ID NO: 7593266 - DNA, 22 bp, Homo sapiens
ggccctgggatgctcagcagtg

SEQ ID NO: 7593267 - DNA, 22 bp, Homo sapiens
ggccctgggacacaacaccgaa

SEQ ID NO: 7593268 - DNA, 22 bp, Homo sapiens
ggccctggcagccacgaaagcc

SEQ ID NO: 7593269 - DNA, 22 bp, Homo sapiens
ggccctggcagccacgaaagcc

SEQ ID NO: 7593270 - DNA, 22 bp, Homo sapiens
ggccctgggacacaacaccgaa

SEQ ID NO: 7593271 - DNA, 22 bp, Homo sapiens
ggccctgggacacaacaccgaa

SEQ ID NO: 7593272 - DNA, 22 bp, Homo sapiens
ggccctgggatgctcagcagtg

SEQ ID NO: 7593273 - DNA, 22 bp, Homo sapiens
ggccctgggatgctcagcagtg

SEQ ID NO: 7593274 - DNA, 22 bp, Homo sapiens
ggccctgggcagaggagtgggc

SEQ ID NO: 7593275 - DNA, 22 bp, Homo sapiens
ggccctgggcagaggagtgggc

SEQ ID NO: 7593276 - DNA, 22 bp, Homo sapiens
ggccctgggcagaggagtgggc

SEQ ID NO: 7593277 - DNA, 22 bp, Homo sapiens
ggccctgggatgctcagcagtg

SEQ ID NO: 7593278 - DNA, 22 bp, Homo sapiens
ggccctgggatgctcagcagtg

SEQ ID NO: 7593279 - DNA, 22 bp, Homo sapiens
ggccctgggatgctcagcagtg

SEQ ID NO: 7593280 - DNA, 22 bp, Homo sapiens
ggccctggtcctaggggtggaa

SEQ ID NO: 7593281 - DNA, 22 bp, Homo sapiens
ggccctgggccctctagcttgt

SEQ ID NO: 7593282 - DNA, 22 bp, Homo sapiens
ggccctggtcctaggggtggaa

SEQ ID NO: 7593283 - DNA, 22 bp, Homo sapiens
ggccctggtcctaggggtggaa

SEQ ID NO: 7593284 - DNA, 22 bp, Homo sapiens
ggccctggtcctaggggtggaa

SEQ ID NO: 7593285 - DNA, 21 bp, Homo sapiens
ggccctggttacgcctcctct

SEQ ID NO: 7593286 - DNA, 21 bp, Homo sapiens
ggccctggttacgcctcctct

SEQ ID NO: 7593287 - DNA, 21 bp, Homo sapiens
ggccctggttacgcctcctct

SEQ ID NO: 7593288 - DNA, 21 bp, Homo sapiens
ggccctggttacgcctcctct

SEQ ID NO: 7593289 - DNA, 21 bp, Homo sapiens
ggccctggttacgcctcctct

SEQ ID NO: 7593290 - DNA, 22 bp, Homo sapiens
ggccctggtcctaggggtggaa

SEQ ID NO: 7593291 - DNA, 22 bp, Homo sapiens
ggccctgggccctctagcttgt

SEQ ID NO: 7593292 - DNA, 22 bp, Homo sapiens
ggccctgggccctctagcttgt

SEQ ID NO: 7593293 - DNA, 22 bp, Homo sapiens
ggccctgggccctctagcttgt

SEQ ID NO: 7593294 - DNA, 22 bp, Homo sapiens
ggccctgggccctctagcttgt

SEQ ID NO: 7593295 - DNA, 22 bp, Homo sapiens
ggccctgggccctctagcttgt

SEQ ID NO: 7593296 - DNA, 22 bp, Homo sapiens
ggccctgggccctctagcttgt

SEQ ID NO: 7593297 - DNA, 22 bp, Homo sapiens
ggccctgggcagaggagtgggc

SEQ ID NO: 7593298 - DNA, 22 bp, Homo sapiens
ggccctgggcagaggagtgggc

SEQ ID NO: 7593299 - DNA, 22 bp, Homo sapiens
ggccctgggcagaggagtgggc

SEQ ID NO: 7593300 - DNA, 22 bp, Homo sapiens
ggccctgggcagaggagtgggc

SEQ ID NO: 7593301 - DNA, 22 bp, Homo sapiens
ggcctacgccagtatccccagg

SEQ ID NO: 7593302 - DNA, 21 bp, Homo sapiens
ggccctggttacgcctcctct

SEQ ID NO: 7593303 - DNA, 21 bp, Homo sapiens
ggccctggttacgcctcctct

SEQ ID NO: 7593304 - DNA, 22 bp, Homo sapiens
ggccgtgctccaaagtcatcgt

SEQ ID NO: 7593305 - DNA, 21 bp, Homo sapiens
ggccctggttacgcctcctct

SEQ ID NO: 7593306 - DNA, 21 bp, Homo sapiens
ggccctggttacgcctcctct

SEQ ID NO: 7593307 - DNA, 22 bp, Homo sapiens
ggcctaggattctgcatttcta

SEQ ID NO: 7593308 - DNA, 22 bp, Homo sapiens
ggcctaggattctgcatttcta

SEQ ID NO: 7593309 - DNA, 22 bp, Homo sapiens
ggcctagggagtggccatgcct

SEQ ID NO: 7593310 - DNA, 22 bp, Homo sapiens
ggcctaggaaggggatgtaact

SEQ ID NO: 7593311 - DNA, 22 bp, Homo sapiens
ggcctcactgtgcatcccttgg

SEQ ID NO: 7593312 - DNA, 22 bp, Homo sapiens
ggcctcactgtgcatcccttgg

SEQ ID NO: 7593313 - DNA, 22 bp, Homo sapiens
ggcctcactgtgcatcccttgg

SEQ ID NO: 7593314 - DNA, 22 bp, Homo sapiens
ggcctcagaaatagagtaaaat

SEQ ID NO: 7593315 - DNA, 22 bp, Homo sapiens
ggcctcacccatcggtgccttt

SEQ ID NO: 7593316 - DNA, 22 bp, Homo sapiens
ggcctatgttcctgggctaggg

SEQ ID NO: 7593317 - DNA, 22 bp, Homo sapiens
ggcctcaagctaccctctcacc

SEQ ID NO: 7593318 - DNA, 22 bp, Homo sapiens
ggcctagttttttctggtaggt

SEQ ID NO: 7593319 - DNA, 21 bp, Homo sapiens
ggcctaggggcagatggtgct

SEQ ID NO: 7593320 - DNA, 22 bp, Homo sapiens
ggcctatgttcctgggctaggg

SEQ ID NO: 7593321 - DNA, 22 bp, Homo sapiens
ggcctatgttcctgggctaggg

SEQ ID NO: 7593322 - DNA, 22 bp, Homo sapiens
ggcctagggagtggccatgcct

SEQ ID NO: 7593323 - DNA, 22 bp, Homo sapiens
ggcctagggcttggtcatggca

SEQ ID NO: 7593324 - DNA, 22 bp, Homo sapiens
ggcctagggcttggtcatggca

SEQ ID NO: 7593325 - DNA, 22 bp, Homo sapiens
ggcctagggcttggtcatggca

SEQ ID NO: 7593326 - DNA, 22 bp, Homo sapiens
ggcctagggcttggtcatggca

SEQ ID NO: 7593327 - DNA, 22 bp, Homo sapiens
ggcctagggcttggtcatggca

SEQ ID NO: 7593328 - DNA, 22 bp, Homo sapiens
ggcctagggcttggtcatggca

SEQ ID NO: 7593329 - DNA, 22 bp, Homo sapiens
ggcctagggcttggtcatggca

SEQ ID NO: 7593330 - DNA, 21 bp, Homo sapiens
ggcctaggggcagatggtgct

SEQ ID NO: 7593331 - DNA, 21 bp, Homo sapiens
ggcctaggggcagatggtgct

SEQ ID NO: 7593332 - DNA, 22 bp, Homo sapiens
ggccaggcgatgacccctccac

SEQ ID NO: 7593333 - DNA, 22 bp, Homo sapiens
ggccaggcgatgacccctccac

SEQ ID NO: 7593334 - DNA, 22 bp, Homo sapiens
ggccaggccaagagggttggaa

SEQ ID NO: 7593335 - DNA, 22 bp, Homo sapiens
ggccaggccaagagggttggaa

SEQ ID NO: 7593336 - DNA, 22 bp, Homo sapiens
ggccaggccaagagggttggaa

SEQ ID NO: 7593337 - DNA, 22 bp, Homo sapiens
ggccaggcactgtgtgagatat

SEQ ID NO: 7593338 - DNA, 22 bp, Homo sapiens
ggccaggcactgtgtgagatat

SEQ ID NO: 7593339 - DNA, 22 bp, Homo sapiens
ggccaggatctgtttgtccacc

SEQ ID NO: 7593340 - DNA, 22 bp, Homo sapiens
ggccaggatctgtttgtccacc

SEQ ID NO: 7593341 - DNA, 22 bp, Homo sapiens
ggccaggcactgtgtgagatat

SEQ ID NO: 7593342 - DNA, 22 bp, Homo sapiens
ggccaggcactgtgtgagatat

SEQ ID NO: 7593343 - DNA, 22 bp, Homo sapiens
ggccaggcactgtgtgagatat

SEQ ID NO: 7593344 - DNA, 22 bp, Homo sapiens
ggccctgctcaggctgcgatga

SEQ ID NO: 7593345 - DNA, 22 bp, Homo sapiens
ggccctgctgaagccgggtcta

SEQ ID NO: 7593346 - DNA, 22 bp, Homo sapiens
ggccctgctgaagccgggtcta

SEQ ID NO: 7593347 - DNA, 19 bp, Homo sapiens
ggccaggctgactgtggtc

SEQ ID NO: 7593348 - DNA, 22 bp, Homo sapiens
ggccaggcgatgacccctccac

SEQ ID NO: 7593349 - DNA, 22 bp, Homo sapiens
ggccaggcgatgacccctccac

SEQ ID NO: 7593350 - DNA, 22 bp, Homo sapiens
ggccctggcagccacgaaagcc

SEQ ID NO: 7593351 - DNA, 22 bp, Homo sapiens
ggccctgctgagtggagtggag

SEQ ID NO: 7593352 - DNA, 22 bp, Homo sapiens
ggccctgctgagtggagtggag

SEQ ID NO: 7593353 - DNA, 22 bp, Homo sapiens
ggccctggcagccacgaaagcc

SEQ ID NO: 7593354 - DNA, 22 bp, Homo sapiens
ggccctggcagccacgaaagcc

SEQ ID NO: 7593355 - DNA, 22 bp, Homo sapiens
ggccctggcagccacgaaagcc

SEQ ID NO: 7593356 - DNA, 22 bp, Homo sapiens
ggccctggcagccacgaaagcc

SEQ ID NO: 7593357 - DNA, 22 bp, Homo sapiens
ggccctggcagccacgaaagcc

SEQ ID NO: 7593358 - DNA, 22 bp, Homo sapiens
ggccctggcagccacgaaagcc

SEQ ID NO: 7593359 - DNA, 22 bp, Homo sapiens
ggccaggaggcaggggctcaat

SEQ ID NO: 7593360 - DNA, 22 bp, Homo sapiens
ggccaggaggcaggggctcaat

SEQ ID NO: 7593361 - DNA, 22 bp, Homo sapiens
ggccaggaggcaggggctcaat

SEQ ID NO: 7593362 - DNA, 22 bp, Homo sapiens
ggccaggaggcaggggctcaat

SEQ ID NO: 7593363 - DNA, 22 bp, Homo sapiens
ggccaggaggcaggggctcaat

SEQ ID NO: 7593364 - DNA, 22 bp, Homo sapiens
ggccaggaggcaggggctcaat

SEQ ID NO: 7593365 - DNA, 22 bp, Homo sapiens
ggccaggaggcaggggctcaat

SEQ ID NO: 7593366 - DNA, 22 bp, Homo sapiens
ggccaggaggcaggggctcaat

SEQ ID NO: 7593367 - DNA, 22 bp, Homo sapiens
ggccaggagcagaatcgcctgc

SEQ ID NO: 7593368 - DNA, 22 bp, Homo sapiens
ggccaggagctgcacagggctc

SEQ ID NO: 7593369 - DNA, 22 bp, Homo sapiens
ggccaggagctgcacagggctc

SEQ ID NO: 7593370 - DNA, 22 bp, Homo sapiens
ggccaggagcaagccaggctct

SEQ ID NO: 7593371 - DNA, 22 bp, Homo sapiens
ggccaggagcaagccaggctct

SEQ ID NO: 7593372 - DNA, 22 bp, Homo sapiens
ggccaggagctgcacagggctc

SEQ ID NO: 7593373 - DNA, 22 bp, Homo sapiens
ggccaggagctgcacagggctc

SEQ ID NO: 7593374 - DNA, 22 bp, Homo sapiens
ggccaggagctgcacagggctc

SEQ ID NO: 7593375 - DNA, 22 bp, Homo sapiens
ggccaggagctgcacagggctc

SEQ ID NO: 7593376 - DNA, 22 bp, Homo sapiens
ggccaggagctgcacagggctc

SEQ ID NO: 7593377 - DNA, 22 bp, Homo sapiens
ggccaggagctgcacagggctc

SEQ ID NO: 7593378 - DNA, 22 bp, Homo sapiens
ggccaggagcaagccaggctct

SEQ ID NO: 7593379 - DNA, 22 bp, Homo sapiens
ggccaggagatggacaccacat

SEQ ID NO: 7593380 - DNA, 22 bp, Homo sapiens
ggccaggagaggagggcactga

SEQ ID NO: 7593381 - DNA, 22 bp, Homo sapiens
ggccaggagcaagccaggctct

SEQ ID NO: 7593382 - DNA, 22 bp, Homo sapiens
ggccaggagcaagccaggctct

SEQ ID NO: 7593383 - DNA, 22 bp, Homo sapiens
ggccaggagcaagccaggctct

SEQ ID NO: 7593384 - DNA, 22 bp, Homo sapiens
ggccaggagcaagccaggctct

SEQ ID NO: 7593385 - DNA, 22 bp, Homo sapiens
ggccaggagaggagggcactga

SEQ ID NO: 7593386 - DNA, 22 bp, Homo sapiens
ggccaggagaggagggcactga

SEQ ID NO: 7593387 - DNA, 22 bp, Homo sapiens
ggccaggagaggagggcactga

SEQ ID NO: 7593388 - DNA, 22 bp, Homo sapiens
ggccaggagaggagggcactga

SEQ ID NO: 7593389 - DNA, 22 bp, Homo sapiens
ggccaggagaggagggcactga

SEQ ID NO: 7593390 - DNA, 22 bp, Homo sapiens
ggccaggaagggaagatcagca

SEQ ID NO: 7593391 - DNA, 22 bp, Homo sapiens
ggccaggaagggaagatcagca

SEQ ID NO: 7593392 - DNA, 22 bp, Homo sapiens
ggcaggaggaagagttagcacc

SEQ ID NO: 7593393 - DNA, 22 bp, Homo sapiens
ggcaggaggaagagttagcacc

SEQ ID NO: 7593394 - DNA, 22 bp, Homo sapiens
ggcaggaggaagagttagcacc

SEQ ID NO: 7593395 - DNA, 22 bp, Homo sapiens
ggcaggaggaagagttagcacc

SEQ ID NO: 7593396 - DNA, 22 bp, Homo sapiens
ggcaggagctctccagtttgcc

SEQ ID NO: 7593397 - DNA, 22 bp, Homo sapiens
ggcaggaggaagagttagcacc

SEQ ID NO: 7593398 - DNA, 18 bp, Homo sapiens
ggcaggggtgaaccacag

SEQ ID NO: 7593399 - DNA, 18 bp, Homo sapiens
ggcaggggtgaaccacag

SEQ ID NO: 7593400 - DNA, 22 bp, Homo sapiens
ggcaggagctctccagtttgcc

SEQ ID NO: 7593401 - DNA, 22 bp, Homo sapiens
ggcaggagctctccagtttgcc

SEQ ID NO: 7593402 - DNA, 22 bp, Homo sapiens
ggcaggagctctccagtttgcc

SEQ ID NO: 7593403 - DNA, 22 bp, Homo sapiens
ggcaggagctcaggttggttcc

SEQ ID NO: 7593404 - DNA, 22 bp, Homo sapiens
ggcaggagctctccagtttgcc

SEQ ID NO: 7593405 - DNA, 22 bp, Homo sapiens
ggcaggagctctccagtttgcc

SEQ ID NO: 7593406 - DNA, 22 bp, Homo sapiens
ggcaggagaatggcgtgaactc

SEQ ID NO: 7593407 - DNA, 22 bp, Homo sapiens
ggcaggagaatggcgtgaactc

SEQ ID NO: 7593408 - DNA, 22 bp, Homo sapiens
ggcaggagaatggcgtgaactc

SEQ ID NO: 7593409 - DNA, 22 bp, Homo sapiens
ggcaggagaatggcgtgaactc

SEQ ID NO: 7593410 - DNA, 22 bp, Homo sapiens
ggcaggagataaaatattagtt

SEQ ID NO: 7593411 - DNA, 22 bp, Homo sapiens
ggcaggagaatggcgtgaactc

SEQ ID NO: 7593412 - DNA, 22 bp, Homo sapiens
ggcaggagaatggcgtgaactc

SEQ ID NO: 7593413 - DNA, 22 bp, Homo sapiens
ggcaggagataaaatattagtt

SEQ ID NO: 7593414 - DNA, 22 bp, Homo sapiens
ggcaggagctcaggttggttcc

SEQ ID NO: 7593415 - DNA, 22 bp, Homo sapiens
ggcaggagctcaggttggttcc

SEQ ID NO: 7593416 - DNA, 22 bp, Homo sapiens
ggcaggagctcaggttggttcc

SEQ ID NO: 7593417 - DNA, 22 bp, Homo sapiens
ggcaggagctcaggttggttcc

SEQ ID NO: 7593418 - DNA, 18 bp, Homo sapiens
ggcaggagcaagaatagg

SEQ ID NO: 7593419 - DNA, 18 bp, Homo sapiens
ggcaggagcaagaatagg

SEQ ID NO: 7593420 - DNA, 18 bp, Homo sapiens
ggcaggagcaagaatagg

SEQ ID NO: 7593421 - DNA, 18 bp, Homo sapiens
ggcaggagcaagaatagg

SEQ ID NO: 7593422 - DNA, 18 bp, Homo sapiens
ggcaggagcaagaatagg

SEQ ID NO: 7593423 - DNA, 22 bp, Homo sapiens
ggcaggggtgaggccactctga

SEQ ID NO: 7593424 - DNA, 22 bp, Homo sapiens
ggcaggggtgaggccactctga

SEQ ID NO: 7593425 - DNA, 18 bp, Homo sapiens
ggcaggggtgaaccacag

SEQ ID NO: 7593426 - DNA, 18 bp, Homo sapiens
ggcaggggtgaaccacag

SEQ ID NO: 7593427 - DNA, 22 bp, Homo sapiens
ggcaggggtgaggccactctga

SEQ ID NO: 7593428 - DNA, 22 bp, Homo sapiens
ggcaggggtgaggccactctga

SEQ ID NO: 7593429 - DNA, 22 bp, Homo sapiens
ggcaggggtgaggccactctga

SEQ ID NO: 7593430 - DNA, 22 bp, Homo sapiens
ggcaggggtgaggccactctga

SEQ ID NO: 7593431 - DNA, 22 bp, Homo sapiens
ggcaggggtgaggccactctga

SEQ ID NO: 7593432 - DNA, 22 bp, Homo sapiens
ggcaggggtggccttcctttgg

SEQ ID NO: 7593433 - DNA, 22 bp, Homo sapiens
ggcaggggtgaggccactctga

SEQ ID NO: 7593434 - DNA, 22 bp, Homo sapiens
ggcaggggtgaggccactctga

SEQ ID NO: 7593435 - DNA, 22 bp, Homo sapiens
ggcaggggttcattttgtctta

SEQ ID NO: 7593436 - DNA, 22 bp, Homo sapiens
ggcaggggttcattttgtctta

SEQ ID NO: 7593437 - DNA, 22 bp, Homo sapiens
ggcaggggtggccttcctttgg

SEQ ID NO: 7593438 - DNA, 22 bp, Homo sapiens
ggcagggtccacacctgggaaa

SEQ ID NO: 7593439 - DNA, 22 bp, Homo sapiens
ggcagggtccacacctgggaaa

SEQ ID NO: 7593440 - DNA, 22 bp, Homo sapiens
ggcagggtctggactgaaagct

SEQ ID NO: 7593441 - DNA, 22 bp, Homo sapiens
ggcagggtctggactgaaagct

SEQ ID NO: 7593442 - DNA, 22 bp, Homo sapiens
ggcagggtgcctggctcctgtt

SEQ ID NO: 7593443 - DNA, 22 bp, Homo sapiens
ggcagggtaaaccgaggtaagt

SEQ ID NO: 7593444 - DNA, 22 bp, Homo sapiens
ggcagggtaaaccgaggtaagt

SEQ ID NO: 7593445 - DNA, 22 bp, Homo sapiens
ggcagggtaaaccgaggtaagt

SEQ ID NO: 7593446 - DNA, 22 bp, Homo sapiens
ggcagggtaaaccgaggtaagt

SEQ ID NO: 7593447 - DNA, 22 bp, Homo sapiens
ggcaggggttcattttgtctta

SEQ ID NO: 7593448 - DNA, 22 bp, Homo sapiens
ggcaggggttcattttgtctta

SEQ ID NO: 7593449 - DNA, 22 bp, Homo sapiens
ggcaggggttcattttgtctta

SEQ ID NO: 7593450 - DNA, 22 bp, Homo sapiens
ggcaggggttcattttgtctta

SEQ ID NO: 7593451 - DNA, 22 bp, Homo sapiens
ggcagggtaaaccgaggtaagt

SEQ ID NO: 7593452 - DNA, 22 bp, Homo sapiens
ggcagggtatgattacctctga

SEQ ID NO: 7593453 - DNA, 22 bp, Homo sapiens
ggcagggtatgattacctctga

SEQ ID NO: 7593454 - DNA, 22 bp, Homo sapiens
ggcagggtaaaccgaggtaagt

SEQ ID NO: 7593455 - DNA, 22 bp, Homo sapiens
ggcagggtaaaccgaggtaagt

SEQ ID NO: 7593456 - DNA, 22 bp, Homo sapiens
ggcaggggtggccttcctttgg

SEQ ID NO: 7593457 - DNA, 22 bp, Homo sapiens
ggcaggtgagagctctttgaaa

SEQ ID NO: 7593458 - DNA, 22 bp, Homo sapiens
ggcaggtgagagctctttgaaa

SEQ ID NO: 7593459 - DNA, 22 bp, Homo sapiens
ggcaggtgacggggatgagtat

SEQ ID NO: 7593460 - DNA, 22 bp, Homo sapiens
ggcaggtgacggggatgagtat

SEQ ID NO: 7593461 - DNA, 22 bp, Homo sapiens
ggcaggtgacggggatgagtat

SEQ ID NO: 7593462 - DNA, 22 bp, Homo sapiens
ggcaggtgacggggatgagtat

SEQ ID NO: 7593463 - DNA, 22 bp, Homo sapiens
ggcaggtgacggggatgagtat

SEQ ID NO: 7593464 - DNA, 22 bp, Homo sapiens
ggcaggtgacggggatgagtat

SEQ ID NO: 7593465 - DNA, 22 bp, Homo sapiens
ggcaggtgacggggatgagtat

SEQ ID NO: 7593466 - DNA, 22 bp, Homo sapiens
ggcagtgggtggatctcaggga

SEQ ID NO: 7593467 - DNA, 22 bp, Homo sapiens
ggcaggtgaggcatgtgcctgg

SEQ ID NO: 7593468 - DNA, 22 bp, Homo sapiens
ggcaggtgagagctctttgaaa

SEQ ID NO: 7593469 - DNA, 22 bp, Homo sapiens
ggcagtgggttccccaaggcac

SEQ ID NO: 7593470 - DNA, 22 bp, Homo sapiens
ggcagtgggttccccaaggcac

SEQ ID NO: 7593471 - DNA, 22 bp, Homo sapiens
ggcaggtagcctagaggaggtt

SEQ ID NO: 7593472 - DNA, 22 bp, Homo sapiens
ggcaggtcatcaactgtaattt

SEQ ID NO: 7593473 - DNA, 17 bp, Homo sapiens
ggcaggtgacagacacc

SEQ ID NO: 7593474 - DNA, 17 bp, Homo sapiens
ggcaggtgacagacacc

SEQ ID NO: 7593475 - DNA, 22 bp, Homo sapiens
ggcaggtgacctggcctcccag

SEQ ID NO: 7593476 - DNA, 22 bp, Homo sapiens
ggcaggtgacggggatgagtat

SEQ ID NO: 7593477 - DNA, 22 bp, Homo sapiens
ggcaggtgacctggcctcccag

SEQ ID NO: 7593478 - DNA, 17 bp, Homo sapiens
ggcaggtgacagacacc

SEQ ID NO: 7593479 - DNA, 22 bp, Homo sapiens
ggcaggtgacctggcctcccag

SEQ ID NO: 7593480 - DNA, 22 bp, Homo sapiens
ggcaggtgacctggcctcccag

SEQ ID NO: 7593481 - DNA, 22 bp, Homo sapiens
ggcaggtgacctggcctcccag

SEQ ID NO: 7593482 - DNA, 22 bp, Homo sapiens
ggcaggtagcctagaggaggtt

SEQ ID NO: 7593483 - DNA, 22 bp, Homo sapiens
ggcaggtagcctagaggaggtt

SEQ ID NO: 7593484 - DNA, 22 bp, Homo sapiens
ggcaggtagcctagaggaggtt

SEQ ID NO: 7593485 - DNA, 19 bp, Homo sapiens
ggcaggtagagggccagtc

SEQ ID NO: 7593486 - DNA, 19 bp, Homo sapiens
ggcaggtagagggccagtc

SEQ ID NO: 7593487 - DNA, 22 bp, Homo sapiens
ggcaggtacagcaagaggacaa

SEQ ID NO: 7593488 - DNA, 22 bp, Homo sapiens
ggcaggtactggggagtgaaga

SEQ ID NO: 7593489 - DNA, 22 bp, Homo sapiens
ggcaggtacagcaagaggacaa

SEQ ID NO: 7593490 - DNA, 22 bp, Homo sapiens
ggcaggtacagcaagaggacaa

SEQ ID NO: 7593491 - DNA, 22 bp, Homo sapiens
ggcaggtacagcaagaggacaa

SEQ ID NO: 7593492 - DNA, 22 bp, Homo sapiens
ggcagggtgtggagttgggaca

SEQ ID NO: 7593493 - DNA, 22 bp, Homo sapiens
ggcagggtgtggagttgggaca

SEQ ID NO: 7593494 - DNA, 22 bp, Homo sapiens
ggcagggtgtggagttgggaca

SEQ ID NO: 7593495 - DNA, 22 bp, Homo sapiens
ggcagggtgtggagttgggaca

SEQ ID NO: 7593496 - DNA, 22 bp, Homo sapiens
ggcagggtgtggagttgggaca

SEQ ID NO: 7593497 - DNA, 22 bp, Homo sapiens
ggcagggtttacaatagcaata

SEQ ID NO: 7593498 - DNA, 22 bp, Homo sapiens
ggcagggtttacaatagcaata

SEQ ID NO: 7593499 - DNA, 22 bp, Homo sapiens
ggcagggtttctccattctgcc

SEQ ID NO: 7593500 - DNA, 22 bp, Homo sapiens
ggcagggtgtggagttgggaca

SEQ ID NO: 7593501 - DNA, 22 bp, Homo sapiens
ggcagggtttacaatagcaata

SEQ ID NO: 7593502 - DNA, 22 bp, Homo sapiens
ggcagggtggcagaggctcaga

SEQ ID NO: 7593503 - DNA, 22 bp, Homo sapiens
ggcagggtggcagaggctcaga

SEQ ID NO: 7593504 - DNA, 17 bp, Homo sapiens
ggcagggtgctgggtat

SEQ ID NO: 7593505 - DNA, 17 bp, Homo sapiens
ggcagggtgctgggtat

SEQ ID NO: 7593506 - DNA, 17 bp, Homo sapiens
ggcagggtgctgggtat

SEQ ID NO: 7593507 - DNA, 22 bp, Homo sapiens
ggcagggtgcctggctcctgtt

SEQ ID NO: 7593508 - DNA, 17 bp, Homo sapiens
ggcagggtgctgggtat

SEQ ID NO: 7593509 - DNA, 17 bp, Homo sapiens
ggcagggtgctgggtat

SEQ ID NO: 7593510 - DNA, 17 bp, Homo sapiens
ggcagggtgctgggtat

SEQ ID NO: 7593511 - DNA, 22 bp, Homo sapiens
ggcagggtggcagaggctcaga

SEQ ID NO: 7593512 - DNA, 22 bp, Homo sapiens
ggcagggtggcagaggctcaga

SEQ ID NO: 7593513 - DNA, 22 bp, Homo sapiens
ggcagggtggcagaggctcaga

SEQ ID NO: 7593514 - DNA, 22 bp, Homo sapiens
ggcagggtggcagaggctcaga

SEQ ID NO: 7593515 - DNA, 22 bp, Homo sapiens
ggcagggtggcagaggctcaga

SEQ ID NO: 7593516 - DNA, 22 bp, Homo sapiens
ggcagggtggccctccagtgag

SEQ ID NO: 7593517 - DNA, 22 bp, Homo sapiens
ggcagggtggccctccagtgag

SEQ ID NO: 7593518 - DNA, 22 bp, Homo sapiens
ggcagggtggccctccagtgag

SEQ ID NO: 7593519 - DNA, 22 bp, Homo sapiens
ggcatctgagctgtgtatggtt

SEQ ID NO: 7593520 - DNA, 22 bp, Homo sapiens
ggcatctcgcattcttgtttct

SEQ ID NO: 7593521 - DNA, 22 bp, Homo sapiens
ggcatctcgcattcttgtttct

SEQ ID NO: 7593522 - DNA, 22 bp, Homo sapiens
ggcatctcagatagttcagacc

SEQ ID NO: 7593523 - DNA, 22 bp, Homo sapiens
ggcatctctgtgtgtgtgaatc

SEQ ID NO: 7593524 - DNA, 22 bp, Homo sapiens
ggcatctctgtgtgtgtgaatc

SEQ ID NO: 7593525 - DNA, 18 bp, Homo sapiens
ggcatctgcacagcagcc

SEQ ID NO: 7593526 - DNA, 21 bp, Homo sapiens
ggcatctcttagtatcaccat

SEQ ID NO: 7593527 - DNA, 22 bp, Homo sapiens
ggcatctgtggagccttttcca

SEQ ID NO: 7593528 - DNA, 22 bp, Homo sapiens
ggcatctgtccatctctccagc

SEQ ID NO: 7593529 - DNA, 22 bp, Homo sapiens
ggcatctggatctgcttctccc

SEQ ID NO: 7593530 - DNA, 22 bp, Homo sapiens
ggcatgagaggtcctggggatt

SEQ ID NO: 7593531 - DNA, 22 bp, Homo sapiens
ggcatgagaggtcctggggatt

SEQ ID NO: 7593532 - DNA, 22 bp, Homo sapiens
ggcatgagaggtcctggggatt

SEQ ID NO: 7593533 - DNA, 22 bp, Homo sapiens
ggcatcttgttgctcaaatcta

SEQ ID NO: 7593534 - DNA, 22 bp, Homo sapiens
ggcatctgtggagccttttcca

SEQ ID NO: 7593535 - DNA, 23 bp, Homo sapiens
ggcatcttgtctagagaaatctg

SEQ ID NO: 7593536 - DNA, 20 bp, Homo sapiens
ggcatgagatgtgagggagg

SEQ ID NO: 7593537 - DNA, 20 bp, Homo sapiens
ggcatgagatgtgagggagg

SEQ ID NO: 7593538 - DNA, 20 bp, Homo sapiens
ggcatgagatgtgagggagg

SEQ ID NO: 7593539 - DNA, 20 bp, Homo sapiens
ggcatgagatgtgagggagg

SEQ ID NO: 7593540 - DNA, 20 bp, Homo sapiens
ggcatgagatgtgagggagg

SEQ ID NO: 7593541 - DNA, 22 bp, Homo sapiens
ggcatgagaggtcctggggatt

SEQ ID NO: 7593542 - DNA, 22 bp, Homo sapiens
ggcatgagaggtcctggggatt

SEQ ID NO: 7593543 - DNA, 21 bp, Homo sapiens
ggcatgagggcagtgagcaga

SEQ ID NO: 7593544 - DNA, 21 bp, Homo sapiens
ggcatgagggcagtgagcaga

SEQ ID NO: 7593545 - DNA, 21 bp, Homo sapiens
ggcatgagggcagtgagcaga

SEQ ID NO: 7593546 - DNA, 21 bp, Homo sapiens
ggcatgagggcagtgagcaga

SEQ ID NO: 7593547 - DNA, 22 bp, Homo sapiens
ggcatgagtaacgtgagtgagg

SEQ ID NO: 7593548 - DNA, 21 bp, Homo sapiens
ggcatgagggcagtgagcaga

SEQ ID NO: 7593549 - DNA, 22 bp, Homo sapiens
ggcatctcgcattcttgtttct

SEQ ID NO: 7593550 - DNA, 19 bp, Homo sapiens
ggcatctccactcctaccc

SEQ ID NO: 7593551 - DNA, 22 bp, Homo sapiens
ggcatctccaaaacatgaactc

SEQ ID NO: 7593552 - DNA, 22 bp, Homo sapiens
ggcatctcggaacacgcctccg

SEQ ID NO: 7593553 - DNA, 22 bp, Homo sapiens
ggcatctcagatagttcagacc

SEQ ID NO: 7593554 - DNA, 22 bp, Homo sapiens
ggcatctccaaaacatgaactc

SEQ ID NO: 7593555 - DNA, 20 bp, Homo sapiens
ggcatctataaacacatcca

SEQ ID NO: 7593556 - DNA, 22 bp, Homo sapiens
ggcatcgtcctgggcataggga

SEQ ID NO: 7593557 - DNA, 22 bp, Homo sapiens
ggcatcgtcctgggcataggga

SEQ ID NO: 7593558 - DNA, 22 bp, Homo sapiens
ggcatcgtcctgggcataggga

SEQ ID NO: 7593559 - DNA, 22 bp, Homo sapiens
ggcatcgtcctgggcataggga

SEQ ID NO: 7593560 - DNA, 22 bp, Homo sapiens
ggcatcggttgcttttcatatc

SEQ ID NO: 7593561 - DNA, 22 bp, Homo sapiens
ggcatcggaggctgaagtttcc

SEQ ID NO: 7593562 - DNA, 21 bp, Homo sapiens
ggcatcggcgcagtgatagag

SEQ ID NO: 7593563 - DNA, 22 bp, Homo sapiens
ggcatccagttctgatcaacaa

SEQ ID NO: 7593564 - DNA, 22 bp, Homo sapiens
ggcatccctagaatagccaggt

SEQ ID NO: 7593565 - DNA, 22 bp, Homo sapiens
ggcatccctagaatagccaggt

SEQ ID NO: 7593566 - DNA, 21 bp, Homo sapiens
ggcatcccaggccagtgactg

SEQ ID NO: 7593567 - DNA, 21 bp, Homo sapiens
ggcatcccaggccagtgactg

SEQ ID NO: 7593568 - DNA, 22 bp, Homo sapiens
ggcatccgcctggagggtgcta

SEQ ID NO: 7593569 - DNA, 22 bp, Homo sapiens
ggcatcccttcttccagtgtca

SEQ ID NO: 7593570 - DNA, 22 bp, Homo sapiens
ggcatcccttcttccagtgtca

SEQ ID NO: 7593571 - DNA, 22 bp, Homo sapiens
ggcatcctgggactggcttctt

SEQ ID NO: 7593572 - DNA, 22 bp, Homo sapiens
ggcatcctggccacagtacctg

SEQ ID NO: 7593573 - DNA, 22 bp, Homo sapiens
ggcatcctccatataggtgaat

SEQ ID NO: 7593574 - DNA, 23 bp, Homo sapiens
ggcatccttcccgctgcgagtcc

SEQ ID NO: 7593575 - DNA, 22 bp, Homo sapiens
ggcatccaaataccaagatgta

SEQ ID NO: 7593576 - DNA, 22 bp, Homo sapiens
ggcatcagtatggccatagggt

SEQ ID NO: 7593577 - DNA, 22 bp, Homo sapiens
ggcatccaaataccaagatgta

SEQ ID NO: 7593578 - DNA, 22 bp, Homo sapiens
ggcatcagtatggccatagggt

SEQ ID NO: 7593579 - DNA, 22 bp, Homo sapiens
ggcatccaaataccaagatgta

SEQ ID NO: 7593580 - DNA, 22 bp, Homo sapiens
ggcagtggttagaaacatgagc

SEQ ID NO: 7593581 - DNA, 22 bp, Homo sapiens
ggcatcagggtaggaaggtatc

SEQ ID NO: 7593582 - DNA, 22 bp, Homo sapiens
ggcagtggtgggaggctcgctc

SEQ ID NO: 7593583 - DNA, 22 bp, Homo sapiens
ggcagtggtgggaggctcgctc

SEQ ID NO: 7593584 - DNA, 22 bp, Homo sapiens
ggccagctttctgtcttctagg

SEQ ID NO: 7593585 - DNA, 22 bp, Homo sapiens
ggccagctttctgtcttctagg

SEQ ID NO: 7593586 - DNA, 22 bp, Homo sapiens
ggccagctttctgtcttctagg

SEQ ID NO: 7593587 - DNA, 22 bp, Homo sapiens
ggccagctttctgtcttctagg

SEQ ID NO: 7593588 - DNA, 22 bp, Homo sapiens
ggccagctttgagctgcaggaa

SEQ ID NO: 7593589 - DNA, 22 bp, Homo sapiens
ggccagctttgagctgcaggaa

SEQ ID NO: 7593590 - DNA, 22 bp, Homo sapiens
ggccagctttgagctgcaggaa

SEQ ID NO: 7593591 - DNA, 22 bp, Homo sapiens
ggccagctttgagctgcaggaa

SEQ ID NO: 7593592 - DNA, 22 bp, Homo sapiens
ggccagctttgagctgcaggaa

SEQ ID NO: 7593593 - DNA, 22 bp, Homo sapiens
ggccaggaacttttgggatggg

SEQ ID NO: 7593594 - DNA, 22 bp, Homo sapiens
ggccaggaacttttgggatggg

SEQ ID NO: 7593595 - DNA, 22 bp, Homo sapiens
ggccaggaagggaagatcagca

SEQ ID NO: 7593596 - DNA, 22 bp, Homo sapiens
ggccaggaagggaagatcagca

SEQ ID NO: 7593597 - DNA, 22 bp, Homo sapiens
ggccaggaagggaagatcagca

SEQ ID NO: 7593598 - DNA, 22 bp, Homo sapiens
ggccaggaagggaagatcagca

SEQ ID NO: 7593599 - DNA, 22 bp, Homo sapiens
ggccaggaacttttgggatggg

SEQ ID NO: 7593600 - DNA, 22 bp, Homo sapiens
ggccaggaacttttgggatggg

SEQ ID NO: 7593601 - DNA, 22 bp, Homo sapiens
ggccaggaacttttgggatggg

SEQ ID NO: 7593602 - DNA, 22 bp, Homo sapiens
ggccaggaacttttgggatggg

SEQ ID NO: 7593603 - DNA, 22 bp, Homo sapiens
ggccaggaacgatcctaccctt

SEQ ID NO: 7593604 - DNA, 22 bp, Homo sapiens
ggccaggaacgatcctaccctt

SEQ ID NO: 7593605 - DNA, 22 bp, Homo sapiens
ggccagcttattagctcagagg

SEQ ID NO: 7593606 - DNA, 22 bp, Homo sapiens
ggccagcttattagctcagagg

SEQ ID NO: 7593607 - DNA, 22 bp, Homo sapiens
ggccagcttattagctcagagg

SEQ ID NO: 7593608 - DNA, 22 bp, Homo sapiens
ggccagctgtggggccgagcct

SEQ ID NO: 7593609 - DNA, 22 bp, Homo sapiens
ggccagctgtgggattttctgc

SEQ ID NO: 7593610 - DNA, 22 bp, Homo sapiens
ggccagctgtggggccgagcct

SEQ ID NO: 7593611 - DNA, 22 bp, Homo sapiens
ggccagctgtgggattttctgc

SEQ ID NO: 7593612 - DNA, 22 bp, Homo sapiens
ggccagctgtaagctgctgaat

SEQ ID NO: 7593613 - DNA, 19 bp, Homo sapiens
ggccagctgtctcctgcta

SEQ ID NO: 7593614 - DNA, 22 bp, Homo sapiens
ggccagcttctctgctgcctgt

SEQ ID NO: 7593615 - DNA, 22 bp, Homo sapiens
ggccagcttctctgctgcctgt

SEQ ID NO: 7593616 - DNA, 22 bp, Homo sapiens
ggccagcttattagctcagagg

SEQ ID NO: 7593617 - DNA, 22 bp, Homo sapiens
ggccagcttattagctcagagg

SEQ ID NO: 7593618 - DNA, 22 bp, Homo sapiens
ggccagcttctctgctgcctgt

SEQ ID NO: 7593619 - DNA, 22 bp, Homo sapiens
ggcatgctaggcattttatggg

SEQ ID NO: 7593620 - DNA, 22 bp, Homo sapiens
ggcatgctacttcttcaatttt

SEQ ID NO: 7593621 - DNA, 22 bp, Homo sapiens
ggcatgcattggcatttcggtt

SEQ ID NO: 7593622 - DNA, 22 bp, Homo sapiens
ggcatgcatgttgttttaggtg

SEQ ID NO: 7593623 - DNA, 22 bp, Homo sapiens
ggcatgcatgttgttttaggtg

SEQ ID NO: 7593624 - DNA, 22 bp, Homo sapiens
ggcatgcatgcatgcacctgtg

SEQ ID NO: 7593625 - DNA, 22 bp, Homo sapiens
ggcatgcatgcatgcacctgtg

SEQ ID NO: 7593626 - DNA, 22 bp, Homo sapiens
ggcatgcatgcaaggtggtgta

SEQ ID NO: 7593627 - DNA, 22 bp, Homo sapiens
ggcatgcatacgtagtgatttt

SEQ ID NO: 7593628 - DNA, 22 bp, Homo sapiens
ggcatgcatacgtagtgatttt

SEQ ID NO: 7593629 - DNA, 22 bp, Homo sapiens
ggcatgcatgcaaggtggtgta

SEQ ID NO: 7593630 - DNA, 22 bp, Homo sapiens
ggcatgctgcgtacagatgaac

SEQ ID NO: 7593631 - DNA, 22 bp, Homo sapiens
ggcatgctctttgtccacagta

SEQ ID NO: 7593632 - DNA, 22 bp, Homo sapiens
ggcatgctcaggcttcttgctg

SEQ ID NO: 7593633 - DNA, 22 bp, Homo sapiens
ggcatgctctgggggtcctccg

SEQ ID NO: 7593634 - DNA, 22 bp, Homo sapiens
ggcatgctctttatattgcaat

SEQ ID NO: 7593635 - DNA, 22 bp, Homo sapiens
ggcatgcttgctgtttgggaat

SEQ ID NO: 7593636 - DNA, 22 bp, Homo sapiens
ggccagctgggccaccaggtgc

SEQ ID NO: 7593637 - DNA, 21 bp, Homo sapiens
ggcatgctgctgctacttggc

SEQ ID NO: 7593638 - DNA, 22 bp, Homo sapiens
ggccagctgtaagctgctgaat

SEQ ID NO: 7593639 - DNA, 22 bp, Homo sapiens
ggccagctgtaagctgctgaat

SEQ ID NO: 7593640 - DNA, 22 bp, Homo sapiens
ggccagctgtaagctgctgaat

SEQ ID NO: 7593641 - DNA, 22 bp, Homo sapiens
ggccagctgtaagctgctgaat

SEQ ID NO: 7593642 - DNA, 19 bp, Homo sapiens
ggccagctgtctcctgcta

SEQ ID NO: 7593643 - DNA, 19 bp, Homo sapiens
ggccagctgtctcctgcta

SEQ ID NO: 7593644 - DNA, 22 bp, Homo sapiens
ggcatgagtggcagtgggcagt

SEQ ID NO: 7593645 - DNA, 22 bp, Homo sapiens
ggcatgagtggcagtgggcagt

SEQ ID NO: 7593646 - DNA, 22 bp, Homo sapiens
ggcatgagtaacgtgagtgagg

SEQ ID NO: 7593647 - DNA, 22 bp, Homo sapiens
ggcatgagtaacgtgagtgagg

SEQ ID NO: 7593648 - DNA, 22 bp, Homo sapiens
ggcatgagtggcagtgggcagt

SEQ ID NO: 7593649 - DNA, 22 bp, Homo sapiens
ggcatgcaaaacaactcagaga

SEQ ID NO: 7593650 - DNA, 22 bp, Homo sapiens
ggcatgcaaaacaactcagaga

SEQ ID NO: 7593651 - DNA, 22 bp, Homo sapiens
ggcatgagtggcagtgggcagt

SEQ ID NO: 7593652 - DNA, 22 bp, Homo sapiens
ggcatgagtggcagtgggcagt

SEQ ID NO: 7593653 - DNA, 22 bp, Homo sapiens
ggcatgagtggcagtgggcagt

SEQ ID NO: 7593654 - DNA, 22 bp, Homo sapiens
ggcatgcaaatgtgggtgacct

SEQ ID NO: 7593655 - DNA, 22 bp, Homo sapiens
ggcatgcaaagccccttacaga

SEQ ID NO: 7593656 - DNA, 22 bp, Homo sapiens
ggcatgcaaagccccttacaga

SEQ ID NO: 7593657 - DNA, 22 bp, Homo sapiens
ggcatgcaaatgtgggtgacct

SEQ ID NO: 7593658 - DNA, 23 bp, Homo sapiens
ggcatgcaatggacagagctgga

SEQ ID NO: 7593659 - DNA, 22 bp, Homo sapiens
ggcatgcaaatgtgggtgacct

SEQ ID NO: 7593660 - DNA, 22 bp, Homo sapiens
ggcatgcaaatgtgggtgacct

SEQ ID NO: 7593661 - DNA, 22 bp, Homo sapiens
ggcatgcaaatgtgggtgacct

SEQ ID NO: 7593662 - DNA, 22 bp, Homo sapiens
ggcatgcatcaccacgccacgc

SEQ ID NO: 7593663 - DNA, 22 bp, Homo sapiens
ggcatgcatacgtagtgatttt

SEQ ID NO: 7593664 - DNA, 22 bp, Homo sapiens
ggcatgcacccggtgaccatga

SEQ ID NO: 7593665 - DNA, 22 bp, Homo sapiens
ggcatgcacccggtgaccatga

SEQ ID NO: 7593666 - DNA, 23 bp, Homo sapiens
ggcatgcaatggacagagctgga

SEQ ID NO: 7593667 - DNA, 23 bp, Homo sapiens
ggcatgcaatggacagagctgga

SEQ ID NO: 7593668 - DNA, 23 bp, Homo sapiens
ggcatgcaatggacagagctgga

SEQ ID NO: 7593669 - DNA, 23 bp, Homo sapiens
ggcatgcaatggacagagctgga

SEQ ID NO: 7593670 - DNA, 23 bp, Homo sapiens
ggatggacgtgatgccttagcca

SEQ ID NO: 7593671 - DNA, 18 bp, Homo sapiens
ggatgctgtgtgctcctt

SEQ ID NO: 7593672 - DNA, 22 bp, Homo sapiens
ggatgcttaggttgttttatta

SEQ ID NO: 7593673 - DNA, 23 bp, Homo sapiens
ggatggacgtgatgccttagcca

SEQ ID NO: 7593674 - DNA, 23 bp, Homo sapiens
ggatggacgtgatgccttagcca

SEQ ID NO: 7593675 - DNA, 23 bp, Homo sapiens
ggatggacgtgatgccttagcca

SEQ ID NO: 7593676 - DNA, 23 bp, Homo sapiens
ggatggacgtgatgccttagcca

SEQ ID NO: 7593677 - DNA, 23 bp, Homo sapiens
ggatggacgtgatgccttagcca

SEQ ID NO: 7593678 - DNA, 23 bp, Homo sapiens
ggatggacgtgatgccttagcca

SEQ ID NO: 7593679 - DNA, 22 bp, Homo sapiens
ggatggagatgaccatggtgac

SEQ ID NO: 7593680 - DNA, 22 bp, Homo sapiens
ggatggagatgaccatggtgac

SEQ ID NO: 7593681 - DNA, 22 bp, Homo sapiens
ggatgctgtctaagctgaggac

SEQ ID NO: 7593682 - DNA, 22 bp, Homo sapiens
ggatgctgtctaagctgaggac

SEQ ID NO: 7593683 - DNA, 22 bp, Homo sapiens
ggatgctgtctaagctgaggac

SEQ ID NO: 7593684 - DNA, 22 bp, Homo sapiens
ggatgctggggaccaatctctg

SEQ ID NO: 7593685 - DNA, 22 bp, Homo sapiens
ggatgctgtctaagctgaggac

SEQ ID NO: 7593686 - DNA, 22 bp, Homo sapiens
ggatgctgtctaagctgaggac

SEQ ID NO: 7593687 - DNA, 22 bp, Homo sapiens
ggatgctgtgcactactctggc

SEQ ID NO: 7593688 - DNA, 18 bp, Homo sapiens
ggatgctgtgtgctcctt

SEQ ID NO: 7593689 - DNA, 22 bp, Homo sapiens
ggatgctgactttggagcatgg

SEQ ID NO: 7593690 - DNA, 22 bp, Homo sapiens
ggatgctgatatagagcattct

SEQ ID NO: 7593691 - DNA, 22 bp, Homo sapiens
ggatgctgatatagagcattct

SEQ ID NO: 7593692 - DNA, 22 bp, Homo sapiens
ggatgctgctatcaggcttcga

SEQ ID NO: 7593693 - DNA, 22 bp, Homo sapiens
ggatgctcagtgcctgtgtcca

SEQ ID NO: 7593694 - DNA, 22 bp, Homo sapiens
ggatgctgactttggagcatgg

SEQ ID NO: 7593695 - DNA, 22 bp, Homo sapiens
ggatgctgactttggagcatgg

SEQ ID NO: 7593696 - DNA, 22 bp, Homo sapiens
ggatgctgctgcacatcctgca

SEQ ID NO: 7593697 - DNA, 22 bp, Homo sapiens
ggatgctgctgcacatcctgca

SEQ ID NO: 7593698 - DNA, 22 bp, Homo sapiens
ggatgctgctatcaggcttcga

SEQ ID NO: 7593699 - DNA, 22 bp, Homo sapiens
ggatgctgctatcaggcttcga

SEQ ID NO: 7593700 - DNA, 22 bp, Homo sapiens
ggatgctgctgcacatcctgca

SEQ ID NO: 7593701 - DNA, 22 bp, Homo sapiens
ggatgctgggagacagcaggca

SEQ ID NO: 7593702 - DNA, 22 bp, Homo sapiens
ggatgctgggagacagcaggca

SEQ ID NO: 7593703 - DNA, 22 bp, Homo sapiens
ggatgctgggagacagcaggca

SEQ ID NO: 7593704 - DNA, 22 bp, Homo sapiens
ggatgctgggagacagcaggca

SEQ ID NO: 7593705 - DNA, 22 bp, Homo sapiens
ggatgctgggagacagcaggca

SEQ ID NO: 7593706 - DNA, 22 bp, Homo sapiens
ggatgctgggagacagcaggca

SEQ ID NO: 7593707 - DNA, 22 bp, Homo sapiens
ggatgctgggagacagcaggca

SEQ ID NO: 7593708 - DNA, 22 bp, Homo sapiens
ggatgctgggagacagcaggca

SEQ ID NO: 7593709 - DNA, 22 bp, Homo sapiens
ggatgcaggaacacagcgacct

SEQ ID NO: 7593710 - DNA, 22 bp, Homo sapiens
ggatgcaggaacacagcgacct

SEQ ID NO: 7593711 - DNA, 22 bp, Homo sapiens
ggatgcaggacggcatggatgt

SEQ ID NO: 7593712 - DNA, 22 bp, Homo sapiens
ggatgcacgaaggcgcctcgga

SEQ ID NO: 7593713 - DNA, 22 bp, Homo sapiens
ggatgcaggaacacagcgacct

SEQ ID NO: 7593714 - DNA, 22 bp, Homo sapiens
ggatgcaggaacacagcgacct

SEQ ID NO: 7593715 - DNA, 22 bp, Homo sapiens
ggatgcaggaacacagcgacct

SEQ ID NO: 7593716 - DNA, 22 bp, Homo sapiens
ggatgaggtagatgaacaaggg

SEQ ID NO: 7593717 - DNA, 22 bp, Homo sapiens
ggatgcacgaaggcgcctcgga

SEQ ID NO: 7593718 - DNA, 22 bp, Homo sapiens
ggatgcacgaaggcgcctcgga

SEQ ID NO: 7593719 - DNA, 22 bp, Homo sapiens
ggatgaggtagatgaacaaggg

SEQ ID NO: 7593720 - DNA, 22 bp, Homo sapiens
ggatgaggtagatgaacaaggg

SEQ ID NO: 7593721 - DNA, 22 bp, Homo sapiens
ggatgaggtagatgaacaaggg

SEQ ID NO: 7593722 - DNA, 19 bp, Homo sapiens
ggatgagggtcaggcatag

SEQ ID NO: 7593723 - DNA, 19 bp, Homo sapiens
ggatgagggtcaggcatag

SEQ ID NO: 7593724 - DNA, 19 bp, Homo sapiens
ggatgagggtcaggcatag

SEQ ID NO: 7593725 - DNA, 22 bp, Homo sapiens
ggatgcagtgaggagcccgcgc

SEQ ID NO: 7593726 - DNA, 22 bp, Homo sapiens
ggatgccaactctgtttctgtg

SEQ ID NO: 7593727 - DNA, 22 bp, Homo sapiens
ggatgccaactctgtttctgtg

SEQ ID NO: 7593728 - DNA, 22 bp, Homo sapiens
ggatgcacgaaggcgcctcgga

SEQ ID NO: 7593729 - DNA, 22 bp, Homo sapiens
ggatgcagtgaggagcccgcgc

SEQ ID NO: 7593730 - DNA, 22 bp, Homo sapiens
ggatgcagtgaggagcccgcgc

SEQ ID NO: 7593731 - DNA, 22 bp, Homo sapiens
ggatgcaggggcagcagagcct

SEQ ID NO: 7593732 - DNA, 22 bp, Homo sapiens
ggatgcaggggcagcagagcct

SEQ ID NO: 7593733 - DNA, 22 bp, Homo sapiens
ggatgcaggggcagcagagcct

SEQ ID NO: 7593734 - DNA, 22 bp, Homo sapiens
ggatgcaggggcagcagagcct

SEQ ID NO: 7593735 - DNA, 22 bp, Homo sapiens
ggatgccatcagagtgtctgtg

SEQ ID NO: 7593736 - DNA, 22 bp, Homo sapiens
ggatgccatcagagtgtctgtg

SEQ ID NO: 7593737 - DNA, 22 bp, Homo sapiens
ggatgccatttgggtctggctt

SEQ ID NO: 7593738 - DNA, 22 bp, Homo sapiens
ggatgccatttgggtctggctt

SEQ ID NO: 7593739 - DNA, 22 bp, Homo sapiens
ggatgcaggaggtcggggagca

SEQ ID NO: 7593740 - DNA, 22 bp, Homo sapiens
ggatgcaggagttgaagaagga

SEQ ID NO: 7593741 - DNA, 22 bp, Homo sapiens
ggatgcaggagttgaagaagga

SEQ ID NO: 7593742 - DNA, 22 bp, Homo sapiens
ggatgcaggagttgaagaagga

SEQ ID NO: 7593743 - DNA, 22 bp, Homo sapiens
ggatgcaggggcagcagagcct

SEQ ID NO: 7593744 - DNA, 22 bp, Homo sapiens
ggatgcaggggcagcagagcct

SEQ ID NO: 7593745 - DNA, 22 bp, Homo sapiens
ggatgcaggggcagcagagcct

SEQ ID NO: 7593746 - DNA, 22 bp, Homo sapiens
ggatgcaggaggtcggggagca

SEQ ID NO: 7593747 - DNA, 22 bp, Homo sapiens
ggatgcaggaggtcggggagca

SEQ ID NO: 7593748 - DNA, 22 bp, Homo sapiens
ggatgcaggacggcatggatgt

SEQ ID NO: 7593749 - DNA, 22 bp, Homo sapiens
ggatgcaggagttgaagaagga

SEQ ID NO: 7593750 - DNA, 22 bp, Homo sapiens
ggatgcaggagttgaagaagga

SEQ ID NO: 7593751 - DNA, 22 bp, Homo sapiens
ggatggagatgaccatggtgac

SEQ ID NO: 7593752 - DNA, 22 bp, Homo sapiens
ggatggagatgaccatggtgac

SEQ ID NO: 7593753 - DNA, 22 bp, Homo sapiens
ggatggagatgaccatggtgac

SEQ ID NO: 7593754 - DNA, 22 bp, Homo sapiens
ggatggagatgaccatggtgac

SEQ ID NO: 7593755 - DNA, 22 bp, Homo sapiens
ggatggaggttctcagatgctc

SEQ ID NO: 7593756 - DNA, 22 bp, Homo sapiens
ggatggaggttctcagatgctc

SEQ ID NO: 7593757 - DNA, 22 bp, Homo sapiens
ggatggaggttctcagatgctc

SEQ ID NO: 7593758 - DNA, 22 bp, Homo sapiens
ggatggaggttctcagatgctc

SEQ ID NO: 7593759 - DNA, 22 bp, Homo sapiens
ggatggaggttctcagatgctc

SEQ ID NO: 7593760 - DNA, 22 bp, Homo sapiens
ggatggaggttctcagatgctc

SEQ ID NO: 7593761 - DNA, 22 bp, Homo sapiens
ggatggaggttctcagatgctc

SEQ ID NO: 7593762 - DNA, 23 bp, Homo sapiens
ggatggagccactttgaaaccac

SEQ ID NO: 7593763 - DNA, 23 bp, Homo sapiens
ggatggagccactttgaaaccac

SEQ ID NO: 7593764 - DNA, 22 bp, Homo sapiens
ggatggaggttctcagatgctc

SEQ ID NO: 7593765 - DNA, 22 bp, Homo sapiens
ggatggcatgttgggctctgtt

SEQ ID NO: 7593766 - DNA, 22 bp, Homo sapiens
ggatggcatgttgggctctgtt

SEQ ID NO: 7593767 - DNA, 22 bp, Homo sapiens
ggatggcatgttgggctctgtt

SEQ ID NO: 7593768 - DNA, 22 bp, Homo sapiens
ggatggccgagaagacagcgta

SEQ ID NO: 7593769 - DNA, 20 bp, Homo sapiens
ggatggccggaccagagcct

SEQ ID NO: 7593770 - DNA, 22 bp, Homo sapiens
ggatggcagtctgcatgagaaa

SEQ ID NO: 7593771 - DNA, 22 bp, Homo sapiens
ggatggcagtctgcatgagaaa

SEQ ID NO: 7593772 - DNA, 22 bp, Homo sapiens
ggatggcagtctgcatgagaaa

SEQ ID NO: 7593773 - DNA, 22 bp, Homo sapiens
ggatggcagtctgcatgagaaa

SEQ ID NO: 7593774 - DNA, 22 bp, Homo sapiens
ggatggcagtctgcatgagaaa

SEQ ID NO: 7593775 - DNA, 22 bp, Homo sapiens
ggatggcagtctgcatgagaaa

SEQ ID NO: 7593776 - DNA, 22 bp, Homo sapiens
ggatggcatgttgggctctgtt

SEQ ID NO: 7593777 - DNA, 22 bp, Homo sapiens
ggatggcagacagtgagtggct

SEQ ID NO: 7593778 - DNA, 22 bp, Homo sapiens
ggatggaggttctcagatgctc

SEQ ID NO: 7593779 - DNA, 21 bp, Homo sapiens
ggatggatagggaagagattt

SEQ ID NO: 7593780 - DNA, 22 bp, Homo sapiens
ggatggcagtctgcatgagaaa

SEQ ID NO: 7593781 - DNA, 22 bp, Homo sapiens
ggatggcaggacaaggacccag

SEQ ID NO: 7593782 - DNA, 22 bp, Homo sapiens
ggatggcagacagtgagtggct

SEQ ID NO: 7593783 - DNA, 22 bp, Homo sapiens
ggatggcagacagtgagtggct

SEQ ID NO: 7593784 - DNA, 22 bp, Homo sapiens
ggatggcaggacaaggacccag

SEQ ID NO: 7593785 - DNA, 22 bp, Homo sapiens
ggatggcaggacaaggacccag

SEQ ID NO: 7593786 - DNA, 22 bp, Homo sapiens
ggattcagataagtggaggtga

SEQ ID NO: 7593787 - DNA, 22 bp, Homo sapiens
ggattcagcgaggcagcctgga

SEQ ID NO: 7593788 - DNA, 22 bp, Homo sapiens
ggattcagcgaggcagcctgga

SEQ ID NO: 7593789 - DNA, 22 bp, Homo sapiens
ggattaaggggaaaaagcagct

SEQ ID NO: 7593790 - DNA, 22 bp, Homo sapiens
ggattaatgagggggttccggt

SEQ ID NO: 7593791 - DNA, 22 bp, Homo sapiens
ggattagcttttgttcttgact

SEQ ID NO: 7593792 - DNA, 22 bp, Homo sapiens
ggatgtttggcgtttgaattgc

SEQ ID NO: 7593793 - DNA, 22 bp, Homo sapiens
ggatgttgattgaatggccatt

SEQ ID NO: 7593794 - DNA, 22 bp, Homo sapiens
ggatgtttatcctatcttagtt

SEQ ID NO: 7593795 - DNA, 22 bp, Homo sapiens
ggatgtttggcgtttgaattgc

SEQ ID NO: 7593796 - DNA, 22 bp, Homo sapiens
ggattcagggtaaagtttcagt

SEQ ID NO: 7593797 - DNA, 22 bp, Homo sapiens
ggattcagtgtctgttaatagt

SEQ ID NO: 7593798 - DNA, 22 bp, Homo sapiens
ggattcagtgtctgttaatagt

SEQ ID NO: 7593799 - DNA, 22 bp, Homo sapiens
ggattccatggtcaggaaatag

SEQ ID NO: 7593800 - DNA, 22 bp, Homo sapiens
ggattccatggtcaggaaatag

SEQ ID NO: 7593801 - DNA, 20 bp, Homo sapiens
ggattctgactgtgaagagg

SEQ ID NO: 7593802 - DNA, 22 bp, Homo sapiens
ggattgagagcactggtagctg

SEQ ID NO: 7593803 - DNA, 18 bp, Homo sapiens
ggattctggggacctggg

SEQ ID NO: 7593804 - DNA, 19 bp, Homo sapiens
ggattctgcagttttcaca

SEQ ID NO: 7593805 - DNA, 22 bp, Homo sapiens
ggattctgccttgttgcttcaa

SEQ ID NO: 7593806 - DNA, 22 bp, Homo sapiens
ggatggctccacagtttctccc

SEQ ID NO: 7593807 - DNA, 20 bp, Homo sapiens
ggatggccggaccagagcct

SEQ ID NO: 7593808 - DNA, 22 bp, Homo sapiens
ggatggccttcttgctcaggaa

SEQ ID NO: 7593809 - DNA, 22 bp, Homo sapiens
ggatggccttcttgctcaggaa

SEQ ID NO: 7593810 - DNA, 22 bp, Homo sapiens
ggatggcttgcatttgaggact

SEQ ID NO: 7593811 - DNA, 22 bp, Homo sapiens
ggatggcttgcatttgaggact

SEQ ID NO: 7593812 - DNA, 22 bp, Homo sapiens
ggatggctgtaaaaggtgggaa

SEQ ID NO: 7593813 - DNA, 22 bp, Homo sapiens
ggatggctccagaaagcagggt

SEQ ID NO: 7593814 - DNA, 22 bp, Homo sapiens
ggatggctgtaaaaggtgggaa

SEQ ID NO: 7593815 - DNA, 22 bp, Homo sapiens
ggatgggaacttggtagggcat

SEQ ID NO: 7593816 - DNA, 22 bp, Homo sapiens
ggatgggaacttggtagggcat

SEQ ID NO: 7593817 - DNA, 22 bp, Homo sapiens
ggatgggaacttggtagggcat

SEQ ID NO: 7593818 - DNA, 22 bp, Homo sapiens
ggatgggaacttggtagggcat

SEQ ID NO: 7593819 - DNA, 22 bp, Homo sapiens
ggatgttgattgaatggccatt

SEQ ID NO: 7593820 - DNA, 22 bp, Homo sapiens
ggatgggaacttggtagggcat

SEQ ID NO: 7593821 - DNA, 22 bp, Homo sapiens
ggatgggaacttggtagggcat

SEQ ID NO: 7593822 - DNA, 22 bp, Homo sapiens
ggatgggaacttggtagggcat

SEQ ID NO: 7593823 - DNA, 22 bp, Homo sapiens
ggatggcttgcatttgaggact

SEQ ID NO: 7593824 - DNA, 22 bp, Homo sapiens
ggatgggaacttggtagggcat

SEQ ID NO: 7593825 - DNA, 22 bp, Homo sapiens
ggagcagacataaccttacaga

SEQ ID NO: 7593826 - DNA, 22 bp, Homo sapiens
ggagcagacataaccttacaga

SEQ ID NO: 7593827 - DNA, 22 bp, Homo sapiens
ggagcagacataaccttacaga

SEQ ID NO: 7593828 - DNA, 22 bp, Homo sapiens
ggagcagagcatttcacagcct

SEQ ID NO: 7593829 - DNA, 22 bp, Homo sapiens
ggagcagacataaccttacaga

SEQ ID NO: 7593830 - DNA, 22 bp, Homo sapiens
ggagcagagcatttcacagcct

SEQ ID NO: 7593831 - DNA, 22 bp, Homo sapiens
ggagcagagcatttcacagcct

SEQ ID NO: 7593832 - DNA, 22 bp, Homo sapiens
ggagcagagcatttcacagcct

SEQ ID NO: 7593833 - DNA, 22 bp, Homo sapiens
ggagcagagcatttcacagcct

SEQ ID NO: 7593834 - DNA, 22 bp, Homo sapiens
ggagcagagcatttcacagcct

SEQ ID NO: 7593835 - DNA, 22 bp, Homo sapiens
ggagcagagcatttcacagcct

SEQ ID NO: 7593836 - DNA, 22 bp, Homo sapiens
ggagcagagctcttcatctgca

SEQ ID NO: 7593837 - DNA, 22 bp, Homo sapiens
ggagcagagctcttcatctgca

SEQ ID NO: 7593838 - DNA, 22 bp, Homo sapiens
ggagcagagctgggcttggctg

SEQ ID NO: 7593839 - DNA, 22 bp, Homo sapiens
ggagcagagctcttcatctgca

SEQ ID NO: 7593840 - DNA, 22 bp, Homo sapiens
ggagcagagctgggcttggctg

SEQ ID NO: 7593841 - DNA, 22 bp, Homo sapiens
ggagcagagcatttcacagcct

SEQ ID NO: 7593842 - DNA, 22 bp, Homo sapiens
ggagcagagcatttcacagcct

SEQ ID NO: 7593843 - DNA, 22 bp, Homo sapiens
ggagcagagctcttcatctgca

SEQ ID NO: 7593844 - DNA, 22 bp, Homo sapiens
ggagcagatgtcttcatggcct

SEQ ID NO: 7593845 - DNA, 22 bp, Homo sapiens
ggagcagatgtcttcatggcct

SEQ ID NO: 7593846 - DNA, 22 bp, Homo sapiens
ggagcagatgtcttcatggcct

SEQ ID NO: 7593847 - DNA, 22 bp, Homo sapiens
ggagcagatgtcttcatggcct

SEQ ID NO: 7593848 - DNA, 22 bp, Homo sapiens
ggagttggaggctccagggaac

SEQ ID NO: 7593849 - DNA, 23 bp, Homo sapiens
ggagttggattgtacttgctgct

SEQ ID NO: 7593850 - DNA, 22 bp, Homo sapiens
ggagttggaggctccagggaac

SEQ ID NO: 7593851 - DNA, 22 bp, Homo sapiens
ggagcagatgtcttcatggcct

SEQ ID NO: 7593852 - DNA, 22 bp, Homo sapiens
ggagttggaggctccagggaac

SEQ ID NO: 7593853 - DNA, 22 bp, Homo sapiens
ggagttggaggctccagggaac

SEQ ID NO: 7593854 - DNA, 17 bp, Homo sapiens
ggagcagatccaccatt

SEQ ID NO: 7593855 - DNA, 17 bp, Homo sapiens
ggagcagatccaccatt

SEQ ID NO: 7593856 - DNA, 17 bp, Homo sapiens
ggagcagatccaccatt

SEQ ID NO: 7593857 - DNA, 17 bp, Homo sapiens
ggagcagatccaccatt

SEQ ID NO: 7593858 - DNA, 17 bp, Homo sapiens
ggagcagatccaccatt

SEQ ID NO: 7593859 - DNA, 17 bp, Homo sapiens
ggagcagatccaccatt

SEQ ID NO: 7593860 - DNA, 17 bp, Homo sapiens
ggagcagatccaccatt

SEQ ID NO: 7593861 - DNA, 22 bp, Homo sapiens
ggagcagagctgggcttggctg

SEQ ID NO: 7593862 - DNA, 22 bp, Homo sapiens
ggagcagagctgggcttggctg

SEQ ID NO: 7593863 - DNA, 22 bp, Homo sapiens
ggagcagagctgggcttggctg

SEQ ID NO: 7593864 - DNA, 22 bp, Homo sapiens
ggagcagagctgggcttggctg

SEQ ID NO: 7593865 - DNA, 22 bp, Homo sapiens
ggagcagagctgggcttggctg

SEQ ID NO: 7593866 - DNA, 22 bp, Homo sapiens
ggatctgttttgcctctgaggg

SEQ ID NO: 7593867 - DNA, 22 bp, Homo sapiens
ggatctggttacgtaagagtct

SEQ ID NO: 7593868 - DNA, 22 bp, Homo sapiens
ggatctggttacgtaagagtct

SEQ ID NO: 7593869 - DNA, 22 bp, Homo sapiens
ggatctggggtagagcagtggg

SEQ ID NO: 7593870 - DNA, 22 bp, Homo sapiens
ggatgacaaggaaagcaaacca

SEQ ID NO: 7593871 - DNA, 22 bp, Homo sapiens
ggatcttatttccaatccaggc

SEQ ID NO: 7593872 - DNA, 22 bp, Homo sapiens
ggatctggggtagagcagtggg

SEQ ID NO: 7593873 - DNA, 19 bp, Homo sapiens
ggagtttccaatgggtaaa

SEQ ID NO: 7593874 - DNA, 23 bp, Homo sapiens
ggagttggattgtacttgctgct

SEQ ID NO: 7593875 - DNA, 22 bp, Homo sapiens
ggagttggtgagcaccaggctt

SEQ ID NO: 7593876 - DNA, 22 bp, Homo sapiens
ggagttggtgagcaccaggctt

SEQ ID NO: 7593877 - DNA, 22 bp, Homo sapiens
ggagttggtggcccggaatctc

SEQ ID NO: 7593878 - DNA, 22 bp, Homo sapiens
ggatgacagctcttccatgtgg

SEQ ID NO: 7593879 - DNA, 22 bp, Homo sapiens
ggatgacagataacagtattaa

SEQ ID NO: 7593880 - DNA, 22 bp, Homo sapiens
ggatgacagataacagtattaa

SEQ ID NO: 7593881 - DNA, 22 bp, Homo sapiens
ggatgaggaaaccacagtgtcc

SEQ ID NO: 7593882 - DNA, 22 bp, Homo sapiens
ggatgaggaaaccacagtgtcc

SEQ ID NO: 7593883 - DNA, 22 bp, Homo sapiens
ggatgaggaaaccacagtgtcc

SEQ ID NO: 7593884 - DNA, 22 bp, Homo sapiens
ggatgaggaagattactgagaa

SEQ ID NO: 7593885 - DNA, 22 bp, Homo sapiens
ggatgaggaagattactgagaa

SEQ ID NO: 7593886 - DNA, 22 bp, Homo sapiens
ggatgaggaagattactgagaa

SEQ ID NO: 7593887 - DNA, 22 bp, Homo sapiens
ggatgaggaagattactgagaa

SEQ ID NO: 7593888 - DNA, 19 bp, Homo sapiens
ggatgagggtcaggcatag

SEQ ID NO: 7593889 - DNA, 22 bp, Homo sapiens
ggatgaggaaaccacagtgtcc

SEQ ID NO: 7593890 - DNA, 22 bp, Homo sapiens
ggatgaggaagattactgagaa

SEQ ID NO: 7593891 - DNA, 19 bp, Homo sapiens
ggatgagggtcaggcatag

SEQ ID NO: 7593892 - DNA, 19 bp, Homo sapiens
ggatgagggtcaggcatag

SEQ ID NO: 7593893 - DNA, 19 bp, Homo sapiens
ggatgagggtcaggcatag

SEQ ID NO: 7593894 - DNA, 19 bp, Homo sapiens
ggatgagggtcaggcatag

SEQ ID NO: 7593895 - DNA, 22 bp, Homo sapiens
ggagcacaccgggagcttgcct

SEQ ID NO: 7593896 - DNA, 22 bp, Homo sapiens
ggagcacagccttgccagtacc

SEQ ID NO: 7593897 - DNA, 22 bp, Homo sapiens
ggagcaagaggtggtgaaaaat

SEQ ID NO: 7593898 - DNA, 22 bp, Homo sapiens
ggagcacagccttgccagtacc

SEQ ID NO: 7593899 - DNA, 22 bp, Homo sapiens
ggagcaccaaagtaactagcac

SEQ ID NO: 7593900 - DNA, 22 bp, Homo sapiens
ggagcacagccttgccagtacc

SEQ ID NO: 7593901 - DNA, 22 bp, Homo sapiens
ggagcacaccgggagcttgcct

SEQ ID NO: 7593902 - DNA, 22 bp, Homo sapiens
ggagcaagtcccaggcactagt

SEQ ID NO: 7593903 - DNA, 22 bp, Homo sapiens
ggagcaagtcccaggcactagt

SEQ ID NO: 7593904 - DNA, 22 bp, Homo sapiens
ggagcaagtcccaggcactagt

SEQ ID NO: 7593905 - DNA, 22 bp, Homo sapiens
ggagcaagtcccaggcactagt

SEQ ID NO: 7593906 - DNA, 22 bp, Homo sapiens
ggagcaagtcccaggcactagt

SEQ ID NO: 7593907 - DNA, 22 bp, Homo sapiens
ggagcaccacaggttgagggga

SEQ ID NO: 7593908 - DNA, 22 bp, Homo sapiens
ggagcaccctgctcagccaagc

SEQ ID NO: 7593909 - DNA, 22 bp, Homo sapiens
ggagcaccccagatcagagaac

SEQ ID NO: 7593910 - DNA, 22 bp, Homo sapiens
ggagcaccctgctcagccaagc

SEQ ID NO: 7593911 - DNA, 22 bp, Homo sapiens
ggagcaccgttgggaggtgagg

SEQ ID NO: 7593912 - DNA, 22 bp, Homo sapiens
ggagcaccctgctcagccaagc

SEQ ID NO: 7593913 - DNA, 22 bp, Homo sapiens
ggagcacctttgtctatttctc

SEQ ID NO: 7593914 - DNA, 22 bp, Homo sapiens
ggagcactttctaggagaagcc

SEQ ID NO: 7593915 - DNA, 22 bp, Homo sapiens
ggagcaaatgccaagtgggagg

SEQ ID NO: 7593916 - DNA, 22 bp, Homo sapiens
ggagcaagaggtggtgaaaaat

SEQ ID NO: 7593917 - DNA, 22 bp, Homo sapiens
ggagcaagaggtggtgaaaaat

SEQ ID NO: 7593918 - DNA, 22 bp, Homo sapiens
ggagatgtagtgtcactggact

SEQ ID NO: 7593919 - DNA, 22 bp, Homo sapiens
ggagatgtagtgtcactggact

SEQ ID NO: 7593920 - DNA, 22 bp, Homo sapiens
ggagatgtagtgtcactggact

SEQ ID NO: 7593921 - DNA, 22 bp, Homo sapiens
ggagatttatagcacacttcag

SEQ ID NO: 7593922 - DNA, 21 bp, Homo sapiens
ggagatgttgtgcaggagggt

SEQ ID NO: 7593923 - DNA, 22 bp, Homo sapiens
ggagatggtggaagctggtgca

SEQ ID NO: 7593924 - DNA, 22 bp, Homo sapiens
ggagatggtggaagctggtgca

SEQ ID NO: 7593925 - DNA, 22 bp, Homo sapiens
ggagatggtggaagctggtgca

SEQ ID NO: 7593926 - DNA, 22 bp, Homo sapiens
ggagatggtggaagctggtgca

SEQ ID NO: 7593927 - DNA, 22 bp, Homo sapiens
ggagatggtggaagctggtgca

SEQ ID NO: 7593928 - DNA, 22 bp, Homo sapiens
ggagatggtggaagctggtgca

SEQ ID NO: 7593929 - DNA, 22 bp, Homo sapiens
ggagatggtggaagctggtgca

SEQ ID NO: 7593930 - DNA, 22 bp, Homo sapiens
ggagatggctggcaggtagatg

SEQ ID NO: 7593931 - DNA, 22 bp, Homo sapiens
ggagatggctggcaggtagatg

SEQ ID NO: 7593932 - DNA, 22 bp, Homo sapiens
ggagatggctggcaggtagatg

SEQ ID NO: 7593933 - DNA, 22 bp, Homo sapiens
ggagatggctggcaggtagatg

SEQ ID NO: 7593934 - DNA, 22 bp, Homo sapiens
ggagatgggggattttacagcg

SEQ ID NO: 7593935 - DNA, 22 bp, Homo sapiens
ggagatggctggcaggtagatg

SEQ ID NO: 7593936 - DNA, 21 bp, Homo sapiens
ggagatgggtatcgcctgggc

SEQ ID NO: 7593937 - DNA, 21 bp, Homo sapiens
ggagatgggtatcgcctgggc

SEQ ID NO: 7593938 - DNA, 21 bp, Homo sapiens
ggagatgggtatcgcctgggc

SEQ ID NO: 7593939 - DNA, 21 bp, Homo sapiens
ggagatgggtatcgcctgggc

SEQ ID NO: 7593940 - DNA, 21 bp, Homo sapiens
ggagatgggtatcgcctgggc

SEQ ID NO: 7593941 - DNA, 22 bp, Homo sapiens
ggagatggtggaagctggtgca

SEQ ID NO: 7593942 - DNA, 22 bp, Homo sapiens
ggagatggtggaagctggtgca

SEQ ID NO: 7593943 - DNA, 22 bp, Homo sapiens
ggagatggtctgttctcatatt

SEQ ID NO: 7593944 - DNA, 22 bp, Homo sapiens
ggagatggctctgcaaggtcta

SEQ ID NO: 7593945 - DNA, 22 bp, Homo sapiens
ggagatggctctgcaaggtcta

SEQ ID NO: 7593946 - DNA, 22 bp, Homo sapiens
ggagatggccacgtcactcagt

SEQ ID NO: 7593947 - DNA, 22 bp, Homo sapiens
ggagatggccacgtcactcagt

SEQ ID NO: 7593948 - DNA, 22 bp, Homo sapiens
ggagatggccacgtcactcagt

SEQ ID NO: 7593949 - DNA, 22 bp, Homo sapiens
ggagatggctctgcaaggtcta

SEQ ID NO: 7593950 - DNA, 22 bp, Homo sapiens
ggagatggctctgcaaggtcta

SEQ ID NO: 7593951 - DNA, 22 bp, Homo sapiens
ggagatggctctgcaaggtcta

SEQ ID NO: 7593952 - DNA, 22 bp, Homo sapiens
ggagatggctggcaggtagatg

SEQ ID NO: 7593953 - DNA, 22 bp, Homo sapiens
ggagatggctggcaggtagatg

SEQ ID NO: 7593954 - DNA, 22 bp, Homo sapiens
ggagaggcttggcccagcctgg

SEQ ID NO: 7593955 - DNA, 22 bp, Homo sapiens
ggagaggcttggcccagcctgg

SEQ ID NO: 7593956 - DNA, 22 bp, Homo sapiens
ggagaggcttggcccagcctgg

SEQ ID NO: 7593957 - DNA, 22 bp, Homo sapiens
ggagatggccaaaaacacaaat

SEQ ID NO: 7593958 - DNA, 22 bp, Homo sapiens
ggagatggccaaaaacacaaat

SEQ ID NO: 7593959 - DNA, 18 bp, Homo sapiens
ggcactggtgatgcagag

SEQ ID NO: 7593960 - DNA, 18 bp, Homo sapiens
ggcactggtgatgcagag

SEQ ID NO: 7593961 - DNA, 18 bp, Homo sapiens
ggcactggtgatgcagag

SEQ ID NO: 7593962 - DNA, 18 bp, Homo sapiens
ggcactggtgatgcagag

SEQ ID NO: 7593963 - DNA, 18 bp, Homo sapiens
ggcactggtgatgcagag

SEQ ID NO: 7593964 - DNA, 22 bp, Homo sapiens
ggcactgggttgtaggaattaa

SEQ ID NO: 7593965 - DNA, 22 bp, Homo sapiens
ggcactgggtgagggtcactgg

SEQ ID NO: 7593966 - DNA, 22 bp, Homo sapiens
ggcactgggtgagggtcactgg

SEQ ID NO: 7593967 - DNA, 22 bp, Homo sapiens
ggcactgggtgagggtcactgg

SEQ ID NO: 7593968 - DNA, 19 bp, Homo sapiens
ggcactggggccaggacca

SEQ ID NO: 7593969 - DNA, 22 bp, Homo sapiens
ggcactgggtgagggtcactgg

SEQ ID NO: 7593970 - DNA, 19 bp, Homo sapiens
ggcactggggccaggacca

SEQ ID NO: 7593971 - DNA, 22 bp, Homo sapiens
ggcactgtgtacacacagagac

SEQ ID NO: 7593972 - DNA, 22 bp, Homo sapiens
ggcactgtgtacacacagagac

SEQ ID NO: 7593973 - DNA, 22 bp, Homo sapiens
ggcactgtgtacacacagagac

SEQ ID NO: 7593974 - DNA, 18 bp, Homo sapiens
ggcactggtgatgcagag

SEQ ID NO: 7593975 - DNA, 18 bp, Homo sapiens
ggcactggtgatgcagag

SEQ ID NO: 7593976 - DNA, 18 bp, Homo sapiens
ggcactggtgatgcagag

SEQ ID NO: 7593977 - DNA, 18 bp, Homo sapiens
ggcactggtgatgcagag

SEQ ID NO: 7593978 - DNA, 18 bp, Homo sapiens
ggcactggtgatgcagag

SEQ ID NO: 7593979 - DNA, 18 bp, Homo sapiens
ggcactggtgatgcagag

SEQ ID NO: 7593980 - DNA, 22 bp, Homo sapiens
ggcacttggatcttagttgggg

SEQ ID NO: 7593981 - DNA, 22 bp, Homo sapiens
ggcactgtgtacacacagagac

SEQ ID NO: 7593982 - DNA, 22 bp, Homo sapiens
ggcactttccagtctatagagc

SEQ ID NO: 7593983 - DNA, 22 bp, Homo sapiens
ggcactttgattttgagatgca

SEQ ID NO: 7593984 - DNA, 22 bp, Homo sapiens
ggcactttgattttgagatgca

SEQ ID NO: 7593985 - DNA, 22 bp, Homo sapiens
ggcactttgattttgagatgca

SEQ ID NO: 7593986 - DNA, 22 bp, Homo sapiens
ggcactgtttttgtattcagtt

SEQ ID NO: 7593987 - DNA, 20 bp, Homo sapiens
ggcacttgatcccctggttc

SEQ ID NO: 7593988 - DNA, 22 bp, Homo sapiens
ggcacttgcttgctgcctttat

SEQ ID NO: 7593989 - DNA, 22 bp, Homo sapiens
ggcacttgcttgctgcctttat

SEQ ID NO: 7593990 - DNA, 22 bp, Homo sapiens
ggcacttggatcttagttgggg

SEQ ID NO: 7593991 - DNA, 19 bp, Homo sapiens
ggcactggggccaggacca

SEQ ID NO: 7593992 - DNA, 19 bp, Homo sapiens
ggcactggggccaggacca

SEQ ID NO: 7593993 - DNA, 19 bp, Homo sapiens
ggcactggggccaggacca

SEQ ID NO: 7593994 - DNA, 22 bp, Homo sapiens
ggcactgctgtaggcagtgagg

SEQ ID NO: 7593995 - DNA, 22 bp, Homo sapiens
ggcactgggcaccggctgaggg

SEQ ID NO: 7593996 - DNA, 22 bp, Homo sapiens
ggcactgctgtaggcagtgagg

SEQ ID NO: 7593997 - DNA, 22 bp, Homo sapiens
ggcactgccccctgcccaggac

SEQ ID NO: 7593998 - DNA, 21 bp, Homo sapiens
ggcactgctgggccatctgct

SEQ ID NO: 7593999 - DNA, 21 bp, Homo sapiens
ggcactgctgggccatctgct

SEQ ID NO: 7594000 - DNA, 21 bp, Homo sapiens
ggcactgctgggccatctgct

SEQ ID NO: 7594001 - DNA, 22 bp, Homo sapiens
ggcactgcccaccctcacaggg

SEQ ID NO: 7594002 - DNA, 22 bp, Homo sapiens
ggcactgccccctgcccaggac

SEQ ID NO: 7594003 - DNA, 22 bp, Homo sapiens
ggcactgccccctgcccaggac

SEQ ID NO: 7594004 - DNA, 22 bp, Homo sapiens
ggcactgcaggtaagtgctgtc

SEQ ID NO: 7594005 - DNA, 22 bp, Homo sapiens
ggcactgcaggtaagtgctgtc

SEQ ID NO: 7594006 - DNA, 22 bp, Homo sapiens
ggcactgcccaccctcacaggg

SEQ ID NO: 7594007 - DNA, 22 bp, Homo sapiens
ggcactgcccaccctcacaggg

SEQ ID NO: 7594008 - DNA, 22 bp, Homo sapiens
ggcactgcaggtaagtgctgtc

SEQ ID NO: 7594009 - DNA, 20 bp, Homo sapiens
ggcactgcaccagttagtag

SEQ ID NO: 7594010 - DNA, 21 bp, Homo sapiens
ggattttaaaaactgcacctg

SEQ ID NO: 7594011 - DNA, 22 bp, Homo sapiens
ggcactgattccattcatgaag

SEQ ID NO: 7594012 - DNA, 22 bp, Homo sapiens
ggatttcctcttgactctaaag

SEQ ID NO: 7594013 - DNA, 22 bp, Homo sapiens
ggatttactatcttgaaatata

SEQ ID NO: 7594014 - DNA, 22 bp, Homo sapiens
ggatttccagcttcattgtcta

SEQ ID NO: 7594015 - DNA, 22 bp, Homo sapiens
ggatttgggcttgcagcagagc

SEQ ID NO: 7594016 - DNA, 22 bp, Homo sapiens
ggatttgaactagagccctgcc

SEQ ID NO: 7594017 - DNA, 22 bp, Homo sapiens
ggatttgaattgttgaaatgat

SEQ ID NO: 7594018 - DNA, 22 bp, Homo sapiens
ggattttagagtacctaagtgt

SEQ ID NO: 7594019 - DNA, 22 bp, Homo sapiens
ggatttgggcttgcagcagagc

SEQ ID NO: 7594020 - DNA, 22 bp, Homo sapiens
ggattgcaacaagctagtttag

SEQ ID NO: 7594021 - DNA, 22 bp, Homo sapiens
ggattgaagggaacctcagaat

SEQ ID NO: 7594022 - DNA, 22 bp, Homo sapiens
ggattgcaacaagctagtttag

SEQ ID NO: 7594023 - DNA, 22 bp, Homo sapiens
ggattgagagcactggtagctg

SEQ ID NO: 7594024 - DNA, 22 bp, Homo sapiens
ggattgtgataattgttgcaaa

SEQ ID NO: 7594025 - DNA, 22 bp, Homo sapiens
ggatttacaagtttaactctca

SEQ ID NO: 7594026 - DNA, 22 bp, Homo sapiens
ggatttacacacctgcctgtca

SEQ ID NO: 7594027 - DNA, 20 bp, Homo sapiens
ggatttacaggggaaaagtg

SEQ ID NO: 7594028 - DNA, 22 bp, Homo sapiens
ggatttacccaatggatagatg

SEQ ID NO: 7594029 - DNA, 22 bp, Homo sapiens
ggcagaaggcctcccagctcct

SEQ ID NO: 7594030 - DNA, 22 bp, Homo sapiens
ggcagaagacaggcaaatcatg

SEQ ID NO: 7594031 - DNA, 22 bp, Homo sapiens
ggcagaaggcaattagagactg

SEQ ID NO: 7594032 - DNA, 22 bp, Homo sapiens
ggcagaaggcaattagagactg

SEQ ID NO: 7594033 - DNA, 22 bp, Homo sapiens
ggcagaaggcaattagagactg

SEQ ID NO: 7594034 - DNA, 22 bp, Homo sapiens
ggcagaaggcaattagagactg

SEQ ID NO: 7594035 - DNA, 22 bp, Homo sapiens
ggcagaaggcctcccagctcct

SEQ ID NO: 7594036 - DNA, 19 bp, Homo sapiens
ggcagaaggtgtaggggga

SEQ ID NO: 7594037 - DNA, 19 bp, Homo sapiens
ggcagaaggtgtaggggga

SEQ ID NO: 7594038 - DNA, 19 bp, Homo sapiens
ggcagaaggtgtaggggga

SEQ ID NO: 7594039 - DNA, 22 bp, Homo sapiens
ggcagaaggcctcccagctcct

SEQ ID NO: 7594040 - DNA, 19 bp, Homo sapiens
ggcagaaggtgtaggggga

SEQ ID NO: 7594041 - DNA, 22 bp, Homo sapiens
ggcagaagaaaggctaagtctc

SEQ ID NO: 7594042 - DNA, 22 bp, Homo sapiens
ggcagaagataggacagggaat

SEQ ID NO: 7594043 - DNA, 22 bp, Homo sapiens
ggcagaagataggacagggaat

SEQ ID NO: 7594044 - DNA, 22 bp, Homo sapiens
ggcagaagaaaggctaagtctc

SEQ ID NO: 7594045 - DNA, 22 bp, Homo sapiens
ggcagaagaaaggctaagtctc

SEQ ID NO: 7594046 - DNA, 22 bp, Homo sapiens
ggcagaagaaaggctaagtctc

SEQ ID NO: 7594047 - DNA, 22 bp, Homo sapiens
ggcagaagataggacagggaat

SEQ ID NO: 7594048 - DNA, 22 bp, Homo sapiens
ggcagaagataggacagggaat

SEQ ID NO: 7594049 - DNA, 22 bp, Homo sapiens
ggcagaagataggacagggaat

SEQ ID NO: 7594050 - DNA, 22 bp, Homo sapiens
ggcagaagataggacagggaat

SEQ ID NO: 7594051 - DNA, 22 bp, Homo sapiens
ggcagaagataggacagggaat

SEQ ID NO: 7594052 - DNA, 22 bp, Homo sapiens
ggcagaagataggacagggaat

SEQ ID NO: 7594053 - DNA, 22 bp, Homo sapiens
ggcagaaggcaattagagactg

SEQ ID NO: 7594054 - DNA, 22 bp, Homo sapiens
ggcagaaggcaattagagactg

SEQ ID NO: 7594055 - DNA, 22 bp, Homo sapiens
ggcagaaggcaattagagactg

SEQ ID NO: 7594056 - DNA, 22 bp, Homo sapiens
ggcagaagataggacagggaat

SEQ ID NO: 7594057 - DNA, 22 bp, Homo sapiens
ggcagaagataggacagggaat

SEQ ID NO: 7594058 - DNA, 21 bp, Homo sapiens
ggcagaagtagcatggacggg

SEQ ID NO: 7594059 - DNA, 21 bp, Homo sapiens
ggcagaagtagcatggacggg

SEQ ID NO: 7594060 - DNA, 22 bp, Homo sapiens
ggcagaaggttgaagtaatttg

SEQ ID NO: 7594061 - DNA, 19 bp, Homo sapiens
ggcagaaggtgtaggggga

SEQ ID NO: 7594062 - DNA, 21 bp, Homo sapiens
ggcagaagtagcatggacggg

SEQ ID NO: 7594063 - DNA, 21 bp, Homo sapiens
ggcagaagtagcatggacggg

SEQ ID NO: 7594064 - DNA, 21 bp, Homo sapiens
ggcagaagtagcatggacggg

SEQ ID NO: 7594065 - DNA, 22 bp, Homo sapiens
ggcagaaggttgaagtaatttg

SEQ ID NO: 7594066 - DNA, 22 bp, Homo sapiens
ggcagcagcaaggttggagctg

SEQ ID NO: 7594067 - DNA, 22 bp, Homo sapiens
ggcagcagcaaggttggagctg

SEQ ID NO: 7594068 - DNA, 22 bp, Homo sapiens
ggcagcagcaaggttggagctg

SEQ ID NO: 7594069 - DNA, 22 bp, Homo sapiens
ggcagcagcaaggttggagctg

SEQ ID NO: 7594070 - DNA, 22 bp, Homo sapiens
ggcagcagcaaggttggagctg

SEQ ID NO: 7594071 - DNA, 22 bp, Homo sapiens
ggcagaagtgatgggatataac

SEQ ID NO: 7594072 - DNA, 22 bp, Homo sapiens
ggcagaatgagagggaaacatg

SEQ ID NO: 7594073 - DNA, 22 bp, Homo sapiens
ggcagaatgaggcttaggaatg

SEQ ID NO: 7594074 - DNA, 22 bp, Homo sapiens
ggcagaatgaggcttaggaatg

SEQ ID NO: 7594075 - DNA, 22 bp, Homo sapiens
ggcagaagtgatgggatataac

SEQ ID NO: 7594076 - DNA, 22 bp, Homo sapiens
ggcagcaggagccatctggtag

SEQ ID NO: 7594077 - DNA, 22 bp, Homo sapiens
ggcagcaggagccatctggtag

SEQ ID NO: 7594078 - DNA, 20 bp, Homo sapiens
ggcagcaggagtttcctctt

SEQ ID NO: 7594079 - DNA, 22 bp, Homo sapiens
ggcagcaggagccatctggtag

SEQ ID NO: 7594080 - DNA, 22 bp, Homo sapiens
ggcagcaggagccatctggtag

SEQ ID NO: 7594081 - DNA, 22 bp, Homo sapiens
ggcagcagcaaggttggagctg

SEQ ID NO: 7594082 - DNA, 22 bp, Homo sapiens
ggcagcagcaaggttggagctg

SEQ ID NO: 7594083 - DNA, 22 bp, Homo sapiens
ggcagcaggagccatctggtag

SEQ ID NO: 7594084 - DNA, 16 bp, Homo sapiens
ggcagcagctccgtgc

SEQ ID NO: 7594085 - DNA, 22 bp, Homo sapiens
ggcagcaggagccatctggtag

SEQ ID NO: 7594086 - DNA, 22 bp, Homo sapiens
ggcagcagggctgtctccctac

SEQ ID NO: 7594087 - DNA, 22 bp, Homo sapiens
ggcagcagggctgtctccctac

SEQ ID NO: 7594088 - DNA, 22 bp, Homo sapiens
ggcagcagggctgtctccctac

SEQ ID NO: 7594089 - DNA, 22 bp, Homo sapiens
ggcagcagggtagccatttctc

SEQ ID NO: 7594090 - DNA, 22 bp, Homo sapiens
ggcagcagggtagccatttctc

SEQ ID NO: 7594091 - DNA, 22 bp, Homo sapiens
ggcagcagggtagccatttctc

SEQ ID NO: 7594092 - DNA, 22 bp, Homo sapiens
ggcagcagggtagccatttctc

SEQ ID NO: 7594093 - DNA, 22 bp, Homo sapiens
ggcagcagggctgtctccctac

SEQ ID NO: 7594094 - DNA, 22 bp, Homo sapiens
ggcagcagggtagccatttctc

SEQ ID NO: 7594095 - DNA, 22 bp, Homo sapiens
ggcagcagggctgtctccctac

SEQ ID NO: 7594096 - DNA, 22 bp, Homo sapiens
ggcagcagggctgtctccctac

SEQ ID NO: 7594097 - DNA, 22 bp, Homo sapiens
ggcagcaggcgacttccctatt

SEQ ID NO: 7594098 - DNA, 22 bp, Homo sapiens
ggcagcaggcgacttccctatt

SEQ ID NO: 7594099 - DNA, 22 bp, Homo sapiens
ggcagaatgagagggaaacatg

SEQ ID NO: 7594100 - DNA, 20 bp, Homo sapiens
ggcagcaggagtttcctctt

SEQ ID NO: 7594101 - DNA, 22 bp, Homo sapiens
ggcagcaggcgacttccctatt

SEQ ID NO: 7594102 - DNA, 20 bp, Homo sapiens
ggcagcaggagtttcctctt

SEQ ID NO: 7594103 - DNA, 22 bp, Homo sapiens
ggcagcagtccatggcccaagg

SEQ ID NO: 7594104 - DNA, 22 bp, Homo sapiens
ggcagcagtccatggcccaagg

SEQ ID NO: 7594105 - DNA, 22 bp, Homo sapiens
ggcagcagtccatggcccaagg

SEQ ID NO: 7594106 - DNA, 22 bp, Homo sapiens
ggcagcagtccatggcccaagg

SEQ ID NO: 7594107 - DNA, 22 bp, Homo sapiens
ggcagcagtccatggcccaagg

SEQ ID NO: 7594108 - DNA, 22 bp, Homo sapiens
ggcagcagtaggagctaatctt

SEQ ID NO: 7594109 - DNA, 22 bp, Homo sapiens
ggcagcagtaggagctaatctt

SEQ ID NO: 7594110 - DNA, 22 bp, Homo sapiens
ggcagcagggtctagattgatg

SEQ ID NO: 7594111 - DNA, 22 bp, Homo sapiens
ggcagcagggtctagattgatg

SEQ ID NO: 7594112 - DNA, 22 bp, Homo sapiens
ggcagcagggtctagattgatg

SEQ ID NO: 7594113 - DNA, 22 bp, Homo sapiens
ggcagcagggtctagattgatg

SEQ ID NO: 7594114 - DNA, 22 bp, Homo sapiens
ggcagcagggtctagattgatg

SEQ ID NO: 7594115 - DNA, 22 bp, Homo sapiens
ggcagcagggtagccatttctc

SEQ ID NO: 7594116 - DNA, 22 bp, Homo sapiens
ggcagcagggtctagattgatg

SEQ ID NO: 7594117 - DNA, 22 bp, Homo sapiens
ggcagcagggtctagattgatg

SEQ ID NO: 7594118 - DNA, 22 bp, Homo sapiens
ggcagccatactcagacctggg

SEQ ID NO: 7594119 - DNA, 22 bp, Homo sapiens
ggcagccatactcagacctggg

SEQ ID NO: 7594120 - DNA, 22 bp, Homo sapiens
ggcagccatactcagacctggg

SEQ ID NO: 7594121 - DNA, 22 bp, Homo sapiens
ggcagccatactcagacctggg

SEQ ID NO: 7594122 - DNA, 22 bp, Homo sapiens
ggcagccatgcacgctgcctgg

SEQ ID NO: 7594123 - DNA, 22 bp, Homo sapiens
ggcagccatgcacgctgcctgg

SEQ ID NO: 7594124 - DNA, 22 bp, Homo sapiens
ggcagccatactcagacctggg

SEQ ID NO: 7594125 - DNA, 22 bp, Homo sapiens
ggcagccatactcagacctggg

SEQ ID NO: 7594126 - DNA, 22 bp, Homo sapiens
ggcagccatgctccaggtgcag

SEQ ID NO: 7594127 - DNA, 22 bp, Homo sapiens
ggcagccatgctccaggtgcag

SEQ ID NO: 7594128 - DNA, 22 bp, Homo sapiens
ggcagccatgcacgctgcctgg

SEQ ID NO: 7594129 - DNA, 22 bp, Homo sapiens
ggcagccatgcacgctgcctgg

SEQ ID NO: 7594130 - DNA, 22 bp, Homo sapiens
ggcagccatgctccaggtgcag

SEQ ID NO: 7594131 - DNA, 22 bp, Homo sapiens
ggcagccatggacactggctag

SEQ ID NO: 7594132 - DNA, 22 bp, Homo sapiens
ggcagccatgctccaggtgcag

SEQ ID NO: 7594133 - DNA, 22 bp, Homo sapiens
ggcagccatgctccaggtgcag

SEQ ID NO: 7594134 - DNA, 22 bp, Homo sapiens
ggcagccatggacactggctag

SEQ ID NO: 7594135 - DNA, 22 bp, Homo sapiens
ggcagccaggagggtgtagttt

SEQ ID NO: 7594136 - DNA, 22 bp, Homo sapiens
ggcagccagtagggccagcctg

SEQ ID NO: 7594137 - DNA, 22 bp, Homo sapiens
ggcagccagtagggccagcctg

SEQ ID NO: 7594138 - DNA, 22 bp, Homo sapiens
ggcagccagtagggccagcctg

SEQ ID NO: 7594139 - DNA, 22 bp, Homo sapiens
ggcagccaggagggtgtagttt

SEQ ID NO: 7594140 - DNA, 22 bp, Homo sapiens
ggcagccagcgggtggacgcgc

SEQ ID NO: 7594141 - DNA, 22 bp, Homo sapiens
ggcagccaggagggtgtagttt

SEQ ID NO: 7594142 - DNA, 22 bp, Homo sapiens
ggcagccagcgggtggacgcgc

SEQ ID NO: 7594143 - DNA, 22 bp, Homo sapiens
ggcagccagcgggtggacgcgc

SEQ ID NO: 7594144 - DNA, 22 bp, Homo sapiens
ggcagccagcgggtggacgcgc

SEQ ID NO: 7594145 - DNA, 22 bp, Homo sapiens
ggcagccagcacgcagttgatg

SEQ ID NO: 7594146 - DNA, 22 bp, Homo sapiens
ggcagccagcaatgagaagttt

SEQ ID NO: 7594147 - DNA, 22 bp, Homo sapiens
ggcagccagcacgcagttgatg

SEQ ID NO: 7594148 - DNA, 22 bp, Homo sapiens
ggcagcagtccatggcccaagg

SEQ ID NO: 7594149 - DNA, 22 bp, Homo sapiens
ggcagcagtccatggcccaagg

SEQ ID NO: 7594150 - DNA, 22 bp, Homo sapiens
ggcagcagtggctgctattgtc

SEQ ID NO: 7594151 - DNA, 22 bp, Homo sapiens
ggcagccagcaatgagaagttt

SEQ ID NO: 7594152 - DNA, 22 bp, Homo sapiens
ggcagccagagggcagctggat

SEQ ID NO: 7594153 - DNA, 22 bp, Homo sapiens
ggcagccagagggcagctggat

SEQ ID NO: 7594154 - DNA, 22 bp, Homo sapiens
ggcagccagcaatgagaagttt

SEQ ID NO: 7594155 - DNA, 22 bp, Homo sapiens
ggcagccagcaatgagaagttt

SEQ ID NO: 7594156 - DNA, 22 bp, Homo sapiens
ggcagccagcaatgagaagttt

SEQ ID NO: 7594157 - DNA, 21 bp, Homo sapiens
ggcagctgtggttaattgaac

SEQ ID NO: 7594158 - DNA, 21 bp, Homo sapiens
ggcagctgtggttaattgaac

SEQ ID NO: 7594159 - DNA, 22 bp, Homo sapiens
ggcagctgtggacgtcgtcatt

SEQ ID NO: 7594160 - DNA, 22 bp, Homo sapiens
ggcagctgtggacgtcgtcatt

SEQ ID NO: 7594161 - DNA, 22 bp, Homo sapiens
ggcagctgtggacgtcgtcatt

SEQ ID NO: 7594162 - DNA, 22 bp, Homo sapiens
ggcagctgtggacgtcgtcatt

SEQ ID NO: 7594163 - DNA, 22 bp, Homo sapiens
ggcagccatggacactggctag

SEQ ID NO: 7594164 - DNA, 22 bp, Homo sapiens
ggcagctgtgaagtgcctcaca

SEQ ID NO: 7594165 - DNA, 22 bp, Homo sapiens
ggcagctgtggacgtcgtcatt

SEQ ID NO: 7594166 - DNA, 22 bp, Homo sapiens
ggcagctgtggacgtcgtcatt

SEQ ID NO: 7594167 - DNA, 17 bp, Homo sapiens
ggcagctgtgtgcatgc

SEQ ID NO: 7594168 - DNA, 17 bp, Homo sapiens
ggcagctgtgtgcatgc

SEQ ID NO: 7594169 - DNA, 17 bp, Homo sapiens
ggcagctgtgtgcatgc

SEQ ID NO: 7594170 - DNA, 17 bp, Homo sapiens
ggcagctgtgtgcatgc

SEQ ID NO: 7594171 - DNA, 17 bp, Homo sapiens
ggcagctgtgtgcatgc

SEQ ID NO: 7594172 - DNA, 21 bp, Homo sapiens
ggcagctgtggttaattgaac

SEQ ID NO: 7594173 - DNA, 17 bp, Homo sapiens
ggcagctgtgtgcatgc

SEQ ID NO: 7594174 - DNA, 17 bp, Homo sapiens
ggcagctgtgtgcatgc

SEQ ID NO: 7594175 - DNA, 17 bp, Homo sapiens
ggcagctgtgtgcatgc

SEQ ID NO: 7594176 - DNA, 17 bp, Homo sapiens
ggcagctgtgtgcatgc

SEQ ID NO: 7594177 - DNA, 22 bp, Homo sapiens
ggcagctgtttgtcctcctgtt

SEQ ID NO: 7594178 - DNA, 22 bp, Homo sapiens
ggcagctgtttgtcctcctgtt

SEQ ID NO: 7594179 - DNA, 22 bp, Homo sapiens
ggcagctgtttgtcctcctgtt

SEQ ID NO: 7594180 - DNA, 22 bp, Homo sapiens
ggcagctgtttgtcctcctgtt

SEQ ID NO: 7594181 - DNA, 22 bp, Homo sapiens
ggcagctgtttgtcctcctgtt

SEQ ID NO: 7594182 - DNA, 22 bp, Homo sapiens
ggcagctgttggctctctagga

SEQ ID NO: 7594183 - DNA, 22 bp, Homo sapiens
ggcagctgtttgtcctcctgtt

SEQ ID NO: 7594184 - DNA, 22 bp, Homo sapiens
ggcagctgtttgtcctcctgtt

SEQ ID NO: 7594185 - DNA, 22 bp, Homo sapiens
ggcagctgttggctctctagga

SEQ ID NO: 7594186 - DNA, 22 bp, Homo sapiens
ggcagctgttggctctctagga

SEQ ID NO: 7594187 - DNA, 22 bp, Homo sapiens
ggcagctgttggctctctagga

SEQ ID NO: 7594188 - DNA, 22 bp, Homo sapiens
ggcagctgttggctctctagga

SEQ ID NO: 7594189 - DNA, 22 bp, Homo sapiens
ggcagctgttggctctctagga

SEQ ID NO: 7594190 - DNA, 17 bp, Homo sapiens
ggcagctgtgtgcatgc

SEQ ID NO: 7594191 - DNA, 22 bp, Homo sapiens
ggcagctgttggctctctagga

SEQ ID NO: 7594192 - DNA, 22 bp, Homo sapiens
ggcagctgttggctctctagga

SEQ ID NO: 7594193 - DNA, 22 bp, Homo sapiens
ggcagctgttggctctctagga

SEQ ID NO: 7594194 - DNA, 22 bp, Homo sapiens
ggcagctgttggctctctagga

SEQ ID NO: 7594195 - DNA, 22 bp, Homo sapiens
ggcagctgttggctctctagga

SEQ ID NO: 7594196 - DNA, 22 bp, Homo sapiens
ggcagctttggattcgcggctg

SEQ ID NO: 7594197 - DNA, 22 bp, Homo sapiens
ggcagctttgccctcactgtcc

SEQ ID NO: 7594198 - DNA, 22 bp, Homo sapiens
ggcagctttgccctcactgtcc

SEQ ID NO: 7594199 - DNA, 22 bp, Homo sapiens
ggcagctttggattcgcggctg

SEQ ID NO: 7594200 - DNA, 22 bp, Homo sapiens
ggcaggagaatggcgtgaactc

SEQ ID NO: 7594201 - DNA, 22 bp, Homo sapiens
ggcaggagaatggcgtgaactc

SEQ ID NO: 7594202 - DNA, 22 bp, Homo sapiens
ggcagctttgagtcttagagta

SEQ ID NO: 7594203 - DNA, 22 bp, Homo sapiens
ggcagctttctcacccatgacc

SEQ ID NO: 7594204 - DNA, 22 bp, Homo sapiens
ggcagctttcacctgtcttcct

SEQ ID NO: 7594205 - DNA, 22 bp, Homo sapiens
ggcagctttcacctgtcttcct

SEQ ID NO: 7594206 - DNA, 22 bp, Homo sapiens
ggcagctttccttatcctaggg

SEQ ID NO: 7594207 - DNA, 22 bp, Homo sapiens
ggcagctttcaatagggttatg

SEQ ID NO: 7594208 - DNA, 23 bp, Homo sapiens
ggcagcttgttcctttgcttcca

SEQ ID NO: 7594209 - DNA, 22 bp, Homo sapiens
ggcagctttcaatagggttatg

SEQ ID NO: 7594210 - DNA, 23 bp, Homo sapiens
ggcagcttgttcctttgcttcca

SEQ ID NO: 7594211 - DNA, 23 bp, Homo sapiens
ggcagcttgttcctttgcttcca

SEQ ID NO: 7594212 - DNA, 22 bp, Homo sapiens
ggcagcttgtccttcaggagag

SEQ ID NO: 7594213 - DNA, 22 bp, Homo sapiens
ggcagcttgtccttcaggagag

SEQ ID NO: 7594214 - DNA, 22 bp, Homo sapiens
ggcagcttggttgcagaccatc

SEQ ID NO: 7594215 - DNA, 20 bp, Homo sapiens
ggcagcttgggcagcagtta

SEQ ID NO: 7594216 - DNA, 19 bp, Homo sapiens
ggcagcttgggaaggtagc

SEQ ID NO: 7594217 - DNA, 22 bp, Homo sapiens
ggcagcttgtcctggaggatgg

SEQ ID NO: 7594218 - DNA, 22 bp, Homo sapiens
ggcagcttgtccttcaggagag

SEQ ID NO: 7594219 - DNA, 22 bp, Homo sapiens
ggcagcttgtccttcaggagag

SEQ ID NO: 7594220 - DNA, 22 bp, Homo sapiens
ggcagcttgtccttcaggagag

SEQ ID NO: 7594221 - DNA, 22 bp, Homo sapiens
ggcagcttgtccttcaggagag

SEQ ID NO: 7594222 - DNA, 18 bp, Homo sapiens
ggcagcttgactagcaac

SEQ ID NO: 7594223 - DNA, 22 bp, Homo sapiens
ggcagcttgccctggtctcaac

SEQ ID NO: 7594224 - DNA, 22 bp, Homo sapiens
ggcagcttgccctggtctcaac

SEQ ID NO: 7594225 - DNA, 22 bp, Homo sapiens
ggcagcttcttaatatggagac

SEQ ID NO: 7594226 - DNA, 22 bp, Homo sapiens
ggcagcttcttaatatggagac

SEQ ID NO: 7594227 - DNA, 22 bp, Homo sapiens
ggcagcttctcccaggctgttt

SEQ ID NO: 7594228 - DNA, 22 bp, Homo sapiens
ggcagcttctcccaggctgttt

SEQ ID NO: 7594229 - DNA, 22 bp, Homo sapiens
ggcagcttcggacggcttataa

SEQ ID NO: 7594230 - DNA, 22 bp, Homo sapiens
ggcagcttcctgagccagcagc

SEQ ID NO: 7594231 - DNA, 22 bp, Homo sapiens
ggcagcttcggacggcttataa

SEQ ID NO: 7594232 - DNA, 23 bp, Homo sapiens
ggcagcttatactttcatagaca

SEQ ID NO: 7594233 - DNA, 22 bp, Homo sapiens
ggcagcttcctaggagagggca

SEQ ID NO: 7594234 - DNA, 22 bp, Homo sapiens
ggcagcttcctaggagagggca

SEQ ID NO: 7594235 - DNA, 23 bp, Homo sapiens
ggcagcttacttggtctctttca

SEQ ID NO: 7594236 - DNA, 23 bp, Homo sapiens
ggcagcttatactttcatagaca

SEQ ID NO: 7594237 - DNA, 22 bp, Homo sapiens
ggcagcttacgttttgctagtg

SEQ ID NO: 7594238 - DNA, 23 bp, Homo sapiens
ggcagcttacttggtctctttca

SEQ ID NO: 7594239 - DNA, 22 bp, Homo sapiens
ggcagctgtttgtcctcctgtt

SEQ ID NO: 7594240 - DNA, 22 bp, Homo sapiens
gggaggtgatggcaagcagcgg

SEQ ID NO: 7594241 - DNA, 22 bp, Homo sapiens
gggaggtgattaggaccatgta

SEQ ID NO: 7594242 - DNA, 22 bp, Homo sapiens
gggaggtgattaggaccatgta

SEQ ID NO: 7594243 - DNA, 22 bp, Homo sapiens
gggaggtgattaggaccatgta

SEQ ID NO: 7594244 - DNA, 22 bp, Homo sapiens
gggaggtgattaggaccatgta

SEQ ID NO: 7594245 - DNA, 22 bp, Homo sapiens
gggagggccaggctcacccagg

SEQ ID NO: 7594246 - DNA, 22 bp, Homo sapiens
gggagggccaggctcacccagg

SEQ ID NO: 7594247 - DNA, 22 bp, Homo sapiens
gggagggccaggctcacccagg

SEQ ID NO: 7594248 - DNA, 22 bp, Homo sapiens
gggaggtgatggcaagcagcgg

SEQ ID NO: 7594249 - DNA, 22 bp, Homo sapiens
gggaggtgatggcaagcagcgg

SEQ ID NO: 7594250 - DNA, 22 bp, Homo sapiens
gggaggtgatggcaagcagcgg

SEQ ID NO: 7594251 - DNA, 22 bp, Homo sapiens
gggaggtgatggcaagcagcgg

SEQ ID NO: 7594252 - DNA, 21 bp, Homo sapiens
gggagggatggaaatgatgtt

SEQ ID NO: 7594253 - DNA, 21 bp, Homo sapiens
gggagggatggaaatgatgtt

SEQ ID NO: 7594254 - DNA, 21 bp, Homo sapiens
gggagggatggaaatgatgtt

SEQ ID NO: 7594255 - DNA, 21 bp, Homo sapiens
gggagggatggaaatgatgtt

SEQ ID NO: 7594256 - DNA, 21 bp, Homo sapiens
gggagggatggaaatgatgtt

SEQ ID NO: 7594257 - DNA, 22 bp, Homo sapiens
gggagggatctgctaggcaatg

SEQ ID NO: 7594258 - DNA, 21 bp, Homo sapiens
gggagggatggaaatgatgtt

SEQ ID NO: 7594259 - DNA, 21 bp, Homo sapiens
gggagggatggaaatgatgtt

SEQ ID NO: 7594260 - DNA, 22 bp, Homo sapiens
gggagggattagttctgcctgg

SEQ ID NO: 7594261 - DNA, 22 bp, Homo sapiens
gggagggattagttctgcctgg

SEQ ID NO: 7594262 - DNA, 21 bp, Homo sapiens
gggagggatggaaatgatgtt

SEQ ID NO: 7594263 - DNA, 21 bp, Homo sapiens
gggagggatggaaatgatgtt

SEQ ID NO: 7594264 - DNA, 21 bp, Homo sapiens
gggagggatggaaatgatgtt

SEQ ID NO: 7594265 - DNA, 22 bp, Homo sapiens
gggagggattagttctgcctgg

SEQ ID NO: 7594266 - DNA, 22 bp, Homo sapiens
gggagggattagttctgcctgg

SEQ ID NO: 7594267 - DNA, 22 bp, Homo sapiens
gggagggattagttctgcctgg

SEQ ID NO: 7594268 - DNA, 22 bp, Homo sapiens
gggaggtgttccagtgttggta

SEQ ID NO: 7594269 - DNA, 22 bp, Homo sapiens
gggaggtgttccagtgttggta

SEQ ID NO: 7594270 - DNA, 22 bp, Homo sapiens
gggaggtgttccagtgttggta

SEQ ID NO: 7594271 - DNA, 22 bp, Homo sapiens
gggaggtgttccagtgttggta

SEQ ID NO: 7594272 - DNA, 22 bp, Homo sapiens
gggaggtgttccagtgttggta

SEQ ID NO: 7594273 - DNA, 22 bp, Homo sapiens
gggaggtgattaggaccatgta

SEQ ID NO: 7594274 - DNA, 22 bp, Homo sapiens
gggaggtgattaggaccatgta

SEQ ID NO: 7594275 - DNA, 22 bp, Homo sapiens
gggaggtgattaggaccatgta

SEQ ID NO: 7594276 - DNA, 22 bp, Homo sapiens
gggaggtgattaggaccatgta

SEQ ID NO: 7594277 - DNA, 22 bp, Homo sapiens
gggaggtgttctgccaacgcgg

SEQ ID NO: 7594278 - DNA, 22 bp, Homo sapiens
gggaggtgttctgccaacgcgg

SEQ ID NO: 7594279 - DNA, 22 bp, Homo sapiens
gggaggtgttctgccaacgcgg

SEQ ID NO: 7594280 - DNA, 22 bp, Homo sapiens
gggaggtgttccagtgttggta

SEQ ID NO: 7594281 - DNA, 22 bp, Homo sapiens
gggaggtgttccagtgttggta

SEQ ID NO: 7594282 - DNA, 22 bp, Homo sapiens
gggaggtgttccagtgttggta

SEQ ID NO: 7594283 - DNA, 22 bp, Homo sapiens
gggaggttctgttcgcacttga

SEQ ID NO: 7594284 - DNA, 22 bp, Homo sapiens
gggaggttctgttcgcacttga

SEQ ID NO: 7594285 - DNA, 22 bp, Homo sapiens
gggaggttgaggctgcagtgag

SEQ ID NO: 7594286 - DNA, 22 bp, Homo sapiens
gggaggttgaggctgcagtgag

SEQ ID NO: 7594287 - DNA, 22 bp, Homo sapiens
gggcacagtactccaatcaact

SEQ ID NO: 7594288 - DNA, 22 bp, Homo sapiens
gggcacagtactccaatcaact

SEQ ID NO: 7594289 - DNA, 22 bp, Homo sapiens
gggcacaggagaaggatctggc

SEQ ID NO: 7594290 - DNA, 22 bp, Homo sapiens
gggcacaggagaaggatctggc

SEQ ID NO: 7594291 - DNA, 22 bp, Homo sapiens
gggcacaggagaaggatctggc

SEQ ID NO: 7594292 - DNA, 22 bp, Homo sapiens
gggcacaggagaaggatctggc

SEQ ID NO: 7594293 - DNA, 22 bp, Homo sapiens
gggcacaggagaaggatctggc

SEQ ID NO: 7594294 - DNA, 22 bp, Homo sapiens
gggcacaggagaaggatctggc

SEQ ID NO: 7594295 - DNA, 22 bp, Homo sapiens
gggcacaggagaaggatctggc

SEQ ID NO: 7594296 - DNA, 22 bp, Homo sapiens
gggcacaggagaaggatctggc

SEQ ID NO: 7594297 - DNA, 22 bp, Homo sapiens
gggcacaggagaaggatctggc

SEQ ID NO: 7594298 - DNA, 22 bp, Homo sapiens
gggagggaggtgctggttcacg

SEQ ID NO: 7594299 - DNA, 22 bp, Homo sapiens
gggagggaggtgctggttcacg

SEQ ID NO: 7594300 - DNA, 22 bp, Homo sapiens
gggagggaggtgctggttcacg

SEQ ID NO: 7594301 - DNA, 22 bp, Homo sapiens
gggagggaggtgatgcttggct

SEQ ID NO: 7594302 - DNA, 22 bp, Homo sapiens
gggagggaggtgatgcttggct

SEQ ID NO: 7594303 - DNA, 22 bp, Homo sapiens
gggagggaggtgatgcttggct

SEQ ID NO: 7594304 - DNA, 22 bp, Homo sapiens
gggagggaggtgatgcttggct

SEQ ID NO: 7594305 - DNA, 22 bp, Homo sapiens
gggagggaggtgatgcttggct

SEQ ID NO: 7594306 - DNA, 22 bp, Homo sapiens
gggagggaggtgatgcttggct

SEQ ID NO: 7594307 - DNA, 22 bp, Homo sapiens
gggagggaggtgatgcttggct

SEQ ID NO: 7594308 - DNA, 22 bp, Homo sapiens
gggagggaggtgatgcttggct

SEQ ID NO: 7594309 - DNA, 22 bp, Homo sapiens
gggagggaggtgatgcttggct

SEQ ID NO: 7594310 - DNA, 22 bp, Homo sapiens
gggagggaggtgatgcttggct

SEQ ID NO: 7594311 - DNA, 22 bp, Homo sapiens
gggagggagaggacagttctat

SEQ ID NO: 7594312 - DNA, 22 bp, Homo sapiens
gggagggagaggacagttctat

SEQ ID NO: 7594313 - DNA, 22 bp, Homo sapiens
gggagggagaggacagttctat

SEQ ID NO: 7594314 - DNA, 22 bp, Homo sapiens
gggagggatctgctaggcaatg

SEQ ID NO: 7594315 - DNA, 22 bp, Homo sapiens
gggagggatctgctaggcaatg

SEQ ID NO: 7594316 - DNA, 22 bp, Homo sapiens
gggagggatctgctaggcaatg

SEQ ID NO: 7594317 - DNA, 22 bp, Homo sapiens
gggagggatctgctaggcaatg

SEQ ID NO: 7594318 - DNA, 22 bp, Homo sapiens
gggagggatctgctaggcaatg

SEQ ID NO: 7594319 - DNA, 22 bp, Homo sapiens
gggagggatctgctaggcaatg

SEQ ID NO: 7594320 - DNA, 22 bp, Homo sapiens
gggagggaggtgctggttcacg

SEQ ID NO: 7594321 - DNA, 22 bp, Homo sapiens
gggagggatctgctaggcaatg

SEQ ID NO: 7594322 - DNA, 22 bp, Homo sapiens
gggagggatctgctaggcaatg

SEQ ID NO: 7594323 - DNA, 22 bp, Homo sapiens
gggagggatctgctaggcaatg

SEQ ID NO: 7594324 - DNA, 16 bp, Homo sapiens
gggagggagttggtgg

SEQ ID NO: 7594325 - DNA, 16 bp, Homo sapiens
gggagggagttggtgg

SEQ ID NO: 7594326 - DNA, 16 bp, Homo sapiens
gggagggagttggtgg

SEQ ID NO: 7594327 - DNA, 22 bp, Homo sapiens
gggagggaggtgctggttcacg

SEQ ID NO: 7594328 - DNA, 22 bp, Homo sapiens
gggagggaggtgctggttcacg

SEQ ID NO: 7594329 - DNA, 22 bp, Homo sapiens
gggagggaggtgctggttcacg

SEQ ID NO: 7594330 - DNA, 22 bp, Homo sapiens
gggagggaggtgctggttcacg

SEQ ID NO: 7594331 - DNA, 22 bp, Homo sapiens
gggagctggatgattgaggcaa

SEQ ID NO: 7594332 - DNA, 22 bp, Homo sapiens
gggagctggatgattgaggcaa

SEQ ID NO: 7594333 - DNA, 22 bp, Homo sapiens
gggagctggcctactattagat

SEQ ID NO: 7594334 - DNA, 22 bp, Homo sapiens
gggagctggcctactattagat

SEQ ID NO: 7594335 - DNA, 22 bp, Homo sapiens
gggagctggcggattccccagg

SEQ ID NO: 7594336 - DNA, 22 bp, Homo sapiens
gggagctggcggattccccagg

SEQ ID NO: 7594337 - DNA, 22 bp, Homo sapiens
gggagctggcggattccccagg

SEQ ID NO: 7594338 - DNA, 22 bp, Homo sapiens
gggagggagaggacagttctat

SEQ ID NO: 7594339 - DNA, 22 bp, Homo sapiens
gggagggagaggacagttctat

SEQ ID NO: 7594340 - DNA, 22 bp, Homo sapiens
gggagggagaggacagttctat

SEQ ID NO: 7594341 - DNA, 22 bp, Homo sapiens
gggagggacacaaagagttccc

SEQ ID NO: 7594342 - DNA, 22 bp, Homo sapiens
gggagggagaggacagttctat

SEQ ID NO: 7594343 - DNA, 22 bp, Homo sapiens
gggagggagaggacagttctat

SEQ ID NO: 7594344 - DNA, 22 bp, Homo sapiens
gggagggacacaaagagttccc

SEQ ID NO: 7594345 - DNA, 22 bp, Homo sapiens
gggagggacacaaagagttccc

SEQ ID NO: 7594346 - DNA, 22 bp, Homo sapiens
gggagggacacaaagagttccc

SEQ ID NO: 7594347 - DNA, 22 bp, Homo sapiens
gggagggacacaaagagttccc

SEQ ID NO: 7594348 - DNA, 22 bp, Homo sapiens
gggagggacacaaagagttccc

SEQ ID NO: 7594349 - DNA, 22 bp, Homo sapiens
gggagggacacaaagagttccc

SEQ ID NO: 7594350 - DNA, 22 bp, Homo sapiens
gggagggacacaaagagttccc

SEQ ID NO: 7594351 - DNA, 22 bp, Homo sapiens
gggagctggagctggaagactc

SEQ ID NO: 7594352 - DNA, 22 bp, Homo sapiens
gggagctggagctggaagactc

SEQ ID NO: 7594353 - DNA, 22 bp, Homo sapiens
gggagctggagttgtgttgcct

SEQ ID NO: 7594354 - DNA, 22 bp, Homo sapiens
gggagctggatcgcgcgcccgg

SEQ ID NO: 7594355 - DNA, 22 bp, Homo sapiens
gggagctggatcgcgcgcccgg

SEQ ID NO: 7594356 - DNA, 22 bp, Homo sapiens
gggagctggagttgtgttgcct

SEQ ID NO: 7594357 - DNA, 22 bp, Homo sapiens
gggagctggagttgtgttgcct

SEQ ID NO: 7594358 - DNA, 22 bp, Homo sapiens
gggagctggatgattgaggcaa

SEQ ID NO: 7594359 - DNA, 22 bp, Homo sapiens
gggagctggatcgcgcgcccgg

SEQ ID NO: 7594360 - DNA, 22 bp, Homo sapiens
gggagctggatcgcgcgcccgg

SEQ ID NO: 7594361 - DNA, 23 bp, Homo sapiens
gggcaggtttttataggcttcag

SEQ ID NO: 7594362 - DNA, 23 bp, Homo sapiens
gggcaggtttttataggcttcag

SEQ ID NO: 7594363 - DNA, 18 bp, Homo sapiens
gggcagtaagtgtggggt

SEQ ID NO: 7594364 - DNA, 18 bp, Homo sapiens
gggcagtaagtgtggggt

SEQ ID NO: 7594365 - DNA, 23 bp, Homo sapiens
gggcaggtttttataggcttcag

SEQ ID NO: 7594366 - DNA, 23 bp, Homo sapiens
gggcaggtttttataggcttcag

SEQ ID NO: 7594367 - DNA, 23 bp, Homo sapiens
gggcaggtttttataggcttcag

SEQ ID NO: 7594368 - DNA, 22 bp, Homo sapiens
gggcaggttggcatcccgggca

SEQ ID NO: 7594369 - DNA, 23 bp, Homo sapiens
gggcaggtttttataggcttcag

SEQ ID NO: 7594370 - DNA, 22 bp, Homo sapiens
gggcaggttggcatcccgggca

SEQ ID NO: 7594371 - DNA, 22 bp, Homo sapiens
gggcaggttattggagtaggga

SEQ ID NO: 7594372 - DNA, 22 bp, Homo sapiens
gggcaggttattggagtaggga

SEQ ID NO: 7594373 - DNA, 22 bp, Homo sapiens
gggcaggttattggagtaggga

SEQ ID NO: 7594374 - DNA, 22 bp, Homo sapiens
gggcaggttattggagtaggga

SEQ ID NO: 7594375 - DNA, 22 bp, Homo sapiens
gggcactggcgttttgttaaac

SEQ ID NO: 7594376 - DNA, 18 bp, Homo sapiens
gggcactggggactggag

SEQ ID NO: 7594377 - DNA, 18 bp, Homo sapiens
gggcactggggactggag

SEQ ID NO: 7594378 - DNA, 18 bp, Homo sapiens
gggcactggggactggag

SEQ ID NO: 7594379 - DNA, 18 bp, Homo sapiens
gggcactggggactggag

SEQ ID NO: 7594380 - DNA, 22 bp, Homo sapiens
gggcactggcgttttgttaaac

SEQ ID NO: 7594381 - DNA, 22 bp, Homo sapiens
gggcactggccgcccatccctg

SEQ ID NO: 7594382 - DNA, 22 bp, Homo sapiens
gggcactggccgcccatccctg

SEQ ID NO: 7594383 - DNA, 18 bp, Homo sapiens
gggcactggggactggag

SEQ ID NO: 7594384 - DNA, 22 bp, Homo sapiens
gggcaggttattggagtaggga

SEQ ID NO: 7594385 - DNA, 22 bp, Homo sapiens
gggcactgggtcttctccacgc

SEQ ID NO: 7594386 - DNA, 22 bp, Homo sapiens
gggcaggttattggagtaggga

SEQ ID NO: 7594387 - DNA, 22 bp, Homo sapiens
gggcaggttattggagtaggga

SEQ ID NO: 7594388 - DNA, 22 bp, Homo sapiens
gggcaggttattggagtaggga

SEQ ID NO: 7594389 - DNA, 22 bp, Homo sapiens
gggcaggttattggagtaggga

SEQ ID NO: 7594390 - DNA, 22 bp, Homo sapiens
gggcagtgaatattggtgggaa

SEQ ID NO: 7594391 - DNA, 22 bp, Homo sapiens
gggcagtgaatattggtgggaa

SEQ ID NO: 7594392 - DNA, 22 bp, Homo sapiens
gggcagtgaatattggtgggaa

SEQ ID NO: 7594393 - DNA, 22 bp, Homo sapiens
gggcagtgaatattggtgggaa

SEQ ID NO: 7594394 - DNA, 21 bp, Homo sapiens
gggcagtctggtggctatggc

SEQ ID NO: 7594395 - DNA, 22 bp, Homo sapiens
gggcagtgaatattggtgggaa

SEQ ID NO: 7594396 - DNA, 22 bp, Homo sapiens
gggcagtgaatattggtgggaa

SEQ ID NO: 7594397 - DNA, 22 bp, Homo sapiens
gggcagtgaatattggtgggaa

SEQ ID NO: 7594398 - DNA, 22 bp, Homo sapiens
gggcagtgacaaaggggatgaa

SEQ ID NO: 7594399 - DNA, 22 bp, Homo sapiens
gggcagtgacaaaggggatgaa

SEQ ID NO: 7594400 - DNA, 21 bp, Homo sapiens
gggcagtctggtggctatggc

SEQ ID NO: 7594401 - DNA, 21 bp, Homo sapiens
gggcagtctggtggctatggc

SEQ ID NO: 7594402 - DNA, 22 bp, Homo sapiens
gggcagtgaatattggtgggaa

SEQ ID NO: 7594403 - DNA, 22 bp, Homo sapiens
gggcagtgaatattggtgggaa

SEQ ID NO: 7594404 - DNA, 22 bp, Homo sapiens
gggcagtcacagtgctggagca

SEQ ID NO: 7594405 - DNA, 22 bp, Homo sapiens
gggcagtagcttcgtaggcatc

SEQ ID NO: 7594406 - DNA, 22 bp, Homo sapiens
gggcagtcacagtgctggagca

SEQ ID NO: 7594407 - DNA, 22 bp, Homo sapiens
gggcagtcacagtgctggagca

SEQ ID NO: 7594408 - DNA, 22 bp, Homo sapiens
gggcagtgttgtggttctctat

SEQ ID NO: 7594409 - DNA, 22 bp, Homo sapiens
gggcagtgttgtggttctctat

SEQ ID NO: 7594410 - DNA, 19 bp, Homo sapiens
gggcagtggcactagggag

SEQ ID NO: 7594411 - DNA, 19 bp, Homo sapiens
gggcagtggcactagggag

SEQ ID NO: 7594412 - DNA, 19 bp, Homo sapiens
gggcagtggcactagggag

SEQ ID NO: 7594413 - DNA, 19 bp, Homo sapiens
gggcagtggcactagggag

SEQ ID NO: 7594414 - DNA, 19 bp, Homo sapiens
gggcagtggcactagggag

SEQ ID NO: 7594415 - DNA, 19 bp, Homo sapiens
gggcagtggcactagggag

SEQ ID NO: 7594416 - DNA, 22 bp, Homo sapiens
gggcagtgacaaaggggatgaa

SEQ ID NO: 7594417 - DNA, 22 bp, Homo sapiens
gggcagtgacaaaggggatgaa

SEQ ID NO: 7594418 - DNA, 22 bp, Homo sapiens
gggcagtgattttccttagagg

SEQ ID NO: 7594419 - DNA, 22 bp, Homo sapiens
gggcagtgattttccttagagg

SEQ ID NO: 7594420 - DNA, 22 bp, Homo sapiens
gggcagtgattttccttagagg

SEQ ID NO: 7594421 - DNA, 22 bp, Homo sapiens
gggcagtgacaaaggggatgaa

SEQ ID NO: 7594422 - DNA, 22 bp, Homo sapiens
gggcagtgacaaaggggatgaa

SEQ ID NO: 7594423 - DNA, 22 bp, Homo sapiens
gggcagtgacaaaggggatgaa

SEQ ID NO: 7594424 - DNA, 22 bp, Homo sapiens
gggcagtgacaaaggggatgaa

SEQ ID NO: 7594425 - DNA, 22 bp, Homo sapiens
gggcagtgacaaaggggatgaa

SEQ ID NO: 7594426 - DNA, 22 bp, Homo sapiens
gggcagtgacaaaggggatgaa

SEQ ID NO: 7594427 - DNA, 22 bp, Homo sapiens
gggcactggaggccaaggagct

SEQ ID NO: 7594428 - DNA, 22 bp, Homo sapiens
gggcactggaggccaaggagct

SEQ ID NO: 7594429 - DNA, 22 bp, Homo sapiens
gggcactggaggccaaggagct

SEQ ID NO: 7594430 - DNA, 22 bp, Homo sapiens
gggcactggaaggctctcaggc

SEQ ID NO: 7594431 - DNA, 22 bp, Homo sapiens
gggcactggaggccaaggagct

SEQ ID NO: 7594432 - DNA, 22 bp, Homo sapiens
gggcactggaggccaaggagct

SEQ ID NO: 7594433 - DNA, 22 bp, Homo sapiens
gggcactggcaccaaagacttg

SEQ ID NO: 7594434 - DNA, 22 bp, Homo sapiens
gggcactggaggccaaggagct

SEQ ID NO: 7594435 - DNA, 22 bp, Homo sapiens
gggcactggcagtcggggacgc

SEQ ID NO: 7594436 - DNA, 22 bp, Homo sapiens
gggcactggcaccaaagacttg

SEQ ID NO: 7594437 - DNA, 22 bp, Homo sapiens
gggcactggcagtcggggacgc

SEQ ID NO: 7594438 - DNA, 22 bp, Homo sapiens
gggcactggaaggctctcaggc

SEQ ID NO: 7594439 - DNA, 22 bp, Homo sapiens
gggcactggaaggctctcaggc

SEQ ID NO: 7594440 - DNA, 22 bp, Homo sapiens
gggcactggaaggctctcaggc

SEQ ID NO: 7594441 - DNA, 22 bp, Homo sapiens
gggcactggaaggctctcaggc

SEQ ID NO: 7594442 - DNA, 22 bp, Homo sapiens
gggcactgctttgctctgtcac

SEQ ID NO: 7594443 - DNA, 22 bp, Homo sapiens
gggcactggaaggctctcaggc

SEQ ID NO: 7594444 - DNA, 22 bp, Homo sapiens
gggcactgctttgctctgtcac

SEQ ID NO: 7594445 - DNA, 22 bp, Homo sapiens
gggcactgacagggtcccaact

SEQ ID NO: 7594446 - DNA, 22 bp, Homo sapiens
gggcactgaatgccaagctagg

SEQ ID NO: 7594447 - DNA, 22 bp, Homo sapiens
gggcactgacagggtcccaact

SEQ ID NO: 7594448 - DNA, 22 bp, Homo sapiens
gggcactgaatgccaagctagg

SEQ ID NO: 7594449 - DNA, 22 bp, Homo sapiens
gggcactgagaattttccactt

SEQ ID NO: 7594450 - DNA, 22 bp, Homo sapiens
gggcactgagggcccacaggat

SEQ ID NO: 7594451 - DNA, 22 bp, Homo sapiens
gggcactgagggcccacaggat

SEQ ID NO: 7594452 - DNA, 22 bp, Homo sapiens
gggcactgagggcccacaggat

SEQ ID NO: 7594453 - DNA, 22 bp, Homo sapiens
gggcactgagaattttccactt

SEQ ID NO: 7594454 - DNA, 22 bp, Homo sapiens
gggcactgagtggatgatgcag

SEQ ID NO: 7594455 - DNA, 22 bp, Homo sapiens
gggcactgagtggatgatgcag

SEQ ID NO: 7594456 - DNA, 22 bp, Homo sapiens
gggcactgagtggatgatgcag

SEQ ID NO: 7594457 - DNA, 22 bp, Homo sapiens
gggcactgagtggatgatgcag

SEQ ID NO: 7594458 - DNA, 22 bp, Homo sapiens
gggcactgctggaggctccctg

SEQ ID NO: 7594459 - DNA, 22 bp, Homo sapiens
gggcactgctggaggctccctg

SEQ ID NO: 7594460 - DNA, 22 bp, Homo sapiens
gggcactgctggaggctccctg

SEQ ID NO: 7594461 - DNA, 22 bp, Homo sapiens
gggcactgctggaggctccctg

SEQ ID NO: 7594462 - DNA, 22 bp, Homo sapiens
gggcactgctggaggctccctg

SEQ ID NO: 7594463 - DNA, 22 bp, Homo sapiens
gggcaccagcggccgcactgcc

SEQ ID NO: 7594464 - DNA, 22 bp, Homo sapiens
gggcacagtctgcagcccccca

SEQ ID NO: 7594465 - DNA, 22 bp, Homo sapiens
gggcaccagcggccgcactgcc

SEQ ID NO: 7594466 - DNA, 22 bp, Homo sapiens
gggcaccagcggccgcactgcc

SEQ ID NO: 7594467 - DNA, 23 bp, Homo sapiens
gggcaccaggagcaccggacagg

SEQ ID NO: 7594468 - DNA, 22 bp, Homo sapiens
gggcaccagcggccgcactgcc

SEQ ID NO: 7594469 - DNA, 23 bp, Homo sapiens
gggcaccaggagcaccggacagg

SEQ ID NO: 7594470 - DNA, 22 bp, Homo sapiens
gggcacagtctaaagttgggcc

SEQ ID NO: 7594471 - DNA, 22 bp, Homo sapiens
gggcacagtctaaagttgggcc

SEQ ID NO: 7594472 - DNA, 22 bp, Homo sapiens
gggcacagtctaaagttgggcc

SEQ ID NO: 7594473 - DNA, 22 bp, Homo sapiens
gggcacagtctaaagttgggcc

SEQ ID NO: 7594474 - DNA, 22 bp, Homo sapiens
gggcacagtctgcagcccccca

SEQ ID NO: 7594475 - DNA, 22 bp, Homo sapiens
gggcacagtctgcagcccccca

SEQ ID NO: 7594476 - DNA, 22 bp, Homo sapiens
gggcacagtctgcagcccccca

SEQ ID NO: 7594477 - DNA, 22 bp, Homo sapiens
gggcacagtctaaagttgggcc

SEQ ID NO: 7594478 - DNA, 22 bp, Homo sapiens
gggcactgaacaccctcttcgc

SEQ ID NO: 7594479 - DNA, 22 bp, Homo sapiens
gggcactgaatgccaagctagg

SEQ ID NO: 7594480 - DNA, 21 bp, Homo sapiens
gggcactgaaagggaatagca

SEQ ID NO: 7594481 - DNA, 21 bp, Homo sapiens
gggcactgaaagggaatagca

SEQ ID NO: 7594482 - DNA, 22 bp, Homo sapiens
gggcactgaacaccctcttcgc

SEQ ID NO: 7594483 - DNA, 22 bp, Homo sapiens
gggcactctgctcccagtgttt

SEQ ID NO: 7594484 - DNA, 22 bp, Homo sapiens
gggcactcctctggtccagccc

SEQ ID NO: 7594485 - DNA, 22 bp, Homo sapiens
gggcactcctgatcgggacttg

SEQ ID NO: 7594486 - DNA, 21 bp, Homo sapiens
gggcactgaaagggaatagca

SEQ ID NO: 7594487 - DNA, 22 bp, Homo sapiens
gggcactcctctggtccagccc

SEQ ID NO: 7594488 - DNA, 22 bp, Homo sapiens
gggcactctgctcccagtgttt

SEQ ID NO: 7594489 - DNA, 21 bp, Homo sapiens
gggcacccttagcctcctctg

SEQ ID NO: 7594490 - DNA, 21 bp, Homo sapiens
gggcacccttagcctcctctg

SEQ ID NO: 7594491 - DNA, 22 bp, Homo sapiens
gggcacctggctagtgacagtg

SEQ ID NO: 7594492 - DNA, 22 bp, Homo sapiens
gggcacctggctagtgacagtg

SEQ ID NO: 7594493 - DNA, 22 bp, Homo sapiens
gggcacctggctagtgacagtg

SEQ ID NO: 7594494 - DNA, 22 bp, Homo sapiens
gggcactcagctgtagagcagg

SEQ ID NO: 7594495 - DNA, 22 bp, Homo sapiens
gggcaccttgggtctcaggcaa

SEQ ID NO: 7594496 - DNA, 22 bp, Homo sapiens
gggcacctggctagtgacagtg

SEQ ID NO: 7594497 - DNA, 22 bp, Homo sapiens
gggcaccttgggtctcaggcaa

SEQ ID NO: 7594498 - DNA, 22 bp, Homo sapiens
gggcaccttgggtctcaggcaa

SEQ ID NO: 7594499 - DNA, 22 bp, Homo sapiens
gggcaccttgggtctcaggcaa

SEQ ID NO: 7594500 - DNA, 22 bp, Homo sapiens
gggaagtgatggagccaggatt

SEQ ID NO: 7594501 - DNA, 22 bp, Homo sapiens
gggaagtgccctcttcaggaga

SEQ ID NO: 7594502 - DNA, 22 bp, Homo sapiens
gggaagtgccctcttcaggaga

SEQ ID NO: 7594503 - DNA, 22 bp, Homo sapiens
gggaagtgccctcttcaggaga

SEQ ID NO: 7594504 - DNA, 17 bp, Homo sapiens
gggaagtggagaaagct

SEQ ID NO: 7594505 - DNA, 23 bp, Homo sapiens
gggaagtggggatttgaagtcat

SEQ ID NO: 7594506 - DNA, 23 bp, Homo sapiens
gggaagtggggatttgaagtcat

SEQ ID NO: 7594507 - DNA, 23 bp, Homo sapiens
gggaagtggggatttgaagtcat

SEQ ID NO: 7594508 - DNA, 17 bp, Homo sapiens
gggaagtggagaaagct

SEQ ID NO: 7594509 - DNA, 17 bp, Homo sapiens
gggaagtggagaaagct

SEQ ID NO: 7594510 - DNA, 17 bp, Homo sapiens
gggaagtggagaaagct

SEQ ID NO: 7594511 - DNA, 22 bp, Homo sapiens
gggaagtgtgcagagttctctt

SEQ ID NO: 7594512 - DNA, 22 bp, Homo sapiens
gggaagtgtggtttctttacag

SEQ ID NO: 7594513 - DNA, 22 bp, Homo sapiens
gggaagtgtggtttctttacag

SEQ ID NO: 7594514 - DNA, 22 bp, Homo sapiens
gggaagttctgatatttgcagg

SEQ ID NO: 7594515 - DNA, 22 bp, Homo sapiens
gggaagtttgtgggaggaatat

SEQ ID NO: 7594516 - DNA, 22 bp, Homo sapiens
gggaagtgtgcagagttctctt

SEQ ID NO: 7594517 - DNA, 22 bp, Homo sapiens
gggaagtgtgcagagttctctt

SEQ ID NO: 7594518 - DNA, 23 bp, Homo sapiens
gggaagtggggatttgaagtcat

SEQ ID NO: 7594519 - DNA, 23 bp, Homo sapiens
gggaagtggggatttgaagtcat

SEQ ID NO: 7594520 - DNA, 22 bp, Homo sapiens
gggaagtgtgcagagttctctt

SEQ ID NO: 7594521 - DNA, 22 bp, Homo sapiens
gggaagtgtgcagagttctctt

SEQ ID NO: 7594522 - DNA, 21 bp, Homo sapiens
gggaatgagattcttggagat

SEQ ID NO: 7594523 - DNA, 22 bp, Homo sapiens
gggaatgaggcagatagataaa

SEQ ID NO: 7594524 - DNA, 22 bp, Homo sapiens
gggaatgaggcagatagataaa

SEQ ID NO: 7594525 - DNA, 22 bp, Homo sapiens
gggaatgaggcagatagataaa

SEQ ID NO: 7594526 - DNA, 19 bp, Homo sapiens
gggaatgatggaagacttc

SEQ ID NO: 7594527 - DNA, 21 bp, Homo sapiens
gggagctgacagcagcacggc

SEQ ID NO: 7594528 - DNA, 21 bp, Homo sapiens
gggagctgacagcagcacggc

SEQ ID NO: 7594529 - DNA, 21 bp, Homo sapiens
gggagctgacagcagcacggc

SEQ ID NO: 7594530 - DNA, 21 bp, Homo sapiens
gggagctgacagcagcacggc

SEQ ID NO: 7594531 - DNA, 21 bp, Homo sapiens
gggagctgacagcagcacggc

SEQ ID NO: 7594532 - DNA, 21 bp, Homo sapiens
gggagctgacagcagcacggc

SEQ ID NO: 7594533 - DNA, 22 bp, Homo sapiens
gggaatgtaagatatatactag

SEQ ID NO: 7594534 - DNA, 22 bp, Homo sapiens
gggaatatggaagtggacactt

SEQ ID NO: 7594535 - DNA, 22 bp, Homo sapiens
gggaatatggaagtggacactt

SEQ ID NO: 7594536 - DNA, 22 bp, Homo sapiens
gggaatgaccttaataagtagg

SEQ ID NO: 7594537 - DNA, 22 bp, Homo sapiens
gggaatgaccttaataagtagg

SEQ ID NO: 7594538 - DNA, 22 bp, Homo sapiens
gggaataggacaaatgaaggag

SEQ ID NO: 7594539 - DNA, 22 bp, Homo sapiens
gggaataggacaaatgaaggag

SEQ ID NO: 7594540 - DNA, 22 bp, Homo sapiens
gggaagtttgtgggaggaatat

SEQ ID NO: 7594541 - DNA, 22 bp, Homo sapiens
gggaagtttgtgggaggaatat

SEQ ID NO: 7594542 - DNA, 22 bp, Homo sapiens
gggaatgagagtcagcccagga

SEQ ID NO: 7594543 - DNA, 21 bp, Homo sapiens
gggaatgagattcttggagat

SEQ ID NO: 7594544 - DNA, 22 bp, Homo sapiens
gggaatgagagtcagcccagga

SEQ ID NO: 7594545 - DNA, 22 bp, Homo sapiens
gggaatgaccttaataagtagg

SEQ ID NO: 7594546 - DNA, 22 bp, Homo sapiens
gggaatgaccttaataagtagg

SEQ ID NO: 7594547 - DNA, 22 bp, Homo sapiens
gggaagtgatggagccaggatt

SEQ ID NO: 7594548 - DNA, 22 bp, Homo sapiens
gggaagtgatggagccaggatt

SEQ ID NO: 7594549 - DNA, 22 bp, Homo sapiens
gggaagtgatggagccaggatt

SEQ ID NO: 7594550 - DNA, 22 bp, Homo sapiens
gggaagtgatggagccaggatt

SEQ ID NO: 7594551 - DNA, 22 bp, Homo sapiens
gggaagtgatggagccaggatt

SEQ ID NO: 7594552 - DNA, 22 bp, Homo sapiens
gggaagtgatggagccaggatt

SEQ ID NO: 7594553 - DNA, 22 bp, Homo sapiens
gggaagtgatggagccaggatt

SEQ ID NO: 7594554 - DNA, 23 bp, Homo sapiens
gggaagtgaggagcccctctgcc

SEQ ID NO: 7594555 - DNA, 23 bp, Homo sapiens
gggaagtgaggagcccctctgcc

SEQ ID NO: 7594556 - DNA, 23 bp, Homo sapiens
gggaagtgaggagcccctcagcc

SEQ ID NO: 7594557 - DNA, 22 bp, Homo sapiens
gggaagtgaggagcccctctgc

SEQ ID NO: 7594558 - DNA, 22 bp, Homo sapiens
gggaagtgaggagcccctctgc

SEQ ID NO: 7594559 - DNA, 23 bp, Homo sapiens
gggaagtgaggagcccctcagcc

SEQ ID NO: 7594560 - DNA, 23 bp, Homo sapiens
gggaagtgaggagcccctcagcc

SEQ ID NO: 7594561 - DNA, 22 bp, Homo sapiens
gggaagtgagctggaatcaagg

SEQ ID NO: 7594562 - DNA, 22 bp, Homo sapiens
gggaagtgaagtgtagctgtct

SEQ ID NO: 7594563 - DNA, 22 bp, Homo sapiens
gggaagtcctgaggtcaaataa

SEQ ID NO: 7594564 - DNA, 22 bp, Homo sapiens
gggaagtcgggttgagcactta

SEQ ID NO: 7594565 - DNA, 22 bp, Homo sapiens
gggaagtgaagtgtagctgtct

SEQ ID NO: 7594566 - DNA, 22 bp, Homo sapiens
gggaagggagggcctccagtca

SEQ ID NO: 7594567 - DNA, 22 bp, Homo sapiens
gggaagggctccttttattgca

SEQ ID NO: 7594568 - DNA, 22 bp, Homo sapiens
gggaagggctccttttattgca

SEQ ID NO: 7594569 - DNA, 22 bp, Homo sapiens
gggaagggctccttttattgca

SEQ ID NO: 7594570 - DNA, 22 bp, Homo sapiens
gggaagggctccttttattgca

SEQ ID NO: 7594571 - DNA, 22 bp, Homo sapiens
gggaagggctccttttattgca

SEQ ID NO: 7594572 - DNA, 22 bp, Homo sapiens
gggaagggagggcctccagtca

SEQ ID NO: 7594573 - DNA, 22 bp, Homo sapiens
gggaagggagggcctccagtca

SEQ ID NO: 7594574 - DNA, 22 bp, Homo sapiens
gggaagggagggcctccagtca

SEQ ID NO: 7594575 - DNA, 22 bp, Homo sapiens
gggaagggtgttgtcttatctt

SEQ ID NO: 7594576 - DNA, 22 bp, Homo sapiens
gggaagggtgttgtcttatctt

SEQ ID NO: 7594577 - DNA, 22 bp, Homo sapiens
gggaaggtatttagctgctgaa

SEQ ID NO: 7594578 - DNA, 22 bp, Homo sapiens
gggaaggtatttagctgctgaa

SEQ ID NO: 7594579 - DNA, 20 bp, Homo sapiens
gggaagtcccgcctgtcttc

SEQ ID NO: 7594580 - DNA, 22 bp, Homo sapiens
gggaagggctccttttattgca

SEQ ID NO: 7594581 - DNA, 22 bp, Homo sapiens
gggaagggtgttgtcttatctt

SEQ ID NO: 7594582 - DNA, 22 bp, Homo sapiens
gggaagggtgttgtcttatctt

SEQ ID NO: 7594583 - DNA, 19 bp, Homo sapiens
gggagctgaggtctttggt

SEQ ID NO: 7594584 - DNA, 19 bp, Homo sapiens
gggagctgaggtctttggt

SEQ ID NO: 7594585 - DNA, 19 bp, Homo sapiens
gggagctgaggtctttggt

SEQ ID NO: 7594586 - DNA, 19 bp, Homo sapiens
gggagctgaggtctttggt

SEQ ID NO: 7594587 - DNA, 19 bp, Homo sapiens
gggagctgaggtctttggt

SEQ ID NO: 7594588 - DNA, 22 bp, Homo sapiens
gggagctggagctggaagactc

SEQ ID NO: 7594589 - DNA, 22 bp, Homo sapiens
gggagctggagctggaagactc

SEQ ID NO: 7594590 - DNA, 22 bp, Homo sapiens
gggagctggagctggaagactc

SEQ ID NO: 7594591 - DNA, 22 bp, Homo sapiens
gggagctggagctggaagactc

SEQ ID NO: 7594592 - DNA, 22 bp, Homo sapiens
gggagctggagctggaagactc

SEQ ID NO: 7594593 - DNA, 22 bp, Homo sapiens
gggagctggagctggaagactc

SEQ ID NO: 7594594 - DNA, 22 bp, Homo sapiens
gggagctggagctggaagactc

SEQ ID NO: 7594595 - DNA, 22 bp, Homo sapiens
gggagctggagctggaagactc

SEQ ID NO: 7594596 - DNA, 22 bp, Homo sapiens
gggagctgagggacctctgtgg

SEQ ID NO: 7594597 - DNA, 22 bp, Homo sapiens
gggagctgagggacctctgtgg

SEQ ID NO: 7594598 - DNA, 22 bp, Homo sapiens
gggagctgagggacctctgtgg

SEQ ID NO: 7594599 - DNA, 22 bp, Homo sapiens
gggagctgagggacctctgtgg

SEQ ID NO: 7594600 - DNA, 22 bp, Homo sapiens
gggagctgagctggaagagaat

SEQ ID NO: 7594601 - DNA, 22 bp, Homo sapiens
gggagctgaggagccccgtcgg

SEQ ID NO: 7594602 - DNA, 22 bp, Homo sapiens
gggagctgaggagccccgtcgg

SEQ ID NO: 7594603 - DNA, 22 bp, Homo sapiens
gggagctgaggagccccgtcgg

SEQ ID NO: 7594604 - DNA, 22 bp, Homo sapiens
gggagctgaggagccccgtcgg

SEQ ID NO: 7594605 - DNA, 22 bp, Homo sapiens
gggagctgaggagccccgtcgg

SEQ ID NO: 7594606 - DNA, 22 bp, Homo sapiens
gggagctgaggagccccgtcgg

SEQ ID NO: 7594607 - DNA, 22 bp, Homo sapiens
gggagctgaggagccccgtcgg

SEQ ID NO: 7594608 - DNA, 21 bp, Homo sapiens
gggagctgacagcagcacggc

SEQ ID NO: 7594609 - DNA, 21 bp, Homo sapiens
gggagctgacagcagcacggc

SEQ ID NO: 7594610 - DNA, 21 bp, Homo sapiens
gggagctgacagcagcacggc

SEQ ID NO: 7594611 - DNA, 22 bp, Homo sapiens
gggagctgacctgcaggttccc

SEQ ID NO: 7594612 - DNA, 22 bp, Homo sapiens
gggagctgacctgcaggttccc

SEQ ID NO: 7594613 - DNA, 22 bp, Homo sapiens
gggagctgacctgcaggttccc

SEQ ID NO: 7594614 - DNA, 22 bp, Homo sapiens
gggagctgacctgcaggttccc

SEQ ID NO: 7594615 - DNA, 22 bp, Homo sapiens
gggagctgacctgcaggttccc

SEQ ID NO: 7594616 - DNA, 22 bp, Homo sapiens
gggagctgacctgcaggttccc

SEQ ID NO: 7594617 - DNA, 22 bp, Homo sapiens
gggagctgacctgcaggttccc

SEQ ID NO: 7594618 - DNA, 22 bp, Homo sapiens
gggagctgagctctgagccacg

SEQ ID NO: 7594619 - DNA, 22 bp, Homo sapiens
gggagctgagctctgagccacg

SEQ ID NO: 7594620 - DNA, 22 bp, Homo sapiens
gggagctgagctctgagccacg

SEQ ID NO: 7594621 - DNA, 22 bp, Homo sapiens
gggagctgagctctgagccacg

SEQ ID NO: 7594622 - DNA, 22 bp, Homo sapiens
gggagctgagctctgagccacg

SEQ ID NO: 7594623 - DNA, 22 bp, Homo sapiens
gggagctgagaaacaacattct

SEQ ID NO: 7594624 - DNA, 22 bp, Homo sapiens
gggagctgagctggaagagaat

SEQ ID NO: 7594625 - DNA, 22 bp, Homo sapiens
gggagctgagctggaagagaat

SEQ ID NO: 7594626 - DNA, 22 bp, Homo sapiens
gggagctgagctggaagagaat

SEQ ID NO: 7594627 - DNA, 22 bp, Homo sapiens
gggagctgagctggaagagaat

SEQ ID NO: 7594628 - DNA, 22 bp, Homo sapiens
gggagctgagctggaagagaat

SEQ ID NO: 7594629 - DNA, 22 bp, Homo sapiens
gggagctgagctggaagagaat

SEQ ID NO: 7594630 - DNA, 22 bp, Homo sapiens
gggagctgagctggaagagaat

SEQ ID NO: 7594631 - DNA, 22 bp, Homo sapiens
gggagctgagctggaagagaat

SEQ ID NO: 7594632 - DNA, 22 bp, Homo sapiens
gggagctgagctctgagccacg

SEQ ID NO: 7594633 - DNA, 22 bp, Homo sapiens
gggagctgagctctgagccacg

SEQ ID NO: 7594634 - DNA, 22 bp, Homo sapiens
gggagctgagctctgagccacg

SEQ ID NO: 7594635 - DNA, 22 bp, Homo sapiens
gggagctgagctctgagccacg

SEQ ID NO: 7594636 - DNA, 22 bp, Homo sapiens
ggctttattaagcagggtaagt

SEQ ID NO: 7594637 - DNA, 22 bp, Homo sapiens
ggctttattaagcagggtaagt

SEQ ID NO: 7594638 - DNA, 22 bp, Homo sapiens
ggctttattaagcagggtaagt

SEQ ID NO: 7594639 - DNA, 22 bp, Homo sapiens
ggctttattaactcatccgtaa

SEQ ID NO: 7594640 - DNA, 22 bp, Homo sapiens
ggctttattaactcatccgtaa

SEQ ID NO: 7594641 - DNA, 22 bp, Homo sapiens
ggctttatgtttttcatgtggt

SEQ ID NO: 7594642 - DNA, 22 bp, Homo sapiens
ggctttattaactcatccgtaa

SEQ ID NO: 7594643 - DNA, 22 bp, Homo sapiens
ggctttatgtttttcatgtggt

SEQ ID NO: 7594644 - DNA, 21 bp, Homo sapiens
ggctttatgctcacccagcct

SEQ ID NO: 7594645 - DNA, 22 bp, Homo sapiens
ggctttatgtttttcatgtggt

SEQ ID NO: 7594646 - DNA, 21 bp, Homo sapiens
ggctttatgctcacccagcct

SEQ ID NO: 7594647 - DNA, 21 bp, Homo sapiens
ggctttatgctcacccagcct

SEQ ID NO: 7594648 - DNA, 22 bp, Homo sapiens
ggctttatttgcagccattgtt

SEQ ID NO: 7594649 - DNA, 22 bp, Homo sapiens
ggctttatttgcagccattgtt

SEQ ID NO: 7594650 - DNA, 22 bp, Homo sapiens
ggctttattttgcatgaatgct

SEQ ID NO: 7594651 - DNA, 22 bp, Homo sapiens
ggctttatttcactgtaccata

SEQ ID NO: 7594652 - DNA, 22 bp, Homo sapiens
ggctttatttcactgtaccata

SEQ ID NO: 7594653 - DNA, 22 bp, Homo sapiens
ggctttatttgcagccattgtt

SEQ ID NO: 7594654 - DNA, 22 bp, Homo sapiens
ggctttattatgtggccatgtg

SEQ ID NO: 7594655 - DNA, 22 bp, Homo sapiens
ggctttattatgtggccatgtg

SEQ ID NO: 7594656 - DNA, 22 bp, Homo sapiens
ggctttattatgtggccatgtg

SEQ ID NO: 7594657 - DNA, 22 bp, Homo sapiens
ggctttatttcactgtaccata

SEQ ID NO: 7594658 - DNA, 22 bp, Homo sapiens
ggctttatttcactgtaccata

SEQ ID NO: 7594659 - DNA, 22 bp, Homo sapiens
ggctttattatgtggccatgtg

SEQ ID NO: 7594660 - DNA, 22 bp, Homo sapiens
ggctttatattgtttgagcaga

SEQ ID NO: 7594661 - DNA, 22 bp, Homo sapiens
ggctttatattgtttgagcaga

SEQ ID NO: 7594662 - DNA, 22 bp, Homo sapiens
ggctttatattgtttgagcaga

SEQ ID NO: 7594663 - DNA, 22 bp, Homo sapiens
ggctttatcaaatgagaccctg

SEQ ID NO: 7594664 - DNA, 22 bp, Homo sapiens
ggctttatcaaatgagaccctg

SEQ ID NO: 7594665 - DNA, 22 bp, Homo sapiens
ggctttatcaaatgagaccctg

SEQ ID NO: 7594666 - DNA, 22 bp, Homo sapiens
ggctttatgcacagcagatggt

SEQ ID NO: 7594667 - DNA, 22 bp, Homo sapiens
ggctttatgcacagcagatggt

SEQ ID NO: 7594668 - DNA, 22 bp, Homo sapiens
ggctttatcaaatgagaccctg

SEQ ID NO: 7594669 - DNA, 22 bp, Homo sapiens
ggctttatgcacagcagatggt

SEQ ID NO: 7594670 - DNA, 22 bp, Homo sapiens
ggctttatgcagggatagaaat

SEQ ID NO: 7594671 - DNA, 22 bp, Homo sapiens
ggctttatgcagggatagaaat

SEQ ID NO: 7594672 - DNA, 22 bp, Homo sapiens
ggctttatgcagggatagaaat

SEQ ID NO: 7594673 - DNA, 22 bp, Homo sapiens
ggctgtgcctctggcagcacat

SEQ ID NO: 7594674 - DNA, 22 bp, Homo sapiens
ggctgtgcgggcagccgtggga

SEQ ID NO: 7594675 - DNA, 22 bp, Homo sapiens
ggctttatagggtagaggatca

SEQ ID NO: 7594676 - DNA, 22 bp, Homo sapiens
ggctttatagggtagaggatca

SEQ ID NO: 7594677 - DNA, 22 bp, Homo sapiens
ggctttatattgtttgagcaga

SEQ ID NO: 7594678 - DNA, 22 bp, Homo sapiens
ggctttatattgtttgagcaga

SEQ ID NO: 7594679 - DNA, 22 bp, Homo sapiens
ggctgtgcctcaaggctactca

SEQ ID NO: 7594680 - DNA, 20 bp, Homo sapiens
ggctgtgcccttccgtggcc

SEQ ID NO: 7594681 - DNA, 22 bp, Homo sapiens
ggctgtgcctctggcagcacat

SEQ ID NO: 7594682 - DNA, 22 bp, Homo sapiens
ggctgtgcctcaaggctactca

SEQ ID NO: 7594683 - DNA, 22 bp, Homo sapiens
ggctgtgcctcaaggctactca

SEQ ID NO: 7594684 - DNA, 22 bp, Homo sapiens
ggctttgaggatacagaggaaa

SEQ ID NO: 7594685 - DNA, 22 bp, Homo sapiens
ggctttgatgtggtgtcaattt

SEQ ID NO: 7594686 - DNA, 22 bp, Homo sapiens
ggctttgatgtggtgtcaattt

SEQ ID NO: 7594687 - DNA, 22 bp, Homo sapiens
ggctttgcaaactcattccaca

SEQ ID NO: 7594688 - DNA, 22 bp, Homo sapiens
ggctttgcagcctcattgctct

SEQ ID NO: 7594689 - DNA, 22 bp, Homo sapiens
ggctttgacatgctgaattaaa

SEQ ID NO: 7594690 - DNA, 22 bp, Homo sapiens
ggctttgacatgctgaattaaa

SEQ ID NO: 7594691 - DNA, 22 bp, Homo sapiens
ggctttgacatgctgaattaaa

SEQ ID NO: 7594692 - DNA, 22 bp, Homo sapiens
ggctttgacatgctgaattaaa

SEQ ID NO: 7594693 - DNA, 22 bp, Homo sapiens
ggctttgacatgctgaattaaa

SEQ ID NO: 7594694 - DNA, 22 bp, Homo sapiens
ggctttgacatgctgaattaaa

SEQ ID NO: 7594695 - DNA, 22 bp, Homo sapiens
ggctttgcattttgatggaggt

SEQ ID NO: 7594696 - DNA, 23 bp, Homo sapiens
ggctttgccacatattgaccatg

SEQ ID NO: 7594697 - DNA, 22 bp, Homo sapiens
ggctttgcattttgatggaggt

SEQ ID NO: 7594698 - DNA, 22 bp, Homo sapiens
ggctttgcctgaataagcccac

SEQ ID NO: 7594699 - DNA, 21 bp, Homo sapiens
ggctttgctcagcttaccaaa

SEQ ID NO: 7594700 - DNA, 22 bp, Homo sapiens
ggctttgcgaagatggcggcgc

SEQ ID NO: 7594701 - DNA, 18 bp, Homo sapiens
ggctttgctggggtttct

SEQ ID NO: 7594702 - DNA, 22 bp, Homo sapiens
ggctttcaaggaaaggcctcat

SEQ ID NO: 7594703 - DNA, 22 bp, Homo sapiens
ggctttctagatctagctctgt

SEQ ID NO: 7594704 - DNA, 22 bp, Homo sapiens
ggctttctagatctagctctgt

SEQ ID NO: 7594705 - DNA, 22 bp, Homo sapiens
ggctttctatgaactcaaaggc

SEQ ID NO: 7594706 - DNA, 22 bp, Homo sapiens
ggctttctatgaactcaaaggc

SEQ ID NO: 7594707 - DNA, 22 bp, Homo sapiens
ggctttattttgcatgaatgct

SEQ ID NO: 7594708 - DNA, 22 bp, Homo sapiens
ggctttattttgcatgaatgct

SEQ ID NO: 7594709 - DNA, 22 bp, Homo sapiens
ggctttcaacacaggctttcct

SEQ ID NO: 7594710 - DNA, 20 bp, Homo sapiens
ggctttctgtgatcctcagt

SEQ ID NO: 7594711 - DNA, 22 bp, Homo sapiens
ggctttgacatgctgaattaaa

SEQ ID NO: 7594712 - DNA, 22 bp, Homo sapiens
ggctttcttgttaaatgtccat

SEQ ID NO: 7594713 - DNA, 22 bp, Homo sapiens
ggctttctgtctgcgtctgtgt

SEQ ID NO: 7594714 - DNA, 22 bp, Homo sapiens
ggctttctccttgccttagtct

SEQ ID NO: 7594715 - DNA, 22 bp, Homo sapiens
gggaaggctgcctgagggatgg

SEQ ID NO: 7594716 - DNA, 22 bp, Homo sapiens
gggaaggctgcctgagggatgg

SEQ ID NO: 7594717 - DNA, 22 bp, Homo sapiens
gggaaggctgcctgagggatgg

SEQ ID NO: 7594718 - DNA, 22 bp, Homo sapiens
gggaaggctgcctgagggatgg

SEQ ID NO: 7594719 - DNA, 22 bp, Homo sapiens
gggaaggctgcctgagggatgg

SEQ ID NO: 7594720 - DNA, 22 bp, Homo sapiens
gggaaggctgcctgagggatgg

SEQ ID NO: 7594721 - DNA, 22 bp, Homo sapiens
gggaaggctgcctgagggatgg

SEQ ID NO: 7594722 - DNA, 22 bp, Homo sapiens
gggaagggacttgtttaaggtc

SEQ ID NO: 7594723 - DNA, 22 bp, Homo sapiens
gggaagggacttgtttaaggtc

SEQ ID NO: 7594724 - DNA, 22 bp, Homo sapiens
gggaagggacttgtttaaggtc

SEQ ID NO: 7594725 - DNA, 22 bp, Homo sapiens
gggaagggacttgtttaaggtc

SEQ ID NO: 7594726 - DNA, 22 bp, Homo sapiens
gggaagggacttgtttaaggtc

SEQ ID NO: 7594727 - DNA, 22 bp, Homo sapiens
gggaagggacttgtttaaggtc

SEQ ID NO: 7594728 - DNA, 22 bp, Homo sapiens
gggaagggacttgtttaaggtc

SEQ ID NO: 7594729 - DNA, 22 bp, Homo sapiens
gggaagggacttgtttaaggtc

SEQ ID NO: 7594730 - DNA, 22 bp, Homo sapiens
gggaagggacttgtttaaggtc

SEQ ID NO: 7594731 - DNA, 22 bp, Homo sapiens
gggaagggacttgtttaaggtc

SEQ ID NO: 7594732 - DNA, 22 bp, Homo sapiens
gggaagggacttgtttaaggtc

SEQ ID NO: 7594733 - DNA, 22 bp, Homo sapiens
gggaagggagggacctcagtct

SEQ ID NO: 7594734 - DNA, 22 bp, Homo sapiens
gggaagggagggacctcagtct

SEQ ID NO: 7594735 - DNA, 22 bp, Homo sapiens
gggaagggagggacctcagtct

SEQ ID NO: 7594736 - DNA, 22 bp, Homo sapiens
gggaagggagggcctccagtca

SEQ ID NO: 7594737 - DNA, 22 bp, Homo sapiens
gggaagggagggcctccagtca

SEQ ID NO: 7594738 - DNA, 22 bp, Homo sapiens
gggaagggagggcctccagtca

SEQ ID NO: 7594739 - DNA, 22 bp, Homo sapiens
gggaagggagggcctccagtca

SEQ ID NO: 7594740 - DNA, 22 bp, Homo sapiens
gggaagggagggcctccagtca

SEQ ID NO: 7594741 - DNA, 22 bp, Homo sapiens
gggaagggagggcctccagtca

SEQ ID NO: 7594742 - DNA, 22 bp, Homo sapiens
gggaagggagggcctccagtca

SEQ ID NO: 7594743 - DNA, 22 bp, Homo sapiens
gggaagggagggacctcagtct

SEQ ID NO: 7594744 - DNA, 22 bp, Homo sapiens
gggaagggagctgggtatttag

SEQ ID NO: 7594745 - DNA, 22 bp, Homo sapiens
gggaagggagctgggtatttag

SEQ ID NO: 7594746 - DNA, 22 bp, Homo sapiens
gggaagggagctgggtatttag

SEQ ID NO: 7594747 - DNA, 22 bp, Homo sapiens
gggaagggagctgggtatttag

SEQ ID NO: 7594748 - DNA, 22 bp, Homo sapiens
gggaagggagctgggtatttag

SEQ ID NO: 7594749 - DNA, 22 bp, Homo sapiens
gggaagggagggacctcagtct

SEQ ID NO: 7594750 - DNA, 22 bp, Homo sapiens
gggaagggagggacctcagtct

SEQ ID NO: 7594751 - DNA, 22 bp, Homo sapiens
gggaagggagggacctcagtct

SEQ ID NO: 7594752 - DNA, 22 bp, Homo sapiens
gggaagggagggacctcagtct

SEQ ID NO: 7594753 - DNA, 22 bp, Homo sapiens
gggaagggagggacctcagtct

SEQ ID NO: 7594754 - DNA, 22 bp, Homo sapiens
gggaagggagggacctcagtct

SEQ ID NO: 7594755 - DNA, 22 bp, Homo sapiens
gggaagggagggacctcagtct

SEQ ID NO: 7594756 - DNA, 22 bp, Homo sapiens
ggctccctgcaacctccgcctc

SEQ ID NO: 7594757 - DNA, 22 bp, Homo sapiens
ggctccctgcaacctccgcctc

SEQ ID NO: 7594758 - DNA, 22 bp, Homo sapiens
ggctccctgcaacctccgcctc

SEQ ID NO: 7594759 - DNA, 22 bp, Homo sapiens
ggctccctgcaacctccgcctc

SEQ ID NO: 7594760 - DNA, 22 bp, Homo sapiens
ggctccctgcaacctccgcctc

SEQ ID NO: 7594761 - DNA, 17 bp, Homo sapiens
ggctccctgactatgga

SEQ ID NO: 7594762 - DNA, 17 bp, Homo sapiens
ggctccctgactatgga

SEQ ID NO: 7594763 - DNA, 17 bp, Homo sapiens
ggctccctgactatgga

SEQ ID NO: 7594764 - DNA, 17 bp, Homo sapiens
ggctccctgactatgga

SEQ ID NO: 7594765 - DNA, 22 bp, Homo sapiens
ggctccctagggagagtgggag

SEQ ID NO: 7594766 - DNA, 22 bp, Homo sapiens
ggctccctcaccaccatcacat

SEQ ID NO: 7594767 - DNA, 22 bp, Homo sapiens
ggctccctcaccaccatcacat

SEQ ID NO: 7594768 - DNA, 22 bp, Homo sapiens
ggctccctagggagagtgggag

SEQ ID NO: 7594769 - DNA, 22 bp, Homo sapiens
ggctccctcaccaccatcacat

SEQ ID NO: 7594770 - DNA, 23 bp, Homo sapiens
ggctccctcctagctttcccaat

SEQ ID NO: 7594771 - DNA, 22 bp, Homo sapiens
ggctccctcaccaccatcacat

SEQ ID NO: 7594772 - DNA, 22 bp, Homo sapiens
ggctccctcaccaccatcacat

SEQ ID NO: 7594773 - DNA, 22 bp, Homo sapiens
ggctccctagggagagtgggag

SEQ ID NO: 7594774 - DNA, 22 bp, Homo sapiens
ggctccccaggtccaggagctg

SEQ ID NO: 7594775 - DNA, 22 bp, Homo sapiens
ggctccctagggagagtgggag

SEQ ID NO: 7594776 - DNA, 22 bp, Homo sapiens
ggctccctagggagagtgggag

SEQ ID NO: 7594777 - DNA, 22 bp, Homo sapiens
ggctccctagggagagtgggag

SEQ ID NO: 7594778 - DNA, 22 bp, Homo sapiens
ggctccctgcctgtcctcagtc

SEQ ID NO: 7594779 - DNA, 22 bp, Homo sapiens
ggctccctggaaatcccgaggc

SEQ ID NO: 7594780 - DNA, 22 bp, Homo sapiens
ggctccctggaaatcccgaggc

SEQ ID NO: 7594781 - DNA, 22 bp, Homo sapiens
ggctccctggaaatcccgaggc

SEQ ID NO: 7594782 - DNA, 22 bp, Homo sapiens
ggctccctggaaatcccgaggc

SEQ ID NO: 7594783 - DNA, 22 bp, Homo sapiens
ggctccctgcctgtcctcagtc

SEQ ID NO: 7594784 - DNA, 22 bp, Homo sapiens
ggctccctgcctgtcctcagtc

SEQ ID NO: 7594785 - DNA, 22 bp, Homo sapiens
ggctccctgcctgtcctcagtc

SEQ ID NO: 7594786 - DNA, 22 bp, Homo sapiens
ggctccctgcctgtcctcagtc

SEQ ID NO: 7594787 - DNA, 22 bp, Homo sapiens
ggctccctgcctgtcctcagtc

SEQ ID NO: 7594788 - DNA, 22 bp, Homo sapiens
ggctccctggaaatcccgaggc

SEQ ID NO: 7594789 - DNA, 21 bp, Homo sapiens
ggctccctggcaggggtctgg

SEQ ID NO: 7594790 - DNA, 21 bp, Homo sapiens
ggctccctggcaggggtctgg

SEQ ID NO: 7594791 - DNA, 22 bp, Homo sapiens
ggctccctggccctggggacac

SEQ ID NO: 7594792 - DNA, 22 bp, Homo sapiens
ggctccctggccctggggacac

SEQ ID NO: 7594793 - DNA, 22 bp, Homo sapiens
ggctccctggccctggggacac

SEQ ID NO: 7594794 - DNA, 21 bp, Homo sapiens
ggctccctggcaggggtctgg

SEQ ID NO: 7594795 - DNA, 22 bp, Homo sapiens
ggctccctgggggtcggagagt

SEQ ID NO: 7594796 - DNA, 22 bp, Homo sapiens
ggctccctgggggtcggagagt

SEQ ID NO: 7594797 - DNA, 22 bp, Homo sapiens
ggctccctggccctggggacac

SEQ ID NO: 7594798 - DNA, 22 bp, Homo sapiens
ggctccctggccctggggacac

SEQ ID NO: 7594799 - DNA, 22 bp, Homo sapiens
ggctccctggccctggggacac

SEQ ID NO: 7594800 - DNA, 22 bp, Homo sapiens
ggctccctgggtgctcctgctc

SEQ ID NO: 7594801 - DNA, 22 bp, Homo sapiens
ggctccctgggggtcggagagt

SEQ ID NO: 7594802 - DNA, 22 bp, Homo sapiens
ggctccctgggtgctcctgctc

SEQ ID NO: 7594803 - DNA, 22 bp, Homo sapiens
ggctccagtttgtgccttcagc

SEQ ID NO: 7594804 - DNA, 22 bp, Homo sapiens
ggctccagtttgtgccttcagc

SEQ ID NO: 7594805 - DNA, 22 bp, Homo sapiens
ggctccagtttgtgccttcagc

SEQ ID NO: 7594806 - DNA, 22 bp, Homo sapiens
ggctccagggagtggagagaag

SEQ ID NO: 7594807 - DNA, 22 bp, Homo sapiens
ggctccagggagtggagagaag

SEQ ID NO: 7594808 - DNA, 22 bp, Homo sapiens
ggctccagtttgtgccttcagc

SEQ ID NO: 7594809 - DNA, 22 bp, Homo sapiens
ggctccagtttgtgccttcagc

SEQ ID NO: 7594810 - DNA, 22 bp, Homo sapiens
ggctcccaggagggcctggagg

SEQ ID NO: 7594811 - DNA, 22 bp, Homo sapiens
ggctcccaggagggcctggagg

SEQ ID NO: 7594812 - DNA, 22 bp, Homo sapiens
ggctcccaggagggcctggagg

SEQ ID NO: 7594813 - DNA, 22 bp, Homo sapiens
ggctcccaggagggcctggagg

SEQ ID NO: 7594814 - DNA, 22 bp, Homo sapiens
ggctcccaggagggcctggagg

SEQ ID NO: 7594815 - DNA, 22 bp, Homo sapiens
ggctcccaggagggcctggagg

SEQ ID NO: 7594816 - DNA, 22 bp, Homo sapiens
ggctcccacccatagggcgagt

SEQ ID NO: 7594817 - DNA, 22 bp, Homo sapiens
ggctcccacccatagggcgagt

SEQ ID NO: 7594818 - DNA, 22 bp, Homo sapiens
ggctcccaggagggcctggagg

SEQ ID NO: 7594819 - DNA, 22 bp, Homo sapiens
ggctcccacccatagggcgagt

SEQ ID NO: 7594820 - DNA, 22 bp, Homo sapiens
ggctccaggctcctatttcact

SEQ ID NO: 7594821 - DNA, 22 bp, Homo sapiens
ggctccaggctcctatttcact

SEQ ID NO: 7594822 - DNA, 22 bp, Homo sapiens
ggctccaggctcctatttcact

SEQ ID NO: 7594823 - DNA, 22 bp, Homo sapiens
ggctccagggagtggagagaag

SEQ ID NO: 7594824 - DNA, 22 bp, Homo sapiens
ggctccagggagtggagagaag

SEQ ID NO: 7594825 - DNA, 22 bp, Homo sapiens
ggctccagggagtggagagaag

SEQ ID NO: 7594826 - DNA, 22 bp, Homo sapiens
ggctccagggagtggagagaag

SEQ ID NO: 7594827 - DNA, 22 bp, Homo sapiens
ggctccagggagtggagagaag

SEQ ID NO: 7594828 - DNA, 22 bp, Homo sapiens
ggctaggcgggcacatggtgga

SEQ ID NO: 7594829 - DNA, 22 bp, Homo sapiens
ggctaggcgggcacatggtgga

SEQ ID NO: 7594830 - DNA, 22 bp, Homo sapiens
ggctaggcgggcacatggtgga

SEQ ID NO: 7594831 - DNA, 22 bp, Homo sapiens
ggctaggcgggcacatggtgga

SEQ ID NO: 7594832 - DNA, 22 bp, Homo sapiens
ggctaggcctcaggcctgcctg

SEQ ID NO: 7594833 - DNA, 22 bp, Homo sapiens
ggctaggcctcaggcctgcctg

SEQ ID NO: 7594834 - DNA, 22 bp, Homo sapiens
ggcgtgttggatctggattggc

SEQ ID NO: 7594835 - DNA, 22 bp, Homo sapiens
ggcgttgctctccccaggctca

SEQ ID NO: 7594836 - DNA, 22 bp, Homo sapiens
ggctaacagtggaagctgacca

SEQ ID NO: 7594837 - DNA, 22 bp, Homo sapiens
ggctaaggaacgcaggcttctc

SEQ ID NO: 7594838 - DNA, 22 bp, Homo sapiens
ggctaaggaacgcaggcttctc

SEQ ID NO: 7594839 - DNA, 22 bp, Homo sapiens
ggcgtggggccttctgcccgct

SEQ ID NO: 7594840 - DNA, 22 bp, Homo sapiens
ggcgtttcaccatgttgaccag

SEQ ID NO: 7594841 - DNA, 22 bp, Homo sapiens
ggctaagtacaagggatacagc

SEQ ID NO: 7594842 - DNA, 23 bp, Homo sapiens
ggctaaggccgccggccctgctc

SEQ ID NO: 7594843 - DNA, 22 bp, Homo sapiens
ggcgtttcaccatgttgaccag

SEQ ID NO: 7594844 - DNA, 22 bp, Homo sapiens
ggctaaggaagaaggatcgtta

SEQ ID NO: 7594845 - DNA, 22 bp, Homo sapiens
ggctaaggaacgcaggcttctc

SEQ ID NO: 7594846 - DNA, 22 bp, Homo sapiens
ggctacagaaggagaaagaaat

SEQ ID NO: 7594847 - DNA, 22 bp, Homo sapiens
ggctacactggctatgctggct

SEQ ID NO: 7594848 - DNA, 22 bp, Homo sapiens
ggctacactggctatgctggct

SEQ ID NO: 7594849 - DNA, 22 bp, Homo sapiens
ggctaattttcagtgttcatag

SEQ ID NO: 7594850 - DNA, 22 bp, Homo sapiens
ggctacagactgcataagggca

SEQ ID NO: 7594851 - DNA, 22 bp, Homo sapiens
ggctacagaggccgtgagcctg

SEQ ID NO: 7594852 - DNA, 22 bp, Homo sapiens
ggctacagcggggtggagacgg

SEQ ID NO: 7594853 - DNA, 22 bp, Homo sapiens
ggctacagcggggtggagacgg

SEQ ID NO: 7594854 - DNA, 22 bp, Homo sapiens
ggctacagcggggtggagacgg

SEQ ID NO: 7594855 - DNA, 22 bp, Homo sapiens
ggctacagcggggtggagacgg

SEQ ID NO: 7594856 - DNA, 22 bp, Homo sapiens
ggctacagaggccgtgagcctg

SEQ ID NO: 7594857 - DNA, 22 bp, Homo sapiens
ggctacagaggccgtgagcctg

SEQ ID NO: 7594858 - DNA, 22 bp, Homo sapiens
ggctacagaggccgtgagcctg

SEQ ID NO: 7594859 - DNA, 22 bp, Homo sapiens
ggctacagaaggagaaagaaat

SEQ ID NO: 7594860 - DNA, 22 bp, Homo sapiens
ggctacagactgcataagggca

SEQ ID NO: 7594861 - DNA, 22 bp, Homo sapiens
ggctacagaggccgtgagcctg

SEQ ID NO: 7594862 - DNA, 22 bp, Homo sapiens
ggctacagactgcataagggca

SEQ ID NO: 7594863 - DNA, 22 bp, Homo sapiens
ggcggtggttgagaggacggcg

SEQ ID NO: 7594864 - DNA, 22 bp, Homo sapiens
ggcggtggttgagaggacggcg

SEQ ID NO: 7594865 - DNA, 22 bp, Homo sapiens
ggcggtggttgagaggacggcg

SEQ ID NO: 7594866 - DNA, 22 bp, Homo sapiens
ggcggtggttgagaggacggcg

SEQ ID NO: 7594867 - DNA, 22 bp, Homo sapiens
ggcggtggcgtgaaggtggctg

SEQ ID NO: 7594868 - DNA, 22 bp, Homo sapiens
ggcggtggttgagaggacggcg

SEQ ID NO: 7594869 - DNA, 22 bp, Homo sapiens
ggcggtggcgtgaaggtggctg

SEQ ID NO: 7594870 - DNA, 22 bp, Homo sapiens
ggcggtggcgtgaaggtggctg

SEQ ID NO: 7594871 - DNA, 22 bp, Homo sapiens
ggcgtgggcgaggtgctctatc

SEQ ID NO: 7594872 - DNA, 22 bp, Homo sapiens
ggcgtggggccttctgcccgct

SEQ ID NO: 7594873 - DNA, 22 bp, Homo sapiens
ggcgtgggcgaggtgctctatc

SEQ ID NO: 7594874 - DNA, 22 bp, Homo sapiens
ggcgtaaggataatgatagctc

SEQ ID NO: 7594875 - DNA, 23 bp, Homo sapiens
ggcgtcggtcaggagagctggag

SEQ ID NO: 7594876 - DNA, 22 bp, Homo sapiens
ggcgtgatctggaggtcccagc

SEQ ID NO: 7594877 - DNA, 22 bp, Homo sapiens
ggcgtgctgcccgggcctgctg

SEQ ID NO: 7594878 - DNA, 22 bp, Homo sapiens
ggcgtgggaagtggggcttctg

SEQ ID NO: 7594879 - DNA, 22 bp, Homo sapiens
ggcgtgggaagtggggcttctg

SEQ ID NO: 7594880 - DNA, 22 bp, Homo sapiens
ggcgtgggaagtggggcttctg

SEQ ID NO: 7594881 - DNA, 22 bp, Homo sapiens
ggcgtgggaagtggggcttctg

SEQ ID NO: 7594882 - DNA, 22 bp, Homo sapiens
ggctagcaaggtagcagaatgc

SEQ ID NO: 7594883 - DNA, 22 bp, Homo sapiens
ggctagctcctccgcgcatcca

SEQ ID NO: 7594884 - DNA, 22 bp, Homo sapiens
ggctagcttagagtcatgctag

SEQ ID NO: 7594885 - DNA, 22 bp, Homo sapiens
ggctaggcctcaggcctgcctg

SEQ ID NO: 7594886 - DNA, 22 bp, Homo sapiens
ggctaggcaggctcagagccta

SEQ ID NO: 7594887 - DNA, 22 bp, Homo sapiens
ggctaggcaggctcagagccta

SEQ ID NO: 7594888 - DNA, 22 bp, Homo sapiens
ggctaggcaggctcagagccta

SEQ ID NO: 7594889 - DNA, 23 bp, Homo sapiens
ggctagagtggaggggaactgca

SEQ ID NO: 7594890 - DNA, 22 bp, Homo sapiens
ggctagcaaggtagcagaatgc

SEQ ID NO: 7594891 - DNA, 22 bp, Homo sapiens
ggctagattttggcattgctct

SEQ ID NO: 7594892 - DNA, 23 bp, Homo sapiens
ggctagagtggaggggaactgca

SEQ ID NO: 7594893 - DNA, 23 bp, Homo sapiens
ggctagagtggaggggaactgca

SEQ ID NO: 7594894 - DNA, 23 bp, Homo sapiens
ggctagagtggaggggaactgca

SEQ ID NO: 7594895 - DNA, 22 bp, Homo sapiens
ggctagagtggaactggagcgg

SEQ ID NO: 7594896 - DNA, 22 bp, Homo sapiens
ggctagagtggaactggagcgg

SEQ ID NO: 7594897 - DNA, 22 bp, Homo sapiens
ggctacagggcctggccaaggt

SEQ ID NO: 7594898 - DNA, 22 bp, Homo sapiens
ggctacagggcctggccaaggt

SEQ ID NO: 7594899 - DNA, 22 bp, Homo sapiens
ggctacagggcctggccaaggt

SEQ ID NO: 7594900 - DNA, 22 bp, Homo sapiens
ggctacagcggggtggagacgg

SEQ ID NO: 7594901 - DNA, 22 bp, Homo sapiens
ggctacagggcctggccaaggt

SEQ ID NO: 7594902 - DNA, 22 bp, Homo sapiens
ggctacagtggcactgggcttt

SEQ ID NO: 7594903 - DNA, 22 bp, Homo sapiens
ggctacagtggcactgggcttt

SEQ ID NO: 7594904 - DNA, 22 bp, Homo sapiens
ggctacagggtacaccacatct

SEQ ID NO: 7594905 - DNA, 22 bp, Homo sapiens
ggctacagtggcactgggcttt

SEQ ID NO: 7594906 - DNA, 22 bp, Homo sapiens
ggctacagtggctcagtgctgg

SEQ ID NO: 7594907 - DNA, 22 bp, Homo sapiens
ggctacagtggctcagtgctgg

SEQ ID NO: 7594908 - DNA, 22 bp, Homo sapiens
ggctacagtggcactgggcttt

SEQ ID NO: 7594909 - DNA, 22 bp, Homo sapiens
ggctacagtggctcagtgctgg

SEQ ID NO: 7594910 - DNA, 22 bp, Homo sapiens
ggctacagtggcactgggcttt

SEQ ID NO: 7594911 - DNA, 22 bp, Homo sapiens
ggctactagactttgatactag

SEQ ID NO: 7594912 - DNA, 22 bp, Homo sapiens
ggctagagtggaactggagcgg

SEQ ID NO: 7594913 - DNA, 22 bp, Homo sapiens
ggctagagtggaactggagcgg

SEQ ID NO: 7594914 - DNA, 22 bp, Homo sapiens
ggctagaataattgacttcatt

SEQ ID NO: 7594915 - DNA, 22 bp, Homo sapiens
ggctagagtggaactggagcgg

SEQ ID NO: 7594916 - DNA, 22 bp, Homo sapiens
ggctagagtggaactggagcgg

SEQ ID NO: 7594917 - DNA, 22 bp, Homo sapiens
ggctactaggtaccatttagaa

SEQ ID NO: 7594918 - DNA, 22 bp, Homo sapiens
ggctactgtgatggtctgcaag

SEQ ID NO: 7594919 - DNA, 22 bp, Homo sapiens
ggctagaaactcaggcaagaaa

SEQ ID NO: 7594920 - DNA, 22 bp, Homo sapiens
ggctagaaagctactacaggag

SEQ ID NO: 7594921 - DNA, 22 bp, Homo sapiens
ggctagaaatttttacttaagt

SEQ ID NO: 7594922 - DNA, 22 bp, Homo sapiens
ggctagaactttacactttgca

SEQ ID NO: 7594923 - DNA, 22 bp, Homo sapiens
ggctagaagtcagaggtcaaga

SEQ ID NO: 7594924 - DNA, 22 bp, Homo sapiens
ggctcctgaggaccaggcacag

SEQ ID NO: 7594925 - DNA, 22 bp, Homo sapiens
ggctcctgaggaccaggcacag

SEQ ID NO: 7594926 - DNA, 22 bp, Homo sapiens
ggctcctgaggaccaggcacag

SEQ ID NO: 7594927 - DNA, 22 bp, Homo sapiens
ggctcctgaggaccaggcacag

SEQ ID NO: 7594928 - DNA, 22 bp, Homo sapiens
ggctcctgaggaccaggcacag

SEQ ID NO: 7594929 - DNA, 22 bp, Homo sapiens
ggctcctgaggaccaggcacag

SEQ ID NO: 7594930 - DNA, 22 bp, Homo sapiens
ggctcctgaggaccaggcacag

SEQ ID NO: 7594931 - DNA, 22 bp, Homo sapiens
ggctcctgagaatgggccatca

SEQ ID NO: 7594932 - DNA, 22 bp, Homo sapiens
ggctcctgagaatgggccatca

SEQ ID NO: 7594933 - DNA, 22 bp, Homo sapiens
ggctcctgataggagaatgcgg

SEQ ID NO: 7594934 - DNA, 22 bp, Homo sapiens
ggctcctgataggagaatgcgg

SEQ ID NO: 7594935 - DNA, 22 bp, Homo sapiens
ggctcctgataggagaatgcgg

SEQ ID NO: 7594936 - DNA, 22 bp, Homo sapiens
ggctcctgaggaccaggcacag

SEQ ID NO: 7594937 - DNA, 22 bp, Homo sapiens
ggctcctgataggagaatgcgg

SEQ ID NO: 7594938 - DNA, 22 bp, Homo sapiens
ggctcctgataggagaatgcgg

SEQ ID NO: 7594939 - DNA, 22 bp, Homo sapiens
ggctcctgataggagaatgcgg

SEQ ID NO: 7594940 - DNA, 22 bp, Homo sapiens
ggctcctgataggagaatgcgg

SEQ ID NO: 7594941 - DNA, 22 bp, Homo sapiens
ggctccctgttctattccctgg

SEQ ID NO: 7594942 - DNA, 22 bp, Homo sapiens
ggctccctgggtgctcctgctc

SEQ ID NO: 7594943 - DNA, 22 bp, Homo sapiens
ggctccctgggtgctcctgctc

SEQ ID NO: 7594944 - DNA, 22 bp, Homo sapiens
ggctccctgggtgctcctgctc

SEQ ID NO: 7594945 - DNA, 22 bp, Homo sapiens
ggctccctgttctattccctgg

SEQ ID NO: 7594946 - DNA, 22 bp, Homo sapiens
ggctcctctctggccgctcccg

SEQ ID NO: 7594947 - DNA, 22 bp, Homo sapiens
ggctcctctctggccgctcccg

SEQ ID NO: 7594948 - DNA, 22 bp, Homo sapiens
ggctccctgttctattccctgg

SEQ ID NO: 7594949 - DNA, 22 bp, Homo sapiens
ggctccctgttctattccctgg

SEQ ID NO: 7594950 - DNA, 18 bp, Homo sapiens
ggctccgacgggccgtgc

SEQ ID NO: 7594951 - DNA, 22 bp, Homo sapiens
ggctcctgaaagactatgggaa

SEQ ID NO: 7594952 - DNA, 22 bp, Homo sapiens
ggctcctgagaatgggccatca

SEQ ID NO: 7594953 - DNA, 22 bp, Homo sapiens
ggctcctgaaagactatgggaa

SEQ ID NO: 7594954 - DNA, 22 bp, Homo sapiens
ggctcctgaaagactatgggaa

SEQ ID NO: 7594955 - DNA, 22 bp, Homo sapiens
ggctcctctctggccgctcccg

SEQ ID NO: 7594956 - DNA, 22 bp, Homo sapiens
ggctctggggttggcccatctc

SEQ ID NO: 7594957 - DNA, 22 bp, Homo sapiens
ggctctggggttggcccatctc

SEQ ID NO: 7594958 - DNA, 22 bp, Homo sapiens
ggctctggggttggcccatctc

SEQ ID NO: 7594959 - DNA, 22 bp, Homo sapiens
ggctctggggttggcccatctc

SEQ ID NO: 7594960 - DNA, 22 bp, Homo sapiens
ggctctggggggaagtctgttg

SEQ ID NO: 7594961 - DNA, 22 bp, Homo sapiens
ggctctggggggaagtctgttg

SEQ ID NO: 7594962 - DNA, 22 bp, Homo sapiens
ggctctggggggaagtctgttg

SEQ ID NO: 7594963 - DNA, 22 bp, Homo sapiens
ggctctggggggaagtctgttg

SEQ ID NO: 7594964 - DNA, 22 bp, Homo sapiens
ggctctggggggaagtctgttg

SEQ ID NO: 7594965 - DNA, 22 bp, Homo sapiens
ggctctgggtctgtggggagcg

SEQ ID NO: 7594966 - DNA, 22 bp, Homo sapiens
ggctctgggtctgtggggagcg

SEQ ID NO: 7594967 - DNA, 22 bp, Homo sapiens
ggctctgggtctgtggggagcg

SEQ ID NO: 7594968 - DNA, 22 bp, Homo sapiens
ggctctgggtctgtggggagcg

SEQ ID NO: 7594969 - DNA, 22 bp, Homo sapiens
ggctctgggtaaggcgtttgac

SEQ ID NO: 7594970 - DNA, 22 bp, Homo sapiens
ggctctgggtaaggcgtttgac

SEQ ID NO: 7594971 - DNA, 22 bp, Homo sapiens
ggctctgggtaaggcgtttgac

SEQ ID NO: 7594972 - DNA, 22 bp, Homo sapiens
ggctctggggttggcccatctc

SEQ ID NO: 7594973 - DNA, 22 bp, Homo sapiens
ggctctggggttggcccatctc

SEQ ID NO: 7594974 - DNA, 22 bp, Homo sapiens
ggctctggggttggcccatctc

SEQ ID NO: 7594975 - DNA, 22 bp, Homo sapiens
ggctctgggcctccaaggtctg

SEQ ID NO: 7594976 - DNA, 22 bp, Homo sapiens
ggctctgggcctccaaggtctg

SEQ ID NO: 7594977 - DNA, 22 bp, Homo sapiens
ggctctgggccagagttggctt

SEQ ID NO: 7594978 - DNA, 22 bp, Homo sapiens
ggctctgggcctccaaggtctg

SEQ ID NO: 7594979 - DNA, 22 bp, Homo sapiens
ggctctgggcctccaaggtctg

SEQ ID NO: 7594980 - DNA, 22 bp, Homo sapiens
ggctctgggcctccaaggtctg

SEQ ID NO: 7594981 - DNA, 22 bp, Homo sapiens
ggctctgggcctccaaggtctg

SEQ ID NO: 7594982 - DNA, 22 bp, Homo sapiens
ggctctggggaagctctcttca

SEQ ID NO: 7594983 - DNA, 22 bp, Homo sapiens
ggctctggggaagctctcttca

SEQ ID NO: 7594984 - DNA, 22 bp, Homo sapiens
ggctctgggcctccaaggtctg

SEQ ID NO: 7594985 - DNA, 22 bp, Homo sapiens
ggctctgggcctccaaggtctg

SEQ ID NO: 7594986 - DNA, 22 bp, Homo sapiens
ggctctggggaagctctcttca

SEQ ID NO: 7594987 - DNA, 22 bp, Homo sapiens
ggctctggggcctcctcccttg

SEQ ID NO: 7594988 - DNA, 22 bp, Homo sapiens
ggctctggggaagctctcttca

SEQ ID NO: 7594989 - DNA, 22 bp, Homo sapiens
ggctctggggaagctctcttca

SEQ ID NO: 7594990 - DNA, 22 bp, Homo sapiens
ggctctggggcctcctcccttg

SEQ ID NO: 7594991 - DNA, 22 bp, Homo sapiens
ggctctggggggaagtctgttg

SEQ ID NO: 7594992 - DNA, 22 bp, Homo sapiens
ggctctggggcctcctcccttg

SEQ ID NO: 7594993 - DNA, 22 bp, Homo sapiens
ggctctggggcctcctcccttg

SEQ ID NO: 7594994 - DNA, 22 bp, Homo sapiens
ggctcttctacttcagatgggg

SEQ ID NO: 7594995 - DNA, 22 bp, Homo sapiens
ggctcttctacttcagatgggg

SEQ ID NO: 7594996 - DNA, 22 bp, Homo sapiens
ggctcttctacttcagatgggg

SEQ ID NO: 7594997 - DNA, 22 bp, Homo sapiens
ggctgagcactttaggcaggag

SEQ ID NO: 7594998 - DNA, 22 bp, Homo sapiens
ggctcttccgccaccagccaca

SEQ ID NO: 7594999 - DNA, 22 bp, Homo sapiens
ggctcttccgccaccagccaca

SEQ ID NO: 7595000 - DNA, 22 bp, Homo sapiens
ggctcttccgccaccagccaca

SEQ ID NO: 7595001 - DNA, 22 bp, Homo sapiens
ggctcttcacacagtgatgtca

SEQ ID NO: 7595002 - DNA, 22 bp, Homo sapiens
ggctctgtttactttcagaggc

SEQ ID NO: 7595003 - DNA, 22 bp, Homo sapiens
ggctcttcacacagtgatgtca

SEQ ID NO: 7595004 - DNA, 22 bp, Homo sapiens
ggctgagccactgcgcctggct

SEQ ID NO: 7595005 - DNA, 22 bp, Homo sapiens
ggctgagccactgcgcctggct

SEQ ID NO: 7595006 - DNA, 22 bp, Homo sapiens
ggctgagccactgcgcctggct

SEQ ID NO: 7595007 - DNA, 22 bp, Homo sapiens
ggctgagccatgggcactgcag

SEQ ID NO: 7595008 - DNA, 22 bp, Homo sapiens
ggctgagccactgcgcctggct

SEQ ID NO: 7595009 - DNA, 22 bp, Homo sapiens
ggctgagccatgggcactgcag

SEQ ID NO: 7595010 - DNA, 22 bp, Homo sapiens
ggctgaggctcatgccatcttg

SEQ ID NO: 7595011 - DNA, 22 bp, Homo sapiens
ggctgagccatgggcactgcag

SEQ ID NO: 7595012 - DNA, 22 bp, Homo sapiens
ggctgagccatgggcactgcag

SEQ ID NO: 7595013 - DNA, 22 bp, Homo sapiens
ggctgagccatgggcactgcag

SEQ ID NO: 7595014 - DNA, 22 bp, Homo sapiens
ggctgagccatgggcactgcag

SEQ ID NO: 7595015 - DNA, 22 bp, Homo sapiens
ggctctgttctaaattaataag

SEQ ID NO: 7595016 - DNA, 22 bp, Homo sapiens
ggctctgtggctggccatgatg

SEQ ID NO: 7595017 - DNA, 22 bp, Homo sapiens
ggctctgtgtctccacccaaat

SEQ ID NO: 7595018 - DNA, 23 bp, Homo sapiens
ggctctgtgctgggcctgcagga

SEQ ID NO: 7595019 - DNA, 23 bp, Homo sapiens
ggctctgtgctgggcctgcagga

SEQ ID NO: 7595020 - DNA, 23 bp, Homo sapiens
ggctctgtgctaattgctgaaaa

SEQ ID NO: 7595021 - DNA, 23 bp, Homo sapiens
ggctctgtgctaattgctgaaaa

SEQ ID NO: 7595022 - DNA, 23 bp, Homo sapiens
ggctctgtgctgggcctgcagga

SEQ ID NO: 7595023 - DNA, 23 bp, Homo sapiens
ggctctgtgctgggcctgcagga

SEQ ID NO: 7595024 - DNA, 23 bp, Homo sapiens
ggctctgtgctgggcctgcagga

SEQ ID NO: 7595025 - DNA, 22 bp, Homo sapiens
ggctctgtcacctatgagctga

SEQ ID NO: 7595026 - DNA, 22 bp, Homo sapiens
ggctctgtgagaacaaaggcta

SEQ ID NO: 7595027 - DNA, 23 bp, Homo sapiens
ggctctgtgctaattgctgaaaa

SEQ ID NO: 7595028 - DNA, 22 bp, Homo sapiens
ggctctgtaagtgttgcaggta

SEQ ID NO: 7595029 - DNA, 22 bp, Homo sapiens
ggctctgtaagtgttgcaggta

SEQ ID NO: 7595030 - DNA, 22 bp, Homo sapiens
ggctctggttgaccatgatggc

SEQ ID NO: 7595031 - DNA, 22 bp, Homo sapiens
ggctctggttgaccatgatggc

SEQ ID NO: 7595032 - DNA, 22 bp, Homo sapiens
ggctctggttgaccatgatggc

SEQ ID NO: 7595033 - DNA, 22 bp, Homo sapiens
ggctctgtaaagtgacacctgc

SEQ ID NO: 7595034 - DNA, 22 bp, Homo sapiens
ggctctggtgtgaagcagcctc

SEQ ID NO: 7595035 - DNA, 22 bp, Homo sapiens
ggctctggtgtgaagcagcctc

SEQ ID NO: 7595036 - DNA, 22 bp, Homo sapiens
ggctctggtgtgaagcagcctc

SEQ ID NO: 7595037 - DNA, 22 bp, Homo sapiens
ggctctggtgtgaagcagcctc

SEQ ID NO: 7595038 - DNA, 22 bp, Homo sapiens
ggctctgggttctgcaatgcgt

SEQ ID NO: 7595039 - DNA, 22 bp, Homo sapiens
ggctctgggttctgcaatgcgt

SEQ ID NO: 7595040 - DNA, 22 bp, Homo sapiens
ggctctgggttctgcaatgcgt

SEQ ID NO: 7595041 - DNA, 22 bp, Homo sapiens
ggctctgggttctgcaatgcgt

SEQ ID NO: 7595042 - DNA, 22 bp, Homo sapiens
ggctctgggttctgcaatgcgt

SEQ ID NO: 7595043 - DNA, 22 bp, Homo sapiens
ggctctgggttctgcaatgcgt

SEQ ID NO: 7595044 - DNA, 22 bp, Homo sapiens
ggctctgggtgtgaccttgggt

SEQ ID NO: 7595045 - DNA, 22 bp, Homo sapiens
ggctctggttgaccatgatggc

SEQ ID NO: 7595046 - DNA, 22 bp, Homo sapiens
ggctctggtgtgaagcagcctc

SEQ ID NO: 7595047 - DNA, 22 bp, Homo sapiens
ggctctggttgaccatgatggc

SEQ ID NO: 7595048 - DNA, 22 bp, Homo sapiens
ggctctggttgaccatgatggc

SEQ ID NO: 7595049 - DNA, 22 bp, Homo sapiens
ggctctggttgaccatgatggc

SEQ ID NO: 7595050 - DNA, 22 bp, Homo sapiens
ggctctggttgaccatgatggc

SEQ ID NO: 7595051 - DNA, 22 bp, Homo sapiens
ggctctggtgtgaagcagcctc

SEQ ID NO: 7595052 - DNA, 22 bp, Homo sapiens
ggctctggtgtgaagcagcctc

SEQ ID NO: 7595053 - DNA, 22 bp, Homo sapiens
ggctctggtgtgaagcagcctc

SEQ ID NO: 7595054 - DNA, 22 bp, Homo sapiens
ggctctgggtgtgaccttgggt

SEQ ID NO: 7595055 - DNA, 22 bp, Homo sapiens
ggctctgggtgtgaccttgggt

SEQ ID NO: 7595056 - DNA, 22 bp, Homo sapiens
ggctctgggtgtgaccttgggt

SEQ ID NO: 7595057 - DNA, 22 bp, Homo sapiens
ggctctgggtgtgaccttgggt

SEQ ID NO: 7595058 - DNA, 22 bp, Homo sapiens
ggctctgggtgtgaccttgggt

SEQ ID NO: 7595059 - DNA, 17 bp, Homo sapiens
ggctctgggtgtcacat

SEQ ID NO: 7595060 - DNA, 17 bp, Homo sapiens
ggctctgggtgtcacat

SEQ ID NO: 7595061 - DNA, 17 bp, Homo sapiens
ggctctgggtgtcacat

SEQ ID NO: 7595062 - DNA, 22 bp, Homo sapiens
ggctctgggtgtgaccttgggt

SEQ ID NO: 7595063 - DNA, 17 bp, Homo sapiens
ggctctgggtgtcacat

SEQ ID NO: 7595064 - DNA, 17 bp, Homo sapiens
ggctctgggtgtcacat

SEQ ID NO: 7595065 - DNA, 17 bp, Homo sapiens
ggctctgggtgtcacat

SEQ ID NO: 7595066 - DNA, 22 bp, Homo sapiens
ggctctgggtctgtggggagcg

SEQ ID NO: 7595067 - DNA, 22 bp, Homo sapiens
ggctctgggtctgtggggagcg

SEQ ID NO: 7595068 - DNA, 17 bp, Homo sapiens
ggctctgggtgtcacat

SEQ ID NO: 7595069 - DNA, 22 bp, Homo sapiens
ggctctgggtctgtggggagcg

SEQ ID NO: 7595070 - DNA, 22 bp, Homo sapiens
ggctctgggtctgtggggagcg

SEQ ID NO: 7595071 - DNA, 22 bp, Homo sapiens
ggctctgggtctgtggggagcg

SEQ ID NO: 7595072 - DNA, 19 bp, Homo sapiens
ggctggagaaaggaatcag

SEQ ID NO: 7595073 - DNA, 19 bp, Homo sapiens
ggctggagaaaggaatcag

SEQ ID NO: 7595074 - DNA, 19 bp, Homo sapiens
ggctggagaaaggaatcag

SEQ ID NO: 7595075 - DNA, 22 bp, Homo sapiens
ggctggactttttgcaggtcat

SEQ ID NO: 7595076 - DNA, 19 bp, Homo sapiens
ggctggagaaaggaatcag

SEQ ID NO: 7595077 - DNA, 19 bp, Homo sapiens
ggctggagaaaggaatcag

SEQ ID NO: 7595078 - DNA, 19 bp, Homo sapiens
ggctggagaaaggaatcag

SEQ ID NO: 7595079 - DNA, 19 bp, Homo sapiens
ggctggagaaaggaatcag

SEQ ID NO: 7595080 - DNA, 19 bp, Homo sapiens
ggctggagaaaggaatcag

SEQ ID NO: 7595081 - DNA, 19 bp, Homo sapiens
ggctggagaaaggaatcag

SEQ ID NO: 7595082 - DNA, 19 bp, Homo sapiens
ggctggagaaaggaatcag

SEQ ID NO: 7595083 - DNA, 19 bp, Homo sapiens
ggctggagaaaggaatcag

SEQ ID NO: 7595084 - DNA, 19 bp, Homo sapiens
ggctggagaaaggaatcag

SEQ ID NO: 7595085 - DNA, 22 bp, Homo sapiens
ggctggagaagggtggttgaca

SEQ ID NO: 7595086 - DNA, 22 bp, Homo sapiens
ggctggagaagggtggttgaca

SEQ ID NO: 7595087 - DNA, 22 bp, Homo sapiens
ggctggagaagggtggttgaca

SEQ ID NO: 7595088 - DNA, 22 bp, Homo sapiens
ggctggagaagggtggttgaca

SEQ ID NO: 7595089 - DNA, 22 bp, Homo sapiens
ggctggagaagggtggttgaca

SEQ ID NO: 7595090 - DNA, 22 bp, Homo sapiens
ggctggagaagggtggttgaca

SEQ ID NO: 7595091 - DNA, 22 bp, Homo sapiens
ggctggactttttgcaggtcat

SEQ ID NO: 7595092 - DNA, 22 bp, Homo sapiens
ggctggactttctgctgggctc

SEQ ID NO: 7595093 - DNA, 22 bp, Homo sapiens
ggctggactttctgctgggctc

SEQ ID NO: 7595094 - DNA, 22 bp, Homo sapiens
ggctggactttctgctgggctc

SEQ ID NO: 7595095 - DNA, 22 bp, Homo sapiens
ggctggactttctgctgggctc

SEQ ID NO: 7595096 - DNA, 22 bp, Homo sapiens
ggctggacttggtcctgttttg

SEQ ID NO: 7595097 - DNA, 22 bp, Homo sapiens
ggctggactgcctcccagagtc

SEQ ID NO: 7595098 - DNA, 21 bp, Homo sapiens
ggctggactgtgctttccttc

SEQ ID NO: 7595099 - DNA, 22 bp, Homo sapiens
ggctggactttctgctgggctc

SEQ ID NO: 7595100 - DNA, 22 bp, Homo sapiens
ggctggactttctgctgggctc

SEQ ID NO: 7595101 - DNA, 22 bp, Homo sapiens
ggctggactttctgctgggctc

SEQ ID NO: 7595102 - DNA, 22 bp, Homo sapiens
ggctggaccatgctgccccttc

SEQ ID NO: 7595103 - DNA, 22 bp, Homo sapiens
ggctggacatgagcttggcagt

SEQ ID NO: 7595104 - DNA, 21 bp, Homo sapiens
ggctggacatcccaggagact

SEQ ID NO: 7595105 - DNA, 22 bp, Homo sapiens
ggctggacatgagcttggcagt

SEQ ID NO: 7595106 - DNA, 22 bp, Homo sapiens
ggctggacatgagcttggcagt

SEQ ID NO: 7595107 - DNA, 22 bp, Homo sapiens
ggctggactgcctcccagagtc

SEQ ID NO: 7595108 - DNA, 22 bp, Homo sapiens
ggctggactgcctcccagagtc

SEQ ID NO: 7595109 - DNA, 22 bp, Homo sapiens
ggctggactgcctcccagagtc

SEQ ID NO: 7595110 - DNA, 22 bp, Homo sapiens
ggctggactctgggcctctcca

SEQ ID NO: 7595111 - DNA, 22 bp, Homo sapiens
ggctggactctgggcctctcca

SEQ ID NO: 7595112 - DNA, 22 bp, Homo sapiens
ggctgggtacagggcagtgtgc

SEQ ID NO: 7595113 - DNA, 22 bp, Homo sapiens
ggctgggtacagggcagtgtgc

SEQ ID NO: 7595114 - DNA, 22 bp, Homo sapiens
ggctgggtacagggcagtgtgc

SEQ ID NO: 7595115 - DNA, 22 bp, Homo sapiens
ggctgggtacagggcagtgtgc

SEQ ID NO: 7595116 - DNA, 22 bp, Homo sapiens
ggctgggtacagggcagtgtgc

SEQ ID NO: 7595117 - DNA, 22 bp, Homo sapiens
ggctggagacaacgtcctgccc

SEQ ID NO: 7595118 - DNA, 22 bp, Homo sapiens
ggctggagacaacgtcctgccc

SEQ ID NO: 7595119 - DNA, 22 bp, Homo sapiens
ggctggagaagggtggttgaca

SEQ ID NO: 7595120 - DNA, 22 bp, Homo sapiens
ggctggagacaacgtcctgccc

SEQ ID NO: 7595121 - DNA, 22 bp, Homo sapiens
ggctgggtaccctgtttcccct

SEQ ID NO: 7595122 - DNA, 22 bp, Homo sapiens
ggctgggtacagggcagtgtgc

SEQ ID NO: 7595123 - DNA, 22 bp, Homo sapiens
ggctgggtaccctgtttcccct

SEQ ID NO: 7595124 - DNA, 22 bp, Homo sapiens
ggctgggtaccctgtttcccct

SEQ ID NO: 7595125 - DNA, 21 bp, Homo sapiens
ggctgggtcatgcagctggcc

SEQ ID NO: 7595126 - DNA, 21 bp, Homo sapiens
ggctgggtcatgcagctggcc

SEQ ID NO: 7595127 - DNA, 21 bp, Homo sapiens
ggctgggtcatgcagctggcc

SEQ ID NO: 7595128 - DNA, 21 bp, Homo sapiens
ggctgggtcatgcagctggcc

SEQ ID NO: 7595129 - DNA, 21 bp, Homo sapiens
ggctgggtcatgcagctggcc

SEQ ID NO: 7595130 - DNA, 21 bp, Homo sapiens
ggctgggtcatgcagctggcc

SEQ ID NO: 7595131 - DNA, 21 bp, Homo sapiens
ggctgggtcatgcagctggcc

SEQ ID NO: 7595132 - DNA, 19 bp, Homo sapiens
ggctgggtctggcaggttc

SEQ ID NO: 7595133 - DNA, 22 bp, Homo sapiens
ggctgggtcccagctgggagga

SEQ ID NO: 7595134 - DNA, 22 bp, Homo sapiens
ggctgggtcccagctgggagga

SEQ ID NO: 7595135 - DNA, 19 bp, Homo sapiens
ggctgggtctggcaggttc

SEQ ID NO: 7595136 - DNA, 22 bp, Homo sapiens
ggctgggttatttatggccaag

SEQ ID NO: 7595137 - DNA, 19 bp, Homo sapiens
ggctgggtctggcaggttc

SEQ ID NO: 7595138 - DNA, 19 bp, Homo sapiens
ggctgggtctggcaggttc

SEQ ID NO: 7595139 - DNA, 19 bp, Homo sapiens
ggctgggtctggcaggttc

SEQ ID NO: 7595140 - DNA, 19 bp, Homo sapiens
ggctgggtctggcaggttc

SEQ ID NO: 7595141 - DNA, 19 bp, Homo sapiens
ggctgggtctggcaggttc

SEQ ID NO: 7595142 - DNA, 22 bp, Homo sapiens
ggctgggtcccagctgggagga

SEQ ID NO: 7595143 - DNA, 21 bp, Homo sapiens
ggctgggtcatgcagctggcc

SEQ ID NO: 7595144 - DNA, 21 bp, Homo sapiens
ggctgggtcatgcagctggcc

SEQ ID NO: 7595145 - DNA, 22 bp, Homo sapiens
ggctgggtcccagctgggagga

SEQ ID NO: 7595146 - DNA, 22 bp, Homo sapiens
ggctgggtcccagctgggagga

SEQ ID NO: 7595147 - DNA, 22 bp, Homo sapiens
ggctgggtcccagctgggagga

SEQ ID NO: 7595148 - DNA, 22 bp, Homo sapiens
ggctgggtcccagctgggagga

SEQ ID NO: 7595149 - DNA, 22 bp, Homo sapiens
ggctgggtcccagctgggagga

SEQ ID NO: 7595150 - DNA, 22 bp, Homo sapiens
ggctgggtcccagctgggagga

SEQ ID NO: 7595151 - DNA, 22 bp, Homo sapiens
ggctgtgattggtggatgtgaa

SEQ ID NO: 7595152 - DNA, 22 bp, Homo sapiens
ggctgtgagcaggcagaatgct

SEQ ID NO: 7595153 - DNA, 22 bp, Homo sapiens
ggctgtgagtttgtcctccatg

SEQ ID NO: 7595154 - DNA, 22 bp, Homo sapiens
ggctgtgatgcaattaacacgg

SEQ ID NO: 7595155 - DNA, 21 bp, Homo sapiens
ggctgtgacgctgctccacag

SEQ ID NO: 7595156 - DNA, 22 bp, Homo sapiens
ggctgtgacccccacaggggtg

SEQ ID NO: 7595157 - DNA, 22 bp, Homo sapiens
ggctgtgacccccacaggggtg

SEQ ID NO: 7595158 - DNA, 22 bp, Homo sapiens
ggctgtgacccccacaggggtg

SEQ ID NO: 7595159 - DNA, 22 bp, Homo sapiens
ggctgtgacccccacaggggtg

SEQ ID NO: 7595160 - DNA, 22 bp, Homo sapiens
ggctgtgacccccacaggggtg

SEQ ID NO: 7595161 - DNA, 22 bp, Homo sapiens
ggctgtgagcaggcagaatgct

SEQ ID NO: 7595162 - DNA, 21 bp, Homo sapiens
ggctgtgacgctgctccacag

SEQ ID NO: 7595163 - DNA, 22 bp, Homo sapiens
ggctgtgagcaggcagaatgct

SEQ ID NO: 7595164 - DNA, 22 bp, Homo sapiens
ggctgtgagcaggcagaatgct

SEQ ID NO: 7595165 - DNA, 22 bp, Homo sapiens
ggctgtgacaaggctgcgggaa

SEQ ID NO: 7595166 - DNA, 22 bp, Homo sapiens
ggctgtgacaaggctgcgggaa

SEQ ID NO: 7595167 - DNA, 22 bp, Homo sapiens
ggctgtgaagtagcaggggcag

SEQ ID NO: 7595168 - DNA, 22 bp, Homo sapiens
ggctggtggggaaagaggacca

SEQ ID NO: 7595169 - DNA, 22 bp, Homo sapiens
ggctggtggggaaagaggacca

SEQ ID NO: 7595170 - DNA, 22 bp, Homo sapiens
ggctggtggggaaagaggacca

SEQ ID NO: 7595171 - DNA, 22 bp, Homo sapiens
ggctggtggggaaagaggacca

SEQ ID NO: 7595172 - DNA, 22 bp, Homo sapiens
ggctgtgcagggcagagtctca

SEQ ID NO: 7595173 - DNA, 22 bp, Homo sapiens
ggctgtgattggtggatgtgaa

SEQ ID NO: 7595174 - DNA, 22 bp, Homo sapiens
ggctgtgcaccatccacctccc

SEQ ID NO: 7595175 - DNA, 22 bp, Homo sapiens
ggctgtgcaccatccacctccc

SEQ ID NO: 7595176 - DNA, 17 bp, Homo sapiens
ggctgtgccaggtgaga

SEQ ID NO: 7595177 - DNA, 17 bp, Homo sapiens
ggctgtgccaggtgaga

SEQ ID NO: 7595178 - DNA, 17 bp, Homo sapiens
ggctgtgccaggtgaga

SEQ ID NO: 7595179 - DNA, 23 bp, Homo sapiens
ggctgtgcagcctgcggcaaaag

SEQ ID NO: 7595180 - DNA, 22 bp, Homo sapiens
ggctgtgcagggcagagtctca

SEQ ID NO: 7595181 - DNA, 22 bp, Homo sapiens
ggctgtgccctcacatggggca

SEQ ID NO: 7595182 - DNA, 22 bp, Homo sapiens
ggctgtgccctcacatggggca

SEQ ID NO: 7595183 - DNA, 17 bp, Homo sapiens
ggctgtgccaggtgaga

SEQ ID NO: 7595184 - DNA, 17 bp, Homo sapiens
ggctgtgccaggtgaga

SEQ ID NO: 7595185 - DNA, 20 bp, Homo sapiens
ggctgtgcccttccgtggcc

SEQ ID NO: 7595186 - DNA, 17 bp, Homo sapiens
ggctgtgccaggtgaga

SEQ ID NO: 7595187 - DNA, 22 bp, Homo sapiens
ggctgtgccctcacatggggca

SEQ ID NO: 7595188 - DNA, 22 bp, Homo sapiens
ggctgggtttgactcctggctt

SEQ ID NO: 7595189 - DNA, 22 bp, Homo sapiens
ggctgggtttgactcctggctt

SEQ ID NO: 7595190 - DNA, 22 bp, Homo sapiens
ggctgggttctgagaaagagta

SEQ ID NO: 7595191 - DNA, 22 bp, Homo sapiens
ggctgggttctgagaaagagta

SEQ ID NO: 7595192 - DNA, 22 bp, Homo sapiens
ggctgggttctgagaaagagta

SEQ ID NO: 7595193 - DNA, 22 bp, Homo sapiens
ggctgggttctgagaaagagta

SEQ ID NO: 7595194 - DNA, 22 bp, Homo sapiens
ggctgggttctgagaaagagta

SEQ ID NO: 7595195 - DNA, 22 bp, Homo sapiens
ggctgggttctgagaaagagta

SEQ ID NO: 7595196 - DNA, 22 bp, Homo sapiens
ggctgggttatttatggccaag

SEQ ID NO: 7595197 - DNA, 19 bp, Homo sapiens
ggctgggtctggcaggttc

SEQ ID NO: 7595198 - DNA, 22 bp, Homo sapiens
ggctgggttatttatggccaag

SEQ ID NO: 7595199 - DNA, 22 bp, Homo sapiens
ggctggtcaggaaactaggctc

SEQ ID NO: 7595200 - DNA, 22 bp, Homo sapiens
ggctggtcaggaaactaggctc

SEQ ID NO: 7595201 - DNA, 22 bp, Homo sapiens
ggctggtcacaccactgcaggg

SEQ ID NO: 7595202 - DNA, 22 bp, Homo sapiens
ggctggtcacaccactgcaggg

SEQ ID NO: 7595203 - DNA, 22 bp, Homo sapiens
ggctggtcacaccactgcaggg

SEQ ID NO: 7595204 - DNA, 21 bp, Homo sapiens
ggctggtcgcgtgcatgtctc

SEQ ID NO: 7595205 - DNA, 22 bp, Homo sapiens
ggctggtcctttctctgtccta

SEQ ID NO: 7595206 - DNA, 22 bp, Homo sapiens
ggctggtcctttctctgtccta

SEQ ID NO: 7595207 - DNA, 22 bp, Homo sapiens
ggctggtcccgggtcctccggc

SEQ ID NO: 7595208 - DNA, 22 bp, Homo sapiens
ggctggtctcagtgctgggttc

SEQ ID NO: 7595209 - DNA, 21 bp, Homo sapiens
ggctggtcgcgtgcatgtctc

SEQ ID NO: 7595210 - DNA, 22 bp, Homo sapiens
ggctggtgagttcagagaaccc

SEQ ID NO: 7595211 - DNA, 22 bp, Homo sapiens
ggctggtgagttcagagaaccc

SEQ ID NO: 7595212 - DNA, 22 bp, Homo sapiens
ggctggtgagttcagagaaccc

SEQ ID NO: 7595213 - DNA, 23 bp, Homo sapiens
ggctggtgcccttggccagtcgg

SEQ ID NO: 7595214 - DNA, 23 bp, Homo sapiens
ggctggtgcccttggccagtcgg

SEQ ID NO: 7595215 - DNA, 23 bp, Homo sapiens
ggctggtgcccttggccagtcgg

SEQ ID NO: 7595216 - DNA, 23 bp, Homo sapiens
ggctggtgcccttggccagtcgg

SEQ ID NO: 7595217 - DNA, 23 bp, Homo sapiens
ggctggtgcccttggccagtcgg

SEQ ID NO: 7595218 - DNA, 23 bp, Homo sapiens
ggctggtgcccttggccagtcgg

SEQ ID NO: 7595219 - DNA, 23 bp, Homo sapiens
ggctggtgcccttggccagtcgg

SEQ ID NO: 7595220 - DNA, 23 bp, Homo sapiens
ggctggtgcccttggccagtcgg

SEQ ID NO: 7595221 - DNA, 22 bp, Homo sapiens
ggctggtggggaaagaggacca

SEQ ID NO: 7595222 - DNA, 23 bp, Homo sapiens
ggctggtgcccttggccagtcgg

SEQ ID NO: 7595223 - DNA, 22 bp, Homo sapiens
ggctggtggggaaagaggacca

SEQ ID NO: 7595224 - DNA, 22 bp, Homo sapiens
ggctgctggggacgtgggagag

SEQ ID NO: 7595225 - DNA, 22 bp, Homo sapiens
ggctgctggggacgtgggagag

SEQ ID NO: 7595226 - DNA, 22 bp, Homo sapiens
ggctgctggggacgtgggagag

SEQ ID NO: 7595227 - DNA, 22 bp, Homo sapiens
ggctgctggggacgtgggagag

SEQ ID NO: 7595228 - DNA, 21 bp, Homo sapiens
ggctgctgggggttggcacag

SEQ ID NO: 7595229 - DNA, 22 bp, Homo sapiens
ggctgctgggtcatgatgcaga

SEQ ID NO: 7595230 - DNA, 22 bp, Homo sapiens
ggctgctgggtcatgatgcaga

SEQ ID NO: 7595231 - DNA, 21 bp, Homo sapiens
ggctgctgggggttggcacag

SEQ ID NO: 7595232 - DNA, 22 bp, Homo sapiens
ggctgagttctcttgctgaatc

SEQ ID NO: 7595233 - DNA, 22 bp, Homo sapiens
ggctgagttctcttgctgaatc

SEQ ID NO: 7595234 - DNA, 22 bp, Homo sapiens
ggctgagttgagaggattactt

SEQ ID NO: 7595235 - DNA, 22 bp, Homo sapiens
ggctgagttgagaggattactt

SEQ ID NO: 7595236 - DNA, 22 bp, Homo sapiens
ggctgctggggacgtgggagag

SEQ ID NO: 7595237 - DNA, 22 bp, Homo sapiens
ggctgctggggacgtgggagag

SEQ ID NO: 7595238 - DNA, 22 bp, Homo sapiens
ggctgagttctcttgctgaatc

SEQ ID NO: 7595239 - DNA, 22 bp, Homo sapiens
ggctgctggggacgtgggagag

SEQ ID NO: 7595240 - DNA, 22 bp, Homo sapiens
ggctgctggggacgtgggagag

SEQ ID NO: 7595241 - DNA, 22 bp, Homo sapiens
ggctgctgtttcagagactgtt

SEQ ID NO: 7595242 - DNA, 22 bp, Homo sapiens
ggctgcttaaacagatgtgctg

SEQ ID NO: 7595243 - DNA, 22 bp, Homo sapiens
ggctgctgtttcagagactgtt

SEQ ID NO: 7595244 - DNA, 22 bp, Homo sapiens
ggctgctgtttcagagactgtt

SEQ ID NO: 7595245 - DNA, 20 bp, Homo sapiens
ggctgctgtgggcagagagg

SEQ ID NO: 7595246 - DNA, 22 bp, Homo sapiens
ggctgctgtttcagagactgtt

SEQ ID NO: 7595247 - DNA, 22 bp, Homo sapiens
ggctgctgtttcagagactgtt

SEQ ID NO: 7595248 - DNA, 20 bp, Homo sapiens
ggctgctgtgggcagagagg

SEQ ID NO: 7595249 - DNA, 20 bp, Homo sapiens
ggctgctgtgggcagagagg

SEQ ID NO: 7595250 - DNA, 20 bp, Homo sapiens
ggctgctgtgggcagagagg

SEQ ID NO: 7595251 - DNA, 20 bp, Homo sapiens
ggctgctgtgggcagagagg

SEQ ID NO: 7595252 - DNA, 20 bp, Homo sapiens
ggctgctgtgggcagagagg

SEQ ID NO: 7595253 - DNA, 22 bp, Homo sapiens
ggctgctttgtagcttttgcca

SEQ ID NO: 7595254 - DNA, 22 bp, Homo sapiens
ggctggaaaagacaaagctatt

SEQ ID NO: 7595255 - DNA, 22 bp, Homo sapiens
ggctggaaactcaggtagggtt

SEQ ID NO: 7595256 - DNA, 22 bp, Homo sapiens
ggctggaaactcaggtagggtt

SEQ ID NO: 7595257 - DNA, 22 bp, Homo sapiens
ggctggaaggtagaagatgagg

SEQ ID NO: 7595258 - DNA, 22 bp, Homo sapiens
ggctggaaggccctttgttgat

SEQ ID NO: 7595259 - DNA, 22 bp, Homo sapiens
ggctggaaggtagaagatgagg

SEQ ID NO: 7595260 - DNA, 22 bp, Homo sapiens
ggctggaagagactgaggacac

SEQ ID NO: 7595261 - DNA, 22 bp, Homo sapiens
ggctggaagagactgaggacac

SEQ ID NO: 7595262 - DNA, 18 bp, Homo sapiens
ggctggaagctgttgctg

SEQ ID NO: 7595263 - DNA, 22 bp, Homo sapiens
ggctggaaaggatattttaggt

SEQ ID NO: 7595264 - DNA, 22 bp, Homo sapiens
ggctggaaccagagtgaggcag

SEQ ID NO: 7595265 - DNA, 22 bp, Homo sapiens
ggctggaaccagagtgaggcag

SEQ ID NO: 7595266 - DNA, 22 bp, Homo sapiens
ggctggaaccagagtgaggcag

SEQ ID NO: 7595267 - DNA, 22 bp, Homo sapiens
ggctggaacttcttctggcatt

SEQ ID NO: 7595268 - DNA, 22 bp, Homo sapiens
ggctggaacttcttctggcatt

SEQ ID NO: 7595269 - DNA, 23 bp, Homo sapiens
ggctggaagaaaacagaattgtt

SEQ ID NO: 7595270 - DNA, 21 bp, Homo sapiens
ggctggacatcccaggagact

SEQ ID NO: 7595271 - DNA, 21 bp, Homo sapiens
ggctggacatcccaggagact

SEQ ID NO: 7595272 - DNA, 21 bp, Homo sapiens
ggctggacatcccaggagact

SEQ ID NO: 7595273 - DNA, 21 bp, Homo sapiens
ggctggacatcccaggagact

SEQ ID NO: 7595274 - DNA, 22 bp, Homo sapiens
ggctggacatagacatagccat

SEQ ID NO: 7595275 - DNA, 21 bp, Homo sapiens
ggctggacatcccaggagact

SEQ ID NO: 7595276 - DNA, 22 bp, Homo sapiens
ggctggacatagacatagccat

SEQ ID NO: 7595277 - DNA, 22 bp, Homo sapiens
ggctggacatagacatagccat

SEQ ID NO: 7595278 - DNA, 22 bp, Homo sapiens
ggctggacatagacatagccat

SEQ ID NO: 7595279 - DNA, 22 bp, Homo sapiens
ggctggaatgtgtggatgtgat

SEQ ID NO: 7595280 - DNA, 22 bp, Homo sapiens
ggctggaatgtgtggatgtgat

SEQ ID NO: 7595281 - DNA, 22 bp, Homo sapiens
ggctggacatagacatagccat

SEQ ID NO: 7595282 - DNA, 22 bp, Homo sapiens
ggctggaatgtgtggatgtgat

SEQ ID NO: 7595283 - DNA, 22 bp, Homo sapiens
ggctggaatgcaactgtgtgtt

SEQ ID NO: 7595284 - DNA, 22 bp, Homo sapiens
ggctggaatgtgtggatgtgat

SEQ ID NO: 7595285 - DNA, 22 bp, Homo sapiens
ggctggaatgtgtggatgtgat

SEQ ID NO: 7595286 - DNA, 22 bp, Homo sapiens
ggctggaatgcaactgtgtgtt

SEQ ID NO: 7595287 - DNA, 22 bp, Homo sapiens
ggctggaatagagactgactgg

SEQ ID NO: 7595288 - DNA, 22 bp, Homo sapiens
ggctggaagtccaagatcaaga

SEQ ID NO: 7595289 - DNA, 22 bp, Homo sapiens
ggctggaagtccaagatcaagg

SEQ ID NO: 7595290 - DNA, 20 bp, Homo sapiens
ggctggaagtgtgggtttgg

SEQ ID NO: 7595291 - DNA, 20 bp, Homo sapiens
ggctggaagtgtgggtttgg

SEQ ID NO: 7595292 - DNA, 22 bp, Homo sapiens
ggctgagggccagggctagtct

SEQ ID NO: 7595293 - DNA, 22 bp, Homo sapiens
ggctgagggccagggctagtct

SEQ ID NO: 7595294 - DNA, 22 bp, Homo sapiens
ggctgagggccagggctagtct

SEQ ID NO: 7595295 - DNA, 22 bp, Homo sapiens
ggctgagggccagggctagtct

SEQ ID NO: 7595296 - DNA, 22 bp, Homo sapiens
ggctgagggccagggctagtct

SEQ ID NO: 7595297 - DNA, 22 bp, Homo sapiens
ggctgagggccagggctagtct

SEQ ID NO: 7595298 - DNA, 22 bp, Homo sapiens
ggctgagggccagggctagtct

SEQ ID NO: 7595299 - DNA, 22 bp, Homo sapiens
ggctgaggggcccagaggaaca

SEQ ID NO: 7595300 - DNA, 22 bp, Homo sapiens
ggctgagggccagggctagtct

SEQ ID NO: 7595301 - DNA, 22 bp, Homo sapiens
ggctgagggccagggctagtct

SEQ ID NO: 7595302 - DNA, 22 bp, Homo sapiens
ggctgaggggcccagaggaaca

SEQ ID NO: 7595303 - DNA, 22 bp, Homo sapiens
ggctgaggggcccagaggaaca

SEQ ID NO: 7595304 - DNA, 22 bp, Homo sapiens
ggctgaggggcccagaggaaca

SEQ ID NO: 7595305 - DNA, 22 bp, Homo sapiens
ggctgaggggcccagaggaaca

SEQ ID NO: 7595306 - DNA, 22 bp, Homo sapiens
ggctgagggtatagctgtccca

SEQ ID NO: 7595307 - DNA, 22 bp, Homo sapiens
ggctgagggtatagctgtccca

SEQ ID NO: 7595308 - DNA, 22 bp, Homo sapiens
ggctgagggtatagctgtccca

SEQ ID NO: 7595309 - DNA, 22 bp, Homo sapiens
ggctgagggtatagctgtccca

SEQ ID NO: 7595310 - DNA, 22 bp, Homo sapiens
ggctgaggggcccagaggaaca

SEQ ID NO: 7595311 - DNA, 22 bp, Homo sapiens
ggctgaggggcccagaggaaca

SEQ ID NO: 7595312 - DNA, 22 bp, Homo sapiens
ggctgagggtatagctgtccca

SEQ ID NO: 7595313 - DNA, 22 bp, Homo sapiens
ggctgaggggcccagaggaaca

SEQ ID NO: 7595314 - DNA, 22 bp, Homo sapiens
ggctgagggtcccagaccctaa

SEQ ID NO: 7595315 - DNA, 22 bp, Homo sapiens
ggctgagggtcccagaccctaa

SEQ ID NO: 7595316 - DNA, 22 bp, Homo sapiens
ggctgagggtatagctgtccca

SEQ ID NO: 7595317 - DNA, 22 bp, Homo sapiens
ggctgagggtcccagaccctaa

SEQ ID NO: 7595318 - DNA, 22 bp, Homo sapiens
ggctgagggtcccagaccctaa

SEQ ID NO: 7595319 - DNA, 22 bp, Homo sapiens
ggctgagggtatagctgtccca

SEQ ID NO: 7595320 - DNA, 22 bp, Homo sapiens
ggctgagggtatagctgtccca

SEQ ID NO: 7595321 - DNA, 22 bp, Homo sapiens
ggctgagggtatagctgtccca

SEQ ID NO: 7595322 - DNA, 22 bp, Homo sapiens
ggctgagggtatagctgtccca

SEQ ID NO: 7595323 - DNA, 22 bp, Homo sapiens
ggctgagtctgtgacccatgcg

SEQ ID NO: 7595324 - DNA, 22 bp, Homo sapiens
ggctgagtggaggtagccctgt

SEQ ID NO: 7595325 - DNA, 22 bp, Homo sapiens
ggctgagtgctgctgttcacga

SEQ ID NO: 7595326 - DNA, 22 bp, Homo sapiens
ggctgagtggctgggtctagtt

SEQ ID NO: 7595327 - DNA, 22 bp, Homo sapiens
ggctgagtggctgggtctagtt

SEQ ID NO: 7595328 - DNA, 22 bp, Homo sapiens
ggctgagtggctgggtctagtt

SEQ ID NO: 7595329 - DNA, 22 bp, Homo sapiens
ggctgagtggctgggtctagtt

SEQ ID NO: 7595330 - DNA, 22 bp, Homo sapiens
ggctgagtggaggtagccctgt

SEQ ID NO: 7595331 - DNA, 18 bp, Homo sapiens
ggctgaggttgactagaa

SEQ ID NO: 7595332 - DNA, 18 bp, Homo sapiens
ggctgaggttgactagaa

SEQ ID NO: 7595333 - DNA, 18 bp, Homo sapiens
ggctgaggttgactagaa

SEQ ID NO: 7595334 - DNA, 18 bp, Homo sapiens
ggctgaggttgactagaa

SEQ ID NO: 7595335 - DNA, 18 bp, Homo sapiens
ggctgaggttgactagaa

SEQ ID NO: 7595336 - DNA, 22 bp, Homo sapiens
ggctgaggtgtggggaactata

SEQ ID NO: 7595337 - DNA, 18 bp, Homo sapiens
ggctgaggttgactagaa

SEQ ID NO: 7595338 - DNA, 18 bp, Homo sapiens
ggctgaggttgactagaa

SEQ ID NO: 7595339 - DNA, 18 bp, Homo sapiens
ggctgaggttgactagaa

SEQ ID NO: 7595340 - DNA, 18 bp, Homo sapiens
ggctgaggttgactagaa

SEQ ID NO: 7595341 - DNA, 22 bp, Homo sapiens
ggctgaggtgtggggaactata

SEQ ID NO: 7595342 - DNA, 22 bp, Homo sapiens
ggctgaggtgtggggaactata

SEQ ID NO: 7595343 - DNA, 18 bp, Homo sapiens
ggctgaggttgactagaa

SEQ ID NO: 7595344 - DNA, 22 bp, Homo sapiens
ggctgaggtgtggggaactata

SEQ ID NO: 7595345 - DNA, 22 bp, Homo sapiens
ggctgagggttaagatcagaca

SEQ ID NO: 7595346 - DNA, 22 bp, Homo sapiens
ggctgaggtgtggggaactata

SEQ ID NO: 7595347 - DNA, 22 bp, Homo sapiens
ggctgaggtgtggggaactata

SEQ ID NO: 7595348 - DNA, 22 bp, Homo sapiens
ggctgaggtgtggggaactata

SEQ ID NO: 7595349 - DNA, 22 bp, Homo sapiens
ggctgagggtcccagaccctaa

SEQ ID NO: 7595350 - DNA, 22 bp, Homo sapiens
ggctgagggttaagatcagaca

SEQ ID NO: 7595351 - DNA, 22 bp, Homo sapiens
ggctgagggttaagatcagaca

SEQ ID NO: 7595352 - DNA, 22 bp, Homo sapiens
ggctgagggttaagatcagaca

SEQ ID NO: 7595353 - DNA, 22 bp, Homo sapiens
ggctgagggtcccagaccctaa

SEQ ID NO: 7595354 - DNA, 22 bp, Homo sapiens
ggctgagggttaagatcagaca

SEQ ID NO: 7595355 - DNA, 22 bp, Homo sapiens
ggctgagggttaagatcagaca

SEQ ID NO: 7595356 - DNA, 22 bp, Homo sapiens
ggagaggcgatgagtcacagcc

SEQ ID NO: 7595357 - DNA, 22 bp, Homo sapiens
ggagaggcgatgagtcacagcc

SEQ ID NO: 7595358 - DNA, 22 bp, Homo sapiens
ggagaggcgatgagtcacagcc

SEQ ID NO: 7595359 - DNA, 22 bp, Homo sapiens
ggagaggcgatgagtcacagcc

SEQ ID NO: 7595360 - DNA, 22 bp, Homo sapiens
ggagaggcgatgagtcacagcc

SEQ ID NO: 7595361 - DNA, 22 bp, Homo sapiens
ggagaggcgatgagtcacagcc

SEQ ID NO: 7595362 - DNA, 22 bp, Homo sapiens
ggagaggcgatgagtcacagcc

SEQ ID NO: 7595363 - DNA, 22 bp, Homo sapiens
ggagaggcgatgagtcacagcc

SEQ ID NO: 7595364 - DNA, 22 bp, Homo sapiens
ggagaggagctattgggggctc

SEQ ID NO: 7595365 - DNA, 22 bp, Homo sapiens
ggagaggcgatgagtcacagcc

SEQ ID NO: 7595366 - DNA, 22 bp, Homo sapiens
ggagaggatgttttagtaactt

SEQ ID NO: 7595367 - DNA, 22 bp, Homo sapiens
ggagaggatgttttagtaactt

SEQ ID NO: 7595368 - DNA, 22 bp, Homo sapiens
ggagaggagctattgggggctc

SEQ ID NO: 7595369 - DNA, 22 bp, Homo sapiens
ggagaggagctattgggggctc

SEQ ID NO: 7595370 - DNA, 22 bp, Homo sapiens
ggagaggagctattgggggctc

SEQ ID NO: 7595371 - DNA, 19 bp, Homo sapiens
ggagaggctggagggatgc

SEQ ID NO: 7595372 - DNA, 19 bp, Homo sapiens
ggagaggctggagggatgc

SEQ ID NO: 7595373 - DNA, 19 bp, Homo sapiens
ggagaggctggagggatgc

SEQ ID NO: 7595374 - DNA, 19 bp, Homo sapiens
ggagaggctggagggatgc

SEQ ID NO: 7595375 - DNA, 19 bp, Homo sapiens
ggagaggctggagggatgc

SEQ ID NO: 7595376 - DNA, 19 bp, Homo sapiens
ggagaggctggagggatgc

SEQ ID NO: 7595377 - DNA, 19 bp, Homo sapiens
ggagaggctggagggatgc

SEQ ID NO: 7595378 - DNA, 22 bp, Homo sapiens
ggagaggcgatgagtcacagcc

SEQ ID NO: 7595379 - DNA, 22 bp, Homo sapiens
ggagaggcttccagagtcgtgc

SEQ ID NO: 7595380 - DNA, 19 bp, Homo sapiens
ggagaggctggagggatgc

SEQ ID NO: 7595381 - DNA, 22 bp, Homo sapiens
ggagaggcttccagagtcgtgc

SEQ ID NO: 7595382 - DNA, 22 bp, Homo sapiens
ggagaggcttccagagtcgtgc

SEQ ID NO: 7595383 - DNA, 22 bp, Homo sapiens
ggagaggcttccagagtcgtgc

SEQ ID NO: 7595384 - DNA, 22 bp, Homo sapiens
ggagaggcttccagagtcgtgc

SEQ ID NO: 7595385 - DNA, 22 bp, Homo sapiens
ggagaggcttccagagtcgtgc

SEQ ID NO: 7595386 - DNA, 22 bp, Homo sapiens
ggagagctggtatatgaagaca

SEQ ID NO: 7595387 - DNA, 22 bp, Homo sapiens
ggagagctggtatatgaagaca

SEQ ID NO: 7595388 - DNA, 22 bp, Homo sapiens
ggagagctggtatatgaagaca

SEQ ID NO: 7595389 - DNA, 22 bp, Homo sapiens
ggagagcttggagtgcgatttt

SEQ ID NO: 7595390 - DNA, 22 bp, Homo sapiens
ggagagcttggagtgcgatttt

SEQ ID NO: 7595391 - DNA, 22 bp, Homo sapiens
ggagagcttggagtgcgatttt

SEQ ID NO: 7595392 - DNA, 22 bp, Homo sapiens
ggagagcttggagtgcgatttt

SEQ ID NO: 7595393 - DNA, 22 bp, Homo sapiens
ggagagcttggagtgcgatttt

SEQ ID NO: 7595394 - DNA, 22 bp, Homo sapiens
ggagagcttggagtgcgatttt

SEQ ID NO: 7595395 - DNA, 22 bp, Homo sapiens
ggagaggaaatgccagcacttc

SEQ ID NO: 7595396 - DNA, 22 bp, Homo sapiens
ggagaggaaatgccagcacttc

SEQ ID NO: 7595397 - DNA, 22 bp, Homo sapiens
ggagaggaaatgccagcacttc

SEQ ID NO: 7595398 - DNA, 22 bp, Homo sapiens
ggagaggaaatgccagcacttc

SEQ ID NO: 7595399 - DNA, 22 bp, Homo sapiens
ggagaggaaatgccagcacttc

SEQ ID NO: 7595400 - DNA, 22 bp, Homo sapiens
ggagagcttggagtgcgatttt

SEQ ID NO: 7595401 - DNA, 22 bp, Homo sapiens
ggagaggaaatgccagcacttc

SEQ ID NO: 7595402 - DNA, 22 bp, Homo sapiens
ggagaggaaatgccagcacttc

SEQ ID NO: 7595403 - DNA, 22 bp, Homo sapiens
ggagaggaaatgccagcacttc

SEQ ID NO: 7595404 - DNA, 22 bp, Homo sapiens
ggagaggaaatgccagcacttc

SEQ ID NO: 7595405 - DNA, 22 bp, Homo sapiens
ggagaggaaatgccagcacttc

SEQ ID NO: 7595406 - DNA, 22 bp, Homo sapiens
ggagaggaaatgccagcacttc

SEQ ID NO: 7595407 - DNA, 22 bp, Homo sapiens
ggagaggagctattgggggctc

SEQ ID NO: 7595408 - DNA, 22 bp, Homo sapiens
ggagaggagctattgggggctc

SEQ ID NO: 7595409 - DNA, 22 bp, Homo sapiens
ggagaggagctattgggggctc

SEQ ID NO: 7595410 - DNA, 22 bp, Homo sapiens
ggagaggagattgtggcatttt

SEQ ID NO: 7595411 - DNA, 22 bp, Homo sapiens
ggagaggagattgtggcatttt

SEQ ID NO: 7595412 - DNA, 22 bp, Homo sapiens
ggagaggagattgtggcatttt

SEQ ID NO: 7595413 - DNA, 22 bp, Homo sapiens
ggagaggagattgtggcatttt

SEQ ID NO: 7595414 - DNA, 22 bp, Homo sapiens
ggagaggagattgtggcatttt

SEQ ID NO: 7595415 - DNA, 22 bp, Homo sapiens
ggagaggagattgtggcatttt

SEQ ID NO: 7595416 - DNA, 22 bp, Homo sapiens
ggagaggagattgtggcatttt

SEQ ID NO: 7595417 - DNA, 22 bp, Homo sapiens
ggagaggagattgtggcatttt

SEQ ID NO: 7595418 - DNA, 22 bp, Homo sapiens
ggagaggagattgtggcatttt

SEQ ID NO: 7595419 - DNA, 22 bp, Homo sapiens
ggagaggacatggctcccacag

SEQ ID NO: 7595420 - DNA, 22 bp, Homo sapiens
ggagaggacatggctcccacag

SEQ ID NO: 7595421 - DNA, 22 bp, Homo sapiens
ggagaggacatggctcccacag

SEQ ID NO: 7595422 - DNA, 22 bp, Homo sapiens
ggagaggacatggctcccacag

SEQ ID NO: 7595423 - DNA, 22 bp, Homo sapiens
ggagaggaaatgccagcacttc

SEQ ID NO: 7595424 - DNA, 22 bp, Homo sapiens
ggagaggaaatgccagcacttc

SEQ ID NO: 7595425 - DNA, 22 bp, Homo sapiens
ggactgaggacatgtgaggcat

SEQ ID NO: 7595426 - DNA, 22 bp, Homo sapiens
ggactgaatgccagtctatgga

SEQ ID NO: 7595427 - DNA, 22 bp, Homo sapiens
ggactgaggacatgtgaggcat

SEQ ID NO: 7595428 - DNA, 22 bp, Homo sapiens
ggactgaggacatgtgaggcat

SEQ ID NO: 7595429 - DNA, 22 bp, Homo sapiens
ggactgaggacatgtgaggcat

SEQ ID NO: 7595430 - DNA, 22 bp, Homo sapiens
ggactgaatgccagtctatgga

SEQ ID NO: 7595431 - DNA, 22 bp, Homo sapiens
ggactgaatggaagatatatgg

SEQ ID NO: 7595432 - DNA, 22 bp, Homo sapiens
ggactgaggacatgtgaggcat

SEQ ID NO: 7595433 - DNA, 22 bp, Homo sapiens
ggactgaggacatgtgaggcat

SEQ ID NO: 7595434 - DNA, 22 bp, Homo sapiens
ggactgaggacatgtgaggcat

SEQ ID NO: 7595435 - DNA, 22 bp, Homo sapiens
ggactgaggacatgtgaggcat

SEQ ID NO: 7595436 - DNA, 22 bp, Homo sapiens
ggactgaggcccacttgaggga

SEQ ID NO: 7595437 - DNA, 20 bp, Homo sapiens
ggactgaaaacacaaacctg

SEQ ID NO: 7595438 - DNA, 22 bp, Homo sapiens
ggactctgttttcctgatcact

SEQ ID NO: 7595439 - DNA, 22 bp, Homo sapiens
ggactctgtagaggttctcatt

SEQ ID NO: 7595440 - DNA, 22 bp, Homo sapiens
ggactgaaagcgaagaatttgt

SEQ ID NO: 7595441 - DNA, 22 bp, Homo sapiens
ggactgaaatctttccatgtca

SEQ ID NO: 7595442 - DNA, 22 bp, Homo sapiens
ggactgaaagcgaagaatttgt

SEQ ID NO: 7595443 - DNA, 22 bp, Homo sapiens
ggactgaacacttaaatgtcca

SEQ ID NO: 7595444 - DNA, 22 bp, Homo sapiens
ggactgaacacttaaatgtcca

SEQ ID NO: 7595445 - DNA, 22 bp, Homo sapiens
ggactgaaggacaatctggttc

SEQ ID NO: 7595446 - DNA, 22 bp, Homo sapiens
ggactgaagtgctgtctagtgt

SEQ ID NO: 7595447 - DNA, 22 bp, Homo sapiens
ggagagagatgccgccttgctc

SEQ ID NO: 7595448 - DNA, 22 bp, Homo sapiens
ggagagagatgccgccttgctc

SEQ ID NO: 7595449 - DNA, 22 bp, Homo sapiens
ggagagagatgccgccttgctc

SEQ ID NO: 7595450 - DNA, 22 bp, Homo sapiens
ggactgaggcccacttgaggga

SEQ ID NO: 7595451 - DNA, 22 bp, Homo sapiens
ggagagagatgccgccttgctc

SEQ ID NO: 7595452 - DNA, 22 bp, Homo sapiens
ggagagagagctcattagctgc

SEQ ID NO: 7595453 - DNA, 22 bp, Homo sapiens
ggagagctggtagctggctcca

SEQ ID NO: 7595454 - DNA, 22 bp, Homo sapiens
ggagagaggagcccactgctgt

SEQ ID NO: 7595455 - DNA, 22 bp, Homo sapiens
ggagagaggagcccactgctgt

SEQ ID NO: 7595456 - DNA, 22 bp, Homo sapiens
ggagagaggagcccactgctgt

SEQ ID NO: 7595457 - DNA, 22 bp, Homo sapiens
ggagagctggtagctggctcca

SEQ ID NO: 7595458 - DNA, 22 bp, Homo sapiens
ggagagctggtagctggctcca

SEQ ID NO: 7595459 - DNA, 22 bp, Homo sapiens
ggagagaggagcccactgctgt

SEQ ID NO: 7595460 - DNA, 22 bp, Homo sapiens
ggagagaggagcccactgctgt

SEQ ID NO: 7595461 - DNA, 22 bp, Homo sapiens
ggagagagatgccgccttgctc

SEQ ID NO: 7595462 - DNA, 22 bp, Homo sapiens
ggagagagatgccgccttgctc

SEQ ID NO: 7595463 - DNA, 22 bp, Homo sapiens
ggactcctctagaagttgaggc

SEQ ID NO: 7595464 - DNA, 22 bp, Homo sapiens
ggactcaggctggtgttcggac

SEQ ID NO: 7595465 - DNA, 22 bp, Homo sapiens
ggactcagcagccaggagtggc

SEQ ID NO: 7595466 - DNA, 18 bp, Homo sapiens
ggactacaggcacaggga

SEQ ID NO: 7595467 - DNA, 23 bp, Homo sapiens
ggactaggcaacagatgggacag

SEQ ID NO: 7595468 - DNA, 22 bp, Homo sapiens
ggactcctctagaagttgaggc

SEQ ID NO: 7595469 - DNA, 22 bp, Homo sapiens
ggactaaactattgacatagtg

SEQ ID NO: 7595470 - DNA, 18 bp, Homo sapiens
ggactacaggcacaggga

SEQ ID NO: 7595471 - DNA, 22 bp, Homo sapiens
ggacggggagctggaaagggga

SEQ ID NO: 7595472 - DNA, 22 bp, Homo sapiens
ggacggggagctggaaagggga

SEQ ID NO: 7595473 - DNA, 22 bp, Homo sapiens
ggacggggagctggaaagggga

SEQ ID NO: 7595474 - DNA, 22 bp, Homo sapiens
ggacgcagcgagggaagcagcc

SEQ ID NO: 7595475 - DNA, 22 bp, Homo sapiens
ggacgcagcgagggaagcagcc

SEQ ID NO: 7595476 - DNA, 22 bp, Homo sapiens
ggacgcagcgagggaagcagcc

SEQ ID NO: 7595477 - DNA, 22 bp, Homo sapiens
ggacgcagcgagggaagcagcc

SEQ ID NO: 7595478 - DNA, 22 bp, Homo sapiens
ggacggctctctggcactgtgg

SEQ ID NO: 7595479 - DNA, 22 bp, Homo sapiens
ggacgcagcgagggaagcagcc

SEQ ID NO: 7595480 - DNA, 22 bp, Homo sapiens
ggacgcagcgagggaagcagcc

SEQ ID NO: 7595481 - DNA, 22 bp, Homo sapiens
ggacgcttaccagtaacgactt

SEQ ID NO: 7595482 - DNA, 22 bp, Homo sapiens
ggacgcagccgagggagcaggg

SEQ ID NO: 7595483 - DNA, 22 bp, Homo sapiens
ggacgcagccgagggagcaggg

SEQ ID NO: 7595484 - DNA, 22 bp, Homo sapiens
ggacgcagccgagggagcaggg

SEQ ID NO: 7595485 - DNA, 22 bp, Homo sapiens
ggacgcagccgagggagcaggg

SEQ ID NO: 7595486 - DNA, 22 bp, Homo sapiens
ggacctttgagggggaattggt

SEQ ID NO: 7595487 - DNA, 22 bp, Homo sapiens
ggacctgccctggctcagatgc

SEQ ID NO: 7595488 - DNA, 22 bp, Homo sapiens
ggacctgctctcccagttctct

SEQ ID NO: 7595489 - DNA, 22 bp, Homo sapiens
ggacctggaagtttggtgatcc

SEQ ID NO: 7595490 - DNA, 19 bp, Homo sapiens
ggacctggcaatctgcatt

SEQ ID NO: 7595491 - DNA, 19 bp, Homo sapiens
ggacctggcaatctgcatt

SEQ ID NO: 7595492 - DNA, 22 bp, Homo sapiens
ggacctggcaatttgcatctct

SEQ ID NO: 7595493 - DNA, 22 bp, Homo sapiens
ggacctgtgtctacagcatgtg

SEQ ID NO: 7595494 - DNA, 22 bp, Homo sapiens
ggacctgtgtctacagcatgtg

SEQ ID NO: 7595495 - DNA, 22 bp, Homo sapiens
ggaccctgggcagctggctgct

SEQ ID NO: 7595496 - DNA, 22 bp, Homo sapiens
ggaccctgggcagctggctgct

SEQ ID NO: 7595497 - DNA, 22 bp, Homo sapiens
ggaccctgggcagctggctgct

SEQ ID NO: 7595498 - DNA, 22 bp, Homo sapiens
ggaccctgggcagctggctgct

SEQ ID NO: 7595499 - DNA, 22 bp, Homo sapiens
ggaccctgggcagctggctgct

SEQ ID NO: 7595500 - DNA, 22 bp, Homo sapiens
ggaccctggagacccactggga

SEQ ID NO: 7595501 - DNA, 22 bp, Homo sapiens
ggaccctgcagccacccgacat

SEQ ID NO: 7595502 - DNA, 22 bp, Homo sapiens
ggaccctgcagccacccgacat

SEQ ID NO: 7595503 - DNA, 22 bp, Homo sapiens
ggaccctgcgtgtatccacact

SEQ ID NO: 7595504 - DNA, 22 bp, Homo sapiens
ggaccctggagacccactggga

SEQ ID NO: 7595505 - DNA, 22 bp, Homo sapiens
ggaccctgcgtgtatccacact

SEQ ID NO: 7595506 - DNA, 22 bp, Homo sapiens
ggaccctggagacccactggga

SEQ ID NO: 7595507 - DNA, 22 bp, Homo sapiens
ggaccctggagacccactggga

SEQ ID NO: 7595508 - DNA, 22 bp, Homo sapiens
ggaccctgggctctgggcctat

SEQ ID NO: 7595509 - DNA, 22 bp, Homo sapiens
ggaccctgggctctgggcctat

SEQ ID NO: 7595510 - DNA, 22 bp, Homo sapiens
ggaccctgggcttgctcctggg

SEQ ID NO: 7595511 - DNA, 22 bp, Homo sapiens
ggaccctgggcttgctcctggg

SEQ ID NO: 7595512 - DNA, 22 bp, Homo sapiens
ggaccctgggcttgctcctggg

SEQ ID NO: 7595513 - DNA, 22 bp, Homo sapiens
ggaccctgggcttgctcctggg

SEQ ID NO: 7595514 - DNA, 23 bp, Homo sapiens
ggaccctgtggagggtgagagtc

SEQ ID NO: 7595515 - DNA, 23 bp, Homo sapiens
ggaccctgtggagggtgagagtc

SEQ ID NO: 7595516 - DNA, 23 bp, Homo sapiens
ggaccctgtggagggtgagagtc

SEQ ID NO: 7595517 - DNA, 22 bp, Homo sapiens
ggaccctgtaaagtcgtgtcca

SEQ ID NO: 7595518 - DNA, 23 bp, Homo sapiens
ggaccctgtggagggtgagagtc

SEQ ID NO: 7595519 - DNA, 23 bp, Homo sapiens
ggaccctgtggagggtgagagtc

SEQ ID NO: 7595520 - DNA, 22 bp, Homo sapiens
ggaccggtggcttcctcgggtc

SEQ ID NO: 7595521 - DNA, 22 bp, Homo sapiens
ggaccggtggcttcctcgggtc

SEQ ID NO: 7595522 - DNA, 22 bp, Homo sapiens
ggacctgaacataaaacgaggc

SEQ ID NO: 7595523 - DNA, 22 bp, Homo sapiens
ggaccggtggcttcctcgggtc

SEQ ID NO: 7595524 - DNA, 22 bp, Homo sapiens
ggacctgaacataaaacgaggc

SEQ ID NO: 7595525 - DNA, 22 bp, Homo sapiens
ggacctgaacataaaacgaggc

SEQ ID NO: 7595526 - DNA, 22 bp, Homo sapiens
ggacctgaacataaaacgaggc

SEQ ID NO: 7595527 - DNA, 22 bp, Homo sapiens
ggacctgaacataaaacgaggc

SEQ ID NO: 7595528 - DNA, 22 bp, Homo sapiens
ggacctgaacataaaacgaggc

SEQ ID NO: 7595529 - DNA, 22 bp, Homo sapiens
ggacctgaaggaaagccactta

SEQ ID NO: 7595530 - DNA, 22 bp, Homo sapiens
ggacctgatgtttagtcttgtt

SEQ ID NO: 7595531 - DNA, 22 bp, Homo sapiens
ggacctgatgtttagtcttgtt

SEQ ID NO: 7595532 - DNA, 22 bp, Homo sapiens
ggacctgagaacgccttggctt

SEQ ID NO: 7595533 - DNA, 22 bp, Homo sapiens
ggacctgcattttaacaagatc

SEQ ID NO: 7595534 - DNA, 22 bp, Homo sapiens
ggacctgccagaactcaggcta

SEQ ID NO: 7595535 - DNA, 22 bp, Homo sapiens
ggacctgccagaactcaggcta

SEQ ID NO: 7595536 - DNA, 18 bp, Homo sapiens
ggacccagggcctcaccc

SEQ ID NO: 7595537 - DNA, 22 bp, Homo sapiens
ggacccaggtagggaggaagat

SEQ ID NO: 7595538 - DNA, 18 bp, Homo sapiens
ggacccagggcctcaccc

SEQ ID NO: 7595539 - DNA, 22 bp, Homo sapiens
ggacccaggtagggaggaagat

SEQ ID NO: 7595540 - DNA, 18 bp, Homo sapiens
ggacccagggcctcaccc

SEQ ID NO: 7595541 - DNA, 22 bp, Homo sapiens
ggacccaggtagggaggaagat

SEQ ID NO: 7595542 - DNA, 22 bp, Homo sapiens
ggacccaggtagggaggaagat

SEQ ID NO: 7595543 - DNA, 22 bp, Homo sapiens
ggaccccagagataccagtttt

SEQ ID NO: 7595544 - DNA, 22 bp, Homo sapiens
ggacccagctctgagaccctgc

SEQ ID NO: 7595545 - DNA, 22 bp, Homo sapiens
ggacccagctctgagaccctgc

SEQ ID NO: 7595546 - DNA, 22 bp, Homo sapiens
ggacccagctctgagaccctgc

SEQ ID NO: 7595547 - DNA, 22 bp, Homo sapiens
ggacccagaggggagtctggca

SEQ ID NO: 7595548 - DNA, 22 bp, Homo sapiens
ggacccaggaattaattaagag

SEQ ID NO: 7595549 - DNA, 18 bp, Homo sapiens
ggacccagggcctcaccc

SEQ ID NO: 7595550 - DNA, 22 bp, Homo sapiens
ggacccagctctgagaccctgc

SEQ ID NO: 7595551 - DNA, 22 bp, Homo sapiens
ggacccagctctgagaccctgc

SEQ ID NO: 7595552 - DNA, 22 bp, Homo sapiens
ggacagagggcaggagcccaga

SEQ ID NO: 7595553 - DNA, 22 bp, Homo sapiens
ggacagagggcaggagcccaga

SEQ ID NO: 7595554 - DNA, 22 bp, Homo sapiens
ggacagagggcaggagcccaga

SEQ ID NO: 7595555 - DNA, 22 bp, Homo sapiens
ggacagagggcaggagcccaga

SEQ ID NO: 7595556 - DNA, 22 bp, Homo sapiens
ggacagagggcaggagcccaga

SEQ ID NO: 7595557 - DNA, 21 bp, Homo sapiens
ggacagaggagaaggcaccct

SEQ ID NO: 7595558 - DNA, 21 bp, Homo sapiens
ggacagaggagaaggcaccct

SEQ ID NO: 7595559 - DNA, 21 bp, Homo sapiens
ggacagaggagaaggcaccct

SEQ ID NO: 7595560 - DNA, 21 bp, Homo sapiens
ggacagaggagaaggcaccct

SEQ ID NO: 7595561 - DNA, 21 bp, Homo sapiens
ggacagaggagaaggcaccct

SEQ ID NO: 7595562 - DNA, 22 bp, Homo sapiens
ggacagagggcaggagcccaga

SEQ ID NO: 7595563 - DNA, 22 bp, Homo sapiens
ggacagagggcaggagcccaga

SEQ ID NO: 7595564 - DNA, 22 bp, Homo sapiens
ggacagagggttgacagagtat

SEQ ID NO: 7595565 - DNA, 22 bp, Homo sapiens
ggacccagaggggagtctggca

SEQ ID NO: 7595566 - DNA, 23 bp, Homo sapiens
ggacccacggtctttgaggctct

SEQ ID NO: 7595567 - DNA, 22 bp, Homo sapiens
ggacagagggcaggagcccaga

SEQ ID NO: 7595568 - DNA, 22 bp, Homo sapiens
ggacagagggcaggagcccaga

SEQ ID NO: 7595569 - DNA, 22 bp, Homo sapiens
ggacagagggcaggagcccaga

SEQ ID NO: 7595570 - DNA, 22 bp, Homo sapiens
ggacagagggcaggagcccaga

SEQ ID NO: 7595571 - DNA, 22 bp, Homo sapiens
ggacagagggcaggagcccaga

SEQ ID NO: 7595572 - DNA, 22 bp, Homo sapiens
ggacacgtggctgaaggcggcc

SEQ ID NO: 7595573 - DNA, 22 bp, Homo sapiens
ggacacgtggctgaaggcggcc

SEQ ID NO: 7595574 - DNA, 22 bp, Homo sapiens
ggacacgatttattgctaaggg

SEQ ID NO: 7595575 - DNA, 22 bp, Homo sapiens
ggacacgtggctgaaggcggcc

SEQ ID NO: 7595576 - DNA, 17 bp, Homo sapiens
ggacacctggagtctcc

SEQ ID NO: 7595577 - DNA, 17 bp, Homo sapiens
ggacacctggagtctcc

SEQ ID NO: 7595578 - DNA, 19 bp, Homo sapiens
ggacaccctatcaatacct

SEQ ID NO: 7595579 - DNA, 19 bp, Homo sapiens
ggacaccctatcaatacct

SEQ ID NO: 7595580 - DNA, 17 bp, Homo sapiens
ggacacctggagtctcc

SEQ ID NO: 7595581 - DNA, 21 bp, Homo sapiens
ggacaccagtcacactggatt

SEQ ID NO: 7595582 - DNA, 21 bp, Homo sapiens
ggacaccagtcacactggatt

SEQ ID NO: 7595583 - DNA, 22 bp, Homo sapiens
ggacaccccgggtaccaggtct

SEQ ID NO: 7595584 - DNA, 23 bp, Homo sapiens
ggacactgctataaaggatctgc

SEQ ID NO: 7595585 - DNA, 23 bp, Homo sapiens
ggacactgctataaaggatctgc

SEQ ID NO: 7595586 - DNA, 21 bp, Homo sapiens
ggacactgataatcttgttgc

SEQ ID NO: 7595587 - DNA, 22 bp, Homo sapiens
ggacactgaagaatctcagatg

SEQ ID NO: 7595588 - DNA, 22 bp, Homo sapiens
ggacactgaagaatctcagatg

SEQ ID NO: 7595589 - DNA, 21 bp, Homo sapiens
ggacactgataatcttgttgc

SEQ ID NO: 7595590 - DNA, 23 bp, Homo sapiens
ggacactgtgcagatgctagtgc

SEQ ID NO: 7595591 - DNA, 22 bp, Homo sapiens
ggacactgttcatggggagggg

SEQ ID NO: 7595592 - DNA, 22 bp, Homo sapiens
ggacactgttcatggggagggg

SEQ ID NO: 7595593 - DNA, 22 bp, Homo sapiens
ggacactgttcatggggagggg

SEQ ID NO: 7595594 - DNA, 22 bp, Homo sapiens
ggacactttgagttgaaggggt

SEQ ID NO: 7595595 - DNA, 22 bp, Homo sapiens
ggacagaaattcttgttggaca

SEQ ID NO: 7595596 - DNA, 22 bp, Homo sapiens
ggacagaaaccatatgagtgta

SEQ ID NO: 7595597 - DNA, 22 bp, Homo sapiens
ggacagaaattcttgttggaca

SEQ ID NO: 7595598 - DNA, 22 bp, Homo sapiens
ggacagaaaccatatgagtgta

SEQ ID NO: 7595599 - DNA, 22 bp, Homo sapiens
ggacagaaaccatatgagtgta

SEQ ID NO: 7595600 - DNA, 22 bp, Homo sapiens
ggacactgtataagttagagta

SEQ ID NO: 7595601 - DNA, 22 bp, Homo sapiens
ggacactgtataagttagagta

SEQ ID NO: 7595602 - DNA, 20 bp, Homo sapiens
ggacactgtagatttcaaac

SEQ ID NO: 7595603 - DNA, 22 bp, Homo sapiens
ggacactggccacatttcaaaa

SEQ ID NO: 7595604 - DNA, 23 bp, Homo sapiens
ggacactgtgcagatgctagtgc

SEQ ID NO: 7595605 - DNA, 22 bp, Homo sapiens
ggacactgtataagttagagta

SEQ ID NO: 7595606 - DNA, 23 bp, Homo sapiens
ggacactgtgcagatgctagtgc

SEQ ID NO: 7595607 - DNA, 22 bp, Homo sapiens
ggacactgttcatggggagggg

SEQ ID NO: 7595608 - DNA, 22 bp, Homo sapiens
ggacagagccctggtggcctaa

SEQ ID NO: 7595609 - DNA, 22 bp, Homo sapiens
ggacagagccctggtggcctaa

SEQ ID NO: 7595610 - DNA, 22 bp, Homo sapiens
ggacagagccctggtggcctaa

SEQ ID NO: 7595611 - DNA, 22 bp, Homo sapiens
ggacagagccctggtggcctaa

SEQ ID NO: 7595612 - DNA, 22 bp, Homo sapiens
ggacagagcagacgagcagcgg

SEQ ID NO: 7595613 - DNA, 22 bp, Homo sapiens
ggacagagcagacgagcagcgg

SEQ ID NO: 7595614 - DNA, 22 bp, Homo sapiens
ggacagagcagacgagcagcgg

SEQ ID NO: 7595615 - DNA, 22 bp, Homo sapiens
ggacagagccctggtggcctaa

SEQ ID NO: 7595616 - DNA, 22 bp, Homo sapiens
ggacagagccctggtggcctaa

SEQ ID NO: 7595617 - DNA, 22 bp, Homo sapiens
ggacagagccctggtggcctaa

SEQ ID NO: 7595618 - DNA, 22 bp, Homo sapiens
ggacagagccctggtggcctaa

SEQ ID NO: 7595619 - DNA, 22 bp, Homo sapiens
ggacagagccctggtggcctaa

SEQ ID NO: 7595620 - DNA, 22 bp, Homo sapiens
ggacagacagtgtgagtgaggc

SEQ ID NO: 7595621 - DNA, 22 bp, Homo sapiens
ggacagacagtgtgagtgaggc

SEQ ID NO: 7595622 - DNA, 19 bp, Homo sapiens
ggacagacgcagagatctg

SEQ ID NO: 7595623 - DNA, 19 bp, Homo sapiens
ggacagacgcagagatctg

SEQ ID NO: 7595624 - DNA, 19 bp, Homo sapiens
ggacagacgcagagatctg

SEQ ID NO: 7595625 - DNA, 19 bp, Homo sapiens
ggacagacgcagagatctg

SEQ ID NO: 7595626 - DNA, 22 bp, Homo sapiens
ggacagagagtgaatatgacat

SEQ ID NO: 7595627 - DNA, 22 bp, Homo sapiens
ggacagactttacagccccggg

SEQ ID NO: 7595628 - DNA, 22 bp, Homo sapiens
ggacagagcagacgagcagcgg

SEQ ID NO: 7595629 - DNA, 22 bp, Homo sapiens
ggacagagcagacgagcagcgg

SEQ ID NO: 7595630 - DNA, 22 bp, Homo sapiens
ggacagagagtgaatatgacat

SEQ ID NO: 7595631 - DNA, 22 bp, Homo sapiens
ggacagagcagacgagcagcgg

SEQ ID NO: 7595632 - DNA, 22 bp, Homo sapiens
ggacagagcagacgagcagcgg

SEQ ID NO: 7595633 - DNA, 22 bp, Homo sapiens
ggacagagcagacgagcagcgg

SEQ ID NO: 7595634 - DNA, 22 bp, Homo sapiens
ggacagagcagacgagcagcgg

SEQ ID NO: 7595635 - DNA, 22 bp, Homo sapiens
ggacagagcagacgagcagcgg

SEQ ID NO: 7595636 - DNA, 22 bp, Homo sapiens
ggacagagcagacgagcagcgg

SEQ ID NO: 7595637 - DNA, 22 bp, Homo sapiens
ggaaaggagatgaataggatta

SEQ ID NO: 7595638 - DNA, 22 bp, Homo sapiens
ggaaaggagatgaataggatta

SEQ ID NO: 7595639 - DNA, 22 bp, Homo sapiens
ggaaaggcaggggccctgccca

SEQ ID NO: 7595640 - DNA, 22 bp, Homo sapiens
ggaaaggcctgggtgtcctggg

SEQ ID NO: 7595641 - DNA, 22 bp, Homo sapiens
ggaaaggcctgggtgtcctggg

SEQ ID NO: 7595642 - DNA, 22 bp, Homo sapiens
ggaaaggcaggggccctgccca

SEQ ID NO: 7595643 - DNA, 22 bp, Homo sapiens
ggaaaggcaggggccctgccca

SEQ ID NO: 7595644 - DNA, 22 bp, Homo sapiens
ggaaaggagatattggagagtg

SEQ ID NO: 7595645 - DNA, 22 bp, Homo sapiens
ggaaaggagatattggagagtg

SEQ ID NO: 7595646 - DNA, 22 bp, Homo sapiens
ggaaaggagatgaataggatta

SEQ ID NO: 7595647 - DNA, 22 bp, Homo sapiens
ggaaaggagatattggagagtg

SEQ ID NO: 7595648 - DNA, 22 bp, Homo sapiens
ggaaaggagatgaataggatta

SEQ ID NO: 7595649 - DNA, 22 bp, Homo sapiens
ggaaaggagatgaataggatta

SEQ ID NO: 7595650 - DNA, 22 bp, Homo sapiens
ggaaagggcagaggccttggag

SEQ ID NO: 7595651 - DNA, 22 bp, Homo sapiens
ggaaaggctaacagtcatggaa

SEQ ID NO: 7595652 - DNA, 22 bp, Homo sapiens
ggaaagggagttttgcttatga

SEQ ID NO: 7595653 - DNA, 22 bp, Homo sapiens
ggaaagggagttttgcttatga

SEQ ID NO: 7595654 - DNA, 22 bp, Homo sapiens
ggaaaggcctgggtgtcctggg

SEQ ID NO: 7595655 - DNA, 22 bp, Homo sapiens
ggaaaggctaacagtcatggaa

SEQ ID NO: 7595656 - DNA, 22 bp, Homo sapiens
ggaaaggctaacagtcatggaa

SEQ ID NO: 7595657 - DNA, 22 bp, Homo sapiens
ggaaaggctaacagtcatggaa

SEQ ID NO: 7595658 - DNA, 22 bp, Homo sapiens
ggaaaggagatattggagagtg

SEQ ID NO: 7595659 - DNA, 22 bp, Homo sapiens
ggaaaggagatattggagagtg

SEQ ID NO: 7595660 - DNA, 22 bp, Homo sapiens
ggaaaggagatattggagagtg

SEQ ID NO: 7595661 - DNA, 22 bp, Homo sapiens
ggaaaggagatattggagagtg

SEQ ID NO: 7595662 - DNA, 22 bp, Homo sapiens
ggaaaggagatattggagagtg

SEQ ID NO: 7595663 - DNA, 22 bp, Homo sapiens
ggaaaggagatattggagagtg

SEQ ID NO: 7595664 - DNA, 22 bp, Homo sapiens
ggaaagctttgtacttgaaaac

SEQ ID NO: 7595665 - DNA, 22 bp, Homo sapiens
ggaaagctttgttttcctcacc

SEQ ID NO: 7595666 - DNA, 22 bp, Homo sapiens
gcttcctgagtacaccctcatc

SEQ ID NO: 7595667 - DNA, 22 bp, Homo sapiens
gcttcctgagtacaccctcatc

SEQ ID NO: 7595668 - DNA, 22 bp, Homo sapiens
gcttcctgatattcatactgtt

SEQ ID NO: 7595669 - DNA, 22 bp, Homo sapiens
gcttcctggaacaactgttgct

SEQ ID NO: 7595670 - DNA, 22 bp, Homo sapiens
gcttcctggaacaactgttgct

SEQ ID NO: 7595671 - DNA, 22 bp, Homo sapiens
ggaaagctttgtacttgaaaac

SEQ ID NO: 7595672 - DNA, 22 bp, Homo sapiens
ggaaagctcagatcttgttgga

SEQ ID NO: 7595673 - DNA, 22 bp, Homo sapiens
ggaaagggcagaggccttggag

SEQ ID NO: 7595674 - DNA, 22 bp, Homo sapiens
ggaaagggcatggccttttcac

SEQ ID NO: 7595675 - DNA, 22 bp, Homo sapiens
ggaaaggggcctggatcttttg

SEQ ID NO: 7595676 - DNA, 22 bp, Homo sapiens
ggaaaggggcctggatcttttg

SEQ ID NO: 7595677 - DNA, 22 bp, Homo sapiens
ggaaaggcctgggtgtcctggg

SEQ ID NO: 7595678 - DNA, 22 bp, Homo sapiens
ggaaagggcagaggccttggag

SEQ ID NO: 7595679 - DNA, 22 bp, Homo sapiens
ggaaagggcagaggccttggag

SEQ ID NO: 7595680 - DNA, 22 bp, Homo sapiens
ggaaagggcatggccttttcac

SEQ ID NO: 7595681 - DNA, 22 bp, Homo sapiens
ggaaagggcagaggccttggag

SEQ ID NO: 7595682 - DNA, 17 bp, Homo sapiens
ggaaaggtagagtaatc

SEQ ID NO: 7595683 - DNA, 17 bp, Homo sapiens
ggaaaggtagagtaatc

SEQ ID NO: 7595684 - DNA, 22 bp, Homo sapiens
ggaaagtcttgtgtagatgtct

SEQ ID NO: 7595685 - DNA, 22 bp, Homo sapiens
ggaaagtggtggtggaaagagg

SEQ ID NO: 7595686 - DNA, 22 bp, Homo sapiens
ggaaagtggtggtggaaagagg

SEQ ID NO: 7595687 - DNA, 22 bp, Homo sapiens
ggaaatacaaagatacaccact

SEQ ID NO: 7595688 - DNA, 22 bp, Homo sapiens
ggaaagtggtggtggaaagagg

SEQ ID NO: 7595689 - DNA, 22 bp, Homo sapiens
ggaaatacaaagatacaccact

SEQ ID NO: 7595690 - DNA, 22 bp, Homo sapiens
ggaaatcaggggtgttgctttc

SEQ ID NO: 7595691 - DNA, 22 bp, Homo sapiens
ggaaatcatctgattggctttc

SEQ ID NO: 7595692 - DNA, 22 bp, Homo sapiens
ggaaatcagcagatgctggtga

SEQ ID NO: 7595693 - DNA, 22 bp, Homo sapiens
ggaaatcatgggagagttggaa

SEQ ID NO: 7595694 - DNA, 22 bp, Homo sapiens
ggaaatcatgggagagttggaa

SEQ ID NO: 7595695 - DNA, 22 bp, Homo sapiens
ggaaatccttctaaaaagtcag

SEQ ID NO: 7595696 - DNA, 22 bp, Homo sapiens
ggaaatctcagatctcccagat

SEQ ID NO: 7595697 - DNA, 22 bp, Homo sapiens
ggaaatctctactttgtcattt

SEQ ID NO: 7595698 - DNA, 22 bp, Homo sapiens
ggaaatctctactttgtcattt

SEQ ID NO: 7595699 - DNA, 22 bp, Homo sapiens
ggaaatatcttgtactatgtga

SEQ ID NO: 7595700 - DNA, 22 bp, Homo sapiens
ggaaatataagcagtttgtgtg

SEQ ID NO: 7595701 - DNA, 22 bp, Homo sapiens
ggaaatataagcagtttgtgtg

SEQ ID NO: 7595702 - DNA, 22 bp, Homo sapiens
ggaaatatcttgtactatgtga

SEQ ID NO: 7595703 - DNA, 22 bp, Homo sapiens
ggaaatattttgtctaatttgt

SEQ ID NO: 7595704 - DNA, 22 bp, Homo sapiens
ggaaatattttgtctaatttgt

SEQ ID NO: 7595705 - DNA, 22 bp, Homo sapiens
ggaaatattgattgctctgtat

SEQ ID NO: 7595706 - DNA, 22 bp, Homo sapiens
ggaaatattgattgctctgtat

SEQ ID NO: 7595707 - DNA, 22 bp, Homo sapiens
ggaaatcaaggggacaaattgt

SEQ ID NO: 7595708 - DNA, 22 bp, Homo sapiens
ggaaatcaagaagcagatgagt

SEQ ID NO: 7595709 - DNA, 22 bp, Homo sapiens
ggaaatattttgtctaatttgt

SEQ ID NO: 7595710 - DNA, 22 bp, Homo sapiens
gcttcctccagggaggggcctg

SEQ ID NO: 7595711 - DNA, 22 bp, Homo sapiens
gcttcctccctgctgctcacta

SEQ ID NO: 7595712 - DNA, 22 bp, Homo sapiens
gcttcctccctgctgctcacta

SEQ ID NO: 7595713 - DNA, 22 bp, Homo sapiens
gcttcctccctgctgctcacta

SEQ ID NO: 7595714 - DNA, 22 bp, Homo sapiens
gcttcctccctgctgctcacta

SEQ ID NO: 7595715 - DNA, 22 bp, Homo sapiens
gcttcctccctgctgctcacta

SEQ ID NO: 7595716 - DNA, 22 bp, Homo sapiens
gcttcctcctggaggtcactca

SEQ ID NO: 7595717 - DNA, 22 bp, Homo sapiens
gcttcctcctggaggtcactca

SEQ ID NO: 7595718 - DNA, 22 bp, Homo sapiens
gcttcctccctgctgctcacta

SEQ ID NO: 7595719 - DNA, 22 bp, Homo sapiens
gcttcctccctgctgctcacta

SEQ ID NO: 7595720 - DNA, 22 bp, Homo sapiens
gcttcctcgctgggcagaggca

SEQ ID NO: 7595721 - DNA, 22 bp, Homo sapiens
gcttcctcgctgggcagaggca

SEQ ID NO: 7595722 - DNA, 22 bp, Homo sapiens
gcttcctgagacaacattgagt

SEQ ID NO: 7595723 - DNA, 22 bp, Homo sapiens
gcttcctgagacaacattgagt

SEQ ID NO: 7595724 - DNA, 22 bp, Homo sapiens
gcttcctgagaaacaatctgat

SEQ ID NO: 7595725 - DNA, 22 bp, Homo sapiens
gcttcctgagaaacaatctgat

SEQ ID NO: 7595726 - DNA, 22 bp, Homo sapiens
gcttcctgagagagacagttcc

SEQ ID NO: 7595727 - DNA, 22 bp, Homo sapiens
gcttcctgagtacaccctcatc

SEQ ID NO: 7595728 - DNA, 22 bp, Homo sapiens
gcttcctgagagagacagttcc

SEQ ID NO: 7595729 - DNA, 22 bp, Homo sapiens
gcttcctgagaaacaatctgat

SEQ ID NO: 7595730 - DNA, 22 bp, Homo sapiens
gcttcctgagaaacaatctgat

SEQ ID NO: 7595731 - DNA, 18 bp, Homo sapiens
gcttcctgaaagctgccc

SEQ ID NO: 7595732 - DNA, 18 bp, Homo sapiens
gcttcctgaaagctgccc

SEQ ID NO: 7595733 - DNA, 18 bp, Homo sapiens
gcttcctgaaagctgccc

SEQ ID NO: 7595734 - DNA, 18 bp, Homo sapiens
gcttcctgaaagctgccc

SEQ ID NO: 7595735 - DNA, 18 bp, Homo sapiens
gcttcctgaaagctgccc

SEQ ID NO: 7595736 - DNA, 19 bp, Homo sapiens
gcttcccaccagccagccc

SEQ ID NO: 7595737 - DNA, 19 bp, Homo sapiens
gcttcccaccagccagccc

SEQ ID NO: 7595738 - DNA, 22 bp, Homo sapiens
gcttcccacagctggactgggg

SEQ ID NO: 7595739 - DNA, 22 bp, Homo sapiens
gcttcccacagctggactgggg

SEQ ID NO: 7595740 - DNA, 22 bp, Homo sapiens
gcttcccacagctggactgggg

SEQ ID NO: 7595741 - DNA, 20 bp, Homo sapiens
gcttcccaattcttgatctg

SEQ ID NO: 7595742 - DNA, 20 bp, Homo sapiens
gcttcccaattcttgatctg

SEQ ID NO: 7595743 - DNA, 20 bp, Homo sapiens
gcttcccaattcttgatctg

SEQ ID NO: 7595744 - DNA, 22 bp, Homo sapiens
gcttcccaatgtgctagtttct

SEQ ID NO: 7595745 - DNA, 22 bp, Homo sapiens
gcttcccaatgtgctagtttct

SEQ ID NO: 7595746 - DNA, 22 bp, Homo sapiens
gcttcccagcagaggaaagact

SEQ ID NO: 7595747 - DNA, 22 bp, Homo sapiens
gcttcccagcagaggaaagact

SEQ ID NO: 7595748 - DNA, 22 bp, Homo sapiens
gcttcccaggcgcctgaccttt

SEQ ID NO: 7595749 - DNA, 22 bp, Homo sapiens
gcttcccaggcgcctgaccttt

SEQ ID NO: 7595750 - DNA, 22 bp, Homo sapiens
gcttcccaggcgcctgaccttt

SEQ ID NO: 7595751 - DNA, 22 bp, Homo sapiens
gcttcccaggcgcctgaccttt

SEQ ID NO: 7595752 - DNA, 22 bp, Homo sapiens
gcttcccaggcgcctgaccttt

SEQ ID NO: 7595753 - DNA, 22 bp, Homo sapiens
gcttcccaggcgcctgaccttt

SEQ ID NO: 7595754 - DNA, 23 bp, Homo sapiens
gcttcccagacaatactgcttcc

SEQ ID NO: 7595755 - DNA, 23 bp, Homo sapiens
gcttcccagacaatactgcttcc

SEQ ID NO: 7595756 - DNA, 23 bp, Homo sapiens
gcttcccagacaatactgcttcc

SEQ ID NO: 7595757 - DNA, 22 bp, Homo sapiens
gcttcccagcagaggaaagact

SEQ ID NO: 7595758 - DNA, 22 bp, Homo sapiens
gcttcccagcagaggaaagact

SEQ ID NO: 7595759 - DNA, 19 bp, Homo sapiens
gcttcccaccagccagccc

SEQ ID NO: 7595760 - DNA, 19 bp, Homo sapiens
gcttcccaccagccagccc

SEQ ID NO: 7595761 - DNA, 23 bp, Homo sapiens
gcttcccagacaatactgcttcc

SEQ ID NO: 7595762 - DNA, 22 bp, Homo sapiens
gcttcctcaccttctcttgcat

SEQ ID NO: 7595763 - DNA, 22 bp, Homo sapiens
gcttcctcaccttctcttgcat

SEQ ID NO: 7595764 - DNA, 22 bp, Homo sapiens
gcttcctcaccttctcttgcat

SEQ ID NO: 7595765 - DNA, 17 bp, Homo sapiens
gcttcctcatgcagttc

SEQ ID NO: 7595766 - DNA, 17 bp, Homo sapiens
gcttcctcatgcagttc

SEQ ID NO: 7595767 - DNA, 17 bp, Homo sapiens
gcttcctcatgcagttc

SEQ ID NO: 7595768 - DNA, 22 bp, Homo sapiens
gcttcccctccaagcactgcct

SEQ ID NO: 7595769 - DNA, 22 bp, Homo sapiens
gcttccggagccaaaaggcccc

SEQ ID NO: 7595770 - DNA, 22 bp, Homo sapiens
gcttccggagccaaaaggcccc

SEQ ID NO: 7595771 - DNA, 17 bp, Homo sapiens
gcttcccctgccctctc

SEQ ID NO: 7595772 - DNA, 17 bp, Homo sapiens
gcttcccctgccctctc

SEQ ID NO: 7595773 - DNA, 22 bp, Homo sapiens
gcttccgcgatgtcctaggtgg

SEQ ID NO: 7595774 - DNA, 22 bp, Homo sapiens
gcttccgcgatgtcctaggtgg

SEQ ID NO: 7595775 - DNA, 22 bp, Homo sapiens
gcttcccattatggaaactctt

SEQ ID NO: 7595776 - DNA, 22 bp, Homo sapiens
gcttcccattatggaaactctt

SEQ ID NO: 7595777 - DNA, 22 bp, Homo sapiens
gcttcccattatggaaactctt

SEQ ID NO: 7595778 - DNA, 22 bp, Homo sapiens
gcttcccattatggaaactctt

SEQ ID NO: 7595779 - DNA, 22 bp, Homo sapiens
gcttcccaggcgcctgaccttt

SEQ ID NO: 7595780 - DNA, 22 bp, Homo sapiens
gcttcccatagtggaattcggg

SEQ ID NO: 7595781 - DNA, 22 bp, Homo sapiens
gcttcccatagtggaattcggg

SEQ ID NO: 7595782 - DNA, 22 bp, Homo sapiens
gcttcccatagtggaattcggg

SEQ ID NO: 7595783 - DNA, 22 bp, Homo sapiens
ggaagctgttcctgtgtggcca

SEQ ID NO: 7595784 - DNA, 22 bp, Homo sapiens
ggaagctgttcctgtgtggcca

SEQ ID NO: 7595785 - DNA, 21 bp, Homo sapiens
ggaagctgtgtccatgctcct

SEQ ID NO: 7595786 - DNA, 21 bp, Homo sapiens
ggaagctgtgtccatgctcct

SEQ ID NO: 7595787 - DNA, 21 bp, Homo sapiens
ggaagctgtgtccatgctcct

SEQ ID NO: 7595788 - DNA, 22 bp, Homo sapiens
ggaagcttcatacctttattta

SEQ ID NO: 7595789 - DNA, 22 bp, Homo sapiens
ggaagctgttgtgagtgcagca

SEQ ID NO: 7595790 - DNA, 22 bp, Homo sapiens
ggaagctgttgtgagtgcagca

SEQ ID NO: 7595791 - DNA, 22 bp, Homo sapiens
ggaagctgttgtgagtgcagca

SEQ ID NO: 7595792 - DNA, 22 bp, Homo sapiens
ggaagctgttgtgagtgcagca

SEQ ID NO: 7595793 - DNA, 22 bp, Homo sapiens
ggaagctgttgtgagtgcagca

SEQ ID NO: 7595794 - DNA, 22 bp, Homo sapiens
ggaagctgttgtgagtgcagca

SEQ ID NO: 7595795 - DNA, 22 bp, Homo sapiens
ggaagccaggttactgttcaga

SEQ ID NO: 7595796 - DNA, 19 bp, Homo sapiens
ggaagccaggtcagcccac

SEQ ID NO: 7595797 - DNA, 22 bp, Homo sapiens
ggaagccagttgcttggtgtgg

SEQ ID NO: 7595798 - DNA, 22 bp, Homo sapiens
ggaagccataccctgatttctg

SEQ ID NO: 7595799 - DNA, 22 bp, Homo sapiens
ggaagccatgagggacagttct

SEQ ID NO: 7595800 - DNA, 22 bp, Homo sapiens
ggaagcccagctgtctcctgtc

SEQ ID NO: 7595801 - DNA, 22 bp, Homo sapiens
ggaagcccagctgtctcctgtc

SEQ ID NO: 7595802 - DNA, 22 bp, Homo sapiens
ggaagccccagacccagagtct

SEQ ID NO: 7595803 - DNA, 22 bp, Homo sapiens
ggaagccccagacccagagtct

SEQ ID NO: 7595804 - DNA, 22 bp, Homo sapiens
ggaagccccagcatggccttgg

SEQ ID NO: 7595805 - DNA, 22 bp, Homo sapiens
ggaagccccagcatggccttgg

SEQ ID NO: 7595806 - DNA, 22 bp, Homo sapiens
ggaagccccagcatggccttgg

SEQ ID NO: 7595807 - DNA, 22 bp, Homo sapiens
ggaagccccagctgtgggatcc

SEQ ID NO: 7595808 - DNA, 19 bp, Homo sapiens
ggaagccctgggtcagagc

SEQ ID NO: 7595809 - DNA, 19 bp, Homo sapiens
ggaagccctaaaggaccta

SEQ ID NO: 7595810 - DNA, 19 bp, Homo sapiens
ggaagccctgggtcagagc

SEQ ID NO: 7595811 - DNA, 17 bp, Homo sapiens
ggaagcccttctgcctg

SEQ ID NO: 7595812 - DNA, 17 bp, Homo sapiens
ggaagcccttctgcctg

SEQ ID NO: 7595813 - DNA, 17 bp, Homo sapiens
ggaagcccttctgcctg

SEQ ID NO: 7595814 - DNA, 22 bp, Homo sapiens
ggaagcctaaagcccaggtctc

SEQ ID NO: 7595815 - DNA, 22 bp, Homo sapiens
ggaagcctaaagcccaggtctc

SEQ ID NO: 7595816 - DNA, 22 bp, Homo sapiens
ggacacagtggaagacagcttg

SEQ ID NO: 7595817 - DNA, 21 bp, Homo sapiens
ggacaccagtcacactggatt

SEQ ID NO: 7595818 - DNA, 21 bp, Homo sapiens
ggacaccagtcacactggatt

SEQ ID NO: 7595819 - DNA, 22 bp, Homo sapiens
ggaaggaagtgaccaggatatc

SEQ ID NO: 7595820 - DNA, 22 bp, Homo sapiens
ggaaggaagtgaccaggatatc

SEQ ID NO: 7595821 - DNA, 22 bp, Homo sapiens
ggaaggaagtgaccaggatatc

SEQ ID NO: 7595822 - DNA, 22 bp, Homo sapiens
ggaaggaagtgaccaggatatc

SEQ ID NO: 7595823 - DNA, 22 bp, Homo sapiens
ggaaggaagtgaccaggatatc

SEQ ID NO: 7595824 - DNA, 22 bp, Homo sapiens
ggaaggaagtgaccaggatatc

SEQ ID NO: 7595825 - DNA, 22 bp, Homo sapiens
ggaaggaagtgaccaggatatc

SEQ ID NO: 7595826 - DNA, 22 bp, Homo sapiens
ggaaggaagtgaccaggatatc

SEQ ID NO: 7595827 - DNA, 22 bp, Homo sapiens
ggacacagtggaagacagcttg

SEQ ID NO: 7595828 - DNA, 22 bp, Homo sapiens
ggaaggaagaggaccgagctgg

SEQ ID NO: 7595829 - DNA, 22 bp, Homo sapiens
ggaaggaagaggaccgagctgg

SEQ ID NO: 7595830 - DNA, 22 bp, Homo sapiens
ggaaggaagtaaatgatgctat

SEQ ID NO: 7595831 - DNA, 22 bp, Homo sapiens
ggaaggaagattctaactggag

SEQ ID NO: 7595832 - DNA, 22 bp, Homo sapiens
ggaaggaagtaaatgatgctat

SEQ ID NO: 7595833 - DNA, 22 bp, Homo sapiens
ggaaggaagtaaatgatgctat

SEQ ID NO: 7595834 - DNA, 22 bp, Homo sapiens
ggaaggaagaggaccgagctgg

SEQ ID NO: 7595835 - DNA, 22 bp, Homo sapiens
ggaaggaagaggaccgagctgg

SEQ ID NO: 7595836 - DNA, 22 bp, Homo sapiens
ggaaggaagaggaccgagctgg

SEQ ID NO: 7595837 - DNA, 22 bp, Homo sapiens
ggaaggaagattctaactggag

SEQ ID NO: 7595838 - DNA, 22 bp, Homo sapiens
ggaaggaagattctaactggag

SEQ ID NO: 7595839 - DNA, 22 bp, Homo sapiens
ggaaggaaattggggcagttgt

SEQ ID NO: 7595840 - DNA, 22 bp, Homo sapiens
ggaaggaaattggggcagttgt

SEQ ID NO: 7595841 - DNA, 22 bp, Homo sapiens
ggaaggaaattggggcagttgt

SEQ ID NO: 7595842 - DNA, 22 bp, Homo sapiens
ggaaggaaattggggcagttgt

SEQ ID NO: 7595843 - DNA, 22 bp, Homo sapiens
ggaaggaaagcagcttggccct

SEQ ID NO: 7595844 - DNA, 22 bp, Homo sapiens
ggaaggaaagcagcttggccct

SEQ ID NO: 7595845 - DNA, 22 bp, Homo sapiens
ggaagctttctctgtttcctta

SEQ ID NO: 7595846 - DNA, 22 bp, Homo sapiens
ggaaggaaattggggcagttgt

SEQ ID NO: 7595847 - DNA, 22 bp, Homo sapiens
ggaaggaaagcagcttggccct

SEQ ID NO: 7595848 - DNA, 22 bp, Homo sapiens
ggaaggaaagcagcttggccct

SEQ ID NO: 7595849 - DNA, 18 bp, Homo sapiens
ggaaggaagaatgcattt

SEQ ID NO: 7595850 - DNA, 18 bp, Homo sapiens
ggaaggaagaatgcattt

SEQ ID NO: 7595851 - DNA, 18 bp, Homo sapiens
ggaaggaagaatgcattt

SEQ ID NO: 7595852 - DNA, 18 bp, Homo sapiens
ggaaggaagaatgcattt

SEQ ID NO: 7595853 - DNA, 18 bp, Homo sapiens
ggaaggaagaatgcattt

SEQ ID NO: 7595854 - DNA, 18 bp, Homo sapiens
ggaaggaagaatgcattt

SEQ ID NO: 7595855 - DNA, 18 bp, Homo sapiens
ggaaggaagaatgcattt

SEQ ID NO: 7595856 - DNA, 18 bp, Homo sapiens
ggaaggaagaatgcattt

SEQ ID NO: 7595857 - DNA, 18 bp, Homo sapiens
ggaaggaagaatgcattt

SEQ ID NO: 7595858 - DNA, 18 bp, Homo sapiens
ggaaggaagaatgcattt

SEQ ID NO: 7595859 - DNA, 22 bp, Homo sapiens
ggaaggaacaaaccctgtgtgg

SEQ ID NO: 7595860 - DNA, 22 bp, Homo sapiens
ggaaggaacaaaccctgtgtgg

SEQ ID NO: 7595861 - DNA, 22 bp, Homo sapiens
ggaaggaacaaaccctgtgtgg

SEQ ID NO: 7595862 - DNA, 22 bp, Homo sapiens
ggaaggaacaaaccctgtgtgg

SEQ ID NO: 7595863 - DNA, 21 bp, Homo sapiens
ggaagcagtggcggcaactcc

SEQ ID NO: 7595864 - DNA, 21 bp, Homo sapiens
ggaagcagtggcggcaactcc

SEQ ID NO: 7595865 - DNA, 21 bp, Homo sapiens
ggaagcagtggcggcaactcc

SEQ ID NO: 7595866 - DNA, 21 bp, Homo sapiens
ggaagcagtggcggcaactcc

SEQ ID NO: 7595867 - DNA, 21 bp, Homo sapiens
ggaagcagtggcggcaactcc

SEQ ID NO: 7595868 - DNA, 22 bp, Homo sapiens
ggaagcaggaggctggggtaaa

SEQ ID NO: 7595869 - DNA, 22 bp, Homo sapiens
ggaagcaggaggctggggtaaa

SEQ ID NO: 7595870 - DNA, 22 bp, Homo sapiens
ggaaccttgctagatgctgagg

SEQ ID NO: 7595871 - DNA, 22 bp, Homo sapiens
ggaaccttgataataagttgtt

SEQ ID NO: 7595872 - DNA, 22 bp, Homo sapiens
ggaagccagaaagtgagaatat

SEQ ID NO: 7595873 - DNA, 22 bp, Homo sapiens
ggaagccacccagctttgatag

SEQ ID NO: 7595874 - DNA, 22 bp, Homo sapiens
ggaagccagagtgctgggcagg

SEQ ID NO: 7595875 - DNA, 22 bp, Homo sapiens
ggaagccagaaagtgagaatat

SEQ ID NO: 7595876 - DNA, 22 bp, Homo sapiens
ggaagccagagtgctgggcagg

SEQ ID NO: 7595877 - DNA, 22 bp, Homo sapiens
ggaagccagagtgctgggcagg

SEQ ID NO: 7595878 - DNA, 22 bp, Homo sapiens
ggaagccaggccaatgagaaca

SEQ ID NO: 7595879 - DNA, 22 bp, Homo sapiens
ggaagccaggccaatgagaaca

SEQ ID NO: 7595880 - DNA, 22 bp, Homo sapiens
ggaagccaggccaatgagaaca

SEQ ID NO: 7595881 - DNA, 22 bp, Homo sapiens
ggaagccaggccaatgagaaca

SEQ ID NO: 7595882 - DNA, 22 bp, Homo sapiens
ggaagccagagtgctgggcagg

SEQ ID NO: 7595883 - DNA, 20 bp, Homo sapiens
ggaagccagcatccttgagg

SEQ ID NO: 7595884 - DNA, 22 bp, Homo sapiens
ggaagccaggccaatgagaaca

SEQ ID NO: 7595885 - DNA, 22 bp, Homo sapiens
ggaagccaggctgggggatctg

SEQ ID NO: 7595886 - DNA, 20 bp, Homo sapiens
ggaagccagggtgcagggga

SEQ ID NO: 7595887 - DNA, 20 bp, Homo sapiens
ggaagccagggtgcagggga

SEQ ID NO: 7595888 - DNA, 22 bp, Homo sapiens
ggaagccaggctgggggatctg

SEQ ID NO: 7595889 - DNA, 22 bp, Homo sapiens
ggaagccaggctgggggatctg

SEQ ID NO: 7595890 - DNA, 22 bp, Homo sapiens
ggaagccaggctgggggatctg

SEQ ID NO: 7595891 - DNA, 22 bp, Homo sapiens
ggaagccaggcccagagatgct

SEQ ID NO: 7595892 - DNA, 22 bp, Homo sapiens
ggaagccaggcccagagatgct

SEQ ID NO: 7595893 - DNA, 21 bp, Homo sapiens
ggaacattgttaatagtctct

SEQ ID NO: 7595894 - DNA, 22 bp, Homo sapiens
ggaacatttcctggcagagagg

SEQ ID NO: 7595895 - DNA, 22 bp, Homo sapiens
ggaacatttaaattcttatttg

SEQ ID NO: 7595896 - DNA, 22 bp, Homo sapiens
ggaacatttaaattcttatttg

SEQ ID NO: 7595897 - DNA, 22 bp, Homo sapiens
ggaacatttaaattcttatttg

SEQ ID NO: 7595898 - DNA, 22 bp, Homo sapiens
ggaacattttttaaggcagaaa

SEQ ID NO: 7595899 - DNA, 22 bp, Homo sapiens
ggaacattttttaaggcagaaa

SEQ ID NO: 7595900 - DNA, 15 bp, Homo sapiens
ggaacatttctgttt

SEQ ID NO: 7595901 - DNA, 22 bp, Homo sapiens
ggaacatttcctggcagagagg

SEQ ID NO: 7595902 - DNA, 22 bp, Homo sapiens
ggaaccacagcccccagcaggc

SEQ ID NO: 7595903 - DNA, 22 bp, Homo sapiens
ggaaccactgtcttctaaagat

SEQ ID NO: 7595904 - DNA, 22 bp, Homo sapiens
ggaaccacagcccccagcaggc

SEQ ID NO: 7595905 - DNA, 22 bp, Homo sapiens
ggaaccttgataataagttgtt

SEQ ID NO: 7595906 - DNA, 22 bp, Homo sapiens
ggaaccttcatactgtttacca

SEQ ID NO: 7595907 - DNA, 23 bp, Homo sapiens
ggaaccttcttagcccctgagca

SEQ ID NO: 7595908 - DNA, 22 bp, Homo sapiens
ggaaccttattcacgccattta

SEQ ID NO: 7595909 - DNA, 22 bp, Homo sapiens
ggaaccttcatactgtttacca

SEQ ID NO: 7595910 - DNA, 22 bp, Homo sapiens
ggaacccatgattatggttagg

SEQ ID NO: 7595911 - DNA, 22 bp, Homo sapiens
ggaaccttacctaccagtggag

SEQ ID NO: 7595912 - DNA, 19 bp, Homo sapiens
ggaaccttagagcttcagc

SEQ ID NO: 7595913 - DNA, 22 bp, Homo sapiens
ggaaccttagtgttcttttacc

SEQ ID NO: 7595914 - DNA, 22 bp, Homo sapiens
ggaacagttgagatgatgtacc

SEQ ID NO: 7595915 - DNA, 22 bp, Homo sapiens
ggaacagtactcggaggccaga

SEQ ID NO: 7595916 - DNA, 20 bp, Homo sapiens
ggaaatcaccaggctccacc

SEQ ID NO: 7595917 - DNA, 22 bp, Homo sapiens
ggaacagggatttggcctggtt

SEQ ID NO: 7595918 - DNA, 22 bp, Homo sapiens
ggaacagggatttggcctggtt

SEQ ID NO: 7595919 - DNA, 22 bp, Homo sapiens
ggaacagggatttggcctggtt

SEQ ID NO: 7595920 - DNA, 22 bp, Homo sapiens
ggaaatctggtggtagatggga

SEQ ID NO: 7595921 - DNA, 22 bp, Homo sapiens
ggaaatctggtggtagatggga

SEQ ID NO: 7595922 - DNA, 22 bp, Homo sapiens
ggaaatctcttttgtggtgttt

SEQ ID NO: 7595923 - DNA, 22 bp, Homo sapiens
ggaaatctgcattttgaacaca

SEQ ID NO: 7595924 - DNA, 22 bp, Homo sapiens
ggaaatctgcattttgaacaca

SEQ ID NO: 7595925 - DNA, 22 bp, Homo sapiens
ggaaatctgcattttgaacaca

SEQ ID NO: 7595926 - DNA, 22 bp, Homo sapiens
ggaacattggcattttaaggct

SEQ ID NO: 7595927 - DNA, 22 bp, Homo sapiens
ggaacattctagagtgttgtga

SEQ ID NO: 7595928 - DNA, 21 bp, Homo sapiens
ggaacattgttaatagtctct

SEQ ID NO: 7595929 - DNA, 21 bp, Homo sapiens
ggaacattgttaatagtctct

SEQ ID NO: 7595930 - DNA, 22 bp, Homo sapiens
ggaacatactgtgtagactttg

SEQ ID NO: 7595931 - DNA, 22 bp, Homo sapiens
ggaacataccgaaaatacttaa

SEQ ID NO: 7595932 - DNA, 22 bp, Homo sapiens
ggaacagttgcgtcatgggcct

SEQ ID NO: 7595933 - DNA, 22 bp, Homo sapiens
ggaacataccgaaaatacttaa

SEQ ID NO: 7595934 - DNA, 22 bp, Homo sapiens
ggaacatactgtgtagactttg

SEQ ID NO: 7595935 - DNA, 22 bp, Homo sapiens
ggaacatactgtgtagactttg

SEQ ID NO: 7595936 - DNA, 20 bp, Homo sapiens
ggaacatgaatgtgagtggc

SEQ ID NO: 7595937 - DNA, 22 bp, Homo sapiens
gctgggtggatcggaggctctg

SEQ ID NO: 7595938 - DNA, 22 bp, Homo sapiens
gctgggtggatcggaggctctg

SEQ ID NO: 7595939 - DNA, 22 bp, Homo sapiens
gctgggtggatcggaggctctg

SEQ ID NO: 7595940 - DNA, 22 bp, Homo sapiens
gctgggtggatcggaggctctg

SEQ ID NO: 7595941 - DNA, 22 bp, Homo sapiens
gctgggtggatcggaggctctg

SEQ ID NO: 7595942 - DNA, 22 bp, Homo sapiens
gctgggtggatcggaggctctg

SEQ ID NO: 7595943 - DNA, 22 bp, Homo sapiens
gctgggtggatcggaggctctg

SEQ ID NO: 7595944 - DNA, 22 bp, Homo sapiens
gctgggtggatcggaggctctg

SEQ ID NO: 7595945 - DNA, 22 bp, Homo sapiens
gctgggtggatcggaggctctg

SEQ ID NO: 7595946 - DNA, 19 bp, Homo sapiens
gctgggtggggtccacagc

SEQ ID NO: 7595947 - DNA, 19 bp, Homo sapiens
gctgggtggggtccacagc

SEQ ID NO: 7595948 - DNA, 19 bp, Homo sapiens
gctgggtggggtccacagc

SEQ ID NO: 7595949 - DNA, 19 bp, Homo sapiens
gctgggtggggtccacagc

SEQ ID NO: 7595950 - DNA, 22 bp, Homo sapiens
gctgggtggatcggaggctctg

SEQ ID NO: 7595951 - DNA, 22 bp, Homo sapiens
gctgggtggatcggaggctctg

SEQ ID NO: 7595952 - DNA, 22 bp, Homo sapiens
gctgggtgtcacggggctcgtg

SEQ ID NO: 7595953 - DNA, 22 bp, Homo sapiens
gctgggtgtcacggggctcgtg

SEQ ID NO: 7595954 - DNA, 22 bp, Homo sapiens
gctgggtgtcacggggctcgtg

SEQ ID NO: 7595955 - DNA, 22 bp, Homo sapiens
gctgggtgtcacggggctcgtg

SEQ ID NO: 7595956 - DNA, 22 bp, Homo sapiens
gctgggtgtcacggggctcgtg

SEQ ID NO: 7595957 - DNA, 22 bp, Homo sapiens
gctgggtgtcacggggctcgtg

SEQ ID NO: 7595958 - DNA, 19 bp, Homo sapiens
gctgggtggggtccacagc

SEQ ID NO: 7595959 - DNA, 22 bp, Homo sapiens
gctgggtgattcatttccataa

SEQ ID NO: 7595960 - DNA, 19 bp, Homo sapiens
gctgggtgaggtcgttgga

SEQ ID NO: 7595961 - DNA, 19 bp, Homo sapiens
gctgggtgaggtcgttgga

SEQ ID NO: 7595962 - DNA, 19 bp, Homo sapiens
gctgggtgaggtcgttgga

SEQ ID NO: 7595963 - DNA, 22 bp, Homo sapiens
gctgggtctggctgtgagccgg

SEQ ID NO: 7595964 - DNA, 22 bp, Homo sapiens
gctgggtctggctgtgagccgg

SEQ ID NO: 7595965 - DNA, 22 bp, Homo sapiens
gctgggtctggctgtgagccgg

SEQ ID NO: 7595966 - DNA, 22 bp, Homo sapiens
gctgggtctggatgctcaggtg

SEQ ID NO: 7595967 - DNA, 22 bp, Homo sapiens
gctgggtctggatgctcaggtg

SEQ ID NO: 7595968 - DNA, 22 bp, Homo sapiens
gctgggtctggctgtgagccgg

SEQ ID NO: 7595969 - DNA, 22 bp, Homo sapiens
gctgggtctggctgtgagccgg

SEQ ID NO: 7595970 - DNA, 22 bp, Homo sapiens
gctgggtctggctgtgagccgg

SEQ ID NO: 7595971 - DNA, 22 bp, Homo sapiens
gctgggtcctatgctggtagag

SEQ ID NO: 7595972 - DNA, 22 bp, Homo sapiens
gctgggtcctatgctggtagag

SEQ ID NO: 7595973 - DNA, 22 bp, Homo sapiens
gctgggtctctccctggtcctg

SEQ ID NO: 7595974 - DNA, 22 bp, Homo sapiens
gctgggtcctatgctggtagag

SEQ ID NO: 7595975 - DNA, 22 bp, Homo sapiens
gctgggtctctccctggtcctg

SEQ ID NO: 7595976 - DNA, 22 bp, Homo sapiens
gctgggtctctccctggtcctg

SEQ ID NO: 7595977 - DNA, 22 bp, Homo sapiens
gctgggtctggatgctcaggtg

SEQ ID NO: 7595978 - DNA, 22 bp, Homo sapiens
gctgggtctctgggtgtaacaa

SEQ ID NO: 7595979 - DNA, 22 bp, Homo sapiens
gctgggtctctgggtgtaacaa

SEQ ID NO: 7595980 - DNA, 22 bp, Homo sapiens
gctgggtctggatgctcaggtg

SEQ ID NO: 7595981 - DNA, 22 bp, Homo sapiens
gctgggtctggatgctcaggtg

SEQ ID NO: 7595982 - DNA, 22 bp, Homo sapiens
gctgggtctggatgctcaggtg

SEQ ID NO: 7595983 - DNA, 22 bp, Homo sapiens
gctgggtctctccctggtcctg

SEQ ID NO: 7595984 - DNA, 22 bp, Homo sapiens
gctgggtttccagcaggcagga

SEQ ID NO: 7595985 - DNA, 22 bp, Homo sapiens
gctgggttttcttccgggccta

SEQ ID NO: 7595986 - DNA, 22 bp, Homo sapiens
gctgggtgtcacggggctcgtg

SEQ ID NO: 7595987 - DNA, 22 bp, Homo sapiens
gctgggtgtcacggggctcgtg

SEQ ID NO: 7595988 - DNA, 22 bp, Homo sapiens
gctgggttttcttccgggccta

SEQ ID NO: 7595989 - DNA, 22 bp, Homo sapiens
gctgggttttcttccgggccta

SEQ ID NO: 7595990 - DNA, 22 bp, Homo sapiens
gctgggttttcttccgggccta

SEQ ID NO: 7595991 - DNA, 22 bp, Homo sapiens
gctgggttttcttccgggccta

SEQ ID NO: 7595992 - DNA, 22 bp, Homo sapiens
gctgggttttcttccgggccta

SEQ ID NO: 7595993 - DNA, 22 bp, Homo sapiens
gctgggttttcttccgggccta

SEQ ID NO: 7595994 - DNA, 22 bp, Homo sapiens
gctggtcagagagaaaggaggc

SEQ ID NO: 7595995 - DNA, 22 bp, Homo sapiens
gctggtcactctgggagctgct

SEQ ID NO: 7595996 - DNA, 22 bp, Homo sapiens
gctgtcttcacttcctggtttc

SEQ ID NO: 7595997 - DNA, 16 bp, Homo sapiens
gctggtcaagcagcag

SEQ ID NO: 7595998 - DNA, 22 bp, Homo sapiens
gctggtaggaagtgctcctgcc

SEQ ID NO: 7595999 - DNA, 22 bp, Homo sapiens
gctggtagacctcactgcactc

SEQ ID NO: 7596000 - DNA, 22 bp, Homo sapiens
gctggtagacctcactgcactc

SEQ ID NO: 7596001 - DNA, 22 bp, Homo sapiens
gctggtagacctcactgcactc

SEQ ID NO: 7596002 - DNA, 22 bp, Homo sapiens
gctggtagacctcactgcactc

SEQ ID NO: 7596003 - DNA, 22 bp, Homo sapiens
gctggtagacctcactgcactc

SEQ ID NO: 7596004 - DNA, 22 bp, Homo sapiens
gctggtagacctcactgcactc

SEQ ID NO: 7596005 - DNA, 16 bp, Homo sapiens
gctgggagggagaggt

SEQ ID NO: 7596006 - DNA, 16 bp, Homo sapiens
gctgggagggagaggt

SEQ ID NO: 7596007 - DNA, 16 bp, Homo sapiens
gctgggagggagaggt

SEQ ID NO: 7596008 - DNA, 16 bp, Homo sapiens
gctgggagggagaggt

SEQ ID NO: 7596009 - DNA, 22 bp, Homo sapiens
gctgggaggatctctccctgtc

SEQ ID NO: 7596010 - DNA, 22 bp, Homo sapiens
gctgggaggcagcacctttagc

SEQ ID NO: 7596011 - DNA, 22 bp, Homo sapiens
gctgggaggcagcacctttagc

SEQ ID NO: 7596012 - DNA, 22 bp, Homo sapiens
gctgggaggcagcacctttagc

SEQ ID NO: 7596013 - DNA, 22 bp, Homo sapiens
gctgggaggcagcacctttagc

SEQ ID NO: 7596014 - DNA, 16 bp, Homo sapiens
gctgggagggagaggt

SEQ ID NO: 7596015 - DNA, 16 bp, Homo sapiens
gctgggagggagaggt

SEQ ID NO: 7596016 - DNA, 16 bp, Homo sapiens
gctgggagggagaggt

SEQ ID NO: 7596017 - DNA, 16 bp, Homo sapiens
gctgggagggagaggt

SEQ ID NO: 7596018 - DNA, 22 bp, Homo sapiens
gctgggagggaggctataccct

SEQ ID NO: 7596019 - DNA, 22 bp, Homo sapiens
gctgggagtcgcgtctgtggcc

SEQ ID NO: 7596020 - DNA, 22 bp, Homo sapiens
gctgggagtcgcgtctgtggcc

SEQ ID NO: 7596021 - DNA, 22 bp, Homo sapiens
gctgggagtcgcgtctgtggcc

SEQ ID NO: 7596022 - DNA, 22 bp, Homo sapiens
gctggggctgggctgaggaaga

SEQ ID NO: 7596023 - DNA, 20 bp, Homo sapiens
gctgggggtgtgctgagtga

SEQ ID NO: 7596024 - DNA, 20 bp, Homo sapiens
gctgggggtgtgctgagtga

SEQ ID NO: 7596025 - DNA, 20 bp, Homo sapiens
gctgggggtgtgctgagtga

SEQ ID NO: 7596026 - DNA, 20 bp, Homo sapiens
gctgggggtgtgctgagtga

SEQ ID NO: 7596027 - DNA, 20 bp, Homo sapiens
gctgggggtgtgctgagtga

SEQ ID NO: 7596028 - DNA, 20 bp, Homo sapiens
gctgggggtgtgctgagtga

SEQ ID NO: 7596029 - DNA, 20 bp, Homo sapiens
gctgggggtgtgctgagtga

SEQ ID NO: 7596030 - DNA, 20 bp, Homo sapiens
gctgggggtgtgctgagtga

SEQ ID NO: 7596031 - DNA, 22 bp, Homo sapiens
gctgggagtgggcaagatgaga

SEQ ID NO: 7596032 - DNA, 22 bp, Homo sapiens
gctgggagtcgcgtctgtggcc

SEQ ID NO: 7596033 - DNA, 22 bp, Homo sapiens
gctgggagtcgcgtctgtggcc

SEQ ID NO: 7596034 - DNA, 22 bp, Homo sapiens
gctgggagtcgcgtctgtggcc

SEQ ID NO: 7596035 - DNA, 22 bp, Homo sapiens
gctgggagtcgcgtctgtggcc

SEQ ID NO: 7596036 - DNA, 22 bp, Homo sapiens
gctgggagtcgcgtctgtggcc

SEQ ID NO: 7596037 - DNA, 22 bp, Homo sapiens
gctgggagtcgcgtctgtggcc

SEQ ID NO: 7596038 - DNA, 22 bp, Homo sapiens
gctggggtctgtgaggagggct

SEQ ID NO: 7596039 - DNA, 22 bp, Homo sapiens
gctggggtctgtgaggagggct

SEQ ID NO: 7596040 - DNA, 22 bp, Homo sapiens
gctggggtctgtgaggagggct

SEQ ID NO: 7596041 - DNA, 22 bp, Homo sapiens
gctggggtctgtgaggagggct

SEQ ID NO: 7596042 - DNA, 22 bp, Homo sapiens
gctggggtctgtgaggagggct

SEQ ID NO: 7596043 - DNA, 20 bp, Homo sapiens
gctgggggtgtgctgagtga

SEQ ID NO: 7596044 - DNA, 20 bp, Homo sapiens
gctgggggtgtgctgagtga

SEQ ID NO: 7596045 - DNA, 22 bp, Homo sapiens
gctggggtctgtgaggagggct

SEQ ID NO: 7596046 - DNA, 22 bp, Homo sapiens
gctggggtgtggtggataagct

SEQ ID NO: 7596047 - DNA, 22 bp, Homo sapiens
gctggggtgtggtggataagct

SEQ ID NO: 7596048 - DNA, 18 bp, Homo sapiens
gctggggttgagctctcc

SEQ ID NO: 7596049 - DNA, 18 bp, Homo sapiens
gctggggttgagctctcc

SEQ ID NO: 7596050 - DNA, 18 bp, Homo sapiens
gctggggttgagctctcc

SEQ ID NO: 7596051 - DNA, 18 bp, Homo sapiens
gctggggttgagctctcc

SEQ ID NO: 7596052 - DNA, 18 bp, Homo sapiens
gctggggttgagctctcc

SEQ ID NO: 7596053 - DNA, 22 bp, Homo sapiens
gctgggtcctatgctggtagag

SEQ ID NO: 7596054 - DNA, 22 bp, Homo sapiens
gctgggtcccaagcctggggag

SEQ ID NO: 7596055 - DNA, 22 bp, Homo sapiens
gctgggtcccaagcctggggag

SEQ ID NO: 7596056 - DNA, 22 bp, Homo sapiens
gctgggtccatggtcctcgggt

SEQ ID NO: 7596057 - DNA, 22 bp, Homo sapiens
gctgggtccatggtcctcgggt

SEQ ID NO: 7596058 - DNA, 21 bp, Homo sapiens
gctgggtcagcaggtcctctg

SEQ ID NO: 7596059 - DNA, 18 bp, Homo sapiens
gctggggttgagctctcc

SEQ ID NO: 7596060 - DNA, 18 bp, Homo sapiens
gctggggttgagctctcc

SEQ ID NO: 7596061 - DNA, 22 bp, Homo sapiens
gctgggtcagaatctccctgtg

SEQ ID NO: 7596062 - DNA, 22 bp, Homo sapiens
gctgggtattttaagaaaggaa

SEQ ID NO: 7596063 - DNA, 22 bp, Homo sapiens
gctgggtcagaatctccctgtg

SEQ ID NO: 7596064 - DNA, 22 bp, Homo sapiens
gctgggtcagaatctccctgtg

SEQ ID NO: 7596065 - DNA, 21 bp, Homo sapiens
gctgggtcagcaggtcctctg

SEQ ID NO: 7596066 - DNA, 21 bp, Homo sapiens
gctgggtcagcaggtcctctg

SEQ ID NO: 7596067 - DNA, 22 bp, Homo sapiens
gcttccagtaagttgctgccat

SEQ ID NO: 7596068 - DNA, 22 bp, Homo sapiens
gcttccagtaagttgctgccat

SEQ ID NO: 7596069 - DNA, 22 bp, Homo sapiens
gcttccagtaagttgctgccat

SEQ ID NO: 7596070 - DNA, 22 bp, Homo sapiens
gcttccagtaactcttgaaagg

SEQ ID NO: 7596071 - DNA, 22 bp, Homo sapiens
gcttccagtaagttgctgccat

SEQ ID NO: 7596072 - DNA, 22 bp, Homo sapiens
gcttccagtaagttgctgccat

SEQ ID NO: 7596073 - DNA, 22 bp, Homo sapiens
gcttccaagtcaatcaatgctg

SEQ ID NO: 7596074 - DNA, 22 bp, Homo sapiens
gcttccagtaactcttgaaagg

SEQ ID NO: 7596075 - DNA, 22 bp, Homo sapiens
gcttccaagcggtagatagcat

SEQ ID NO: 7596076 - DNA, 22 bp, Homo sapiens
gcttccaagtcaatcaatgctg

SEQ ID NO: 7596077 - DNA, 22 bp, Homo sapiens
gcttccaatgcttctatcacat

SEQ ID NO: 7596078 - DNA, 22 bp, Homo sapiens
gcttccacctactaaatgccac

SEQ ID NO: 7596079 - DNA, 22 bp, Homo sapiens
gcttccacctactaaatgccac

SEQ ID NO: 7596080 - DNA, 22 bp, Homo sapiens
gcttccaatgcttctatcacat

SEQ ID NO: 7596081 - DNA, 21 bp, Homo sapiens
gcttccaagatggcaccttga

SEQ ID NO: 7596082 - DNA, 21 bp, Homo sapiens
gcttccaagatggcaccttga

SEQ ID NO: 7596083 - DNA, 22 bp, Homo sapiens
gcttccaaatctgttcaaaatg

SEQ ID NO: 7596084 - DNA, 21 bp, Homo sapiens
gcttccaagatggcaccttga

SEQ ID NO: 7596085 - DNA, 21 bp, Homo sapiens
gcttccaagatggcaccttga

SEQ ID NO: 7596086 - DNA, 22 bp, Homo sapiens
gcttccaagcggtagatagcat

SEQ ID NO: 7596087 - DNA, 22 bp, Homo sapiens
gcttcattttgccctctggtgg

SEQ ID NO: 7596088 - DNA, 22 bp, Homo sapiens
gcttccaaacaaaattttgatg

SEQ ID NO: 7596089 - DNA, 19 bp, Homo sapiens
gctgtgcccctgccgcttg

SEQ ID NO: 7596090 - DNA, 20 bp, Homo sapiens
gcttcatttgcaagtctagt

SEQ ID NO: 7596091 - DNA, 20 bp, Homo sapiens
gcttcatttgcaagtctagt

SEQ ID NO: 7596092 - DNA, 22 bp, Homo sapiens
gcttcatttgagaacctctgtg

SEQ ID NO: 7596093 - DNA, 20 bp, Homo sapiens
gcttcatttgcaagtctagt

SEQ ID NO: 7596094 - DNA, 22 bp, Homo sapiens
gcttccagtcctcagaggctgg

SEQ ID NO: 7596095 - DNA, 22 bp, Homo sapiens
gcttccagtcctcagaggctgg

SEQ ID NO: 7596096 - DNA, 22 bp, Homo sapiens
gcttccagtcctcagaggctgg

SEQ ID NO: 7596097 - DNA, 22 bp, Homo sapiens
gcttccagtcctcagaggctgg

SEQ ID NO: 7596098 - DNA, 22 bp, Homo sapiens
gcttccagtgactttggtcgtg

SEQ ID NO: 7596099 - DNA, 16 bp, Homo sapiens
gcttccagtttagtgg

SEQ ID NO: 7596100 - DNA, 22 bp, Homo sapiens
gcttccagtcctcagaggctgg

SEQ ID NO: 7596101 - DNA, 22 bp, Homo sapiens
gcttccagtcctcagaggctgg

SEQ ID NO: 7596102 - DNA, 22 bp, Homo sapiens
gcttccagtcctcagaggctgg

SEQ ID NO: 7596103 - DNA, 22 bp, Homo sapiens
gcttccagtaagttgctgccat

SEQ ID NO: 7596104 - DNA, 22 bp, Homo sapiens
gcttccagtaagttgctgccat

SEQ ID NO: 7596105 - DNA, 22 bp, Homo sapiens
gcttccagtaagttgctgccat

SEQ ID NO: 7596106 - DNA, 22 bp, Homo sapiens
gcttccatctatgtcttcatca

SEQ ID NO: 7596107 - DNA, 22 bp, Homo sapiens
gcttcccaaacttgtggataga

SEQ ID NO: 7596108 - DNA, 22 bp, Homo sapiens
gcttcccaaacttgtggataga

SEQ ID NO: 7596109 - DNA, 22 bp, Homo sapiens
gcttcccaaacttgtggataga

SEQ ID NO: 7596110 - DNA, 22 bp, Homo sapiens
gcttcccaaacttgtggataga

SEQ ID NO: 7596111 - DNA, 22 bp, Homo sapiens
gctgtgcattgagcctgagagt

SEQ ID NO: 7596112 - DNA, 22 bp, Homo sapiens
gctgtgcattgagcctgagagt

SEQ ID NO: 7596113 - DNA, 20 bp, Homo sapiens
gctgtgccatgaccctcgag

SEQ ID NO: 7596114 - DNA, 22 bp, Homo sapiens
gctgtgcattgagcctgagagt

SEQ ID NO: 7596115 - DNA, 22 bp, Homo sapiens
gctgtgcatcttcattctggac

SEQ ID NO: 7596116 - DNA, 22 bp, Homo sapiens
gctgtgcatggagggccgttca

SEQ ID NO: 7596117 - DNA, 22 bp, Homo sapiens
gctgtgcataagtataataaac

SEQ ID NO: 7596118 - DNA, 22 bp, Homo sapiens
gctgtgcatcttcattctggac

SEQ ID NO: 7596119 - DNA, 22 bp, Homo sapiens
gctgtgcagtgggagttcggtg

SEQ ID NO: 7596120 - DNA, 22 bp, Homo sapiens
gctgtgcagtctttggtgtgcc

SEQ ID NO: 7596121 - DNA, 22 bp, Homo sapiens
gctgtgcagtgggagttcggtg

SEQ ID NO: 7596122 - DNA, 22 bp, Homo sapiens
gctgtgcagtgggagttcggtg

SEQ ID NO: 7596123 - DNA, 22 bp, Homo sapiens
gctgtgcataagtataataaac

SEQ ID NO: 7596124 - DNA, 22 bp, Homo sapiens
gctgtgcccagctccagctctg

SEQ ID NO: 7596125 - DNA, 22 bp, Homo sapiens
gctgtgcccagctccagctctg

SEQ ID NO: 7596126 - DNA, 22 bp, Homo sapiens
gctgtgcccagccattctagat

SEQ ID NO: 7596127 - DNA, 22 bp, Homo sapiens
gctgtgcccagctccagctctg

SEQ ID NO: 7596128 - DNA, 22 bp, Homo sapiens
gctgtgcccagccattctagat

SEQ ID NO: 7596129 - DNA, 22 bp, Homo sapiens
gctgtgcccagctccagctctg

SEQ ID NO: 7596130 - DNA, 22 bp, Homo sapiens
gctgtgcccatattctgctgac

SEQ ID NO: 7596131 - DNA, 22 bp, Homo sapiens
gctgtgcccatattctgctgac

SEQ ID NO: 7596132 - DNA, 22 bp, Homo sapiens
gctgtgcccatattctgctgac

SEQ ID NO: 7596133 - DNA, 22 bp, Homo sapiens
gctgtgcccagctccagctctg

SEQ ID NO: 7596134 - DNA, 22 bp, Homo sapiens
gctgtgcccagctccagctctg

SEQ ID NO: 7596135 - DNA, 22 bp, Homo sapiens
gctgtgcccagctccagctctg

SEQ ID NO: 7596136 - DNA, 21 bp, Homo sapiens
gctgtgcaggtgcccctgctc

SEQ ID NO: 7596137 - DNA, 22 bp, Homo sapiens
gctgtgcaggtccccactgcct

SEQ ID NO: 7596138 - DNA, 22 bp, Homo sapiens
gctgtgcaggtccccactgcct

SEQ ID NO: 7596139 - DNA, 22 bp, Homo sapiens
gctgtgcaggtccccactgcct

SEQ ID NO: 7596140 - DNA, 22 bp, Homo sapiens
gctgtgcagtagtaggtacagt

SEQ ID NO: 7596141 - DNA, 22 bp, Homo sapiens
gctgtgcagtagtaggtacagt

SEQ ID NO: 7596142 - DNA, 22 bp, Homo sapiens
gctgtgcagtagtaggtacagt

SEQ ID NO: 7596143 - DNA, 22 bp, Homo sapiens
gctgtgcagtagtaggtacagt

SEQ ID NO: 7596144 - DNA, 22 bp, Homo sapiens
gctgtgcagtagtaggtacagt

SEQ ID NO: 7596145 - DNA, 22 bp, Homo sapiens
gctgtgcagtctttggtgtgcc

SEQ ID NO: 7596146 - DNA, 22 bp, Homo sapiens
gctgtgcagtctttggtgtgcc

SEQ ID NO: 7596147 - DNA, 22 bp, Homo sapiens
gctgtgcagccaagtgcctctg

SEQ ID NO: 7596148 - DNA, 22 bp, Homo sapiens
gctgtgcagccaagtgcctctg

SEQ ID NO: 7596149 - DNA, 21 bp, Homo sapiens
gctgtgcaggattgaaagcag

SEQ ID NO: 7596150 - DNA, 22 bp, Homo sapiens
gctgtgcaggggatttggttat

SEQ ID NO: 7596151 - DNA, 22 bp, Homo sapiens
gctgtgcagccaagtgcctctg

SEQ ID NO: 7596152 - DNA, 22 bp, Homo sapiens
gctgtgcagccaagtgcctctg

SEQ ID NO: 7596153 - DNA, 22 bp, Homo sapiens
gctgtgcagatgtagggagtgg

SEQ ID NO: 7596154 - DNA, 22 bp, Homo sapiens
gctgtgcagatgtagggagtgg

SEQ ID NO: 7596155 - DNA, 22 bp, Homo sapiens
gctgtgcagccaagtgcctctg

SEQ ID NO: 7596156 - DNA, 22 bp, Homo sapiens
gctgtgcagccaagtgcctctg

SEQ ID NO: 7596157 - DNA, 22 bp, Homo sapiens
gctgtcttgggtagaaagaggt

SEQ ID NO: 7596158 - DNA, 22 bp, Homo sapiens
gctgtcttgggtagaaagaggt

SEQ ID NO: 7596159 - DNA, 22 bp, Homo sapiens
gctgtcttgatgattggatgct

SEQ ID NO: 7596160 - DNA, 22 bp, Homo sapiens
gctgtcttgatgattggatgct

SEQ ID NO: 7596161 - DNA, 22 bp, Homo sapiens
gctgtcttgctcactcttgcag

SEQ ID NO: 7596162 - DNA, 22 bp, Homo sapiens
gctgtcttgatgattggatgct

SEQ ID NO: 7596163 - DNA, 22 bp, Homo sapiens
gctgtcttgtatgttgtaggac

SEQ ID NO: 7596164 - DNA, 22 bp, Homo sapiens
gctgtcttttcctggcagtaaa

SEQ ID NO: 7596165 - DNA, 22 bp, Homo sapiens
gctgtgaaacctcagtgatagt

SEQ ID NO: 7596166 - DNA, 22 bp, Homo sapiens
gctgtgaaagctgccacactgt

SEQ ID NO: 7596167 - DNA, 22 bp, Homo sapiens
gctgtgaacatgcacatggagt

SEQ ID NO: 7596168 - DNA, 22 bp, Homo sapiens
gctgtgaagaacctagtgaacc

SEQ ID NO: 7596169 - DNA, 22 bp, Homo sapiens
gctgtgagaaacagggagtgtc

SEQ ID NO: 7596170 - DNA, 22 bp, Homo sapiens
gctgtgagaaacagggagtgtc

SEQ ID NO: 7596171 - DNA, 22 bp, Homo sapiens
gctgtgagcactgctgggtgga

SEQ ID NO: 7596172 - DNA, 22 bp, Homo sapiens
gctgtgagcactgctgggtgga

SEQ ID NO: 7596173 - DNA, 22 bp, Homo sapiens
gctgtgagaaacagggagtgtc

SEQ ID NO: 7596174 - DNA, 22 bp, Homo sapiens
gctgtgaatctgaagactaaaa

SEQ ID NO: 7596175 - DNA, 22 bp, Homo sapiens
gctgtgaattattcttaactgg

SEQ ID NO: 7596176 - DNA, 22 bp, Homo sapiens
gctgtgaagaggccactgcatg

SEQ ID NO: 7596177 - DNA, 22 bp, Homo sapiens
gctgtgaagaggccactgcatg

SEQ ID NO: 7596178 - DNA, 22 bp, Homo sapiens
gctgtgaagctgcctggggctg

SEQ ID NO: 7596179 - DNA, 19 bp, Homo sapiens
gctgtgaatatcatgaggg

SEQ ID NO: 7596180 - DNA, 22 bp, Homo sapiens
gctgtgagccgctgctgagcat

SEQ ID NO: 7596181 - DNA, 22 bp, Homo sapiens
gctgtgagcactgctgggtgga

SEQ ID NO: 7596182 - DNA, 22 bp, Homo sapiens
gctgtgagccgctgctgagcat

SEQ ID NO: 7596183 - DNA, 22 bp, Homo sapiens
gctgtgagctgcctgtgtcaca

SEQ ID NO: 7596184 - DNA, 22 bp, Homo sapiens
gctgtgagctgcctgtgtcaca

SEQ ID NO: 7596185 - DNA, 22 bp, Homo sapiens
gctgtgagccgctgctgagcat

SEQ ID NO: 7596186 - DNA, 22 bp, Homo sapiens
gctgtgagctgcctgtgtcaca

SEQ ID NO: 7596187 - DNA, 22 bp, Homo sapiens
gctgtgagggcttctgaggcat

SEQ ID NO: 7596188 - DNA, 22 bp, Homo sapiens
gctgtgagggcttctgaggcat

SEQ ID NO: 7596189 - DNA, 22 bp, Homo sapiens
gctgtgagggcttctgaggcat

SEQ ID NO: 7596190 - DNA, 22 bp, Homo sapiens
gctgtgagggtctagtgaggtg

SEQ ID NO: 7596191 - DNA, 22 bp, Homo sapiens
gctgtgagggtctagtgaggtg

SEQ ID NO: 7596192 - DNA, 22 bp, Homo sapiens
gctgtgagggtctagtgaggtg

SEQ ID NO: 7596193 - DNA, 22 bp, Homo sapiens
gctgtgagggtctagtgaggtg

SEQ ID NO: 7596194 - DNA, 22 bp, Homo sapiens
gctgtgagtggaggaggctgag

SEQ ID NO: 7596195 - DNA, 22 bp, Homo sapiens
gctgtgagtggaggaggctgag

SEQ ID NO: 7596196 - DNA, 22 bp, Homo sapiens
gctgtgagtacaaggccctggg

SEQ ID NO: 7596197 - DNA, 22 bp, Homo sapiens
gctgtgagtgagctgcctaggc

SEQ ID NO: 7596198 - DNA, 22 bp, Homo sapiens
gctgtgagtgagctgcctaggc

SEQ ID NO: 7596199 - DNA, 22 bp, Homo sapiens
gctgtgagggtctagtgaggtg

SEQ ID NO: 7596200 - DNA, 22 bp, Homo sapiens
gctgtgagtacaaggccctggg

SEQ ID NO: 7596201 - DNA, 22 bp, Homo sapiens
gctgtgagtacaaggccctggg

SEQ ID NO: 7596202 - DNA, 22 bp, Homo sapiens
gctgtgatacagaaagacagag

SEQ ID NO: 7596203 - DNA, 22 bp, Homo sapiens
gctgtgataaatgcagatgtca

SEQ ID NO: 7596204 - DNA, 22 bp, Homo sapiens
gctgtgataaatgcagatgtca

SEQ ID NO: 7596205 - DNA, 22 bp, Homo sapiens
gctgtgatccttgagagaaggt

SEQ ID NO: 7596206 - DNA, 22 bp, Homo sapiens
gctgtgcaaatcgatttgttgg

SEQ ID NO: 7596207 - DNA, 22 bp, Homo sapiens
gctgtgcaaatcgatttgttgg

SEQ ID NO: 7596208 - DNA, 23 bp, Homo sapiens
gctgtgcacgagccactgcctgt

SEQ ID NO: 7596209 - DNA, 23 bp, Homo sapiens
gctgtgcacgagccactgcctgt

SEQ ID NO: 7596210 - DNA, 23 bp, Homo sapiens
gctgtgcacgagccactgcctgt

SEQ ID NO: 7596211 - DNA, 21 bp, Homo sapiens
gctgtgcacatagtagaagtg

SEQ ID NO: 7596212 - DNA, 21 bp, Homo sapiens
gctgtgcacatagtagaagtg

SEQ ID NO: 7596213 - DNA, 21 bp, Homo sapiens
gctgtgcacatagtagaagtg

SEQ ID NO: 7596214 - DNA, 22 bp, Homo sapiens
gctgtgcagatgtagggagtgg

SEQ ID NO: 7596215 - DNA, 22 bp, Homo sapiens
gctgtgcagatgtagggagtgg

SEQ ID NO: 7596216 - DNA, 21 bp, Homo sapiens
gctgtgcagaggatggagtgg

SEQ ID NO: 7596217 - DNA, 22 bp, Homo sapiens
gctgtgcagaggtgagaatcca

SEQ ID NO: 7596218 - DNA, 22 bp, Homo sapiens
gctgtgcagagcacagggtccc

SEQ ID NO: 7596219 - DNA, 21 bp, Homo sapiens
gctgtgcagaggatggagtgg

SEQ ID NO: 7596220 - DNA, 22 bp, Homo sapiens
gctgtgcactacctatacatcc

SEQ ID NO: 7596221 - DNA, 22 bp, Homo sapiens
gctgtgcagagcacagggtccc

SEQ ID NO: 7596222 - DNA, 22 bp, Homo sapiens
gctgtgcagagcacagggtccc

SEQ ID NO: 7596223 - DNA, 22 bp, Homo sapiens
gctgtgcagagcacagggtccc

SEQ ID NO: 7596224 - DNA, 23 bp, Homo sapiens
gctgtgcacgagccactgcctgt

SEQ ID NO: 7596225 - DNA, 22 bp, Homo sapiens
gctgtgcactacctatacatcc

SEQ ID NO: 7596226 - DNA, 23 bp, Homo sapiens
gctgtgcacgagccactgcctgt

SEQ ID NO: 7596227 - DNA, 23 bp, Homo sapiens
gctgtgcacgagccactgcctgt

SEQ ID NO: 7596228 - DNA, 22 bp, Homo sapiens
gctgccatgttgtgaggacact

SEQ ID NO: 7596229 - DNA, 21 bp, Homo sapiens
gctgcccaaccctgcatctcc

SEQ ID NO: 7596230 - DNA, 22 bp, Homo sapiens
gctgccattatgggaacgagaa

SEQ ID NO: 7596231 - DNA, 22 bp, Homo sapiens
gctgccatggtccaggctccag

SEQ ID NO: 7596232 - DNA, 22 bp, Homo sapiens
gctgccatgttgtgaggacact

SEQ ID NO: 7596233 - DNA, 22 bp, Homo sapiens
gctgccatggctgggggccgtg

SEQ ID NO: 7596234 - DNA, 22 bp, Homo sapiens
gctgccatggcctcctgcaagg

SEQ ID NO: 7596235 - DNA, 22 bp, Homo sapiens
gctgccatggcctcctgcaagg

SEQ ID NO: 7596236 - DNA, 22 bp, Homo sapiens
gctgccatgccacagcactcac

SEQ ID NO: 7596237 - DNA, 22 bp, Homo sapiens
gctgccatgccacagcactcac

SEQ ID NO: 7596238 - DNA, 22 bp, Homo sapiens
gctggcaatggtgtggtctggt

SEQ ID NO: 7596239 - DNA, 22 bp, Homo sapiens
gctgcccaatggtagtgtcttt

SEQ ID NO: 7596240 - DNA, 22 bp, Homo sapiens
gctggcacacagtacacgcctt

SEQ ID NO: 7596241 - DNA, 19 bp, Homo sapiens
gctggatggatcctggagt

SEQ ID NO: 7596242 - DNA, 21 bp, Homo sapiens
gctgcccaaccctgcatctcc

SEQ ID NO: 7596243 - DNA, 21 bp, Homo sapiens
gctgcccaaccctgcatctcc

SEQ ID NO: 7596244 - DNA, 21 bp, Homo sapiens
gctgcccaaccctgcatctcc

SEQ ID NO: 7596245 - DNA, 22 bp, Homo sapiens
gctgcccaatggtagtgtcttt

SEQ ID NO: 7596246 - DNA, 22 bp, Homo sapiens
gctgcccaatggtagtgtcttt

SEQ ID NO: 7596247 - DNA, 22 bp, Homo sapiens
gctgcccaatggtagtgtcttt

SEQ ID NO: 7596248 - DNA, 22 bp, Homo sapiens
gctgcccaatggtagtgtcttt

SEQ ID NO: 7596249 - DNA, 22 bp, Homo sapiens
gctggcactgggaaggactgag

SEQ ID NO: 7596250 - DNA, 22 bp, Homo sapiens
gctggcactgggaaggactgag

SEQ ID NO: 7596251 - DNA, 22 bp, Homo sapiens
gctggcactgggaaggactgag

SEQ ID NO: 7596252 - DNA, 22 bp, Homo sapiens
gctggcactgggaaggactgag

SEQ ID NO: 7596253 - DNA, 22 bp, Homo sapiens
gctggcactgggaaggactgag

SEQ ID NO: 7596254 - DNA, 19 bp, Homo sapiens
gctggcacttcaagggagc

SEQ ID NO: 7596255 - DNA, 19 bp, Homo sapiens
gctggcacttcaagggagc

SEQ ID NO: 7596256 - DNA, 22 bp, Homo sapiens
gctggcacttgggacaaaatct

SEQ ID NO: 7596257 - DNA, 22 bp, Homo sapiens
gctggcacctgcaccaagcagg

SEQ ID NO: 7596258 - DNA, 22 bp, Homo sapiens
gctggcacctgcaccaagcagg

SEQ ID NO: 7596259 - DNA, 22 bp, Homo sapiens
gctggcacctatttggacctgg

SEQ ID NO: 7596260 - DNA, 22 bp, Homo sapiens
gctggcacctatttggacctgg

SEQ ID NO: 7596261 - DNA, 22 bp, Homo sapiens
gctggcacatggctcagggcct

SEQ ID NO: 7596262 - DNA, 22 bp, Homo sapiens
gctggcacatggctcagggcct

SEQ ID NO: 7596263 - DNA, 22 bp, Homo sapiens
gctggcacctatttggacctgg

SEQ ID NO: 7596264 - DNA, 22 bp, Homo sapiens
gctggcacatggctcagggcct

SEQ ID NO: 7596265 - DNA, 22 bp, Homo sapiens
gctggcacatggctcagggcct

SEQ ID NO: 7596266 - DNA, 22 bp, Homo sapiens
gctggcacatggctcagggcct

SEQ ID NO: 7596267 - DNA, 22 bp, Homo sapiens
gctggcacatggctcagggcct

SEQ ID NO: 7596268 - DNA, 22 bp, Homo sapiens
gctggcacaggtggatgctggc

SEQ ID NO: 7596269 - DNA, 22 bp, Homo sapiens
gctggcacagaataagcaggca

SEQ ID NO: 7596270 - DNA, 22 bp, Homo sapiens
gctggcacacagtacacgcctt

SEQ ID NO: 7596271 - DNA, 22 bp, Homo sapiens
gctggcacacagtacacgcctt

SEQ ID NO: 7596272 - DNA, 22 bp, Homo sapiens
gctggcagaatttcttcttgct

SEQ ID NO: 7596273 - DNA, 19 bp, Homo sapiens
gctggcagaattttgaacc

SEQ ID NO: 7596274 - DNA, 22 bp, Homo sapiens
gctggcagactgggggcagaac

SEQ ID NO: 7596275 - DNA, 22 bp, Homo sapiens
gctggcagactgggggcagaac

SEQ ID NO: 7596276 - DNA, 22 bp, Homo sapiens
gctggcagactgggggcagaac

SEQ ID NO: 7596277 - DNA, 22 bp, Homo sapiens
gctggcagactgggggcagaac

SEQ ID NO: 7596278 - DNA, 22 bp, Homo sapiens
gctggcagactgggggcagaac

SEQ ID NO: 7596279 - DNA, 22 bp, Homo sapiens
gctggcagaagagctggttcaa

SEQ ID NO: 7596280 - DNA, 22 bp, Homo sapiens
gctggcagaagagctggttcaa

SEQ ID NO: 7596281 - DNA, 22 bp, Homo sapiens
gctggcacttgggacaaaatct

SEQ ID NO: 7596282 - DNA, 22 bp, Homo sapiens
gctggcagaagagctggttcaa

SEQ ID NO: 7596283 - DNA, 22 bp, Homo sapiens
gctggcagaagagctggttcaa

SEQ ID NO: 7596284 - DNA, 22 bp, Homo sapiens
gctggcagaagagctggttcaa

SEQ ID NO: 7596285 - DNA, 22 bp, Homo sapiens
gctggcagaatttcttcttgct

SEQ ID NO: 7596286 - DNA, 22 bp, Homo sapiens
gctggcagaatttcttcttgct

SEQ ID NO: 7596287 - DNA, 22 bp, Homo sapiens
gctggcagacttcctctggaac

SEQ ID NO: 7596288 - DNA, 22 bp, Homo sapiens
gctggcagacttcctctggaac

SEQ ID NO: 7596289 - DNA, 22 bp, Homo sapiens
gctggcagacttcctctggaac

SEQ ID NO: 7596290 - DNA, 22 bp, Homo sapiens
gctggcagacttcctctggaac

SEQ ID NO: 7596291 - DNA, 22 bp, Homo sapiens
gctggcagacttcctctggaac

SEQ ID NO: 7596292 - DNA, 22 bp, Homo sapiens
gctggcagacttcctctggaac

SEQ ID NO: 7596293 - DNA, 22 bp, Homo sapiens
gctggcagacttcctctggaac

SEQ ID NO: 7596294 - DNA, 22 bp, Homo sapiens
gctggcagacttcctctggaac

SEQ ID NO: 7596295 - DNA, 22 bp, Homo sapiens
gctggcagacttcctctggaac

SEQ ID NO: 7596296 - DNA, 22 bp, Homo sapiens
gctggcagactgggggcagaac

SEQ ID NO: 7596297 - DNA, 22 bp, Homo sapiens
gctggcagactgggggcagaac

SEQ ID NO: 7596298 - DNA, 22 bp, Homo sapiens
gctggcagactgggggcagaac

SEQ ID NO: 7596299 - DNA, 22 bp, Homo sapiens
gctggcagactgggggcagaac

SEQ ID NO: 7596300 - DNA, 22 bp, Homo sapiens
gctggcagactgggggcagaac

SEQ ID NO: 7596301 - DNA, 22 bp, Homo sapiens
gctggctcccagaggccccagc

SEQ ID NO: 7596302 - DNA, 22 bp, Homo sapiens
gctggctcccagaggccccagc

SEQ ID NO: 7596303 - DNA, 22 bp, Homo sapiens
gctggctcccagaggccccagc

SEQ ID NO: 7596304 - DNA, 22 bp, Homo sapiens
gctggctcccagaggccccagc

SEQ ID NO: 7596305 - DNA, 22 bp, Homo sapiens
gctggctccaaaagcaggggct

SEQ ID NO: 7596306 - DNA, 22 bp, Homo sapiens
gctggctcccagaggccccagc

SEQ ID NO: 7596307 - DNA, 22 bp, Homo sapiens
gctggctccaaaagcaggggct

SEQ ID NO: 7596308 - DNA, 22 bp, Homo sapiens
gctggctcaagtgtgcttccca

SEQ ID NO: 7596309 - DNA, 22 bp, Homo sapiens
gctggctccaaaagcaggggct

SEQ ID NO: 7596310 - DNA, 22 bp, Homo sapiens
gctggctccaaaagcaggggct

SEQ ID NO: 7596311 - DNA, 22 bp, Homo sapiens
gctggctccaaaagcaggggct

SEQ ID NO: 7596312 - DNA, 22 bp, Homo sapiens
gctggctcagggactagagttt

SEQ ID NO: 7596313 - DNA, 22 bp, Homo sapiens
gctggctcagggactagagttt

SEQ ID NO: 7596314 - DNA, 22 bp, Homo sapiens
gctggctcaagtgtgcttccca

SEQ ID NO: 7596315 - DNA, 22 bp, Homo sapiens
gctggctcaagtgtgcttccca

SEQ ID NO: 7596316 - DNA, 22 bp, Homo sapiens
gctggctcaagtgtgcttccca

SEQ ID NO: 7596317 - DNA, 22 bp, Homo sapiens
gctggctcaagtgtgcttccca

SEQ ID NO: 7596318 - DNA, 22 bp, Homo sapiens
gctggctcaagtgtgcttccca

SEQ ID NO: 7596319 - DNA, 22 bp, Homo sapiens
gctggctcagggggattagcaa

SEQ ID NO: 7596320 - DNA, 22 bp, Homo sapiens
gctggctcagggactagagttt

SEQ ID NO: 7596321 - DNA, 22 bp, Homo sapiens
gctggctcaagtgtgcttccca

SEQ ID NO: 7596322 - DNA, 22 bp, Homo sapiens
gctggctcaagtgtgcttccca

SEQ ID NO: 7596323 - DNA, 22 bp, Homo sapiens
gctggctcaagaggtccagagg

SEQ ID NO: 7596324 - DNA, 22 bp, Homo sapiens
gctggctcaagtgtgcttccca

SEQ ID NO: 7596325 - DNA, 22 bp, Homo sapiens
gctggctcaagaggtccagagg

SEQ ID NO: 7596326 - DNA, 22 bp, Homo sapiens
gctggctcaagaggtccagagg

SEQ ID NO: 7596327 - DNA, 22 bp, Homo sapiens
gctggctcaagaggtccagagg

SEQ ID NO: 7596328 - DNA, 22 bp, Homo sapiens
gctggctcaagaggtccagagg

SEQ ID NO: 7596329 - DNA, 22 bp, Homo sapiens
gctggcagggtggttgagagag

SEQ ID NO: 7596330 - DNA, 21 bp, Homo sapiens
gctggctcaaatgcttgtgtc

SEQ ID NO: 7596331 - DNA, 21 bp, Homo sapiens
gctggctcaaatgcttgtgtc

SEQ ID NO: 7596332 - DNA, 22 bp, Homo sapiens
gctggcagggacagctgcgtgt

SEQ ID NO: 7596333 - DNA, 22 bp, Homo sapiens
gctggcagggacagctgcgtgt

SEQ ID NO: 7596334 - DNA, 22 bp, Homo sapiens
gctggcagggacagctgcgtgt

SEQ ID NO: 7596335 - DNA, 22 bp, Homo sapiens
gctggcagggacagctgcgtgt

SEQ ID NO: 7596336 - DNA, 22 bp, Homo sapiens
gctggcagggacagctgcgtgt

SEQ ID NO: 7596337 - DNA, 22 bp, Homo sapiens
gctggcagggacagctgcgtgt

SEQ ID NO: 7596338 - DNA, 22 bp, Homo sapiens
gctggcagggacagctgcgtgt

SEQ ID NO: 7596339 - DNA, 22 bp, Homo sapiens
gctggcagggacagctgcgtgt

SEQ ID NO: 7596340 - DNA, 22 bp, Homo sapiens
gctggcagggacagctgcgtgt

SEQ ID NO: 7596341 - DNA, 22 bp, Homo sapiens
gctggcaggatagaagtctaat

SEQ ID NO: 7596342 - DNA, 22 bp, Homo sapiens
gctggcaggatagaagtctaat

SEQ ID NO: 7596343 - DNA, 22 bp, Homo sapiens
gctggcaggataacttctaagc

SEQ ID NO: 7596344 - DNA, 22 bp, Homo sapiens
gctggcaggataacttctaagc

SEQ ID NO: 7596345 - DNA, 22 bp, Homo sapiens
gctggcaggagaaacggggtgc

SEQ ID NO: 7596346 - DNA, 22 bp, Homo sapiens
gctggcaggagaaacggggtgc

SEQ ID NO: 7596347 - DNA, 22 bp, Homo sapiens
gctggcaggagaaacggggtgc

SEQ ID NO: 7596348 - DNA, 22 bp, Homo sapiens
gctggcaggagaccatacccta

SEQ ID NO: 7596349 - DNA, 22 bp, Homo sapiens
gctggcaggagaaacggggtgc

SEQ ID NO: 7596350 - DNA, 22 bp, Homo sapiens
gctggcaggagaccatacccta

SEQ ID NO: 7596351 - DNA, 22 bp, Homo sapiens
gctggcaggagcctttcccttt

SEQ ID NO: 7596352 - DNA, 22 bp, Homo sapiens
gctggcaggagaccatacccta

SEQ ID NO: 7596353 - DNA, 22 bp, Homo sapiens
gctggcagagacaagaagacta

SEQ ID NO: 7596354 - DNA, 22 bp, Homo sapiens
gctggcagagacaagaagacta

SEQ ID NO: 7596355 - DNA, 22 bp, Homo sapiens
gctggcagagacaagaagacta

SEQ ID NO: 7596356 - DNA, 22 bp, Homo sapiens
gctggcagagacaagaagacta

SEQ ID NO: 7596357 - DNA, 22 bp, Homo sapiens
gctggcagagagctggtgagga

SEQ ID NO: 7596358 - DNA, 22 bp, Homo sapiens
gctggcagagacaagaagacta

SEQ ID NO: 7596359 - DNA, 22 bp, Homo sapiens
gctggcagagacaagaagacta

SEQ ID NO: 7596360 - DNA, 22 bp, Homo sapiens
gctggcagctggaagttgggct

SEQ ID NO: 7596361 - DNA, 22 bp, Homo sapiens
gctggcagctggaagttgggct

SEQ ID NO: 7596362 - DNA, 22 bp, Homo sapiens
gctggcagctggaagttgggct

SEQ ID NO: 7596363 - DNA, 22 bp, Homo sapiens
gctggcagccaagtgaagaggg

SEQ ID NO: 7596364 - DNA, 22 bp, Homo sapiens
gctggcaggagaaacggggtgc

SEQ ID NO: 7596365 - DNA, 22 bp, Homo sapiens
gctggcagctggaagttgggct

SEQ ID NO: 7596366 - DNA, 22 bp, Homo sapiens
gctgggagcaaagccatgcata

SEQ ID NO: 7596367 - DNA, 22 bp, Homo sapiens
gctgggagcaaagccatgcata

SEQ ID NO: 7596368 - DNA, 22 bp, Homo sapiens
gctgggagcaaagccatgcata

SEQ ID NO: 7596369 - DNA, 22 bp, Homo sapiens
gctgggagcaaagccatgcata

SEQ ID NO: 7596370 - DNA, 22 bp, Homo sapiens
gctgggagcaaagccatgcata

SEQ ID NO: 7596371 - DNA, 22 bp, Homo sapiens
gctgggagcaaagccatgcata

SEQ ID NO: 7596372 - DNA, 22 bp, Homo sapiens
gctgggagaggccctgaagtga

SEQ ID NO: 7596373 - DNA, 22 bp, Homo sapiens
gctgggaggatctctccctgtc

SEQ ID NO: 7596374 - DNA, 22 bp, Homo sapiens
gctgggaggatctctccctgtc

SEQ ID NO: 7596375 - DNA, 22 bp, Homo sapiens
gctgggaggatctctccctgtc

SEQ ID NO: 7596376 - DNA, 22 bp, Homo sapiens
gctgggaggaatttggggaata

SEQ ID NO: 7596377 - DNA, 22 bp, Homo sapiens
gctgggaggatctctccctgtc

SEQ ID NO: 7596378 - DNA, 22 bp, Homo sapiens
gctgggaggatctctccctgtc

SEQ ID NO: 7596379 - DNA, 22 bp, Homo sapiens
gctgggaggatctctccctgtc

SEQ ID NO: 7596380 - DNA, 22 bp, Homo sapiens
gctgggagaggccctgaagtga

SEQ ID NO: 7596381 - DNA, 22 bp, Homo sapiens
gctgggagaggcagctttcgga

SEQ ID NO: 7596382 - DNA, 22 bp, Homo sapiens
gctgggagaggccctgaagtga

SEQ ID NO: 7596383 - DNA, 22 bp, Homo sapiens
gctgggagaggccctgaagtga

SEQ ID NO: 7596384 - DNA, 22 bp, Homo sapiens
gctgggagaggccctgaagtga

SEQ ID NO: 7596385 - DNA, 22 bp, Homo sapiens
gctgggagaggccctgaagtga

SEQ ID NO: 7596386 - DNA, 22 bp, Homo sapiens
gctgggagacagacttggaacc

SEQ ID NO: 7596387 - DNA, 22 bp, Homo sapiens
gctgggagaggcagctttcgga

SEQ ID NO: 7596388 - DNA, 22 bp, Homo sapiens
gctgggagaggcagctttcgga

SEQ ID NO: 7596389 - DNA, 22 bp, Homo sapiens
gctgggagaggccctgaagtga

SEQ ID NO: 7596390 - DNA, 22 bp, Homo sapiens
gctgggactgagacagtgacct

SEQ ID NO: 7596391 - DNA, 22 bp, Homo sapiens
gctgggactgagacagtgacct

SEQ ID NO: 7596392 - DNA, 22 bp, Homo sapiens
gctgggagacagacttggaacc

SEQ ID NO: 7596393 - DNA, 22 bp, Homo sapiens
gctgggagacagacttggaacc

SEQ ID NO: 7596394 - DNA, 22 bp, Homo sapiens
gctgggagacagacttggaacc

SEQ ID NO: 7596395 - DNA, 22 bp, Homo sapiens
gctgggagacagacttggaacc

SEQ ID NO: 7596396 - DNA, 22 bp, Homo sapiens
gctgggagacagacttggaacc

SEQ ID NO: 7596397 - DNA, 22 bp, Homo sapiens
gctgggagacagacttggaacc

SEQ ID NO: 7596398 - DNA, 22 bp, Homo sapiens
gctgggaagaacaggagagaat

SEQ ID NO: 7596399 - DNA, 22 bp, Homo sapiens
gctgggaagagatgcacatgat

SEQ ID NO: 7596400 - DNA, 22 bp, Homo sapiens
gctgggaagaacaggagagaat

SEQ ID NO: 7596401 - DNA, 22 bp, Homo sapiens
gctgggaagaacaggagagaat

SEQ ID NO: 7596402 - DNA, 22 bp, Homo sapiens
gctgggaagaacaggagagaat

SEQ ID NO: 7596403 - DNA, 22 bp, Homo sapiens
gctgggaaccatgggaaggcag

SEQ ID NO: 7596404 - DNA, 22 bp, Homo sapiens
gctgggaaccatgggaaggcag

SEQ ID NO: 7596405 - DNA, 22 bp, Homo sapiens
gctgggaaccatgggaaggcag

SEQ ID NO: 7596406 - DNA, 22 bp, Homo sapiens
gctgggaaccatgggaaggcag

SEQ ID NO: 7596407 - DNA, 22 bp, Homo sapiens
gctgggaagtgcaagatcaagg

SEQ ID NO: 7596408 - DNA, 22 bp, Homo sapiens
gctgggaagagatgcacatgat

SEQ ID NO: 7596409 - DNA, 22 bp, Homo sapiens
gctgggaagagatgcacatgat

SEQ ID NO: 7596410 - DNA, 22 bp, Homo sapiens
gctgggaagagatgcacatgat

SEQ ID NO: 7596411 - DNA, 22 bp, Homo sapiens
gctgggaagtgcaagatcaagg

SEQ ID NO: 7596412 - DNA, 22 bp, Homo sapiens
gctgggaagtgcaagatcaagg

SEQ ID NO: 7596413 - DNA, 22 bp, Homo sapiens
gctgggaagtggcagagctgga

SEQ ID NO: 7596414 - DNA, 22 bp, Homo sapiens
gctgggaagtggcagagctgga

SEQ ID NO: 7596415 - DNA, 22 bp, Homo sapiens
gctgggaagtggcagagctgga

SEQ ID NO: 7596416 - DNA, 22 bp, Homo sapiens
gctgggaagtggcagagctgga

SEQ ID NO: 7596417 - DNA, 22 bp, Homo sapiens
gctgggaagtgcaagatcaagg

SEQ ID NO: 7596418 - DNA, 20 bp, Homo sapiens
gctgggacgcccggtccgga

SEQ ID NO: 7596419 - DNA, 22 bp, Homo sapiens
gctgggacggctcagtaagaag

SEQ ID NO: 7596420 - DNA, 20 bp, Homo sapiens
gctgggacgcccggtccgga

SEQ ID NO: 7596421 - DNA, 22 bp, Homo sapiens
gctgggacaggcttggccctgt

SEQ ID NO: 7596422 - DNA, 22 bp, Homo sapiens
gctgggacaggcttggccctgt

SEQ ID NO: 7596423 - DNA, 22 bp, Homo sapiens
gctgggacaggcttggccctgt

SEQ ID NO: 7596424 - DNA, 22 bp, Homo sapiens
gctgggacaggcttggccctgt

SEQ ID NO: 7596425 - DNA, 20 bp, Homo sapiens
gctgggacgcccggtccgga

SEQ ID NO: 7596426 - DNA, 22 bp, Homo sapiens
gctgggacggctcagtaagaag

SEQ ID NO: 7596427 - DNA, 22 bp, Homo sapiens
gctgggacggctcagtaagaag

SEQ ID NO: 7596428 - DNA, 22 bp, Homo sapiens
gctgggactgagacagtgacct

SEQ ID NO: 7596429 - DNA, 22 bp, Homo sapiens
gctgggactgagacagtgacct

SEQ ID NO: 7596430 - DNA, 22 bp, Homo sapiens
gctgggactgagacagtgacct

SEQ ID NO: 7596431 - DNA, 22 bp, Homo sapiens
gctgggactgagacagtgacct

SEQ ID NO: 7596432 - DNA, 22 bp, Homo sapiens
gctgggaatgattttggagagg

SEQ ID NO: 7596433 - DNA, 22 bp, Homo sapiens
gctgggaagtggcagagctgga

SEQ ID NO: 7596434 - DNA, 22 bp, Homo sapiens
gctgggaatgattttggagagg

SEQ ID NO: 7596435 - DNA, 22 bp, Homo sapiens
gctgggaatgattttggagagg

SEQ ID NO: 7596436 - DNA, 22 bp, Homo sapiens
gctgggacaggcttggccctgt

SEQ ID NO: 7596437 - DNA, 22 bp, Homo sapiens
gctgggacaggcttggccctgt

SEQ ID NO: 7596438 - DNA, 22 bp, Homo sapiens
gctgggacaggcttggccctgt

SEQ ID NO: 7596439 - DNA, 22 bp, Homo sapiens
gctgggacaacaggtgagcacc

SEQ ID NO: 7596440 - DNA, 22 bp, Homo sapiens
gctgggacaacaggtgagcacc

SEQ ID NO: 7596441 - DNA, 22 bp, Homo sapiens
gctgggacaacaggtgagcacc

SEQ ID NO: 7596442 - DNA, 22 bp, Homo sapiens
gctggctgcacaggggctcact

SEQ ID NO: 7596443 - DNA, 22 bp, Homo sapiens
gctggctgcacaggggctcact

SEQ ID NO: 7596444 - DNA, 22 bp, Homo sapiens
gctggctgcacaggggctcact

SEQ ID NO: 7596445 - DNA, 22 bp, Homo sapiens
gctggctgcacaggggctcact

SEQ ID NO: 7596446 - DNA, 22 bp, Homo sapiens
gctggctgcacaggggctcact

SEQ ID NO: 7596447 - DNA, 22 bp, Homo sapiens
gctggctgcacaggggctcact

SEQ ID NO: 7596448 - DNA, 22 bp, Homo sapiens
gctggctgagttctgtcgtctg

SEQ ID NO: 7596449 - DNA, 22 bp, Homo sapiens
gctggctcttcagtggagatag

SEQ ID NO: 7596450 - DNA, 22 bp, Homo sapiens
gctggctgcacaggggctcact

SEQ ID NO: 7596451 - DNA, 22 bp, Homo sapiens
gctggctgagttctgtcgtctg

SEQ ID NO: 7596452 - DNA, 22 bp, Homo sapiens
gctggctgcacaggggctcact

SEQ ID NO: 7596453 - DNA, 22 bp, Homo sapiens
gctggctgcacaggggctcact

SEQ ID NO: 7596454 - DNA, 22 bp, Homo sapiens
gctggctgcacaggggctcact

SEQ ID NO: 7596455 - DNA, 22 bp, Homo sapiens
gctggctgcacaggggctcact

SEQ ID NO: 7596456 - DNA, 18 bp, Homo sapiens
gctggctgcacttctgct

SEQ ID NO: 7596457 - DNA, 18 bp, Homo sapiens
gctggctgcacttctgct

SEQ ID NO: 7596458 - DNA, 18 bp, Homo sapiens
gctggctgcacttctgct

SEQ ID NO: 7596459 - DNA, 18 bp, Homo sapiens
gctggctgcacttctgct

SEQ ID NO: 7596460 - DNA, 18 bp, Homo sapiens
gctggctgcacttctgct

SEQ ID NO: 7596461 - DNA, 18 bp, Homo sapiens
gctggctgcacttctgct

SEQ ID NO: 7596462 - DNA, 22 bp, Homo sapiens
gctggctgccaatttcagagct

SEQ ID NO: 7596463 - DNA, 22 bp, Homo sapiens
gctggctgcagattttagaggt

SEQ ID NO: 7596464 - DNA, 22 bp, Homo sapiens
gctggctgcagattttagaggt

SEQ ID NO: 7596465 - DNA, 22 bp, Homo sapiens
gctggctgcagattttagaggt

SEQ ID NO: 7596466 - DNA, 22 bp, Homo sapiens
gctggctgccaatttcagagct

SEQ ID NO: 7596467 - DNA, 22 bp, Homo sapiens
gctggctgccaatttcagagct

SEQ ID NO: 7596468 - DNA, 22 bp, Homo sapiens
gctggctgccaatttcagagct

SEQ ID NO: 7596469 - DNA, 22 bp, Homo sapiens
gctggctgcagattttagaggt

SEQ ID NO: 7596470 - DNA, 22 bp, Homo sapiens
gctggctgcagattttagaggt

SEQ ID NO: 7596471 - DNA, 18 bp, Homo sapiens
gctggctgcacttctgct

SEQ ID NO: 7596472 - DNA, 18 bp, Homo sapiens
gctggctgcacttctgct

SEQ ID NO: 7596473 - DNA, 22 bp, Homo sapiens
gctggctgcagattttagaggt

SEQ ID NO: 7596474 - DNA, 22 bp, Homo sapiens
gctggctgcagattttagaggt

SEQ ID NO: 7596475 - DNA, 20 bp, Homo sapiens
gctgggaacaggattgaatc

SEQ ID NO: 7596476 - DNA, 22 bp, Homo sapiens
gctggctgccttactttgtgga

SEQ ID NO: 7596477 - DNA, 22 bp, Homo sapiens
gctggctgcctggttatgcctt

SEQ ID NO: 7596478 - DNA, 22 bp, Homo sapiens
gctggctgcctggttatgcctt

SEQ ID NO: 7596479 - DNA, 22 bp, Homo sapiens
gctggctgccttactttgtgga

SEQ ID NO: 7596480 - DNA, 22 bp, Homo sapiens
gctggctgccttactttgtgga

SEQ ID NO: 7596481 - DNA, 22 bp, Homo sapiens
gctggctgccttactttgtgga

SEQ ID NO: 7596482 - DNA, 22 bp, Homo sapiens
gctggctgcctggttatgcctt

SEQ ID NO: 7596483 - DNA, 22 bp, Homo sapiens
gctggctgccaatttcagagct

SEQ ID NO: 7596484 - DNA, 22 bp, Homo sapiens
gctggctgccaatttcagagct

SEQ ID NO: 7596485 - DNA, 22 bp, Homo sapiens
gctggctgccaatttcagagct

SEQ ID NO: 7596486 - DNA, 22 bp, Homo sapiens
gctggctcttcagtggagatag

SEQ ID NO: 7596487 - DNA, 22 bp, Homo sapiens
gctggctcttcagtggagatag

SEQ ID NO: 7596488 - DNA, 22 bp, Homo sapiens
gctggctcttcagtggagatag

SEQ ID NO: 7596489 - DNA, 22 bp, Homo sapiens
gctggctcttcagtggagatag

SEQ ID NO: 7596490 - DNA, 22 bp, Homo sapiens
gctggctctgccccacctgttc

SEQ ID NO: 7596491 - DNA, 22 bp, Homo sapiens
gctggctctgccccacctgttc

SEQ ID NO: 7596492 - DNA, 22 bp, Homo sapiens
gctggctctgtggtagttggca

SEQ ID NO: 7596493 - DNA, 22 bp, Homo sapiens
gctggctctgccccacctgttc

SEQ ID NO: 7596494 - DNA, 22 bp, Homo sapiens
gctggctctgcacccaggcctc

SEQ ID NO: 7596495 - DNA, 22 bp, Homo sapiens
gctggctctgcacccaggcctc

SEQ ID NO: 7596496 - DNA, 22 bp, Homo sapiens
gctggctctgcacccaggcctc

SEQ ID NO: 7596497 - DNA, 22 bp, Homo sapiens
gctggctctgatgggctccagg

SEQ ID NO: 7596498 - DNA, 22 bp, Homo sapiens
gctggctctgatgggctccagg

SEQ ID NO: 7596499 - DNA, 22 bp, Homo sapiens
gctggctctgcacccaggcctc

SEQ ID NO: 7596500 - DNA, 22 bp, Homo sapiens
gctggctctgcacccaggcctc

SEQ ID NO: 7596501 - DNA, 22 bp, Homo sapiens
gctggctctgcacccaggcctc

SEQ ID NO: 7596502 - DNA, 21 bp, Homo sapiens
gctggctctctgacgtgcttt

SEQ ID NO: 7596503 - DNA, 22 bp, Homo sapiens
gctggctctgatgggctccagg

SEQ ID NO: 7596504 - DNA, 21 bp, Homo sapiens
gctggctctctgacgtgcttt

SEQ ID NO: 7596505 - DNA, 22 bp, Homo sapiens
gctggctctgatgggctccagg

SEQ ID NO: 7596506 - DNA, 22 bp, Homo sapiens
gctggctctgatgggctccagg

SEQ ID NO: 7596507 - DNA, 22 bp, Homo sapiens
gctggctcgggaagcaggggat

SEQ ID NO: 7596508 - DNA, 22 bp, Homo sapiens
gctggctcctctgtcctcacgg

SEQ ID NO: 7596509 - DNA, 22 bp, Homo sapiens
gctggctcctctgtcctcacgg

SEQ ID NO: 7596510 - DNA, 22 bp, Homo sapiens
gctggctcggatttgaacagga

SEQ ID NO: 7596511 - DNA, 22 bp, Homo sapiens
gctggctcccattggtccttcc

SEQ ID NO: 7596512 - DNA, 22 bp, Homo sapiens
gctggctcccattggtccttcc

SEQ ID NO: 7596513 - DNA, 22 bp, Homo sapiens
gctggctcctctgtcctcacgg

SEQ ID NO: 7596514 - DNA, 22 bp, Homo sapiens
gctggctcctctgtcctcacgg

SEQ ID NO: 7596515 - DNA, 22 bp, Homo sapiens
gctggctcgggaagcaggggat

SEQ ID NO: 7596516 - DNA, 22 bp, Homo sapiens
gctggctcgggaagcaggggat

SEQ ID NO: 7596517 - DNA, 22 bp, Homo sapiens
gctggctcgggaagcaggggat

SEQ ID NO: 7596518 - DNA, 22 bp, Homo sapiens
gctggctcgggaagcaggggat

SEQ ID NO: 7596519 - DNA, 22 bp, Homo sapiens
gctggctctacatttgaggtca

SEQ ID NO: 7596520 - DNA, 22 bp, Homo sapiens
gctggctctcctcacagtacag

SEQ ID NO: 7596521 - DNA, 21 bp, Homo sapiens
gctggctctctgacgtgcttt

SEQ ID NO: 7596522 - DNA, 21 bp, Homo sapiens
gctggctctctgacgtgcttt

SEQ ID NO: 7596523 - DNA, 22 bp, Homo sapiens
gcctggggccagcttgggctga

SEQ ID NO: 7596524 - DNA, 22 bp, Homo sapiens
gcctggggccagcttgggctga

SEQ ID NO: 7596525 - DNA, 22 bp, Homo sapiens
gcctggggccagcttgggctga

SEQ ID NO: 7596526 - DNA, 22 bp, Homo sapiens
gcctggggccagcttgggctga

SEQ ID NO: 7596527 - DNA, 22 bp, Homo sapiens
gcctggggccagcttgggctga

SEQ ID NO: 7596528 - DNA, 22 bp, Homo sapiens
gcctggggccagcttgggctga

SEQ ID NO: 7596529 - DNA, 22 bp, Homo sapiens
gcctggggggcatgtcataata

SEQ ID NO: 7596530 - DNA, 22 bp, Homo sapiens
gcctggggggcatgtcataata

SEQ ID NO: 7596531 - DNA, 22 bp, Homo sapiens
gcctggggggcatgtcataata

SEQ ID NO: 7596532 - DNA, 22 bp, Homo sapiens
gcctggggcatgcagctgatac

SEQ ID NO: 7596533 - DNA, 22 bp, Homo sapiens
gcctggggcatgcagctgatac

SEQ ID NO: 7596534 - DNA, 22 bp, Homo sapiens
gcctggggcatgcagctgatac

SEQ ID NO: 7596535 - DNA, 22 bp, Homo sapiens
gcctggggaacttgatcctgtc

SEQ ID NO: 7596536 - DNA, 22 bp, Homo sapiens
gcctggggaacttgatcctgtc

SEQ ID NO: 7596537 - DNA, 22 bp, Homo sapiens
gcctggggcatgcagctgatac

SEQ ID NO: 7596538 - DNA, 22 bp, Homo sapiens
gcctggggcatgcagctgatac

SEQ ID NO: 7596539 - DNA, 22 bp, Homo sapiens
gcctggggcatgcagctgatac

SEQ ID NO: 7596540 - DNA, 22 bp, Homo sapiens
gcctggggtcccttgttggcac

SEQ ID NO: 7596541 - DNA, 22 bp, Homo sapiens
gcctggggtcccttgttggcac

SEQ ID NO: 7596542 - DNA, 22 bp, Homo sapiens
gcctggggtcccttgttggcac

SEQ ID NO: 7596543 - DNA, 22 bp, Homo sapiens
gcctggggtcccttgttggcac

SEQ ID NO: 7596544 - DNA, 22 bp, Homo sapiens
gcctggggtcccttgttggcac

SEQ ID NO: 7596545 - DNA, 22 bp, Homo sapiens
gcctggggtcccttgttggcac

SEQ ID NO: 7596546 - DNA, 22 bp, Homo sapiens
gcctggggggcatgtcataata

SEQ ID NO: 7596547 - DNA, 22 bp, Homo sapiens
gcctgggtaggagacaaaaggt

SEQ ID NO: 7596548 - DNA, 22 bp, Homo sapiens
gcctggggtctctgactcacag

SEQ ID NO: 7596549 - DNA, 22 bp, Homo sapiens
gcctggggtctctgactcacag

SEQ ID NO: 7596550 - DNA, 22 bp, Homo sapiens
gcctggggtctctgactcacag

SEQ ID NO: 7596551 - DNA, 22 bp, Homo sapiens
gcctggggtctctgactcacag

SEQ ID NO: 7596552 - DNA, 22 bp, Homo sapiens
gcctggggtctctgactcacag

SEQ ID NO: 7596553 - DNA, 22 bp, Homo sapiens
gcctggggtctctgactcacag

SEQ ID NO: 7596554 - DNA, 22 bp, Homo sapiens
gcctggggtctctgactcacag

SEQ ID NO: 7596555 - DNA, 22 bp, Homo sapiens
gcctggggtctctgactcacag

SEQ ID NO: 7596556 - DNA, 22 bp, Homo sapiens
gcctggggtctctgactcacag

SEQ ID NO: 7596557 - DNA, 22 bp, Homo sapiens
gcctggtgataagcagtgacct

SEQ ID NO: 7596558 - DNA, 22 bp, Homo sapiens
gcctggtgaaaggcagagagcg

SEQ ID NO: 7596559 - DNA, 22 bp, Homo sapiens
gcctggtgataagcagtgacct

SEQ ID NO: 7596560 - DNA, 22 bp, Homo sapiens
gcctggtgataagcagtgacct

SEQ ID NO: 7596561 - DNA, 22 bp, Homo sapiens
gcctggtgataagcagtgacct

SEQ ID NO: 7596562 - DNA, 22 bp, Homo sapiens
gcctggtgataagcagtgacct

SEQ ID NO: 7596563 - DNA, 22 bp, Homo sapiens
gcctggtgaaaggcagagagcg

SEQ ID NO: 7596564 - DNA, 22 bp, Homo sapiens
gcctggtgaaaggcagagagcg

SEQ ID NO: 7596565 - DNA, 22 bp, Homo sapiens
gcctggtgaaaggcagagagcg

SEQ ID NO: 7596566 - DNA, 22 bp, Homo sapiens
gcctggtgaaaggcagagagcg

SEQ ID NO: 7596567 - DNA, 22 bp, Homo sapiens
gcctggtgaaaggcagagagcg

SEQ ID NO: 7596568 - DNA, 22 bp, Homo sapiens
gcctggtgaaaggcagagagcg

SEQ ID NO: 7596569 - DNA, 22 bp, Homo sapiens
gcctggtgaaaggcagagagcg

SEQ ID NO: 7596570 - DNA, 22 bp, Homo sapiens
gcctggtgaaaggcagagagcg

SEQ ID NO: 7596571 - DNA, 22 bp, Homo sapiens
gcctggtgaaaggcagagagcg

SEQ ID NO: 7596572 - DNA, 22 bp, Homo sapiens
gcctggtgaaaggcagagagcg

SEQ ID NO: 7596573 - DNA, 22 bp, Homo sapiens
gcctggtctctttcatgtcagt

SEQ ID NO: 7596574 - DNA, 22 bp, Homo sapiens
gcctggtctctggggttgggta

SEQ ID NO: 7596575 - DNA, 23 bp, Homo sapiens
gcctgggttgtaactagtgcatc

SEQ ID NO: 7596576 - DNA, 23 bp, Homo sapiens
gcctgggttgtaactagtgcatc

SEQ ID NO: 7596577 - DNA, 22 bp, Homo sapiens
gcctgggttcctgcttttgtga

SEQ ID NO: 7596578 - DNA, 22 bp, Homo sapiens
gcctgggtgaatttgatcctaa

SEQ ID NO: 7596579 - DNA, 22 bp, Homo sapiens
gcctgggtgaatttgatcctaa

SEQ ID NO: 7596580 - DNA, 22 bp, Homo sapiens
gcctgggtctcctccgcttccc

SEQ ID NO: 7596581 - DNA, 22 bp, Homo sapiens
gcctgggtgagggtctccttca

SEQ ID NO: 7596582 - DNA, 22 bp, Homo sapiens
gcctgggtgagggtctccttca

SEQ ID NO: 7596583 - DNA, 22 bp, Homo sapiens
gcctgggtgagggtctccttca

SEQ ID NO: 7596584 - DNA, 22 bp, Homo sapiens
gcctgggtccaccgctcgcgct

SEQ ID NO: 7596585 - DNA, 22 bp, Homo sapiens
gcctgggtccactgatcatgct

SEQ ID NO: 7596586 - DNA, 22 bp, Homo sapiens
gcctgggtccactgatcatgct

SEQ ID NO: 7596587 - DNA, 22 bp, Homo sapiens
gcctgggtccactgatcatgct

SEQ ID NO: 7596588 - DNA, 23 bp, Homo sapiens
gcctgggtctagagataagagcc

SEQ ID NO: 7596589 - DNA, 22 bp, Homo sapiens
gcctgggttccatgatctccag

SEQ ID NO: 7596590 - DNA, 22 bp, Homo sapiens
gcctgggttccatgatctccag

SEQ ID NO: 7596591 - DNA, 22 bp, Homo sapiens
gcctgggttccatgatctccag

SEQ ID NO: 7596592 - DNA, 22 bp, Homo sapiens
gcctgggtgcccaatgatgaga

SEQ ID NO: 7596593 - DNA, 22 bp, Homo sapiens
gcctgggtgcccaatgatgaga

SEQ ID NO: 7596594 - DNA, 22 bp, Homo sapiens
gcctgggtgctctgtgtaaggg

SEQ ID NO: 7596595 - DNA, 22 bp, Homo sapiens
gcctgggtggagaggggtgaca

SEQ ID NO: 7596596 - DNA, 22 bp, Homo sapiens
gcctgggtggagaggggtgaca

SEQ ID NO: 7596597 - DNA, 22 bp, Homo sapiens
gcctgggtgtcgatcactagtg

SEQ ID NO: 7596598 - DNA, 22 bp, Homo sapiens
gcctgggtgtcgatcactagtg

SEQ ID NO: 7596599 - DNA, 22 bp, Homo sapiens
gccttaggggtcagacagagct

SEQ ID NO: 7596600 - DNA, 22 bp, Homo sapiens
gccttattacctgcactttgaa

SEQ ID NO: 7596601 - DNA, 21 bp, Homo sapiens
gccttcactcccagagtttgt

SEQ ID NO: 7596602 - DNA, 22 bp, Homo sapiens
gcctggtggacactgggcatca

SEQ ID NO: 7596603 - DNA, 18 bp, Homo sapiens
gccttcagactgcatgct

SEQ ID NO: 7596604 - DNA, 18 bp, Homo sapiens
gccttcagactgcatgct

SEQ ID NO: 7596605 - DNA, 21 bp, Homo sapiens
gccttcactcccagagtttgt

SEQ ID NO: 7596606 - DNA, 22 bp, Homo sapiens
gccttcagagtaccatgtcctc

SEQ ID NO: 7596607 - DNA, 22 bp, Homo sapiens
gccttcagagtaccatgtcctc

SEQ ID NO: 7596608 - DNA, 22 bp, Homo sapiens
gccttcagagtaccatgtcctc

SEQ ID NO: 7596609 - DNA, 18 bp, Homo sapiens
gccttcagactgcatgct

SEQ ID NO: 7596610 - DNA, 18 bp, Homo sapiens
gccttcagactgcatgct

SEQ ID NO: 7596611 - DNA, 22 bp, Homo sapiens
gccttcagcggccgctcgctgc

SEQ ID NO: 7596612 - DNA, 22 bp, Homo sapiens
gccttcagccctgactggccag

SEQ ID NO: 7596613 - DNA, 22 bp, Homo sapiens
gccttcagccctgactggccag

SEQ ID NO: 7596614 - DNA, 22 bp, Homo sapiens
gccttcagagtaccatgtcctc

SEQ ID NO: 7596615 - DNA, 22 bp, Homo sapiens
gccttcagccctgactggccag

SEQ ID NO: 7596616 - DNA, 22 bp, Homo sapiens
gcctggtgtccagaggcgagtg

SEQ ID NO: 7596617 - DNA, 22 bp, Homo sapiens
gcctggtgtccagaggcgagtg

SEQ ID NO: 7596618 - DNA, 22 bp, Homo sapiens
gcctggtgtccagaggcgagtg

SEQ ID NO: 7596619 - DNA, 22 bp, Homo sapiens
gcctggtgtccagaggcgagtg

SEQ ID NO: 7596620 - DNA, 22 bp, Homo sapiens
gcctggtggacactgggcatca

SEQ ID NO: 7596621 - DNA, 22 bp, Homo sapiens
gcctggtggtatcctggcaaga

SEQ ID NO: 7596622 - DNA, 22 bp, Homo sapiens
gcctggtggtgtgctcaagtgg

SEQ ID NO: 7596623 - DNA, 22 bp, Homo sapiens
gcctggtggtatcctggcaaga

SEQ ID NO: 7596624 - DNA, 22 bp, Homo sapiens
gcctggtggacactgggcatca

SEQ ID NO: 7596625 - DNA, 22 bp, Homo sapiens
gcctggtggacactgggcatca

SEQ ID NO: 7596626 - DNA, 22 bp, Homo sapiens
gcctggtggacactgggcatca

SEQ ID NO: 7596627 - DNA, 22 bp, Homo sapiens
gcctggtgctatgagggccagc

SEQ ID NO: 7596628 - DNA, 22 bp, Homo sapiens
gcctggtgctatgagggccagc

SEQ ID NO: 7596629 - DNA, 22 bp, Homo sapiens
gcctggtgctatgagggccagc

SEQ ID NO: 7596630 - DNA, 22 bp, Homo sapiens
gcctggtgctatgagggccagc

SEQ ID NO: 7596631 - DNA, 22 bp, Homo sapiens
gcctggtgctatgagggccagc

SEQ ID NO: 7596632 - DNA, 22 bp, Homo sapiens
gccttcatagagtgtaggcctt

SEQ ID NO: 7596633 - DNA, 22 bp, Homo sapiens
gccttccacctaggcctctgct

SEQ ID NO: 7596634 - DNA, 22 bp, Homo sapiens
gccttcagtagtgtcagctgta

SEQ ID NO: 7596635 - DNA, 22 bp, Homo sapiens
gccttcagtagtgtcagctgta

SEQ ID NO: 7596636 - DNA, 22 bp, Homo sapiens
gccttcagtagtgtcagctgta

SEQ ID NO: 7596637 - DNA, 22 bp, Homo sapiens
gccttcagtagtatcctcatga

SEQ ID NO: 7596638 - DNA, 22 bp, Homo sapiens
gccttcagtagtgtcagctgta

SEQ ID NO: 7596639 - DNA, 22 bp, Homo sapiens
gccttcagtagtgtcagctgta

SEQ ID NO: 7596640 - DNA, 22 bp, Homo sapiens
gccttcagtagtgtcagctgta

SEQ ID NO: 7596641 - DNA, 22 bp, Homo sapiens
gccttcagtagtatcctcatga

SEQ ID NO: 7596642 - DNA, 22 bp, Homo sapiens
gccttcagtaactgagacggaa

SEQ ID NO: 7596643 - DNA, 22 bp, Homo sapiens
gccttcagtagtatcctcatga

SEQ ID NO: 7596644 - DNA, 22 bp, Homo sapiens
gccttcagtagtatcctcatga

SEQ ID NO: 7596645 - DNA, 22 bp, Homo sapiens
gccttcaggtgtccctgtgggc

SEQ ID NO: 7596646 - DNA, 22 bp, Homo sapiens
gccttcaggtgtccctgtgggc

SEQ ID NO: 7596647 - DNA, 22 bp, Homo sapiens
gccttcaggtgctgccaggcta

SEQ ID NO: 7596648 - DNA, 22 bp, Homo sapiens
gccttcaggagggttccagaca

SEQ ID NO: 7596649 - DNA, 22 bp, Homo sapiens
gccttcaggagggttccagaca

SEQ ID NO: 7596650 - DNA, 22 bp, Homo sapiens
gccttcaggtgctgccaggcta

SEQ ID NO: 7596651 - DNA, 22 bp, Homo sapiens
gccttcaggtgctgccaggcta

SEQ ID NO: 7596652 - DNA, 22 bp, Homo sapiens
gccttcaggagggttccagaca

SEQ ID NO: 7596653 - DNA, 22 bp, Homo sapiens
gccttcaggaaatcagtccttg

SEQ ID NO: 7596654 - DNA, 22 bp, Homo sapiens
gccttcaggaaatcagtccttg

SEQ ID NO: 7596655 - DNA, 22 bp, Homo sapiens
gccttcaggaaatcagtccttg

SEQ ID NO: 7596656 - DNA, 23 bp, Homo sapiens
gccttcagctcgggaaggctccc

SEQ ID NO: 7596657 - DNA, 22 bp, Homo sapiens
gccttcagcggccgctcgctgc

SEQ ID NO: 7596658 - DNA, 22 bp, Homo sapiens
gccttcagcggccgctcgctgc

SEQ ID NO: 7596659 - DNA, 22 bp, Homo sapiens
gccttcagcggccgctcgctgc

SEQ ID NO: 7596660 - DNA, 22 bp, Homo sapiens
gccttcaggaaatcagtccttg

SEQ ID NO: 7596661 - DNA, 23 bp, Homo sapiens
gccttcagctcgggaaggctccc

SEQ ID NO: 7596662 - DNA, 23 bp, Homo sapiens
gccttcagctcgggaaggctccc

SEQ ID NO: 7596663 - DNA, 22 bp, Homo sapiens
gcctggctgggcaccaggggag

SEQ ID NO: 7596664 - DNA, 22 bp, Homo sapiens
gcctggctgggcaccaggggag

SEQ ID NO: 7596665 - DNA, 19 bp, Homo sapiens
gcctggctgggatgagccc

SEQ ID NO: 7596666 - DNA, 19 bp, Homo sapiens
gcctggctgggatgagccc

SEQ ID NO: 7596667 - DNA, 19 bp, Homo sapiens
gcctggctgggatgagccc

SEQ ID NO: 7596668 - DNA, 19 bp, Homo sapiens
gcctggctgggatgagccc

SEQ ID NO: 7596669 - DNA, 22 bp, Homo sapiens
gcctggctgcttagcctacttc

SEQ ID NO: 7596670 - DNA, 22 bp, Homo sapiens
gcctggctgcttagcctacttc

SEQ ID NO: 7596671 - DNA, 22 bp, Homo sapiens
gcctggctggtagagggggctc

SEQ ID NO: 7596672 - DNA, 22 bp, Homo sapiens
gcctggctggtagagggggctc

SEQ ID NO: 7596673 - DNA, 22 bp, Homo sapiens
gcctggctgggctgaatgctta

SEQ ID NO: 7596674 - DNA, 22 bp, Homo sapiens
gcctggctgggctgaatgctta

SEQ ID NO: 7596675 - DNA, 22 bp, Homo sapiens
gcctggctgggctgaatgctta

SEQ ID NO: 7596676 - DNA, 22 bp, Homo sapiens
gcctggctgggcaccaggggag

SEQ ID NO: 7596677 - DNA, 22 bp, Homo sapiens
gcctggctgggcaccaggggag

SEQ ID NO: 7596678 - DNA, 22 bp, Homo sapiens
gcctggctgggcaccaggggag

SEQ ID NO: 7596679 - DNA, 22 bp, Homo sapiens
gcctggctggtcactgcctggc

SEQ ID NO: 7596680 - DNA, 22 bp, Homo sapiens
gcctggctggtagagggggctc

SEQ ID NO: 7596681 - DNA, 22 bp, Homo sapiens
gcctggctggtcactgcctggc

SEQ ID NO: 7596682 - DNA, 22 bp, Homo sapiens
gcctggctggtcactgcctggc

SEQ ID NO: 7596683 - DNA, 22 bp, Homo sapiens
gcctggctggtagagggggctc

SEQ ID NO: 7596684 - DNA, 22 bp, Homo sapiens
gcctggctggtagagggggctc

SEQ ID NO: 7596685 - DNA, 22 bp, Homo sapiens
gcctggctggtagagggggctc

SEQ ID NO: 7596686 - DNA, 22 bp, Homo sapiens
gcctggctggtagagggggctc

SEQ ID NO: 7596687 - DNA, 22 bp, Homo sapiens
gcctggctggtcactgcctggc

SEQ ID NO: 7596688 - DNA, 22 bp, Homo sapiens
gcctggctggtcactgcctggc

SEQ ID NO: 7596689 - DNA, 22 bp, Homo sapiens
gcctggctggtcactgcctggc

SEQ ID NO: 7596690 - DNA, 22 bp, Homo sapiens
gcctggctggtcactgcctggc

SEQ ID NO: 7596691 - DNA, 22 bp, Homo sapiens
gcctggctgtctggcaaggttc

SEQ ID NO: 7596692 - DNA, 22 bp, Homo sapiens
gcctggctgtctggcaaggttc

SEQ ID NO: 7596693 - DNA, 22 bp, Homo sapiens
gcctggctgtctggcaaggttc

SEQ ID NO: 7596694 - DNA, 22 bp, Homo sapiens
gcctggctgtcaaacccagaag

SEQ ID NO: 7596695 - DNA, 22 bp, Homo sapiens
gcctggctgtctggcaaggttc

SEQ ID NO: 7596696 - DNA, 22 bp, Homo sapiens
gcctggctgtcaaacccagaag

SEQ ID NO: 7596697 - DNA, 22 bp, Homo sapiens
gcctggctggtcactgcctggc

SEQ ID NO: 7596698 - DNA, 18 bp, Homo sapiens
gcctggcttcggagccgc

SEQ ID NO: 7596699 - DNA, 18 bp, Homo sapiens
gcctggcttcggagccgc

SEQ ID NO: 7596700 - DNA, 18 bp, Homo sapiens
gcctggcttcggagccgc

SEQ ID NO: 7596701 - DNA, 22 bp, Homo sapiens
gcctggcttcccttggagcatt

SEQ ID NO: 7596702 - DNA, 23 bp, Homo sapiens
gcctggcttccaaggtaggggag

SEQ ID NO: 7596703 - DNA, 22 bp, Homo sapiens
gcctggcttcccttggagcatt

SEQ ID NO: 7596704 - DNA, 22 bp, Homo sapiens
gcctggcttcccttggagcatt

SEQ ID NO: 7596705 - DNA, 22 bp, Homo sapiens
gcctggcttcccttggagcatt

SEQ ID NO: 7596706 - DNA, 22 bp, Homo sapiens
gcctggcttcccttggagcatt

SEQ ID NO: 7596707 - DNA, 21 bp, Homo sapiens
gcctggcttcacaggcactga

SEQ ID NO: 7596708 - DNA, 21 bp, Homo sapiens
gcctggcttcacaggcactga

SEQ ID NO: 7596709 - DNA, 21 bp, Homo sapiens
gcctggcttcacaggcactga

SEQ ID NO: 7596710 - DNA, 22 bp, Homo sapiens
gcctggctgtctggcaaggttc

SEQ ID NO: 7596711 - DNA, 21 bp, Homo sapiens
gcctggcttcacaggcactga

SEQ ID NO: 7596712 - DNA, 21 bp, Homo sapiens
gcctggcttcacaggcactga

SEQ ID NO: 7596713 - DNA, 23 bp, Homo sapiens
gcctggcttccaaggtaggggag

SEQ ID NO: 7596714 - DNA, 21 bp, Homo sapiens
gcctggcttcacaggcactga

SEQ ID NO: 7596715 - DNA, 21 bp, Homo sapiens
gcctggcttcacaggcactga

SEQ ID NO: 7596716 - DNA, 22 bp, Homo sapiens
gcctggcttcccttggagcatt

SEQ ID NO: 7596717 - DNA, 23 bp, Homo sapiens
gcctggcttccaaggtaggggag

SEQ ID NO: 7596718 - DNA, 23 bp, Homo sapiens
gcctggcttccaaggtaggggag

SEQ ID NO: 7596719 - DNA, 22 bp, Homo sapiens
gcctggcttgccagccctggcg

SEQ ID NO: 7596720 - DNA, 22 bp, Homo sapiens
gcctggcttgccagccctggcg

SEQ ID NO: 7596721 - DNA, 22 bp, Homo sapiens
gcctggcttgccagccctggcg

SEQ ID NO: 7596722 - DNA, 22 bp, Homo sapiens
gcctggcttgccagccctggcg

SEQ ID NO: 7596723 - DNA, 22 bp, Homo sapiens
gcctggcttgccagccctggcg

SEQ ID NO: 7596724 - DNA, 22 bp, Homo sapiens
gcctggcttgccagccctggcg

SEQ ID NO: 7596725 - DNA, 22 bp, Homo sapiens
gcctggcttgccagccctggcg

SEQ ID NO: 7596726 - DNA, 22 bp, Homo sapiens
gcctggcttgccagccctggcg

SEQ ID NO: 7596727 - DNA, 22 bp, Homo sapiens
gcctggcttgccagccctggcg

SEQ ID NO: 7596728 - DNA, 22 bp, Homo sapiens
gcctggcttgccagccctggcg

SEQ ID NO: 7596729 - DNA, 22 bp, Homo sapiens
gcctggcttttgcctcatgttc

SEQ ID NO: 7596730 - DNA, 22 bp, Homo sapiens
gcctggcttggggctcagtggt

SEQ ID NO: 7596731 - DNA, 22 bp, Homo sapiens
gcctggcttggggctcagtggt

SEQ ID NO: 7596732 - DNA, 22 bp, Homo sapiens
gcctggcttggggctcagtggt

SEQ ID NO: 7596733 - DNA, 22 bp, Homo sapiens
gcctggcttggggctcagtggt

SEQ ID NO: 7596734 - DNA, 22 bp, Homo sapiens
gcctggcttggggctcagtggt

SEQ ID NO: 7596735 - DNA, 22 bp, Homo sapiens
gcctggggaacttgatcctgtc

SEQ ID NO: 7596736 - DNA, 22 bp, Homo sapiens
gcctcaggcctatagctgctgt

SEQ ID NO: 7596737 - DNA, 22 bp, Homo sapiens
gcctcaggcctatagctgctgt

SEQ ID NO: 7596738 - DNA, 22 bp, Homo sapiens
gcctcaggcctatagctgctgt

SEQ ID NO: 7596739 - DNA, 22 bp, Homo sapiens
gcctcaggcctatagctgctgt

SEQ ID NO: 7596740 - DNA, 22 bp, Homo sapiens
gcctcaggcctatagctgctgt

SEQ ID NO: 7596741 - DNA, 22 bp, Homo sapiens
gcctcaggcctatagctgctgt

SEQ ID NO: 7596742 - DNA, 22 bp, Homo sapiens
gcctcaggccgccctgctgctc

SEQ ID NO: 7596743 - DNA, 22 bp, Homo sapiens
gcctcaggccgccctgctgctc

SEQ ID NO: 7596744 - DNA, 22 bp, Homo sapiens
gcctcaggccgccctgctgctc

SEQ ID NO: 7596745 - DNA, 22 bp, Homo sapiens
gcctcaggcctatagctgctgt

SEQ ID NO: 7596746 - DNA, 22 bp, Homo sapiens
gcctcaggcctatagctgctgt

SEQ ID NO: 7596747 - DNA, 22 bp, Homo sapiens
gcctcaggcctatagctgctgt

SEQ ID NO: 7596748 - DNA, 22 bp, Homo sapiens
gcctcagggataggatgagcat

SEQ ID NO: 7596749 - DNA, 22 bp, Homo sapiens
gcctcagggataggatgagcat

SEQ ID NO: 7596750 - DNA, 22 bp, Homo sapiens
gcctcagggataggatgagcat

SEQ ID NO: 7596751 - DNA, 22 bp, Homo sapiens
gcctggctaagcagaaggaccc

SEQ ID NO: 7596752 - DNA, 22 bp, Homo sapiens
gcctggctaagcagaaggaccc

SEQ ID NO: 7596753 - DNA, 22 bp, Homo sapiens
gcctcagggggagaggccagct

SEQ ID NO: 7596754 - DNA, 22 bp, Homo sapiens
gcctcagggggagaggccagct

SEQ ID NO: 7596755 - DNA, 22 bp, Homo sapiens
gcctcagggggagaggccagct

SEQ ID NO: 7596756 - DNA, 22 bp, Homo sapiens
gcctggctaattttggtatttt

SEQ ID NO: 7596757 - DNA, 22 bp, Homo sapiens
gcctggctaagcagaaggaccc

SEQ ID NO: 7596758 - DNA, 21 bp, Homo sapiens
gcctggctagaagctcctagc

SEQ ID NO: 7596759 - DNA, 21 bp, Homo sapiens
gcctggctagaagctcctagc

SEQ ID NO: 7596760 - DNA, 21 bp, Homo sapiens
gcctggctagaagctcctagc

SEQ ID NO: 7596761 - DNA, 22 bp, Homo sapiens
gcctggctacccactgaaatat

SEQ ID NO: 7596762 - DNA, 22 bp, Homo sapiens
gcctggctaattttggtatttt

SEQ ID NO: 7596763 - DNA, 22 bp, Homo sapiens
gcctcagggataggatgagcat

SEQ ID NO: 7596764 - DNA, 22 bp, Homo sapiens
gcctcagggataggatgagcat

SEQ ID NO: 7596765 - DNA, 22 bp, Homo sapiens
gcctcagggataggatgagcat

SEQ ID NO: 7596766 - DNA, 22 bp, Homo sapiens
gcctcagggataggatgagcat

SEQ ID NO: 7596767 - DNA, 22 bp, Homo sapiens
gcctcagggataggatgagcat

SEQ ID NO: 7596768 - DNA, 22 bp, Homo sapiens
gcctcagggataggatgagcat

SEQ ID NO: 7596769 - DNA, 22 bp, Homo sapiens
gcctcagggggagaggccagct

SEQ ID NO: 7596770 - DNA, 22 bp, Homo sapiens
gcctcagggataggatgagcat

SEQ ID NO: 7596771 - DNA, 22 bp, Homo sapiens
gcctcagggataggatgagcat

SEQ ID NO: 7596772 - DNA, 22 bp, Homo sapiens
gcctcagggataggatgagcat

SEQ ID NO: 7596773 - DNA, 22 bp, Homo sapiens
gcctggctgcttagcctacttc

SEQ ID NO: 7596774 - DNA, 22 bp, Homo sapiens
gcctggctgcttagcctacttc

SEQ ID NO: 7596775 - DNA, 22 bp, Homo sapiens
gcctggctgctggttctgagga

SEQ ID NO: 7596776 - DNA, 22 bp, Homo sapiens
gcctggctgctcagccactcac

SEQ ID NO: 7596777 - DNA, 22 bp, Homo sapiens
gcctggctgctcagccactcac

SEQ ID NO: 7596778 - DNA, 22 bp, Homo sapiens
gcctggctgctcagccactcac

SEQ ID NO: 7596779 - DNA, 22 bp, Homo sapiens
gcctggctgctcagccactcac

SEQ ID NO: 7596780 - DNA, 22 bp, Homo sapiens
gcctggctgctcagccactcac

SEQ ID NO: 7596781 - DNA, 22 bp, Homo sapiens
gcctggctgctcagccactcac

SEQ ID NO: 7596782 - DNA, 22 bp, Homo sapiens
gcctggctgctagccagaggca

SEQ ID NO: 7596783 - DNA, 22 bp, Homo sapiens
gcctggctgctagccagaggca

SEQ ID NO: 7596784 - DNA, 22 bp, Homo sapiens
gcctggctgctagccagaggca

SEQ ID NO: 7596785 - DNA, 18 bp, Homo sapiens
gcctggctgccaacccag

SEQ ID NO: 7596786 - DNA, 18 bp, Homo sapiens
gcctggctgccaacccag

SEQ ID NO: 7596787 - DNA, 22 bp, Homo sapiens
gcctggctgccggccttggcaa

SEQ ID NO: 7596788 - DNA, 22 bp, Homo sapiens
gcctggctgaggtggggaggca

SEQ ID NO: 7596789 - DNA, 18 bp, Homo sapiens
gcctggctgccaacccag

SEQ ID NO: 7596790 - DNA, 22 bp, Homo sapiens
gcctggctgaggtggggaggca

SEQ ID NO: 7596791 - DNA, 22 bp, Homo sapiens
gcctggctatggcctcccccat

SEQ ID NO: 7596792 - DNA, 22 bp, Homo sapiens
gcctggctgaggtggggaggca

SEQ ID NO: 7596793 - DNA, 22 bp, Homo sapiens
gcctggctgccggccttggcaa

SEQ ID NO: 7596794 - DNA, 22 bp, Homo sapiens
gcctggctgccggccttggcaa

SEQ ID NO: 7596795 - DNA, 22 bp, Homo sapiens
gcctggctgccggccttggcaa

SEQ ID NO: 7596796 - DNA, 22 bp, Homo sapiens
gcctggctgccggccttggcaa

SEQ ID NO: 7596797 - DNA, 22 bp, Homo sapiens
gcctggctagttagtgtcaggt

SEQ ID NO: 7596798 - DNA, 22 bp, Homo sapiens
gcctggctagttagtgtcaggt

SEQ ID NO: 7596799 - DNA, 22 bp, Homo sapiens
gcctggctatggcctcccccat

SEQ ID NO: 7596800 - DNA, 22 bp, Homo sapiens
gcctggctagttagtgtcaggt

SEQ ID NO: 7596801 - DNA, 22 bp, Homo sapiens
gcctggctagttagtgtcaggt

SEQ ID NO: 7596802 - DNA, 22 bp, Homo sapiens
gccttctgattgctggactgac

SEQ ID NO: 7596803 - DNA, 22 bp, Homo sapiens
gccttctgattgctggactgac

SEQ ID NO: 7596804 - DNA, 22 bp, Homo sapiens
gccttctgatcgctggactgac

SEQ ID NO: 7596805 - DNA, 22 bp, Homo sapiens
gccttctgatcgctggactgac

SEQ ID NO: 7596806 - DNA, 22 bp, Homo sapiens
gccttctgcgctcgtgtctccg

SEQ ID NO: 7596807 - DNA, 22 bp, Homo sapiens
gccttctgcgctcgtgtctccg

SEQ ID NO: 7596808 - DNA, 22 bp, Homo sapiens
gccttctgtgctcctggccttt

SEQ ID NO: 7596809 - DNA, 22 bp, Homo sapiens
gccttctgtccaaccccacgat

SEQ ID NO: 7596810 - DNA, 22 bp, Homo sapiens
gccttctgtccaaccccacgat

SEQ ID NO: 7596811 - DNA, 22 bp, Homo sapiens
gccttctgtccaaccccacgat

SEQ ID NO: 7596812 - DNA, 22 bp, Homo sapiens
gccttctgtgctcctggccttt

SEQ ID NO: 7596813 - DNA, 22 bp, Homo sapiens
gccttgaactcatgtatattga

SEQ ID NO: 7596814 - DNA, 22 bp, Homo sapiens
gccttcttcttgcaagggaatg

SEQ ID NO: 7596815 - DNA, 22 bp, Homo sapiens
gccttgagaaatgtttggtttt

SEQ ID NO: 7596816 - DNA, 22 bp, Homo sapiens
gccttctgattgctggactgac

SEQ ID NO: 7596817 - DNA, 22 bp, Homo sapiens
gccttctgatatctcttggcat

SEQ ID NO: 7596818 - DNA, 22 bp, Homo sapiens
gccttctgatatctcttggcat

SEQ ID NO: 7596819 - DNA, 22 bp, Homo sapiens
gccttctgatcgctggactgac

SEQ ID NO: 7596820 - DNA, 22 bp, Homo sapiens
gccttctgatatctcttggcat

SEQ ID NO: 7596821 - DNA, 22 bp, Homo sapiens
gccttctctgtgagctcctagg

SEQ ID NO: 7596822 - DNA, 22 bp, Homo sapiens
gccttctctgtgagctcctagg

SEQ ID NO: 7596823 - DNA, 22 bp, Homo sapiens
gccttctctgtgagctcctagg

SEQ ID NO: 7596824 - DNA, 22 bp, Homo sapiens
gccttccacctaggcctctgct

SEQ ID NO: 7596825 - DNA, 22 bp, Homo sapiens
gccttccacctaggcctctgct

SEQ ID NO: 7596826 - DNA, 22 bp, Homo sapiens
gccttccacgtcaggggaaata

SEQ ID NO: 7596827 - DNA, 22 bp, Homo sapiens
gccttccacctaggcctctgct

SEQ ID NO: 7596828 - DNA, 22 bp, Homo sapiens
gccttccacctaggcctctgct

SEQ ID NO: 7596829 - DNA, 22 bp, Homo sapiens
gccttccacctaggcctctgct

SEQ ID NO: 7596830 - DNA, 22 bp, Homo sapiens
gccttctctgtgagctcctagg

SEQ ID NO: 7596831 - DNA, 22 bp, Homo sapiens
gccttgcaggaaggagggacag

SEQ ID NO: 7596832 - DNA, 22 bp, Homo sapiens
gccttgagaagtcctgcagtga

SEQ ID NO: 7596833 - DNA, 22 bp, Homo sapiens
gccttgagctgcacggccaggt

SEQ ID NO: 7596834 - DNA, 22 bp, Homo sapiens
gccttgagaagtcctgcagtga

SEQ ID NO: 7596835 - DNA, 21 bp, Homo sapiens
gccttgccacatgtgccacag

SEQ ID NO: 7596836 - DNA, 22 bp, Homo sapiens
gccttttttaaactccaagtct

SEQ ID NO: 7596837 - DNA, 22 bp, Homo sapiens
gccttttttaaactccaagtct

SEQ ID NO: 7596838 - DNA, 22 bp, Homo sapiens
gccttttttaaactccaagtct

SEQ ID NO: 7596839 - DNA, 22 bp, Homo sapiens
gccttttttgttgctctgtcac

SEQ ID NO: 7596840 - DNA, 22 bp, Homo sapiens
gccttttttgttgctctgtcac

SEQ ID NO: 7596841 - DNA, 22 bp, Homo sapiens
gcgaagggtcctcactagatgc

SEQ ID NO: 7596842 - DNA, 22 bp, Homo sapiens
gcgaagggtcctcactagatgc

SEQ ID NO: 7596843 - DNA, 22 bp, Homo sapiens
gccttttttgttgctctgtcac

SEQ ID NO: 7596844 - DNA, 22 bp, Homo sapiens
gcgaaaaatgtgtaaatatgtt

SEQ ID NO: 7596845 - DNA, 22 bp, Homo sapiens
gcgacgcaggcacgacgtgttg

SEQ ID NO: 7596846 - DNA, 22 bp, Homo sapiens
gcgcctggcacacagcaagggc

SEQ ID NO: 7596847 - DNA, 22 bp, Homo sapiens
gcgcgcggggcatcagtggccg

SEQ ID NO: 7596848 - DNA, 22 bp, Homo sapiens
gcgcctggcacacagcaagggc

SEQ ID NO: 7596849 - DNA, 22 bp, Homo sapiens
gcgcctggcacacagcaagggc

SEQ ID NO: 7596850 - DNA, 22 bp, Homo sapiens
gcgcctgccaccatgccaggct

SEQ ID NO: 7596851 - DNA, 16 bp, Homo sapiens
gcgcctcctcggcctc

SEQ ID NO: 7596852 - DNA, 16 bp, Homo sapiens
gcgcctcctcggcctc

SEQ ID NO: 7596853 - DNA, 22 bp, Homo sapiens
gcgagacagctatttgggaagc

SEQ ID NO: 7596854 - DNA, 22 bp, Homo sapiens
gcgagaaactaagtgccctttg

SEQ ID NO: 7596855 - DNA, 22 bp, Homo sapiens
gcgagaaactaagtgccctttg

SEQ ID NO: 7596856 - DNA, 22 bp, Homo sapiens
gcgagaaactaagtgccctttg

SEQ ID NO: 7596857 - DNA, 22 bp, Homo sapiens
gcgccccatctacagtactttt

SEQ ID NO: 7596858 - DNA, 22 bp, Homo sapiens
gcggaaggctgcctggcttgag

SEQ ID NO: 7596859 - DNA, 22 bp, Homo sapiens
gcggaaggctgcctggcttgag

SEQ ID NO: 7596860 - DNA, 22 bp, Homo sapiens
gcggaagcggtagtcaccctcg

SEQ ID NO: 7596861 - DNA, 22 bp, Homo sapiens
gcggaaatgcagggctagggtg

SEQ ID NO: 7596862 - DNA, 22 bp, Homo sapiens
gcggagcggagctgccggtgat

SEQ ID NO: 7596863 - DNA, 22 bp, Homo sapiens
gcggagaggcagagactccgcg

SEQ ID NO: 7596864 - DNA, 23 bp, Homo sapiens
gcggaaggggtcataatggagac

SEQ ID NO: 7596865 - DNA, 22 bp, Homo sapiens
gcggagggagataggccttgct

SEQ ID NO: 7596866 - DNA, 22 bp, Homo sapiens
gcggagggagataggccttgct

SEQ ID NO: 7596867 - DNA, 22 bp, Homo sapiens
gcggaggaaactgaggcaagag

SEQ ID NO: 7596868 - DNA, 22 bp, Homo sapiens
gcggaggacaggaatgcgggcg

SEQ ID NO: 7596869 - DNA, 22 bp, Homo sapiens
gcggcaggaagagcgcagcccc

SEQ ID NO: 7596870 - DNA, 22 bp, Homo sapiens
gcggaggtgaggaagtggggca

SEQ ID NO: 7596871 - DNA, 22 bp, Homo sapiens
gcggaggtggagcaccaagggc

SEQ ID NO: 7596872 - DNA, 22 bp, Homo sapiens
gcggaggttttcttgctcactt

SEQ ID NO: 7596873 - DNA, 22 bp, Homo sapiens
gcggcagaggtgttgcgagcga

SEQ ID NO: 7596874 - DNA, 22 bp, Homo sapiens
gcggaggtgaggaagtggggca

SEQ ID NO: 7596875 - DNA, 22 bp, Homo sapiens
gcggagggcgagcccgcggagc

SEQ ID NO: 7596876 - DNA, 22 bp, Homo sapiens
gcggagggcgagcccgcggagc

SEQ ID NO: 7596877 - DNA, 22 bp, Homo sapiens
gcggagggcgagcccgcggagc

SEQ ID NO: 7596878 - DNA, 22 bp, Homo sapiens
gcggagggcgagcccgcggagc

SEQ ID NO: 7596879 - DNA, 22 bp, Homo sapiens
gcgctgcgcctcctcttccgca

SEQ ID NO: 7596880 - DNA, 22 bp, Homo sapiens
gcgctgcgcctcctcttccgca

SEQ ID NO: 7596881 - DNA, 22 bp, Homo sapiens
gcgctgcgcctcctcttccgca

SEQ ID NO: 7596882 - DNA, 22 bp, Homo sapiens
gcgctctgtctcaggggtccag

SEQ ID NO: 7596883 - DNA, 22 bp, Homo sapiens
gcgctgcctctgctctccccac

SEQ ID NO: 7596884 - DNA, 22 bp, Homo sapiens
gcgcggggtacacgcggtggcc

SEQ ID NO: 7596885 - DNA, 22 bp, Homo sapiens
gcgcggggtacacgcggtggcc

SEQ ID NO: 7596886 - DNA, 22 bp, Homo sapiens
gcgcgtgggccgcggctggtta

SEQ ID NO: 7596887 - DNA, 22 bp, Homo sapiens
gcgctcaggtgccaggcctgcg

SEQ ID NO: 7596888 - DNA, 22 bp, Homo sapiens
gcgctcagaaaagattttcttc

SEQ ID NO: 7596889 - DNA, 22 bp, Homo sapiens
gcgctcaggtgccaggcctgcg

SEQ ID NO: 7596890 - DNA, 22 bp, Homo sapiens
gcgctcaggtgccaggcctgcg

SEQ ID NO: 7596891 - DNA, 22 bp, Homo sapiens
gcgctcaggtgccaggcctgcg

SEQ ID NO: 7596892 - DNA, 22 bp, Homo sapiens
gcgggcgctcaggctgcagctg

SEQ ID NO: 7596893 - DNA, 22 bp, Homo sapiens
gcgggccaccttggagagcgct

SEQ ID NO: 7596894 - DNA, 22 bp, Homo sapiens
gcgggccaccttggagagcgct

SEQ ID NO: 7596895 - DNA, 22 bp, Homo sapiens
gcgggccaccttggagagcgct

SEQ ID NO: 7596896 - DNA, 22 bp, Homo sapiens
gcgggaagaacgaccaggctcg

SEQ ID NO: 7596897 - DNA, 22 bp, Homo sapiens
gcgggccaccttggagagcgct

SEQ ID NO: 7596898 - DNA, 22 bp, Homo sapiens
gcgggccaccttggagagcgct

SEQ ID NO: 7596899 - DNA, 22 bp, Homo sapiens
gcgggccaccttggagagcgct

SEQ ID NO: 7596900 - DNA, 22 bp, Homo sapiens
gcgggccaccttggagagcgct

SEQ ID NO: 7596901 - DNA, 18 bp, Homo sapiens
gcgggcggtgcagtgggc

SEQ ID NO: 7596902 - DNA, 18 bp, Homo sapiens
gcgggcggtgcagtgggc

SEQ ID NO: 7596903 - DNA, 18 bp, Homo sapiens
gcgggcggtgcagtgggc

SEQ ID NO: 7596904 - DNA, 22 bp, Homo sapiens
gcgggcgggggttcccaggtct

SEQ ID NO: 7596905 - DNA, 18 bp, Homo sapiens
gcgggcggtgcagtgggc

SEQ ID NO: 7596906 - DNA, 22 bp, Homo sapiens
gcgggcgggggttcccaggtct

SEQ ID NO: 7596907 - DNA, 22 bp, Homo sapiens
gcgggcgctcaggctgcagctg

SEQ ID NO: 7596908 - DNA, 19 bp, Homo sapiens
gcgggcggcgcctgcgagg

SEQ ID NO: 7596909 - DNA, 22 bp, Homo sapiens
gcggggacagaaggcggttctc

SEQ ID NO: 7596910 - DNA, 22 bp, Homo sapiens
gcggggcacagtgatggagcac

SEQ ID NO: 7596911 - DNA, 22 bp, Homo sapiens
gcggggcacagtgatggagcac

SEQ ID NO: 7596912 - DNA, 22 bp, Homo sapiens
gcggggcacagtgatggagcac

SEQ ID NO: 7596913 - DNA, 22 bp, Homo sapiens
gcggcggagacagcaggaagcc

SEQ ID NO: 7596914 - DNA, 22 bp, Homo sapiens
gcgggcagggcactggtcccct

SEQ ID NO: 7596915 - DNA, 22 bp, Homo sapiens
gcgggaagaacgaccaggctcg

SEQ ID NO: 7596916 - DNA, 22 bp, Homo sapiens
gcggcgcctaagccccgacctc

SEQ ID NO: 7596917 - DNA, 22 bp, Homo sapiens
gcggcgcctaagccccgacctc

SEQ ID NO: 7596918 - DNA, 22 bp, Homo sapiens
gcggcgcctaagccccgacctc

SEQ ID NO: 7596919 - DNA, 22 bp, Homo sapiens
gcggcggagacagcaggaagcc

SEQ ID NO: 7596920 - DNA, 22 bp, Homo sapiens
gcggcggagacagcaggaagcc

SEQ ID NO: 7596921 - DNA, 22 bp, Homo sapiens
gcggcgcctgggacccgccagc

SEQ ID NO: 7596922 - DNA, 22 bp, Homo sapiens
gcggcaggagtaaaggaggaag

SEQ ID NO: 7596923 - DNA, 22 bp, Homo sapiens
gcggcaggagtaaaggaggaag

SEQ ID NO: 7596924 - DNA, 22 bp, Homo sapiens
gcggcccgagcaggacgggtgg

SEQ ID NO: 7596925 - DNA, 22 bp, Homo sapiens
gcggcccgagcaggacgggtgg

SEQ ID NO: 7596926 - DNA, 22 bp, Homo sapiens
gcggcccgagcaggacgggtgg

SEQ ID NO: 7596927 - DNA, 22 bp, Homo sapiens
gcggcccgagcaggacgggtgg

SEQ ID NO: 7596928 - DNA, 22 bp, Homo sapiens
gcggccttgtggcggagcaggc

SEQ ID NO: 7596929 - DNA, 22 bp, Homo sapiens
gcggccttgtggcggagcaggc

SEQ ID NO: 7596930 - DNA, 22 bp, Homo sapiens
gcggccttgtggcggagcaggc

SEQ ID NO: 7596931 - DNA, 22 bp, Homo sapiens
gctcacaggcagtgttgggaga

SEQ ID NO: 7596932 - DNA, 22 bp, Homo sapiens
gctcacaggcagtgttgggaga

SEQ ID NO: 7596933 - DNA, 22 bp, Homo sapiens
gctcacaggcagtgttgggaga

SEQ ID NO: 7596934 - DNA, 22 bp, Homo sapiens
gctcacagccggctggcagggg

SEQ ID NO: 7596935 - DNA, 22 bp, Homo sapiens
gctcacagccggctggcagggg

SEQ ID NO: 7596936 - DNA, 22 bp, Homo sapiens
gctcacagccggctggcagggg

SEQ ID NO: 7596937 - DNA, 22 bp, Homo sapiens
gctcacagccggctggcagggg

SEQ ID NO: 7596938 - DNA, 22 bp, Homo sapiens
gctcacagccggctggcagggg

SEQ ID NO: 7596939 - DNA, 22 bp, Homo sapiens
gctcacagccggctggcagggg

SEQ ID NO: 7596940 - DNA, 22 bp, Homo sapiens
gctcacagccggctggcagggg

SEQ ID NO: 7596941 - DNA, 22 bp, Homo sapiens
gctcacagcccaggccagcgtg

SEQ ID NO: 7596942 - DNA, 22 bp, Homo sapiens
gctcacagccggctggcagggg

SEQ ID NO: 7596943 - DNA, 22 bp, Homo sapiens
gctcacagccggctggcagggg

SEQ ID NO: 7596944 - DNA, 22 bp, Homo sapiens
gctcacactctgaaatttaagc

SEQ ID NO: 7596945 - DNA, 23 bp, Homo sapiens
gctcacagaatgttgaagggaat

SEQ ID NO: 7596946 - DNA, 22 bp, Homo sapiens
gctcacagcccaggccagcgtg

SEQ ID NO: 7596947 - DNA, 23 bp, Homo sapiens
gctcacagaatgttgaagggaat

SEQ ID NO: 7596948 - DNA, 22 bp, Homo sapiens
gctcacagagggtgcttaatac

SEQ ID NO: 7596949 - DNA, 22 bp, Homo sapiens
gctcacagtacagtgctggctc

SEQ ID NO: 7596950 - DNA, 22 bp, Homo sapiens
gctcacagtacagtgctggctc

SEQ ID NO: 7596951 - DNA, 22 bp, Homo sapiens
gctcacagtctgctgagtgcag

SEQ ID NO: 7596952 - DNA, 22 bp, Homo sapiens
gctcacagtctgctgagtgcag

SEQ ID NO: 7596953 - DNA, 22 bp, Homo sapiens
gctcacagtacagtgctggctc

SEQ ID NO: 7596954 - DNA, 22 bp, Homo sapiens
gctcacagtctggcatagtctc

SEQ ID NO: 7596955 - DNA, 22 bp, Homo sapiens
gctcacagtctgctgagtgcag

SEQ ID NO: 7596956 - DNA, 22 bp, Homo sapiens
gctcacagtctgctgagtgcag

SEQ ID NO: 7596957 - DNA, 22 bp, Homo sapiens
gctcacagtctgctgagtgcag

SEQ ID NO: 7596958 - DNA, 22 bp, Homo sapiens
gctcacagtacagtgctggctc

SEQ ID NO: 7596959 - DNA, 22 bp, Homo sapiens
gctcacagtacagtgctggctc

SEQ ID NO: 7596960 - DNA, 22 bp, Homo sapiens
gctcacaggtctgtggctattg

SEQ ID NO: 7596961 - DNA, 22 bp, Homo sapiens
gctcacaggggcagacgagttg

SEQ ID NO: 7596962 - DNA, 22 bp, Homo sapiens
gctcacaggggcagacgagttg

SEQ ID NO: 7596963 - DNA, 21 bp, Homo sapiens
gctcagctgcttggttcctgt

SEQ ID NO: 7596964 - DNA, 22 bp, Homo sapiens
gctcactgcaacctccgccttc

SEQ ID NO: 7596965 - DNA, 22 bp, Homo sapiens
gctcactgcaacctccacctcc

SEQ ID NO: 7596966 - DNA, 22 bp, Homo sapiens
gctcaccttcgtccagcagccg

SEQ ID NO: 7596967 - DNA, 22 bp, Homo sapiens
gctcaccttcgtccagcagccg

SEQ ID NO: 7596968 - DNA, 22 bp, Homo sapiens
gctcaccttcgtccagcagccg

SEQ ID NO: 7596969 - DNA, 22 bp, Homo sapiens
gctcactgcaacctccacctcc

SEQ ID NO: 7596970 - DNA, 22 bp, Homo sapiens
gctcactaaataacaggaagaa

SEQ ID NO: 7596971 - DNA, 22 bp, Homo sapiens
gctcaccaagcagagactctgg

SEQ ID NO: 7596972 - DNA, 22 bp, Homo sapiens
gctcaccaagcagagactctgg

SEQ ID NO: 7596973 - DNA, 22 bp, Homo sapiens
gctcacagttctatttttcatg

SEQ ID NO: 7596974 - DNA, 22 bp, Homo sapiens
gctcaccaagcagagactctgg

SEQ ID NO: 7596975 - DNA, 22 bp, Homo sapiens
gctcaccactgctagagtctat

SEQ ID NO: 7596976 - DNA, 22 bp, Homo sapiens
gctcacatcatagtaagctcat

SEQ ID NO: 7596977 - DNA, 22 bp, Homo sapiens
gctcaccactgctagagtctat

SEQ ID NO: 7596978 - DNA, 22 bp, Homo sapiens
gctcaccactgctagagtctat

SEQ ID NO: 7596979 - DNA, 22 bp, Homo sapiens
gctcaccttcgtccagcagccg

SEQ ID NO: 7596980 - DNA, 21 bp, Homo sapiens
gctcaccagttgggaatagac

SEQ ID NO: 7596981 - DNA, 21 bp, Homo sapiens
gctcaccagttgggaatagac

SEQ ID NO: 7596982 - DNA, 22 bp, Homo sapiens
gctcacctcgctgcaggtgggt

SEQ ID NO: 7596983 - DNA, 22 bp, Homo sapiens
gctcagctggagagggacgggt

SEQ ID NO: 7596984 - DNA, 22 bp, Homo sapiens
gctcagctgggaccaatgtgtt

SEQ ID NO: 7596985 - DNA, 22 bp, Homo sapiens
gctcagctgggaccaatgtgtt

SEQ ID NO: 7596986 - DNA, 22 bp, Homo sapiens
gctcagcttgggagcgcccggt

SEQ ID NO: 7596987 - DNA, 22 bp, Homo sapiens
gctcagctgggaccaatgtgtt

SEQ ID NO: 7596988 - DNA, 22 bp, Homo sapiens
gctcagctgggaccaatgtgtt

SEQ ID NO: 7596989 - DNA, 22 bp, Homo sapiens
gctcagctggaccatcgtgttt

SEQ ID NO: 7596990 - DNA, 22 bp, Homo sapiens
gctcagctggaccatcgtgttt

SEQ ID NO: 7596991 - DNA, 21 bp, Homo sapiens
gctcagctgcttggttcctgt

SEQ ID NO: 7596992 - DNA, 21 bp, Homo sapiens
gctcagctgcttggttcctgt

SEQ ID NO: 7596993 - DNA, 22 bp, Homo sapiens
gctcagctggaccatcgtgttt

SEQ ID NO: 7596994 - DNA, 22 bp, Homo sapiens
gctcaggcatgtatgtggttgc

SEQ ID NO: 7596995 - DNA, 22 bp, Homo sapiens
gctcaggcccagcggctggtgt

SEQ ID NO: 7596996 - DNA, 22 bp, Homo sapiens
gctcaggcccagcggctggtgt

SEQ ID NO: 7596997 - DNA, 18 bp, Homo sapiens
gctcaggccctagtcagt

SEQ ID NO: 7596998 - DNA, 18 bp, Homo sapiens
gctcaggccctagtcagt

SEQ ID NO: 7596999 - DNA, 18 bp, Homo sapiens
gctcaggccctagtcagt

SEQ ID NO: 7597000 - DNA, 22 bp, Homo sapiens
gctcaggcccagcggctggtgt

SEQ ID NO: 7597001 - DNA, 22 bp, Homo sapiens
gctcaagccttctgcccacctc

SEQ ID NO: 7597002 - DNA, 22 bp, Homo sapiens
gctcaagccttctgcccacctc

SEQ ID NO: 7597003 - DNA, 22 bp, Homo sapiens
gctcaagccttctgcccacctc

SEQ ID NO: 7597004 - DNA, 22 bp, Homo sapiens
gctcaagccttctgcccacctc

SEQ ID NO: 7597005 - DNA, 22 bp, Homo sapiens
gctcaagccttctgcccacctc

SEQ ID NO: 7597006 - DNA, 22 bp, Homo sapiens
gctcaagccttctgcccacctc

SEQ ID NO: 7597007 - DNA, 22 bp, Homo sapiens
gctcaagccttctgcccacctc

SEQ ID NO: 7597008 - DNA, 22 bp, Homo sapiens
gctcacagaacttctcttccca

SEQ ID NO: 7597009 - DNA, 22 bp, Homo sapiens
gctcaatcctagaggctcaggg

SEQ ID NO: 7597010 - DNA, 21 bp, Homo sapiens
gctcaagtttctctggcaaca

SEQ ID NO: 7597011 - DNA, 21 bp, Homo sapiens
gctcaagtttctctggcaaca

SEQ ID NO: 7597012 - DNA, 22 bp, Homo sapiens
gctcaagggatgggagtgggtg

SEQ ID NO: 7597013 - DNA, 22 bp, Homo sapiens
gctcaaggcaggcagacatgag

SEQ ID NO: 7597014 - DNA, 22 bp, Homo sapiens
gctcaaggcaggcagacatgag

SEQ ID NO: 7597015 - DNA, 22 bp, Homo sapiens
gctcaagggatgggagtgggtg

SEQ ID NO: 7597016 - DNA, 22 bp, Homo sapiens
gctcaagggatgggagtgggtg

SEQ ID NO: 7597017 - DNA, 22 bp, Homo sapiens
gctcaagatgtggcctctgaag

SEQ ID NO: 7597018 - DNA, 22 bp, Homo sapiens
gctcaagccttctgcccacctc

SEQ ID NO: 7597019 - DNA, 22 bp, Homo sapiens
gctcaagactgttagcctggca

SEQ ID NO: 7597020 - DNA, 22 bp, Homo sapiens
gctcaagactgttagcctggca

SEQ ID NO: 7597021 - DNA, 22 bp, Homo sapiens
gctcaagagagatgcagttctt

SEQ ID NO: 7597022 - DNA, 19 bp, Homo sapiens
gctcaacagctcgggtcct

SEQ ID NO: 7597023 - DNA, 21 bp, Homo sapiens
gctatgaatgtagaaaattat

SEQ ID NO: 7597024 - DNA, 22 bp, Homo sapiens
gctcaaatttcagactcatgaa

SEQ ID NO: 7597025 - DNA, 22 bp, Homo sapiens
gctcaaatttcagactcatgaa

SEQ ID NO: 7597026 - DNA, 21 bp, Homo sapiens
gctatgaatgtagaaaattat

SEQ ID NO: 7597027 - DNA, 19 bp, Homo sapiens
gctcaacagctcgggtcct

SEQ ID NO: 7597028 - DNA, 22 bp, Homo sapiens
gctcaagaccagacaaagcctg

SEQ ID NO: 7597029 - DNA, 22 bp, Homo sapiens
gctcaagaccagacaaagcctg

SEQ ID NO: 7597030 - DNA, 22 bp, Homo sapiens
gctcaagacccctctgtgactg

SEQ ID NO: 7597031 - DNA, 22 bp, Homo sapiens
gctatattttgaaggagagcca

SEQ ID NO: 7597032 - DNA, 22 bp, Homo sapiens
gctatcccaccaaggtcccagt

SEQ ID NO: 7597033 - DNA, 22 bp, Homo sapiens
gctatcatccttgtcagtgact

SEQ ID NO: 7597034 - DNA, 22 bp, Homo sapiens
gctatacagcaggagaatggaa

SEQ ID NO: 7597035 - DNA, 22 bp, Homo sapiens
gcggggggcagcagtcgctcag

SEQ ID NO: 7597036 - DNA, 22 bp, Homo sapiens
gcggggggcagcagtcgctcag

SEQ ID NO: 7597037 - DNA, 22 bp, Homo sapiens
gcggggggaggaacatcttgca

SEQ ID NO: 7597038 - DNA, 22 bp, Homo sapiens
gcggggggaggaacatcttgca

SEQ ID NO: 7597039 - DNA, 22 bp, Homo sapiens
gcggggggaggaacatcttgca

SEQ ID NO: 7597040 - DNA, 22 bp, Homo sapiens
gctatctttctgcaccataatt

SEQ ID NO: 7597041 - DNA, 22 bp, Homo sapiens
gctatgaaacacatttagttca

SEQ ID NO: 7597042 - DNA, 22 bp, Homo sapiens
gctatgaacatgagaatgcaaa

SEQ ID NO: 7597043 - DNA, 22 bp, Homo sapiens
gctatgaacatgagaatgcaaa

SEQ ID NO: 7597044 - DNA, 22 bp, Homo sapiens
gctatgaatatggatggtggtg

SEQ ID NO: 7597045 - DNA, 22 bp, Homo sapiens
gctatgaatatccatgatcagc

SEQ ID NO: 7597046 - DNA, 22 bp, Homo sapiens
gctatgaaggagaggaaggttt

SEQ ID NO: 7597047 - DNA, 22 bp, Homo sapiens
gctatcttcatggaaatacagg

SEQ ID NO: 7597048 - DNA, 22 bp, Homo sapiens
gctatctaccacatcagccagg

SEQ ID NO: 7597049 - DNA, 22 bp, Homo sapiens
gcgggggcggcgcagacctcag

SEQ ID NO: 7597050 - DNA, 22 bp, Homo sapiens
gcggggggaggaacatcttgca

SEQ ID NO: 7597051 - DNA, 22 bp, Homo sapiens
gcggggggaggaacatcttgca

SEQ ID NO: 7597052 - DNA, 22 bp, Homo sapiens
gcggggggaggaacatcttgca

SEQ ID NO: 7597053 - DNA, 22 bp, Homo sapiens
gcggggggaggaacatcttgca

SEQ ID NO: 7597054 - DNA, 22 bp, Homo sapiens
gcggggctttgccatgctgttt

SEQ ID NO: 7597055 - DNA, 22 bp, Homo sapiens
gcgggggcagactgggcagttc

SEQ ID NO: 7597056 - DNA, 22 bp, Homo sapiens
gcgggggcagactgggcagttc

SEQ ID NO: 7597057 - DNA, 22 bp, Homo sapiens
gcgggggcggcgcagacctcag

SEQ ID NO: 7597058 - DNA, 22 bp, Homo sapiens
gcgggggcggcgcagacctcag

SEQ ID NO: 7597059 - DNA, 22 bp, Homo sapiens
gcgggggcagactgggcagttc

SEQ ID NO: 7597060 - DNA, 22 bp, Homo sapiens
gcggggcctgactctgacccgc

SEQ ID NO: 7597061 - DNA, 22 bp, Homo sapiens
gcggggcgtgctgctgctgagg

SEQ ID NO: 7597062 - DNA, 22 bp, Homo sapiens
gcggggcccggacccagcctct

SEQ ID NO: 7597063 - DNA, 22 bp, Homo sapiens
gcggggcccggacccagcctct

SEQ ID NO: 7597064 - DNA, 22 bp, Homo sapiens
gcggggcacagtgatggagcac

SEQ ID NO: 7597065 - DNA, 22 bp, Homo sapiens
gcggggccatgtccaacggcct

SEQ ID NO: 7597066 - DNA, 22 bp, Homo sapiens
gcggggcacagtgatggagcac

SEQ ID NO: 7597067 - DNA, 22 bp, Homo sapiens
gcggggcccccggccgagctct

SEQ ID NO: 7597068 - DNA, 22 bp, Homo sapiens
gcggggcccccggccgagctct

SEQ ID NO: 7597069 - DNA, 22 bp, Homo sapiens
gcggggcccccggccgagctct

SEQ ID NO: 7597070 - DNA, 22 bp, Homo sapiens
gctgccagccaacttgctgtgc

SEQ ID NO: 7597071 - DNA, 22 bp, Homo sapiens
gctgccagccaacttgctgtgc

SEQ ID NO: 7597072 - DNA, 22 bp, Homo sapiens
gctgccagcacagttcagctgt

SEQ ID NO: 7597073 - DNA, 22 bp, Homo sapiens
gctgccagcacagttcagctgt

SEQ ID NO: 7597074 - DNA, 22 bp, Homo sapiens
gctgccagcacacaggtgttag

SEQ ID NO: 7597075 - DNA, 22 bp, Homo sapiens
gctgccagcacacaggtgttag

SEQ ID NO: 7597076 - DNA, 22 bp, Homo sapiens
gctgccagagctcacttaatgc

SEQ ID NO: 7597077 - DNA, 22 bp, Homo sapiens
gctgccagagctcacttaatgc

SEQ ID NO: 7597078 - DNA, 22 bp, Homo sapiens
gctgccagagattttagaacta

SEQ ID NO: 7597079 - DNA, 22 bp, Homo sapiens
gctgccagaatgggaaatctga

SEQ ID NO: 7597080 - DNA, 22 bp, Homo sapiens
gctgccagaatgggaaatctga

SEQ ID NO: 7597081 - DNA, 22 bp, Homo sapiens
gctgccactctgagcttgcttc

SEQ ID NO: 7597082 - DNA, 22 bp, Homo sapiens
gctgccacttggtcatgtcatg

SEQ ID NO: 7597083 - DNA, 22 bp, Homo sapiens
gctgccagaagaggaggggtta

SEQ ID NO: 7597084 - DNA, 22 bp, Homo sapiens
gctgccagaagaggaggggtta

SEQ ID NO: 7597085 - DNA, 22 bp, Homo sapiens
gctgcaggtttgtctagtctgg

SEQ ID NO: 7597086 - DNA, 22 bp, Homo sapiens
gctgcaggtttgtctagtctgg

SEQ ID NO: 7597087 - DNA, 22 bp, Homo sapiens
gctgccactctgagcttgcttc

SEQ ID NO: 7597088 - DNA, 22 bp, Homo sapiens
gctgccactctgagcttgcttc

SEQ ID NO: 7597089 - DNA, 22 bp, Homo sapiens
gctgcagggggtgggcgtctcc

SEQ ID NO: 7597090 - DNA, 22 bp, Homo sapiens
gctgcagggggtgggcgtctcc

SEQ ID NO: 7597091 - DNA, 22 bp, Homo sapiens
gctgcaggatgaggctctgctc

SEQ ID NO: 7597092 - DNA, 22 bp, Homo sapiens
gctgcaggatgaggctctgctc

SEQ ID NO: 7597093 - DNA, 22 bp, Homo sapiens
gctgcaggatgaggctctgctc

SEQ ID NO: 7597094 - DNA, 22 bp, Homo sapiens
gctgcaggatgaggctctgctc

SEQ ID NO: 7597095 - DNA, 22 bp, Homo sapiens
gctgcaggatgaggctctgctc

SEQ ID NO: 7597096 - DNA, 22 bp, Homo sapiens
gctgcaggttgggcaacagagt

SEQ ID NO: 7597097 - DNA, 22 bp, Homo sapiens
gctgcaggttgggcaacagagt

SEQ ID NO: 7597098 - DNA, 22 bp, Homo sapiens
gctgcaggttgggcaacagagt

SEQ ID NO: 7597099 - DNA, 22 bp, Homo sapiens
gctgcaggagattttgagagtc

SEQ ID NO: 7597100 - DNA, 22 bp, Homo sapiens
gctgcaggagctggagctgtgg

SEQ ID NO: 7597101 - DNA, 22 bp, Homo sapiens
gctgcaggagattttgagagtc

SEQ ID NO: 7597102 - DNA, 22 bp, Homo sapiens
gctgcaggagattttgagagtc

SEQ ID NO: 7597103 - DNA, 22 bp, Homo sapiens
gctgcaggagattttgagagtc

SEQ ID NO: 7597104 - DNA, 22 bp, Homo sapiens
gctgcagctttaggatccagtg

SEQ ID NO: 7597105 - DNA, 22 bp, Homo sapiens
gctgcagctttaggatccagtg

SEQ ID NO: 7597106 - DNA, 22 bp, Homo sapiens
gctgcaggagctggagctgtgg

SEQ ID NO: 7597107 - DNA, 22 bp, Homo sapiens
gctgcaggagctggagctgtgg

SEQ ID NO: 7597108 - DNA, 22 bp, Homo sapiens
gctgcaggagctggagctgtgg

SEQ ID NO: 7597109 - DNA, 22 bp, Homo sapiens
gctgcaggagctggagctgtgg

SEQ ID NO: 7597110 - DNA, 22 bp, Homo sapiens
gctgcagactgggaggcaggtg

SEQ ID NO: 7597111 - DNA, 22 bp, Homo sapiens
gctgcagactgggaggcaggtg

SEQ ID NO: 7597112 - DNA, 22 bp, Homo sapiens
gctgcagactgggaggcaggtg

SEQ ID NO: 7597113 - DNA, 22 bp, Homo sapiens
gctgcagactgggaggcaggtg

SEQ ID NO: 7597114 - DNA, 22 bp, Homo sapiens
gctgcagacctcatgcaggtgg

SEQ ID NO: 7597115 - DNA, 22 bp, Homo sapiens
gctgcagaatttccttctcatt

SEQ ID NO: 7597116 - DNA, 22 bp, Homo sapiens
gctgcagaatttccttctcatt

SEQ ID NO: 7597117 - DNA, 22 bp, Homo sapiens
gctgcagaatttccttctcatt

SEQ ID NO: 7597118 - DNA, 22 bp, Homo sapiens
gctgcagctttaggatccagtg

SEQ ID NO: 7597119 - DNA, 22 bp, Homo sapiens
gctgcagctttaggatccagtg

SEQ ID NO: 7597120 - DNA, 23 bp, Homo sapiens
gctgcagctgtggatgttctcag

SEQ ID NO: 7597121 - DNA, 23 bp, Homo sapiens
gctgcagctgtggatgttctcag

SEQ ID NO: 7597122 - DNA, 23 bp, Homo sapiens
gctgcagctgtggatgttctcag

SEQ ID NO: 7597123 - DNA, 23 bp, Homo sapiens
gctgcagctgtggatgttctcag

SEQ ID NO: 7597124 - DNA, 23 bp, Homo sapiens
gctgcagctgtggatgttctcag

SEQ ID NO: 7597125 - DNA, 22 bp, Homo sapiens
gctgcagctcgccttccggcct

SEQ ID NO: 7597126 - DNA, 22 bp, Homo sapiens
gctgcagctgtaggacacaatt

SEQ ID NO: 7597127 - DNA, 22 bp, Homo sapiens
gctgcagctgtaggacacaatt

SEQ ID NO: 7597128 - DNA, 22 bp, Homo sapiens
gctgccatctcctgaggacagg

SEQ ID NO: 7597129 - DNA, 22 bp, Homo sapiens
gctgccatctcctgaggacagg

SEQ ID NO: 7597130 - DNA, 22 bp, Homo sapiens
gctgccatcccctgctgggctg

SEQ ID NO: 7597131 - DNA, 22 bp, Homo sapiens
gctgccatcagagttcaggaat

SEQ ID NO: 7597132 - DNA, 22 bp, Homo sapiens
gctgccatcccctgctgggctg

SEQ ID NO: 7597133 - DNA, 22 bp, Homo sapiens
gctgccagttccttcttactcc

SEQ ID NO: 7597134 - DNA, 22 bp, Homo sapiens
gctgccagttccttcttactcc

SEQ ID NO: 7597135 - DNA, 22 bp, Homo sapiens
gctgccagttccttcttactcc

SEQ ID NO: 7597136 - DNA, 22 bp, Homo sapiens
gctgccagtgtggcatgatgca

SEQ ID NO: 7597137 - DNA, 20 bp, Homo sapiens
gctgccagtgcctgatgctt

SEQ ID NO: 7597138 - DNA, 20 bp, Homo sapiens
gctgccagtgcctgatgctt

SEQ ID NO: 7597139 - DNA, 20 bp, Homo sapiens
gctgccagtgcctgatgctt

SEQ ID NO: 7597140 - DNA, 22 bp, Homo sapiens
gctgccagtgtggcatgatgca

SEQ ID NO: 7597141 - DNA, 22 bp, Homo sapiens
gctgccagtgtggcatgatgca

SEQ ID NO: 7597142 - DNA, 22 bp, Homo sapiens
gctgccagtgtggcatgatgca

SEQ ID NO: 7597143 - DNA, 22 bp, Homo sapiens
gctgccagtgtggcatgatgca

SEQ ID NO: 7597144 - DNA, 20 bp, Homo sapiens
gctgccagggcggagacatc

SEQ ID NO: 7597145 - DNA, 20 bp, Homo sapiens
gctgccagggcggagacatc

SEQ ID NO: 7597146 - DNA, 22 bp, Homo sapiens
gctgccagggaggtggtggagg

SEQ ID NO: 7597147 - DNA, 22 bp, Homo sapiens
gctgccagggaggtggtggagg

SEQ ID NO: 7597148 - DNA, 22 bp, Homo sapiens
gctgccaggggcagctgtctca

SEQ ID NO: 7597149 - DNA, 22 bp, Homo sapiens
gctgccaggggcagctgtctca

SEQ ID NO: 7597150 - DNA, 20 bp, Homo sapiens
gctgccagggcggagacatc

SEQ ID NO: 7597151 - DNA, 22 bp, Homo sapiens
gctgccaggggcagctgtctca

SEQ ID NO: 7597152 - DNA, 22 bp, Homo sapiens
gctgccaggggcagctgtctca

SEQ ID NO: 7597153 - DNA, 22 bp, Homo sapiens
gctgccaggggcagctgtctca

SEQ ID NO: 7597154 - DNA, 22 bp, Homo sapiens
gctgccagtagttggagctcca

SEQ ID NO: 7597155 - DNA, 22 bp, Homo sapiens
gctgccagtagttggagctcca

SEQ ID NO: 7597156 - DNA, 22 bp, Homo sapiens
gctgccagtagttggagctcca

SEQ ID NO: 7597157 - DNA, 22 bp, Homo sapiens
gctgccagtagttggagctcca

SEQ ID NO: 7597158 - DNA, 22 bp, Homo sapiens
gctgccagtagttggagctcca

SEQ ID NO: 7597159 - DNA, 22 bp, Homo sapiens
gctgccagtctaatgggaaaca

SEQ ID NO: 7597160 - DNA, 22 bp, Homo sapiens
gctgccagtagttggagctcca

SEQ ID NO: 7597161 - DNA, 22 bp, Homo sapiens
gctgccagtagttggagctcca

SEQ ID NO: 7597162 - DNA, 22 bp, Homo sapiens
gctgccagggaggtggtggagg

SEQ ID NO: 7597163 - DNA, 22 bp, Homo sapiens
gctgccagggaggtggtggagg

SEQ ID NO: 7597164 - DNA, 22 bp, Homo sapiens
gctgccagggaggtggtggagg

SEQ ID NO: 7597165 - DNA, 22 bp, Homo sapiens
gctgccaggccctggggctatg

SEQ ID NO: 7597166 - DNA, 22 bp, Homo sapiens
gctgccagggaggtggtggagg

SEQ ID NO: 7597167 - DNA, 21 bp, Homo sapiens
gctgccaggattttgcaggaa

SEQ ID NO: 7597168 - DNA, 21 bp, Homo sapiens
gctgccaggattttgcaggaa

SEQ ID NO: 7597169 - DNA, 22 bp, Homo sapiens
gctgccaggccctggggctatg

SEQ ID NO: 7597170 - DNA, 21 bp, Homo sapiens
gctgccaggattttgcaggaa

SEQ ID NO: 7597171 - DNA, 22 bp, Homo sapiens
gctgccaggacggagaggagcg

SEQ ID NO: 7597172 - DNA, 22 bp, Homo sapiens
gctgccaggacggagaggagcg

SEQ ID NO: 7597173 - DNA, 22 bp, Homo sapiens
gctgccaggacggagaggagcg

SEQ ID NO: 7597174 - DNA, 22 bp, Homo sapiens
gctgccaggacggagaggagcg

SEQ ID NO: 7597175 - DNA, 22 bp, Homo sapiens
gctgccaggacggagaggagcg

SEQ ID NO: 7597176 - DNA, 19 bp, Homo sapiens
gctgccaggacagttactg

SEQ ID NO: 7597177 - DNA, 22 bp, Homo sapiens
gctgccagctttccttggctga

SEQ ID NO: 7597178 - DNA, 22 bp, Homo sapiens
gctgccagctttccttggctga

SEQ ID NO: 7597179 - DNA, 22 bp, Homo sapiens
gctgccagctttccttggctga

SEQ ID NO: 7597180 - DNA, 22 bp, Homo sapiens
gctgccagccagggtgggatcc

SEQ ID NO: 7597181 - DNA, 22 bp, Homo sapiens
gctgccagccagggtgggatcc

SEQ ID NO: 7597182 - DNA, 22 bp, Homo sapiens
gctgccagccagggtgggatcc

SEQ ID NO: 7597183 - DNA, 22 bp, Homo sapiens
gctgccagcccagcaaggtgtg

SEQ ID NO: 7597184 - DNA, 22 bp, Homo sapiens
gctgccagccagggtgggatcc

SEQ ID NO: 7597185 - DNA, 22 bp, Homo sapiens
gctgccagcccagcaaggtgtg

SEQ ID NO: 7597186 - DNA, 22 bp, Homo sapiens
gctgccagcccagcaaggtgtg

SEQ ID NO: 7597187 - DNA, 22 bp, Homo sapiens
gctgccagcgtcagacctgggg

SEQ ID NO: 7597188 - DNA, 22 bp, Homo sapiens
gctgccagcgtcagacctgggg

SEQ ID NO: 7597189 - DNA, 22 bp, Homo sapiens
gctgccagccctcggggtctga

SEQ ID NO: 7597190 - DNA, 22 bp, Homo sapiens
gctgccagccctcggggtctga

SEQ ID NO: 7597191 - DNA, 22 bp, Homo sapiens
gctgccagccctcggggtctga

SEQ ID NO: 7597192 - DNA, 22 bp, Homo sapiens
gctgccagctcactctcctgag

SEQ ID NO: 7597193 - DNA, 22 bp, Homo sapiens
gctgccagctgcggcccacgcg

SEQ ID NO: 7597194 - DNA, 22 bp, Homo sapiens
gctgccagctgcggcccacgcg

SEQ ID NO: 7597195 - DNA, 22 bp, Homo sapiens
gctgccagctgcggcccacgcg

SEQ ID NO: 7597196 - DNA, 22 bp, Homo sapiens
gctgccagctcactctcctgag

SEQ ID NO: 7597197 - DNA, 22 bp, Homo sapiens
gctgccagcgtcagacctgggg

SEQ ID NO: 7597198 - DNA, 22 bp, Homo sapiens
gctgccagcgtcagacctgggg

SEQ ID NO: 7597199 - DNA, 22 bp, Homo sapiens
gctgccagcgtcagacctgggg

SEQ ID NO: 7597200 - DNA, 22 bp, Homo sapiens
gctgccagctcactctcctgag

SEQ ID NO: 7597201 - DNA, 22 bp, Homo sapiens
gctgatagactgaatgttggga

SEQ ID NO: 7597202 - DNA, 22 bp, Homo sapiens
gctgaataggactgtcatctct

SEQ ID NO: 7597203 - DNA, 22 bp, Homo sapiens
gctgaatagaagtcttcaaagg

SEQ ID NO: 7597204 - DNA, 22 bp, Homo sapiens
gctgaatacagcatgccttatg

SEQ ID NO: 7597205 - DNA, 22 bp, Homo sapiens
gctgaataattctttgttgtgg

SEQ ID NO: 7597206 - DNA, 22 bp, Homo sapiens
gctgaataatgtgtaatgtctc

SEQ ID NO: 7597207 - DNA, 22 bp, Homo sapiens
gctgatccttttatgtctagct

SEQ ID NO: 7597208 - DNA, 22 bp, Homo sapiens
gctgatccttttatgtctagct

SEQ ID NO: 7597209 - DNA, 22 bp, Homo sapiens
gctgatcacatttccaaaaccc

SEQ ID NO: 7597210 - DNA, 22 bp, Homo sapiens
gctgatccatacataaatgtgt

SEQ ID NO: 7597211 - DNA, 22 bp, Homo sapiens
gctgatattttgaagggcaagg

SEQ ID NO: 7597212 - DNA, 22 bp, Homo sapiens
gctgatatgattgataaaggta

SEQ ID NO: 7597213 - DNA, 22 bp, Homo sapiens
gctgatagactgaatgttggga

SEQ ID NO: 7597214 - DNA, 22 bp, Homo sapiens
gctgatagactgaatgttggga

SEQ ID NO: 7597215 - DNA, 22 bp, Homo sapiens
gctgatataaaattacagagga

SEQ ID NO: 7597216 - DNA, 22 bp, Homo sapiens
gctgatggaaggacaggcgccg

SEQ ID NO: 7597217 - DNA, 22 bp, Homo sapiens
gctgatgcagggttgagaggag

SEQ ID NO: 7597218 - DNA, 22 bp, Homo sapiens
gctgatgcagggttgagaggag

SEQ ID NO: 7597219 - DNA, 22 bp, Homo sapiens
gctgatggcttgctggctgaca

SEQ ID NO: 7597220 - DNA, 23 bp, Homo sapiens
gctgatggagacttgtggcctcc

SEQ ID NO: 7597221 - DNA, 23 bp, Homo sapiens
gctgatggagacttgtggcctcc

SEQ ID NO: 7597222 - DNA, 22 bp, Homo sapiens
gctgatggcttgctggctgaca

SEQ ID NO: 7597223 - DNA, 22 bp, Homo sapiens
gctgatggcttgctggctgaca

SEQ ID NO: 7597224 - DNA, 22 bp, Homo sapiens
gctgatgggagctggctcaccc

SEQ ID NO: 7597225 - DNA, 22 bp, Homo sapiens
gctgatgggagctggctcaccc

SEQ ID NO: 7597226 - DNA, 22 bp, Homo sapiens
gctgatgtgatgtcagaagagg

SEQ ID NO: 7597227 - DNA, 22 bp, Homo sapiens
gctgatgtcccactgacagcca

SEQ ID NO: 7597228 - DNA, 22 bp, Homo sapiens
gctgcactttgactgctggggt

SEQ ID NO: 7597229 - DNA, 22 bp, Homo sapiens
gctgcactttgactgctggggt

SEQ ID NO: 7597230 - DNA, 22 bp, Homo sapiens
gctgcagaatttccttctcatt

SEQ ID NO: 7597231 - DNA, 22 bp, Homo sapiens
gctgcacttgagcctgggagaa

SEQ ID NO: 7597232 - DNA, 22 bp, Homo sapiens
gctgcacttgagcctgggagaa

SEQ ID NO: 7597233 - DNA, 22 bp, Homo sapiens
gctgcactttgactgctggggt

SEQ ID NO: 7597234 - DNA, 22 bp, Homo sapiens
gctgcaccagctccaccagggc

SEQ ID NO: 7597235 - DNA, 22 bp, Homo sapiens
gctgcaccagctccaccagggc

SEQ ID NO: 7597236 - DNA, 22 bp, Homo sapiens
gctgcaccagctccaccagggc

SEQ ID NO: 7597237 - DNA, 22 bp, Homo sapiens
gctgcacttgagcctgggagaa

SEQ ID NO: 7597238 - DNA, 22 bp, Homo sapiens
gctgcaccagctgcacccagta

SEQ ID NO: 7597239 - DNA, 22 bp, Homo sapiens
gctgcaccagctgcacccagta

SEQ ID NO: 7597240 - DNA, 22 bp, Homo sapiens
gctgcaccagctccaccagggc

SEQ ID NO: 7597241 - DNA, 22 bp, Homo sapiens
gctgcaatggagtcaggctggt

SEQ ID NO: 7597242 - DNA, 22 bp, Homo sapiens
gctgcaagttagtatacattct

SEQ ID NO: 7597243 - DNA, 22 bp, Homo sapiens
gctgcacaaagtgttggttaag

SEQ ID NO: 7597244 - DNA, 19 bp, Homo sapiens
gctgcacacccagcaactg

SEQ ID NO: 7597245 - DNA, 19 bp, Homo sapiens
gctgcacacccagcaactg

SEQ ID NO: 7597246 - DNA, 22 bp, Homo sapiens
gctgcacaggagaccccattta

SEQ ID NO: 7597247 - DNA, 22 bp, Homo sapiens
gctgcacagaacagtcattggc

SEQ ID NO: 7597248 - DNA, 22 bp, Homo sapiens
gctgcacagacttgctcattta

SEQ ID NO: 7597249 - DNA, 22 bp, Homo sapiens
gctgcacagacttgctcattta

SEQ ID NO: 7597250 - DNA, 22 bp, Homo sapiens
gctgcacatggcagaggccttt

SEQ ID NO: 7597251 - DNA, 22 bp, Homo sapiens
gctgcacatggcagaggccttt

SEQ ID NO: 7597252 - DNA, 22 bp, Homo sapiens
gctgattctgaggtgctttcct

SEQ ID NO: 7597253 - DNA, 22 bp, Homo sapiens
gctgattattacatgtctgtgg

SEQ ID NO: 7597254 - DNA, 22 bp, Homo sapiens
gctgattattacatgtctgtgg

SEQ ID NO: 7597255 - DNA, 22 bp, Homo sapiens
gctgattaacttcattgtagtt

SEQ ID NO: 7597256 - DNA, 22 bp, Homo sapiens
gctgattttgtcacatagcaag

SEQ ID NO: 7597257 - DNA, 22 bp, Homo sapiens
gctgattttgtcacatagcaag

SEQ ID NO: 7597258 - DNA, 22 bp, Homo sapiens
gctgattttgtcacatagcaag

SEQ ID NO: 7597259 - DNA, 22 bp, Homo sapiens
gctgattttgtcacatagcaag

SEQ ID NO: 7597260 - DNA, 22 bp, Homo sapiens
gctgattttgagaagcacagtc

SEQ ID NO: 7597261 - DNA, 22 bp, Homo sapiens
gctgattttgagaagcacagtc

SEQ ID NO: 7597262 - DNA, 22 bp, Homo sapiens
gctgattttgagaagcacagtc

SEQ ID NO: 7597263 - DNA, 22 bp, Homo sapiens
gctgattttgagaagcacagtc

SEQ ID NO: 7597264 - DNA, 22 bp, Homo sapiens
gctgcaaacctgccacctggtg

SEQ ID NO: 7597265 - DNA, 22 bp, Homo sapiens
gctgcaactgttgctctctgca

SEQ ID NO: 7597266 - DNA, 22 bp, Homo sapiens
gctgcaagatcttaaaagggag

SEQ ID NO: 7597267 - DNA, 22 bp, Homo sapiens
gctgcaagcatgtcatcctcac

SEQ ID NO: 7597268 - DNA, 21 bp, Homo sapiens
gctgcaaggaagttttggtct

SEQ ID NO: 7597269 - DNA, 22 bp, Homo sapiens
gctgcaagtcacagaaacagtg

SEQ ID NO: 7597270 - DNA, 22 bp, Homo sapiens
gctgcaagtcacagaaacagtg

SEQ ID NO: 7597271 - DNA, 22 bp, Homo sapiens
gctgcaagtcatggcttttgca

SEQ ID NO: 7597272 - DNA, 22 bp, Homo sapiens
gctgcaagtccttccctctctt

SEQ ID NO: 7597273 - DNA, 22 bp, Homo sapiens
gctgaagataagtgaagaggct

SEQ ID NO: 7597274 - DNA, 22 bp, Homo sapiens
gctgaagataagtgaagaggct

SEQ ID NO: 7597275 - DNA, 22 bp, Homo sapiens
gctgaagataagtgaagaggct

SEQ ID NO: 7597276 - DNA, 22 bp, Homo sapiens
gctgaagataagtgaagaggct

SEQ ID NO: 7597277 - DNA, 22 bp, Homo sapiens
gctgaagataggcatttcagca

SEQ ID NO: 7597278 - DNA, 22 bp, Homo sapiens
gctgaagataggcatttcagca

SEQ ID NO: 7597279 - DNA, 22 bp, Homo sapiens
gctgaagatgcatcccttctct

SEQ ID NO: 7597280 - DNA, 20 bp, Homo sapiens
gctgaagattcccatgcaag

SEQ ID NO: 7597281 - DNA, 22 bp, Homo sapiens
gctgaagatttttgctagcccc

SEQ ID NO: 7597282 - DNA, 22 bp, Homo sapiens
gctgaagatgcatcccttctct

SEQ ID NO: 7597283 - DNA, 22 bp, Homo sapiens
gctgaagatttttgctagcccc

SEQ ID NO: 7597284 - DNA, 20 bp, Homo sapiens
gctgaagattcccatgcaag

SEQ ID NO: 7597285 - DNA, 22 bp, Homo sapiens
gctgaagcagatccaggtgtgg

SEQ ID NO: 7597286 - DNA, 22 bp, Homo sapiens
gctgaagctgacacatagtgct

SEQ ID NO: 7597287 - DNA, 22 bp, Homo sapiens
gctgaagctaacggctatgtct

SEQ ID NO: 7597288 - DNA, 22 bp, Homo sapiens
gctgaagctgacacatagtgct

SEQ ID NO: 7597289 - DNA, 22 bp, Homo sapiens
gctgaagcccacgtggcttgta

SEQ ID NO: 7597290 - DNA, 19 bp, Homo sapiens
gctgaaggcgctcagaagc

SEQ ID NO: 7597291 - DNA, 22 bp, Homo sapiens
gctgaagggagtgctgagtctg

SEQ ID NO: 7597292 - DNA, 22 bp, Homo sapiens
gctgaaggcccggaggacaggg

SEQ ID NO: 7597293 - DNA, 22 bp, Homo sapiens
gctgaaggcccggaggacaggg

SEQ ID NO: 7597294 - DNA, 22 bp, Homo sapiens
gctgaaggcccggaggacaggg

SEQ ID NO: 7597295 - DNA, 22 bp, Homo sapiens
gctgaaggcccggaggacaggg

SEQ ID NO: 7597296 - DNA, 22 bp, Homo sapiens
gctgaaggcccggaggacaggg

SEQ ID NO: 7597297 - DNA, 22 bp, Homo sapiens
gctgaaggaggctctggtacta

SEQ ID NO: 7597298 - DNA, 22 bp, Homo sapiens
gctgaaggaggctctggtacta

SEQ ID NO: 7597299 - DNA, 22 bp, Homo sapiens
gctgaaggaggctctggtacta

SEQ ID NO: 7597300 - DNA, 19 bp, Homo sapiens
gctgaaggaggtgcctgca

SEQ ID NO: 7597301 - DNA, 19 bp, Homo sapiens
gctgaaggaggtgcctgca

SEQ ID NO: 7597302 - DNA, 19 bp, Homo sapiens
gctgaaggaggtgcctgca

SEQ ID NO: 7597303 - DNA, 22 bp, Homo sapiens
gctgaaggagcctggggtggga

SEQ ID NO: 7597304 - DNA, 22 bp, Homo sapiens
gctgaaggagcctggggtggga

SEQ ID NO: 7597305 - DNA, 22 bp, Homo sapiens
gctgaagctgcagcaggaggaa

SEQ ID NO: 7597306 - DNA, 22 bp, Homo sapiens
gctgaagctgcagcaggaggaa

SEQ ID NO: 7597307 - DNA, 22 bp, Homo sapiens
gctgaagctgcagcaggaggaa

SEQ ID NO: 7597308 - DNA, 22 bp, Homo sapiens
gctgaataatgtgtaatgtctc

SEQ ID NO: 7597309 - DNA, 22 bp, Homo sapiens
gctgaataagagtctactttgc

SEQ ID NO: 7597310 - DNA, 22 bp, Homo sapiens
gctgaagttttgcagagagtaa

SEQ ID NO: 7597311 - DNA, 22 bp, Homo sapiens
gctgaagtgtggagtgacagtt

SEQ ID NO: 7597312 - DNA, 22 bp, Homo sapiens
gctgaagtgtggagtgacagtt

SEQ ID NO: 7597313 - DNA, 22 bp, Homo sapiens
gctgaagtgcttttgaatttgg

SEQ ID NO: 7597314 - DNA, 22 bp, Homo sapiens
gctgaagtgtggagtgacagtt

SEQ ID NO: 7597315 - DNA, 22 bp, Homo sapiens
gctgaagtctgagaatttgcaa

SEQ ID NO: 7597316 - DNA, 22 bp, Homo sapiens
gctgaagtctgagaatttgcaa

SEQ ID NO: 7597317 - DNA, 22 bp, Homo sapiens
gctgaaggtgtgtggagagagg

SEQ ID NO: 7597318 - DNA, 22 bp, Homo sapiens
gctgaaggtgtgtggagagagg

SEQ ID NO: 7597319 - DNA, 22 bp, Homo sapiens
gctgaaggtgtgtggagagagg

SEQ ID NO: 7597320 - DNA, 22 bp, Homo sapiens
gctgaaggtgtgtggagagagg

SEQ ID NO: 7597321 - DNA, 22 bp, Homo sapiens
gctgaaggtgtgtggagagagg

SEQ ID NO: 7597322 - DNA, 22 bp, Homo sapiens
gctgaaggtctctggagaggtc

SEQ ID NO: 7597323 - DNA, 22 bp, Homo sapiens
gctgaaggtctctggagaggtc

SEQ ID NO: 7597324 - DNA, 22 bp, Homo sapiens
gctgaaggtctctggagaggtc

SEQ ID NO: 7597325 - DNA, 22 bp, Homo sapiens
gctgaaggtctctggagaggtc

SEQ ID NO: 7597326 - DNA, 20 bp, Homo sapiens
gctgaaggggtgggtttgtt

SEQ ID NO: 7597327 - DNA, 20 bp, Homo sapiens
gctgaaggggtgggtttgtt

SEQ ID NO: 7597328 - DNA, 22 bp, Homo sapiens
gctgaagggagtgctgagtctg

SEQ ID NO: 7597329 - DNA, 19 bp, Homo sapiens
gctgaaggcgctcagaagc

SEQ ID NO: 7597330 - DNA, 22 bp, Homo sapiens
gctgaagggagtgctgagtctg

SEQ ID NO: 7597331 - DNA, 22 bp, Homo sapiens
gctcaggcttcttctataaaga

SEQ ID NO: 7597332 - DNA, 22 bp, Homo sapiens
gctcaggcttcttctataaaga

SEQ ID NO: 7597333 - DNA, 19 bp, Homo sapiens
gctcaggctgtgtgtgggg

SEQ ID NO: 7597334 - DNA, 19 bp, Homo sapiens
gctcaggctgtgtgtgggg

SEQ ID NO: 7597335 - DNA, 22 bp, Homo sapiens
gctcagggaaagagctcctgtc

SEQ ID NO: 7597336 - DNA, 22 bp, Homo sapiens
gctcagggaaagagctcctgtc

SEQ ID NO: 7597337 - DNA, 22 bp, Homo sapiens
gctcagggaaagagctcctgtc

SEQ ID NO: 7597338 - DNA, 22 bp, Homo sapiens
gctcagggaaagagctcctgtc

SEQ ID NO: 7597339 - DNA, 22 bp, Homo sapiens
gctcaggctggattgcagtggc

SEQ ID NO: 7597340 - DNA, 22 bp, Homo sapiens
gctcaggctggattgcagtggc

SEQ ID NO: 7597341 - DNA, 22 bp, Homo sapiens
gctcaggctggattgcagtggc

SEQ ID NO: 7597342 - DNA, 19 bp, Homo sapiens
gctcaggctgtgtgtgggg

SEQ ID NO: 7597343 - DNA, 19 bp, Homo sapiens
gctcaggctgtgtgtgggg

SEQ ID NO: 7597344 - DNA, 22 bp, Homo sapiens
gctcaggctggattgcagtggc

SEQ ID NO: 7597345 - DNA, 22 bp, Homo sapiens
gctcaggctggattgcagtggc

SEQ ID NO: 7597346 - DNA, 22 bp, Homo sapiens
gctcaggctggattgcagtggc

SEQ ID NO: 7597347 - DNA, 21 bp, Homo sapiens
gctcaggctcttgacagagca

SEQ ID NO: 7597348 - DNA, 22 bp, Homo sapiens
gctcagggaactttttgcaggc

SEQ ID NO: 7597349 - DNA, 22 bp, Homo sapiens
gctcagggaaagagctcctgtc

SEQ ID NO: 7597350 - DNA, 22 bp, Homo sapiens
gctcagggaactttttgcaggc

SEQ ID NO: 7597351 - DNA, 22 bp, Homo sapiens
gctcagggaactttttgcaggc

SEQ ID NO: 7597352 - DNA, 22 bp, Homo sapiens
gctcctggtctggagcttcaag

SEQ ID NO: 7597353 - DNA, 22 bp, Homo sapiens
gctcctggtctggagcttcaag

SEQ ID NO: 7597354 - DNA, 21 bp, Homo sapiens
gctcctggtgctgcgtggcgc

SEQ ID NO: 7597355 - DNA, 21 bp, Homo sapiens
gctcctggtgctgcgtggcgc

SEQ ID NO: 7597356 - DNA, 21 bp, Homo sapiens
gctcctggtgctgcgtggcgc

SEQ ID NO: 7597357 - DNA, 22 bp, Homo sapiens
gctcctggtgcaaagtttcttc

SEQ ID NO: 7597358 - DNA, 22 bp, Homo sapiens
gctcctggtgcaaagtttcttc

SEQ ID NO: 7597359 - DNA, 22 bp, Homo sapiens
gctcctggtctggagcttcaag

SEQ ID NO: 7597360 - DNA, 22 bp, Homo sapiens
gctcctggtgcaaagtttcttc

SEQ ID NO: 7597361 - DNA, 22 bp, Homo sapiens
gctcctggtctggagcttcaag

SEQ ID NO: 7597362 - DNA, 22 bp, Homo sapiens
gctcaggcctccagaggggcaa

SEQ ID NO: 7597363 - DNA, 22 bp, Homo sapiens
gctcaggcctccagaggggcaa

SEQ ID NO: 7597364 - DNA, 22 bp, Homo sapiens
gctcaggcctccagaggggcaa

SEQ ID NO: 7597365 - DNA, 22 bp, Homo sapiens
gctcaggcctccagaggggcaa

SEQ ID NO: 7597366 - DNA, 22 bp, Homo sapiens
gctcaggcctccagaggggcaa

SEQ ID NO: 7597367 - DNA, 22 bp, Homo sapiens
gctcaggcctccagaggggcaa

SEQ ID NO: 7597368 - DNA, 22 bp, Homo sapiens
gctcaggcctcactccatttgg

SEQ ID NO: 7597369 - DNA, 18 bp, Homo sapiens
gctcaggccctagtcagt

SEQ ID NO: 7597370 - DNA, 18 bp, Homo sapiens
gctcaggccctagtcagt

SEQ ID NO: 7597371 - DNA, 22 bp, Homo sapiens
gctcaggcctggcccatgggac

SEQ ID NO: 7597372 - DNA, 22 bp, Homo sapiens
gctcaggcctggcccatgggac

SEQ ID NO: 7597373 - DNA, 22 bp, Homo sapiens
gctcaggcctcggacacacaat

SEQ ID NO: 7597374 - DNA, 22 bp, Homo sapiens
gctcaggcctggcccatgggac

SEQ ID NO: 7597375 - DNA, 22 bp, Homo sapiens
gctcaggcctggcccatgggac

SEQ ID NO: 7597376 - DNA, 22 bp, Homo sapiens
gctcaggcctcggacacacaat

SEQ ID NO: 7597377 - DNA, 22 bp, Homo sapiens
gctcaggcctcggacacacaat

SEQ ID NO: 7597378 - DNA, 22 bp, Homo sapiens
gctcaggcctccagaggggcaa

SEQ ID NO: 7597379 - DNA, 21 bp, Homo sapiens
gctcaggctcaggttcaggtt

SEQ ID NO: 7597380 - DNA, 22 bp, Homo sapiens
gctcaggcctggctatccattg

SEQ ID NO: 7597381 - DNA, 22 bp, Homo sapiens
gctcaggcctggctatccattg

SEQ ID NO: 7597382 - DNA, 22 bp, Homo sapiens
gctcaggcctggcccatgggac

SEQ ID NO: 7597383 - DNA, 22 bp, Homo sapiens
gctcaggctctcccaggggaat

SEQ ID NO: 7597384 - DNA, 21 bp, Homo sapiens
gctcaggctcaggttcaggtt

SEQ ID NO: 7597385 - DNA, 22 bp, Homo sapiens
gctcaggctctcccaggggaat

SEQ ID NO: 7597386 - DNA, 22 bp, Homo sapiens
gctcaggctctcccaggggaat

SEQ ID NO: 7597387 - DNA, 22 bp, Homo sapiens
gctcaggctctcccaggggaat

SEQ ID NO: 7597388 - DNA, 22 bp, Homo sapiens
gctcaggctctcccaggggaat

SEQ ID NO: 7597389 - DNA, 22 bp, Homo sapiens
gctcaggctctcccaggggaat

SEQ ID NO: 7597390 - DNA, 21 bp, Homo sapiens
gctcaggctcaggttcaggtt

SEQ ID NO: 7597391 - DNA, 21 bp, Homo sapiens
gctcaggctcttgacagagca

SEQ ID NO: 7597392 - DNA, 21 bp, Homo sapiens
gctcaggctcttgacagagca

SEQ ID NO: 7597393 - DNA, 21 bp, Homo sapiens
gctcaggctcttgacagagca

SEQ ID NO: 7597394 - DNA, 22 bp, Homo sapiens
gctcaggctctcccaggggaat

SEQ ID NO: 7597395 - DNA, 22 bp, Homo sapiens
gctcaggctctcccaggggaat

SEQ ID NO: 7597396 - DNA, 22 bp, Homo sapiens
gctcctgtcttggggcactggc

SEQ ID NO: 7597397 - DNA, 22 bp, Homo sapiens
gctcctgtcttggggcactggc

SEQ ID NO: 7597398 - DNA, 22 bp, Homo sapiens
gctcctgtgaaggcattaggtg

SEQ ID NO: 7597399 - DNA, 22 bp, Homo sapiens
gctcctgtgaggacacagccgc

SEQ ID NO: 7597400 - DNA, 20 bp, Homo sapiens
gctcctgtcctggtggaggg

SEQ ID NO: 7597401 - DNA, 20 bp, Homo sapiens
gctcctgtcctggtggaggg

SEQ ID NO: 7597402 - DNA, 22 bp, Homo sapiens
gctcctgtccttagccccagag

SEQ ID NO: 7597403 - DNA, 22 bp, Homo sapiens
gctcctgtccttagccccagag

SEQ ID NO: 7597404 - DNA, 22 bp, Homo sapiens
gctcctgtcttggggcactggc

SEQ ID NO: 7597405 - DNA, 22 bp, Homo sapiens
gctcctgtcttggggcactggc

SEQ ID NO: 7597406 - DNA, 18 bp, Homo sapiens
gctcctggttggaaagaa

SEQ ID NO: 7597407 - DNA, 18 bp, Homo sapiens
gctcctggttggaaagaa

SEQ ID NO: 7597408 - DNA, 18 bp, Homo sapiens
gctcctggttggaaagaa

SEQ ID NO: 7597409 - DNA, 22 bp, Homo sapiens
gctcctgtaatttttaaaagtc

SEQ ID NO: 7597410 - DNA, 20 bp, Homo sapiens
gctcctgtcctggtggaggg

SEQ ID NO: 7597411 - DNA, 22 bp, Homo sapiens
gctcctgtcatcaaacaatcct

SEQ ID NO: 7597412 - DNA, 22 bp, Homo sapiens
gctcctgtcagtcatcaggtgc

SEQ ID NO: 7597413 - DNA, 22 bp, Homo sapiens
gctcctgtcagtcatcaggtgc

SEQ ID NO: 7597414 - DNA, 22 bp, Homo sapiens
gctcctgtcatcaaacaatcct

SEQ ID NO: 7597415 - DNA, 22 bp, Homo sapiens
gctcctggtgctgtagagattt

SEQ ID NO: 7597416 - DNA, 22 bp, Homo sapiens
gctcctggtgctgtagagattt

SEQ ID NO: 7597417 - DNA, 21 bp, Homo sapiens
gctcctggtgctgcgtggcgc

SEQ ID NO: 7597418 - DNA, 22 bp, Homo sapiens
gctcctggtgctgtagagattt

SEQ ID NO: 7597419 - DNA, 18 bp, Homo sapiens
gctcctggttggaaagaa

SEQ ID NO: 7597420 - DNA, 18 bp, Homo sapiens
gctcctggttggaaagaa

SEQ ID NO: 7597421 - DNA, 18 bp, Homo sapiens
gctcctggttggaaagaa

SEQ ID NO: 7597422 - DNA, 22 bp, Homo sapiens
gctcctggtgctgtagagattt

SEQ ID NO: 7597423 - DNA, 22 bp, Homo sapiens
gctcctggtgctgtagagattt

SEQ ID NO: 7597424 - DNA, 21 bp, Homo sapiens
gctcctggtgctgcgtggcgc

SEQ ID NO: 7597425 - DNA, 21 bp, Homo sapiens
gctcctggtgctgcgtggcgc

SEQ ID NO: 7597426 - DNA, 21 bp, Homo sapiens
gctcctggtgctgcgtggcgc

SEQ ID NO: 7597427 - DNA, 21 bp, Homo sapiens
gctcctggtgctgcgtggcgc

SEQ ID NO: 7597428 - DNA, 21 bp, Homo sapiens
gctcctggtgctgcgtggcgc

SEQ ID NO: 7597429 - DNA, 21 bp, Homo sapiens
gctcctggtgctgcgtggcgc

SEQ ID NO: 7597430 - DNA, 21 bp, Homo sapiens
gctcctggtgctgcgtggcgc

SEQ ID NO: 7597431 - DNA, 21 bp, Homo sapiens
gctcctggtgctgcgtggcgc

SEQ ID NO: 7597432 - DNA, 21 bp, Homo sapiens
gctcctggtgctgcgtggcgc

SEQ ID NO: 7597433 - DNA, 21 bp, Homo sapiens
gctcctggtgctgcgtggcgc

SEQ ID NO: 7597434 - DNA, 21 bp, Homo sapiens
gctctcagctgcctgctggtt

SEQ ID NO: 7597435 - DNA, 21 bp, Homo sapiens
gctctcagctgcctgctggtt

SEQ ID NO: 7597436 - DNA, 21 bp, Homo sapiens
gctctcagctgcctgctggtt

SEQ ID NO: 7597437 - DNA, 21 bp, Homo sapiens
gctctcagctgcctgctggtt

SEQ ID NO: 7597438 - DNA, 21 bp, Homo sapiens
gctctcagctgcctgctggtt

SEQ ID NO: 7597439 - DNA, 22 bp, Homo sapiens
gctctcagatgctccagcagcc

SEQ ID NO: 7597440 - DNA, 22 bp, Homo sapiens
gctctcagatgctccagcagcc

SEQ ID NO: 7597441 - DNA, 22 bp, Homo sapiens
gctctcagcccactgaggggaa

SEQ ID NO: 7597442 - DNA, 22 bp, Homo sapiens
gctctattactttcaataaaaa

SEQ ID NO: 7597443 - DNA, 22 bp, Homo sapiens
gctctattactttcaataaaaa

SEQ ID NO: 7597444 - DNA, 22 bp, Homo sapiens
gctctcactttaggttggaccg

SEQ ID NO: 7597445 - DNA, 22 bp, Homo sapiens
gctctcagaagagccaggctac

SEQ ID NO: 7597446 - DNA, 22 bp, Homo sapiens
gctctcagaagagccaggctac

SEQ ID NO: 7597447 - DNA, 22 bp, Homo sapiens
gctctcagaagagccaggctac

SEQ ID NO: 7597448 - DNA, 22 bp, Homo sapiens
gctctcactttaggttggaccg

SEQ ID NO: 7597449 - DNA, 22 bp, Homo sapiens
gctctcagaagtaacttgtcca

SEQ ID NO: 7597450 - DNA, 22 bp, Homo sapiens
gctctcagaagtaacttgtcca

SEQ ID NO: 7597451 - DNA, 22 bp, Homo sapiens
gctctcagaagagccaggctac

SEQ ID NO: 7597452 - DNA, 22 bp, Homo sapiens
gctccttcaggtggtagctgtt

SEQ ID NO: 7597453 - DNA, 22 bp, Homo sapiens
gctccttcaggtggtagctgtt

SEQ ID NO: 7597454 - DNA, 22 bp, Homo sapiens
gctcctgtttgtttgttcctga

SEQ ID NO: 7597455 - DNA, 22 bp, Homo sapiens
gctcctgtttgtttgttcctga

SEQ ID NO: 7597456 - DNA, 22 bp, Homo sapiens
gctccttcaggtggtagctgtt

SEQ ID NO: 7597457 - DNA, 22 bp, Homo sapiens
gctcctgtttgtttgttcctga

SEQ ID NO: 7597458 - DNA, 22 bp, Homo sapiens
gctcctgttttcttccagaaat

SEQ ID NO: 7597459 - DNA, 22 bp, Homo sapiens
gctcctgtgcaggtctcggttg

SEQ ID NO: 7597460 - DNA, 22 bp, Homo sapiens
gctcctgtgcaggtctcggttg

SEQ ID NO: 7597461 - DNA, 22 bp, Homo sapiens
gctcctgtttgtttgttcctga

SEQ ID NO: 7597462 - DNA, 22 bp, Homo sapiens
gctcctgtgaggacacagccgc

SEQ ID NO: 7597463 - DNA, 22 bp, Homo sapiens
gctcctgtgcaggtctcggttg

SEQ ID NO: 7597464 - DNA, 22 bp, Homo sapiens
gctcctgtgaggacacagccgc

SEQ ID NO: 7597465 - DNA, 17 bp, Homo sapiens
gctccttctaacttcca

SEQ ID NO: 7597466 - DNA, 22 bp, Homo sapiens
gctctatgttgaccttcagtgg

SEQ ID NO: 7597467 - DNA, 22 bp, Homo sapiens
gctctatgttgaccttcagtgg

SEQ ID NO: 7597468 - DNA, 22 bp, Homo sapiens
gctctattactttcaataaaaa

SEQ ID NO: 7597469 - DNA, 22 bp, Homo sapiens
gctgaagagacttctgttcgaa

SEQ ID NO: 7597470 - DNA, 22 bp, Homo sapiens
gctgaagacctccctctccatg

SEQ ID NO: 7597471 - DNA, 22 bp, Homo sapiens
gctgaagacctccctctccatg

SEQ ID NO: 7597472 - DNA, 22 bp, Homo sapiens
gctctggctactgtggctaccg

SEQ ID NO: 7597473 - DNA, 22 bp, Homo sapiens
gctctggctactgtggctaccg

SEQ ID NO: 7597474 - DNA, 22 bp, Homo sapiens
gctctggctactccaccctgtt

SEQ ID NO: 7597475 - DNA, 22 bp, Homo sapiens
gctctggctactgtggctaccg

SEQ ID NO: 7597476 - DNA, 22 bp, Homo sapiens
gctctggctactgtggctaccg

SEQ ID NO: 7597477 - DNA, 22 bp, Homo sapiens
gctgaagagaggccttgagcac

SEQ ID NO: 7597478 - DNA, 23 bp, Homo sapiens
gctgaagagcaaaccaggcaaaa

SEQ ID NO: 7597479 - DNA, 22 bp, Homo sapiens
gctgaagagagatgcgtccagc

SEQ ID NO: 7597480 - DNA, 22 bp, Homo sapiens
gctgaagagagatgcgtccagc

SEQ ID NO: 7597481 - DNA, 23 bp, Homo sapiens
gctgaagagcaaaccaggcaaaa

SEQ ID NO: 7597482 - DNA, 22 bp, Homo sapiens
gctgaagagcaaggctgggtct

SEQ ID NO: 7597483 - DNA, 23 bp, Homo sapiens
gctgaagagcaaaccaggcaaaa

SEQ ID NO: 7597484 - DNA, 22 bp, Homo sapiens
gctgaagagcaaggctgggtct

SEQ ID NO: 7597485 - DNA, 22 bp, Homo sapiens
gctgaagataagtgaagaggct

SEQ ID NO: 7597486 - DNA, 22 bp, Homo sapiens
gctctggctactccaccctgtt

SEQ ID NO: 7597487 - DNA, 22 bp, Homo sapiens
gctctggctactccaccctgtt

SEQ ID NO: 7597488 - DNA, 22 bp, Homo sapiens
gctctggctactccaccctgtt

SEQ ID NO: 7597489 - DNA, 22 bp, Homo sapiens
gctctggctactccaccctgtt

SEQ ID NO: 7597490 - DNA, 22 bp, Homo sapiens
gctctggctactccaccctgtt

SEQ ID NO: 7597491 - DNA, 21 bp, Homo sapiens
gctctggcctactgttccctc

SEQ ID NO: 7597492 - DNA, 21 bp, Homo sapiens
gctctggcctactgttccctc

SEQ ID NO: 7597493 - DNA, 21 bp, Homo sapiens
gctctggcctactgttccctc

SEQ ID NO: 7597494 - DNA, 22 bp, Homo sapiens
gctctggccagaccctcagtgg

SEQ ID NO: 7597495 - DNA, 22 bp, Homo sapiens
gctctggccagaccctcagtgg

SEQ ID NO: 7597496 - DNA, 22 bp, Homo sapiens
gctctggccagaccctcagtgg

SEQ ID NO: 7597497 - DNA, 22 bp, Homo sapiens
gctctggccagaccctcagtgg

SEQ ID NO: 7597498 - DNA, 22 bp, Homo sapiens
gctctggcccaaaccctttcta

SEQ ID NO: 7597499 - DNA, 22 bp, Homo sapiens
gctctggcagctgatattagga

SEQ ID NO: 7597500 - DNA, 22 bp, Homo sapiens
gctctggcactggcgcgggatg

SEQ ID NO: 7597501 - DNA, 22 bp, Homo sapiens
gctctggcactggcgcgggatg

SEQ ID NO: 7597502 - DNA, 17 bp, Homo sapiens
gctctggcacaggattg

SEQ ID NO: 7597503 - DNA, 22 bp, Homo sapiens
gctctgctggagggaaagagaa

SEQ ID NO: 7597504 - DNA, 22 bp, Homo sapiens
gctctgctggaagttctctgga

SEQ ID NO: 7597505 - DNA, 22 bp, Homo sapiens
gctctgctggaagttctctgga

SEQ ID NO: 7597506 - DNA, 22 bp, Homo sapiens
gctctgctggaagttctctgga

SEQ ID NO: 7597507 - DNA, 22 bp, Homo sapiens
gctctggccagaccctcagtgg

SEQ ID NO: 7597508 - DNA, 23 bp, Homo sapiens
gctctggcagcttgtgtcagcac

SEQ ID NO: 7597509 - DNA, 23 bp, Homo sapiens
gctctggcagcttgtgtcagcac

SEQ ID NO: 7597510 - DNA, 23 bp, Homo sapiens
gctctggcagcttgtgtcagcac

SEQ ID NO: 7597511 - DNA, 23 bp, Homo sapiens
gctctggcagcttgtgtcagcac

SEQ ID NO: 7597512 - DNA, 22 bp, Homo sapiens
gctctgctgacagctgggacag

SEQ ID NO: 7597513 - DNA, 22 bp, Homo sapiens
gctctgctgacagctgggacag

SEQ ID NO: 7597514 - DNA, 22 bp, Homo sapiens
gctctgctgagatatctgggag

SEQ ID NO: 7597515 - DNA, 22 bp, Homo sapiens
gctctgctgagatatctgggag

SEQ ID NO: 7597516 - DNA, 22 bp, Homo sapiens
gctctgctgagatatctgggag

SEQ ID NO: 7597517 - DNA, 22 bp, Homo sapiens
gctctgctgagatatctgggag

SEQ ID NO: 7597518 - DNA, 16 bp, Homo sapiens
gctctgctgaggccca

SEQ ID NO: 7597519 - DNA, 16 bp, Homo sapiens
gctctgctgaggccca

SEQ ID NO: 7597520 - DNA, 22 bp, Homo sapiens
gctctgctgatccgcagccatc

SEQ ID NO: 7597521 - DNA, 22 bp, Homo sapiens
gctctgctgatccgcagccatc

SEQ ID NO: 7597522 - DNA, 22 bp, Homo sapiens
gctctgctgatccgcagccatc

SEQ ID NO: 7597523 - DNA, 22 bp, Homo sapiens
gctctgctgatccgcagccatc

SEQ ID NO: 7597524 - DNA, 22 bp, Homo sapiens
gctctgctgcttactagatggt

SEQ ID NO: 7597525 - DNA, 22 bp, Homo sapiens
gctctgctgcttactagatggt

SEQ ID NO: 7597526 - DNA, 22 bp, Homo sapiens
gctctgctgcttactagatggt

SEQ ID NO: 7597527 - DNA, 22 bp, Homo sapiens
gctctgctgcttactagatggt

SEQ ID NO: 7597528 - DNA, 22 bp, Homo sapiens
gctctgctgaagccccttgcat

SEQ ID NO: 7597529 - DNA, 22 bp, Homo sapiens
gctctgctgacagctgggacag

SEQ ID NO: 7597530 - DNA, 22 bp, Homo sapiens
gctctgctgacagctgggacag

SEQ ID NO: 7597531 - DNA, 22 bp, Homo sapiens
gctctgctgacagctgggacag

SEQ ID NO: 7597532 - DNA, 22 bp, Homo sapiens
gctctgctgaagccccttgcat

SEQ ID NO: 7597533 - DNA, 22 bp, Homo sapiens
gctctgctcttgacttaccagg

SEQ ID NO: 7597534 - DNA, 22 bp, Homo sapiens
gctctgctcttgacttaccagg

SEQ ID NO: 7597535 - DNA, 22 bp, Homo sapiens
gctctgctgaagccccttgcat

SEQ ID NO: 7597536 - DNA, 23 bp, Homo sapiens
gctctgctctgtttcatagacag

SEQ ID NO: 7597537 - DNA, 22 bp, Homo sapiens
gctctgctcttgacttaccagg

SEQ ID NO: 7597538 - DNA, 18 bp, Homo sapiens
gctctgcccaggctgccc

SEQ ID NO: 7597539 - DNA, 18 bp, Homo sapiens
gctctgcccaggctgccc

SEQ ID NO: 7597540 - DNA, 22 bp, Homo sapiens
gctctgcccagtgccctgagac

SEQ ID NO: 7597541 - DNA, 22 bp, Homo sapiens
gctctgcccagtgccctgagac

SEQ ID NO: 7597542 - DNA, 22 bp, Homo sapiens
gctctgcccaggaccgtccttg

SEQ ID NO: 7597543 - DNA, 18 bp, Homo sapiens
gctctgcccaggctgccc

SEQ ID NO: 7597544 - DNA, 22 bp, Homo sapiens
gctctgcccaggaccgtccttg

SEQ ID NO: 7597545 - DNA, 18 bp, Homo sapiens
gctctgcccaggctgccc

SEQ ID NO: 7597546 - DNA, 18 bp, Homo sapiens
gctctgcccaggctgccc

SEQ ID NO: 7597547 - DNA, 18 bp, Homo sapiens
gctctgcccaggctgccc

SEQ ID NO: 7597548 - DNA, 17 bp, Homo sapiens
gctctgccccagcctct

SEQ ID NO: 7597549 - DNA, 17 bp, Homo sapiens
gctctgccccagcctct

SEQ ID NO: 7597550 - DNA, 17 bp, Homo sapiens
gctctgccccagcctct

SEQ ID NO: 7597551 - DNA, 17 bp, Homo sapiens
gctctgccccagcctct

SEQ ID NO: 7597552 - DNA, 22 bp, Homo sapiens
gctctgcccagtgccctgagac

SEQ ID NO: 7597553 - DNA, 22 bp, Homo sapiens
gctctgcccagtgccctgagac

SEQ ID NO: 7597554 - DNA, 22 bp, Homo sapiens
gctctgcccagtgccctgagac

SEQ ID NO: 7597555 - DNA, 22 bp, Homo sapiens
gctctgcccagtgccctgagac

SEQ ID NO: 7597556 - DNA, 21 bp, Homo sapiens
gctctccagggccagcccagg

SEQ ID NO: 7597557 - DNA, 21 bp, Homo sapiens
gctctccagggccagcccagg

SEQ ID NO: 7597558 - DNA, 22 bp, Homo sapiens
gctctccagctacccctttagc

SEQ ID NO: 7597559 - DNA, 22 bp, Homo sapiens
gctctccagattcaggagggat

SEQ ID NO: 7597560 - DNA, 22 bp, Homo sapiens
gctctccaaaccctgtggcttt

SEQ ID NO: 7597561 - DNA, 22 bp, Homo sapiens
gctctccactgaccacggggca

SEQ ID NO: 7597562 - DNA, 22 bp, Homo sapiens
gctctccactgaccacggggca

SEQ ID NO: 7597563 - DNA, 22 bp, Homo sapiens
gctctcagggtgatggcatact

SEQ ID NO: 7597564 - DNA, 21 bp, Homo sapiens
gctctcagctgcctgctggtt

SEQ ID NO: 7597565 - DNA, 22 bp, Homo sapiens
gctctcagggtgatggcatact

SEQ ID NO: 7597566 - DNA, 22 bp, Homo sapiens
gctctcagggtgatggcatact

SEQ ID NO: 7597567 - DNA, 22 bp, Homo sapiens
gctctcaggtacaaagctgtgt

SEQ ID NO: 7597568 - DNA, 22 bp, Homo sapiens
gctctccaaaccctgtggcttt

SEQ ID NO: 7597569 - DNA, 22 bp, Homo sapiens
gctctccaaaccctgtggcttt

SEQ ID NO: 7597570 - DNA, 22 bp, Homo sapiens
gctctcaggtgccactttgtgg

SEQ ID NO: 7597571 - DNA, 22 bp, Homo sapiens
gctctcaggtgccactttgtgg

SEQ ID NO: 7597572 - DNA, 22 bp, Homo sapiens
gctctgcctcccctagtgttac

SEQ ID NO: 7597573 - DNA, 17 bp, Homo sapiens
gctctgcctctcccacc

SEQ ID NO: 7597574 - DNA, 17 bp, Homo sapiens
gctctgcctctcccacc

SEQ ID NO: 7597575 - DNA, 22 bp, Homo sapiens
gctctgccctgggccgttgtaa

SEQ ID NO: 7597576 - DNA, 22 bp, Homo sapiens
gctctgcctcccctagtgttac

SEQ ID NO: 7597577 - DNA, 22 bp, Homo sapiens
gctctgccccaggaactcagcc

SEQ ID NO: 7597578 - DNA, 22 bp, Homo sapiens
gctctgccccaggaactcagcc

SEQ ID NO: 7597579 - DNA, 22 bp, Homo sapiens
gctctgcctctttgctgcgtca

SEQ ID NO: 7597580 - DNA, 22 bp, Homo sapiens
gctctgcctctttgctgcgtca

SEQ ID NO: 7597581 - DNA, 22 bp, Homo sapiens
gctctgcctggtcgcgtgctgg

SEQ ID NO: 7597582 - DNA, 22 bp, Homo sapiens
gctctgcctctttgctgcgtca

SEQ ID NO: 7597583 - DNA, 22 bp, Homo sapiens
gctctgcctctttgctgcgtca

SEQ ID NO: 7597584 - DNA, 17 bp, Homo sapiens
gctctgcctctcccacc

SEQ ID NO: 7597585 - DNA, 17 bp, Homo sapiens
gctctgcctctcccacc

SEQ ID NO: 7597586 - DNA, 22 bp, Homo sapiens
gctctgcctggtcgcgtgctgg

SEQ ID NO: 7597587 - DNA, 22 bp, Homo sapiens
gctctgcctggtcgcgtgctgg

SEQ ID NO: 7597588 - DNA, 22 bp, Homo sapiens
gctctgccttctcactgggttc

SEQ ID NO: 7597589 - DNA, 22 bp, Homo sapiens
gctctgccttctcactgggttc

SEQ ID NO: 7597590 - DNA, 22 bp, Homo sapiens
gctctgcctttgtcttacacgg

SEQ ID NO: 7597591 - DNA, 22 bp, Homo sapiens
gctctgccttctcactgggttc

SEQ ID NO: 7597592 - DNA, 22 bp, Homo sapiens
gctctgcctttgtcttacacgg

SEQ ID NO: 7597593 - DNA, 22 bp, Homo sapiens
gctctgctaatattgtagtacc

SEQ ID NO: 7597594 - DNA, 22 bp, Homo sapiens
gctctgctaatattgtagtacc

SEQ ID NO: 7597595 - DNA, 22 bp, Homo sapiens
gctctgcctttgtcttacacgg

SEQ ID NO: 7597596 - DNA, 22 bp, Homo sapiens
gctctgctctaacattcctgac

SEQ ID NO: 7597597 - DNA, 22 bp, Homo sapiens
gctctgctctaacattcctgac

SEQ ID NO: 7597598 - DNA, 23 bp, Homo sapiens
gctctgctctgtttcatagacag

SEQ ID NO: 7597599 - DNA, 23 bp, Homo sapiens
gctctgctctgtttcatagacag

SEQ ID NO: 7597600 - DNA, 22 bp, Homo sapiens
gctctgcgattattgggccttt

SEQ ID NO: 7597601 - DNA, 22 bp, Homo sapiens
gctctgctaatattgtagtacc

SEQ ID NO: 7597602 - DNA, 22 bp, Homo sapiens
gctctgctaatattgtagtacc

SEQ ID NO: 7597603 - DNA, 22 bp, Homo sapiens
gctctgctccctcaaatgacat

SEQ ID NO: 7597604 - DNA, 19 bp, Homo sapiens
gctctgctactattaccac

SEQ ID NO: 7597605 - DNA, 19 bp, Homo sapiens
gctctgctactattaccac

SEQ ID NO: 7597606 - DNA, 22 bp, Homo sapiens
gctctgctccctcaaatgacat

SEQ ID NO: 7597607 - DNA, 22 bp, Homo sapiens
gctctgctccctcaaatgacat

SEQ ID NO: 7597608 - DNA, 22 bp, Homo sapiens
gctctgctctaacattcctgac

SEQ ID NO: 7597609 - DNA, 22 bp, Homo sapiens
gctctgctctaacattcctgac

SEQ ID NO: 7597610 - DNA, 22 bp, Homo sapiens
gcaagaaaagagccttcagtgg

SEQ ID NO: 7597611 - DNA, 22 bp, Homo sapiens
gcaaatgctctccagcctgggt

SEQ ID NO: 7597612 - DNA, 22 bp, Homo sapiens
gcaaatgctaaagtgtagagac

SEQ ID NO: 7597613 - DNA, 22 bp, Homo sapiens
gcaagaacaggtgcttggcaag

SEQ ID NO: 7597614 - DNA, 22 bp, Homo sapiens
gcaagaacgaatcctacttgct

SEQ ID NO: 7597615 - DNA, 22 bp, Homo sapiens
gcaagaacgaatcctacttgct

SEQ ID NO: 7597616 - DNA, 22 bp, Homo sapiens
gcaagacatgtctaaggtttaa

SEQ ID NO: 7597617 - DNA, 22 bp, Homo sapiens
gcaagacctatctagttgctgt

SEQ ID NO: 7597618 - DNA, 22 bp, Homo sapiens
gcaagacctatctagttgctgt

SEQ ID NO: 7597619 - DNA, 22 bp, Homo sapiens
gcaagacaatggagcataaacg

SEQ ID NO: 7597620 - DNA, 22 bp, Homo sapiens
gcaagaactgcaattacttttg

SEQ ID NO: 7597621 - DNA, 22 bp, Homo sapiens
gcaagacaatggagcataaacg

SEQ ID NO: 7597622 - DNA, 22 bp, Homo sapiens
gcaagacaatggagcataaacg

SEQ ID NO: 7597623 - DNA, 21 bp, Homo sapiens
gcaaatgagttaactaactca

SEQ ID NO: 7597624 - DNA, 22 bp, Homo sapiens
gcaaatgagttgtaacataaaa

SEQ ID NO: 7597625 - DNA, 21 bp, Homo sapiens
gcaaatgagttaactaactca

SEQ ID NO: 7597626 - DNA, 22 bp, Homo sapiens
gcaaatgagttgtaacataaaa

SEQ ID NO: 7597627 - DNA, 22 bp, Homo sapiens
gcaaatgctaaagtgtagagac

SEQ ID NO: 7597628 - DNA, 22 bp, Homo sapiens
gcaaatgatggcttgctggctg

SEQ ID NO: 7597629 - DNA, 22 bp, Homo sapiens
gcaaatgcactgcatttagatt

SEQ ID NO: 7597630 - DNA, 22 bp, Homo sapiens
gcaaatgatggcttgctggctg

SEQ ID NO: 7597631 - DNA, 22 bp, Homo sapiens
gcaaatgagttgtaacataaaa

SEQ ID NO: 7597632 - DNA, 22 bp, Homo sapiens
gcaaatgagttgtaacataaaa

SEQ ID NO: 7597633 - DNA, 22 bp, Homo sapiens
gagggtccctgctcagggccag

SEQ ID NO: 7597634 - DNA, 22 bp, Homo sapiens
gagggtccctgctcagggccag

SEQ ID NO: 7597635 - DNA, 22 bp, Homo sapiens
gagggtccctgctcagggccag

SEQ ID NO: 7597636 - DNA, 22 bp, Homo sapiens
gcaaatgaactgatgccaatgg

SEQ ID NO: 7597637 - DNA, 22 bp, Homo sapiens
gcaaatcctggaccagcctctt

SEQ ID NO: 7597638 - DNA, 19 bp, Homo sapiens
gcaaatctgaccaaatagt

SEQ ID NO: 7597639 - DNA, 22 bp, Homo sapiens
gagggtccccatgcagagctca

SEQ ID NO: 7597640 - DNA, 22 bp, Homo sapiens
gagggtccccatgcagagctca

SEQ ID NO: 7597641 - DNA, 22 bp, Homo sapiens
gagggtccccatgcagagctca

SEQ ID NO: 7597642 - DNA, 22 bp, Homo sapiens
gagggtcccgagccctgtcaga

SEQ ID NO: 7597643 - DNA, 22 bp, Homo sapiens
gagggtcccgagccctgtcaga

SEQ ID NO: 7597644 - DNA, 22 bp, Homo sapiens
gagggtcccgagccctgtcaga

SEQ ID NO: 7597645 - DNA, 22 bp, Homo sapiens
gagggtcccgagccctgtcaga

SEQ ID NO: 7597646 - DNA, 22 bp, Homo sapiens
gagggtcccgagccctgtcaga

SEQ ID NO: 7597647 - DNA, 23 bp, Homo sapiens
gcaagcaaggcagggtaaagaga

SEQ ID NO: 7597648 - DNA, 22 bp, Homo sapiens
gcaagcaagcaggtagagctga

SEQ ID NO: 7597649 - DNA, 22 bp, Homo sapiens
gcaagcaagcaggtagagctga

SEQ ID NO: 7597650 - DNA, 22 bp, Homo sapiens
gcaagcacagatagactcagcc

SEQ ID NO: 7597651 - DNA, 22 bp, Homo sapiens
gcaagcacagatagactcagcc

SEQ ID NO: 7597652 - DNA, 22 bp, Homo sapiens
gcaagcagacattcaggtaggt

SEQ ID NO: 7597653 - DNA, 22 bp, Homo sapiens
gcaagcagacattcaggtaggt

SEQ ID NO: 7597654 - DNA, 22 bp, Homo sapiens
gcaagcagacattcaggtaggt

SEQ ID NO: 7597655 - DNA, 22 bp, Homo sapiens
gcaagcagacattcaggtaggt

SEQ ID NO: 7597656 - DNA, 22 bp, Homo sapiens
gcaagcaagtatctggcaggga

SEQ ID NO: 7597657 - DNA, 22 bp, Homo sapiens
gcaagcaagtatctggcaggga

SEQ ID NO: 7597658 - DNA, 22 bp, Homo sapiens
gcaagcaatggacggtgacttt

SEQ ID NO: 7597659 - DNA, 22 bp, Homo sapiens
gcaagatgttaacatagggaga

SEQ ID NO: 7597660 - DNA, 22 bp, Homo sapiens
gcaagcaaaatgggagattccc

SEQ ID NO: 7597661 - DNA, 22 bp, Homo sapiens
gcaagcaaattatttataggca

SEQ ID NO: 7597662 - DNA, 22 bp, Homo sapiens
gcaagatgttaccattagggaa

SEQ ID NO: 7597663 - DNA, 22 bp, Homo sapiens
gcaagatggttataaaaaatgt

SEQ ID NO: 7597664 - DNA, 22 bp, Homo sapiens
gcaagattccttgagcctagtt

SEQ ID NO: 7597665 - DNA, 22 bp, Homo sapiens
gcaagcaaaatgggagattccc

SEQ ID NO: 7597666 - DNA, 22 bp, Homo sapiens
gcaagacctatctagttgctgt

SEQ ID NO: 7597667 - DNA, 22 bp, Homo sapiens
gcaagacctatctagttgctgt

SEQ ID NO: 7597668 - DNA, 22 bp, Homo sapiens
gcaagacctatctagttgctgt

SEQ ID NO: 7597669 - DNA, 22 bp, Homo sapiens
gcaagacctatctagttgctgt

SEQ ID NO: 7597670 - DNA, 22 bp, Homo sapiens
gcaagacctatctagttgctgt

SEQ ID NO: 7597671 - DNA, 22 bp, Homo sapiens
gcaagagacttttatgtctgcc

SEQ ID NO: 7597672 - DNA, 22 bp, Homo sapiens
gcaagagacttttatgtctgcc

SEQ ID NO: 7597673 - DNA, 22 bp, Homo sapiens
gcaagagacttttatgtctgcc

SEQ ID NO: 7597674 - DNA, 22 bp, Homo sapiens
gcaagagcaactttatggagct

SEQ ID NO: 7597675 - DNA, 22 bp, Homo sapiens
gcaagagacttttatgtctgcc

SEQ ID NO: 7597676 - DNA, 22 bp, Homo sapiens
gcaagagtttctggagcagagt

SEQ ID NO: 7597677 - DNA, 19 bp, Homo sapiens
gcaagagcttaggaggggt

SEQ ID NO: 7597678 - DNA, 22 bp, Homo sapiens
gcaagatgttaacatagggaga

SEQ ID NO: 7597679 - DNA, 22 bp, Homo sapiens
gcaagatggttataaaaaatgt

SEQ ID NO: 7597680 - DNA, 22 bp, Homo sapiens
gcaagatgttaacatagggaga

SEQ ID NO: 7597681 - DNA, 22 bp, Homo sapiens
gcaagatagagttgcaaatatt

SEQ ID NO: 7597682 - DNA, 22 bp, Homo sapiens
gcaagatggttataaaaaatgt

SEQ ID NO: 7597683 - DNA, 22 bp, Homo sapiens
gagggggagatgtgcacacact

SEQ ID NO: 7597684 - DNA, 22 bp, Homo sapiens
gagggggagatgtgcacacact

SEQ ID NO: 7597685 - DNA, 22 bp, Homo sapiens
gagggggacgtatcctggtatg

SEQ ID NO: 7597686 - DNA, 22 bp, Homo sapiens
gagggggagatgtgcacacact

SEQ ID NO: 7597687 - DNA, 22 bp, Homo sapiens
gagggggagatgtgcacacact

SEQ ID NO: 7597688 - DNA, 22 bp, Homo sapiens
gagggggacgtatcctggtatg

SEQ ID NO: 7597689 - DNA, 22 bp, Homo sapiens
gagggggacgtatcctggtatg

SEQ ID NO: 7597690 - DNA, 22 bp, Homo sapiens
gagggggacgtatcctggtatg

SEQ ID NO: 7597691 - DNA, 22 bp, Homo sapiens
gagggggaaagtccctggagtc

SEQ ID NO: 7597692 - DNA, 22 bp, Homo sapiens
gagggggaaagtccctggagtc

SEQ ID NO: 7597693 - DNA, 22 bp, Homo sapiens
gagggggaaagtccctggagtc

SEQ ID NO: 7597694 - DNA, 22 bp, Homo sapiens
gagggggaaagtccctggagtc

SEQ ID NO: 7597695 - DNA, 22 bp, Homo sapiens
gagggggaaagtccctggagtc

SEQ ID NO: 7597696 - DNA, 22 bp, Homo sapiens
gaggggcttgaggccctgatgg

SEQ ID NO: 7597697 - DNA, 22 bp, Homo sapiens
gagggggaaagtccctggagtc

SEQ ID NO: 7597698 - DNA, 22 bp, Homo sapiens
gaggggcttgaggccctgatgg

SEQ ID NO: 7597699 - DNA, 22 bp, Homo sapiens
gaggggcttgaggccctgatgg

SEQ ID NO: 7597700 - DNA, 22 bp, Homo sapiens
gaggggctgtggagctctctgg

SEQ ID NO: 7597701 - DNA, 22 bp, Homo sapiens
gaggggctgtggagctctctgg

SEQ ID NO: 7597702 - DNA, 22 bp, Homo sapiens
gaggggctgtggagctctctgg

SEQ ID NO: 7597703 - DNA, 22 bp, Homo sapiens
gaggggctgtggagctctctgg

SEQ ID NO: 7597704 - DNA, 22 bp, Homo sapiens
gaggggctgggtagggcaaccc

SEQ ID NO: 7597705 - DNA, 22 bp, Homo sapiens
gaggggctgggtagggcaaccc

SEQ ID NO: 7597706 - DNA, 22 bp, Homo sapiens
gaggggctgggtagggcaaccc

SEQ ID NO: 7597707 - DNA, 22 bp, Homo sapiens
gaggggctgtggagctctctgg

SEQ ID NO: 7597708 - DNA, 22 bp, Homo sapiens
gaggggctgtggagctctctgg

SEQ ID NO: 7597709 - DNA, 22 bp, Homo sapiens
gaggggctgggtagggcaaccc

SEQ ID NO: 7597710 - DNA, 22 bp, Homo sapiens
gaggggctgggtagggcaaccc

SEQ ID NO: 7597711 - DNA, 22 bp, Homo sapiens
gaggggctgtggagctctctgg

SEQ ID NO: 7597712 - DNA, 22 bp, Homo sapiens
gaggggctgtggagctctctgg

SEQ ID NO: 7597713 - DNA, 22 bp, Homo sapiens
gaggggctgtggagctctctgg

SEQ ID NO: 7597714 - DNA, 22 bp, Homo sapiens
gaggggctgtggagctctctgg

SEQ ID NO: 7597715 - DNA, 22 bp, Homo sapiens
gaggggctgggcagtccctgga

SEQ ID NO: 7597716 - DNA, 22 bp, Homo sapiens
gaggggctgggcagtccctgga

SEQ ID NO: 7597717 - DNA, 22 bp, Homo sapiens
gaggggctggggttgactccaa

SEQ ID NO: 7597718 - DNA, 22 bp, Homo sapiens
gaggggctggggttgactccaa

SEQ ID NO: 7597719 - DNA, 22 bp, Homo sapiens
gaggggctggggttgactccaa

SEQ ID NO: 7597720 - DNA, 22 bp, Homo sapiens
gaggggctggggttgactccaa

SEQ ID NO: 7597721 - DNA, 22 bp, Homo sapiens
gaggggctgggtagggcaaccc

SEQ ID NO: 7597722 - DNA, 22 bp, Homo sapiens
gaggggctgggtagggcaaccc

SEQ ID NO: 7597723 - DNA, 22 bp, Homo sapiens
gaggggctgggtagggcaaccc

SEQ ID NO: 7597724 - DNA, 22 bp, Homo sapiens
gaggggctgggtagggcaaccc

SEQ ID NO: 7597725 - DNA, 22 bp, Homo sapiens
gaggggtggcgttggcatttag

SEQ ID NO: 7597726 - DNA, 22 bp, Homo sapiens
gaggggtggcgttggcatttag

SEQ ID NO: 7597727 - DNA, 22 bp, Homo sapiens
gaggggtggcgttggcatttag

SEQ ID NO: 7597728 - DNA, 22 bp, Homo sapiens
gaggggtgggctggaagttata

SEQ ID NO: 7597729 - DNA, 22 bp, Homo sapiens
gaggggtgggctggaagttata

SEQ ID NO: 7597730 - DNA, 22 bp, Homo sapiens
gaggggtgggctggaagttata

SEQ ID NO: 7597731 - DNA, 22 bp, Homo sapiens
gaggggtggccctggcgtgtac

SEQ ID NO: 7597732 - DNA, 22 bp, Homo sapiens
gaggggtggccctggcgtgtac

SEQ ID NO: 7597733 - DNA, 22 bp, Homo sapiens
gaggggtggccctggcgtgtac

SEQ ID NO: 7597734 - DNA, 22 bp, Homo sapiens
gaggggtggccctggcgtgtac

SEQ ID NO: 7597735 - DNA, 22 bp, Homo sapiens
gaggggtggccctggcgtgtac

SEQ ID NO: 7597736 - DNA, 22 bp, Homo sapiens
gaggggtggccctggcgtgtac

SEQ ID NO: 7597737 - DNA, 22 bp, Homo sapiens
gagggtcagaagggcctggttc

SEQ ID NO: 7597738 - DNA, 22 bp, Homo sapiens
gagggtcagaagggcctggttc

SEQ ID NO: 7597739 - DNA, 22 bp, Homo sapiens
gaggggtgtggagccatcagtt

SEQ ID NO: 7597740 - DNA, 22 bp, Homo sapiens
gaggggtgtggagccatcagtt

SEQ ID NO: 7597741 - DNA, 22 bp, Homo sapiens
gaggggtgtggagccatcagtt

SEQ ID NO: 7597742 - DNA, 22 bp, Homo sapiens
gaggggtgtggagccatcagtt

SEQ ID NO: 7597743 - DNA, 22 bp, Homo sapiens
gaggggtgtggagccatcagtt

SEQ ID NO: 7597744 - DNA, 22 bp, Homo sapiens
gaggggtgtggagccatcagtt

SEQ ID NO: 7597745 - DNA, 22 bp, Homo sapiens
gaggggtgtggagccatcagtt

SEQ ID NO: 7597746 - DNA, 22 bp, Homo sapiens
gagggggcgaacagaagcaagg

SEQ ID NO: 7597747 - DNA, 22 bp, Homo sapiens
gaggggtccaggaggcacttac

SEQ ID NO: 7597748 - DNA, 22 bp, Homo sapiens
gaggggtccaggaggcacttac

SEQ ID NO: 7597749 - DNA, 22 bp, Homo sapiens
gaggggtccaggaggcacttac

SEQ ID NO: 7597750 - DNA, 22 bp, Homo sapiens
gaggggtccaggaggcacttac

SEQ ID NO: 7597751 - DNA, 22 bp, Homo sapiens
gaggggtcctgccttggctgga

SEQ ID NO: 7597752 - DNA, 22 bp, Homo sapiens
gaggggtcctgccttggctgga

SEQ ID NO: 7597753 - DNA, 22 bp, Homo sapiens
gaggggtcctgccttggctgga

SEQ ID NO: 7597754 - DNA, 22 bp, Homo sapiens
gaggggtcctgccttggctgga

SEQ ID NO: 7597755 - DNA, 22 bp, Homo sapiens
gaggggtcttttgttgtcaggg

SEQ ID NO: 7597756 - DNA, 22 bp, Homo sapiens
gaggggtcttttgttgtcaggg

SEQ ID NO: 7597757 - DNA, 22 bp, Homo sapiens
gaggggtcttttgttgtcaggg

SEQ ID NO: 7597758 - DNA, 22 bp, Homo sapiens
gagggggcgaacagaagcaagg

SEQ ID NO: 7597759 - DNA, 22 bp, Homo sapiens
gagggggcgaacagaagcaagg

SEQ ID NO: 7597760 - DNA, 22 bp, Homo sapiens
gagggggagatgtgcacacact

SEQ ID NO: 7597761 - DNA, 22 bp, Homo sapiens
gagggggagatgtgcacacact

SEQ ID NO: 7597762 - DNA, 22 bp, Homo sapiens
gagggggagatgtgcacacact

SEQ ID NO: 7597763 - DNA, 22 bp, Homo sapiens
gagggggcgaacagaagcaagg

SEQ ID NO: 7597764 - DNA, 22 bp, Homo sapiens
gagggggcgaacagaagcaagg

SEQ ID NO: 7597765 - DNA, 22 bp, Homo sapiens
gagggggcgaacagaagcaagg

SEQ ID NO: 7597766 - DNA, 22 bp, Homo sapiens
gagggggcgaacagaagcaagg

SEQ ID NO: 7597767 - DNA, 22 bp, Homo sapiens
gagggggcgaacagaagcaagg

SEQ ID NO: 7597768 - DNA, 22 bp, Homo sapiens
gaggggtcacatgggctggctt

SEQ ID NO: 7597769 - DNA, 22 bp, Homo sapiens
gaggggtcacatgggctggctt

SEQ ID NO: 7597770 - DNA, 22 bp, Homo sapiens
gcaagctgctcttatgtggagg

SEQ ID NO: 7597771 - DNA, 22 bp, Homo sapiens
gcaagctgctcttatgtggagg

SEQ ID NO: 7597772 - DNA, 22 bp, Homo sapiens
gcaagctgcttaagctcattgt

SEQ ID NO: 7597773 - DNA, 22 bp, Homo sapiens
gcaagctggctgttagaggatg

SEQ ID NO: 7597774 - DNA, 22 bp, Homo sapiens
gcaagctggctgttagaggatg

SEQ ID NO: 7597775 - DNA, 22 bp, Homo sapiens
gcaagctgatgtgatagtgaaa

SEQ ID NO: 7597776 - DNA, 22 bp, Homo sapiens
gcaagctgatgtgatagtgaaa

SEQ ID NO: 7597777 - DNA, 20 bp, Homo sapiens
gcaagcatgaagagtagaga

SEQ ID NO: 7597778 - DNA, 22 bp, Homo sapiens
gcaagcagttgtggcttctgag

SEQ ID NO: 7597779 - DNA, 21 bp, Homo sapiens
gcaagccaccactgctgccac

SEQ ID NO: 7597780 - DNA, 22 bp, Homo sapiens
gcaagcagacattcaggtaggt

SEQ ID NO: 7597781 - DNA, 22 bp, Homo sapiens
gcaagcagacattcaggtaggt

SEQ ID NO: 7597782 - DNA, 22 bp, Homo sapiens
gcaagcagactgggcccctgtg

SEQ ID NO: 7597783 - DNA, 22 bp, Homo sapiens
gcaagcagactgggcccctgtg

SEQ ID NO: 7597784 - DNA, 22 bp, Homo sapiens
gcaagcagactgggcccctgtg

SEQ ID NO: 7597785 - DNA, 22 bp, Homo sapiens
gcaagcagcccagaacagctct

SEQ ID NO: 7597786 - DNA, 22 bp, Homo sapiens
gcaagcagcccagaacagctct

SEQ ID NO: 7597787 - DNA, 22 bp, Homo sapiens
gcaagcagcccagaacagctct

SEQ ID NO: 7597788 - DNA, 22 bp, Homo sapiens
gcaagcagatctccggagggaa

SEQ ID NO: 7597789 - DNA, 22 bp, Homo sapiens
gcaagcagatctccggagggaa

SEQ ID NO: 7597790 - DNA, 22 bp, Homo sapiens
gcaagcagatctccggagggaa

SEQ ID NO: 7597791 - DNA, 22 bp, Homo sapiens
gcaagcagttacccaggattcg

SEQ ID NO: 7597792 - DNA, 22 bp, Homo sapiens
gcaagcagggttccttagggca

SEQ ID NO: 7597793 - DNA, 22 bp, Homo sapiens
gcaagcagttacccaggattcg

SEQ ID NO: 7597794 - DNA, 22 bp, Homo sapiens
gcaagcagttacccaggattcg

SEQ ID NO: 7597795 - DNA, 22 bp, Homo sapiens
gcaagcagggttccttagggca

SEQ ID NO: 7597796 - DNA, 22 bp, Homo sapiens
gcaagcagcccagaacagctct

SEQ ID NO: 7597797 - DNA, 22 bp, Homo sapiens
gcaagcagttgtggcttctgag

SEQ ID NO: 7597798 - DNA, 22 bp, Homo sapiens
gcaagcagttcgcagcccgcct

SEQ ID NO: 7597799 - DNA, 22 bp, Homo sapiens
gcaagcagttgtggcttctgag

SEQ ID NO: 7597800 - DNA, 22 bp, Homo sapiens
gcaagcagttgtggcttctgag

SEQ ID NO: 7597801 - DNA, 22 bp, Homo sapiens
gcaagcagttgtggcttctgag

SEQ ID NO: 7597802 - DNA, 22 bp, Homo sapiens
gcaagcagttgtggcttctgag

SEQ ID NO: 7597803 - DNA, 22 bp, Homo sapiens
gcaagctgtgatttatgtgaat

SEQ ID NO: 7597804 - DNA, 22 bp, Homo sapiens
gcaagctgtgatttatgtgaat

SEQ ID NO: 7597805 - DNA, 20 bp, Homo sapiens
gcaagcttattagtgatatt

SEQ ID NO: 7597806 - DNA, 22 bp, Homo sapiens
gcaagctgtccttttgcatggc

SEQ ID NO: 7597807 - DNA, 22 bp, Homo sapiens
gcaagctgtccttttgcatggc

SEQ ID NO: 7597808 - DNA, 22 bp, Homo sapiens
gcacagcagtggcataaacaat

SEQ ID NO: 7597809 - DNA, 22 bp, Homo sapiens
gcaaggaagagcaggtggtgct

SEQ ID NO: 7597810 - DNA, 22 bp, Homo sapiens
gcacagcagtggcataaacaat

SEQ ID NO: 7597811 - DNA, 22 bp, Homo sapiens
gcaaggaagagcaggtggtgct

SEQ ID NO: 7597812 - DNA, 22 bp, Homo sapiens
gcacagcagtggcataaacaat

SEQ ID NO: 7597813 - DNA, 22 bp, Homo sapiens
gcacagcagtggcataaacaat

SEQ ID NO: 7597814 - DNA, 22 bp, Homo sapiens
gcacagcagtggcataaacaat

SEQ ID NO: 7597815 - DNA, 22 bp, Homo sapiens
gcaaggaacaaatgctctgctt

SEQ ID NO: 7597816 - DNA, 22 bp, Homo sapiens
gcaagcttcatatggcattttc

SEQ ID NO: 7597817 - DNA, 20 bp, Homo sapiens
gcaagcttattagtgatatt

SEQ ID NO: 7597818 - DNA, 22 bp, Homo sapiens
gcaagcttcatatggcattttc

SEQ ID NO: 7597819 - DNA, 22 bp, Homo sapiens
gcaaggaacaaatgctctgctt

SEQ ID NO: 7597820 - DNA, 22 bp, Homo sapiens
gcaaggaacaaatgctctgctt

SEQ ID NO: 7597821 - DNA, 22 bp, Homo sapiens
gcacagcatgaagagaggaagc

SEQ ID NO: 7597822 - DNA, 22 bp, Homo sapiens
gcacagcatgaagagaggaagc

SEQ ID NO: 7597823 - DNA, 22 bp, Homo sapiens
gcacagcatgaagagaggaagc

SEQ ID NO: 7597824 - DNA, 22 bp, Homo sapiens
gcacagcatgaagagaggaagc

SEQ ID NO: 7597825 - DNA, 22 bp, Homo sapiens
gcaaggaagagcaggtggtgct

SEQ ID NO: 7597826 - DNA, 22 bp, Homo sapiens
gcacagcatgaagagaggaagc

SEQ ID NO: 7597827 - DNA, 22 bp, Homo sapiens
gcacagcatgaagagaggaagc

SEQ ID NO: 7597828 - DNA, 21 bp, Homo sapiens
gcacagcatgagtgttggcat

SEQ ID NO: 7597829 - DNA, 22 bp, Homo sapiens
gcacagcatgaagagaggaagc

SEQ ID NO: 7597830 - DNA, 21 bp, Homo sapiens
gcacagcatgagtgttggcat

SEQ ID NO: 7597831 - DNA, 21 bp, Homo sapiens
gcacagcatgagtgttggcat

SEQ ID NO: 7597832 - DNA, 21 bp, Homo sapiens
gcacagcatgagtgttggcat

SEQ ID NO: 7597833 - DNA, 21 bp, Homo sapiens
gcacagcatgagtgttggcat

SEQ ID NO: 7597834 - DNA, 22 bp, Homo sapiens
gcacagccagcatctgagggat

SEQ ID NO: 7597835 - DNA, 22 bp, Homo sapiens
gcacagccagcatctgagggat

SEQ ID NO: 7597836 - DNA, 22 bp, Homo sapiens
gcacagccagcatctgagggat

SEQ ID NO: 7597837 - DNA, 22 bp, Homo sapiens
gcacagccagcatctgagggat

SEQ ID NO: 7597838 - DNA, 22 bp, Homo sapiens
gcacagccactgagtgagaacc

SEQ ID NO: 7597839 - DNA, 22 bp, Homo sapiens
gcacagccactgagtgagaacc

SEQ ID NO: 7597840 - DNA, 22 bp, Homo sapiens
gcacagccactgagtgagaacc

SEQ ID NO: 7597841 - DNA, 22 bp, Homo sapiens
gcacagccactgagtgagaacc

SEQ ID NO: 7597842 - DNA, 22 bp, Homo sapiens
gcacagccactgagtgagaacc

SEQ ID NO: 7597843 - DNA, 22 bp, Homo sapiens
gcacagccacgtaatgtggtca

SEQ ID NO: 7597844 - DNA, 22 bp, Homo sapiens
gcacagccacgtaatgtggtca

SEQ ID NO: 7597845 - DNA, 22 bp, Homo sapiens
gcacagccacgtaatgtggtca

SEQ ID NO: 7597846 - DNA, 22 bp, Homo sapiens
gcacagctggactctgcctggc

SEQ ID NO: 7597847 - DNA, 20 bp, Homo sapiens
gcacagctgagttcagggtc

SEQ ID NO: 7597848 - DNA, 22 bp, Homo sapiens
gcacagctggactctgcctggc

SEQ ID NO: 7597849 - DNA, 22 bp, Homo sapiens
gcacagctctccccaagacgaa

SEQ ID NO: 7597850 - DNA, 22 bp, Homo sapiens
gcacagctcgagctcaggaggg

SEQ ID NO: 7597851 - DNA, 22 bp, Homo sapiens
gcacagctcgagctcaggaggg

SEQ ID NO: 7597852 - DNA, 22 bp, Homo sapiens
gcacagctctccccaagacgaa

SEQ ID NO: 7597853 - DNA, 22 bp, Homo sapiens
gcacagctctccccaagacgaa

SEQ ID NO: 7597854 - DNA, 22 bp, Homo sapiens
gcacaggaaatgactcatgtta

SEQ ID NO: 7597855 - DNA, 22 bp, Homo sapiens
gcacaggaaatgactcatgtta

SEQ ID NO: 7597856 - DNA, 22 bp, Homo sapiens
gcacagctggactctgcctggc

SEQ ID NO: 7597857 - DNA, 22 bp, Homo sapiens
gcacagctggggtatgatgcca

SEQ ID NO: 7597858 - DNA, 22 bp, Homo sapiens
gcacagctggggtatgatgcca

SEQ ID NO: 7597859 - DNA, 22 bp, Homo sapiens
gcacagctggggtatgatgcca

SEQ ID NO: 7597860 - DNA, 22 bp, Homo sapiens
gcacagcttcctctttctctga

SEQ ID NO: 7597861 - DNA, 22 bp, Homo sapiens
gcacagcttcctctttctctga

SEQ ID NO: 7597862 - DNA, 19 bp, Homo sapiens
gcacaggacatctgatgga

SEQ ID NO: 7597863 - DNA, 19 bp, Homo sapiens
gcacaggacatctgatgga

SEQ ID NO: 7597864 - DNA, 22 bp, Homo sapiens
gcacaggagccaggtccttcac

SEQ ID NO: 7597865 - DNA, 22 bp, Homo sapiens
gcacaggaggccgatgctcatg

SEQ ID NO: 7597866 - DNA, 22 bp, Homo sapiens
gcacaggaggccgatgctcatg

SEQ ID NO: 7597867 - DNA, 22 bp, Homo sapiens
gcacaggaggccgatgctcatg

SEQ ID NO: 7597868 - DNA, 22 bp, Homo sapiens
gcacaggaggccgatgctcatg

SEQ ID NO: 7597869 - DNA, 22 bp, Homo sapiens
gcacaggatgatgggttgaggg

SEQ ID NO: 7597870 - DNA, 22 bp, Homo sapiens
gcacaggatgatgggttgaggg

SEQ ID NO: 7597871 - DNA, 22 bp, Homo sapiens
gcacaggatgatgggttgaggg

SEQ ID NO: 7597872 - DNA, 22 bp, Homo sapiens
gcacaggcaatagatacagcta

SEQ ID NO: 7597873 - DNA, 22 bp, Homo sapiens
gcacaggcaatagatacagcta

SEQ ID NO: 7597874 - DNA, 22 bp, Homo sapiens
gcacaggatgatgggttgaggg

SEQ ID NO: 7597875 - DNA, 22 bp, Homo sapiens
gcacaggcacagagggccactg

SEQ ID NO: 7597876 - DNA, 22 bp, Homo sapiens
gcacaggcacagagggccactg

SEQ ID NO: 7597877 - DNA, 22 bp, Homo sapiens
gcacaggcacagagggccactg

SEQ ID NO: 7597878 - DNA, 22 bp, Homo sapiens
gcacaggcaatagatacagcta

SEQ ID NO: 7597879 - DNA, 22 bp, Homo sapiens
gcacagcctgtccctgtcctgg

SEQ ID NO: 7597880 - DNA, 22 bp, Homo sapiens
gcacagcctgtccctgtcctgg

SEQ ID NO: 7597881 - DNA, 22 bp, Homo sapiens
gcacagccttgccctgtgccct

SEQ ID NO: 7597882 - DNA, 22 bp, Homo sapiens
gcacagccttgccctgtgccct

SEQ ID NO: 7597883 - DNA, 22 bp, Homo sapiens
gcacagccttgccctgtgccct

SEQ ID NO: 7597884 - DNA, 22 bp, Homo sapiens
gcacagcctgtccctgtcctgg

SEQ ID NO: 7597885 - DNA, 22 bp, Homo sapiens
gcacagcctgtccctgtcctgg

SEQ ID NO: 7597886 - DNA, 22 bp, Homo sapiens
gcacagccttgccctgtgccct

SEQ ID NO: 7597887 - DNA, 22 bp, Homo sapiens
gcacagccttgccctgtgccct

SEQ ID NO: 7597888 - DNA, 18 bp, Homo sapiens
gcacagcgaaaaactagt

SEQ ID NO: 7597889 - DNA, 22 bp, Homo sapiens
gcacagccttgccctgtgccct

SEQ ID NO: 7597890 - DNA, 22 bp, Homo sapiens
gcacagccttgccctgtgccct

SEQ ID NO: 7597891 - DNA, 22 bp, Homo sapiens
gcacagccctggtcggggcccc

SEQ ID NO: 7597892 - DNA, 22 bp, Homo sapiens
gcacagccctggtcggggcccc

SEQ ID NO: 7597893 - DNA, 22 bp, Homo sapiens
gcacagccagcatctgagggat

SEQ ID NO: 7597894 - DNA, 22 bp, Homo sapiens
gcacagccctggtcggggcccc

SEQ ID NO: 7597895 - DNA, 22 bp, Homo sapiens
gcacagccggaccgaggaaaag

SEQ ID NO: 7597896 - DNA, 22 bp, Homo sapiens
gcacagccggaccgaggaaaag

SEQ ID NO: 7597897 - DNA, 22 bp, Homo sapiens
gcacagccggaccgaggaaaag

SEQ ID NO: 7597898 - DNA, 22 bp, Homo sapiens
gcacagccctgagcgcatgtct

SEQ ID NO: 7597899 - DNA, 22 bp, Homo sapiens
gcacagccctgagcgcatgtct

SEQ ID NO: 7597900 - DNA, 22 bp, Homo sapiens
gcacagccagcatctgagggat

SEQ ID NO: 7597901 - DNA, 22 bp, Homo sapiens
gcacagctagacggtagccaaa

SEQ ID NO: 7597902 - DNA, 22 bp, Homo sapiens
gcacagctagacggtagccaaa

SEQ ID NO: 7597903 - DNA, 18 bp, Homo sapiens
gcacagctaggagggtcc

SEQ ID NO: 7597904 - DNA, 18 bp, Homo sapiens
gcacagctaggagggtcc

SEQ ID NO: 7597905 - DNA, 22 bp, Homo sapiens
gcacagctagacggtagccaaa

SEQ ID NO: 7597906 - DNA, 18 bp, Homo sapiens
gcacagctaggagggtcc

SEQ ID NO: 7597907 - DNA, 18 bp, Homo sapiens
gcacagctaggagggtcc

SEQ ID NO: 7597908 - DNA, 18 bp, Homo sapiens
gcacagctaggagggtcc

SEQ ID NO: 7597909 - DNA, 22 bp, Homo sapiens
gcacagctatgagctgaattgt

SEQ ID NO: 7597910 - DNA, 22 bp, Homo sapiens
gcacagctatgagctgaattgt

SEQ ID NO: 7597911 - DNA, 22 bp, Homo sapiens
gcacagctcagcatgggaggac

SEQ ID NO: 7597912 - DNA, 22 bp, Homo sapiens
gcacagctcagcatgggaggac

SEQ ID NO: 7597913 - DNA, 22 bp, Homo sapiens
gcacagctcagcatgggaggac

SEQ ID NO: 7597914 - DNA, 22 bp, Homo sapiens
gcacagctcagtactccctctg

SEQ ID NO: 7597915 - DNA, 22 bp, Homo sapiens
gcacagctcagtactccctctg

SEQ ID NO: 7597916 - DNA, 22 bp, Homo sapiens
gcacagctcagtactccctctg

SEQ ID NO: 7597917 - DNA, 22 bp, Homo sapiens
gcacagctcagtactccctctg

SEQ ID NO: 7597918 - DNA, 22 bp, Homo sapiens
gcacagctccgcttcctcacac

SEQ ID NO: 7597919 - DNA, 22 bp, Homo sapiens
gcacagctccgcttcctcacac

SEQ ID NO: 7597920 - DNA, 22 bp, Homo sapiens
gcacagctccgcttcctcacac

SEQ ID NO: 7597921 - DNA, 22 bp, Homo sapiens
gcacagctccgcttcctcacac

SEQ ID NO: 7597922 - DNA, 22 bp, Homo sapiens
gcacagctccgcttcctcacac

SEQ ID NO: 7597923 - DNA, 22 bp, Homo sapiens
gcacagctcctggtaagctggg

SEQ ID NO: 7597924 - DNA, 22 bp, Homo sapiens
gcacagctcgagctcaggaggg

SEQ ID NO: 7597925 - DNA, 22 bp, Homo sapiens
gcacagctcgagctcaggaggg

SEQ ID NO: 7597926 - DNA, 22 bp, Homo sapiens
gcacagctcctggtaagctggg

SEQ ID NO: 7597927 - DNA, 22 bp, Homo sapiens
gcacagctcgagctcaggaggg

SEQ ID NO: 7597928 - DNA, 22 bp, Homo sapiens
gcagaggacacaggagggcaag

SEQ ID NO: 7597929 - DNA, 22 bp, Homo sapiens
gcagaggacacaggagggcaag

SEQ ID NO: 7597930 - DNA, 22 bp, Homo sapiens
gcagaggacacaggagggcaag

SEQ ID NO: 7597931 - DNA, 22 bp, Homo sapiens
gcagaggacacaggagggcaag

SEQ ID NO: 7597932 - DNA, 21 bp, Homo sapiens
gcagaggaatggtatacataa

SEQ ID NO: 7597933 - DNA, 22 bp, Homo sapiens
gcagaggacacaggagggcaag

SEQ ID NO: 7597934 - DNA, 22 bp, Homo sapiens
gcagaggacacaggagggcaag

SEQ ID NO: 7597935 - DNA, 22 bp, Homo sapiens
gcagaggacacaggagggcaag

SEQ ID NO: 7597936 - DNA, 22 bp, Homo sapiens
gcagaggacacaggagggcaag

SEQ ID NO: 7597937 - DNA, 22 bp, Homo sapiens
gcagaggacacaggagggcaag

SEQ ID NO: 7597938 - DNA, 22 bp, Homo sapiens
gcagaggacacaggagggcaag

SEQ ID NO: 7597939 - DNA, 21 bp, Homo sapiens
gcagaggaatggtatacataa

SEQ ID NO: 7597940 - DNA, 21 bp, Homo sapiens
gcagaggaatggtatacataa

SEQ ID NO: 7597941 - DNA, 21 bp, Homo sapiens
gcagaggaatggtatacataa

SEQ ID NO: 7597942 - DNA, 22 bp, Homo sapiens
gcagaggacacaggagggcaag

SEQ ID NO: 7597943 - DNA, 22 bp, Homo sapiens
gcagaggacacaggagggcaag

SEQ ID NO: 7597944 - DNA, 22 bp, Homo sapiens
gcagaggacacaggagggcaag

SEQ ID NO: 7597945 - DNA, 22 bp, Homo sapiens
gcagaggacacaggagggcaag

SEQ ID NO: 7597946 - DNA, 22 bp, Homo sapiens
gcagaggacacaggagggcaag

SEQ ID NO: 7597947 - DNA, 22 bp, Homo sapiens
gcagaggacacaggagggcaag

SEQ ID NO: 7597948 - DNA, 22 bp, Homo sapiens
gcagaggacacaggagggcaag

SEQ ID NO: 7597949 - DNA, 22 bp, Homo sapiens
gcagaggacacaggagggcaag

SEQ ID NO: 7597950 - DNA, 22 bp, Homo sapiens
gcagaggacacaggagggcaag

SEQ ID NO: 7597951 - DNA, 22 bp, Homo sapiens
gcagaggacacaggagggcaag

SEQ ID NO: 7597952 - DNA, 22 bp, Homo sapiens
gcacttggagggagggttcaag

SEQ ID NO: 7597953 - DNA, 22 bp, Homo sapiens
gcacttggagggagggttcaag

SEQ ID NO: 7597954 - DNA, 22 bp, Homo sapiens
gcacttggaggtgcccacacag

SEQ ID NO: 7597955 - DNA, 22 bp, Homo sapiens
gcacttggaggtgcccacacag

SEQ ID NO: 7597956 - DNA, 22 bp, Homo sapiens
gcacttggagggagggttcaag

SEQ ID NO: 7597957 - DNA, 22 bp, Homo sapiens
gcacttgattacattagtgcct

SEQ ID NO: 7597958 - DNA, 22 bp, Homo sapiens
gcacttgattacattagtgcct

SEQ ID NO: 7597959 - DNA, 22 bp, Homo sapiens
gcacttgatcattgttacagat

SEQ ID NO: 7597960 - DNA, 22 bp, Homo sapiens
gcagagctctgttcttatctcc

SEQ ID NO: 7597961 - DNA, 22 bp, Homo sapiens
gcacttggatatacaaatgaag

SEQ ID NO: 7597962 - DNA, 22 bp, Homo sapiens
gcagagctgagcggctgcccgg

SEQ ID NO: 7597963 - DNA, 22 bp, Homo sapiens
gcagagctgagcggctgcccgg

SEQ ID NO: 7597964 - DNA, 22 bp, Homo sapiens
gcagagctgagcggctgcccgg

SEQ ID NO: 7597965 - DNA, 22 bp, Homo sapiens
gcagagctgcagcgaggcctgg

SEQ ID NO: 7597966 - DNA, 22 bp, Homo sapiens
gcagagctgcagcgaggcctgg

SEQ ID NO: 7597967 - DNA, 22 bp, Homo sapiens
gcagagctgcagcgaggcctgg

SEQ ID NO: 7597968 - DNA, 22 bp, Homo sapiens
gcagagctgcagcgaggcctgg

SEQ ID NO: 7597969 - DNA, 22 bp, Homo sapiens
gcagagctgcagcgaggcctgg

SEQ ID NO: 7597970 - DNA, 22 bp, Homo sapiens
gcagaggagatgaagatacttt

SEQ ID NO: 7597971 - DNA, 22 bp, Homo sapiens
gcagaggagatgaagatacttt

SEQ ID NO: 7597972 - DNA, 22 bp, Homo sapiens
gcagaggagcaagctggacacc

SEQ ID NO: 7597973 - DNA, 22 bp, Homo sapiens
gcagaggagcaagctggacacc

SEQ ID NO: 7597974 - DNA, 22 bp, Homo sapiens
gcagaggagcaagctggacacc

SEQ ID NO: 7597975 - DNA, 22 bp, Homo sapiens
gcagaggagcaagctggacacc

SEQ ID NO: 7597976 - DNA, 22 bp, Homo sapiens
gcagaggagatgaagatacttt

SEQ ID NO: 7597977 - DNA, 22 bp, Homo sapiens
gcagaggagcaagctggacacc

SEQ ID NO: 7597978 - DNA, 22 bp, Homo sapiens
gcagaggagcaagctggacacc

SEQ ID NO: 7597979 - DNA, 22 bp, Homo sapiens
gcagaggagcaagctggacacc

SEQ ID NO: 7597980 - DNA, 22 bp, Homo sapiens
gcagaggagcaagctggacacc

SEQ ID NO: 7597981 - DNA, 22 bp, Homo sapiens
gcagaggagcaagctggacacc

SEQ ID NO: 7597982 - DNA, 22 bp, Homo sapiens
gcagaggagcaagctggacacc

SEQ ID NO: 7597983 - DNA, 22 bp, Homo sapiens
gcagaggagcaagctggacacc

SEQ ID NO: 7597984 - DNA, 22 bp, Homo sapiens
gcagaggagcaagctggacacc

SEQ ID NO: 7597985 - DNA, 22 bp, Homo sapiens
gcagaggagcaagctggacacc

SEQ ID NO: 7597986 - DNA, 22 bp, Homo sapiens
gcagaggagcaagctggacacc

SEQ ID NO: 7597987 - DNA, 22 bp, Homo sapiens
gcagaggagcaagctggacacc

SEQ ID NO: 7597988 - DNA, 23 bp, Homo sapiens
gcagaggagcaagctggacacca

SEQ ID NO: 7597989 - DNA, 23 bp, Homo sapiens
gcagaggagcaagctggacacca

SEQ ID NO: 7597990 - DNA, 23 bp, Homo sapiens
gcagaggagcaagctggacacca

SEQ ID NO: 7597991 - DNA, 23 bp, Homo sapiens
gcagaggagcaagctggacacca

SEQ ID NO: 7597992 - DNA, 23 bp, Homo sapiens
gcagaggagcaagctggacacca

SEQ ID NO: 7597993 - DNA, 23 bp, Homo sapiens
gcagaggagcaagctggacacca

SEQ ID NO: 7597994 - DNA, 23 bp, Homo sapiens
gcagaggagcaagctggacacca

SEQ ID NO: 7597995 - DNA, 23 bp, Homo sapiens
gcagaggagcaagctggacacca

SEQ ID NO: 7597996 - DNA, 22 bp, Homo sapiens
gcagaggacacaggagggcaag

SEQ ID NO: 7597997 - DNA, 22 bp, Homo sapiens
gcagaggacacaggagggcaag

SEQ ID NO: 7597998 - DNA, 22 bp, Homo sapiens
gcagaggacacaggagggcaag

SEQ ID NO: 7597999 - DNA, 22 bp, Homo sapiens
gcagaggacagggatttagatt

SEQ ID NO: 7598000 - DNA, 22 bp, Homo sapiens
gcagaggacacaggagggcaag

SEQ ID NO: 7598001 - DNA, 22 bp, Homo sapiens
gcagaggacagggatttagatt

SEQ ID NO: 7598002 - DNA, 22 bp, Homo sapiens
gcagaggacagggatttagatt

SEQ ID NO: 7598003 - DNA, 22 bp, Homo sapiens
gcagaggacagggatttagatt

SEQ ID NO: 7598004 - DNA, 22 bp, Homo sapiens
gcagaggacagggatttagatt

SEQ ID NO: 7598005 - DNA, 22 bp, Homo sapiens
gcagaggactcaatcaaggtat

SEQ ID NO: 7598006 - DNA, 22 bp, Homo sapiens
gcagaggacagggatttagatt

SEQ ID NO: 7598007 - DNA, 22 bp, Homo sapiens
gcagaggactcaatcaaggtat

SEQ ID NO: 7598008 - DNA, 22 bp, Homo sapiens
gcagaggactcaatcaaggtat

SEQ ID NO: 7598009 - DNA, 22 bp, Homo sapiens
gcagaggactcaatcaaggtat

SEQ ID NO: 7598010 - DNA, 22 bp, Homo sapiens
gcagaggactcaatcaaggtat

SEQ ID NO: 7598011 - DNA, 22 bp, Homo sapiens
gcagaggactcaatcaaggtat

SEQ ID NO: 7598012 - DNA, 22 bp, Homo sapiens
gcagaggactcaatcaaggtat

SEQ ID NO: 7598013 - DNA, 22 bp, Homo sapiens
gcagaggagatgaagatacttt

SEQ ID NO: 7598014 - DNA, 22 bp, Homo sapiens
gcagaggagatgaagatacttt

SEQ ID NO: 7598015 - DNA, 22 bp, Homo sapiens
gcagaggagatgaagatacttt

SEQ ID NO: 7598016 - DNA, 22 bp, Homo sapiens
gcacttccatctgtcaccaggt

SEQ ID NO: 7598017 - DNA, 22 bp, Homo sapiens
gcacttccatctgtcaccaggt

SEQ ID NO: 7598018 - DNA, 22 bp, Homo sapiens
gcacttcaccactgtcctggtt

SEQ ID NO: 7598019 - DNA, 22 bp, Homo sapiens
gcacttcaccactgtcctggtt

SEQ ID NO: 7598020 - DNA, 22 bp, Homo sapiens
gcacttcaccactgtcctggtt

SEQ ID NO: 7598021 - DNA, 22 bp, Homo sapiens
gcacttctatttttttcagtgg

SEQ ID NO: 7598022 - DNA, 22 bp, Homo sapiens
gcacttgaaaagatcaggtgca

SEQ ID NO: 7598023 - DNA, 22 bp, Homo sapiens
gcacttgaaaagatcaggtgca

SEQ ID NO: 7598024 - DNA, 22 bp, Homo sapiens
gcacttgataaatgttaactga

SEQ ID NO: 7598025 - DNA, 22 bp, Homo sapiens
gcacttgaggacgactcagctg

SEQ ID NO: 7598026 - DNA, 22 bp, Homo sapiens
gcacttgataaatgttaactga

SEQ ID NO: 7598027 - DNA, 22 bp, Homo sapiens
gcacttgagccaatgctagtag

SEQ ID NO: 7598028 - DNA, 22 bp, Homo sapiens
gcacttgagccaatgctagtag

SEQ ID NO: 7598029 - DNA, 22 bp, Homo sapiens
gcacttgacccccagagctggt

SEQ ID NO: 7598030 - DNA, 22 bp, Homo sapiens
gcacttgacccccagagctggt

SEQ ID NO: 7598031 - DNA, 22 bp, Homo sapiens
gcacttgaagaattgaactgga

SEQ ID NO: 7598032 - DNA, 22 bp, Homo sapiens
gcacttgaagaattgaactgga

SEQ ID NO: 7598033 - DNA, 22 bp, Homo sapiens
gcacttgaaaagatcaggtgca

SEQ ID NO: 7598034 - DNA, 22 bp, Homo sapiens
gcactgtttatctaagtcttga

SEQ ID NO: 7598035 - DNA, 22 bp, Homo sapiens
gcacttaactggaaaagaattt

SEQ ID NO: 7598036 - DNA, 22 bp, Homo sapiens
gcactgttctaggtgcagagct

SEQ ID NO: 7598037 - DNA, 22 bp, Homo sapiens
gcactgttctaggtgcagagct

SEQ ID NO: 7598038 - DNA, 22 bp, Homo sapiens
gcactgttctcagagcattaga

SEQ ID NO: 7598039 - DNA, 22 bp, Homo sapiens
gcacttagggtatgtactgggc

SEQ ID NO: 7598040 - DNA, 22 bp, Homo sapiens
gcactgtgctagaagccagggg

SEQ ID NO: 7598041 - DNA, 22 bp, Homo sapiens
gcactgtgctagaagccagggg

SEQ ID NO: 7598042 - DNA, 22 bp, Homo sapiens
gcactgtgctaggtatcaggga

SEQ ID NO: 7598043 - DNA, 22 bp, Homo sapiens
gcactgtgctagaagccagggg

SEQ ID NO: 7598044 - DNA, 22 bp, Homo sapiens
gcactgtgctaggtatcaggga

SEQ ID NO: 7598045 - DNA, 22 bp, Homo sapiens
gcactgtgcttagttcactatt

SEQ ID NO: 7598046 - DNA, 20 bp, Homo sapiens
gcactgttacaaagcacacc

SEQ ID NO: 7598047 - DNA, 22 bp, Homo sapiens
gcactgtgcttagttcactatt

SEQ ID NO: 7598048 - DNA, 22 bp, Homo sapiens
gcactgttctaggtgcagagct

SEQ ID NO: 7598049 - DNA, 22 bp, Homo sapiens
gcactgggaatgctgatgggct

SEQ ID NO: 7598050 - DNA, 22 bp, Homo sapiens
gcactgggaatgtgagcagctg

SEQ ID NO: 7598051 - DNA, 22 bp, Homo sapiens
gcactgggaatgtgagcagctg

SEQ ID NO: 7598052 - DNA, 22 bp, Homo sapiens
gcactgggaatgtgagcagctg

SEQ ID NO: 7598053 - DNA, 22 bp, Homo sapiens
gcactgggaatgtgagcagctg

SEQ ID NO: 7598054 - DNA, 22 bp, Homo sapiens
gcactgggaatgtgagcagctg

SEQ ID NO: 7598055 - DNA, 22 bp, Homo sapiens
gcactgggaatgctgatgggct

SEQ ID NO: 7598056 - DNA, 22 bp, Homo sapiens
gcactgggaatgctgatgggct

SEQ ID NO: 7598057 - DNA, 22 bp, Homo sapiens
gcactgggaatgctgatgggct

SEQ ID NO: 7598058 - DNA, 22 bp, Homo sapiens
gcactgggaatgctgatgggct

SEQ ID NO: 7598059 - DNA, 22 bp, Homo sapiens
gcactgggaatgctgatgggct

SEQ ID NO: 7598060 - DNA, 22 bp, Homo sapiens
gcactgggagtctgtgggggtt

SEQ ID NO: 7598061 - DNA, 22 bp, Homo sapiens
gcactgggagtctgtgggggtt

SEQ ID NO: 7598062 - DNA, 22 bp, Homo sapiens
gcactgggagtctgtgggggtt

SEQ ID NO: 7598063 - DNA, 22 bp, Homo sapiens
gcactgggagtctgtgggggtt

SEQ ID NO: 7598064 - DNA, 22 bp, Homo sapiens
gcactgggagctgcctgccggt

SEQ ID NO: 7598065 - DNA, 22 bp, Homo sapiens
gcactgggagctgcctgccggt

SEQ ID NO: 7598066 - DNA, 22 bp, Homo sapiens
gcactgggagctgcctgccggt

SEQ ID NO: 7598067 - DNA, 22 bp, Homo sapiens
gcactgggagctgcctgccggt

SEQ ID NO: 7598068 - DNA, 22 bp, Homo sapiens
gcactgggaatgtgagcagctg

SEQ ID NO: 7598069 - DNA, 22 bp, Homo sapiens
gcactgggaatgtgagcagctg

SEQ ID NO: 7598070 - DNA, 22 bp, Homo sapiens
gcactgggaatgtgagcagctg

SEQ ID NO: 7598071 - DNA, 23 bp, Homo sapiens
gcactgggctctcagcaaggtgt

SEQ ID NO: 7598072 - DNA, 23 bp, Homo sapiens
gcactgggctctcagcaaggtgt

SEQ ID NO: 7598073 - DNA, 22 bp, Homo sapiens
gcactgggctccaggaaggagg

SEQ ID NO: 7598074 - DNA, 23 bp, Homo sapiens
gcactgggctctcagcaaggtgt

SEQ ID NO: 7598075 - DNA, 23 bp, Homo sapiens
gcactgggctctcagcaaggtgt

SEQ ID NO: 7598076 - DNA, 23 bp, Homo sapiens
gcactgggctctcagcaaggtgt

SEQ ID NO: 7598077 - DNA, 23 bp, Homo sapiens
gcactgggctctcagcaaggtgt

SEQ ID NO: 7598078 - DNA, 22 bp, Homo sapiens
gcactgtgctaaacatgtatca

SEQ ID NO: 7598079 - DNA, 22 bp, Homo sapiens
gcactgtgctaaacatgtatca

SEQ ID NO: 7598080 - DNA, 22 bp, Homo sapiens
gcactgtgctagaagccagggg

SEQ ID NO: 7598081 - DNA, 22 bp, Homo sapiens
gcactgtgctagaagccagggg

SEQ ID NO: 7598082 - DNA, 23 bp, Homo sapiens
gcactgggctctcagcaaggtgt

SEQ ID NO: 7598083 - DNA, 22 bp, Homo sapiens
gcactgtgctaaacatgtatca

SEQ ID NO: 7598084 - DNA, 16 bp, Homo sapiens
gcactgggatgtcttc

SEQ ID NO: 7598085 - DNA, 22 bp, Homo sapiens
gcactgggctccaggaaggagg

SEQ ID NO: 7598086 - DNA, 22 bp, Homo sapiens
gcactgggagtctgtgggggtt

SEQ ID NO: 7598087 - DNA, 22 bp, Homo sapiens
gcactgggagtctgtgggggtt

SEQ ID NO: 7598088 - DNA, 22 bp, Homo sapiens
gcactgggctccaggaaggagg

SEQ ID NO: 7598089 - DNA, 22 bp, Homo sapiens
gcactgggctccaggaaggagg

SEQ ID NO: 7598090 - DNA, 22 bp, Homo sapiens
gcactgggctccaggaaggagg

SEQ ID NO: 7598091 - DNA, 22 bp, Homo sapiens
gcactgggctccaggaaggagg

SEQ ID NO: 7598092 - DNA, 22 bp, Homo sapiens
gcactgggctccaggaaggagg

SEQ ID NO: 7598093 - DNA, 22 bp, Homo sapiens
gcacaggccatgggaggacagc

SEQ ID NO: 7598094 - DNA, 22 bp, Homo sapiens
gcacctgggacccagaggcacc

SEQ ID NO: 7598095 - DNA, 22 bp, Homo sapiens
gcacctgggacccagaggcacc

SEQ ID NO: 7598096 - DNA, 22 bp, Homo sapiens
gcacctgggacccagaggcacc

SEQ ID NO: 7598097 - DNA, 22 bp, Homo sapiens
gcacctggggtacacagctaca

SEQ ID NO: 7598098 - DNA, 22 bp, Homo sapiens
gcacctgggcaaggattcagag

SEQ ID NO: 7598099 - DNA, 22 bp, Homo sapiens
gcacctgggcaaggattcagag

SEQ ID NO: 7598100 - DNA, 22 bp, Homo sapiens
gcacctgggacccagaggcacc

SEQ ID NO: 7598101 - DNA, 22 bp, Homo sapiens
gcacaggcatcaggctttttct

SEQ ID NO: 7598102 - DNA, 22 bp, Homo sapiens
gcacaggcacagagggccactg

SEQ ID NO: 7598103 - DNA, 22 bp, Homo sapiens
gcacaggccatgggaggacagc

SEQ ID NO: 7598104 - DNA, 22 bp, Homo sapiens
gcacaggccatgggaggacagc

SEQ ID NO: 7598105 - DNA, 22 bp, Homo sapiens
gcacaggccatgggaggacagc

SEQ ID NO: 7598106 - DNA, 22 bp, Homo sapiens
gcacaggccatgggaggacagc

SEQ ID NO: 7598107 - DNA, 22 bp, Homo sapiens
gcacaggccatgggaggacagc

SEQ ID NO: 7598108 - DNA, 22 bp, Homo sapiens
gcacaggcacagagggccactg

SEQ ID NO: 7598109 - DNA, 22 bp, Homo sapiens
gcacaggcacagagggccactg

SEQ ID NO: 7598110 - DNA, 22 bp, Homo sapiens
gcacaggcacagagggccactg

SEQ ID NO: 7598111 - DNA, 22 bp, Homo sapiens
gcactctcctggctgccacagt

SEQ ID NO: 7598112 - DNA, 22 bp, Homo sapiens
gcactctcctggctgccacagt

SEQ ID NO: 7598113 - DNA, 17 bp, Homo sapiens
gcactcccccacctcct

SEQ ID NO: 7598114 - DNA, 18 bp, Homo sapiens
gcactctgactgcagagc

SEQ ID NO: 7598115 - DNA, 22 bp, Homo sapiens
gcactctcctggctgccacagt

SEQ ID NO: 7598116 - DNA, 18 bp, Homo sapiens
gcactctgactgcagagc

SEQ ID NO: 7598117 - DNA, 17 bp, Homo sapiens
gcactcccccacctcct

SEQ ID NO: 7598118 - DNA, 17 bp, Homo sapiens
gcactcccccacctcct

SEQ ID NO: 7598119 - DNA, 21 bp, Homo sapiens
gcactcagtcactactcaaga

SEQ ID NO: 7598120 - DNA, 17 bp, Homo sapiens
gcactcccccacctcct

SEQ ID NO: 7598121 - DNA, 17 bp, Homo sapiens
gcactcccccacctcct

SEQ ID NO: 7598122 - DNA, 22 bp, Homo sapiens
gcactgaaattatatgcatttg

SEQ ID NO: 7598123 - DNA, 22 bp, Homo sapiens
gcactgaaaatgttggattcca

SEQ ID NO: 7598124 - DNA, 22 bp, Homo sapiens
gcactgaaaatgttggattcca

SEQ ID NO: 7598125 - DNA, 22 bp, Homo sapiens
gcactctgtttctcctgtcagc

SEQ ID NO: 7598126 - DNA, 22 bp, Homo sapiens
gcactctgtttctcctgtcagc

SEQ ID NO: 7598127 - DNA, 22 bp, Homo sapiens
gcactctgtgatctgcagagcc

SEQ ID NO: 7598128 - DNA, 22 bp, Homo sapiens
gcactctgccaggtctcctgat

SEQ ID NO: 7598129 - DNA, 22 bp, Homo sapiens
gcactctgccaggtctcctgat

SEQ ID NO: 7598130 - DNA, 21 bp, Homo sapiens
gcactgagcatctcctctgcc

SEQ ID NO: 7598131 - DNA, 22 bp, Homo sapiens
gcactgagcaccagccacagat

SEQ ID NO: 7598132 - DNA, 22 bp, Homo sapiens
gcactgagcaccagccacagat

SEQ ID NO: 7598133 - DNA, 22 bp, Homo sapiens
gcactgagcaccagccacagat

SEQ ID NO: 7598134 - DNA, 22 bp, Homo sapiens
gcactgagcaccagccacagat

SEQ ID NO: 7598135 - DNA, 22 bp, Homo sapiens
gcactgagcaccagccacagat

SEQ ID NO: 7598136 - DNA, 17 bp, Homo sapiens
gcactgagccacagttt

SEQ ID NO: 7598137 - DNA, 17 bp, Homo sapiens
gcactgagccacagttt

SEQ ID NO: 7598138 - DNA, 17 bp, Homo sapiens
gcactgagccacagttt

SEQ ID NO: 7598139 - DNA, 22 bp, Homo sapiens
gcactgagcattgttatttcca

SEQ ID NO: 7598140 - DNA, 21 bp, Homo sapiens
gcactgagcatctcctctgcc

SEQ ID NO: 7598141 - DNA, 21 bp, Homo sapiens
gcactgagcatctcctctgcc

SEQ ID NO: 7598142 - DNA, 23 bp, Homo sapiens
gcactgagctcactagtcccctg

SEQ ID NO: 7598143 - DNA, 17 bp, Homo sapiens
gcactgagccacagttt

SEQ ID NO: 7598144 - DNA, 22 bp, Homo sapiens
gcactgagctttggaggagcag

SEQ ID NO: 7598145 - DNA, 23 bp, Homo sapiens
gcactgagctcactagtcccctg

SEQ ID NO: 7598146 - DNA, 22 bp, Homo sapiens
gcactgagctttggaggagcag

SEQ ID NO: 7598147 - DNA, 18 bp, Homo sapiens
gcactgaggaaaacctct

SEQ ID NO: 7598148 - DNA, 22 bp, Homo sapiens
gcactgaggaaggagggagtgg

SEQ ID NO: 7598149 - DNA, 22 bp, Homo sapiens
gcactgaggaaggagggagtgg

SEQ ID NO: 7598150 - DNA, 18 bp, Homo sapiens
gcactgaggaaaacctct

SEQ ID NO: 7598151 - DNA, 22 bp, Homo sapiens
gcactgaggaaggagggagtgg

SEQ ID NO: 7598152 - DNA, 22 bp, Homo sapiens
gcactgaggaaggagggagtgg

SEQ ID NO: 7598153 - DNA, 22 bp, Homo sapiens
gcactgagtctgtcatgctgca

SEQ ID NO: 7598154 - DNA, 22 bp, Homo sapiens
gcactgagtctgtcatgctgca

SEQ ID NO: 7598155 - DNA, 22 bp, Homo sapiens
gcactgagtctgtcatgctgca

SEQ ID NO: 7598156 - DNA, 20 bp, Homo sapiens
gcactgaaattcaatgtttg

SEQ ID NO: 7598157 - DNA, 20 bp, Homo sapiens
gcactgaaattcaatgtttg

SEQ ID NO: 7598158 - DNA, 22 bp, Homo sapiens
gcactgaaattatatgcatttg

SEQ ID NO: 7598159 - DNA, 17 bp, Homo sapiens
gcactgaacaatcctgt

SEQ ID NO: 7598160 - DNA, 20 bp, Homo sapiens
gcactgaaattcaatgtttg

SEQ ID NO: 7598161 - DNA, 19 bp, Homo sapiens
gcactgaagagttggtcac

SEQ ID NO: 7598162 - DNA, 22 bp, Homo sapiens
gcactgaactttaatcatttct

SEQ ID NO: 7598163 - DNA, 22 bp, Homo sapiens
gcactgaactttaatcatttct

SEQ ID NO: 7598164 - DNA, 20 bp, Homo sapiens
gcactgaaggttccagggga

SEQ ID NO: 7598165 - DNA, 19 bp, Homo sapiens
gcactgaagagttggtcac

SEQ ID NO: 7598166 - DNA, 22 bp, Homo sapiens
gcactgaatgccaaagtgtagg

SEQ ID NO: 7598167 - DNA, 22 bp, Homo sapiens
gcactgaatgccaaagtgtagg

SEQ ID NO: 7598168 - DNA, 22 bp, Homo sapiens
gcactgaatgccaaagtgtagg

SEQ ID NO: 7598169 - DNA, 22 bp, Homo sapiens
gcactgaatgcttttactgtaa

SEQ ID NO: 7598170 - DNA, 22 bp, Homo sapiens
gcactgaatgcttttactgtaa

SEQ ID NO: 7598171 - DNA, 22 bp, Homo sapiens
gcactgaatgcttttactgtaa

SEQ ID NO: 7598172 - DNA, 22 bp, Homo sapiens
gcactgaatgcttttactgtaa

SEQ ID NO: 7598173 - DNA, 22 bp, Homo sapiens
gcactgagcaccagccacagat

SEQ ID NO: 7598174 - DNA, 22 bp, Homo sapiens
gcactgagagctttattctaga

SEQ ID NO: 7598175 - DNA, 22 bp, Homo sapiens
gcactgagagctttattctaga

SEQ ID NO: 7598176 - DNA, 22 bp, Homo sapiens
gcactgagatacatttctaagg

SEQ ID NO: 7598177 - DNA, 22 bp, Homo sapiens
gcactgagaactgttttctaga

SEQ ID NO: 7598178 - DNA, 22 bp, Homo sapiens
gcactgctttctgagtcattgt

SEQ ID NO: 7598179 - DNA, 22 bp, Homo sapiens
gcactgctccaggtgtggcttg

SEQ ID NO: 7598180 - DNA, 22 bp, Homo sapiens
gcactgctccagtctctgcttt

SEQ ID NO: 7598181 - DNA, 22 bp, Homo sapiens
gcactgctccagtctctgcttt

SEQ ID NO: 7598182 - DNA, 22 bp, Homo sapiens
gcactgctccagtctctgcttt

SEQ ID NO: 7598183 - DNA, 23 bp, Homo sapiens
gcactggaaaaatgaagattact

SEQ ID NO: 7598184 - DNA, 22 bp, Homo sapiens
gcactgcttttacctaggtgag

SEQ ID NO: 7598185 - DNA, 22 bp, Homo sapiens
gcactgcttttacctaggtgag

SEQ ID NO: 7598186 - DNA, 22 bp, Homo sapiens
gcactgcttttacctaggtgag

SEQ ID NO: 7598187 - DNA, 22 bp, Homo sapiens
gcactggaaggagggaatctta

SEQ ID NO: 7598188 - DNA, 22 bp, Homo sapiens
gcactggacaggagtgaaatta

SEQ ID NO: 7598189 - DNA, 22 bp, Homo sapiens
gcactggagatacagagatgaa

SEQ ID NO: 7598190 - DNA, 22 bp, Homo sapiens
gcactggagatacagagatgaa

SEQ ID NO: 7598191 - DNA, 22 bp, Homo sapiens
gcactggaccccaggatatgga

SEQ ID NO: 7598192 - DNA, 22 bp, Homo sapiens
gcactggaccccaggatatgga

SEQ ID NO: 7598193 - DNA, 22 bp, Homo sapiens
gcactggagatacagagatgaa

SEQ ID NO: 7598194 - DNA, 22 bp, Homo sapiens
gcactggagatacagagatgaa

SEQ ID NO: 7598195 - DNA, 22 bp, Homo sapiens
gcactggagaatggctgtattc

SEQ ID NO: 7598196 - DNA, 22 bp, Homo sapiens
gcactggattttgatctgcaag

SEQ ID NO: 7598197 - DNA, 22 bp, Homo sapiens
gcactggccgcacgcgtagggc

SEQ ID NO: 7598198 - DNA, 22 bp, Homo sapiens
gcactggccgcacgcgtagggc

SEQ ID NO: 7598199 - DNA, 22 bp, Homo sapiens
gcactggccgcacgcgtagggc

SEQ ID NO: 7598200 - DNA, 22 bp, Homo sapiens
gcactgggaagaatgagcctgt

SEQ ID NO: 7598201 - DNA, 22 bp, Homo sapiens
gcactgggaagaatgagcctgt

SEQ ID NO: 7598202 - DNA, 22 bp, Homo sapiens
gcactgggaagaatgagcctgt

SEQ ID NO: 7598203 - DNA, 22 bp, Homo sapiens
gcactgggaagaatgagcctgt

SEQ ID NO: 7598204 - DNA, 22 bp, Homo sapiens
gcactggattttgatctgcaag

SEQ ID NO: 7598205 - DNA, 22 bp, Homo sapiens
gcactggatcttgggagacgtg

SEQ ID NO: 7598206 - DNA, 22 bp, Homo sapiens
gcactggatcttgggagacgtg

SEQ ID NO: 7598207 - DNA, 22 bp, Homo sapiens
gcactggatcttgggagacgtg

SEQ ID NO: 7598208 - DNA, 22 bp, Homo sapiens
gcactgggaatgagggcagctt

SEQ ID NO: 7598209 - DNA, 22 bp, Homo sapiens
gcactgggaatgagggcagctt

SEQ ID NO: 7598210 - DNA, 22 bp, Homo sapiens
gcactgggaatgagggcagctt

SEQ ID NO: 7598211 - DNA, 22 bp, Homo sapiens
gcactgggaagaatgagcctgt

SEQ ID NO: 7598212 - DNA, 22 bp, Homo sapiens
gcactgggaagaatgagcctgt

SEQ ID NO: 7598213 - DNA, 22 bp, Homo sapiens
gcactgggaatgagggcagctt

SEQ ID NO: 7598214 - DNA, 22 bp, Homo sapiens
gcactgggaatgagggcagctt

SEQ ID NO: 7598215 - DNA, 22 bp, Homo sapiens
gcactgggaatgagggcagctt

SEQ ID NO: 7598216 - DNA, 22 bp, Homo sapiens
gcactgggaatgagggcagctt

SEQ ID NO: 7598217 - DNA, 22 bp, Homo sapiens
gcactgggaatgagggcagctt

SEQ ID NO: 7598218 - DNA, 22 bp, Homo sapiens
gcactgccacataatctcagca

SEQ ID NO: 7598219 - DNA, 22 bp, Homo sapiens
gcactgccacataatctcagca

SEQ ID NO: 7598220 - DNA, 22 bp, Homo sapiens
gcactgccacataatctcagca

SEQ ID NO: 7598221 - DNA, 22 bp, Homo sapiens
gcactgccacataatctcagca

SEQ ID NO: 7598222 - DNA, 22 bp, Homo sapiens
gcactgccacataatctcagca

SEQ ID NO: 7598223 - DNA, 22 bp, Homo sapiens
gcactgcaggtgggtggagagg

SEQ ID NO: 7598224 - DNA, 22 bp, Homo sapiens
gcactgcatctactggcaagta

SEQ ID NO: 7598225 - DNA, 22 bp, Homo sapiens
gcactgcaggtgggtggagagg

SEQ ID NO: 7598226 - DNA, 22 bp, Homo sapiens
gcactgcagcctcagatggtgg

SEQ ID NO: 7598227 - DNA, 22 bp, Homo sapiens
gcactgcaggtgggtggagagg

SEQ ID NO: 7598228 - DNA, 22 bp, Homo sapiens
gcactgattacccattgctgct

SEQ ID NO: 7598229 - DNA, 22 bp, Homo sapiens
gcactgattacccattgctgct

SEQ ID NO: 7598230 - DNA, 22 bp, Homo sapiens
gcactgatgcaaaaatcactca

SEQ ID NO: 7598231 - DNA, 22 bp, Homo sapiens
gcactgatgcaaaaatcactca

SEQ ID NO: 7598232 - DNA, 22 bp, Homo sapiens
gcactgagtctgtcatgctgca

SEQ ID NO: 7598233 - DNA, 22 bp, Homo sapiens
gcactgagtctgtcatgctgca

SEQ ID NO: 7598234 - DNA, 22 bp, Homo sapiens
gcactgagtctgtcatgctgca

SEQ ID NO: 7598235 - DNA, 22 bp, Homo sapiens
gcactgagtctgtcatgctgca

SEQ ID NO: 7598236 - DNA, 16 bp, Homo sapiens
gcactgccttgggccc

SEQ ID NO: 7598237 - DNA, 21 bp, Homo sapiens
gcactgctagaaccccctgga

SEQ ID NO: 7598238 - DNA, 21 bp, Homo sapiens
gcactgctagaaccccctgga

SEQ ID NO: 7598239 - DNA, 16 bp, Homo sapiens
gcactgccttgggccc

SEQ ID NO: 7598240 - DNA, 22 bp, Homo sapiens
gcactgctatttagctccatca

SEQ ID NO: 7598241 - DNA, 22 bp, Homo sapiens
gcactgctatttagctccatca

SEQ ID NO: 7598242 - DNA, 22 bp, Homo sapiens
gcactgctccaggtgtggcttg

SEQ ID NO: 7598243 - DNA, 22 bp, Homo sapiens
gcactgctccaggtgtggcttg

SEQ ID NO: 7598244 - DNA, 22 bp, Homo sapiens
gcactgctccaggtgtggcttg

SEQ ID NO: 7598245 - DNA, 22 bp, Homo sapiens
gcactgcctgtgttcagggtaa

SEQ ID NO: 7598246 - DNA, 22 bp, Homo sapiens
gcactgcctgtgttcagggtaa

SEQ ID NO: 7598247 - DNA, 22 bp, Homo sapiens
gcactgcctgtgttcagggtaa

SEQ ID NO: 7598248 - DNA, 22 bp, Homo sapiens
gcactgcctgtgagccctggtt

SEQ ID NO: 7598249 - DNA, 22 bp, Homo sapiens
gcactgcctatgcaaatgtact

SEQ ID NO: 7598250 - DNA, 22 bp, Homo sapiens
gcactgcctcatgctaataaat

SEQ ID NO: 7598251 - DNA, 22 bp, Homo sapiens
gcactgcctgtgagccctggtt

SEQ ID NO: 7598252 - DNA, 23 bp, Homo sapiens
gcactgccatgtgctctgcaggc

SEQ ID NO: 7598253 - DNA, 23 bp, Homo sapiens
gcactgccatgtgctctgcaggc

SEQ ID NO: 7598254 - DNA, 23 bp, Homo sapiens
gcactgccatgtgctctgcaggc

SEQ ID NO: 7598255 - DNA, 22 bp, Homo sapiens
gcactgccatcaatgcatgaca

SEQ ID NO: 7598256 - DNA, 22 bp, Homo sapiens
gcactgccatcaatgcatgaca

SEQ ID NO: 7598257 - DNA, 22 bp, Homo sapiens
gcactgccatcaatgcatgaca

SEQ ID NO: 7598258 - DNA, 23 bp, Homo sapiens
gcactgccatgtgctctgcaggc

SEQ ID NO: 7598259 - DNA, 22 bp, Homo sapiens
gcactgccctcttcggggttcc

SEQ ID NO: 7598260 - DNA, 23 bp, Homo sapiens
gcactgccatgtgctctgcaggc

SEQ ID NO: 7598261 - DNA, 23 bp, Homo sapiens
gcactgccatgtgctctgcaggc

SEQ ID NO: 7598262 - DNA, 23 bp, Homo sapiens
gcactgccatgtgctctgcaggc

SEQ ID NO: 7598263 - DNA, 23 bp, Homo sapiens
gcactgccatgtgctctgcaggc

SEQ ID NO: 7598264 - DNA, 22 bp, Homo sapiens
gcagcagccgacatggattgca

SEQ ID NO: 7598265 - DNA, 22 bp, Homo sapiens
gcagcagccgacatggattgca

SEQ ID NO: 7598266 - DNA, 22 bp, Homo sapiens
gcagcagccgacatggattgca

SEQ ID NO: 7598267 - DNA, 22 bp, Homo sapiens
gcagcagccgacatggattgca

SEQ ID NO: 7598268 - DNA, 22 bp, Homo sapiens
gcagcagcggggcccctgcgcg

SEQ ID NO: 7598269 - DNA, 22 bp, Homo sapiens
gcagcagcggggcccctgcgcg

SEQ ID NO: 7598270 - DNA, 22 bp, Homo sapiens
gcagcagccgacatggattgca

SEQ ID NO: 7598271 - DNA, 22 bp, Homo sapiens
gcagcagccgacatggattgca

SEQ ID NO: 7598272 - DNA, 22 bp, Homo sapiens
gcagcagcggggcccctgcgcg

SEQ ID NO: 7598273 - DNA, 22 bp, Homo sapiens
gcagcagcggggcccctgcgcg

SEQ ID NO: 7598274 - DNA, 22 bp, Homo sapiens
gcagcagcggggcccctgcgcg

SEQ ID NO: 7598275 - DNA, 22 bp, Homo sapiens
gcagcagcggggcccctgcgcg

SEQ ID NO: 7598276 - DNA, 22 bp, Homo sapiens
gcagcagccgacatggattgca

SEQ ID NO: 7598277 - DNA, 22 bp, Homo sapiens
gcagcagccgacatggattgca

SEQ ID NO: 7598278 - DNA, 22 bp, Homo sapiens
gcagcagcccagggctctcaga

SEQ ID NO: 7598279 - DNA, 22 bp, Homo sapiens
gcagaggaggacccaggaatta

SEQ ID NO: 7598280 - DNA, 22 bp, Homo sapiens
gcagaggaggacccaggaatta

SEQ ID NO: 7598281 - DNA, 22 bp, Homo sapiens
gcagaggaggacccaggaatta

SEQ ID NO: 7598282 - DNA, 22 bp, Homo sapiens
gcagaggaggacccaggaatta

SEQ ID NO: 7598283 - DNA, 22 bp, Homo sapiens
gcagaggaggacccaggaatta

SEQ ID NO: 7598284 - DNA, 22 bp, Homo sapiens
gcagaggaggacccaggaatta

SEQ ID NO: 7598285 - DNA, 22 bp, Homo sapiens
gcagaggaggacccaggaatta

SEQ ID NO: 7598286 - DNA, 22 bp, Homo sapiens
gcagaggaggacccaggaatta

SEQ ID NO: 7598287 - DNA, 22 bp, Homo sapiens
gcagaggaggacccaggaatta

SEQ ID NO: 7598288 - DNA, 22 bp, Homo sapiens
gcagaggaggacccaggaatta

SEQ ID NO: 7598289 - DNA, 22 bp, Homo sapiens
gcagaggaggacccaggaatta

SEQ ID NO: 7598290 - DNA, 22 bp, Homo sapiens
gcagaggaggacccaggaatta

SEQ ID NO: 7598291 - DNA, 22 bp, Homo sapiens
gcagaggaggacccaggaatta

SEQ ID NO: 7598292 - DNA, 22 bp, Homo sapiens
gcagaggaggacccaggaatta

SEQ ID NO: 7598293 - DNA, 22 bp, Homo sapiens
gcagaggagcaagttgctacag

SEQ ID NO: 7598294 - DNA, 22 bp, Homo sapiens
gcagaggagcaagttgctacag

SEQ ID NO: 7598295 - DNA, 22 bp, Homo sapiens
gcagaggagcaagttgctacag

SEQ ID NO: 7598296 - DNA, 22 bp, Homo sapiens
gcagaggagcaagttgctacag

SEQ ID NO: 7598297 - DNA, 22 bp, Homo sapiens
gcagaggagcaagttgctacag

SEQ ID NO: 7598298 - DNA, 22 bp, Homo sapiens
gcagaggagcaagttgctacag

SEQ ID NO: 7598299 - DNA, 22 bp, Homo sapiens
gcagaggagcaagttgctacag

SEQ ID NO: 7598300 - DNA, 22 bp, Homo sapiens
gcagaggagcaagttgctacag

SEQ ID NO: 7598301 - DNA, 23 bp, Homo sapiens
gcagaggagcaagctggacacca

SEQ ID NO: 7598302 - DNA, 23 bp, Homo sapiens
gcagaggagcaagctggacacca

SEQ ID NO: 7598303 - DNA, 23 bp, Homo sapiens
gcagaggagcaagctggacacca

SEQ ID NO: 7598304 - DNA, 23 bp, Homo sapiens
gcagaggagcaagctggacacca

SEQ ID NO: 7598305 - DNA, 23 bp, Homo sapiens
gcagaggagcaagctggacacca

SEQ ID NO: 7598306 - DNA, 23 bp, Homo sapiens
gcagaggagcaagctggacacca

SEQ ID NO: 7598307 - DNA, 22 bp, Homo sapiens
gcagcagctctcaaagtggtct

SEQ ID NO: 7598308 - DNA, 22 bp, Homo sapiens
gcagcagctctcaaagtggtct

SEQ ID NO: 7598309 - DNA, 22 bp, Homo sapiens
gcagcagctccctatccaggct

SEQ ID NO: 7598310 - DNA, 22 bp, Homo sapiens
gcagcagctctgaatgggcccc

SEQ ID NO: 7598311 - DNA, 22 bp, Homo sapiens
gcagcagctctgaatgggcccc

SEQ ID NO: 7598312 - DNA, 22 bp, Homo sapiens
gcagcagctctgaatgggcccc

SEQ ID NO: 7598313 - DNA, 22 bp, Homo sapiens
gcagcagctctgaatgggcccc

SEQ ID NO: 7598314 - DNA, 22 bp, Homo sapiens
gcagcagctctcaaagtggtct

SEQ ID NO: 7598315 - DNA, 22 bp, Homo sapiens
gcagcagctctgaatgggcccc

SEQ ID NO: 7598316 - DNA, 22 bp, Homo sapiens
gcagcagctctgaatgggcccc

SEQ ID NO: 7598317 - DNA, 22 bp, Homo sapiens
gcagcagctctgaatgggcccc

SEQ ID NO: 7598318 - DNA, 22 bp, Homo sapiens
gcagcagctgacagtgggtgcc

SEQ ID NO: 7598319 - DNA, 22 bp, Homo sapiens
gcagcagctgacagtgggtgcc

SEQ ID NO: 7598320 - DNA, 22 bp, Homo sapiens
gcagcagctgacagtgggtgcc

SEQ ID NO: 7598321 - DNA, 22 bp, Homo sapiens
gcagcagctctgaatgggcccc

SEQ ID NO: 7598322 - DNA, 22 bp, Homo sapiens
gcagcagctgacagtgggtgcc

SEQ ID NO: 7598323 - DNA, 22 bp, Homo sapiens
gcagcagctgacagtgggtgcc

SEQ ID NO: 7598324 - DNA, 22 bp, Homo sapiens
gcagcagctctgaatgggcccc

SEQ ID NO: 7598325 - DNA, 22 bp, Homo sapiens
gcagcagctgacagtgggtgcc

SEQ ID NO: 7598326 - DNA, 22 bp, Homo sapiens
gcagcagctctgaatgggcccc

SEQ ID NO: 7598327 - DNA, 22 bp, Homo sapiens
gcagcagctcagccgggcactg

SEQ ID NO: 7598328 - DNA, 22 bp, Homo sapiens
gcagcagctcagttctgggagg

SEQ ID NO: 7598329 - DNA, 22 bp, Homo sapiens
gcagcagctcagttctgggagg

SEQ ID NO: 7598330 - DNA, 22 bp, Homo sapiens
gcagcagctcagttctgggagg

SEQ ID NO: 7598331 - DNA, 22 bp, Homo sapiens
gcagcagctcagccgggcactg

SEQ ID NO: 7598332 - DNA, 22 bp, Homo sapiens
gcagcagctcagccgggcactg

SEQ ID NO: 7598333 - DNA, 22 bp, Homo sapiens
gcagcagctcagccgggcactg

SEQ ID NO: 7598334 - DNA, 22 bp, Homo sapiens
gcagcagctcagccgggcactg

SEQ ID NO: 7598335 - DNA, 22 bp, Homo sapiens
gcagcagctcagccgggcactg

SEQ ID NO: 7598336 - DNA, 22 bp, Homo sapiens
gcagcagctcagttctgggagg

SEQ ID NO: 7598337 - DNA, 22 bp, Homo sapiens
gcagcagctcagttctgggagg

SEQ ID NO: 7598338 - DNA, 22 bp, Homo sapiens
gcagcagctccctatccaggct

SEQ ID NO: 7598339 - DNA, 22 bp, Homo sapiens
gcagcagctccctatccaggct

SEQ ID NO: 7598340 - DNA, 22 bp, Homo sapiens
gcagcagctccctatccaggct

SEQ ID NO: 7598341 - DNA, 22 bp, Homo sapiens
gcagcagctccctatccaggct

SEQ ID NO: 7598342 - DNA, 22 bp, Homo sapiens
gcagcagctcagttctgggagg

SEQ ID NO: 7598343 - DNA, 22 bp, Homo sapiens
gcagcagctccctatccaggct

SEQ ID NO: 7598344 - DNA, 22 bp, Homo sapiens
gcagcaggtctgtcaatgtcat

SEQ ID NO: 7598345 - DNA, 22 bp, Homo sapiens
gcagcaggtctgtcaatgtcat

SEQ ID NO: 7598346 - DNA, 22 bp, Homo sapiens
gcagcaggtgtgcttttaatga

SEQ ID NO: 7598347 - DNA, 22 bp, Homo sapiens
gcagcaggtctgtcaatgtcat

SEQ ID NO: 7598348 - DNA, 22 bp, Homo sapiens
gcagcaggtctgtcaatgtcat

SEQ ID NO: 7598349 - DNA, 22 bp, Homo sapiens
gcagcaggtctgtcaatgtcat

SEQ ID NO: 7598350 - DNA, 22 bp, Homo sapiens
gcagcaggtctgtcaatgtcat

SEQ ID NO: 7598351 - DNA, 22 bp, Homo sapiens
gcagcaggcacttaccgttgct

SEQ ID NO: 7598352 - DNA, 22 bp, Homo sapiens
gcagcaggtctgtcaatgtcat

SEQ ID NO: 7598353 - DNA, 22 bp, Homo sapiens
gcagcaggcacttaccgttgct

SEQ ID NO: 7598354 - DNA, 22 bp, Homo sapiens
gcagcaggcacttaccgttgct

SEQ ID NO: 7598355 - DNA, 22 bp, Homo sapiens
gcagcaggcacggtctcgacat

SEQ ID NO: 7598356 - DNA, 22 bp, Homo sapiens
gcagcaggcacggtctcgacat

SEQ ID NO: 7598357 - DNA, 22 bp, Homo sapiens
gcagcaggcacggtctcgacat

SEQ ID NO: 7598358 - DNA, 22 bp, Homo sapiens
gcagcaggatggccaattgcca

SEQ ID NO: 7598359 - DNA, 22 bp, Homo sapiens
gcagcaggcacttaccgttgct

SEQ ID NO: 7598360 - DNA, 22 bp, Homo sapiens
gcagcaggatggccaattgcca

SEQ ID NO: 7598361 - DNA, 22 bp, Homo sapiens
gcagcaggatggccaattgcca

SEQ ID NO: 7598362 - DNA, 22 bp, Homo sapiens
gcagcaggatggccaattgcca

SEQ ID NO: 7598363 - DNA, 22 bp, Homo sapiens
gcagcaggatggccaattgcca

SEQ ID NO: 7598364 - DNA, 22 bp, Homo sapiens
gcagcaggagagtttgtcctgc

SEQ ID NO: 7598365 - DNA, 22 bp, Homo sapiens
gcagcaggagagtttgtcctgc

SEQ ID NO: 7598366 - DNA, 22 bp, Homo sapiens
gcagcaggatggccaattgcca

SEQ ID NO: 7598367 - DNA, 22 bp, Homo sapiens
gcagcaggcacggtctcgacat

SEQ ID NO: 7598368 - DNA, 22 bp, Homo sapiens
gcagcaggcacggtctcgacat

SEQ ID NO: 7598369 - DNA, 22 bp, Homo sapiens
gcagcaggcacggtctcgacat

SEQ ID NO: 7598370 - DNA, 22 bp, Homo sapiens
gcagcaggcacggtctcgacat

SEQ ID NO: 7598371 - DNA, 22 bp, Homo sapiens
gcagcaggcacggtctcgacat

SEQ ID NO: 7598372 - DNA, 22 bp, Homo sapiens
gcagcaggatggccaattgcca

SEQ ID NO: 7598373 - DNA, 22 bp, Homo sapiens
gcagcaggaataggataagcaa

SEQ ID NO: 7598374 - DNA, 22 bp, Homo sapiens
gcagcagctgacagtgggtgcc

SEQ ID NO: 7598375 - DNA, 22 bp, Homo sapiens
gcagcaggaataggataagcaa

SEQ ID NO: 7598376 - DNA, 22 bp, Homo sapiens
gcagcaggaataggataagcaa

SEQ ID NO: 7598377 - DNA, 22 bp, Homo sapiens
gcagcagctgacagtgggtgcc

SEQ ID NO: 7598378 - DNA, 22 bp, Homo sapiens
gcagcaggaataggataagcaa

SEQ ID NO: 7598379 - DNA, 22 bp, Homo sapiens
gcagcaggaataggataagcaa

SEQ ID NO: 7598380 - DNA, 22 bp, Homo sapiens
gcagcaggaataggataagcaa

SEQ ID NO: 7598381 - DNA, 22 bp, Homo sapiens
gcagcaggaataggataagcaa

SEQ ID NO: 7598382 - DNA, 22 bp, Homo sapiens
gcagcaggaatttaaatttata

SEQ ID NO: 7598383 - DNA, 22 bp, Homo sapiens
gcagcaggaataggataagcaa

SEQ ID NO: 7598384 - DNA, 22 bp, Homo sapiens
gcagcaggaatttaaatttata

SEQ ID NO: 7598385 - DNA, 22 bp, Homo sapiens
gcagcaggaatttaaatttata

SEQ ID NO: 7598386 - DNA, 22 bp, Homo sapiens
gcagcaggaatttaaatttata

SEQ ID NO: 7598387 - DNA, 22 bp, Homo sapiens
gcagcaggagagtttgtcctgc

SEQ ID NO: 7598388 - DNA, 22 bp, Homo sapiens
gcagcaggagagtttgtcctgc

SEQ ID NO: 7598389 - DNA, 22 bp, Homo sapiens
gcagcaggagagtaatagcggt

SEQ ID NO: 7598390 - DNA, 22 bp, Homo sapiens
gcagcaggagagtaatagcggt

SEQ ID NO: 7598391 - DNA, 22 bp, Homo sapiens
gcagcaggagagtttgtcctgc

SEQ ID NO: 7598392 - DNA, 22 bp, Homo sapiens
gcagcaggagagtttgtcctgc

SEQ ID NO: 7598393 - DNA, 22 bp, Homo sapiens
gcagcaggagagtaatagcggt

SEQ ID NO: 7598394 - DNA, 22 bp, Homo sapiens
gcagcaggagagtaatagcggt

SEQ ID NO: 7598395 - DNA, 22 bp, Homo sapiens
gcagcaggagagtaatagcggt

SEQ ID NO: 7598396 - DNA, 22 bp, Homo sapiens
gcagcaggactgccgttaaagt

SEQ ID NO: 7598397 - DNA, 22 bp, Homo sapiens
gcagcaggactgccgttaaagt

SEQ ID NO: 7598398 - DNA, 22 bp, Homo sapiens
gcagcaggagagtaatagcggt

SEQ ID NO: 7598399 - DNA, 22 bp, Homo sapiens
gcagcaggagagtaatagcggt

SEQ ID NO: 7598400 - DNA, 22 bp, Homo sapiens
gcagctgcctaaagtgctaaga

SEQ ID NO: 7598401 - DNA, 22 bp, Homo sapiens
gcagctgccgtgagctcacgcc

SEQ ID NO: 7598402 - DNA, 22 bp, Homo sapiens
gcagctgcctaaagtgctaaga

SEQ ID NO: 7598403 - DNA, 22 bp, Homo sapiens
gcagctgccgtgagctcacgcc

SEQ ID NO: 7598404 - DNA, 22 bp, Homo sapiens
gcagctgccgtgagctcacgcc

SEQ ID NO: 7598405 - DNA, 22 bp, Homo sapiens
gcagctgccgtgagctcacgcc

SEQ ID NO: 7598406 - DNA, 22 bp, Homo sapiens
gcagctgccccgactgtgagtc

SEQ ID NO: 7598407 - DNA, 22 bp, Homo sapiens
gcagctgccgtgagctcacgcc

SEQ ID NO: 7598408 - DNA, 22 bp, Homo sapiens
gcagctgccgtgagctcacgcc

SEQ ID NO: 7598409 - DNA, 22 bp, Homo sapiens
gcagctgccgtgagctcacgcc

SEQ ID NO: 7598410 - DNA, 22 bp, Homo sapiens
gcagctgccccgactgtgagtc

SEQ ID NO: 7598411 - DNA, 22 bp, Homo sapiens
gcagctgccccgactgtgagtc

SEQ ID NO: 7598412 - DNA, 20 bp, Homo sapiens
gcagctgcccccagtccctg

SEQ ID NO: 7598413 - DNA, 20 bp, Homo sapiens
gcagctgcccccagtccctg

SEQ ID NO: 7598414 - DNA, 22 bp, Homo sapiens
gcagctgccccgactgtgagtc

SEQ ID NO: 7598415 - DNA, 22 bp, Homo sapiens
gcagctgccccgactgtgagtc

SEQ ID NO: 7598416 - DNA, 22 bp, Homo sapiens
gcagctgccccgactgtgagtc

SEQ ID NO: 7598417 - DNA, 22 bp, Homo sapiens
gcagctgccccgactgtgagtc

SEQ ID NO: 7598418 - DNA, 22 bp, Homo sapiens
gcagctgccccgactgtgagtc

SEQ ID NO: 7598419 - DNA, 22 bp, Homo sapiens
gcagctgccccgactgtgagtc

SEQ ID NO: 7598420 - DNA, 22 bp, Homo sapiens
gcagctgcaggcaggcttgctg

SEQ ID NO: 7598421 - DNA, 22 bp, Homo sapiens
gcagctgcaggcaggcttgctg

SEQ ID NO: 7598422 - DNA, 22 bp, Homo sapiens
gcagctgcaggcaggcttgctg

SEQ ID NO: 7598423 - DNA, 22 bp, Homo sapiens
gcagctgcaggcaggcttgctg

SEQ ID NO: 7598424 - DNA, 22 bp, Homo sapiens
gcagctgcaggcaggcttgctg

SEQ ID NO: 7598425 - DNA, 22 bp, Homo sapiens
gcagctgcaggcaggcttgctg

SEQ ID NO: 7598426 - DNA, 22 bp, Homo sapiens
gcagctgcaggcaggcttgctg

SEQ ID NO: 7598427 - DNA, 22 bp, Homo sapiens
gcagctgcaggtggtcccatgc

SEQ ID NO: 7598428 - DNA, 22 bp, Homo sapiens
gcagctgcaggtggtcccatgc

SEQ ID NO: 7598429 - DNA, 22 bp, Homo sapiens
gcagctgccagtccccttccag

SEQ ID NO: 7598430 - DNA, 22 bp, Homo sapiens
gcagctgccagtccccttccag

SEQ ID NO: 7598431 - DNA, 22 bp, Homo sapiens
gcagctgccagtccccttccag

SEQ ID NO: 7598432 - DNA, 22 bp, Homo sapiens
gcagctgccagtccccttccag

SEQ ID NO: 7598433 - DNA, 20 bp, Homo sapiens
gcagctgcccccagtccctg

SEQ ID NO: 7598434 - DNA, 20 bp, Homo sapiens
gcagctgcccccagtccctg

SEQ ID NO: 7598435 - DNA, 22 bp, Homo sapiens
gcagctgcaggtggtcccatgc

SEQ ID NO: 7598436 - DNA, 18 bp, Homo sapiens
gcagctgcagttgtagct

SEQ ID NO: 7598437 - DNA, 18 bp, Homo sapiens
gcagctgcagttgtagct

SEQ ID NO: 7598438 - DNA, 18 bp, Homo sapiens
gcagctgcagttgtagct

SEQ ID NO: 7598439 - DNA, 22 bp, Homo sapiens
gcagctgcagaccctcagtgct

SEQ ID NO: 7598440 - DNA, 22 bp, Homo sapiens
gcagctgcagaccctcagtgct

SEQ ID NO: 7598441 - DNA, 22 bp, Homo sapiens
gcagctgcagaccctcagtgct

SEQ ID NO: 7598442 - DNA, 22 bp, Homo sapiens
gcagctgcagaccctcagtgct

SEQ ID NO: 7598443 - DNA, 22 bp, Homo sapiens
gcagctgcagaccctcagtgct

SEQ ID NO: 7598444 - DNA, 22 bp, Homo sapiens
gcagctgcagagaccgggtggg

SEQ ID NO: 7598445 - DNA, 22 bp, Homo sapiens
gcagctgcagagaccgggtggg

SEQ ID NO: 7598446 - DNA, 22 bp, Homo sapiens
gcagctgcagagaccgggtggg

SEQ ID NO: 7598447 - DNA, 22 bp, Homo sapiens
gcagctgcagagaccgggtggg

SEQ ID NO: 7598448 - DNA, 22 bp, Homo sapiens
gcagctgcagagaccgggtggg

SEQ ID NO: 7598449 - DNA, 22 bp, Homo sapiens
gcagctgcaagcacttctggca

SEQ ID NO: 7598450 - DNA, 22 bp, Homo sapiens
gcagctgcaagcacttctggca

SEQ ID NO: 7598451 - DNA, 22 bp, Homo sapiens
gcagctgcaataggcatcaagc

SEQ ID NO: 7598452 - DNA, 22 bp, Homo sapiens
gcagctgcaataggcatcaagc

SEQ ID NO: 7598453 - DNA, 22 bp, Homo sapiens
gcagctgcacttctacctaatt

SEQ ID NO: 7598454 - DNA, 22 bp, Homo sapiens
gcagctgcacttctacctaatt

SEQ ID NO: 7598455 - DNA, 22 bp, Homo sapiens
gcagctgcaataggcatcaagc

SEQ ID NO: 7598456 - DNA, 22 bp, Homo sapiens
gcagctgcaataggcatcaagc

SEQ ID NO: 7598457 - DNA, 22 bp, Homo sapiens
gcagctgcagaccctcagtgct

SEQ ID NO: 7598458 - DNA, 22 bp, Homo sapiens
gcagctgcagaccctcagtgct

SEQ ID NO: 7598459 - DNA, 22 bp, Homo sapiens
gcagctgcagaccctcagtgct

SEQ ID NO: 7598460 - DNA, 22 bp, Homo sapiens
gcagctgcaagcacttctggca

SEQ ID NO: 7598461 - DNA, 22 bp, Homo sapiens
gcagctgcaagcacttctggca

SEQ ID NO: 7598462 - DNA, 22 bp, Homo sapiens
gcagctgcaagcacttctggca

SEQ ID NO: 7598463 - DNA, 22 bp, Homo sapiens
gcagctgcaagcacttctggca

SEQ ID NO: 7598464 - DNA, 22 bp, Homo sapiens
gcagctgcaagcacttctggca

SEQ ID NO: 7598465 - DNA, 22 bp, Homo sapiens
gcagccacactgttacagaatg

SEQ ID NO: 7598466 - DNA, 22 bp, Homo sapiens
gcagccacactgttacagaatg

SEQ ID NO: 7598467 - DNA, 22 bp, Homo sapiens
gcagccacactgttacagaatg

SEQ ID NO: 7598468 - DNA, 22 bp, Homo sapiens
gcagccacactgttacagaatg

SEQ ID NO: 7598469 - DNA, 22 bp, Homo sapiens
gcagccacagaggagggatgca

SEQ ID NO: 7598470 - DNA, 22 bp, Homo sapiens
gcagctgatggaagtcctattg

SEQ ID NO: 7598471 - DNA, 23 bp, Homo sapiens
gcagccaagagaccagggcaggc

SEQ ID NO: 7598472 - DNA, 22 bp, Homo sapiens
gcagccaagccatgaggactac

SEQ ID NO: 7598473 - DNA, 22 bp, Homo sapiens
gcagcatttgtggaatgggccc

SEQ ID NO: 7598474 - DNA, 22 bp, Homo sapiens
gcagcatttgtggaatgggccc

SEQ ID NO: 7598475 - DNA, 22 bp, Homo sapiens
gcagcatttgtggaatgggccc

SEQ ID NO: 7598476 - DNA, 22 bp, Homo sapiens
gcagccaagaccccaagaactg

SEQ ID NO: 7598477 - DNA, 22 bp, Homo sapiens
gcagccaagaccccaagaactg

SEQ ID NO: 7598478 - DNA, 22 bp, Homo sapiens
gcagcattgtgaggtcctgccc

SEQ ID NO: 7598479 - DNA, 22 bp, Homo sapiens
gcagcatttctcaaagggtggt

SEQ ID NO: 7598480 - DNA, 22 bp, Homo sapiens
gcagcatttctcaaagggtggt

SEQ ID NO: 7598481 - DNA, 22 bp, Homo sapiens
gcagcattgcacttttgttctt

SEQ ID NO: 7598482 - DNA, 22 bp, Homo sapiens
gcagcattgcacttttgttctt

SEQ ID NO: 7598483 - DNA, 22 bp, Homo sapiens
gcagcattgcacttttgttctt

SEQ ID NO: 7598484 - DNA, 22 bp, Homo sapiens
gcagcattgtgaggtcctgccc

SEQ ID NO: 7598485 - DNA, 22 bp, Homo sapiens
gcagcattgtgaggtcctgccc

SEQ ID NO: 7598486 - DNA, 20 bp, Homo sapiens
gcagcagtgcaagtcctctt

SEQ ID NO: 7598487 - DNA, 20 bp, Homo sapiens
gcagcagtgcaagtcctctt

SEQ ID NO: 7598488 - DNA, 22 bp, Homo sapiens
gcagcagtgcgggcagctacag

SEQ ID NO: 7598489 - DNA, 22 bp, Homo sapiens
gcagcagtgcgggcagctacag

SEQ ID NO: 7598490 - DNA, 22 bp, Homo sapiens
gcagcagtgcgggcagctacag

SEQ ID NO: 7598491 - DNA, 22 bp, Homo sapiens
gcagcagtgcgggcagctacag

SEQ ID NO: 7598492 - DNA, 22 bp, Homo sapiens
gcagcagtgcgggcagctacag

SEQ ID NO: 7598493 - DNA, 19 bp, Homo sapiens
gcagcagtggaaggaaaaa

SEQ ID NO: 7598494 - DNA, 22 bp, Homo sapiens
gcagcaggtgtgcttttaatga

SEQ ID NO: 7598495 - DNA, 22 bp, Homo sapiens
gcagcaggtgtgcttttaatga

SEQ ID NO: 7598496 - DNA, 22 bp, Homo sapiens
gcagcaggtgtgcttttaatga

SEQ ID NO: 7598497 - DNA, 22 bp, Homo sapiens
gcagcagtaggaaataacacag

SEQ ID NO: 7598498 - DNA, 20 bp, Homo sapiens
gcagcagtgcaagtcctctt

SEQ ID NO: 7598499 - DNA, 20 bp, Homo sapiens
gcagcagtgcaagtcctctt

SEQ ID NO: 7598500 - DNA, 22 bp, Homo sapiens
gcagcagtactcaatatcctgg

SEQ ID NO: 7598501 - DNA, 22 bp, Homo sapiens
gcagcagtaggaaataacacag

SEQ ID NO: 7598502 - DNA, 22 bp, Homo sapiens
gcagcagtggtctgtagaagga

SEQ ID NO: 7598503 - DNA, 22 bp, Homo sapiens
gcagcagtggttttatcatttt

SEQ ID NO: 7598504 - DNA, 22 bp, Homo sapiens
gcagcagtggtctgtagaagga

SEQ ID NO: 7598505 - DNA, 22 bp, Homo sapiens
gcagcagtggtctgtagaagga

SEQ ID NO: 7598506 - DNA, 22 bp, Homo sapiens
gcagcagtggtctgtagaagga

SEQ ID NO: 7598507 - DNA, 22 bp, Homo sapiens
gcagcagtggtctgtagaagga

SEQ ID NO: 7598508 - DNA, 22 bp, Homo sapiens
gcagcagtggctgcaggtccca

SEQ ID NO: 7598509 - DNA, 22 bp, Homo sapiens
gcagcagtggcagttaatattt

SEQ ID NO: 7598510 - DNA, 22 bp, Homo sapiens
gcagcagtggctgcaggtccca

SEQ ID NO: 7598511 - DNA, 22 bp, Homo sapiens
gcagcagtggttttatcatttt

SEQ ID NO: 7598512 - DNA, 22 bp, Homo sapiens
gcagcagtgtctcccatcttgc

SEQ ID NO: 7598513 - DNA, 22 bp, Homo sapiens
gcagcagtgtgggctgaaccta

SEQ ID NO: 7598514 - DNA, 22 bp, Homo sapiens
gcagcagtgtgggctgaaccta

SEQ ID NO: 7598515 - DNA, 22 bp, Homo sapiens
gcagcagtgtgggctgaaccta

SEQ ID NO: 7598516 - DNA, 21 bp, Homo sapiens
gcagcagtgttctagaatact

SEQ ID NO: 7598517 - DNA, 22 bp, Homo sapiens
gcagcatacagggagagtactc

SEQ ID NO: 7598518 - DNA, 22 bp, Homo sapiens
gcagcatgttgaaagggccaca

SEQ ID NO: 7598519 - DNA, 22 bp, Homo sapiens
gcagcatgttgaaagggccaca

SEQ ID NO: 7598520 - DNA, 22 bp, Homo sapiens
gcagcatgttgaaagggccaca

SEQ ID NO: 7598521 - DNA, 22 bp, Homo sapiens
gcagcatgttgaaagggccaca

SEQ ID NO: 7598522 - DNA, 22 bp, Homo sapiens
gcagcatgttgaaagggccaca

SEQ ID NO: 7598523 - DNA, 22 bp, Homo sapiens
gcagcattaccaagacatggca

SEQ ID NO: 7598524 - DNA, 22 bp, Homo sapiens
gcagcattaccaagacatggca

SEQ ID NO: 7598525 - DNA, 22 bp, Homo sapiens
gcagcattaccaagacatggca

SEQ ID NO: 7598526 - DNA, 22 bp, Homo sapiens
gcagcattaccaagacatggca

SEQ ID NO: 7598527 - DNA, 22 bp, Homo sapiens
gcagcattaccaagacatggca

SEQ ID NO: 7598528 - DNA, 22 bp, Homo sapiens
gcagcattgcacttttgttctt

SEQ ID NO: 7598529 - DNA, 22 bp, Homo sapiens
gcagcatggagttgtggaatga

SEQ ID NO: 7598530 - DNA, 22 bp, Homo sapiens
gcagcatgtgccttaaatcatt

SEQ ID NO: 7598531 - DNA, 22 bp, Homo sapiens
gcagcatggagttgtggaatga

SEQ ID NO: 7598532 - DNA, 22 bp, Homo sapiens
gcagcatggagttgtggaatga

SEQ ID NO: 7598533 - DNA, 22 bp, Homo sapiens
gcagcatggagttgtggaatga

SEQ ID NO: 7598534 - DNA, 21 bp, Homo sapiens
gcagcatgagaaagccccaaa

SEQ ID NO: 7598535 - DNA, 21 bp, Homo sapiens
gcagcatgagaaagccccaaa

SEQ ID NO: 7598536 - DNA, 22 bp, Homo sapiens
gcagcatggagaagtagctaga

SEQ ID NO: 7598537 - DNA, 21 bp, Homo sapiens
gcagcatgagaaagccccaaa

SEQ ID NO: 7598538 - DNA, 22 bp, Homo sapiens
gcagcatgagctatacaaagta

SEQ ID NO: 7598539 - DNA, 22 bp, Homo sapiens
gcagcatctagggcactggcct

SEQ ID NO: 7598540 - DNA, 22 bp, Homo sapiens
gcagcatctgtacatagacgct

SEQ ID NO: 7598541 - DNA, 22 bp, Homo sapiens
gcagcatccttggcctccaccc

SEQ ID NO: 7598542 - DNA, 22 bp, Homo sapiens
gcagcatcctgggccacagtcc

SEQ ID NO: 7598543 - DNA, 22 bp, Homo sapiens
gcagcatccccaggcagcaggg

SEQ ID NO: 7598544 - DNA, 22 bp, Homo sapiens
gcagcatccccaggcagcaggg

SEQ ID NO: 7598545 - DNA, 22 bp, Homo sapiens
gcagcatccccaggcagcaggg

SEQ ID NO: 7598546 - DNA, 22 bp, Homo sapiens
gcagcatcctgggccacagtcc

SEQ ID NO: 7598547 - DNA, 22 bp, Homo sapiens
gcagcatcaatccatgcttctc

SEQ ID NO: 7598548 - DNA, 22 bp, Homo sapiens
gcagcatcaggttcactgcgtg

SEQ ID NO: 7598549 - DNA, 22 bp, Homo sapiens
gcagctggagcatcttctcatc

SEQ ID NO: 7598550 - DNA, 22 bp, Homo sapiens
gcagctggagcatcttctcatc

SEQ ID NO: 7598551 - DNA, 22 bp, Homo sapiens
gcagctggagcatcttctcatc

SEQ ID NO: 7598552 - DNA, 22 bp, Homo sapiens
gcagctggagcatcttctcatc

SEQ ID NO: 7598553 - DNA, 22 bp, Homo sapiens
gcagctggagccagccagacac

SEQ ID NO: 7598554 - DNA, 22 bp, Homo sapiens
gcagctggagccagccagacac

SEQ ID NO: 7598555 - DNA, 22 bp, Homo sapiens
gcagctggagccagccagacac

SEQ ID NO: 7598556 - DNA, 22 bp, Homo sapiens
gcagctggagccagccagacac

SEQ ID NO: 7598557 - DNA, 22 bp, Homo sapiens
gcagctggagccagccagacac

SEQ ID NO: 7598558 - DNA, 22 bp, Homo sapiens
gcagctggagccagccagacac

SEQ ID NO: 7598559 - DNA, 22 bp, Homo sapiens
gcagctggatttcaagagggag

SEQ ID NO: 7598560 - DNA, 22 bp, Homo sapiens
gcagctggatttcaagagggag

SEQ ID NO: 7598561 - DNA, 22 bp, Homo sapiens
gcagctggatttcaagagggag

SEQ ID NO: 7598562 - DNA, 22 bp, Homo sapiens
gcagctggatttcaagagggag

SEQ ID NO: 7598563 - DNA, 22 bp, Homo sapiens
gcagctggatttcaagagggag

SEQ ID NO: 7598564 - DNA, 22 bp, Homo sapiens
gcagctgcctattcagggcttg

SEQ ID NO: 7598565 - DNA, 22 bp, Homo sapiens
gcagctgcctattcagggcttg

SEQ ID NO: 7598566 - DNA, 22 bp, Homo sapiens
gcagctgcctaaagtgctaaga

SEQ ID NO: 7598567 - DNA, 22 bp, Homo sapiens
gcagctgcctattcagggcttg

SEQ ID NO: 7598568 - DNA, 22 bp, Homo sapiens
gcagctggacccacacggctta

SEQ ID NO: 7598569 - DNA, 22 bp, Homo sapiens
gcagctggacccacacggctta

SEQ ID NO: 7598570 - DNA, 22 bp, Homo sapiens
gcagctggagcatcttctcatc

SEQ ID NO: 7598571 - DNA, 22 bp, Homo sapiens
gcagctggagaaataccaccct

SEQ ID NO: 7598572 - DNA, 22 bp, Homo sapiens
gcagctggagaaataccaccct

SEQ ID NO: 7598573 - DNA, 22 bp, Homo sapiens
gcagctggagaaataccaccct

SEQ ID NO: 7598574 - DNA, 22 bp, Homo sapiens
gcagctggagaaataccaccct

SEQ ID NO: 7598575 - DNA, 22 bp, Homo sapiens
gcagctggagaaataccaccct

SEQ ID NO: 7598576 - DNA, 22 bp, Homo sapiens
gcagctggcccctttccttgtt

SEQ ID NO: 7598577 - DNA, 22 bp, Homo sapiens
gcagctggcccctttccttgtt

SEQ ID NO: 7598578 - DNA, 22 bp, Homo sapiens
gcagctggatttcaagagggag

SEQ ID NO: 7598579 - DNA, 22 bp, Homo sapiens
gcagctggccctgacacgcaga

SEQ ID NO: 7598580 - DNA, 22 bp, Homo sapiens
gcagctggcccctttccttgtt

SEQ ID NO: 7598581 - DNA, 22 bp, Homo sapiens
gcagctggccctgacacgcaga

SEQ ID NO: 7598582 - DNA, 22 bp, Homo sapiens
gcagctggccctgacacgcaga

SEQ ID NO: 7598583 - DNA, 22 bp, Homo sapiens
gcagctggccctgacacgcaga

SEQ ID NO: 7598584 - DNA, 22 bp, Homo sapiens
gcaggagctggaaagtgatgtt

SEQ ID NO: 7598585 - DNA, 22 bp, Homo sapiens
gcaggagctggaaagtgatgtt

SEQ ID NO: 7598586 - DNA, 22 bp, Homo sapiens
gcaggagctggaaagtgatgtt

SEQ ID NO: 7598587 - DNA, 22 bp, Homo sapiens
gcaggagctggaaagtgatgtt

SEQ ID NO: 7598588 - DNA, 22 bp, Homo sapiens
gcaggagctggaaagtgatgtt

SEQ ID NO: 7598589 - DNA, 22 bp, Homo sapiens
gcaggagctggaaagtgatgtt

SEQ ID NO: 7598590 - DNA, 22 bp, Homo sapiens
gcaggaggagcattaactgagc

SEQ ID NO: 7598591 - DNA, 22 bp, Homo sapiens
gcaggaggagcattaactgagc

SEQ ID NO: 7598592 - DNA, 22 bp, Homo sapiens
gcaggaggagcattaactgagc

SEQ ID NO: 7598593 - DNA, 22 bp, Homo sapiens
gcaggagctttgcttactgctg

SEQ ID NO: 7598594 - DNA, 22 bp, Homo sapiens
gcaggaggagcattaactgagc

SEQ ID NO: 7598595 - DNA, 22 bp, Homo sapiens
gcaggagctggaaagtgatgtt

SEQ ID NO: 7598596 - DNA, 22 bp, Homo sapiens
gcaggagctttgcttactgctg

SEQ ID NO: 7598597 - DNA, 22 bp, Homo sapiens
gcaggagctttgcttactgctg

SEQ ID NO: 7598598 - DNA, 22 bp, Homo sapiens
gcaggaggatcacttgagccca

SEQ ID NO: 7598599 - DNA, 22 bp, Homo sapiens
gcaggaggatcacttgagccca

SEQ ID NO: 7598600 - DNA, 22 bp, Homo sapiens
gcaggaggatcacttgagccca

SEQ ID NO: 7598601 - DNA, 22 bp, Homo sapiens
gcaggaggatcacttgagccca

SEQ ID NO: 7598602 - DNA, 22 bp, Homo sapiens
gcaggaggatcacttgagccca

SEQ ID NO: 7598603 - DNA, 22 bp, Homo sapiens
gcaggaggccaggtatgcttta

SEQ ID NO: 7598604 - DNA, 22 bp, Homo sapiens
gcaggaggccaggtatgcttta

SEQ ID NO: 7598605 - DNA, 22 bp, Homo sapiens
gcaggagttaggcgtcgtggat

SEQ ID NO: 7598606 - DNA, 22 bp, Homo sapiens
gcaggagttagaggtttaatct

SEQ ID NO: 7598607 - DNA, 22 bp, Homo sapiens
gcaggagttaggcgtcgtggat

SEQ ID NO: 7598608 - DNA, 22 bp, Homo sapiens
gcaggagttaaaatatgtaatg

SEQ ID NO: 7598609 - DNA, 22 bp, Homo sapiens
gcaggagtgtgtctaatactca

SEQ ID NO: 7598610 - DNA, 22 bp, Homo sapiens
gcaggcctctgttgagggcctt

SEQ ID NO: 7598611 - DNA, 22 bp, Homo sapiens
gcaggcctctgttgagggcctt

SEQ ID NO: 7598612 - DNA, 22 bp, Homo sapiens
gcaggagttaggcgtcgtggat

SEQ ID NO: 7598613 - DNA, 22 bp, Homo sapiens
gcaggcctctaattcaccgcag

SEQ ID NO: 7598614 - DNA, 19 bp, Homo sapiens
gcaggcctcttgggaatta

SEQ ID NO: 7598615 - DNA, 22 bp, Homo sapiens
gcaggcctctgttgagggcctt

SEQ ID NO: 7598616 - DNA, 22 bp, Homo sapiens
gcaggcctctgttgagggcctt

SEQ ID NO: 7598617 - DNA, 22 bp, Homo sapiens
gcaggagtgacatggatgtgga

SEQ ID NO: 7598618 - DNA, 22 bp, Homo sapiens
gcaggagtggagaccatgggga

SEQ ID NO: 7598619 - DNA, 22 bp, Homo sapiens
gcaggagtggagaccatgggga

SEQ ID NO: 7598620 - DNA, 22 bp, Homo sapiens
gcaggagtggagaccatgggga

SEQ ID NO: 7598621 - DNA, 22 bp, Homo sapiens
gcaggagtgacatggatgtgga

SEQ ID NO: 7598622 - DNA, 22 bp, Homo sapiens
gcaggagtgacatggatgtgga

SEQ ID NO: 7598623 - DNA, 22 bp, Homo sapiens
gcaggagtgacatggatgtgga

SEQ ID NO: 7598624 - DNA, 22 bp, Homo sapiens
gcaggagtgacatggatgtgga

SEQ ID NO: 7598625 - DNA, 22 bp, Homo sapiens
gcaggagtgtggtgggacatcc

SEQ ID NO: 7598626 - DNA, 22 bp, Homo sapiens
gcaggagtgtggtgggacatcc

SEQ ID NO: 7598627 - DNA, 22 bp, Homo sapiens
gcaggagtgtatttgcatgtaa

SEQ ID NO: 7598628 - DNA, 22 bp, Homo sapiens
gcaggagtgtggtgggacatcc

SEQ ID NO: 7598629 - DNA, 22 bp, Homo sapiens
gcaggagtatgcagctatggtt

SEQ ID NO: 7598630 - DNA, 22 bp, Homo sapiens
gcaggagtatgcagctatggtt

SEQ ID NO: 7598631 - DNA, 22 bp, Homo sapiens
gcaggagtatgcagctatggtt

SEQ ID NO: 7598632 - DNA, 22 bp, Homo sapiens
gcaggagtatgcagctatggtt

SEQ ID NO: 7598633 - DNA, 22 bp, Homo sapiens
gcaggagtatctatacattaaa

SEQ ID NO: 7598634 - DNA, 22 bp, Homo sapiens
gcaggagtatgcagctatggtt

SEQ ID NO: 7598635 - DNA, 22 bp, Homo sapiens
gcaggagtgacatggatgtgga

SEQ ID NO: 7598636 - DNA, 22 bp, Homo sapiens
gcaggagtgacatggatgtgga

SEQ ID NO: 7598637 - DNA, 22 bp, Homo sapiens
gcaggagtcccagaaggttttg

SEQ ID NO: 7598638 - DNA, 22 bp, Homo sapiens
gcaggagtcagccctaccttga

SEQ ID NO: 7598639 - DNA, 22 bp, Homo sapiens
gcaggagtcactgacttggtcc

SEQ ID NO: 7598640 - DNA, 22 bp, Homo sapiens
gcaggaggttgagccaggactg

SEQ ID NO: 7598641 - DNA, 22 bp, Homo sapiens
gcaggaggttgagccaggactg

SEQ ID NO: 7598642 - DNA, 22 bp, Homo sapiens
gcaggaggttgagccaggactg

SEQ ID NO: 7598643 - DNA, 22 bp, Homo sapiens
gcaggaggttgagccaggactg

SEQ ID NO: 7598644 - DNA, 22 bp, Homo sapiens
gcaggaggttgagccaggactg

SEQ ID NO: 7598645 - DNA, 22 bp, Homo sapiens
gcaggaggttgagccaggactg

SEQ ID NO: 7598646 - DNA, 22 bp, Homo sapiens
gcaggaggttgagccaggactg

SEQ ID NO: 7598647 - DNA, 22 bp, Homo sapiens
gcaggaggttgagccaggactg

SEQ ID NO: 7598648 - DNA, 22 bp, Homo sapiens
gcaggaggccaggtatgcttta

SEQ ID NO: 7598649 - DNA, 22 bp, Homo sapiens
gcaggaggccaggtatgcttta

SEQ ID NO: 7598650 - DNA, 22 bp, Homo sapiens
gcaggaggccaggtatgcttta

SEQ ID NO: 7598651 - DNA, 22 bp, Homo sapiens
gcaggaggttgagccaggactg

SEQ ID NO: 7598652 - DNA, 22 bp, Homo sapiens
gcaggaggttgagccaggactg

SEQ ID NO: 7598653 - DNA, 16 bp, Homo sapiens
gcaggagtaccacttg

SEQ ID NO: 7598654 - DNA, 22 bp, Homo sapiens
gcaggaggttgagccaggactg

SEQ ID NO: 7598655 - DNA, 22 bp, Homo sapiens
gcaggaggttgagccaggactg

SEQ ID NO: 7598656 - DNA, 22 bp, Homo sapiens
gcaggaggttgagccaggactg

SEQ ID NO: 7598657 - DNA, 22 bp, Homo sapiens
gcagggccttggtcatcttttt

SEQ ID NO: 7598658 - DNA, 22 bp, Homo sapiens
gcagggccttggtcatcttttt

SEQ ID NO: 7598659 - DNA, 20 bp, Homo sapiens
gcagggcgacacgggggagg

SEQ ID NO: 7598660 - DNA, 20 bp, Homo sapiens
gcagggcgacacgggggagg

SEQ ID NO: 7598661 - DNA, 22 bp, Homo sapiens
gcagggccttagcagcggctgc

SEQ ID NO: 7598662 - DNA, 22 bp, Homo sapiens
gcagggccttagcagcggctgc

SEQ ID NO: 7598663 - DNA, 22 bp, Homo sapiens
gcaggctgccaccttctgagtt

SEQ ID NO: 7598664 - DNA, 22 bp, Homo sapiens
gcaggctgccaccttctgagtt

SEQ ID NO: 7598665 - DNA, 22 bp, Homo sapiens
gcaggctgccaccttctgagtt

SEQ ID NO: 7598666 - DNA, 22 bp, Homo sapiens
gcaggctgccaccttctgagtt

SEQ ID NO: 7598667 - DNA, 22 bp, Homo sapiens
gcaggctgccaccttctgagtt

SEQ ID NO: 7598668 - DNA, 22 bp, Homo sapiens
gcaggctgccaccttctgagtt

SEQ ID NO: 7598669 - DNA, 22 bp, Homo sapiens
gcagggccttagcagcggctgc

SEQ ID NO: 7598670 - DNA, 22 bp, Homo sapiens
gcagggccttagcagcggctgc

SEQ ID NO: 7598671 - DNA, 22 bp, Homo sapiens
gcaggctgatgactggagttgg

SEQ ID NO: 7598672 - DNA, 22 bp, Homo sapiens
gcaggctgatgactggagttgg

SEQ ID NO: 7598673 - DNA, 22 bp, Homo sapiens
gcaggctgatagaggattccat

SEQ ID NO: 7598674 - DNA, 22 bp, Homo sapiens
gcaggctgatagaggattccat

SEQ ID NO: 7598675 - DNA, 22 bp, Homo sapiens
gcaggctgatagaggattccat

SEQ ID NO: 7598676 - DNA, 22 bp, Homo sapiens
gcaggctgatagaggattccat

SEQ ID NO: 7598677 - DNA, 22 bp, Homo sapiens
gcaggctgatagaggattccat

SEQ ID NO: 7598678 - DNA, 22 bp, Homo sapiens
gcaggctgatagaggattccat

SEQ ID NO: 7598679 - DNA, 22 bp, Homo sapiens
gcaggctgatgactggagttgg

SEQ ID NO: 7598680 - DNA, 22 bp, Homo sapiens
gcaggctgatgactggagttgg

SEQ ID NO: 7598681 - DNA, 22 bp, Homo sapiens
gcaggctgatgactggagttgg

SEQ ID NO: 7598682 - DNA, 22 bp, Homo sapiens
gcaggctgatgactggagttgg

SEQ ID NO: 7598683 - DNA, 22 bp, Homo sapiens
gcaggctgatgactggagttgg

SEQ ID NO: 7598684 - DNA, 22 bp, Homo sapiens
gcaggctgatgactggagttgg

SEQ ID NO: 7598685 - DNA, 22 bp, Homo sapiens
gcaggctgatgactggagttgg

SEQ ID NO: 7598686 - DNA, 22 bp, Homo sapiens
gcaggctgatgactggagttgg

SEQ ID NO: 7598687 - DNA, 22 bp, Homo sapiens
gcaggctgatgactggagttgg

SEQ ID NO: 7598688 - DNA, 22 bp, Homo sapiens
gcaggctgatgactggagttgg

SEQ ID NO: 7598689 - DNA, 22 bp, Homo sapiens
gcagggctagatatttgcaagt

SEQ ID NO: 7598690 - DNA, 22 bp, Homo sapiens
gcagggctagatatttgcaagt

SEQ ID NO: 7598691 - DNA, 22 bp, Homo sapiens
gcagggctagatatttgcaagt

SEQ ID NO: 7598692 - DNA, 22 bp, Homo sapiens
gcagggctaggtcttctagggc

SEQ ID NO: 7598693 - DNA, 22 bp, Homo sapiens
gcagggctaggtcttctagggc

SEQ ID NO: 7598694 - DNA, 22 bp, Homo sapiens
gcagggctaggtcttctagggc

SEQ ID NO: 7598695 - DNA, 22 bp, Homo sapiens
gcagggctaggtcttctagggc

SEQ ID NO: 7598696 - DNA, 22 bp, Homo sapiens
gcagggctcaacaggacacccc

SEQ ID NO: 7598697 - DNA, 22 bp, Homo sapiens
gcagggctattggaaggagatg

SEQ ID NO: 7598698 - DNA, 22 bp, Homo sapiens
gcagggctaggtcttctagggc

SEQ ID NO: 7598699 - DNA, 22 bp, Homo sapiens
gcagggctattggaaggagatg

SEQ ID NO: 7598700 - DNA, 22 bp, Homo sapiens
gcagggctattggaaggagatg

SEQ ID NO: 7598701 - DNA, 22 bp, Homo sapiens
gcagggcgcgtttgagcgggct

SEQ ID NO: 7598702 - DNA, 22 bp, Homo sapiens
gcagggcgcgtttgagcgggct

SEQ ID NO: 7598703 - DNA, 22 bp, Homo sapiens
gcagggcgcgtttgagcgggct

SEQ ID NO: 7598704 - DNA, 22 bp, Homo sapiens
gcagggcgcgtttgagcgggct

SEQ ID NO: 7598705 - DNA, 20 bp, Homo sapiens
gcagggcgacacgggggagg

SEQ ID NO: 7598706 - DNA, 22 bp, Homo sapiens
gcagggcggcccagagcaggcc

SEQ ID NO: 7598707 - DNA, 22 bp, Homo sapiens
gcagggcggcccagagcaggcc

SEQ ID NO: 7598708 - DNA, 22 bp, Homo sapiens
gcagggcgcgtttgagcgggct

SEQ ID NO: 7598709 - DNA, 22 bp, Homo sapiens
gcagggcggcccagagcaggcc

SEQ ID NO: 7598710 - DNA, 22 bp, Homo sapiens
gcagggcggcccagagcaggcc

SEQ ID NO: 7598711 - DNA, 22 bp, Homo sapiens
gcagggcggcccagagcaggcc

SEQ ID NO: 7598712 - DNA, 22 bp, Homo sapiens
gcagggcggcccagagcaggcc

SEQ ID NO: 7598713 - DNA, 22 bp, Homo sapiens
gcagggctaatggggcaagtag

SEQ ID NO: 7598714 - DNA, 22 bp, Homo sapiens
gcagggctaatggggcaagtag

SEQ ID NO: 7598715 - DNA, 22 bp, Homo sapiens
gcagggctaatggggcaagtag

SEQ ID NO: 7598716 - DNA, 22 bp, Homo sapiens
gcagggctaatggggcaagtag

SEQ ID NO: 7598717 - DNA, 22 bp, Homo sapiens
gcagggctaatggggcaagtag

SEQ ID NO: 7598718 - DNA, 22 bp, Homo sapiens
gcagggctaatggggcaagtag

SEQ ID NO: 7598719 - DNA, 22 bp, Homo sapiens
gcaggctgaaactcggggtcta

SEQ ID NO: 7598720 - DNA, 22 bp, Homo sapiens
gcaggctgaaactcggggtcta

SEQ ID NO: 7598721 - DNA, 22 bp, Homo sapiens
gcaggctcgttggaagtcccct

SEQ ID NO: 7598722 - DNA, 22 bp, Homo sapiens
gcaggctgaaactcggggtcta

SEQ ID NO: 7598723 - DNA, 22 bp, Homo sapiens
gcaggctgaaactcggggtcta

SEQ ID NO: 7598724 - DNA, 22 bp, Homo sapiens
gcaggctgaaactcggggtcta

SEQ ID NO: 7598725 - DNA, 22 bp, Homo sapiens
gcaggctgaaactcggggtcta

SEQ ID NO: 7598726 - DNA, 22 bp, Homo sapiens
gcaggctgagagtccaagaagg

SEQ ID NO: 7598727 - DNA, 22 bp, Homo sapiens
gcaggctgagagtccaagaagg

SEQ ID NO: 7598728 - DNA, 22 bp, Homo sapiens
gcaggctgaaactcggggtcta

SEQ ID NO: 7598729 - DNA, 22 bp, Homo sapiens
gcaggctgaaactcggggtcta

SEQ ID NO: 7598730 - DNA, 22 bp, Homo sapiens
gcaggctgaaactcggggtcta

SEQ ID NO: 7598731 - DNA, 22 bp, Homo sapiens
gcaggctgaaactcggggtcta

SEQ ID NO: 7598732 - DNA, 22 bp, Homo sapiens
gcaggctgaaactcggggtcta

SEQ ID NO: 7598733 - DNA, 22 bp, Homo sapiens
gcaggctcgttggaagtcccct

SEQ ID NO: 7598734 - DNA, 22 bp, Homo sapiens
gcaggctcttctttctgcccag

SEQ ID NO: 7598735 - DNA, 22 bp, Homo sapiens
gcaggctgagtattaccctagt

SEQ ID NO: 7598736 - DNA, 22 bp, Homo sapiens
gcaggctgagtattaccctagt

SEQ ID NO: 7598737 - DNA, 22 bp, Homo sapiens
gcaggctgagtattaccctagt

SEQ ID NO: 7598738 - DNA, 22 bp, Homo sapiens
gcaggctgagagtccaagaagg

SEQ ID NO: 7598739 - DNA, 22 bp, Homo sapiens
gcaggctgagtattaccctagt

SEQ ID NO: 7598740 - DNA, 22 bp, Homo sapiens
gcaggctgagtattaccctagt

SEQ ID NO: 7598741 - DNA, 22 bp, Homo sapiens
gcaggctgagtattaccctagt

SEQ ID NO: 7598742 - DNA, 22 bp, Homo sapiens
gcaggctgagttgggaaaccaa

SEQ ID NO: 7598743 - DNA, 22 bp, Homo sapiens
gcaggctgagtattaccctagt

SEQ ID NO: 7598744 - DNA, 22 bp, Homo sapiens
gcaggctgagttgggaaaccaa

SEQ ID NO: 7598745 - DNA, 22 bp, Homo sapiens
gcaggctgagtattaccctagt

SEQ ID NO: 7598746 - DNA, 22 bp, Homo sapiens
gcaggctgagttgggaaaccaa

SEQ ID NO: 7598747 - DNA, 22 bp, Homo sapiens
gcaggctgatagaggattccat

SEQ ID NO: 7598748 - DNA, 22 bp, Homo sapiens
gcaggctgatagaggattccat

SEQ ID NO: 7598749 - DNA, 22 bp, Homo sapiens
gcaggctgagttgggaaaccaa

SEQ ID NO: 7598750 - DNA, 22 bp, Homo sapiens
gcaggctgagttgggaaaccaa

SEQ ID NO: 7598751 - DNA, 22 bp, Homo sapiens
gcaggctcccttgcagagcagg

SEQ ID NO: 7598752 - DNA, 22 bp, Homo sapiens
gcaggctcccttgcagagcagg

SEQ ID NO: 7598753 - DNA, 22 bp, Homo sapiens
gcaggctcccttgcagagcagg

SEQ ID NO: 7598754 - DNA, 22 bp, Homo sapiens
gcaggctcccttgcagagcagg

SEQ ID NO: 7598755 - DNA, 20 bp, Homo sapiens
gcaggctccgggcttgggag

SEQ ID NO: 7598756 - DNA, 20 bp, Homo sapiens
gcaggctccgggcttgggag

SEQ ID NO: 7598757 - DNA, 20 bp, Homo sapiens
gcaggctccgggcttgggag

SEQ ID NO: 7598758 - DNA, 22 bp, Homo sapiens
gcaggctcgttggaagtcccct

SEQ ID NO: 7598759 - DNA, 20 bp, Homo sapiens
gcaggctccgggcttgggag

SEQ ID NO: 7598760 - DNA, 22 bp, Homo sapiens
gcaggctccaaggcctgggaga

SEQ ID NO: 7598761 - DNA, 22 bp, Homo sapiens
gcaggctccaaggcctgggaga

SEQ ID NO: 7598762 - DNA, 22 bp, Homo sapiens
gcaggctccaaggcctgggaga

SEQ ID NO: 7598763 - DNA, 22 bp, Homo sapiens
gcaggctccaaggcctgggaga

SEQ ID NO: 7598764 - DNA, 22 bp, Homo sapiens
gcaggctccaaggcctgggaga

SEQ ID NO: 7598765 - DNA, 22 bp, Homo sapiens
gcaggctcccttgcagagcagg

SEQ ID NO: 7598766 - DNA, 22 bp, Homo sapiens
gcaggctccaggccggcccctt

SEQ ID NO: 7598767 - DNA, 22 bp, Homo sapiens
gcaggctccaggccggcccctt

SEQ ID NO: 7598768 - DNA, 22 bp, Homo sapiens
gcaggctccaaggcctgggaga

SEQ ID NO: 7598769 - DNA, 22 bp, Homo sapiens
gcaggctcactctgtttggctc

SEQ ID NO: 7598770 - DNA, 22 bp, Homo sapiens
gcaggctcagagcagattagca

SEQ ID NO: 7598771 - DNA, 22 bp, Homo sapiens
gcaggctccaactggaggagtt

SEQ ID NO: 7598772 - DNA, 22 bp, Homo sapiens
gcaggctcaaaagctggtagga

SEQ ID NO: 7598773 - DNA, 22 bp, Homo sapiens
gcaggctccaactggaggagtt

SEQ ID NO: 7598774 - DNA, 22 bp, Homo sapiens
gcaggctccaactggaggagtt

SEQ ID NO: 7598775 - DNA, 22 bp, Homo sapiens
gcaggctcaaaagctggtagga

SEQ ID NO: 7598776 - DNA, 22 bp, Homo sapiens
gcaggctcaaaagctggtagga

SEQ ID NO: 7598777 - DNA, 22 bp, Homo sapiens
gcaggctcaaaagctggtagga

SEQ ID NO: 7598778 - DNA, 19 bp, Homo sapiens
gcaggcctcttgggaatta

SEQ ID NO: 7598779 - DNA, 19 bp, Homo sapiens
gcaggcctcttgggaatta

SEQ ID NO: 7598780 - DNA, 19 bp, Homo sapiens
gcaggcctcttgggaatta

SEQ ID NO: 7598781 - DNA, 19 bp, Homo sapiens
gcaggcctcttgggaatta

SEQ ID NO: 7598782 - DNA, 19 bp, Homo sapiens
gcaggcctcttgggaatta

SEQ ID NO: 7598783 - DNA, 22 bp, Homo sapiens
gcaggctatgtcagggccgctc

SEQ ID NO: 7598784 - DNA, 19 bp, Homo sapiens
gcaggcctcttgggaatta

SEQ ID NO: 7598785 - DNA, 23 bp, Homo sapiens
gcccatgctgttgggcccgagca

SEQ ID NO: 7598786 - DNA, 22 bp, Homo sapiens
gcccatgctctcaggcgggcct

SEQ ID NO: 7598787 - DNA, 22 bp, Homo sapiens
gcccatccatggggtcatggcc

SEQ ID NO: 7598788 - DNA, 22 bp, Homo sapiens
gcccatgctctcaggcgggcct

SEQ ID NO: 7598789 - DNA, 22 bp, Homo sapiens
gcccatgcccctccttctggca

SEQ ID NO: 7598790 - DNA, 22 bp, Homo sapiens
gcccatgcccctccttctggca

SEQ ID NO: 7598791 - DNA, 22 bp, Homo sapiens
gcccatgcactttctgtgatgg

SEQ ID NO: 7598792 - DNA, 22 bp, Homo sapiens
gcccatgaggtggaggctgcag

SEQ ID NO: 7598793 - DNA, 22 bp, Homo sapiens
gcccatgaggtggaggctgcag

SEQ ID NO: 7598794 - DNA, 20 bp, Homo sapiens
gcccatgaggactgcagctg

SEQ ID NO: 7598795 - DNA, 20 bp, Homo sapiens
gcccatgaggactgcagctg

SEQ ID NO: 7598796 - DNA, 20 bp, Homo sapiens
gcccatgaggactgcagctg

SEQ ID NO: 7598797 - DNA, 20 bp, Homo sapiens
gcccatgaggactgcagctg

SEQ ID NO: 7598798 - DNA, 22 bp, Homo sapiens
gcccatggaaaacctgtcctct

SEQ ID NO: 7598799 - DNA, 22 bp, Homo sapiens
gcccatggaaaacctgtcctct

SEQ ID NO: 7598800 - DNA, 22 bp, Homo sapiens
gcccatggaaaacctgtcctct

SEQ ID NO: 7598801 - DNA, 23 bp, Homo sapiens
gcccatgctgttgggcccgagca

SEQ ID NO: 7598802 - DNA, 23 bp, Homo sapiens
gcccatgctgttgggcccgagca

SEQ ID NO: 7598803 - DNA, 22 bp, Homo sapiens
gcccatggacacccaagtgcca

SEQ ID NO: 7598804 - DNA, 23 bp, Homo sapiens
gcccatggagtctggatctggcc

SEQ ID NO: 7598805 - DNA, 23 bp, Homo sapiens
gcccatggagtctggatctggcc

SEQ ID NO: 7598806 - DNA, 23 bp, Homo sapiens
gcccatggagtctggatctggcc

SEQ ID NO: 7598807 - DNA, 22 bp, Homo sapiens
gcccatggacacccaagtgcca

SEQ ID NO: 7598808 - DNA, 22 bp, Homo sapiens
gccctctggcagccttggctgg

SEQ ID NO: 7598809 - DNA, 22 bp, Homo sapiens
gccctctggcagccttggctgg

SEQ ID NO: 7598810 - DNA, 22 bp, Homo sapiens
gcccatggcagaactgtgagca

SEQ ID NO: 7598811 - DNA, 22 bp, Homo sapiens
gccctctggcacagagatgcag

SEQ ID NO: 7598812 - DNA, 22 bp, Homo sapiens
gcccatggcagaactgtgagca

SEQ ID NO: 7598813 - DNA, 22 bp, Homo sapiens
gcccatggcagaactgtgagca

SEQ ID NO: 7598814 - DNA, 18 bp, Homo sapiens
gccctctggctgctgatg

SEQ ID NO: 7598815 - DNA, 22 bp, Homo sapiens
gccctctggggcacacagagga

SEQ ID NO: 7598816 - DNA, 22 bp, Homo sapiens
gccctctggggcacacagagga

SEQ ID NO: 7598817 - DNA, 22 bp, Homo sapiens
gccctctggggcacacagagga

SEQ ID NO: 7598818 - DNA, 22 bp, Homo sapiens
gccctctgtgtaacaatccaga

SEQ ID NO: 7598819 - DNA, 22 bp, Homo sapiens
gccctctggtgggtgagccccg

SEQ ID NO: 7598820 - DNA, 22 bp, Homo sapiens
gccctctgttattgcatcctta

SEQ ID NO: 7598821 - DNA, 22 bp, Homo sapiens
gccctctgttattgcatcctta

SEQ ID NO: 7598822 - DNA, 22 bp, Homo sapiens
gccctctgtgtaacaatccaga

SEQ ID NO: 7598823 - DNA, 22 bp, Homo sapiens
gccctctgtgtaacaatccaga

SEQ ID NO: 7598824 - DNA, 22 bp, Homo sapiens
gccctctggtggccgcctcggc

SEQ ID NO: 7598825 - DNA, 22 bp, Homo sapiens
gccctctggtggccgcctcggc

SEQ ID NO: 7598826 - DNA, 22 bp, Homo sapiens
gccctctggtggccgcctcggc

SEQ ID NO: 7598827 - DNA, 22 bp, Homo sapiens
gccctctggggcacacagagga

SEQ ID NO: 7598828 - DNA, 22 bp, Homo sapiens
gccctctggtgggtgagccccg

SEQ ID NO: 7598829 - DNA, 22 bp, Homo sapiens
gccctctggtgggtgagccccg

SEQ ID NO: 7598830 - DNA, 22 bp, Homo sapiens
gccctctggtgggtgagccccg

SEQ ID NO: 7598831 - DNA, 19 bp, Homo sapiens
gcccaggggcccgatgctg

SEQ ID NO: 7598832 - DNA, 19 bp, Homo sapiens
gcccaggggcccgatgctg

SEQ ID NO: 7598833 - DNA, 22 bp, Homo sapiens
gcccagtggtaaaagcaggcct

SEQ ID NO: 7598834 - DNA, 22 bp, Homo sapiens
gcccagtggtaaaagcaggcct

SEQ ID NO: 7598835 - DNA, 22 bp, Homo sapiens
gcccagtggtaaaagcaggcct

SEQ ID NO: 7598836 - DNA, 22 bp, Homo sapiens
gcccagtgtctaggaggtgaac

SEQ ID NO: 7598837 - DNA, 22 bp, Homo sapiens
gcccagtgtctaggaggtgaac

SEQ ID NO: 7598838 - DNA, 22 bp, Homo sapiens
gcccagtttcagctctgccttt

SEQ ID NO: 7598839 - DNA, 22 bp, Homo sapiens
gcccagtggtaaaagcaggcct

SEQ ID NO: 7598840 - DNA, 22 bp, Homo sapiens
gcccagtggtaaaagcaggcct

SEQ ID NO: 7598841 - DNA, 22 bp, Homo sapiens
gcccagtggtaaaagcaggcct

SEQ ID NO: 7598842 - DNA, 22 bp, Homo sapiens
gcccagtggtaaaagcaggcct

SEQ ID NO: 7598843 - DNA, 22 bp, Homo sapiens
gcccagtggtaaaagcaggcct

SEQ ID NO: 7598844 - DNA, 22 bp, Homo sapiens
gcccatccatggggtcatggcc

SEQ ID NO: 7598845 - DNA, 22 bp, Homo sapiens
gcccatccatggggtcatggcc

SEQ ID NO: 7598846 - DNA, 22 bp, Homo sapiens
gcccatcatcactgtggaggct

SEQ ID NO: 7598847 - DNA, 22 bp, Homo sapiens
gcccagtttcagctctgccttt

SEQ ID NO: 7598848 - DNA, 22 bp, Homo sapiens
gcccatagtctctttctttctt

SEQ ID NO: 7598849 - DNA, 22 bp, Homo sapiens
gcccatcttctagcagctgtta

SEQ ID NO: 7598850 - DNA, 22 bp, Homo sapiens
gcccatccctgaaccaactggg

SEQ ID NO: 7598851 - DNA, 22 bp, Homo sapiens
gcccatcttctagcagctgtta

SEQ ID NO: 7598852 - DNA, 22 bp, Homo sapiens
gcccatcttctagcagctgtta

SEQ ID NO: 7598853 - DNA, 22 bp, Homo sapiens
gcccaggggagtagtcaattta

SEQ ID NO: 7598854 - DNA, 22 bp, Homo sapiens
gcccagggcttcaaagagagaa

SEQ ID NO: 7598855 - DNA, 22 bp, Homo sapiens
gcccagggcttcaaagagagaa

SEQ ID NO: 7598856 - DNA, 22 bp, Homo sapiens
gcccagggcttcaaagagagaa

SEQ ID NO: 7598857 - DNA, 22 bp, Homo sapiens
gcccagggcttcaaagagagaa

SEQ ID NO: 7598858 - DNA, 22 bp, Homo sapiens
gcccagggcttcaaagagagaa

SEQ ID NO: 7598859 - DNA, 22 bp, Homo sapiens
gcccagggcttcaaagagagaa

SEQ ID NO: 7598860 - DNA, 22 bp, Homo sapiens
gcccagggcttcaaagagagaa

SEQ ID NO: 7598861 - DNA, 22 bp, Homo sapiens
gcccagggcttcaaagagagaa

SEQ ID NO: 7598862 - DNA, 22 bp, Homo sapiens
gcccaggggcagcgcatagtgg

SEQ ID NO: 7598863 - DNA, 22 bp, Homo sapiens
gcccaggggcagcgcatagtgg

SEQ ID NO: 7598864 - DNA, 22 bp, Homo sapiens
gcccaggggcagcgcatagtgg

SEQ ID NO: 7598865 - DNA, 22 bp, Homo sapiens
gcccaggggagtagtcaattta

SEQ ID NO: 7598866 - DNA, 22 bp, Homo sapiens
gcccaggggcagcgcatagtgg

SEQ ID NO: 7598867 - DNA, 22 bp, Homo sapiens
gcccaggggcagcgcatagtgg

SEQ ID NO: 7598868 - DNA, 22 bp, Homo sapiens
gcccaggggcagcgcatagtgg

SEQ ID NO: 7598869 - DNA, 22 bp, Homo sapiens
gcccaggctggagttcagtggt

SEQ ID NO: 7598870 - DNA, 22 bp, Homo sapiens
gcccaggctggagttcagtggt

SEQ ID NO: 7598871 - DNA, 23 bp, Homo sapiens
gcccagggactgggaatcagtgg

SEQ ID NO: 7598872 - DNA, 22 bp, Homo sapiens
gcccaggctggagttcagtggt

SEQ ID NO: 7598873 - DNA, 22 bp, Homo sapiens
gcccaggctggagttcagtggt

SEQ ID NO: 7598874 - DNA, 22 bp, Homo sapiens
gcccaggctggagttcagtggt

SEQ ID NO: 7598875 - DNA, 23 bp, Homo sapiens
gcccagggactgggaatcagtgg

SEQ ID NO: 7598876 - DNA, 23 bp, Homo sapiens
gcccagggactgggaatcagtgg

SEQ ID NO: 7598877 - DNA, 23 bp, Homo sapiens
gcccagggactgggaatcagtgg

SEQ ID NO: 7598878 - DNA, 23 bp, Homo sapiens
gcccagggactgggaatcagtgg

SEQ ID NO: 7598879 - DNA, 22 bp, Homo sapiens
gcccagggcagggcaagagtga

SEQ ID NO: 7598880 - DNA, 22 bp, Homo sapiens
gcccagggcagggcaagagtga

SEQ ID NO: 7598881 - DNA, 22 bp, Homo sapiens
gcccagggcagggcaagagtga

SEQ ID NO: 7598882 - DNA, 22 bp, Homo sapiens
gcccagggcagggcaagagtga

SEQ ID NO: 7598883 - DNA, 22 bp, Homo sapiens
gcccagggcagggcaagagtga

SEQ ID NO: 7598884 - DNA, 22 bp, Homo sapiens
gcccagggcagggcaagagtga

SEQ ID NO: 7598885 - DNA, 22 bp, Homo sapiens
gcccagggcagggcaagagtga

SEQ ID NO: 7598886 - DNA, 22 bp, Homo sapiens
gcccagggcagggcaagagtga

SEQ ID NO: 7598887 - DNA, 22 bp, Homo sapiens
gcccagggctgcaagtggacgc

SEQ ID NO: 7598888 - DNA, 22 bp, Homo sapiens
gcccagggctgcaagtggacgc

SEQ ID NO: 7598889 - DNA, 22 bp, Homo sapiens
gcccagggctgcaagtggacgc

SEQ ID NO: 7598890 - DNA, 22 bp, Homo sapiens
gcccagggctgcaagtggacgc

SEQ ID NO: 7598891 - DNA, 22 bp, Homo sapiens
gcccagggctgcaagtggacgc

SEQ ID NO: 7598892 - DNA, 22 bp, Homo sapiens
gcccagggctgcaagtggacgc

SEQ ID NO: 7598893 - DNA, 22 bp, Homo sapiens
gcccagggcgatggtcggggcc

SEQ ID NO: 7598894 - DNA, 22 bp, Homo sapiens
gcccagggcgatggtcggggcc

SEQ ID NO: 7598895 - DNA, 22 bp, Homo sapiens
gcccagggcgatggtcggggcc

SEQ ID NO: 7598896 - DNA, 22 bp, Homo sapiens
gcccagggcgatggtcggggcc

SEQ ID NO: 7598897 - DNA, 22 bp, Homo sapiens
gcccagggcgatggtcggggcc

SEQ ID NO: 7598898 - DNA, 22 bp, Homo sapiens
gcccagggcgatggtcggggcc

SEQ ID NO: 7598899 - DNA, 22 bp, Homo sapiens
gcccagggcgatggtcggggcc

SEQ ID NO: 7598900 - DNA, 22 bp, Homo sapiens
gcccagggcgatggtcggggcc

SEQ ID NO: 7598901 - DNA, 22 bp, Homo sapiens
gcccagggcgatggtcggggcc

SEQ ID NO: 7598902 - DNA, 22 bp, Homo sapiens
gcccaggctggagtgcagtggt

SEQ ID NO: 7598903 - DNA, 22 bp, Homo sapiens
gcccaggctggagtgcagtggt

SEQ ID NO: 7598904 - DNA, 22 bp, Homo sapiens
gcccaggctggagtgcagtggt

SEQ ID NO: 7598905 - DNA, 22 bp, Homo sapiens
gcccaggctggagtgcagtggt

SEQ ID NO: 7598906 - DNA, 22 bp, Homo sapiens
gcccaggctggagtgcagtggt

SEQ ID NO: 7598907 - DNA, 22 bp, Homo sapiens
gcccagcaaggaccaagggccg

SEQ ID NO: 7598908 - DNA, 22 bp, Homo sapiens
gcccagcaactgcacccttctt

SEQ ID NO: 7598909 - DNA, 22 bp, Homo sapiens
gcccagcaaggaccaagggccg

SEQ ID NO: 7598910 - DNA, 22 bp, Homo sapiens
gcccagcaaggaccaagggccg

SEQ ID NO: 7598911 - DNA, 22 bp, Homo sapiens
gcccagcaaggaccaagggccg

SEQ ID NO: 7598912 - DNA, 22 bp, Homo sapiens
gcccagcaaggaccaagggccg

SEQ ID NO: 7598913 - DNA, 22 bp, Homo sapiens
gcccagcaaggaccaagggccg

SEQ ID NO: 7598914 - DNA, 22 bp, Homo sapiens
gcccaggctggagtgcagtggt

SEQ ID NO: 7598915 - DNA, 22 bp, Homo sapiens
gcccagcaaggaccaagggccg

SEQ ID NO: 7598916 - DNA, 22 bp, Homo sapiens
gcccagagttcaaggctgcagt

SEQ ID NO: 7598917 - DNA, 22 bp, Homo sapiens
gcccagagtttgaagatacagt

SEQ ID NO: 7598918 - DNA, 22 bp, Homo sapiens
gcccagagtttgaagatacagt

SEQ ID NO: 7598919 - DNA, 22 bp, Homo sapiens
gcccagagtttgaagatacagt

SEQ ID NO: 7598920 - DNA, 22 bp, Homo sapiens
gcccagagttcaaggctgcagt

SEQ ID NO: 7598921 - DNA, 22 bp, Homo sapiens
gcccagagttcaaggctgcagt

SEQ ID NO: 7598922 - DNA, 22 bp, Homo sapiens
gcccagagttcaaggctgcagt

SEQ ID NO: 7598923 - DNA, 22 bp, Homo sapiens
gcccagagttcaaggctgcagt

SEQ ID NO: 7598924 - DNA, 22 bp, Homo sapiens
gcccagagttcaaggctgcagt

SEQ ID NO: 7598925 - DNA, 22 bp, Homo sapiens
gcccagagtggccacttggctc

SEQ ID NO: 7598926 - DNA, 22 bp, Homo sapiens
gcccagagtggccacttggctc

SEQ ID NO: 7598927 - DNA, 22 bp, Homo sapiens
gcccagagtggccacttggctc

SEQ ID NO: 7598928 - DNA, 21 bp, Homo sapiens
gcccagagttaagcccaccca

SEQ ID NO: 7598929 - DNA, 21 bp, Homo sapiens
gcccagagttaagcccaccca

SEQ ID NO: 7598930 - DNA, 21 bp, Homo sapiens
gcccagagttaagcccaccca

SEQ ID NO: 7598931 - DNA, 22 bp, Homo sapiens
gcccagagttcaaggctgcagt

SEQ ID NO: 7598932 - DNA, 22 bp, Homo sapiens
gcccagagttcaaggctgcagt

SEQ ID NO: 7598933 - DNA, 22 bp, Homo sapiens
gcccagagttcaaggctgcagt

SEQ ID NO: 7598934 - DNA, 22 bp, Homo sapiens
gcccagagttcaaggctgcagt

SEQ ID NO: 7598935 - DNA, 22 bp, Homo sapiens
gcccagagttcaaggctgcagt

SEQ ID NO: 7598936 - DNA, 21 bp, Homo sapiens
gcccagagttaagcccaccca

SEQ ID NO: 7598937 - DNA, 21 bp, Homo sapiens
gcccagagttaagcccaccca

SEQ ID NO: 7598938 - DNA, 22 bp, Homo sapiens
gcccagagttcaaggctgcagt

SEQ ID NO: 7598939 - DNA, 22 bp, Homo sapiens
gcccagagttcaaggctgcagt

SEQ ID NO: 7598940 - DNA, 22 bp, Homo sapiens
gccctgaggggtggtgtctgta

SEQ ID NO: 7598941 - DNA, 22 bp, Homo sapiens
gccctgaggggtggtgtctgta

SEQ ID NO: 7598942 - DNA, 22 bp, Homo sapiens
gccctgaggggtggtgtctgta

SEQ ID NO: 7598943 - DNA, 22 bp, Homo sapiens
gccctgaggggtggtgtctgta

SEQ ID NO: 7598944 - DNA, 22 bp, Homo sapiens
gccctgagggacctcaccccat

SEQ ID NO: 7598945 - DNA, 22 bp, Homo sapiens
gccctgaggcaaaagaacagtc

SEQ ID NO: 7598946 - DNA, 22 bp, Homo sapiens
gccctgagggacctcaccccat

SEQ ID NO: 7598947 - DNA, 22 bp, Homo sapiens
gccctgagggtctgggttccca

SEQ ID NO: 7598948 - DNA, 22 bp, Homo sapiens
gccctgaggggtggtgtctgta

SEQ ID NO: 7598949 - DNA, 22 bp, Homo sapiens
gccctgaggggtggtgtctgta

SEQ ID NO: 7598950 - DNA, 22 bp, Homo sapiens
gccctgaggggtggtgtctgta

SEQ ID NO: 7598951 - DNA, 22 bp, Homo sapiens
gccctgaggggtggtgtctgta

SEQ ID NO: 7598952 - DNA, 22 bp, Homo sapiens
gccctgaggggtggtgtctgta

SEQ ID NO: 7598953 - DNA, 22 bp, Homo sapiens
gcctaataactagctgtgtaac

SEQ ID NO: 7598954 - DNA, 22 bp, Homo sapiens
gcctaatatgcaaaattgatac

SEQ ID NO: 7598955 - DNA, 22 bp, Homo sapiens
gcctaatgtctcattccctagt

SEQ ID NO: 7598956 - DNA, 19 bp, Homo sapiens
gccctgagtaagctaggag

SEQ ID NO: 7598957 - DNA, 22 bp, Homo sapiens
gccctgagggtctgggttccca

SEQ ID NO: 7598958 - DNA, 22 bp, Homo sapiens
gccctgagggtctgggttccca

SEQ ID NO: 7598959 - DNA, 22 bp, Homo sapiens
gccctgagggtctgggttccca

SEQ ID NO: 7598960 - DNA, 22 bp, Homo sapiens
gccctgagggtctgggttccca

SEQ ID NO: 7598961 - DNA, 22 bp, Homo sapiens
gcctagcattgatcagcctgct

SEQ ID NO: 7598962 - DNA, 22 bp, Homo sapiens
gcctagagaagcttactgaagc

SEQ ID NO: 7598963 - DNA, 22 bp, Homo sapiens
gcctagagaagcttactgaagc

SEQ ID NO: 7598964 - DNA, 22 bp, Homo sapiens
gcctagagagggagtgccacac

SEQ ID NO: 7598965 - DNA, 22 bp, Homo sapiens
gcctagagagggagtgccacac

SEQ ID NO: 7598966 - DNA, 22 bp, Homo sapiens
gcctagagagggagtgccacac

SEQ ID NO: 7598967 - DNA, 22 bp, Homo sapiens
gcctacatttcccagttgaatg

SEQ ID NO: 7598968 - DNA, 22 bp, Homo sapiens
gcctagagaaaaagcctctgca

SEQ ID NO: 7598969 - DNA, 22 bp, Homo sapiens
gcctagagaaaaagcctctgca

SEQ ID NO: 7598970 - DNA, 22 bp, Homo sapiens
gcctacggactccttgccctgt

SEQ ID NO: 7598971 - DNA, 22 bp, Homo sapiens
gcctcagagggcagggtggtga

SEQ ID NO: 7598972 - DNA, 22 bp, Homo sapiens
gcctcagagctacacacacgca

SEQ ID NO: 7598973 - DNA, 22 bp, Homo sapiens
gcctcagagctacacacacgca

SEQ ID NO: 7598974 - DNA, 23 bp, Homo sapiens
gcctcagagaaacagctgcacac

SEQ ID NO: 7598975 - DNA, 23 bp, Homo sapiens
gcctcagagaaacagctgcacac

SEQ ID NO: 7598976 - DNA, 22 bp, Homo sapiens
gcctcagaaagtggcaggtagg

SEQ ID NO: 7598977 - DNA, 22 bp, Homo sapiens
gcctcagaaagtggcaggtagg

SEQ ID NO: 7598978 - DNA, 22 bp, Homo sapiens
gcctcaggccgccctgctgctc

SEQ ID NO: 7598979 - DNA, 22 bp, Homo sapiens
gcctcaggccgccctgctgctc

SEQ ID NO: 7598980 - DNA, 22 bp, Homo sapiens
gcctcaggccgccctgctgctc

SEQ ID NO: 7598981 - DNA, 22 bp, Homo sapiens
gcctcaggccgccctgctgctc

SEQ ID NO: 7598982 - DNA, 22 bp, Homo sapiens
gcctcaggactggcatactcat

SEQ ID NO: 7598983 - DNA, 22 bp, Homo sapiens
gcctcaggactggcatactcat

SEQ ID NO: 7598984 - DNA, 22 bp, Homo sapiens
gcctcaggactggcatactcat

SEQ ID NO: 7598985 - DNA, 22 bp, Homo sapiens
gcctcagctgttgcaggggccc

SEQ ID NO: 7598986 - DNA, 22 bp, Homo sapiens
gcctcagctgttgcaggggccc

SEQ ID NO: 7598987 - DNA, 22 bp, Homo sapiens
gcctcagctgttgcaggggccc

SEQ ID NO: 7598988 - DNA, 22 bp, Homo sapiens
gcctcagctcccagcccaggct

SEQ ID NO: 7598989 - DNA, 22 bp, Homo sapiens
gcctcagctcccagcccaggct

SEQ ID NO: 7598990 - DNA, 22 bp, Homo sapiens
gcctcagctcccagcccaggct

SEQ ID NO: 7598991 - DNA, 22 bp, Homo sapiens
gcctcagctgttgcaggggccc

SEQ ID NO: 7598992 - DNA, 22 bp, Homo sapiens
gcctcagctcccagcccaggct

SEQ ID NO: 7598993 - DNA, 22 bp, Homo sapiens
gcctcagctgttgcaggggccc

SEQ ID NO: 7598994 - DNA, 22 bp, Homo sapiens
gcctcagctgttgcaggggccc

SEQ ID NO: 7598995 - DNA, 22 bp, Homo sapiens
gcctcagctcccagcccaggct

SEQ ID NO: 7598996 - DNA, 22 bp, Homo sapiens
gcctcagctcccagcccaggct

SEQ ID NO: 7598997 - DNA, 20 bp, Homo sapiens
gcctcagccaacccatgggg

SEQ ID NO: 7598998 - DNA, 20 bp, Homo sapiens
gcctcagccaacccatgggg

SEQ ID NO: 7598999 - DNA, 20 bp, Homo sapiens
gcctcagccaacccatgggg

SEQ ID NO: 7599000 - DNA, 20 bp, Homo sapiens
gcctcagccaacccatgggg

SEQ ID NO: 7599001 - DNA, 20 bp, Homo sapiens
gcctcagccaacccatgggg

SEQ ID NO: 7599002 - DNA, 22 bp, Homo sapiens
gcctcagagggccctagggaca

SEQ ID NO: 7599003 - DNA, 22 bp, Homo sapiens
gcctcagagggccctagggaca

SEQ ID NO: 7599004 - DNA, 22 bp, Homo sapiens
gcctcagagggccctagggaca

SEQ ID NO: 7599005 - DNA, 22 bp, Homo sapiens
gcctcagccggcggacgccagg

SEQ ID NO: 7599006 - DNA, 22 bp, Homo sapiens
gcctcagccggcggacgccagg

SEQ ID NO: 7599007 - DNA, 22 bp, Homo sapiens
gcctcagccggcggacgccagg

SEQ ID NO: 7599008 - DNA, 20 bp, Homo sapiens
gcctcagccaacccatgggg

SEQ ID NO: 7599009 - DNA, 20 bp, Homo sapiens
gcctcagccaacccatgggg

SEQ ID NO: 7599010 - DNA, 22 bp, Homo sapiens
gcctcagctcccagcccaggct

SEQ ID NO: 7599011 - DNA, 22 bp, Homo sapiens
gcctcagctcccagcccaggct

SEQ ID NO: 7599012 - DNA, 22 bp, Homo sapiens
gcctcagctcccagcccaggct

SEQ ID NO: 7599013 - DNA, 22 bp, Homo sapiens
gcctcagctcccagcccaggct

SEQ ID NO: 7599014 - DNA, 22 bp, Homo sapiens
gcctcagccggcggacgccagg

SEQ ID NO: 7599015 - DNA, 22 bp, Homo sapiens
gccctgagactgagcatgggtt

SEQ ID NO: 7599016 - DNA, 22 bp, Homo sapiens
gccctgagactgaagaactgtc

SEQ ID NO: 7599017 - DNA, 22 bp, Homo sapiens
gccctgagactgagcatgggtt

SEQ ID NO: 7599018 - DNA, 22 bp, Homo sapiens
gccctgagactgagcatgggtt

SEQ ID NO: 7599019 - DNA, 22 bp, Homo sapiens
gccctgagactgaagaactgtc

SEQ ID NO: 7599020 - DNA, 22 bp, Homo sapiens
gccctgagactgagcatgggtt

SEQ ID NO: 7599021 - DNA, 22 bp, Homo sapiens
gccctgagactgagcatgggtt

SEQ ID NO: 7599022 - DNA, 22 bp, Homo sapiens
gccctgagactgagcatgggtt

SEQ ID NO: 7599023 - DNA, 22 bp, Homo sapiens
gccctgagactgagcatgggtt

SEQ ID NO: 7599024 - DNA, 22 bp, Homo sapiens
gccctgagactgagcatgggtt

SEQ ID NO: 7599025 - DNA, 19 bp, Homo sapiens
gccctgagagcttgggttc

SEQ ID NO: 7599026 - DNA, 19 bp, Homo sapiens
gccctgagagcttgggttc

SEQ ID NO: 7599027 - DNA, 19 bp, Homo sapiens
gccctgagagcttgggttc

SEQ ID NO: 7599028 - DNA, 22 bp, Homo sapiens
gccctgagactgagcatgggtt

SEQ ID NO: 7599029 - DNA, 23 bp, Homo sapiens
gccctgactgcggcctcccactc

SEQ ID NO: 7599030 - DNA, 22 bp, Homo sapiens
gccctgagaagaagtcggaggg

SEQ ID NO: 7599031 - DNA, 22 bp, Homo sapiens
gccctgagaatgtgtgtgtcta

SEQ ID NO: 7599032 - DNA, 22 bp, Homo sapiens
gccctgagaagaagtcggaggg

SEQ ID NO: 7599033 - DNA, 22 bp, Homo sapiens
gccctgagaagaagtcggaggg

SEQ ID NO: 7599034 - DNA, 22 bp, Homo sapiens
gccctgagaatgtgtgtgtcta

SEQ ID NO: 7599035 - DNA, 22 bp, Homo sapiens
gccctgagaagaagtcggaggg

SEQ ID NO: 7599036 - DNA, 22 bp, Homo sapiens
gccctgagaatgtgtgtgtcta

SEQ ID NO: 7599037 - DNA, 22 bp, Homo sapiens
gccctgagactgaagaactgtc

SEQ ID NO: 7599038 - DNA, 22 bp, Homo sapiens
gccctgagaatgtgtgtgtcta

SEQ ID NO: 7599039 - DNA, 22 bp, Homo sapiens
gccctgaccttcactgactctc

SEQ ID NO: 7599040 - DNA, 22 bp, Homo sapiens
gccctgaccttcactgactctc

SEQ ID NO: 7599041 - DNA, 22 bp, Homo sapiens
gccctgaccttcactgactctc

SEQ ID NO: 7599042 - DNA, 23 bp, Homo sapiens
gccctgactgcggcctcccactc

SEQ ID NO: 7599043 - DNA, 19 bp, Homo sapiens
gccctgaccttggctgctc

SEQ ID NO: 7599044 - DNA, 22 bp, Homo sapiens
gccctgacactttgcagctgag

SEQ ID NO: 7599045 - DNA, 22 bp, Homo sapiens
gccctgaaggcagaggtggagc

SEQ ID NO: 7599046 - DNA, 22 bp, Homo sapiens
gccctgaattcctcaggctgtg

SEQ ID NO: 7599047 - DNA, 22 bp, Homo sapiens
gccctgacactttgcagctgag

SEQ ID NO: 7599048 - DNA, 22 bp, Homo sapiens
gccctgacactttgcagctgag

SEQ ID NO: 7599049 - DNA, 22 bp, Homo sapiens
gccctgaattcctcaggctgtg

SEQ ID NO: 7599050 - DNA, 22 bp, Homo sapiens
gccctgaattcctcaggctgtg

SEQ ID NO: 7599051 - DNA, 22 bp, Homo sapiens
gccctgaaggcagaggtggagc

SEQ ID NO: 7599052 - DNA, 22 bp, Homo sapiens
gccctgaataatagagtgggga

SEQ ID NO: 7599053 - DNA, 22 bp, Homo sapiens
gccctgaataatagagtgggga

SEQ ID NO: 7599054 - DNA, 22 bp, Homo sapiens
gccctctgttttgtaagcaacg

SEQ ID NO: 7599055 - DNA, 22 bp, Homo sapiens
gccctctgttttgtaagcaacg

SEQ ID NO: 7599056 - DNA, 22 bp, Homo sapiens
gccctgaaatatttccacggcc

SEQ ID NO: 7599057 - DNA, 22 bp, Homo sapiens
gccctctgttattgcatcctta

SEQ ID NO: 7599058 - DNA, 22 bp, Homo sapiens
gccctctgttattgcatcctta

SEQ ID NO: 7599059 - DNA, 22 bp, Homo sapiens
gccctctgttattgcatcctta

SEQ ID NO: 7599060 - DNA, 22 bp, Homo sapiens
gccctgaataatagagtgggga

SEQ ID NO: 7599061 - DNA, 22 bp, Homo sapiens
gccctgaaggcagaggtggagc

SEQ ID NO: 7599062 - DNA, 22 bp, Homo sapiens
gccctgaaggcagaggtggagc

SEQ ID NO: 7599063 - DNA, 22 bp, Homo sapiens
gccctgaacgaggggtctggag

SEQ ID NO: 7599064 - DNA, 22 bp, Homo sapiens
gccctgaacgaggggtctggag

SEQ ID NO: 7599065 - DNA, 22 bp, Homo sapiens
gccctgaacgaggggtctggag

SEQ ID NO: 7599066 - DNA, 22 bp, Homo sapiens
gccctgaagctgagggtgttaa

SEQ ID NO: 7599067 - DNA, 22 bp, Homo sapiens
gccctgagctagtgtgggcagg

SEQ ID NO: 7599068 - DNA, 22 bp, Homo sapiens
gccctgagctagtgtgggcagg

SEQ ID NO: 7599069 - DNA, 22 bp, Homo sapiens
gccctgagcctatgagcctctc

SEQ ID NO: 7599070 - DNA, 22 bp, Homo sapiens
gccctgagcctatgagcctctc

SEQ ID NO: 7599071 - DNA, 22 bp, Homo sapiens
gccctgagcctatgagcctctc

SEQ ID NO: 7599072 - DNA, 22 bp, Homo sapiens
gccctgagcctatgagcctctc

SEQ ID NO: 7599073 - DNA, 22 bp, Homo sapiens
gccctgagccaccaatgccatt

SEQ ID NO: 7599074 - DNA, 22 bp, Homo sapiens
gccctgagcctatgagcctctc

SEQ ID NO: 7599075 - DNA, 22 bp, Homo sapiens
gccctgagcctatgagcctctc

SEQ ID NO: 7599076 - DNA, 22 bp, Homo sapiens
gccctgagcctatgagcctctc

SEQ ID NO: 7599077 - DNA, 22 bp, Homo sapiens
gccctgaggcaaaagaacagtc

SEQ ID NO: 7599078 - DNA, 22 bp, Homo sapiens
gccctgaggcaaaagaacagtc

SEQ ID NO: 7599079 - DNA, 22 bp, Homo sapiens
gccctgaggcaaaagaacagtc

SEQ ID NO: 7599080 - DNA, 22 bp, Homo sapiens
gccctgaggcaaaagaacagtc

SEQ ID NO: 7599081 - DNA, 22 bp, Homo sapiens
gccctgaggatttgcatttcct

SEQ ID NO: 7599082 - DNA, 22 bp, Homo sapiens
gccctgagctagtgtgggcagg

SEQ ID NO: 7599083 - DNA, 22 bp, Homo sapiens
gccctgagctagtgtgggcagg

SEQ ID NO: 7599084 - DNA, 22 bp, Homo sapiens
gccctgaggatttgcatttcct

SEQ ID NO: 7599085 - DNA, 22 bp, Homo sapiens
gccctgaggatttgcatttcct

SEQ ID NO: 7599086 - DNA, 22 bp, Homo sapiens
gccctgagctagtgtgggcagg

SEQ ID NO: 7599087 - DNA, 22 bp, Homo sapiens
gccctgagctagtgtgggcagg

SEQ ID NO: 7599088 - DNA, 22 bp, Homo sapiens
gccctgagctagtgtgggcagg

SEQ ID NO: 7599089 - DNA, 22 bp, Homo sapiens
gccctgagcactgctgctgggg

SEQ ID NO: 7599090 - DNA, 22 bp, Homo sapiens
gccctgagcactgctgctgggg

SEQ ID NO: 7599091 - DNA, 22 bp, Homo sapiens
gccctgagcactgctgctgggg

SEQ ID NO: 7599092 - DNA, 22 bp, Homo sapiens
gccctgagcactgctgctgggg

SEQ ID NO: 7599093 - DNA, 22 bp, Homo sapiens
gccctgagcactgctgctgggg

SEQ ID NO: 7599094 - DNA, 22 bp, Homo sapiens
gccctgagcactgctgctgggg

SEQ ID NO: 7599095 - DNA, 22 bp, Homo sapiens
gccctgagccaccaatgccatt

SEQ ID NO: 7599096 - DNA, 22 bp, Homo sapiens
gccctgagccaccaatgccatt

SEQ ID NO: 7599097 - DNA, 22 bp, Homo sapiens
gccctgagcactgctgctgggg

SEQ ID NO: 7599098 - DNA, 22 bp, Homo sapiens
gccctgagcactgctgctgggg

SEQ ID NO: 7599099 - DNA, 22 bp, Homo sapiens
gccctgagccaccaatgccatt

SEQ ID NO: 7599100 - DNA, 22 bp, Homo sapiens
gccctgagccaccaatgccatt

SEQ ID NO: 7599101 - DNA, 22 bp, Homo sapiens
gccctgagccaccaatgccatt

SEQ ID NO: 7599102 - DNA, 22 bp, Homo sapiens
gccctgagaggcaatgactctt

SEQ ID NO: 7599103 - DNA, 19 bp, Homo sapiens
gccctgagagcttgggttc

SEQ ID NO: 7599104 - DNA, 22 bp, Homo sapiens
gccctgagaggcaatgactctt

SEQ ID NO: 7599105 - DNA, 22 bp, Homo sapiens
gccctgagaggcaatgactctt

SEQ ID NO: 7599106 - DNA, 22 bp, Homo sapiens
gccctgagattcttggattctg

SEQ ID NO: 7599107 - DNA, 22 bp, Homo sapiens
gccctgagaggcaatgactctt

SEQ ID NO: 7599108 - DNA, 22 bp, Homo sapiens
gccctgagaggcaatgactctt

SEQ ID NO: 7599109 - DNA, 22 bp, Homo sapiens
gccctgagcacacagtagcaaa

SEQ ID NO: 7599110 - DNA, 22 bp, Homo sapiens
gccctgagattcttggattctg

SEQ ID NO: 7599111 - DNA, 22 bp, Homo sapiens
gccctgagcacacagtagcaaa

SEQ ID NO: 7599112 - DNA, 22 bp, Homo sapiens
gccctgagcacacagtagcaaa

SEQ ID NO: 7599113 - DNA, 22 bp, Homo sapiens
gccctgagattcttggattctg

SEQ ID NO: 7599114 - DNA, 22 bp, Homo sapiens
gccctgagattcttggattctg

SEQ ID NO: 7599115 - DNA, 22 bp, Homo sapiens
gccctgagcacacagtagcaaa

SEQ ID NO: 7599116 - DNA, 22 bp, Homo sapiens
gccctgagcacacagtagcaaa

SEQ ID NO: 7599117 - DNA, 22 bp, Homo sapiens
gccctgagcacacagtagcaaa

SEQ ID NO: 7599118 - DNA, 22 bp, Homo sapiens
gccctgagcacacagtagcaaa

SEQ ID NO: 7599119 - DNA, 22 bp, Homo sapiens
gccaggactcttcctagaaggt

SEQ ID NO: 7599120 - DNA, 22 bp, Homo sapiens
gccaggactagagggaggtgag

SEQ ID NO: 7599121 - DNA, 22 bp, Homo sapiens
gccaggactagagggaggtgag

SEQ ID NO: 7599122 - DNA, 22 bp, Homo sapiens
gccaggacggtgaatgggctac

SEQ ID NO: 7599123 - DNA, 22 bp, Homo sapiens
gccaggacggtgaatgggctac

SEQ ID NO: 7599124 - DNA, 22 bp, Homo sapiens
gccaggacctcccagagctttc

SEQ ID NO: 7599125 - DNA, 22 bp, Homo sapiens
gccaggacctcccagagctttc

SEQ ID NO: 7599126 - DNA, 22 bp, Homo sapiens
gccaggactgagaatgggagca

SEQ ID NO: 7599127 - DNA, 22 bp, Homo sapiens
gccaggactgagaatgggagca

SEQ ID NO: 7599128 - DNA, 22 bp, Homo sapiens
gccaggactgagaatgggagca

SEQ ID NO: 7599129 - DNA, 22 bp, Homo sapiens
gccaggagaaaaggcgaatgat

SEQ ID NO: 7599130 - DNA, 22 bp, Homo sapiens
gccaggagaaaaggcgaatgat

SEQ ID NO: 7599131 - DNA, 22 bp, Homo sapiens
gccaggagaaaaggcgaatgat

SEQ ID NO: 7599132 - DNA, 22 bp, Homo sapiens
gccaggagaaaaggcgaatgat

SEQ ID NO: 7599133 - DNA, 22 bp, Homo sapiens
gccaggagaaaaggcgaatgat

SEQ ID NO: 7599134 - DNA, 21 bp, Homo sapiens
gccaggaccagcagaccactt

SEQ ID NO: 7599135 - DNA, 21 bp, Homo sapiens
gccaggaccagcagaccactt

SEQ ID NO: 7599136 - DNA, 19 bp, Homo sapiens
gccaggacatcctcctgct

SEQ ID NO: 7599137 - DNA, 19 bp, Homo sapiens
gccaggacatcctcctgct

SEQ ID NO: 7599138 - DNA, 19 bp, Homo sapiens
gccaggacatcctcctgct

SEQ ID NO: 7599139 - DNA, 22 bp, Homo sapiens
gccaggaccctggagggcatct

SEQ ID NO: 7599140 - DNA, 22 bp, Homo sapiens
gccaggaccctggagggcatct

SEQ ID NO: 7599141 - DNA, 21 bp, Homo sapiens
gccaggaccagcagaccactt

SEQ ID NO: 7599142 - DNA, 22 bp, Homo sapiens
gccaggacctcagatgcagggc

SEQ ID NO: 7599143 - DNA, 22 bp, Homo sapiens
gccaggacctcagatgcagggc

SEQ ID NO: 7599144 - DNA, 22 bp, Homo sapiens
gccaggacctcagatgcagggc

SEQ ID NO: 7599145 - DNA, 22 bp, Homo sapiens
gccaggaatggagaggtggcct

SEQ ID NO: 7599146 - DNA, 22 bp, Homo sapiens
gccaggaatggagaggtggcct

SEQ ID NO: 7599147 - DNA, 22 bp, Homo sapiens
gccaggaatggagaggtggcct

SEQ ID NO: 7599148 - DNA, 22 bp, Homo sapiens
gccaggaatggagaggtggcct

SEQ ID NO: 7599149 - DNA, 22 bp, Homo sapiens
gccaggaatggagaggtggcct

SEQ ID NO: 7599150 - DNA, 22 bp, Homo sapiens
gccaggaatttcaagagccact

SEQ ID NO: 7599151 - DNA, 22 bp, Homo sapiens
gccaggaatttcaagagccact

SEQ ID NO: 7599152 - DNA, 22 bp, Homo sapiens
gccaggaatttcaagagccact

SEQ ID NO: 7599153 - DNA, 22 bp, Homo sapiens
gccaggaatttcaagagccact

SEQ ID NO: 7599154 - DNA, 22 bp, Homo sapiens
gccaggaatttcaagagccact

SEQ ID NO: 7599155 - DNA, 22 bp, Homo sapiens
gccaggaggctgctgtgtaggc

SEQ ID NO: 7599156 - DNA, 22 bp, Homo sapiens
gccaggaggctgctgtgtaggc

SEQ ID NO: 7599157 - DNA, 22 bp, Homo sapiens
gccaggagccagcttcttagca

SEQ ID NO: 7599158 - DNA, 22 bp, Homo sapiens
gccaggaggctgctgtgtaggc

SEQ ID NO: 7599159 - DNA, 22 bp, Homo sapiens
gccaggaggctgctgtgtaggc

SEQ ID NO: 7599160 - DNA, 22 bp, Homo sapiens
gccaggaggctgctgtgtaggc

SEQ ID NO: 7599161 - DNA, 22 bp, Homo sapiens
gccaggagccctgggcaagttc

SEQ ID NO: 7599162 - DNA, 22 bp, Homo sapiens
gccaggagccctgggcaagttc

SEQ ID NO: 7599163 - DNA, 22 bp, Homo sapiens
gccaggagtgtgtggctatgtt

SEQ ID NO: 7599164 - DNA, 22 bp, Homo sapiens
gccaggaggctgctgtgtaggc

SEQ ID NO: 7599165 - DNA, 22 bp, Homo sapiens
gccaggagccagcttcttagca

SEQ ID NO: 7599166 - DNA, 22 bp, Homo sapiens
gccaggagccagcttcttagca

SEQ ID NO: 7599167 - DNA, 22 bp, Homo sapiens
gccaggagcatgtcattgttga

SEQ ID NO: 7599168 - DNA, 22 bp, Homo sapiens
gccaggagcatgtcattgttga

SEQ ID NO: 7599169 - DNA, 22 bp, Homo sapiens
gccaggagcatgtcattgttga

SEQ ID NO: 7599170 - DNA, 22 bp, Homo sapiens
gccaggagccctgggcaagttc

SEQ ID NO: 7599171 - DNA, 22 bp, Homo sapiens
gccaggagccctgggcaagttc

SEQ ID NO: 7599172 - DNA, 22 bp, Homo sapiens
gccaggagccctgggcaagttc

SEQ ID NO: 7599173 - DNA, 22 bp, Homo sapiens
gccaggagccctgggcaagttc

SEQ ID NO: 7599174 - DNA, 22 bp, Homo sapiens
gccaggagccctgggcaagttc

SEQ ID NO: 7599175 - DNA, 22 bp, Homo sapiens
gccaggagccctgggcaagttc

SEQ ID NO: 7599176 - DNA, 22 bp, Homo sapiens
gccaggagagctccttcaggtt

SEQ ID NO: 7599177 - DNA, 22 bp, Homo sapiens
gccaggagagctccttcaggtt

SEQ ID NO: 7599178 - DNA, 22 bp, Homo sapiens
gccaggagactccattcatttg

SEQ ID NO: 7599179 - DNA, 22 bp, Homo sapiens
gccaggagagctccttcaggtt

SEQ ID NO: 7599180 - DNA, 22 bp, Homo sapiens
gccaggagagctccttcaggtt

SEQ ID NO: 7599181 - DNA, 22 bp, Homo sapiens
gccaggagactccattcatttg

SEQ ID NO: 7599182 - DNA, 22 bp, Homo sapiens
gccaggagagctccttcaggtt

SEQ ID NO: 7599183 - DNA, 22 bp, Homo sapiens
gccaggagagctccttcaggtt

SEQ ID NO: 7599184 - DNA, 22 bp, Homo sapiens
gccaggagagctccttcaggtt

SEQ ID NO: 7599185 - DNA, 22 bp, Homo sapiens
gccaggagagctccttcaggtt

SEQ ID NO: 7599186 - DNA, 22 bp, Homo sapiens
gccaggagagctccttcaggtt

SEQ ID NO: 7599187 - DNA, 22 bp, Homo sapiens
gccaggagagctccttcaggtt

SEQ ID NO: 7599188 - DNA, 22 bp, Homo sapiens
gccaggagagctccttcaggtt

SEQ ID NO: 7599189 - DNA, 22 bp, Homo sapiens
gccaggagaatgctagcagagg

SEQ ID NO: 7599190 - DNA, 22 bp, Homo sapiens
gccaggagaatgctagcagagg

SEQ ID NO: 7599191 - DNA, 22 bp, Homo sapiens
gccaggagaatgctagcagagg

SEQ ID NO: 7599192 - DNA, 22 bp, Homo sapiens
gccaggagaatgctagcagagg

SEQ ID NO: 7599193 - DNA, 22 bp, Homo sapiens
gccaggagaatgctagcagagg

SEQ ID NO: 7599194 - DNA, 22 bp, Homo sapiens
gccaggagaaaaggcgaatgat

SEQ ID NO: 7599195 - DNA, 22 bp, Homo sapiens
gccaggagactccattcatttg

SEQ ID NO: 7599196 - DNA, 22 bp, Homo sapiens
gccaggagaatgctagcagagg

SEQ ID NO: 7599197 - DNA, 22 bp, Homo sapiens
gccaggagaatgctagcagagg

SEQ ID NO: 7599198 - DNA, 22 bp, Homo sapiens
gccaggagaatgctagcagagg

SEQ ID NO: 7599199 - DNA, 22 bp, Homo sapiens
gccaggagaatgctagcagagg

SEQ ID NO: 7599200 - DNA, 22 bp, Homo sapiens
gccaggtctgggtagcagagga

SEQ ID NO: 7599201 - DNA, 22 bp, Homo sapiens
gccaggtctgggtagcagagga

SEQ ID NO: 7599202 - DNA, 22 bp, Homo sapiens
gccaggtggctgagtgactgag

SEQ ID NO: 7599203 - DNA, 22 bp, Homo sapiens
gccaggtctgcaggcatcctga

SEQ ID NO: 7599204 - DNA, 22 bp, Homo sapiens
gccaggtggctgagtgactgag

SEQ ID NO: 7599205 - DNA, 22 bp, Homo sapiens
gccaggtgggagacagacagca

SEQ ID NO: 7599206 - DNA, 22 bp, Homo sapiens
gccaggtgggagacagacagca

SEQ ID NO: 7599207 - DNA, 22 bp, Homo sapiens
gccaggtgggagacagacagca

SEQ ID NO: 7599208 - DNA, 22 bp, Homo sapiens
gccaggtggctgagtgactgag

SEQ ID NO: 7599209 - DNA, 22 bp, Homo sapiens
gccaggtggctgagtgactgag

SEQ ID NO: 7599210 - DNA, 22 bp, Homo sapiens
gccaggtctgcaggcatcctga

SEQ ID NO: 7599211 - DNA, 22 bp, Homo sapiens
gccaggtctcataaatgcagct

SEQ ID NO: 7599212 - DNA, 18 bp, Homo sapiens
gccaggtctctctgcttc

SEQ ID NO: 7599213 - DNA, 18 bp, Homo sapiens
gccaggtctctctgcttc

SEQ ID NO: 7599214 - DNA, 22 bp, Homo sapiens
gccaggtctaagcatcagccac

SEQ ID NO: 7599215 - DNA, 22 bp, Homo sapiens
gccaggtctcataaatgcagct

SEQ ID NO: 7599216 - DNA, 22 bp, Homo sapiens
gccaggtctaagcatcagccac

SEQ ID NO: 7599217 - DNA, 22 bp, Homo sapiens
gccaggtcgtctccatgtccaa

SEQ ID NO: 7599218 - DNA, 22 bp, Homo sapiens
gccaggtcgtctccatgtccaa

SEQ ID NO: 7599219 - DNA, 22 bp, Homo sapiens
gccaggtcgtctccatgtccaa

SEQ ID NO: 7599220 - DNA, 22 bp, Homo sapiens
gccaggtcccctcatggctcct

SEQ ID NO: 7599221 - DNA, 22 bp, Homo sapiens
gccaggtcccctcatggctcct

SEQ ID NO: 7599222 - DNA, 22 bp, Homo sapiens
gccaggtcccctcatggctcct

SEQ ID NO: 7599223 - DNA, 22 bp, Homo sapiens
gccaggtgtagtggccacacct

SEQ ID NO: 7599224 - DNA, 22 bp, Homo sapiens
gccaggtgtagtggccacacct

SEQ ID NO: 7599225 - DNA, 22 bp, Homo sapiens
gccaggtgtagtggccacacct

SEQ ID NO: 7599226 - DNA, 22 bp, Homo sapiens
gccaggtgtcctcacagtgagg

SEQ ID NO: 7599227 - DNA, 22 bp, Homo sapiens
gccaggtgtcctcacagtgagg

SEQ ID NO: 7599228 - DNA, 22 bp, Homo sapiens
gccaggtgtcctcacagtgagg

SEQ ID NO: 7599229 - DNA, 22 bp, Homo sapiens
gccaggtggtctggctccagag

SEQ ID NO: 7599230 - DNA, 22 bp, Homo sapiens
gccaggtggtctggctccagag

SEQ ID NO: 7599231 - DNA, 22 bp, Homo sapiens
gccaggtgtagtggccacacct

SEQ ID NO: 7599232 - DNA, 22 bp, Homo sapiens
gccaggtggtctggctccagag

SEQ ID NO: 7599233 - DNA, 22 bp, Homo sapiens
gccaggtggtctggctccagag

SEQ ID NO: 7599234 - DNA, 22 bp, Homo sapiens
gccaggtggtctggctccagag

SEQ ID NO: 7599235 - DNA, 22 bp, Homo sapiens
gccaggcacagttctaggtgct

SEQ ID NO: 7599236 - DNA, 22 bp, Homo sapiens
gccaggcacagttctaggtgct

SEQ ID NO: 7599237 - DNA, 22 bp, Homo sapiens
gccaggcacagttctaggtgct

SEQ ID NO: 7599238 - DNA, 22 bp, Homo sapiens
gccaggcacagttctaggtgct

SEQ ID NO: 7599239 - DNA, 22 bp, Homo sapiens
gccaggcacagttctaggtgct

SEQ ID NO: 7599240 - DNA, 22 bp, Homo sapiens
gccaggcacagttctaggtgct

SEQ ID NO: 7599241 - DNA, 22 bp, Homo sapiens
gccaggtccagggtggagcgct

SEQ ID NO: 7599242 - DNA, 23 bp, Homo sapiens
gccaggcacatggtggacacgca

SEQ ID NO: 7599243 - DNA, 23 bp, Homo sapiens
gccaggcacatggtggacacgca

SEQ ID NO: 7599244 - DNA, 22 bp, Homo sapiens
gccaggtccagggtggagcgct

SEQ ID NO: 7599245 - DNA, 22 bp, Homo sapiens
gccaggtccagggtggagcgct

SEQ ID NO: 7599246 - DNA, 23 bp, Homo sapiens
gccaggcacatggtggacacgca

SEQ ID NO: 7599247 - DNA, 23 bp, Homo sapiens
gccaggcacatggtggacacgca

SEQ ID NO: 7599248 - DNA, 23 bp, Homo sapiens
gccaggcacatggtggacacgca

SEQ ID NO: 7599249 - DNA, 23 bp, Homo sapiens
gccaggcacatggtggacacgca

SEQ ID NO: 7599250 - DNA, 23 bp, Homo sapiens
gccaggcacatggtggacacgca

SEQ ID NO: 7599251 - DNA, 23 bp, Homo sapiens
gccaggcacatggtggacacgca

SEQ ID NO: 7599252 - DNA, 22 bp, Homo sapiens
gccaggcaaattaaggaatgca

SEQ ID NO: 7599253 - DNA, 22 bp, Homo sapiens
gccaggcaaattaaggaatgca

SEQ ID NO: 7599254 - DNA, 22 bp, Homo sapiens
gccaggagttcagatgcatgtt

SEQ ID NO: 7599255 - DNA, 22 bp, Homo sapiens
gccaggatgactatacaacagc

SEQ ID NO: 7599256 - DNA, 22 bp, Homo sapiens
gccaggagttcagatgcatgtt

SEQ ID NO: 7599257 - DNA, 22 bp, Homo sapiens
gccaggcaatgtgttagaagcg

SEQ ID NO: 7599258 - DNA, 22 bp, Homo sapiens
gccaggcaatgtgttagaagcg

SEQ ID NO: 7599259 - DNA, 22 bp, Homo sapiens
gccaggcaatgtgttagaagcg

SEQ ID NO: 7599260 - DNA, 22 bp, Homo sapiens
gccaggcaaattaaggaatgca

SEQ ID NO: 7599261 - DNA, 22 bp, Homo sapiens
gccaggcaaattaaggaatgca

SEQ ID NO: 7599262 - DNA, 22 bp, Homo sapiens
gccaggagttcagatgcatgtt

SEQ ID NO: 7599263 - DNA, 22 bp, Homo sapiens
gccaggagttcagatgcatgtt

SEQ ID NO: 7599264 - DNA, 22 bp, Homo sapiens
gccaggagttcagatgcatgtt

SEQ ID NO: 7599265 - DNA, 22 bp, Homo sapiens
gccaggagttcagatgcatgtt

SEQ ID NO: 7599266 - DNA, 22 bp, Homo sapiens
gccaggagttcagatgcatgtt

SEQ ID NO: 7599267 - DNA, 22 bp, Homo sapiens
gccaggagttcagatgcatgtt

SEQ ID NO: 7599268 - DNA, 22 bp, Homo sapiens
gccaggagttcagatgcatgtt

SEQ ID NO: 7599269 - DNA, 22 bp, Homo sapiens
gccaggagtgtgtggctatgtt

SEQ ID NO: 7599270 - DNA, 22 bp, Homo sapiens
gccaggagttcagatgcatgtt

SEQ ID NO: 7599271 - DNA, 22 bp, Homo sapiens
gccaggagttcagatgcatgtt

SEQ ID NO: 7599272 - DNA, 22 bp, Homo sapiens
gccaggagttcagatgcatgtt

SEQ ID NO: 7599273 - DNA, 23 bp, Homo sapiens
gcccagagaggctcaccaggaat

SEQ ID NO: 7599274 - DNA, 23 bp, Homo sapiens
gcccagagaggctcaccaggaat

SEQ ID NO: 7599275 - DNA, 23 bp, Homo sapiens
gcccagagaggctcaccaggaat

SEQ ID NO: 7599276 - DNA, 22 bp, Homo sapiens
gcccagagagatgctgtagacc

SEQ ID NO: 7599277 - DNA, 23 bp, Homo sapiens
gcccagagaggctcaccaggaat

SEQ ID NO: 7599278 - DNA, 23 bp, Homo sapiens
gcccagagaggctcaccaggaat

SEQ ID NO: 7599279 - DNA, 22 bp, Homo sapiens
gcccagagggaagaggtgtcat

SEQ ID NO: 7599280 - DNA, 18 bp, Homo sapiens
gcccagagccctcttatt

SEQ ID NO: 7599281 - DNA, 22 bp, Homo sapiens
gcccagagggaagaggtgtcat

SEQ ID NO: 7599282 - DNA, 18 bp, Homo sapiens
gcccagagccctcttatt

SEQ ID NO: 7599283 - DNA, 18 bp, Homo sapiens
gcccagagccctcttatt

SEQ ID NO: 7599284 - DNA, 23 bp, Homo sapiens
gcccagagaggctcaccaggaat

SEQ ID NO: 7599285 - DNA, 23 bp, Homo sapiens
gcccagagaggctcaccaggaat

SEQ ID NO: 7599286 - DNA, 22 bp, Homo sapiens
gcccagagggaagaggtgtcat

SEQ ID NO: 7599287 - DNA, 21 bp, Homo sapiens
gcccagagggagccaagccca

SEQ ID NO: 7599288 - DNA, 22 bp, Homo sapiens
gcccagagggaagaggtgtcat

SEQ ID NO: 7599289 - DNA, 22 bp, Homo sapiens
gcccagagggaagaggtgtcat

SEQ ID NO: 7599290 - DNA, 22 bp, Homo sapiens
gcccagagggaagaggtgtcat

SEQ ID NO: 7599291 - DNA, 22 bp, Homo sapiens
gcccagagggaagaggtgtcat

SEQ ID NO: 7599292 - DNA, 18 bp, Homo sapiens
gcccagaggtctgggccc

SEQ ID NO: 7599293 - DNA, 18 bp, Homo sapiens
gcccagaggtctgggccc

SEQ ID NO: 7599294 - DNA, 18 bp, Homo sapiens
gcccagaggtctgggccc

SEQ ID NO: 7599295 - DNA, 18 bp, Homo sapiens
gcccagaggtctgggccc

SEQ ID NO: 7599296 - DNA, 18 bp, Homo sapiens
gcccagaggtctgggccc

SEQ ID NO: 7599297 - DNA, 21 bp, Homo sapiens
gcccagagggagccaagccca

SEQ ID NO: 7599298 - DNA, 18 bp, Homo sapiens
gcccagaggtctgggccc

SEQ ID NO: 7599299 - DNA, 18 bp, Homo sapiens
gcccagaggtctgggccc

SEQ ID NO: 7599300 - DNA, 21 bp, Homo sapiens
gcccagagtcctcccactcca

SEQ ID NO: 7599301 - DNA, 21 bp, Homo sapiens
gcccagagtcctcccactcca

SEQ ID NO: 7599302 - DNA, 18 bp, Homo sapiens
gcccagaggtctgggccc

SEQ ID NO: 7599303 - DNA, 21 bp, Homo sapiens
gcccagagtcctcccactcca

SEQ ID NO: 7599304 - DNA, 18 bp, Homo sapiens
gcccagaggtctgggccc

SEQ ID NO: 7599305 - DNA, 18 bp, Homo sapiens
gcccagaggtctgggccc

SEQ ID NO: 7599306 - DNA, 18 bp, Homo sapiens
gcccagaggtctgggccc

SEQ ID NO: 7599307 - DNA, 18 bp, Homo sapiens
gcccagaggtctgggccc

SEQ ID NO: 7599308 - DNA, 22 bp, Homo sapiens
gcccagagtgagtcctgggccc

SEQ ID NO: 7599309 - DNA, 22 bp, Homo sapiens
gcccagagtgagtcctgggccc

SEQ ID NO: 7599310 - DNA, 22 bp, Homo sapiens
gcccagagtggccacttggctc

SEQ ID NO: 7599311 - DNA, 22 bp, Homo sapiens
gcccagagtgagtcctgggccc

SEQ ID NO: 7599312 - DNA, 22 bp, Homo sapiens
gcccagagtgagtcctgggccc

SEQ ID NO: 7599313 - DNA, 22 bp, Homo sapiens
gcccagagtgagtcctgggccc

SEQ ID NO: 7599314 - DNA, 22 bp, Homo sapiens
gcccagagtgagtcctgggccc

SEQ ID NO: 7599315 - DNA, 22 bp, Homo sapiens
gcccagagtgagtcctgggccc

SEQ ID NO: 7599316 - DNA, 22 bp, Homo sapiens
gcccagagtgagtcctgggccc

SEQ ID NO: 7599317 - DNA, 22 bp, Homo sapiens
gcccagagtgagtcctgggccc

SEQ ID NO: 7599318 - DNA, 22 bp, Homo sapiens
gcccagagtgagtcctgggccc

SEQ ID NO: 7599319 - DNA, 21 bp, Homo sapiens
gcccagagtcctcccactcca

SEQ ID NO: 7599320 - DNA, 21 bp, Homo sapiens
gcccagagtcctcccactcca

SEQ ID NO: 7599321 - DNA, 22 bp, Homo sapiens
gcccagagtgagtcctgggccc

SEQ ID NO: 7599322 - DNA, 22 bp, Homo sapiens
gcccactggctggagtgctggt

SEQ ID NO: 7599323 - DNA, 19 bp, Homo sapiens
gcccactgtctttgccaac

SEQ ID NO: 7599324 - DNA, 22 bp, Homo sapiens
gcccactttctgccagctcacc

SEQ ID NO: 7599325 - DNA, 22 bp, Homo sapiens
gcccactttctgccagctcacc

SEQ ID NO: 7599326 - DNA, 22 bp, Homo sapiens
gcccactggctggagtgctggt

SEQ ID NO: 7599327 - DNA, 22 bp, Homo sapiens
gcccactgagtgactccctcag

SEQ ID NO: 7599328 - DNA, 22 bp, Homo sapiens
gcccactggctggagtgctggt

SEQ ID NO: 7599329 - DNA, 22 bp, Homo sapiens
gcccactgagtgactccctcag

SEQ ID NO: 7599330 - DNA, 22 bp, Homo sapiens
gcccagaacagtgtcacatgtc

SEQ ID NO: 7599331 - DNA, 22 bp, Homo sapiens
gcccagaacagtgtcacatgtc

SEQ ID NO: 7599332 - DNA, 22 bp, Homo sapiens
gcccagaaatgaacttgctgtg

SEQ ID NO: 7599333 - DNA, 22 bp, Homo sapiens
gcccagaaatgaacttgctgtg

SEQ ID NO: 7599334 - DNA, 22 bp, Homo sapiens
gcccagaaatgaacttgctgtg

SEQ ID NO: 7599335 - DNA, 22 bp, Homo sapiens
gcccagaaatgaacttgctgtg

SEQ ID NO: 7599336 - DNA, 22 bp, Homo sapiens
gcccagaaatgaacttgctgtg

SEQ ID NO: 7599337 - DNA, 22 bp, Homo sapiens
gcccagaaagactgcctaacag

SEQ ID NO: 7599338 - DNA, 22 bp, Homo sapiens
gcccagaaagactgcctaacag

SEQ ID NO: 7599339 - DNA, 22 bp, Homo sapiens
gcccagaaagcatcattgtgga

SEQ ID NO: 7599340 - DNA, 22 bp, Homo sapiens
gcccagaaagactgcctaacag

SEQ ID NO: 7599341 - DNA, 22 bp, Homo sapiens
gcccagaaagactgcctaacag

SEQ ID NO: 7599342 - DNA, 22 bp, Homo sapiens
gcccagaaagcatcattgtgga

SEQ ID NO: 7599343 - DNA, 22 bp, Homo sapiens
gcccagaaagcatcattgtgga

SEQ ID NO: 7599344 - DNA, 22 bp, Homo sapiens
gcccagaaagcatcattgtgga

SEQ ID NO: 7599345 - DNA, 22 bp, Homo sapiens
gcccagaaagcatcattgtgga

SEQ ID NO: 7599346 - DNA, 22 bp, Homo sapiens
gcccagaagttgaggctgcagt

SEQ ID NO: 7599347 - DNA, 22 bp, Homo sapiens
gcccagaagttgaggctgcagt

SEQ ID NO: 7599348 - DNA, 22 bp, Homo sapiens
gcccagaagttgaggctgcagt

SEQ ID NO: 7599349 - DNA, 22 bp, Homo sapiens
gcccagaagtgactcagcactg

SEQ ID NO: 7599350 - DNA, 22 bp, Homo sapiens
gcccagaagttgaggctgcagt

SEQ ID NO: 7599351 - DNA, 22 bp, Homo sapiens
gcccagaagttgaggctgcagt

SEQ ID NO: 7599352 - DNA, 21 bp, Homo sapiens
gcccagaagactggctctgcc

SEQ ID NO: 7599353 - DNA, 21 bp, Homo sapiens
gcccagaagactggctctgcc

SEQ ID NO: 7599354 - DNA, 21 bp, Homo sapiens
gcccagaagactggctctgcc

SEQ ID NO: 7599355 - DNA, 21 bp, Homo sapiens
gcccagaagactggctctgcc

SEQ ID NO: 7599356 - DNA, 21 bp, Homo sapiens
gcccagaagactggctctgcc

SEQ ID NO: 7599357 - DNA, 22 bp, Homo sapiens
gcccagaagtgactcagcactg

SEQ ID NO: 7599358 - DNA, 22 bp, Homo sapiens
gcccagaagtgactcagcactg

SEQ ID NO: 7599359 - DNA, 22 bp, Homo sapiens
gcccagaagtgactcagcactg

SEQ ID NO: 7599360 - DNA, 22 bp, Homo sapiens
gcccagagagatgctgtagacc

SEQ ID NO: 7599361 - DNA, 22 bp, Homo sapiens
gcccagagagatgctgtagacc

SEQ ID NO: 7599362 - DNA, 22 bp, Homo sapiens
gcccagagagatgctgtagacc

SEQ ID NO: 7599363 - DNA, 22 bp, Homo sapiens
gcccagagagatgctgtagacc

SEQ ID NO: 7599364 - DNA, 22 bp, Homo sapiens
gcccagagagatgaagtgatgg

SEQ ID NO: 7599365 - DNA, 22 bp, Homo sapiens
gcccagagagatgaagtgatgg

SEQ ID NO: 7599366 - DNA, 22 bp, Homo sapiens
gcccagaagttgaggctgcagt

SEQ ID NO: 7599367 - DNA, 22 bp, Homo sapiens
gcccagagagatgaagtgatgg

SEQ ID NO: 7599368 - DNA, 22 bp, Homo sapiens
gcccagagagatgaagtgatgg

SEQ ID NO: 7599369 - DNA, 22 bp, Homo sapiens
gccagtggccctctggagaagg

SEQ ID NO: 7599370 - DNA, 22 bp, Homo sapiens
gccagtggccctctggagaagg

SEQ ID NO: 7599371 - DNA, 22 bp, Homo sapiens
gccagtggccctctggagaagg

SEQ ID NO: 7599372 - DNA, 22 bp, Homo sapiens
gccagtggcttgccaggcagga

SEQ ID NO: 7599373 - DNA, 22 bp, Homo sapiens
gccagtggcttgccaggcagga

SEQ ID NO: 7599374 - DNA, 22 bp, Homo sapiens
gccagtggcttgccaggcagga

SEQ ID NO: 7599375 - DNA, 22 bp, Homo sapiens
gccagtggagcacatggtgaag

SEQ ID NO: 7599376 - DNA, 22 bp, Homo sapiens
gccagtggcttgccaggcagga

SEQ ID NO: 7599377 - DNA, 22 bp, Homo sapiens
gccagtggcttgccaggcagga

SEQ ID NO: 7599378 - DNA, 22 bp, Homo sapiens
gccagtggcatgcggcagggac

SEQ ID NO: 7599379 - DNA, 22 bp, Homo sapiens
gccagtggcatgcggcagggac

SEQ ID NO: 7599380 - DNA, 22 bp, Homo sapiens
gccagtggcatgcggcagggac

SEQ ID NO: 7599381 - DNA, 22 bp, Homo sapiens
gccagtggaggacccatggaga

SEQ ID NO: 7599382 - DNA, 22 bp, Homo sapiens
gccagtggcatgcggcagggac

SEQ ID NO: 7599383 - DNA, 22 bp, Homo sapiens
gccagtggaggacccatggaga

SEQ ID NO: 7599384 - DNA, 22 bp, Homo sapiens
gcccacaggggacctggtggct

SEQ ID NO: 7599385 - DNA, 22 bp, Homo sapiens
gcccacaggtcctacctctttc

SEQ ID NO: 7599386 - DNA, 22 bp, Homo sapiens
gccagtggcttgccaggcagga

SEQ ID NO: 7599387 - DNA, 22 bp, Homo sapiens
gccagtggcttgccaggcagga

SEQ ID NO: 7599388 - DNA, 22 bp, Homo sapiens
gcccacagtacgaggctcaggc

SEQ ID NO: 7599389 - DNA, 22 bp, Homo sapiens
gcccacagtacgaggctcaggc

SEQ ID NO: 7599390 - DNA, 22 bp, Homo sapiens
gcccacagtacgaggctcaggc

SEQ ID NO: 7599391 - DNA, 22 bp, Homo sapiens
gcccacagtacgaggctcaggc

SEQ ID NO: 7599392 - DNA, 22 bp, Homo sapiens
gcccacagtacgaggctcaggc

SEQ ID NO: 7599393 - DNA, 22 bp, Homo sapiens
gcccacaggtcctacctctttc

SEQ ID NO: 7599394 - DNA, 22 bp, Homo sapiens
gcccacaggtcctacctctttc

SEQ ID NO: 7599395 - DNA, 22 bp, Homo sapiens
gcccacaggtcctacctctttc

SEQ ID NO: 7599396 - DNA, 22 bp, Homo sapiens
gcccactctggagcctgttccc

SEQ ID NO: 7599397 - DNA, 22 bp, Homo sapiens
gcccacagtacgaggctcaggc

SEQ ID NO: 7599398 - DNA, 22 bp, Homo sapiens
gcccacagtacgaggctcaggc

SEQ ID NO: 7599399 - DNA, 22 bp, Homo sapiens
gcccacagtacgaggctcaggc

SEQ ID NO: 7599400 - DNA, 22 bp, Homo sapiens
gccagtggagcacatggtgaag

SEQ ID NO: 7599401 - DNA, 22 bp, Homo sapiens
gccagtggagactgaaacccat

SEQ ID NO: 7599402 - DNA, 22 bp, Homo sapiens
gccagtggagcacatggtgaag

SEQ ID NO: 7599403 - DNA, 22 bp, Homo sapiens
gccagtggagactgaaacccat

SEQ ID NO: 7599404 - DNA, 22 bp, Homo sapiens
gccagtgcttgtggagctggca

SEQ ID NO: 7599405 - DNA, 22 bp, Homo sapiens
gccagtgcttgtggagctggca

SEQ ID NO: 7599406 - DNA, 22 bp, Homo sapiens
gccagtgcttgtggagctggca

SEQ ID NO: 7599407 - DNA, 21 bp, Homo sapiens
gccagtgctgtctgtgtgatc

SEQ ID NO: 7599408 - DNA, 22 bp, Homo sapiens
gccagtgcttgtggagctggca

SEQ ID NO: 7599409 - DNA, 22 bp, Homo sapiens
gccagtggagactgaaacccat

SEQ ID NO: 7599410 - DNA, 21 bp, Homo sapiens
gccagtgctgtctgtgtgatc

SEQ ID NO: 7599411 - DNA, 22 bp, Homo sapiens
gccagtgcctgctgctcagggc

SEQ ID NO: 7599412 - DNA, 22 bp, Homo sapiens
gccagtgcctgctgctcagggc

SEQ ID NO: 7599413 - DNA, 22 bp, Homo sapiens
gccagtgcctgctgctcagggc

SEQ ID NO: 7599414 - DNA, 22 bp, Homo sapiens
gccagtgcctgctgctcagggc

SEQ ID NO: 7599415 - DNA, 18 bp, Homo sapiens
gccagtgccctggctcac

SEQ ID NO: 7599416 - DNA, 18 bp, Homo sapiens
gccagtgccctggctcac

SEQ ID NO: 7599417 - DNA, 22 bp, Homo sapiens
gccagtcttcatattcatggtg

SEQ ID NO: 7599418 - DNA, 22 bp, Homo sapiens
gccagtgcctcgccgcgctcct

SEQ ID NO: 7599419 - DNA, 20 bp, Homo sapiens
gccagtaccattctgccact

SEQ ID NO: 7599420 - DNA, 22 bp, Homo sapiens
gccaggttctggggaggtacaa

SEQ ID NO: 7599421 - DNA, 22 bp, Homo sapiens
gccaggttgctgacgacgatct

SEQ ID NO: 7599422 - DNA, 22 bp, Homo sapiens
gccaggttgctgacgacgatct

SEQ ID NO: 7599423 - DNA, 22 bp, Homo sapiens
gccaggttgctgacgacgatct

SEQ ID NO: 7599424 - DNA, 22 bp, Homo sapiens
gccaggttgctgacgacgatct

SEQ ID NO: 7599425 - DNA, 22 bp, Homo sapiens
gccaggttgctgacgacgatct

SEQ ID NO: 7599426 - DNA, 22 bp, Homo sapiens
gccagtctgctcccacaagttc

SEQ ID NO: 7599427 - DNA, 22 bp, Homo sapiens
gccagtcttcatattcatggtg

SEQ ID NO: 7599428 - DNA, 22 bp, Homo sapiens
gccagtctgataggggagaagt

SEQ ID NO: 7599429 - DNA, 22 bp, Homo sapiens
gccagtctgataggggagaagt

SEQ ID NO: 7599430 - DNA, 22 bp, Homo sapiens
gccagtcagctggccaggctgg

SEQ ID NO: 7599431 - DNA, 22 bp, Homo sapiens
gccagtcagctggccaggctgg

SEQ ID NO: 7599432 - DNA, 18 bp, Homo sapiens
gccagtcagtctttggta

SEQ ID NO: 7599433 - DNA, 18 bp, Homo sapiens
gccagtcagtctttggta

SEQ ID NO: 7599434 - DNA, 22 bp, Homo sapiens
gccagtctccctcagtcctctg

SEQ ID NO: 7599435 - DNA, 22 bp, Homo sapiens
gccagcaggtggagagatcaag

SEQ ID NO: 7599436 - DNA, 22 bp, Homo sapiens
gccagcaggtggagagatcaag

SEQ ID NO: 7599437 - DNA, 22 bp, Homo sapiens
gccagcaggtggagagatcaag

SEQ ID NO: 7599438 - DNA, 22 bp, Homo sapiens
gccagcaggtggagagatcaag

SEQ ID NO: 7599439 - DNA, 22 bp, Homo sapiens
gccagcaggttgtcaaggagct

SEQ ID NO: 7599440 - DNA, 22 bp, Homo sapiens
gccagcaggttgtcaaggagct

SEQ ID NO: 7599441 - DNA, 22 bp, Homo sapiens
gccagcaggttgtcaaggagct

SEQ ID NO: 7599442 - DNA, 22 bp, Homo sapiens
gccagcaggttgtcaaggagct

SEQ ID NO: 7599443 - DNA, 22 bp, Homo sapiens
gccagcaggttgtcaaggagct

SEQ ID NO: 7599444 - DNA, 22 bp, Homo sapiens
gccagcaggttgtcaaggagct

SEQ ID NO: 7599445 - DNA, 22 bp, Homo sapiens
gccagcaggttgtcaaggagct

SEQ ID NO: 7599446 - DNA, 22 bp, Homo sapiens
gccagcaggttgtcaaggagct

SEQ ID NO: 7599447 - DNA, 22 bp, Homo sapiens
gccagcagtatgtcctggcagt

SEQ ID NO: 7599448 - DNA, 22 bp, Homo sapiens
gccagcagtatgtcctggcagt

SEQ ID NO: 7599449 - DNA, 22 bp, Homo sapiens
gccagcagtatgtcctggcagt

SEQ ID NO: 7599450 - DNA, 22 bp, Homo sapiens
gccagcagtatgtcctggcagt

SEQ ID NO: 7599451 - DNA, 22 bp, Homo sapiens
gccagcagtatgtcctggcagt

SEQ ID NO: 7599452 - DNA, 22 bp, Homo sapiens
gccagcagggcggagccatcta

SEQ ID NO: 7599453 - DNA, 22 bp, Homo sapiens
gccagcagggcggagccatcta

SEQ ID NO: 7599454 - DNA, 22 bp, Homo sapiens
gccagcaggtggagagatcaag

SEQ ID NO: 7599455 - DNA, 22 bp, Homo sapiens
gccagcaggtggagagatcaag

SEQ ID NO: 7599456 - DNA, 22 bp, Homo sapiens
gccagcaggtggagagatcaag

SEQ ID NO: 7599457 - DNA, 22 bp, Homo sapiens
gccagcagggcggagccatcta

SEQ ID NO: 7599458 - DNA, 22 bp, Homo sapiens
gccagcagggcggagccatcta

SEQ ID NO: 7599459 - DNA, 22 bp, Homo sapiens
gccagcagggcggagccatcta

SEQ ID NO: 7599460 - DNA, 22 bp, Homo sapiens
gccagcagggcggagccatcta

SEQ ID NO: 7599461 - DNA, 22 bp, Homo sapiens
gccagcagggcggagccatcta

SEQ ID NO: 7599462 - DNA, 22 bp, Homo sapiens
gccagcagggcccaaatgctgg

SEQ ID NO: 7599463 - DNA, 22 bp, Homo sapiens
gccagaggcccaaggacagctg

SEQ ID NO: 7599464 - DNA, 22 bp, Homo sapiens
gccagaggcccaaggacagctg

SEQ ID NO: 7599465 - DNA, 22 bp, Homo sapiens
gccagaggcccaaggacagctg

SEQ ID NO: 7599466 - DNA, 22 bp, Homo sapiens
gccagaggcccaaggacagctg

SEQ ID NO: 7599467 - DNA, 22 bp, Homo sapiens
gccagaggcccaaggacagctg

SEQ ID NO: 7599468 - DNA, 22 bp, Homo sapiens
gccagaggcccaaggacagctg

SEQ ID NO: 7599469 - DNA, 22 bp, Homo sapiens
gccagaggaacgctgcgcgccc

SEQ ID NO: 7599470 - DNA, 22 bp, Homo sapiens
gccagaggaacgctgcgcgccc

SEQ ID NO: 7599471 - DNA, 22 bp, Homo sapiens
gccagaggcccaaggacagctg

SEQ ID NO: 7599472 - DNA, 22 bp, Homo sapiens
gccagaggcccaaggacagctg

SEQ ID NO: 7599473 - DNA, 22 bp, Homo sapiens
gccagaggcccaaggacagctg

SEQ ID NO: 7599474 - DNA, 22 bp, Homo sapiens
gccagaggcccaaggacagctg

SEQ ID NO: 7599475 - DNA, 22 bp, Homo sapiens
gccagaggcccaaggacagctg

SEQ ID NO: 7599476 - DNA, 22 bp, Homo sapiens
gccagaggcccaaggacagctg

SEQ ID NO: 7599477 - DNA, 22 bp, Homo sapiens
gccagaggcccaaggacagctg

SEQ ID NO: 7599478 - DNA, 22 bp, Homo sapiens
gccagaggcccaaggacagctg

SEQ ID NO: 7599479 - DNA, 22 bp, Homo sapiens
gccagaggcccaaggacagctg

SEQ ID NO: 7599480 - DNA, 22 bp, Homo sapiens
gccagaggaacgctgcgcgccc

SEQ ID NO: 7599481 - DNA, 22 bp, Homo sapiens
gccagaggaacgctgcgcgccc

SEQ ID NO: 7599482 - DNA, 22 bp, Homo sapiens
gccagaggaacgctgcgcgccc

SEQ ID NO: 7599483 - DNA, 23 bp, Homo sapiens
gccagaggaacgcagagctttct

SEQ ID NO: 7599484 - DNA, 23 bp, Homo sapiens
gccagaggaacgcagagctttct

SEQ ID NO: 7599485 - DNA, 23 bp, Homo sapiens
gccagaggaacgcagagctttct

SEQ ID NO: 7599486 - DNA, 23 bp, Homo sapiens
gccagaggaacgcagagctttct

SEQ ID NO: 7599487 - DNA, 23 bp, Homo sapiens
gccagaggaacgcagagctttct

SEQ ID NO: 7599488 - DNA, 23 bp, Homo sapiens
gccagaggaacgcagagctttct

SEQ ID NO: 7599489 - DNA, 23 bp, Homo sapiens
gccagaggaacgcagagctttct

SEQ ID NO: 7599490 - DNA, 23 bp, Homo sapiens
gccagagctgcctgcccttgctg

SEQ ID NO: 7599491 - DNA, 23 bp, Homo sapiens
gccagagctgcctgcccttgctg

SEQ ID NO: 7599492 - DNA, 22 bp, Homo sapiens
gccagagcttcccccgagtgtg

SEQ ID NO: 7599493 - DNA, 22 bp, Homo sapiens
gccagagcttcccccgagtgtg

SEQ ID NO: 7599494 - DNA, 22 bp, Homo sapiens
gccagagcttcccccgagtgtg

SEQ ID NO: 7599495 - DNA, 23 bp, Homo sapiens
gccagaggaacgcagagctttct

SEQ ID NO: 7599496 - DNA, 22 bp, Homo sapiens
gccagagcttggtttttattta

SEQ ID NO: 7599497 - DNA, 22 bp, Homo sapiens
gccagagcttcccccgagtgtg

SEQ ID NO: 7599498 - DNA, 22 bp, Homo sapiens
gccagagcttcccccgagtgtg

SEQ ID NO: 7599499 - DNA, 22 bp, Homo sapiens
gccagagctgagtgaggttctt

SEQ ID NO: 7599500 - DNA, 22 bp, Homo sapiens
gccagagctgagacacgagtcc

SEQ ID NO: 7599501 - DNA, 22 bp, Homo sapiens
gccagagctgagtgaggttctt

SEQ ID NO: 7599502 - DNA, 22 bp, Homo sapiens
gccagagctgagtgaggttctt

SEQ ID NO: 7599503 - DNA, 23 bp, Homo sapiens
gccagagctgcctgcccttgctg

SEQ ID NO: 7599504 - DNA, 22 bp, Homo sapiens
gccagagctgagacacgagtcc

SEQ ID NO: 7599505 - DNA, 22 bp, Homo sapiens
gccagagctgagacacgagtcc

SEQ ID NO: 7599506 - DNA, 22 bp, Homo sapiens
gccagagctgagacacgagtcc

SEQ ID NO: 7599507 - DNA, 22 bp, Homo sapiens
gccagagctgagacacgagtcc

SEQ ID NO: 7599508 - DNA, 22 bp, Homo sapiens
gccagagctgagacacgagtcc

SEQ ID NO: 7599509 - DNA, 22 bp, Homo sapiens
gccagcccagctccaggggaaa

SEQ ID NO: 7599510 - DNA, 22 bp, Homo sapiens
gccagcccagctccaggggaaa

SEQ ID NO: 7599511 - DNA, 22 bp, Homo sapiens
gccagcccagctccaggggaaa

SEQ ID NO: 7599512 - DNA, 22 bp, Homo sapiens
gccagcccagctccaggggaaa

SEQ ID NO: 7599513 - DNA, 22 bp, Homo sapiens
gccagcccattaacccctgtcc

SEQ ID NO: 7599514 - DNA, 22 bp, Homo sapiens
gccagcccattaacccctgtcc

SEQ ID NO: 7599515 - DNA, 22 bp, Homo sapiens
gccagcccattaacccctgtcc

SEQ ID NO: 7599516 - DNA, 22 bp, Homo sapiens
gccagcccattaacccctgtcc

SEQ ID NO: 7599517 - DNA, 21 bp, Homo sapiens
gccagccatgcttgcctaggc

SEQ ID NO: 7599518 - DNA, 22 bp, Homo sapiens
gccagccataggccagcactgg

SEQ ID NO: 7599519 - DNA, 22 bp, Homo sapiens
gccagccataggccagcactgg

SEQ ID NO: 7599520 - DNA, 22 bp, Homo sapiens
gccagcccagctccaggggaaa

SEQ ID NO: 7599521 - DNA, 22 bp, Homo sapiens
gccagcccagctccaggggaaa

SEQ ID NO: 7599522 - DNA, 22 bp, Homo sapiens
gccagcccagctccaggggaaa

SEQ ID NO: 7599523 - DNA, 21 bp, Homo sapiens
gccagccatgcttgcctaggc

SEQ ID NO: 7599524 - DNA, 21 bp, Homo sapiens
gccagccatgcttgcctaggc

SEQ ID NO: 7599525 - DNA, 22 bp, Homo sapiens
gccagccccttagggctctccc

SEQ ID NO: 7599526 - DNA, 22 bp, Homo sapiens
gccagcccctccatcctgttca

SEQ ID NO: 7599527 - DNA, 22 bp, Homo sapiens
gccagcccctccatcctgttca

SEQ ID NO: 7599528 - DNA, 22 bp, Homo sapiens
gccagccccttagggctctccc

SEQ ID NO: 7599529 - DNA, 22 bp, Homo sapiens
gccagccccttagggctctccc

SEQ ID NO: 7599530 - DNA, 22 bp, Homo sapiens
gccagccccttagggctctccc

SEQ ID NO: 7599531 - DNA, 22 bp, Homo sapiens
gccagccccttagggctctccc

SEQ ID NO: 7599532 - DNA, 22 bp, Homo sapiens
gccagccccttagggctctccc

SEQ ID NO: 7599533 - DNA, 22 bp, Homo sapiens
gccagccccttagggctctccc

SEQ ID NO: 7599534 - DNA, 22 bp, Homo sapiens
gccagccccttagggctctccc

SEQ ID NO: 7599535 - DNA, 22 bp, Homo sapiens
gccagccccttagggctctccc

SEQ ID NO: 7599536 - DNA, 22 bp, Homo sapiens
gccagccccttagggctctccc

SEQ ID NO: 7599537 - DNA, 22 bp, Homo sapiens
gccagccccagacatcctatcg

SEQ ID NO: 7599538 - DNA, 22 bp, Homo sapiens
gccagcccctccatcctgttca

SEQ ID NO: 7599539 - DNA, 22 bp, Homo sapiens
gccagcccctccatcctgttca

SEQ ID NO: 7599540 - DNA, 22 bp, Homo sapiens
gccagccccagacatcctatcg

SEQ ID NO: 7599541 - DNA, 22 bp, Homo sapiens
gccagccccagacatcctatcg

SEQ ID NO: 7599542 - DNA, 22 bp, Homo sapiens
gccagcccagctccaggggaaa

SEQ ID NO: 7599543 - DNA, 22 bp, Homo sapiens
gccagcccattaacccctgtcc

SEQ ID NO: 7599544 - DNA, 22 bp, Homo sapiens
gccagccccagacatcctatcg

SEQ ID NO: 7599545 - DNA, 22 bp, Homo sapiens
gccagccccagacatcctatcg

SEQ ID NO: 7599546 - DNA, 22 bp, Homo sapiens
gccagcagtcctgctgtgtgcc

SEQ ID NO: 7599547 - DNA, 22 bp, Homo sapiens
gccagcagtggccaccaccagg

SEQ ID NO: 7599548 - DNA, 22 bp, Homo sapiens
gccagcagtggccaccaccagg

SEQ ID NO: 7599549 - DNA, 22 bp, Homo sapiens
gccagcagtggccaccaccagg

SEQ ID NO: 7599550 - DNA, 23 bp, Homo sapiens
gccagcatagatcattctgagta

SEQ ID NO: 7599551 - DNA, 23 bp, Homo sapiens
gccagcatagatcattctgagta

SEQ ID NO: 7599552 - DNA, 22 bp, Homo sapiens
gccagcattccttggctcctgg

SEQ ID NO: 7599553 - DNA, 22 bp, Homo sapiens
gccagccataggccagcactgg

SEQ ID NO: 7599554 - DNA, 22 bp, Homo sapiens
gccagccaagattgagaaggta

SEQ ID NO: 7599555 - DNA, 22 bp, Homo sapiens
gccagcatagtaagcagtcatc

SEQ ID NO: 7599556 - DNA, 22 bp, Homo sapiens
gccagcatagtaagcagtcatc

SEQ ID NO: 7599557 - DNA, 22 bp, Homo sapiens
gccagcatcctgcattagggtg

SEQ ID NO: 7599558 - DNA, 22 bp, Homo sapiens
gccagcatcctggtggtggttg

SEQ ID NO: 7599559 - DNA, 22 bp, Homo sapiens
gccagcatcctggtggtggttg

SEQ ID NO: 7599560 - DNA, 22 bp, Homo sapiens
gccagcatcctggtggtggttg

SEQ ID NO: 7599561 - DNA, 22 bp, Homo sapiens
gccagcagtcctgctgtgtgcc

SEQ ID NO: 7599562 - DNA, 22 bp, Homo sapiens
gccagcagtcctgctgtgtgcc

SEQ ID NO: 7599563 - DNA, 22 bp, Homo sapiens
gccagcagtcctgctgtgtgcc

SEQ ID NO: 7599564 - DNA, 22 bp, Homo sapiens
gccagcagtcctgctgtgtgcc

SEQ ID NO: 7599565 - DNA, 22 bp, Homo sapiens
gccagcagtcctgctgtgtgcc

SEQ ID NO: 7599566 - DNA, 22 bp, Homo sapiens
gccagcagtcctgctgtgtgcc

SEQ ID NO: 7599567 - DNA, 22 bp, Homo sapiens
gccagcagtcctgctgtgtgcc

SEQ ID NO: 7599568 - DNA, 22 bp, Homo sapiens
gccagcagtccagtccttagtg

SEQ ID NO: 7599569 - DNA, 22 bp, Homo sapiens
gccagcagtccagtccttagtg

SEQ ID NO: 7599570 - DNA, 22 bp, Homo sapiens
gccagcagtatgtcctggcagt

SEQ ID NO: 7599571 - DNA, 22 bp, Homo sapiens
gccagcagtatgtcctggcagt

SEQ ID NO: 7599572 - DNA, 22 bp, Homo sapiens
gccagcagtatgtcctggcagt

SEQ ID NO: 7599573 - DNA, 22 bp, Homo sapiens
gccagagcagaatagagtggcc

SEQ ID NO: 7599574 - DNA, 22 bp, Homo sapiens
gccagagcacaggctggtagta

SEQ ID NO: 7599575 - DNA, 22 bp, Homo sapiens
gccagagcacaggctggtagta

SEQ ID NO: 7599576 - DNA, 22 bp, Homo sapiens
gccagagcacaggctggtagta

SEQ ID NO: 7599577 - DNA, 22 bp, Homo sapiens
gccagagcacaggctggtagta

SEQ ID NO: 7599578 - DNA, 22 bp, Homo sapiens
gccagagaggccttagaatcca

SEQ ID NO: 7599579 - DNA, 22 bp, Homo sapiens
gccagagaggccttagaatcca

SEQ ID NO: 7599580 - DNA, 22 bp, Homo sapiens
gccagagaggccttagaatcca

SEQ ID NO: 7599581 - DNA, 22 bp, Homo sapiens
gccagagaggcaaatcctagca

SEQ ID NO: 7599582 - DNA, 22 bp, Homo sapiens
gccagagaggccgaggtaccca

SEQ ID NO: 7599583 - DNA, 22 bp, Homo sapiens
gccagagaggccgaggtaccca

SEQ ID NO: 7599584 - DNA, 22 bp, Homo sapiens
gccagagaggccgaggtaccca

SEQ ID NO: 7599585 - DNA, 22 bp, Homo sapiens
gccagagaggcctaaggccata

SEQ ID NO: 7599586 - DNA, 22 bp, Homo sapiens
gccagagaggcctaaggccata

SEQ ID NO: 7599587 - DNA, 22 bp, Homo sapiens
gccagagaggcctaaggccata

SEQ ID NO: 7599588 - DNA, 22 bp, Homo sapiens
gccagagaggcctaaggccata

SEQ ID NO: 7599589 - DNA, 22 bp, Homo sapiens
gccagagaggcctaaggccata

SEQ ID NO: 7599590 - DNA, 22 bp, Homo sapiens
gccagagagagtccctgggcct

SEQ ID NO: 7599591 - DNA, 22 bp, Homo sapiens
gccagagagagtccctgggcct

SEQ ID NO: 7599592 - DNA, 22 bp, Homo sapiens
gccagagagagtccctgggcct

SEQ ID NO: 7599593 - DNA, 22 bp, Homo sapiens
gccagagagatggaaaagctta

SEQ ID NO: 7599594 - DNA, 22 bp, Homo sapiens
gccagagagatggaaaagctta

SEQ ID NO: 7599595 - DNA, 22 bp, Homo sapiens
gccagagagatggaaaagctta

SEQ ID NO: 7599596 - DNA, 22 bp, Homo sapiens
gccagagaggcaaatcctagca

SEQ ID NO: 7599597 - DNA, 22 bp, Homo sapiens
gccagagagagtccctgggcct

SEQ ID NO: 7599598 - DNA, 22 bp, Homo sapiens
gccagagagactgatacatgct

SEQ ID NO: 7599599 - DNA, 22 bp, Homo sapiens
gccagagagactgatacatgct

SEQ ID NO: 7599600 - DNA, 22 bp, Homo sapiens
gccaagggtagtggaggcccct

SEQ ID NO: 7599601 - DNA, 22 bp, Homo sapiens
gccaagggtagtggaggcccct

SEQ ID NO: 7599602 - DNA, 22 bp, Homo sapiens
gccaagtcaggcagggcttctg

SEQ ID NO: 7599603 - DNA, 22 bp, Homo sapiens
gccaagtcaggcagggcttctg

SEQ ID NO: 7599604 - DNA, 22 bp, Homo sapiens
gccagagagactgatacatgct

SEQ ID NO: 7599605 - DNA, 22 bp, Homo sapiens
gccagagagactgatacatgct

SEQ ID NO: 7599606 - DNA, 22 bp, Homo sapiens
gccagagacacttggaggtaga

SEQ ID NO: 7599607 - DNA, 22 bp, Homo sapiens
gccaagggaactgagccggagg

SEQ ID NO: 7599608 - DNA, 22 bp, Homo sapiens
gccaagggaactgagccggagg

SEQ ID NO: 7599609 - DNA, 22 bp, Homo sapiens
gccaaggctgaggccctgggct

SEQ ID NO: 7599610 - DNA, 22 bp, Homo sapiens
gccaagggaactgagccggagg

SEQ ID NO: 7599611 - DNA, 22 bp, Homo sapiens
gccaagggggcagtgcatgggt

SEQ ID NO: 7599612 - DNA, 19 bp, Homo sapiens
gccaagggacttgcttctt

SEQ ID NO: 7599613 - DNA, 22 bp, Homo sapiens
gccaagggggcagtgcatgggt

SEQ ID NO: 7599614 - DNA, 22 bp, Homo sapiens
gccaagggggcagtgcatgggt

SEQ ID NO: 7599615 - DNA, 22 bp, Homo sapiens
gccaagggggcagtgcatgggt

SEQ ID NO: 7599616 - DNA, 21 bp, Homo sapiens
gccaagggggtagctattcct

SEQ ID NO: 7599617 - DNA, 22 bp, Homo sapiens
gccaagggtagtggaggcccct

SEQ ID NO: 7599618 - DNA, 22 bp, Homo sapiens
gccagagcatgcactgcctgca

SEQ ID NO: 7599619 - DNA, 22 bp, Homo sapiens
gccagagcatgcactgcctgca

SEQ ID NO: 7599620 - DNA, 22 bp, Homo sapiens
gccagagcatgcactgcctgca

SEQ ID NO: 7599621 - DNA, 22 bp, Homo sapiens
gccagagccacttttgggtgat

SEQ ID NO: 7599622 - DNA, 22 bp, Homo sapiens
gccagagcatgcactgcctgca

SEQ ID NO: 7599623 - DNA, 22 bp, Homo sapiens
gccagagccacttttgggtgat

SEQ ID NO: 7599624 - DNA, 22 bp, Homo sapiens
gccagagccggcttcacaggat

SEQ ID NO: 7599625 - DNA, 22 bp, Homo sapiens
gccagagccggcttcacaggat

SEQ ID NO: 7599626 - DNA, 22 bp, Homo sapiens
gccagagccacttttgggtgat

SEQ ID NO: 7599627 - DNA, 22 bp, Homo sapiens
gccagagccggcttcacaggat

SEQ ID NO: 7599628 - DNA, 22 bp, Homo sapiens
gccagagctgagacacgagtcc

SEQ ID NO: 7599629 - DNA, 22 bp, Homo sapiens
gccagagccggcttcacaggat

SEQ ID NO: 7599630 - DNA, 22 bp, Homo sapiens
gccagagcctgtggatttaacc

SEQ ID NO: 7599631 - DNA, 22 bp, Homo sapiens
gccagagccggcttcacaggat

SEQ ID NO: 7599632 - DNA, 22 bp, Homo sapiens
gccagagccggcttcacaggat

SEQ ID NO: 7599633 - DNA, 22 bp, Homo sapiens
gccagagcagaatagagtggcc

SEQ ID NO: 7599634 - DNA, 22 bp, Homo sapiens
gccagagcagaatagagtggcc

SEQ ID NO: 7599635 - DNA, 22 bp, Homo sapiens
gccagagcagaatagagtggcc

SEQ ID NO: 7599636 - DNA, 22 bp, Homo sapiens
gccagagcagaatagagtggcc

SEQ ID NO: 7599637 - DNA, 21 bp, Homo sapiens
gccagagcagtacaatgaggt

SEQ ID NO: 7599638 - DNA, 21 bp, Homo sapiens
gccagagcagtacaatgaggt

SEQ ID NO: 7599639 - DNA, 22 bp, Homo sapiens
gccagagcagaatagagtggcc

SEQ ID NO: 7599640 - DNA, 22 bp, Homo sapiens
gccagagcagaatagagtggcc

SEQ ID NO: 7599641 - DNA, 22 bp, Homo sapiens
gccagagcatgcactgcctgca

SEQ ID NO: 7599642 - DNA, 22 bp, Homo sapiens
gccagagcatcgcaccctccat

SEQ ID NO: 7599643 - DNA, 22 bp, Homo sapiens
gccagagcatcgcaccctccat

SEQ ID NO: 7599644 - DNA, 22 bp, Homo sapiens
gccagagcatcgcaccctccat

SEQ ID NO: 7599645 - DNA, 18 bp, Homo sapiens
gccagagcatatctccag

SEQ ID NO: 7599646 - DNA, 18 bp, Homo sapiens
gccagagcatatctccag

SEQ ID NO: 7599647 - DNA, 21 bp, Homo sapiens
gccagagcagtacaatgaggt

SEQ ID NO: 7599648 - DNA, 21 bp, Homo sapiens
gccagagcagtacaatgaggt

SEQ ID NO: 7599649 - DNA, 22 bp, Homo sapiens
gcattttaataagattcatagg

SEQ ID NO: 7599650 - DNA, 22 bp, Homo sapiens
gcattttaataagattcatagg

SEQ ID NO: 7599651 - DNA, 22 bp, Homo sapiens
gcattttaataagattcatagg

SEQ ID NO: 7599652 - DNA, 22 bp, Homo sapiens
gcatttgttgagttgccagcta

SEQ ID NO: 7599653 - DNA, 22 bp, Homo sapiens
gcatttgtttgggctaatctta

SEQ ID NO: 7599654 - DNA, 22 bp, Homo sapiens
gcatttgttccgctttgtcatc

SEQ ID NO: 7599655 - DNA, 22 bp, Homo sapiens
gcatttgttccgctttgtcatc

SEQ ID NO: 7599656 - DNA, 22 bp, Homo sapiens
gcatttgtgttcttcctagagc

SEQ ID NO: 7599657 - DNA, 22 bp, Homo sapiens
gcatttgtgttcttcctagagc

SEQ ID NO: 7599658 - DNA, 22 bp, Homo sapiens
gcatttgtgtggcggaaggatt

SEQ ID NO: 7599659 - DNA, 22 bp, Homo sapiens
gcattttaataagattcatagg

SEQ ID NO: 7599660 - DNA, 18 bp, Homo sapiens
gcattttaatctgaggca

SEQ ID NO: 7599661 - DNA, 18 bp, Homo sapiens
gcattttaatctgaggca

SEQ ID NO: 7599662 - DNA, 22 bp, Homo sapiens
gcattttaatgaggtttatgag

SEQ ID NO: 7599663 - DNA, 18 bp, Homo sapiens
gcattttaatctgaggca

SEQ ID NO: 7599664 - DNA, 18 bp, Homo sapiens
gcattttaatctgaggca

SEQ ID NO: 7599665 - DNA, 22 bp, Homo sapiens
gcattttaatgaggtttatgag

SEQ ID NO: 7599666 - DNA, 22 bp, Homo sapiens
gcattttataaagagttatttg

SEQ ID NO: 7599667 - DNA, 22 bp, Homo sapiens
gcattttataaagagttatttg

SEQ ID NO: 7599668 - DNA, 22 bp, Homo sapiens
gcattttagaatattggagcaa

SEQ ID NO: 7599669 - DNA, 22 bp, Homo sapiens
gcattttagaatattggagcaa

SEQ ID NO: 7599670 - DNA, 22 bp, Homo sapiens
gcatttttcatccctcttgggt

SEQ ID NO: 7599671 - DNA, 22 bp, Homo sapiens
gcatttttcatccctcttgggt

SEQ ID NO: 7599672 - DNA, 22 bp, Homo sapiens
gcatttttcatccctcttgggt

SEQ ID NO: 7599673 - DNA, 22 bp, Homo sapiens
gcatttttcatccctcttgggt

SEQ ID NO: 7599674 - DNA, 22 bp, Homo sapiens
gcatttttcatccctcttgggt

SEQ ID NO: 7599675 - DNA, 22 bp, Homo sapiens
gcatttttcatccctcttgggt

SEQ ID NO: 7599676 - DNA, 22 bp, Homo sapiens
gcatttttcatccctcttgggt

SEQ ID NO: 7599677 - DNA, 22 bp, Homo sapiens
gcatttttctaatcattggcat

SEQ ID NO: 7599678 - DNA, 22 bp, Homo sapiens
gcatttttctaatcattggcat

SEQ ID NO: 7599679 - DNA, 22 bp, Homo sapiens
gcatttttctaatcattggcat

SEQ ID NO: 7599680 - DNA, 22 bp, Homo sapiens
gcatttttctaatcattggcat

SEQ ID NO: 7599681 - DNA, 22 bp, Homo sapiens
gcatttttctaatcattggcat

SEQ ID NO: 7599682 - DNA, 22 bp, Homo sapiens
gcatttttctctcctataggag

SEQ ID NO: 7599683 - DNA, 22 bp, Homo sapiens
gcatttttctctcctataggag

SEQ ID NO: 7599684 - DNA, 22 bp, Homo sapiens
gcatttttctctcctataggag

SEQ ID NO: 7599685 - DNA, 22 bp, Homo sapiens
gcatttttctctcctataggag

SEQ ID NO: 7599686 - DNA, 22 bp, Homo sapiens
gccaaggcctctgcaggatgag

SEQ ID NO: 7599687 - DNA, 22 bp, Homo sapiens
gccaaggcctctgcaggatgag

SEQ ID NO: 7599688 - DNA, 22 bp, Homo sapiens
gccaaggcctctgcaggatgag

SEQ ID NO: 7599689 - DNA, 22 bp, Homo sapiens
gccaaggcctgcagcacctcat

SEQ ID NO: 7599690 - DNA, 22 bp, Homo sapiens
gccaaggcctgcagcacctcat

SEQ ID NO: 7599691 - DNA, 22 bp, Homo sapiens
gccaaggctgaggccctgggct

SEQ ID NO: 7599692 - DNA, 22 bp, Homo sapiens
gccaaggcctgcagcacctcat

SEQ ID NO: 7599693 - DNA, 22 bp, Homo sapiens
gccaaggctgaggccctgggct

SEQ ID NO: 7599694 - DNA, 22 bp, Homo sapiens
gccaaggcctctgcaggatgag

SEQ ID NO: 7599695 - DNA, 22 bp, Homo sapiens
gccaaggcctctgcaggatgag

SEQ ID NO: 7599696 - DNA, 22 bp, Homo sapiens
gccaaggcctctgcaggatgag

SEQ ID NO: 7599697 - DNA, 22 bp, Homo sapiens
gccaaggcctctgcaggatgag

SEQ ID NO: 7599698 - DNA, 22 bp, Homo sapiens
gccaaggataccagctgtgaga

SEQ ID NO: 7599699 - DNA, 22 bp, Homo sapiens
gccaaggataccagctgtgaga

SEQ ID NO: 7599700 - DNA, 21 bp, Homo sapiens
gccaaggaggctagagaacat

SEQ ID NO: 7599701 - DNA, 21 bp, Homo sapiens
gccaaggaggctagagaacat

SEQ ID NO: 7599702 - DNA, 20 bp, Homo sapiens
gccaaggaggagaaacaggc

SEQ ID NO: 7599703 - DNA, 20 bp, Homo sapiens
gccaaggaggagaaacaggc

SEQ ID NO: 7599704 - DNA, 22 bp, Homo sapiens
gccaaggaaggcttcctggaag

SEQ ID NO: 7599705 - DNA, 22 bp, Homo sapiens
gccaagctttgcaggagtgttg

SEQ ID NO: 7599706 - DNA, 22 bp, Homo sapiens
gccaaggagacacggtgttgta

SEQ ID NO: 7599707 - DNA, 22 bp, Homo sapiens
gccaaggaaggcttcctggaag

SEQ ID NO: 7599708 - DNA, 22 bp, Homo sapiens
gccaaggaaggcttcctggaag

SEQ ID NO: 7599709 - DNA, 22 bp, Homo sapiens
gccaagcttggaaggatcatgg

SEQ ID NO: 7599710 - DNA, 22 bp, Homo sapiens
gccaagcttatatgatgcttga

SEQ ID NO: 7599711 - DNA, 22 bp, Homo sapiens
gccaagctcaccttctgatgga

SEQ ID NO: 7599712 - DNA, 22 bp, Homo sapiens
gccaagcttggaaggatcatgg

SEQ ID NO: 7599713 - DNA, 22 bp, Homo sapiens
gccaagctctttaaaggccaaa

SEQ ID NO: 7599714 - DNA, 22 bp, Homo sapiens
gccaagctggatgaagaggttg

SEQ ID NO: 7599715 - DNA, 22 bp, Homo sapiens
gccaagctggatgaagaggttg

SEQ ID NO: 7599716 - DNA, 22 bp, Homo sapiens
gccaagctgtttttcagagacg

SEQ ID NO: 7599717 - DNA, 22 bp, Homo sapiens
gccaagctgtttttcagagacg

SEQ ID NO: 7599718 - DNA, 22 bp, Homo sapiens
gccaagcctgtagacacaagct

SEQ ID NO: 7599719 - DNA, 22 bp, Homo sapiens
gccaagctcaccttctgatgga

SEQ ID NO: 7599720 - DNA, 22 bp, Homo sapiens
gcatttttgatcccactaggat

SEQ ID NO: 7599721 - DNA, 22 bp, Homo sapiens
gcatttttgatcccactaggat

SEQ ID NO: 7599722 - DNA, 22 bp, Homo sapiens
gcatttttgatcccactaggat

SEQ ID NO: 7599723 - DNA, 22 bp, Homo sapiens
gcatttttgatcccactaggat

SEQ ID NO: 7599724 - DNA, 22 bp, Homo sapiens
gcatttttgatcccactaggat

SEQ ID NO: 7599725 - DNA, 22 bp, Homo sapiens
gcagtcctcatcctttagcagt

SEQ ID NO: 7599726 - DNA, 22 bp, Homo sapiens
gcagtcctcatcctttagcagt

SEQ ID NO: 7599727 - DNA, 22 bp, Homo sapiens
gcagtcctcatcctttagcagt

SEQ ID NO: 7599728 - DNA, 22 bp, Homo sapiens
gcagtcctcctgcctcagcctc

SEQ ID NO: 7599729 - DNA, 22 bp, Homo sapiens
gcagtcctcctgcctcagcctc

SEQ ID NO: 7599730 - DNA, 22 bp, Homo sapiens
gcagtcctctcattggcctcct

SEQ ID NO: 7599731 - DNA, 22 bp, Homo sapiens
gcagtcctctcattggcctcct

SEQ ID NO: 7599732 - DNA, 22 bp, Homo sapiens
gcagtcctcgtaaaggtcgaag

SEQ ID NO: 7599733 - DNA, 22 bp, Homo sapiens
gcagtcctgggattctgtcctt

SEQ ID NO: 7599734 - DNA, 22 bp, Homo sapiens
gcagtcctggaggaaggtgtga

SEQ ID NO: 7599735 - DNA, 22 bp, Homo sapiens
gcagtcctgggattctgtcctt

SEQ ID NO: 7599736 - DNA, 22 bp, Homo sapiens
gcagtcctgtagcgactttttt

SEQ ID NO: 7599737 - DNA, 22 bp, Homo sapiens
gcagtcctggaggaaggtgtga

SEQ ID NO: 7599738 - DNA, 22 bp, Homo sapiens
gcagtcctctcattggcctcct

SEQ ID NO: 7599739 - DNA, 22 bp, Homo sapiens
gcagtcctctcattggcctcct

SEQ ID NO: 7599740 - DNA, 20 bp, Homo sapiens
gcagtccagatgcttttaac

SEQ ID NO: 7599741 - DNA, 22 bp, Homo sapiens
gcagtccattgacagaggtctt

SEQ ID NO: 7599742 - DNA, 22 bp, Homo sapiens
gcagtccccgtcgtggcaggga

SEQ ID NO: 7599743 - DNA, 22 bp, Homo sapiens
gcagtccccgtcgtggcaggga

SEQ ID NO: 7599744 - DNA, 20 bp, Homo sapiens
gcagtcccatttctgagcct

SEQ ID NO: 7599745 - DNA, 20 bp, Homo sapiens
gcagtccagatgcttttaac

SEQ ID NO: 7599746 - DNA, 22 bp, Homo sapiens
gcagtccattgacagaggtctt

SEQ ID NO: 7599747 - DNA, 22 bp, Homo sapiens
gcagtcccatatctttaacata

SEQ ID NO: 7599748 - DNA, 22 bp, Homo sapiens
gcagtcctagggtgctctgcag

SEQ ID NO: 7599749 - DNA, 22 bp, Homo sapiens
gcagtcctagggtgctctgcag

SEQ ID NO: 7599750 - DNA, 22 bp, Homo sapiens
gcagtccccgtcgtggcaggga

SEQ ID NO: 7599751 - DNA, 22 bp, Homo sapiens
gcagtccgctcacccgcattgg

SEQ ID NO: 7599752 - DNA, 22 bp, Homo sapiens
gcagtcatttaacctctctgtg

SEQ ID NO: 7599753 - DNA, 22 bp, Homo sapiens
gcagtcatgggtagaactcaag

SEQ ID NO: 7599754 - DNA, 22 bp, Homo sapiens
gcagtccaaagtggctctcacc

SEQ ID NO: 7599755 - DNA, 22 bp, Homo sapiens
gcagtcatctgagctaactact

SEQ ID NO: 7599756 - DNA, 22 bp, Homo sapiens
gcagtcatggaaaaatgtatac

SEQ ID NO: 7599757 - DNA, 22 bp, Homo sapiens
gcagtcatcagtcctttaatta

SEQ ID NO: 7599758 - DNA, 19 bp, Homo sapiens
gcagtctgttgaagggcag

SEQ ID NO: 7599759 - DNA, 19 bp, Homo sapiens
gcagtctgttgaagggcag

SEQ ID NO: 7599760 - DNA, 19 bp, Homo sapiens
gcagtctgttgaagggcag

SEQ ID NO: 7599761 - DNA, 19 bp, Homo sapiens
gcagtctgttgaagggcag

SEQ ID NO: 7599762 - DNA, 19 bp, Homo sapiens
gcagtctgttgaagggcag

SEQ ID NO: 7599763 - DNA, 20 bp, Homo sapiens
gcagtctgtcacagagcatg

SEQ ID NO: 7599764 - DNA, 20 bp, Homo sapiens
gcagtctgtcacagagcatg

SEQ ID NO: 7599765 - DNA, 22 bp, Homo sapiens
gcagtcttgccacagggtttca

SEQ ID NO: 7599766 - DNA, 22 bp, Homo sapiens
gcagtcttgccacagggtttca

SEQ ID NO: 7599767 - DNA, 22 bp, Homo sapiens
gcagtcttgccacagggtttca

SEQ ID NO: 7599768 - DNA, 22 bp, Homo sapiens
gcagtctttgaatgtgaaatag

SEQ ID NO: 7599769 - DNA, 22 bp, Homo sapiens
gcagtctttgaatgtgaaatag

SEQ ID NO: 7599770 - DNA, 22 bp, Homo sapiens
gcagtctttgaatgtgaaatag

SEQ ID NO: 7599771 - DNA, 22 bp, Homo sapiens
gcagtctttgagtatcttcaaa

SEQ ID NO: 7599772 - DNA, 18 bp, Homo sapiens
gcagtctctctggtcttc

SEQ ID NO: 7599773 - DNA, 18 bp, Homo sapiens
gcagtctctctggtcttc

SEQ ID NO: 7599774 - DNA, 20 bp, Homo sapiens
gcagtctgcctctgtgtggt

SEQ ID NO: 7599775 - DNA, 20 bp, Homo sapiens
gcagtctgcctctgtgtggt

SEQ ID NO: 7599776 - DNA, 20 bp, Homo sapiens
gcagtctgcctctgtgtggt

SEQ ID NO: 7599777 - DNA, 20 bp, Homo sapiens
gcagtctgcctctgtgtggt

SEQ ID NO: 7599778 - DNA, 22 bp, Homo sapiens
gcagtctctcaggatttaagct

SEQ ID NO: 7599779 - DNA, 22 bp, Homo sapiens
gcagtctccatatacatttaca

SEQ ID NO: 7599780 - DNA, 22 bp, Homo sapiens
gcagtccttaggagaggaagta

SEQ ID NO: 7599781 - DNA, 22 bp, Homo sapiens
gcagtctataaatcagctttgc

SEQ ID NO: 7599782 - DNA, 22 bp, Homo sapiens
gcagtctatcttgtgatttaac

SEQ ID NO: 7599783 - DNA, 17 bp, Homo sapiens
gcagtgaaaagagatca

SEQ ID NO: 7599784 - DNA, 22 bp, Homo sapiens
gcagtgaacataacacagaagg

SEQ ID NO: 7599785 - DNA, 22 bp, Homo sapiens
gcagtgaacataacacagaagg

SEQ ID NO: 7599786 - DNA, 22 bp, Homo sapiens
gcagtgaacataacacagaagg

SEQ ID NO: 7599787 - DNA, 18 bp, Homo sapiens
gcagtgaagaaagagctt

SEQ ID NO: 7599788 - DNA, 22 bp, Homo sapiens
gcagtgaagatttgggctctgg

SEQ ID NO: 7599789 - DNA, 17 bp, Homo sapiens
gcagtgaaaagagatca

SEQ ID NO: 7599790 - DNA, 22 bp, Homo sapiens
gcagtgaaaaagtgcaccctgt

SEQ ID NO: 7599791 - DNA, 17 bp, Homo sapiens
gcagtgaaaagagatca

SEQ ID NO: 7599792 - DNA, 22 bp, Homo sapiens
gcagtgaaaaagtgcaccctgt

SEQ ID NO: 7599793 - DNA, 22 bp, Homo sapiens
gcagtgaaaaagtgcaccctgt

SEQ ID NO: 7599794 - DNA, 22 bp, Homo sapiens
gcagtctttttcttctagctaa

SEQ ID NO: 7599795 - DNA, 22 bp, Homo sapiens
gcagtcttttctgtgactggct

SEQ ID NO: 7599796 - DNA, 22 bp, Homo sapiens
gcagtcttttctgtgactggct

SEQ ID NO: 7599797 - DNA, 22 bp, Homo sapiens
gcagtcttttctgtgactggct

SEQ ID NO: 7599798 - DNA, 22 bp, Homo sapiens
gcagtctttttcttctagctaa

SEQ ID NO: 7599799 - DNA, 22 bp, Homo sapiens
gcagtcagtgttgactacatgc

SEQ ID NO: 7599800 - DNA, 22 bp, Homo sapiens
gcagtcagtgttgactacatgc

SEQ ID NO: 7599801 - DNA, 22 bp, Homo sapiens
gcagtcagtgttgactacatgc

SEQ ID NO: 7599802 - DNA, 22 bp, Homo sapiens
gcagtcataactaatattggtt

SEQ ID NO: 7599803 - DNA, 22 bp, Homo sapiens
gcagtcagtaaggcagccagaa

SEQ ID NO: 7599804 - DNA, 22 bp, Homo sapiens
gcagtcagtctcttgccttgag

SEQ ID NO: 7599805 - DNA, 22 bp, Homo sapiens
gcagtcagtaaggcagccagaa

SEQ ID NO: 7599806 - DNA, 22 bp, Homo sapiens
gcagtcaggttaaggccttccc

SEQ ID NO: 7599807 - DNA, 22 bp, Homo sapiens
gcagtcaggttaaggccttccc

SEQ ID NO: 7599808 - DNA, 22 bp, Homo sapiens
gcagtcagacaggaggagctcc

SEQ ID NO: 7599809 - DNA, 22 bp, Homo sapiens
gcagtcagacaggaggagctcc

SEQ ID NO: 7599810 - DNA, 22 bp, Homo sapiens
gcagtcagacaggaggagctcc

SEQ ID NO: 7599811 - DNA, 21 bp, Homo sapiens
gcagtcactcggttggctacc

SEQ ID NO: 7599812 - DNA, 22 bp, Homo sapiens
gcagtcacagggagatggtgac

SEQ ID NO: 7599813 - DNA, 22 bp, Homo sapiens
gcagtcacagggagatggtgac

SEQ ID NO: 7599814 - DNA, 22 bp, Homo sapiens
gcagtcagacaggaggagctcc

SEQ ID NO: 7599815 - DNA, 22 bp, Homo sapiens
gcagtcagacaggaggagctcc

SEQ ID NO: 7599816 - DNA, 21 bp, Homo sapiens
gcagtcactcggttggctacc

SEQ ID NO: 7599817 - DNA, 21 bp, Homo sapiens
gcagtcactcggttggctacc

SEQ ID NO: 7599818 - DNA, 19 bp, Homo sapiens
gcagggctctcccagatgc

SEQ ID NO: 7599819 - DNA, 19 bp, Homo sapiens
gcagggctctcccagatgc

SEQ ID NO: 7599820 - DNA, 19 bp, Homo sapiens
gcagggctctcccagatgc

SEQ ID NO: 7599821 - DNA, 22 bp, Homo sapiens
gcagggctccccaggcccgagg

SEQ ID NO: 7599822 - DNA, 22 bp, Homo sapiens
gcagggctctgctgtagtccta

SEQ ID NO: 7599823 - DNA, 19 bp, Homo sapiens
gcagggctctcccagatgc

SEQ ID NO: 7599824 - DNA, 22 bp, Homo sapiens
gcagggctctgctgtagtccta

SEQ ID NO: 7599825 - DNA, 22 bp, Homo sapiens
gcagggctctgctgtagtccta

SEQ ID NO: 7599826 - DNA, 22 bp, Homo sapiens
gcagggctctgctgtagtccta

SEQ ID NO: 7599827 - DNA, 22 bp, Homo sapiens
gcagtatatggattttaaacat

SEQ ID NO: 7599828 - DNA, 22 bp, Homo sapiens
gcagtatatggattttaaacat

SEQ ID NO: 7599829 - DNA, 22 bp, Homo sapiens
gcagtattcattgtttccctga

SEQ ID NO: 7599830 - DNA, 22 bp, Homo sapiens
gcagtcacagggagatggtgac

SEQ ID NO: 7599831 - DNA, 22 bp, Homo sapiens
gcagtattgccctgcctgcagg

SEQ ID NO: 7599832 - DNA, 22 bp, Homo sapiens
gcagggctcattgccaggcatt

SEQ ID NO: 7599833 - DNA, 22 bp, Homo sapiens
gcagggctcattgccaggcatt

SEQ ID NO: 7599834 - DNA, 22 bp, Homo sapiens
gcagggctcattgccaggcatt

SEQ ID NO: 7599835 - DNA, 22 bp, Homo sapiens
gcagggctcattgccaggcatt

SEQ ID NO: 7599836 - DNA, 22 bp, Homo sapiens
gcagggctcattgccaggcatt

SEQ ID NO: 7599837 - DNA, 22 bp, Homo sapiens
gcagggctcattgccaggcatt

SEQ ID NO: 7599838 - DNA, 22 bp, Homo sapiens
gcagggctcattgccaggcatt

SEQ ID NO: 7599839 - DNA, 22 bp, Homo sapiens
gcagggctcattgccaggcatt

SEQ ID NO: 7599840 - DNA, 22 bp, Homo sapiens
gcagggctcattctagtacaat

SEQ ID NO: 7599841 - DNA, 22 bp, Homo sapiens
gcagggctccccaggcccgagg

SEQ ID NO: 7599842 - DNA, 22 bp, Homo sapiens
gcagggctccactgtggccaag

SEQ ID NO: 7599843 - DNA, 22 bp, Homo sapiens
gcagggctccactgtggccaag

SEQ ID NO: 7599844 - DNA, 22 bp, Homo sapiens
gcagggctccactgtggccaag

SEQ ID NO: 7599845 - DNA, 22 bp, Homo sapiens
gcagggctccactgtggccaag

SEQ ID NO: 7599846 - DNA, 22 bp, Homo sapiens
gcagggctccactgtggccaag

SEQ ID NO: 7599847 - DNA, 22 bp, Homo sapiens
gcagggctccactgtggccaag

SEQ ID NO: 7599848 - DNA, 22 bp, Homo sapiens
gcagggctcagccgctcccacc

SEQ ID NO: 7599849 - DNA, 22 bp, Homo sapiens
gcagggctcagccgctcccacc

SEQ ID NO: 7599850 - DNA, 22 bp, Homo sapiens
gcagggctcagccgctcccacc

SEQ ID NO: 7599851 - DNA, 22 bp, Homo sapiens
gcagggctcagccgctcccacc

SEQ ID NO: 7599852 - DNA, 22 bp, Homo sapiens
gcagggctcattgccaggcatt

SEQ ID NO: 7599853 - DNA, 22 bp, Homo sapiens
gcagggctcagccgctcccacc

SEQ ID NO: 7599854 - DNA, 22 bp, Homo sapiens
gcagggctcagccgctcccacc

SEQ ID NO: 7599855 - DNA, 22 bp, Homo sapiens
gcagggctcaacaggacacccc

SEQ ID NO: 7599856 - DNA, 22 bp, Homo sapiens
gcagggctcaacaggacacccc

SEQ ID NO: 7599857 - DNA, 22 bp, Homo sapiens
gcagggctcaacaggacacccc

SEQ ID NO: 7599858 - DNA, 19 bp, Homo sapiens
gcatctgcatgatggggtt

SEQ ID NO: 7599859 - DNA, 19 bp, Homo sapiens
gcatctgcatgatggggtt

SEQ ID NO: 7599860 - DNA, 22 bp, Homo sapiens
gcatctctttagaatcagatgg

SEQ ID NO: 7599861 - DNA, 20 bp, Homo sapiens
gcatctccagggctgtctcc

SEQ ID NO: 7599862 - DNA, 22 bp, Homo sapiens
gcatctgttagagtgtgcatgc

SEQ ID NO: 7599863 - DNA, 22 bp, Homo sapiens
gcatctgtgaatttgatataca

SEQ ID NO: 7599864 - DNA, 22 bp, Homo sapiens
gcatctgtgtttctagctagga

SEQ ID NO: 7599865 - DNA, 22 bp, Homo sapiens
gcatcttcacacaaagccagtg

SEQ ID NO: 7599866 - DNA, 22 bp, Homo sapiens
gcatctttagcctctccgtggc

SEQ ID NO: 7599867 - DNA, 23 bp, Homo sapiens
gcatcttaaaacctacatatgtg

SEQ ID NO: 7599868 - DNA, 22 bp, Homo sapiens
gcatctttctgtccattcagca

SEQ ID NO: 7599869 - DNA, 22 bp, Homo sapiens
gcatctttctgtccattcagca

SEQ ID NO: 7599870 - DNA, 22 bp, Homo sapiens
gcatgaaatgagcgaatataat

SEQ ID NO: 7599871 - DNA, 21 bp, Homo sapiens
gcatgaaaacagcctgtgctc

SEQ ID NO: 7599872 - DNA, 21 bp, Homo sapiens
gcatgaaaacagcctgtgctc

SEQ ID NO: 7599873 - DNA, 22 bp, Homo sapiens
gcatctttctgtccattcagca

SEQ ID NO: 7599874 - DNA, 21 bp, Homo sapiens
gcatgaaaacagcctgtgctc

SEQ ID NO: 7599875 - DNA, 22 bp, Homo sapiens
gcatctttctgtccattcagca

SEQ ID NO: 7599876 - DNA, 22 bp, Homo sapiens
gcatgaaatgagcgaatataat

SEQ ID NO: 7599877 - DNA, 20 bp, Homo sapiens
gcatgaggaatcattgcagc

SEQ ID NO: 7599878 - DNA, 22 bp, Homo sapiens
gcatgacagtcgaaaggttaac

SEQ ID NO: 7599879 - DNA, 22 bp, Homo sapiens
gcatgacatggcctgacttagg

SEQ ID NO: 7599880 - DNA, 22 bp, Homo sapiens
gcatgaggggggttaggaagtt

SEQ ID NO: 7599881 - DNA, 22 bp, Homo sapiens
gcatgaggggggttaggaagtt

SEQ ID NO: 7599882 - DNA, 20 bp, Homo sapiens
gcatgaggaatcattgcagc

SEQ ID NO: 7599883 - DNA, 20 bp, Homo sapiens
gcatgaggaatcattgcagc

SEQ ID NO: 7599884 - DNA, 20 bp, Homo sapiens
gcatgaggaatcattgcagc

SEQ ID NO: 7599885 - DNA, 22 bp, Homo sapiens
gcatgaggtttgggctctgtga

SEQ ID NO: 7599886 - DNA, 22 bp, Homo sapiens
gcatgaggttcttggccagcat

SEQ ID NO: 7599887 - DNA, 22 bp, Homo sapiens
gcatgaggttcttggccagcat

SEQ ID NO: 7599888 - DNA, 22 bp, Homo sapiens
gcatgatgaaggaggaggagtc

SEQ ID NO: 7599889 - DNA, 22 bp, Homo sapiens
gcatgataccataggttttgcc

SEQ ID NO: 7599890 - DNA, 22 bp, Homo sapiens
gcatgaggtttgggctctgtga

SEQ ID NO: 7599891 - DNA, 22 bp, Homo sapiens
gcatgaggttcttggccagcat

SEQ ID NO: 7599892 - DNA, 22 bp, Homo sapiens
gcatgaggttcttggccagcat

SEQ ID NO: 7599893 - DNA, 22 bp, Homo sapiens
gcatgattaatatgcttactgt

SEQ ID NO: 7599894 - DNA, 22 bp, Homo sapiens
gcatgcaaaaaatgtatttgtt

SEQ ID NO: 7599895 - DNA, 23 bp, Homo sapiens
gcatgcaaagaatataggtgttc

SEQ ID NO: 7599896 - DNA, 22 bp, Homo sapiens
gcatgatagctaactcccctca

SEQ ID NO: 7599897 - DNA, 22 bp, Homo sapiens
gcatgattaatatgcttactgt

SEQ ID NO: 7599898 - DNA, 22 bp, Homo sapiens
gcatgcaaatagtcatgcttcc

SEQ ID NO: 7599899 - DNA, 22 bp, Homo sapiens
gcatgcaaatagtcatgcttcc

SEQ ID NO: 7599900 - DNA, 22 bp, Homo sapiens
gcatgcaactcccagttctgcc

SEQ ID NO: 7599901 - DNA, 22 bp, Homo sapiens
gcatgcaaatagtcatgcttcc

SEQ ID NO: 7599902 - DNA, 22 bp, Homo sapiens
gcatttcatgtagattgagaac

SEQ ID NO: 7599903 - DNA, 22 bp, Homo sapiens
gcatgcaactcccagttctgcc

SEQ ID NO: 7599904 - DNA, 22 bp, Homo sapiens
gcatttctgtgcatacacatga

SEQ ID NO: 7599905 - DNA, 22 bp, Homo sapiens
gcatttctgtgcatacacatga

SEQ ID NO: 7599906 - DNA, 22 bp, Homo sapiens
gcatttctgtgcatacacatga

SEQ ID NO: 7599907 - DNA, 19 bp, Homo sapiens
gcatttctctttacagcca

SEQ ID NO: 7599908 - DNA, 19 bp, Homo sapiens
gcatttctctttacagcca

SEQ ID NO: 7599909 - DNA, 19 bp, Homo sapiens
gcatttctctttacagcca

SEQ ID NO: 7599910 - DNA, 19 bp, Homo sapiens
gcatttctctttacagcca

SEQ ID NO: 7599911 - DNA, 22 bp, Homo sapiens
gcatttcctgtgcttggcatat

SEQ ID NO: 7599912 - DNA, 22 bp, Homo sapiens
gcatttgtacaaaatgcagtag

SEQ ID NO: 7599913 - DNA, 22 bp, Homo sapiens
gcatttgtacaaaatgcagtag

SEQ ID NO: 7599914 - DNA, 21 bp, Homo sapiens
gcatttggttttgtcaatgct

SEQ ID NO: 7599915 - DNA, 21 bp, Homo sapiens
gcatttggttttgtcaatgct

SEQ ID NO: 7599916 - DNA, 21 bp, Homo sapiens
gcatttggtgccctgtctgct

SEQ ID NO: 7599917 - DNA, 21 bp, Homo sapiens
gcatttggtgccctgtctgct

SEQ ID NO: 7599918 - DNA, 22 bp, Homo sapiens
gcatttggtttggctcaggcca

SEQ ID NO: 7599919 - DNA, 21 bp, Homo sapiens
gcatttggtgccctgtctgct

SEQ ID NO: 7599920 - DNA, 22 bp, Homo sapiens
gcatttggtttggctcaggcca

SEQ ID NO: 7599921 - DNA, 22 bp, Homo sapiens
gcatttggaattgtgtatagaa

SEQ ID NO: 7599922 - DNA, 22 bp, Homo sapiens
gcatttggaacttggttgagat

SEQ ID NO: 7599923 - DNA, 22 bp, Homo sapiens
gcatttggaacttggttgagat

SEQ ID NO: 7599924 - DNA, 18 bp, Homo sapiens
gcatttggtgagtttggc

SEQ ID NO: 7599925 - DNA, 22 bp, Homo sapiens
gcatttggtgatgcaccgttta

SEQ ID NO: 7599926 - DNA, 22 bp, Homo sapiens
gcatttggtgatgcaccgttta

SEQ ID NO: 7599927 - DNA, 22 bp, Homo sapiens
gcatttctgtgcatacacatga

SEQ ID NO: 7599928 - DNA, 22 bp, Homo sapiens
gcatttctgtgcatacacatga

SEQ ID NO: 7599929 - DNA, 22 bp, Homo sapiens
gcatttctgtgcatacacatga

SEQ ID NO: 7599930 - DNA, 22 bp, Homo sapiens
gcatttcttcctggtgtgagcc

SEQ ID NO: 7599931 - DNA, 22 bp, Homo sapiens
gcatttcttcctggtgtgagcc

SEQ ID NO: 7599932 - DNA, 22 bp, Homo sapiens
gcatttggaaaatgtttggctt

SEQ ID NO: 7599933 - DNA, 22 bp, Homo sapiens
gcatttggaaaatgtttggctt

SEQ ID NO: 7599934 - DNA, 22 bp, Homo sapiens
gcatttggaaaatgtttggctt

SEQ ID NO: 7599935 - DNA, 22 bp, Homo sapiens
gcatttggaacttggttgagat

SEQ ID NO: 7599936 - DNA, 22 bp, Homo sapiens
gcataaatgttctttcagattt

SEQ ID NO: 7599937 - DNA, 22 bp, Homo sapiens
gcataaatgttctttcagattt

SEQ ID NO: 7599938 - DNA, 22 bp, Homo sapiens
gcataacaaatatgctttaaat

SEQ ID NO: 7599939 - DNA, 22 bp, Homo sapiens
gcataaatgtgcacacacatgt

SEQ ID NO: 7599940 - DNA, 22 bp, Homo sapiens
gcataaatgtgcacacacatgt

SEQ ID NO: 7599941 - DNA, 22 bp, Homo sapiens
gcataaatgtgcacacacatgt

SEQ ID NO: 7599942 - DNA, 22 bp, Homo sapiens
gcataaatgtgcacacacatgt

SEQ ID NO: 7599943 - DNA, 22 bp, Homo sapiens
gcataattaaacaggcaagatt

SEQ ID NO: 7599944 - DNA, 22 bp, Homo sapiens
gcataatatacatgcttgatcc

SEQ ID NO: 7599945 - DNA, 18 bp, Homo sapiens
gcataatgtgtatattga

SEQ ID NO: 7599946 - DNA, 22 bp, Homo sapiens
gcataattaaacaggcaagatt

SEQ ID NO: 7599947 - DNA, 22 bp, Homo sapiens
gcataaacttaagattttgttt

SEQ ID NO: 7599948 - DNA, 22 bp, Homo sapiens
gcagtgaagatttgggctctgg

SEQ ID NO: 7599949 - DNA, 22 bp, Homo sapiens
gcagtgaagatttgggctctgg

SEQ ID NO: 7599950 - DNA, 19 bp, Homo sapiens
gcataaatacactattgtc

SEQ ID NO: 7599951 - DNA, 19 bp, Homo sapiens
gcataaatacactattgtc

SEQ ID NO: 7599952 - DNA, 19 bp, Homo sapiens
gcataaatacactattgtc

SEQ ID NO: 7599953 - DNA, 22 bp, Homo sapiens
gcatccagaggtagccactgtg

SEQ ID NO: 7599954 - DNA, 23 bp, Homo sapiens
gcatccagagctcagtccccttt

SEQ ID NO: 7599955 - DNA, 20 bp, Homo sapiens
gcatccagacacccagctgc

SEQ ID NO: 7599956 - DNA, 20 bp, Homo sapiens
gcatccagacacccagctgc

SEQ ID NO: 7599957 - DNA, 22 bp, Homo sapiens
gcatccaaatgtttcatttctt

SEQ ID NO: 7599958 - DNA, 22 bp, Homo sapiens
gcatccagaggtagccactgtg

SEQ ID NO: 7599959 - DNA, 22 bp, Homo sapiens
gcatccagaggtagccactgtg

SEQ ID NO: 7599960 - DNA, 22 bp, Homo sapiens
gcatccaggactatatgatgat

SEQ ID NO: 7599961 - DNA, 23 bp, Homo sapiens
gcatccagagctcagtccccttt

SEQ ID NO: 7599962 - DNA, 22 bp, Homo sapiens
gcatccagaggtagccactgtg

SEQ ID NO: 7599963 - DNA, 22 bp, Homo sapiens
gcatccaggctgcccctctgcg

SEQ ID NO: 7599964 - DNA, 22 bp, Homo sapiens
gcatccaggctgcccctctgcg

SEQ ID NO: 7599965 - DNA, 17 bp, Homo sapiens
gcatccagtaacatgcc

SEQ ID NO: 7599966 - DNA, 22 bp, Homo sapiens
gcatccaggctgcccctctgcg

SEQ ID NO: 7599967 - DNA, 22 bp, Homo sapiens
gcatccaggtagagcttgcggg

SEQ ID NO: 7599968 - DNA, 22 bp, Homo sapiens
gcatccagtcttggctcctgga

SEQ ID NO: 7599969 - DNA, 22 bp, Homo sapiens
gcatccagtcttggctcctgga

SEQ ID NO: 7599970 - DNA, 22 bp, Homo sapiens
gcatccagtcttggctcctgga

SEQ ID NO: 7599971 - DNA, 22 bp, Homo sapiens
gcatccagtcttggctcctgga

SEQ ID NO: 7599972 - DNA, 22 bp, Homo sapiens
gcatccctctgaggggccaggc

SEQ ID NO: 7599973 - DNA, 22 bp, Homo sapiens
gcatcccaaatctgaaagtcca

SEQ ID NO: 7599974 - DNA, 20 bp, Homo sapiens
gcatcctcccagcagagctg

SEQ ID NO: 7599975 - DNA, 20 bp, Homo sapiens
gcatcctcccagcagagctg

SEQ ID NO: 7599976 - DNA, 22 bp, Homo sapiens
gcatccctctgaggggccaggc

SEQ ID NO: 7599977 - DNA, 22 bp, Homo sapiens
gcatcctctgagagctctagat

SEQ ID NO: 7599978 - DNA, 22 bp, Homo sapiens
gcatcctcccggtgctgctggc

SEQ ID NO: 7599979 - DNA, 22 bp, Homo sapiens
gcatcctctgagagctctagat

SEQ ID NO: 7599980 - DNA, 22 bp, Homo sapiens
gcatcctggctctaggtgtcat

SEQ ID NO: 7599981 - DNA, 22 bp, Homo sapiens
gcatcctggctctaggtgtcat

SEQ ID NO: 7599982 - DNA, 22 bp, Homo sapiens
gcatccttaactctgtagatgc

SEQ ID NO: 7599983 - DNA, 22 bp, Homo sapiens
gcatcctggctctaggtgtcat

SEQ ID NO: 7599984 - DNA, 22 bp, Homo sapiens
gcatcctggctctaggtgtcat

SEQ ID NO: 7599985 - DNA, 22 bp, Homo sapiens
gcatccatgcatgcagggtgtg

SEQ ID NO: 7599986 - DNA, 22 bp, Homo sapiens
gcatccatcagcagattgactg

SEQ ID NO: 7599987 - DNA, 22 bp, Homo sapiens
gcatccagtcttggctcctgga

SEQ ID NO: 7599988 - DNA, 20 bp, Homo sapiens
gcatccatatatgcatgtgt

SEQ ID NO: 7599989 - DNA, 20 bp, Homo sapiens
gcatccatatatgcatgtgt

SEQ ID NO: 7599990 - DNA, 22 bp, Homo sapiens
gcatccatggagagcactctga

SEQ ID NO: 7599991 - DNA, 19 bp, Homo sapiens
gcatccatggaggccgctt

SEQ ID NO: 7599992 - DNA, 19 bp, Homo sapiens
gcatccatggaggccgctt

SEQ ID NO: 7599993 - DNA, 19 bp, Homo sapiens
gcatccatggaggccgctt

SEQ ID NO: 7599994 - DNA, 22 bp, Homo sapiens
gcatccattcactcaacttaga

SEQ ID NO: 7599995 - DNA, 22 bp, Homo sapiens
gcatccattgtttatgtgtttc

SEQ ID NO: 7599996 - DNA, 19 bp, Homo sapiens
gcatcgagccccaatcctg

SEQ ID NO: 7599997 - DNA, 20 bp, Homo sapiens
gcatcgagattcgttctttt

SEQ ID NO: 7599998 - DNA, 22 bp, Homo sapiens
gcatccttttttcctgccctgc

SEQ ID NO: 7599999 - DNA, 22 bp, Homo sapiens
gcatcctttcctttccattgtg

SEQ ID NO: 7600000 - DNA, 22 bp, Homo sapiens
gcatcctttcctttccattgtg

SEQ ID NO: 7600001 - DNA, 22 bp, Homo sapiens
gcatccttgggcccagctcctg

SEQ ID NO: 7600002 - DNA, 20 bp, Homo sapiens
gcatccttctcttccactcc

SEQ ID NO: 7600003 - DNA, 22 bp, Homo sapiens
gcatccttgggcccagctcctg

SEQ ID NO: 7600004 - DNA, 22 bp, Homo sapiens
gcatccttctcattcccaagct

SEQ ID NO: 7600005 - DNA, 20 bp, Homo sapiens
gcatccttctcttccactcc

SEQ ID NO: 7600006 - DNA, 22 bp, Homo sapiens
gcatccttctcattcccaagct

SEQ ID NO: 7600007 - DNA, 22 bp, Homo sapiens
gcatccttaatccacatcagag

SEQ ID NO: 7600008 - DNA, 22 bp, Homo sapiens
gcatccttaatccacatcagag

SEQ ID NO: 7600009 - DNA, 20 bp, Homo sapiens
gcatctccagggctgtctcc

SEQ ID NO: 7600010 - DNA, 20 bp, Homo sapiens
gcatctccagggctgtctcc

SEQ ID NO: 7600011 - DNA, 22 bp, Homo sapiens
gcatctctacaacgaagacagt

SEQ ID NO: 7600012 - DNA, 22 bp, Homo sapiens
gcatctaaggtggataacttct

SEQ ID NO: 7600013 - DNA, 22 bp, Homo sapiens
gcatcggcgtctgttcaggttt

SEQ ID NO: 7600014 - DNA, 21 bp, Homo sapiens
gcatcgaggagcttcctgatg

SEQ ID NO: 7600015 - DNA, 22 bp, Homo sapiens
gcatctaaataaacgtgggagt

SEQ ID NO: 7600016 - DNA, 22 bp, Homo sapiens
cctgccttgacgtaacgcatga

SEQ ID NO: 7600017 - DNA, 22 bp, Homo sapiens
cctgccttctaaagcgcccgcc

SEQ ID NO: 7600018 - DNA, 22 bp, Homo sapiens
cctgccttcccagcttggcttt

SEQ ID NO: 7600019 - DNA, 22 bp, Homo sapiens
cctgccttctaaagcgcccgcc

SEQ ID NO: 7600020 - DNA, 22 bp, Homo sapiens
cctgcctttctcagtaatcttt

SEQ ID NO: 7600021 - DNA, 22 bp, Homo sapiens
cctgcctttctcagtaatcttt

SEQ ID NO: 7600022 - DNA, 22 bp, Homo sapiens
cctgccttgacgtaacgcatga

SEQ ID NO: 7600023 - DNA, 22 bp, Homo sapiens
cctgcgcgtctgggtctgtctc

SEQ ID NO: 7600024 - DNA, 22 bp, Homo sapiens
cctgcgcacagggcacccgaga

SEQ ID NO: 7600025 - DNA, 22 bp, Homo sapiens
cctgcgcgtctgggtctgtctc

SEQ ID NO: 7600026 - DNA, 18 bp, Homo sapiens
cctgcgctcaaggtgctc

SEQ ID NO: 7600027 - DNA, 22 bp, Homo sapiens
cctgctatcattctaggcttcc

SEQ ID NO: 7600028 - DNA, 22 bp, Homo sapiens
cctgctagagacctggtgtgta

SEQ ID NO: 7600029 - DNA, 22 bp, Homo sapiens
cctgctcacctgatgtggcaac

SEQ ID NO: 7600030 - DNA, 22 bp, Homo sapiens
cctgctaataaggtagaaatat

SEQ ID NO: 7600031 - DNA, 22 bp, Homo sapiens
cctgctagagacctggtgtgta

SEQ ID NO: 7600032 - DNA, 22 bp, Homo sapiens
cctgcgtccacggctgggagac

SEQ ID NO: 7600033 - DNA, 22 bp, Homo sapiens
cctgcgtccacggctgggagac

SEQ ID NO: 7600034 - DNA, 22 bp, Homo sapiens
cctgcgggctggtaagaggctt

SEQ ID NO: 7600035 - DNA, 22 bp, Homo sapiens
cctgcgggctgtgctgaagcct

SEQ ID NO: 7600036 - DNA, 22 bp, Homo sapiens
cctgctcagctgtcctcacgct

SEQ ID NO: 7600037 - DNA, 22 bp, Homo sapiens
cctgctcagctgtcctcacgct

SEQ ID NO: 7600038 - DNA, 23 bp, Homo sapiens
cctgctcaggcgtgtgccctgct

SEQ ID NO: 7600039 - DNA, 22 bp, Homo sapiens
cctgctcatgggtccctggcag

SEQ ID NO: 7600040 - DNA, 22 bp, Homo sapiens
cctgctcatgggtccctggcag

SEQ ID NO: 7600041 - DNA, 22 bp, Homo sapiens
cctgctccatgctcaccatcag

SEQ ID NO: 7600042 - DNA, 22 bp, Homo sapiens
cctgctcagccccagctcaccc

SEQ ID NO: 7600043 - DNA, 22 bp, Homo sapiens
cctgctcagctgtcctcacgct

SEQ ID NO: 7600044 - DNA, 22 bp, Homo sapiens
cctgctcagccccagctcaccc

SEQ ID NO: 7600045 - DNA, 22 bp, Homo sapiens
cctgctcagagcgtcttgtgtg

SEQ ID NO: 7600046 - DNA, 22 bp, Homo sapiens
tggttagatgaggctggtttca

SEQ ID NO: 7600047 - DNA, 23 bp, Homo sapiens
tggttacatagggcagatggcgc

SEQ ID NO: 7600048 - DNA, 22 bp, Homo sapiens
tggttagaggcttcttgcttgg

SEQ ID NO: 7600049 - DNA, 22 bp, Homo sapiens
tggttagactcaccttatagtt

SEQ ID NO: 7600050 - DNA, 22 bp, Homo sapiens
tggttcagatatggagctggga

SEQ ID NO: 7600051 - DNA, 22 bp, Homo sapiens
tggttataaaagtcctctcatt

SEQ ID NO: 7600052 - DNA, 22 bp, Homo sapiens
tggttataaattgctatgcaga

SEQ ID NO: 7600053 - DNA, 22 bp, Homo sapiens
tggttcatagcctcacaggata

SEQ ID NO: 7600054 - DNA, 22 bp, Homo sapiens
tggttcatagcctcacaggata

SEQ ID NO: 7600055 - DNA, 22 bp, Homo sapiens
tggttccaagatggctgccaca

SEQ ID NO: 7600056 - DNA, 22 bp, Homo sapiens
tggttcagttgcacaggctgtt

SEQ ID NO: 7600057 - DNA, 22 bp, Homo sapiens
tggttcataatttgcactactg

SEQ ID NO: 7600058 - DNA, 22 bp, Homo sapiens
tggttcaggcagggtgttgctg

SEQ ID NO: 7600059 - DNA, 22 bp, Homo sapiens
tggttcagttgcacaggctgtt

SEQ ID NO: 7600060 - DNA, 22 bp, Homo sapiens
tggttcagatatggagctggga

SEQ ID NO: 7600061 - DNA, 22 bp, Homo sapiens
tggttcagatatggagctggga

SEQ ID NO: 7600062 - DNA, 22 bp, Homo sapiens
cctgccttcccagcttggcttt

SEQ ID NO: 7600063 - DNA, 22 bp, Homo sapiens
tggttcctcaagcgctggcggc

SEQ ID NO: 7600064 - DNA, 22 bp, Homo sapiens
tggttcctcaagcgctggcggc

SEQ ID NO: 7600065 - DNA, 22 bp, Homo sapiens
tggttcctcaagcgctggcggc

SEQ ID NO: 7600066 - DNA, 22 bp, Homo sapiens
tggttcctacgcacattgaatt

SEQ ID NO: 7600067 - DNA, 22 bp, Homo sapiens
tggttcctcaagcgctggcggc

SEQ ID NO: 7600068 - DNA, 22 bp, Homo sapiens
tggttcctcaagcgctggcggc

SEQ ID NO: 7600069 - DNA, 22 bp, Homo sapiens
tggttcctcaagcgctggcggc

SEQ ID NO: 7600070 - DNA, 22 bp, Homo sapiens
tggttccaatcgcactggctca

SEQ ID NO: 7600071 - DNA, 22 bp, Homo sapiens
tggttccactaacctgagagcc

SEQ ID NO: 7600072 - DNA, 22 bp, Homo sapiens
tggttcccttaacagctgtata

SEQ ID NO: 7600073 - DNA, 22 bp, Homo sapiens
tgttgctactctccctgggagg

SEQ ID NO: 7600074 - DNA, 20 bp, Homo sapiens
tgttgctctctcctgagttt

SEQ ID NO: 7600075 - DNA, 22 bp, Homo sapiens
tgttgctgacaagagaggagca

SEQ ID NO: 7600076 - DNA, 22 bp, Homo sapiens
tgttgctcttttttaggtgagt

SEQ ID NO: 7600077 - DNA, 22 bp, Homo sapiens
tgttgcctggggaagctctgat

SEQ ID NO: 7600078 - DNA, 18 bp, Homo sapiens
tgttgcgagcataatgga

SEQ ID NO: 7600079 - DNA, 22 bp, Homo sapiens
tgttgcctgactttaaaatgtg

SEQ ID NO: 7600080 - DNA, 22 bp, Homo sapiens
tgttgcctaactgccctctgaa

SEQ ID NO: 7600081 - DNA, 22 bp, Homo sapiens
tgttgcccaggttctctcctgc

SEQ ID NO: 7600082 - DNA, 22 bp, Homo sapiens
tgttgcccaggttctctcctgc

SEQ ID NO: 7600083 - DNA, 22 bp, Homo sapiens
tgttgcccaggttctctcctgc

SEQ ID NO: 7600084 - DNA, 22 bp, Homo sapiens
tgttgcattgtactgaaaagcc

SEQ ID NO: 7600085 - DNA, 19 bp, Homo sapiens
tgttgccaggtatcatgtt

SEQ ID NO: 7600086 - DNA, 22 bp, Homo sapiens
tgttgcccaggttctctcctgc

SEQ ID NO: 7600087 - DNA, 22 bp, Homo sapiens
tgttgctgtatgaataggaagg

SEQ ID NO: 7600088 - DNA, 22 bp, Homo sapiens
tgttggaataagtgcttgaagg

SEQ ID NO: 7600089 - DNA, 22 bp, Homo sapiens
tgttggaaaagaattaactagg

SEQ ID NO: 7600090 - DNA, 19 bp, Homo sapiens
tgttggaggtgctgaatta

SEQ ID NO: 7600091 - DNA, 22 bp, Homo sapiens
tgttggagcccgagtcagggag

SEQ ID NO: 7600092 - DNA, 19 bp, Homo sapiens
tgttggaggtgctgaatta

SEQ ID NO: 7600093 - DNA, 22 bp, Homo sapiens
tgttggatgaccttgtaattat

SEQ ID NO: 7600094 - DNA, 22 bp, Homo sapiens
tgttggcactatctcatgtttt

SEQ ID NO: 7600095 - DNA, 20 bp, Homo sapiens
tgttggcaattgttgtttcc

SEQ ID NO: 7600096 - DNA, 20 bp, Homo sapiens
tgttggcaattgttgtttcc

SEQ ID NO: 7600097 - DNA, 22 bp, Homo sapiens
tgttggcatctctgagagagtt

SEQ ID NO: 7600098 - DNA, 22 bp, Homo sapiens
tgttggcagttggaagggagtg

SEQ ID NO: 7600099 - DNA, 22 bp, Homo sapiens
tgttggcagtgctacagtcagt

SEQ ID NO: 7600100 - DNA, 22 bp, Homo sapiens
tgttggcagtgctacagtcagt

SEQ ID NO: 7600101 - DNA, 22 bp, Homo sapiens
cctggggagaagagcttccccc

SEQ ID NO: 7600102 - DNA, 22 bp, Homo sapiens
tgttgattagtgtttagactta

SEQ ID NO: 7600103 - DNA, 22 bp, Homo sapiens
tgttgattagtgtttagactta

SEQ ID NO: 7600104 - DNA, 22 bp, Homo sapiens
tgttgattagtgtttagactta

SEQ ID NO: 7600105 - DNA, 20 bp, Homo sapiens
tgttgattggtgtcatctca

SEQ ID NO: 7600106 - DNA, 22 bp, Homo sapiens
tgttgatttgtgggctgcaaaa

SEQ ID NO: 7600107 - DNA, 20 bp, Homo sapiens
tgttgattggtgtcatctca

SEQ ID NO: 7600108 - DNA, 22 bp, Homo sapiens
tgttgcacggccttcacagagc

SEQ ID NO: 7600109 - DNA, 22 bp, Homo sapiens
tgttcccacaccagcctcagcc

SEQ ID NO: 7600110 - DNA, 22 bp, Homo sapiens
tgttgcagagctggggagggtg

SEQ ID NO: 7600111 - DNA, 22 bp, Homo sapiens
tgttgcagtagcagtagttgca

SEQ ID NO: 7600112 - DNA, 22 bp, Homo sapiens
tgttgcagtagcagtagttgca

SEQ ID NO: 7600113 - DNA, 22 bp, Homo sapiens
tgttgcagtaaaaatggagagg

SEQ ID NO: 7600114 - DNA, 22 bp, Homo sapiens
cctgctcccgggacgcgttcac

SEQ ID NO: 7600115 - DNA, 22 bp, Homo sapiens
cctgctcccgggacgcgttcac

SEQ ID NO: 7600116 - DNA, 22 bp, Homo sapiens
cctgctcctatctgggctcatt

SEQ ID NO: 7600117 - DNA, 22 bp, Homo sapiens
cctgctcctatctgggctcatt

SEQ ID NO: 7600118 - DNA, 22 bp, Homo sapiens
cctgctcctatctgggctcatt

SEQ ID NO: 7600119 - DNA, 22 bp, Homo sapiens
cctgctcctgctattcttctgg

SEQ ID NO: 7600120 - DNA, 22 bp, Homo sapiens
cctgctcctgctattcttctgg

SEQ ID NO: 7600121 - DNA, 20 bp, Homo sapiens
tgttccatgactatttggat

SEQ ID NO: 7600122 - DNA, 22 bp, Homo sapiens
tgttccatgtctttgtaggact

SEQ ID NO: 7600123 - DNA, 22 bp, Homo sapiens
tgttcccacaccagcctcagcc

SEQ ID NO: 7600124 - DNA, 22 bp, Homo sapiens
tgttgattagtgtttagactta

SEQ ID NO: 7600125 - DNA, 22 bp, Homo sapiens
tgttcccacaccagcctcagcc

SEQ ID NO: 7600126 - DNA, 22 bp, Homo sapiens
tgttcccacaccagcctcagcc

SEQ ID NO: 7600127 - DNA, 22 bp, Homo sapiens
tgttcccatggatatctgcata

SEQ ID NO: 7600128 - DNA, 22 bp, Homo sapiens
tgttcccatggatatctgcata

SEQ ID NO: 7600129 - DNA, 21 bp, Homo sapiens
tgttttccaccttgaggcaag

SEQ ID NO: 7600130 - DNA, 22 bp, Homo sapiens
tgttttccggcctcagcacgcc

SEQ ID NO: 7600131 - DNA, 22 bp, Homo sapiens
tgttttctagaaacaatgccta

SEQ ID NO: 7600132 - DNA, 22 bp, Homo sapiens
tgttttctagaaacaatgccta

SEQ ID NO: 7600133 - DNA, 21 bp, Homo sapiens
tgttttctaaagggcggatca

SEQ ID NO: 7600134 - DNA, 21 bp, Homo sapiens
tgttttctaaagggcggatca

SEQ ID NO: 7600135 - DNA, 22 bp, Homo sapiens
tgttttccggcctcagcacgcc

SEQ ID NO: 7600136 - DNA, 21 bp, Homo sapiens
tgttttctaaagggcggatca

SEQ ID NO: 7600137 - DNA, 21 bp, Homo sapiens
tgttttctaaagggcggatca

SEQ ID NO: 7600138 - DNA, 22 bp, Homo sapiens
tgttttcatttgatgtaacaaa

SEQ ID NO: 7600139 - DNA, 22 bp, Homo sapiens
tgttttcatttgatgtaacaaa

SEQ ID NO: 7600140 - DNA, 22 bp, Homo sapiens
tgttttcatttgatgtaacaaa

SEQ ID NO: 7600141 - DNA, 21 bp, Homo sapiens
tgttttccaccttgaggcaag

SEQ ID NO: 7600142 - DNA, 22 bp, Homo sapiens
tgttttcatttgatgtaacaaa

SEQ ID NO: 7600143 - DNA, 17 bp, Homo sapiens
tgttttcattcattgct

SEQ ID NO: 7600144 - DNA, 17 bp, Homo sapiens
tgttttcattcattgct

SEQ ID NO: 7600145 - DNA, 17 bp, Homo sapiens
tgttttcattcattgct

SEQ ID NO: 7600146 - DNA, 17 bp, Homo sapiens
tgttttcattcattgct

SEQ ID NO: 7600147 - DNA, 22 bp, Homo sapiens
tgttttcatggttatgtgtcta

SEQ ID NO: 7600148 - DNA, 22 bp, Homo sapiens
tgttttcatggttatgtgtcta

SEQ ID NO: 7600149 - DNA, 17 bp, Homo sapiens
tgttttcattcattgct

SEQ ID NO: 7600150 - DNA, 22 bp, Homo sapiens
tgttttcatcacagaatgtaac

SEQ ID NO: 7600151 - DNA, 22 bp, Homo sapiens
tgttttcatcacagaatgtaac

SEQ ID NO: 7600152 - DNA, 22 bp, Homo sapiens
tgttttcatcacagaatgtaac

SEQ ID NO: 7600153 - DNA, 22 bp, Homo sapiens
tgtttcttgagagtattaccct

SEQ ID NO: 7600154 - DNA, 22 bp, Homo sapiens
tgtttcttgagagtattaccct

SEQ ID NO: 7600155 - DNA, 22 bp, Homo sapiens
tgttttcatcacagaatgtaac

SEQ ID NO: 7600156 - DNA, 22 bp, Homo sapiens
tgttttcatggttatgtgtcta

SEQ ID NO: 7600157 - DNA, 22 bp, Homo sapiens
tgttttcatggagatggtggcg

SEQ ID NO: 7600158 - DNA, 22 bp, Homo sapiens
tgtttcttctcacacaaactca

SEQ ID NO: 7600159 - DNA, 22 bp, Homo sapiens
tgtttcttctcacacaaactca

SEQ ID NO: 7600160 - DNA, 22 bp, Homo sapiens
tgtttcttgagagtattaccct

SEQ ID NO: 7600161 - DNA, 22 bp, Homo sapiens
tgtttcttctcacacaaactca

SEQ ID NO: 7600162 - DNA, 22 bp, Homo sapiens
tgttttcagtcatatagcaggt

SEQ ID NO: 7600163 - DNA, 22 bp, Homo sapiens
tgtttcttctcacacaaactca

SEQ ID NO: 7600164 - DNA, 22 bp, Homo sapiens
tgtttcttctcacacaaactca

SEQ ID NO: 7600165 - DNA, 22 bp, Homo sapiens
tgtttcttctcacacaaactca

SEQ ID NO: 7600166 - DNA, 22 bp, Homo sapiens
tgtttcttctcacacaaactca

SEQ ID NO: 7600167 - DNA, 19 bp, Homo sapiens
tgtttcttcctccatctga

SEQ ID NO: 7600168 - DNA, 22 bp, Homo sapiens
tgtttcttctcacacaaactca

SEQ ID NO: 7600169 - DNA, 22 bp, Homo sapiens
tgtttcttctcacacaaactca

SEQ ID NO: 7600170 - DNA, 22 bp, Homo sapiens
tgtttcttctcacacaaactca

SEQ ID NO: 7600171 - DNA, 22 bp, Homo sapiens
tgtttcttctcacacaaactca

SEQ ID NO: 7600172 - DNA, 22 bp, Homo sapiens
tgtttcttctcacacaaactca

SEQ ID NO: 7600173 - DNA, 19 bp, Homo sapiens
tgtttcttcctccatctga

SEQ ID NO: 7600174 - DNA, 19 bp, Homo sapiens
tgtttcttcctccatctga

SEQ ID NO: 7600175 - DNA, 19 bp, Homo sapiens
tgtttcttcctccatctga

SEQ ID NO: 7600176 - DNA, 19 bp, Homo sapiens
tgtttcttcctccatctga

SEQ ID NO: 7600177 - DNA, 19 bp, Homo sapiens
tgtttcttcctccatctga

SEQ ID NO: 7600178 - DNA, 19 bp, Homo sapiens
tgtttcttcctccatctga

SEQ ID NO: 7600179 - DNA, 22 bp, Homo sapiens
tgtttcttatccaagtggtctg

SEQ ID NO: 7600180 - DNA, 22 bp, Homo sapiens
tgtttctgggtgtgtctcacct

SEQ ID NO: 7600181 - DNA, 20 bp, Homo sapiens
tgtttctgacggtaggagag

SEQ ID NO: 7600182 - DNA, 22 bp, Homo sapiens
tgtttctgggtgtgtctcacct

SEQ ID NO: 7600183 - DNA, 22 bp, Homo sapiens
tgtttctgggtgtgtctcacct

SEQ ID NO: 7600184 - DNA, 22 bp, Homo sapiens
tgtttctgggtgtgtctcacct

SEQ ID NO: 7600185 - DNA, 22 bp, Homo sapiens
tgtttctgtatgatcaatattg

SEQ ID NO: 7600186 - DNA, 22 bp, Homo sapiens
tgtttctgtatgatcaatattg

SEQ ID NO: 7600187 - DNA, 22 bp, Homo sapiens
tgtttctgtatgatcaatattg

SEQ ID NO: 7600188 - DNA, 22 bp, Homo sapiens
tgtttctgtctgttttctacat

SEQ ID NO: 7600189 - DNA, 22 bp, Homo sapiens
tgtttctgtctgttttctacat

SEQ ID NO: 7600190 - DNA, 20 bp, Homo sapiens
tgtttctgacggtaggagag

SEQ ID NO: 7600191 - DNA, 20 bp, Homo sapiens
tgtttctgacggtaggagag

SEQ ID NO: 7600192 - DNA, 22 bp, Homo sapiens
tgtttctatctggatcaataga

SEQ ID NO: 7600193 - DNA, 22 bp, Homo sapiens
tgtttctatctggatcaataga

SEQ ID NO: 7600194 - DNA, 22 bp, Homo sapiens
tgtttcttacgtttttagaggc

SEQ ID NO: 7600195 - DNA, 22 bp, Homo sapiens
tgtttcttacgtttttagaggc

SEQ ID NO: 7600196 - DNA, 22 bp, Homo sapiens
tgtttctgtctgttttctacat

SEQ ID NO: 7600197 - DNA, 22 bp, Homo sapiens
tgtttcttacgtttttagaggc

SEQ ID NO: 7600198 - DNA, 22 bp, Homo sapiens
tgtttctgggtgtgtctcacct

SEQ ID NO: 7600199 - DNA, 22 bp, Homo sapiens
tgtttcttacgtttttagaggc

SEQ ID NO: 7600200 - DNA, 22 bp, Homo sapiens
tgtttcttacgtttttagaggc

SEQ ID NO: 7600201 - DNA, 22 bp, Homo sapiens
tgtttcttatccaagtggtctg

SEQ ID NO: 7600202 - DNA, 22 bp, Homo sapiens
tgtttcttatccaagtggtctg

SEQ ID NO: 7600203 - DNA, 22 bp, Homo sapiens
tgtttcttacgtttttagaggc

SEQ ID NO: 7600204 - DNA, 22 bp, Homo sapiens
tgtttcttacgtttttagaggc

SEQ ID NO: 7600205 - DNA, 22 bp, Homo sapiens
cctggggagccgcctgagcccc

SEQ ID NO: 7600206 - DNA, 22 bp, Homo sapiens
cctggggagccgcctgagcccc

SEQ ID NO: 7600207 - DNA, 22 bp, Homo sapiens
cctggggagagaaagcccagcc

SEQ ID NO: 7600208 - DNA, 22 bp, Homo sapiens
cctggggagagaaagcccagcc

SEQ ID NO: 7600209 - DNA, 22 bp, Homo sapiens
cctggggagccgcctgagcccc

SEQ ID NO: 7600210 - DNA, 22 bp, Homo sapiens
cctggggagccgcctgagcccc

SEQ ID NO: 7600211 - DNA, 22 bp, Homo sapiens
cctggggagccgcctgagcccc

SEQ ID NO: 7600212 - DNA, 22 bp, Homo sapiens
cctggggagccgcctgagcccc

SEQ ID NO: 7600213 - DNA, 22 bp, Homo sapiens
cctggggagagaaagcccagcc

SEQ ID NO: 7600214 - DNA, 22 bp, Homo sapiens
cctggggagagaaagcccagcc

SEQ ID NO: 7600215 - DNA, 22 bp, Homo sapiens
cctggggagagaaagcccagcc

SEQ ID NO: 7600216 - DNA, 22 bp, Homo sapiens
cctggggagagaaagcccagcc

SEQ ID NO: 7600217 - DNA, 22 bp, Homo sapiens
cctggggagagaaagcccagcc

SEQ ID NO: 7600218 - DNA, 22 bp, Homo sapiens
cctggggagaagagcttccccc

SEQ ID NO: 7600219 - DNA, 22 bp, Homo sapiens
cctggggagagaaagcccagcc

SEQ ID NO: 7600220 - DNA, 22 bp, Homo sapiens
cctggggattctgacacggagt

SEQ ID NO: 7600221 - DNA, 22 bp, Homo sapiens
cctggggattctgacacggagt

SEQ ID NO: 7600222 - DNA, 22 bp, Homo sapiens
cctggggattctgacacggagt

SEQ ID NO: 7600223 - DNA, 23 bp, Homo sapiens
cctggggcacttgagtcctcatc

SEQ ID NO: 7600224 - DNA, 23 bp, Homo sapiens
cctggggcacttgagtcctcatc

SEQ ID NO: 7600225 - DNA, 23 bp, Homo sapiens
cctggggcacttgagtcctcatc

SEQ ID NO: 7600226 - DNA, 23 bp, Homo sapiens
cctggggcacttgagtcctcatc

SEQ ID NO: 7600227 - DNA, 23 bp, Homo sapiens
cctggggcacttgagtcctcatc

SEQ ID NO: 7600228 - DNA, 23 bp, Homo sapiens
cctggggagctgtatccagagtg

SEQ ID NO: 7600229 - DNA, 23 bp, Homo sapiens
cctggggagctgtatccagagtg

SEQ ID NO: 7600230 - DNA, 22 bp, Homo sapiens
cctggggagccgcctgagcccc

SEQ ID NO: 7600231 - DNA, 22 bp, Homo sapiens
cctggggagccgcctgagcccc

SEQ ID NO: 7600232 - DNA, 22 bp, Homo sapiens
cctggggattctgacacggagt

SEQ ID NO: 7600233 - DNA, 22 bp, Homo sapiens
cctggggattctgacacggagt

SEQ ID NO: 7600234 - DNA, 22 bp, Homo sapiens
cctggggattctgacacggagt

SEQ ID NO: 7600235 - DNA, 23 bp, Homo sapiens
cctggggagctgtatccagagtg

SEQ ID NO: 7600236 - DNA, 22 bp, Homo sapiens
tgtttctaggtcaataattttt

SEQ ID NO: 7600237 - DNA, 22 bp, Homo sapiens
tgtttctaggtcaataattttt

SEQ ID NO: 7600238 - DNA, 22 bp, Homo sapiens
tgtttctaggtcaataattttt

SEQ ID NO: 7600239 - DNA, 22 bp, Homo sapiens
tgtttctaggtcaataattttt

SEQ ID NO: 7600240 - DNA, 22 bp, Homo sapiens
tgtttctaggtcaataattttt

SEQ ID NO: 7600241 - DNA, 22 bp, Homo sapiens
tgtttctagagaaaatatttac

SEQ ID NO: 7600242 - DNA, 22 bp, Homo sapiens
tgtttctatctggatcaataga

SEQ ID NO: 7600243 - DNA, 22 bp, Homo sapiens
tgtttctatctggatcaataga

SEQ ID NO: 7600244 - DNA, 22 bp, Homo sapiens
tgtttctatctggatcaataga

SEQ ID NO: 7600245 - DNA, 22 bp, Homo sapiens
tgtttctatctggatcaataga

SEQ ID NO: 7600246 - DNA, 22 bp, Homo sapiens
tgtttctatctggatcaataga

SEQ ID NO: 7600247 - DNA, 22 bp, Homo sapiens
tgtttctataacctctgaagca

SEQ ID NO: 7600248 - DNA, 22 bp, Homo sapiens
tgtttctataacctctgaagca

SEQ ID NO: 7600249 - DNA, 22 bp, Homo sapiens
tgtttctataacctctgaagca

SEQ ID NO: 7600250 - DNA, 22 bp, Homo sapiens
tgtttctaggtcaataattttt

SEQ ID NO: 7600251 - DNA, 22 bp, Homo sapiens
tgtttctaggtcaataattttt

SEQ ID NO: 7600252 - DNA, 22 bp, Homo sapiens
tgtttataccttggtataacca

SEQ ID NO: 7600253 - DNA, 22 bp, Homo sapiens
tgtttataccttggtataacca

SEQ ID NO: 7600254 - DNA, 22 bp, Homo sapiens
tgtttatacctgcaacctgtca

SEQ ID NO: 7600255 - DNA, 22 bp, Homo sapiens
tgtttctagagaaaatatttac

SEQ ID NO: 7600256 - DNA, 22 bp, Homo sapiens
tgtttctagagaaaatatttac

SEQ ID NO: 7600257 - DNA, 22 bp, Homo sapiens
tgtttctagagaaaatatttac

SEQ ID NO: 7600258 - DNA, 22 bp, Homo sapiens
tgtttctagagaaaatatttac

SEQ ID NO: 7600259 - DNA, 22 bp, Homo sapiens
tgtttataccttggtataacca

SEQ ID NO: 7600260 - DNA, 22 bp, Homo sapiens
tgtttataccttggtataacca

SEQ ID NO: 7600261 - DNA, 22 bp, Homo sapiens
cctggggctcaagatggcgccg

SEQ ID NO: 7600262 - DNA, 22 bp, Homo sapiens
tgtttataatatgcagtgagca

SEQ ID NO: 7600263 - DNA, 22 bp, Homo sapiens
tgtttatacctgcaacctgtca

SEQ ID NO: 7600264 - DNA, 22 bp, Homo sapiens
tgtttataatatgcagtgagca

SEQ ID NO: 7600265 - DNA, 22 bp, Homo sapiens
tgtttataatatgcagtgagca

SEQ ID NO: 7600266 - DNA, 22 bp, Homo sapiens
cctggggctcaagatggcgccg

SEQ ID NO: 7600267 - DNA, 22 bp, Homo sapiens
cctggggctcaagatggcgccg

SEQ ID NO: 7600268 - DNA, 22 bp, Homo sapiens
cctggggctcaagatggcgccg

SEQ ID NO: 7600269 - DNA, 22 bp, Homo sapiens
cctggggctcaagatggcgccg

SEQ ID NO: 7600270 - DNA, 22 bp, Homo sapiens
cctggggccccgagccagaagc

SEQ ID NO: 7600271 - DNA, 22 bp, Homo sapiens
cctggggccccgagccagaagc

SEQ ID NO: 7600272 - DNA, 22 bp, Homo sapiens
cctggggccccgagccagaagc

SEQ ID NO: 7600273 - DNA, 22 bp, Homo sapiens
cctggggccccgagccagaagc

SEQ ID NO: 7600274 - DNA, 22 bp, Homo sapiens
cctggggccccgagccagaagc

SEQ ID NO: 7600275 - DNA, 22 bp, Homo sapiens
cctggggccccgagccagaagc

SEQ ID NO: 7600276 - DNA, 23 bp, Homo sapiens
cctggggcacttgagtcctcatc

SEQ ID NO: 7600277 - DNA, 22 bp, Homo sapiens
cctgtcacatatttgctgttca

SEQ ID NO: 7600278 - DNA, 23 bp, Homo sapiens
cctgtcaacaaggccccactgta

SEQ ID NO: 7600279 - DNA, 22 bp, Homo sapiens
cctgtcacctaggtactgagca

SEQ ID NO: 7600280 - DNA, 22 bp, Homo sapiens
cctgtatttgcttccttctgca

SEQ ID NO: 7600281 - DNA, 22 bp, Homo sapiens
cctgtatttgcttccttctgca

SEQ ID NO: 7600282 - DNA, 22 bp, Homo sapiens
cctgtatttgcttccttctgca

SEQ ID NO: 7600283 - DNA, 22 bp, Homo sapiens
cctgtattaggtagacaactat

SEQ ID NO: 7600284 - DNA, 23 bp, Homo sapiens
cctgtcaacaaggccccactgta

SEQ ID NO: 7600285 - DNA, 18 bp, Homo sapiens
cctgtcacgtccaggcct

SEQ ID NO: 7600286 - DNA, 22 bp, Homo sapiens
cctgtcacctaggtactgagca

SEQ ID NO: 7600287 - DNA, 22 bp, Homo sapiens
cctgtcacgatgactgcactct

SEQ ID NO: 7600288 - DNA, 22 bp, Homo sapiens
cctgtcacgatgactgcactct

SEQ ID NO: 7600289 - DNA, 22 bp, Homo sapiens
ttaatactataatttgaagtac

SEQ ID NO: 7600290 - DNA, 22 bp, Homo sapiens
ttaatacatttcagactgttat

SEQ ID NO: 7600291 - DNA, 22 bp, Homo sapiens
ttaaggaaacatttttccatag

SEQ ID NO: 7600292 - DNA, 22 bp, Homo sapiens
ttaaggaaacatttttccatag

SEQ ID NO: 7600293 - DNA, 22 bp, Homo sapiens
ttaagctctcattattattatt

SEQ ID NO: 7600294 - DNA, 22 bp, Homo sapiens
ttaagctatacattgttagagt

SEQ ID NO: 7600295 - DNA, 20 bp, Homo sapiens
ttaagcattattactcccag

SEQ ID NO: 7600296 - DNA, 22 bp, Homo sapiens
ttaagcatttagttgtattgcc

SEQ ID NO: 7600297 - DNA, 22 bp, Homo sapiens
ttaagcatttattatgtgccag

SEQ ID NO: 7600298 - DNA, 19 bp, Homo sapiens
ttaagctaagatactagta

SEQ ID NO: 7600299 - DNA, 22 bp, Homo sapiens
ttaatagatatgcctctagagt

SEQ ID NO: 7600300 - DNA, 22 bp, Homo sapiens
ttaatactataatttgaagtac

SEQ ID NO: 7600301 - DNA, 22 bp, Homo sapiens
ttaatactataatttgaagtac

SEQ ID NO: 7600302 - DNA, 22 bp, Homo sapiens
ttaatactataatttgaagtac

SEQ ID NO: 7600303 - DNA, 22 bp, Homo sapiens
ttaatagatttgattttaaagg

SEQ ID NO: 7600304 - DNA, 22 bp, Homo sapiens
ttaatagatttgattttaaagg

SEQ ID NO: 7600305 - DNA, 22 bp, Homo sapiens
ttaatagatttgattttaaagg

SEQ ID NO: 7600306 - DNA, 22 bp, Homo sapiens
ttaatagatatgcctctagagt

SEQ ID NO: 7600307 - DNA, 22 bp, Homo sapiens
ttaatagatttgattttaaagg

SEQ ID NO: 7600308 - DNA, 22 bp, Homo sapiens
ttaatatgctgcttcttgaaaa

SEQ ID NO: 7600309 - DNA, 22 bp, Homo sapiens
ttaatatgctgcttcttgaaaa

SEQ ID NO: 7600310 - DNA, 22 bp, Homo sapiens
ttaatatgctgcttcttgaaaa

SEQ ID NO: 7600311 - DNA, 22 bp, Homo sapiens
ttaatatgctgcttcttgaaaa

SEQ ID NO: 7600312 - DNA, 22 bp, Homo sapiens
ttaatatacaattttacgggct

SEQ ID NO: 7600313 - DNA, 22 bp, Homo sapiens
ttaatatacaattttacgggct

SEQ ID NO: 7600314 - DNA, 22 bp, Homo sapiens
ttaatatgttgaaatttattag

SEQ ID NO: 7600315 - DNA, 22 bp, Homo sapiens
ttaatatgttgaaatttattag

SEQ ID NO: 7600316 - DNA, 22 bp, Homo sapiens
cctgtatttgcatctggcctct

SEQ ID NO: 7600317 - DNA, 22 bp, Homo sapiens
cctgtatttgcaacttttctta

SEQ ID NO: 7600318 - DNA, 22 bp, Homo sapiens
cctgtattgtgcccagaatctc

SEQ ID NO: 7600319 - DNA, 22 bp, Homo sapiens
cctgtattcaattttgtgtgat

SEQ ID NO: 7600320 - DNA, 22 bp, Homo sapiens
cctgtattatttgtatgtgctg

SEQ ID NO: 7600321 - DNA, 22 bp, Homo sapiens
cctgtattatttgtatgtgctg

SEQ ID NO: 7600322 - DNA, 22 bp, Homo sapiens
cctgtattaggtagacaactat

SEQ ID NO: 7600323 - DNA, 22 bp, Homo sapiens
cctgtatggctattccttggac

SEQ ID NO: 7600324 - DNA, 22 bp, Homo sapiens
cctgtaggcgagggatggacag

SEQ ID NO: 7600325 - DNA, 22 bp, Homo sapiens
cctgtaggaacgccttcatttg

SEQ ID NO: 7600326 - DNA, 22 bp, Homo sapiens
cctgtagaatctgtagacccat

SEQ ID NO: 7600327 - DNA, 22 bp, Homo sapiens
cctgtagaatctgtagacccat

SEQ ID NO: 7600328 - DNA, 22 bp, Homo sapiens
cctgtaggatattgtagaatac

SEQ ID NO: 7600329 - DNA, 22 bp, Homo sapiens
cctgtactagggtctcattgcc

SEQ ID NO: 7600330 - DNA, 22 bp, Homo sapiens
cctgtaccgcgatctgctgcgc

SEQ ID NO: 7600331 - DNA, 21 bp, Homo sapiens
cctgtaccactgtaagatgcc

SEQ ID NO: 7600332 - DNA, 22 bp, Homo sapiens
cctgtaccattttccctagtct

SEQ ID NO: 7600333 - DNA, 22 bp, Homo sapiens
cctgtacaagctcttggtgaca

SEQ ID NO: 7600334 - DNA, 22 bp, Homo sapiens
cctgtacaagagccatctggat

SEQ ID NO: 7600335 - DNA, 22 bp, Homo sapiens
cctgtacaagctcttggtgaca

SEQ ID NO: 7600336 - DNA, 22 bp, Homo sapiens
cctgtacagtgaatgaatgtga

SEQ ID NO: 7600337 - DNA, 22 bp, Homo sapiens
cctgtacagtgaatgaatgtga

SEQ ID NO: 7600338 - DNA, 22 bp, Homo sapiens
cctgtacagtgaatgaatgtga

SEQ ID NO: 7600339 - DNA, 22 bp, Homo sapiens
cctgtacacaattccgaggata

SEQ ID NO: 7600340 - DNA, 22 bp, Homo sapiens
cctgtacacggtctatgcctcc

SEQ ID NO: 7600341 - DNA, 22 bp, Homo sapiens
cctgtacatctgctctcattgc

SEQ ID NO: 7600342 - DNA, 22 bp, Homo sapiens
cctgtacatctgctctcattgc

SEQ ID NO: 7600343 - DNA, 22 bp, Homo sapiens
cctgtacatggccatctttacc

SEQ ID NO: 7600344 - DNA, 22 bp, Homo sapiens
cctgtacatggccatctttacc

SEQ ID NO: 7600345 - DNA, 22 bp, Homo sapiens
cctgtacatggccatctttacc

SEQ ID NO: 7600346 - DNA, 22 bp, Homo sapiens
cctgtacattagctgtgaattg

SEQ ID NO: 7600347 - DNA, 22 bp, Homo sapiens
cctgtacattagctgtgaattg

SEQ ID NO: 7600348 - DNA, 22 bp, Homo sapiens
cctgtacattagctgtgaattg

SEQ ID NO: 7600349 - DNA, 19 bp, Homo sapiens
cctgtacattattctcccc

SEQ ID NO: 7600350 - DNA, 19 bp, Homo sapiens
cctgtacattattctcccc

SEQ ID NO: 7600351 - DNA, 22 bp, Homo sapiens
ttaaaagggtaagcagcaactt

SEQ ID NO: 7600352 - DNA, 22 bp, Homo sapiens
ttaaaagggtaagcagcaactt

SEQ ID NO: 7600353 - DNA, 22 bp, Homo sapiens
ttaaaagggatgttatctgtaa

SEQ ID NO: 7600354 - DNA, 22 bp, Homo sapiens
ttaaaagggatgttatctgtaa

SEQ ID NO: 7600355 - DNA, 22 bp, Homo sapiens
ttaaaagggatgttatctgtaa

SEQ ID NO: 7600356 - DNA, 22 bp, Homo sapiens
ttaaaagtctgatgatttacat

SEQ ID NO: 7600357 - DNA, 22 bp, Homo sapiens
ttaaaagtctgatgatttacat

SEQ ID NO: 7600358 - DNA, 22 bp, Homo sapiens
ttaaaagtctgatgatttacat

SEQ ID NO: 7600359 - DNA, 23 bp, Homo sapiens
ttaaaagtggagagagaagctgg

SEQ ID NO: 7600360 - DNA, 23 bp, Homo sapiens
ttaaaagtggagagagaagctgg

SEQ ID NO: 7600361 - DNA, 22 bp, Homo sapiens
ttaaaatagccagtgcccctct

SEQ ID NO: 7600362 - DNA, 22 bp, Homo sapiens
ttaaaatagccagtgcccctct

SEQ ID NO: 7600363 - DNA, 22 bp, Homo sapiens
ttaaaatagccagtgcccctct

SEQ ID NO: 7600364 - DNA, 22 bp, Homo sapiens
ttaaaatagccagtgcccctct

SEQ ID NO: 7600365 - DNA, 22 bp, Homo sapiens
ttaaaatagccagtgcccctct

SEQ ID NO: 7600366 - DNA, 23 bp, Homo sapiens
ttaaaagtggagagagaagctgg

SEQ ID NO: 7600367 - DNA, 22 bp, Homo sapiens
ttaaaatagccagtgcccctct

SEQ ID NO: 7600368 - DNA, 22 bp, Homo sapiens
ttaaaatagccagtgcccctct

SEQ ID NO: 7600369 - DNA, 22 bp, Homo sapiens
ttaaaatagccagtgcccctct

SEQ ID NO: 7600370 - DNA, 22 bp, Homo sapiens
ttaaaatagccagtgcccctct

SEQ ID NO: 7600371 - DNA, 22 bp, Homo sapiens
tgttttctattacctgagattg

SEQ ID NO: 7600372 - DNA, 22 bp, Homo sapiens
tgttttctattacctgagattg

SEQ ID NO: 7600373 - DNA, 22 bp, Homo sapiens
tgttttctagaaacaatgccta

SEQ ID NO: 7600374 - DNA, 22 bp, Homo sapiens
tgttttctagaaacaatgccta

SEQ ID NO: 7600375 - DNA, 22 bp, Homo sapiens
tgttttctagaaacaatgccta

SEQ ID NO: 7600376 - DNA, 22 bp, Homo sapiens
tgttttctagaaacaatgccta

SEQ ID NO: 7600377 - DNA, 22 bp, Homo sapiens
tgttttctattacctgagattg

SEQ ID NO: 7600378 - DNA, 22 bp, Homo sapiens
tgttttctattacctgagattg

SEQ ID NO: 7600379 - DNA, 22 bp, Homo sapiens
tgttttctattacctgagattg

SEQ ID NO: 7600380 - DNA, 22 bp, Homo sapiens
tgttttctcttgaaaagcagtc

SEQ ID NO: 7600381 - DNA, 22 bp, Homo sapiens
tgttttctcttgaaaagcagtc

SEQ ID NO: 7600382 - DNA, 22 bp, Homo sapiens
tgttttctattacctgagattg

SEQ ID NO: 7600383 - DNA, 22 bp, Homo sapiens
tgttttctattacctgagattg

SEQ ID NO: 7600384 - DNA, 22 bp, Homo sapiens
ttaaaaggcatcataggtgaat

SEQ ID NO: 7600385 - DNA, 22 bp, Homo sapiens
ttaaaaggcatcataggtgaat

SEQ ID NO: 7600386 - DNA, 22 bp, Homo sapiens
ttaaaagagcagcccagcatat

SEQ ID NO: 7600387 - DNA, 22 bp, Homo sapiens
ttaaaagagcagcccagcatat

SEQ ID NO: 7600388 - DNA, 22 bp, Homo sapiens
ttaaaagagcagcccagcatat

SEQ ID NO: 7600389 - DNA, 22 bp, Homo sapiens
tgttttctcttgaaaagcagtc

SEQ ID NO: 7600390 - DNA, 22 bp, Homo sapiens
tgttttctcttgaaaagcagtc

SEQ ID NO: 7600391 - DNA, 22 bp, Homo sapiens
ttaaaagagcagcccagcatat

SEQ ID NO: 7600392 - DNA, 22 bp, Homo sapiens
ttaaaagagcagcccagcatat

SEQ ID NO: 7600393 - DNA, 21 bp, Homo sapiens
ttaaaatgaggaagtggtggc

SEQ ID NO: 7600394 - DNA, 21 bp, Homo sapiens
ttaaaatgaggaagtggtggc

SEQ ID NO: 7600395 - DNA, 21 bp, Homo sapiens
ttaaaatgaggaagtggtggc

SEQ ID NO: 7600396 - DNA, 21 bp, Homo sapiens
ttaaaatgaggaagtggtggc

SEQ ID NO: 7600397 - DNA, 22 bp, Homo sapiens
ttaaaatgaatattgattagca

SEQ ID NO: 7600398 - DNA, 22 bp, Homo sapiens
ttaaaatgaatattgattagca

SEQ ID NO: 7600399 - DNA, 22 bp, Homo sapiens
ttaaaatgaatattgattagca

SEQ ID NO: 7600400 - DNA, 22 bp, Homo sapiens
ttaaaatgaatattgattagca

SEQ ID NO: 7600401 - DNA, 22 bp, Homo sapiens
ttaaaatgcagattatgactca

SEQ ID NO: 7600402 - DNA, 22 bp, Homo sapiens
ttaaaatgcagattatgactca

SEQ ID NO: 7600403 - DNA, 22 bp, Homo sapiens
ttaaaatgcagattatgactca

SEQ ID NO: 7600404 - DNA, 22 bp, Homo sapiens
ttaaaatgcagattatgactca

SEQ ID NO: 7600405 - DNA, 22 bp, Homo sapiens
ttaaaatgcagattatgactca

SEQ ID NO: 7600406 - DNA, 22 bp, Homo sapiens
cctggtttgggtgccagtgagt

SEQ ID NO: 7600407 - DNA, 22 bp, Homo sapiens
ttaaaatgcagattatgactca

SEQ ID NO: 7600408 - DNA, 22 bp, Homo sapiens
cctgtaactccttggctcaagt

SEQ ID NO: 7600409 - DNA, 22 bp, Homo sapiens
cctggtttgtatttttaacacc

SEQ ID NO: 7600410 - DNA, 22 bp, Homo sapiens
cctggtttttcaaacatacaag

SEQ ID NO: 7600411 - DNA, 22 bp, Homo sapiens
ttaaaatagccagtgcccctct

SEQ ID NO: 7600412 - DNA, 22 bp, Homo sapiens
ttaaaatagccagtgcccctct

SEQ ID NO: 7600413 - DNA, 22 bp, Homo sapiens
ttaaaatagccagtgcccctct

SEQ ID NO: 7600414 - DNA, 22 bp, Homo sapiens
ttaaaatagccagtgcccctct

SEQ ID NO: 7600415 - DNA, 22 bp, Homo sapiens
ttaaaatagccagtgcccctct

SEQ ID NO: 7600416 - DNA, 22 bp, Homo sapiens
ttaaaatcgctgttgcttctgt

SEQ ID NO: 7600417 - DNA, 22 bp, Homo sapiens
ttaaaatcgctgttgcttctgt

SEQ ID NO: 7600418 - DNA, 22 bp, Homo sapiens
ttaaaatctaaagcagttgtct

SEQ ID NO: 7600419 - DNA, 22 bp, Homo sapiens
ttaaaatctaaagcagttgtct

SEQ ID NO: 7600420 - DNA, 22 bp, Homo sapiens
ttaaaatcgctgttgcttctgt

SEQ ID NO: 7600421 - DNA, 22 bp, Homo sapiens
ttaaaatcgctgttgcttctgt

SEQ ID NO: 7600422 - DNA, 22 bp, Homo sapiens
ttaaaatctaaagcagttgtct

SEQ ID NO: 7600423 - DNA, 22 bp, Homo sapiens
ttaaaatgaatattgattagca

SEQ ID NO: 7600424 - DNA, 22 bp, Homo sapiens
ttaaaatgaatattgattagca

SEQ ID NO: 7600425 - DNA, 22 bp, Homo sapiens
ttaaaatgaatattgattagca

SEQ ID NO: 7600426 - DNA, 22 bp, Homo sapiens
ttacaagttttcatgaaattga

SEQ ID NO: 7600427 - DNA, 22 bp, Homo sapiens
ttacaataccacatcacctcat

SEQ ID NO: 7600428 - DNA, 22 bp, Homo sapiens
ttacaagttttcatgaaattga

SEQ ID NO: 7600429 - DNA, 22 bp, Homo sapiens
ttacaagtttctggcttcatcc

SEQ ID NO: 7600430 - DNA, 22 bp, Homo sapiens
ttacaagtttctggcttcatcc

SEQ ID NO: 7600431 - DNA, 22 bp, Homo sapiens
ttacaagtttctggcttcatcc

SEQ ID NO: 7600432 - DNA, 22 bp, Homo sapiens
ttacaagtttctggcttcatcc

SEQ ID NO: 7600433 - DNA, 20 bp, Homo sapiens
ttacaagtttctaataacca

SEQ ID NO: 7600434 - DNA, 23 bp, Homo sapiens
ttacaagttctgaaatttccttc

SEQ ID NO: 7600435 - DNA, 22 bp, Homo sapiens
ttacaagttcagattttctcat

SEQ ID NO: 7600436 - DNA, 22 bp, Homo sapiens
ttacaagttcagattttctcat

SEQ ID NO: 7600437 - DNA, 22 bp, Homo sapiens
ttacaagtgtcaggtactggca

SEQ ID NO: 7600438 - DNA, 20 bp, Homo sapiens
ttacaagtttctaataacca

SEQ ID NO: 7600439 - DNA, 20 bp, Homo sapiens
ttacaagtttctaataacca

SEQ ID NO: 7600440 - DNA, 23 bp, Homo sapiens
ttacaagttctgaaatttccttc

SEQ ID NO: 7600441 - DNA, 22 bp, Homo sapiens
ttacaatagttccttcttttgt

SEQ ID NO: 7600442 - DNA, 22 bp, Homo sapiens
ttacaatagttccttcttttgt

SEQ ID NO: 7600443 - DNA, 22 bp, Homo sapiens
ttacaatagttccttcttttgt

SEQ ID NO: 7600444 - DNA, 22 bp, Homo sapiens
ttacaatagttccttcttttgt

SEQ ID NO: 7600445 - DNA, 22 bp, Homo sapiens
ttacaatcatctaggataaaga

SEQ ID NO: 7600446 - DNA, 22 bp, Homo sapiens
ttacaatgacaggtgtatcatt

SEQ ID NO: 7600447 - DNA, 22 bp, Homo sapiens
ttacaatgacaggtgtatcatt

SEQ ID NO: 7600448 - DNA, 22 bp, Homo sapiens
ttacaatgacaggtgtatcatt

SEQ ID NO: 7600449 - DNA, 22 bp, Homo sapiens
ttacaatgacaggtgtatcatt

SEQ ID NO: 7600450 - DNA, 22 bp, Homo sapiens
ttacaatgacaggtgtatcatt

SEQ ID NO: 7600451 - DNA, 22 bp, Homo sapiens
ttacaataccacatcacctcat

SEQ ID NO: 7600452 - DNA, 22 bp, Homo sapiens
ttacaataccacatcacctcat

SEQ ID NO: 7600453 - DNA, 22 bp, Homo sapiens
ttacaatagttccttcttttgt

SEQ ID NO: 7600454 - DNA, 22 bp, Homo sapiens
ttacaataccacatcacctcat

SEQ ID NO: 7600455 - DNA, 22 bp, Homo sapiens
ttacaatagttccttcttttgt

SEQ ID NO: 7600456 - DNA, 22 bp, Homo sapiens
ttacaatagttccttcttttgt

SEQ ID NO: 7600457 - DNA, 22 bp, Homo sapiens
ttacaatagttccttcttttgt

SEQ ID NO: 7600458 - DNA, 22 bp, Homo sapiens
ttacaatagttccttcttttgt

SEQ ID NO: 7600459 - DNA, 22 bp, Homo sapiens
ttacaatagttccttcttttgt

SEQ ID NO: 7600460 - DNA, 22 bp, Homo sapiens
ttacaatagttccttcttttgt

SEQ ID NO: 7600461 - DNA, 22 bp, Homo sapiens
ttacaatagttccttcttttgt

SEQ ID NO: 7600462 - DNA, 22 bp, Homo sapiens
cctgtggcgggggccagtgcct

SEQ ID NO: 7600463 - DNA, 22 bp, Homo sapiens
cctgtggcgggggccagtgcct

SEQ ID NO: 7600464 - DNA, 22 bp, Homo sapiens
cctgtggcgggggccagtgcct

SEQ ID NO: 7600465 - DNA, 22 bp, Homo sapiens
cctgtggccgcgtcgggcggcg

SEQ ID NO: 7600466 - DNA, 22 bp, Homo sapiens
cctgtggcctgaatttggtaaa

SEQ ID NO: 7600467 - DNA, 22 bp, Homo sapiens
cctgtggcgggggccagtgcct

SEQ ID NO: 7600468 - DNA, 22 bp, Homo sapiens
cctgtggcgggggccagtgcct

SEQ ID NO: 7600469 - DNA, 22 bp, Homo sapiens
cctgtggcgggggccagtgcct

SEQ ID NO: 7600470 - DNA, 22 bp, Homo sapiens
cctgtggcgggggccagtgcct

SEQ ID NO: 7600471 - DNA, 22 bp, Homo sapiens
cctgtggcgggggccagtgcct

SEQ ID NO: 7600472 - DNA, 18 bp, Homo sapiens
cctgtggctcagcccaca

SEQ ID NO: 7600473 - DNA, 22 bp, Homo sapiens
cctgtggctctctttggaggtc

SEQ ID NO: 7600474 - DNA, 22 bp, Homo sapiens
cctgtggctctctttggaggtc

SEQ ID NO: 7600475 - DNA, 18 bp, Homo sapiens
cctgtggctcagcccaca

SEQ ID NO: 7600476 - DNA, 18 bp, Homo sapiens
cctgtggctcagcccaca

SEQ ID NO: 7600477 - DNA, 18 bp, Homo sapiens
cctgtggctcagcccaca

SEQ ID NO: 7600478 - DNA, 22 bp, Homo sapiens
cctgtggctctctttggaggtc

SEQ ID NO: 7600479 - DNA, 22 bp, Homo sapiens
cctgtggctgccacttgggtga

SEQ ID NO: 7600480 - DNA, 22 bp, Homo sapiens
cctgtggctgccacttgggtga

SEQ ID NO: 7600481 - DNA, 20 bp, Homo sapiens
cctgtggctcttgtaattca

SEQ ID NO: 7600482 - DNA, 22 bp, Homo sapiens
cctgtggctggtcaggccagca

SEQ ID NO: 7600483 - DNA, 22 bp, Homo sapiens
cctgtggctggtcaggccagca

SEQ ID NO: 7600484 - DNA, 22 bp, Homo sapiens
cctgtggctggtagtatcgttt

SEQ ID NO: 7600485 - DNA, 22 bp, Homo sapiens
cctgtggctgccacttgggtga

SEQ ID NO: 7600486 - DNA, 22 bp, Homo sapiens
cctgtggctgccccgctgttgg

SEQ ID NO: 7600487 - DNA, 22 bp, Homo sapiens
cctgtggctgccccgctgttgg

SEQ ID NO: 7600488 - DNA, 22 bp, Homo sapiens
cctgtggctggtagtatcgttt

SEQ ID NO: 7600489 - DNA, 22 bp, Homo sapiens
cctgtggctggtagtatcgttt

SEQ ID NO: 7600490 - DNA, 21 bp, Homo sapiens
ttacaaagctacagatgttgc

SEQ ID NO: 7600491 - DNA, 21 bp, Homo sapiens
ttacaaagctacagatgttgc

SEQ ID NO: 7600492 - DNA, 21 bp, Homo sapiens
ttacaaagctacagatgttgc

SEQ ID NO: 7600493 - DNA, 22 bp, Homo sapiens
ttacaaagcgttgagacaagta

SEQ ID NO: 7600494 - DNA, 22 bp, Homo sapiens
ttacaagtatttaagatgctgt

SEQ ID NO: 7600495 - DNA, 22 bp, Homo sapiens
ttacaagtgtcaggcgctggca

SEQ ID NO: 7600496 - DNA, 22 bp, Homo sapiens
ttacaagtgtcaggtactggca

SEQ ID NO: 7600497 - DNA, 21 bp, Homo sapiens
ttacaaagctacagatgttgc

SEQ ID NO: 7600498 - DNA, 22 bp, Homo sapiens
ttacaagtatttaagatgctgt

SEQ ID NO: 7600499 - DNA, 22 bp, Homo sapiens
ttacaagtatttaagatgctgt

SEQ ID NO: 7600500 - DNA, 22 bp, Homo sapiens
ttaatcacagctctgccatgag

SEQ ID NO: 7600501 - DNA, 22 bp, Homo sapiens
ttaatcacagctctgccatgag

SEQ ID NO: 7600502 - DNA, 22 bp, Homo sapiens
ttaatcacagatattaaacatg

SEQ ID NO: 7600503 - DNA, 22 bp, Homo sapiens
ttaatcacagatattaaacatg

SEQ ID NO: 7600504 - DNA, 22 bp, Homo sapiens
ttaatcacagatattaaacatg

SEQ ID NO: 7600505 - DNA, 22 bp, Homo sapiens
ttaatatgttgaaatttattag

SEQ ID NO: 7600506 - DNA, 22 bp, Homo sapiens
ttaatcaaatttacaacccagt

SEQ ID NO: 7600507 - DNA, 22 bp, Homo sapiens
ttaatcaccaagtgaccctgtg

SEQ ID NO: 7600508 - DNA, 21 bp, Homo sapiens
ttaatcagtctccctgtctcc

SEQ ID NO: 7600509 - DNA, 22 bp, Homo sapiens
ttaatccaataacaaggttcaa

SEQ ID NO: 7600510 - DNA, 22 bp, Homo sapiens
ttaatccaatatcctggctatt

SEQ ID NO: 7600511 - DNA, 22 bp, Homo sapiens
ttaatctgaatcagtaaacact

SEQ ID NO: 7600512 - DNA, 22 bp, Homo sapiens
ttaatctcttagcaaattaatg

SEQ ID NO: 7600513 - DNA, 22 bp, Homo sapiens
ttaatcttatatgtaaaggtaa

SEQ ID NO: 7600514 - DNA, 22 bp, Homo sapiens
ttaatcttatatgtaaaggtaa

SEQ ID NO: 7600515 - DNA, 22 bp, Homo sapiens
ttaatcttatattgttgggacc

SEQ ID NO: 7600516 - DNA, 22 bp, Homo sapiens
ttaatcttatatgtaaaggtaa

SEQ ID NO: 7600517 - DNA, 22 bp, Homo sapiens
ttaatccatggcagttattaaa

SEQ ID NO: 7600518 - DNA, 22 bp, Homo sapiens
ttaatccatggcagttattaaa

SEQ ID NO: 7600519 - DNA, 22 bp, Homo sapiens
ttaatctaagtaatggatgctg

SEQ ID NO: 7600520 - DNA, 22 bp, Homo sapiens
ttaatgatacctatgttaattt

SEQ ID NO: 7600521 - DNA, 22 bp, Homo sapiens
ttaatgacttatatttaaagca

SEQ ID NO: 7600522 - DNA, 22 bp, Homo sapiens
ttaatgatttggaaccctttaa

SEQ ID NO: 7600523 - DNA, 22 bp, Homo sapiens
ttaatgatgaagtctggctgta

SEQ ID NO: 7600524 - DNA, 22 bp, Homo sapiens
ttaatgacttatatttaaagca

SEQ ID NO: 7600525 - DNA, 22 bp, Homo sapiens
ttaatgacatcataggtgaagt

SEQ ID NO: 7600526 - DNA, 22 bp, Homo sapiens
ttaatgacctagagcagtaatt

SEQ ID NO: 7600527 - DNA, 22 bp, Homo sapiens
ttaatcttcagggactcttgct

SEQ ID NO: 7600528 - DNA, 22 bp, Homo sapiens
ttaatcttcagggactcttgct

SEQ ID NO: 7600529 - DNA, 22 bp, Homo sapiens
ttaatgaaacattgactatgat

SEQ ID NO: 7600530 - DNA, 22 bp, Homo sapiens
ttaatgaaaggcagtttggaac

SEQ ID NO: 7600531 - DNA, 22 bp, Homo sapiens
ttaatgaatatgacaggagagg

SEQ ID NO: 7600532 - DNA, 22 bp, Homo sapiens
cctgtgctttaggcctcaaact

SEQ ID NO: 7600533 - DNA, 22 bp, Homo sapiens
cctgtgcttggccagagaggtt

SEQ ID NO: 7600534 - DNA, 22 bp, Homo sapiens
cctgtgcttggccagagaggtt

SEQ ID NO: 7600535 - DNA, 22 bp, Homo sapiens
cctgtgcttggccagagaggtt

SEQ ID NO: 7600536 - DNA, 22 bp, Homo sapiens
ttaatgccaacaaagtgatttt

SEQ ID NO: 7600537 - DNA, 22 bp, Homo sapiens
ttaatgcagaaatcaaactgac

SEQ ID NO: 7600538 - DNA, 22 bp, Homo sapiens
ttaatgcagaaatcaaactgac

SEQ ID NO: 7600539 - DNA, 22 bp, Homo sapiens
ttaatgcagctctaccacacag

SEQ ID NO: 7600540 - DNA, 22 bp, Homo sapiens
ttaatgcagctctaccacacag

SEQ ID NO: 7600541 - DNA, 21 bp, Homo sapiens
ttaatgctatgcagaaaatct

SEQ ID NO: 7600542 - DNA, 22 bp, Homo sapiens
ttaatgccaacaaagtgatttt

SEQ ID NO: 7600543 - DNA, 22 bp, Homo sapiens
ttaatgccaacaaagtgatttt

SEQ ID NO: 7600544 - DNA, 20 bp, Homo sapiens
cctgtggagctgcctcctcc

SEQ ID NO: 7600545 - DNA, 22 bp, Homo sapiens
cctgtggaccaggaggcagccc

SEQ ID NO: 7600546 - DNA, 22 bp, Homo sapiens
cctgtggaccaggaggcagccc

SEQ ID NO: 7600547 - DNA, 22 bp, Homo sapiens
cctgtggaccaggaggcagccc

SEQ ID NO: 7600548 - DNA, 22 bp, Homo sapiens
cctgtggaccaggaggcagccc

SEQ ID NO: 7600549 - DNA, 22 bp, Homo sapiens
cctgtgctttaggcctcaaact

SEQ ID NO: 7600550 - DNA, 22 bp, Homo sapiens
cctgtgctttaggcctcaaact

SEQ ID NO: 7600551 - DNA, 22 bp, Homo sapiens
cctgtggaatagaatcttccct

SEQ ID NO: 7600552 - DNA, 22 bp, Homo sapiens
cctgtggaatagaatcttccct

SEQ ID NO: 7600553 - DNA, 22 bp, Homo sapiens
cctgtggagttcccatctgaat

SEQ ID NO: 7600554 - DNA, 21 bp, Homo sapiens
cctgtggattttaaaattgga

SEQ ID NO: 7600555 - DNA, 22 bp, Homo sapiens
cctgtggagttcccatctgaat

SEQ ID NO: 7600556 - DNA, 22 bp, Homo sapiens
cctgtggagctttcagcagctc

SEQ ID NO: 7600557 - DNA, 22 bp, Homo sapiens
cctgtggagctttcagcagctc

SEQ ID NO: 7600558 - DNA, 22 bp, Homo sapiens
cctgtggaggctgctcagctgg

SEQ ID NO: 7600559 - DNA, 20 bp, Homo sapiens
cctgtggagctgcctcctcc

SEQ ID NO: 7600560 - DNA, 20 bp, Homo sapiens
cctgtggagctgcctcctcc

SEQ ID NO: 7600561 - DNA, 20 bp, Homo sapiens
cctgtggagctgcctcctcc

SEQ ID NO: 7600562 - DNA, 23 bp, Homo sapiens
cctgtggcaagtagatgagatga

SEQ ID NO: 7600563 - DNA, 23 bp, Homo sapiens
cctgtggcaagtagatgagatga

SEQ ID NO: 7600564 - DNA, 23 bp, Homo sapiens
cctgtggcaagtagatgagatga

SEQ ID NO: 7600565 - DNA, 22 bp, Homo sapiens
cctgtggcacatgcagggattc

SEQ ID NO: 7600566 - DNA, 22 bp, Homo sapiens
cctgtggcacatgcagggattc

SEQ ID NO: 7600567 - DNA, 22 bp, Homo sapiens
cctgtggcacatgcagggattc

SEQ ID NO: 7600568 - DNA, 23 bp, Homo sapiens
cctgtggcaagtagatgagatga

SEQ ID NO: 7600569 - DNA, 17 bp, Homo sapiens
cctgtggatgacacctg

SEQ ID NO: 7600570 - DNA, 17 bp, Homo sapiens
cctgtggatgacacctg

SEQ ID NO: 7600571 - DNA, 22 bp, Homo sapiens
cctgtggcacatgcagggattc

SEQ ID NO: 7600572 - DNA, 19 bp, Homo sapiens
cctgtggcagagtggaaac

SEQ ID NO: 7600573 - DNA, 22 bp, Homo sapiens
cctgtggccgcgtcgggcggcg

SEQ ID NO: 7600574 - DNA, 22 bp, Homo sapiens
ttatcctgccccagcctggaat

SEQ ID NO: 7600575 - DNA, 22 bp, Homo sapiens
ttatcgtacgcttcagaaattt

SEQ ID NO: 7600576 - DNA, 22 bp, Homo sapiens
cctttacagtatggttgtatca

SEQ ID NO: 7600577 - DNA, 22 bp, Homo sapiens
ttatccatttaaaccagttata

SEQ ID NO: 7600578 - DNA, 21 bp, Homo sapiens
cctttacaattttgcattcct

SEQ ID NO: 7600579 - DNA, 21 bp, Homo sapiens
cctttacaattttgcattcct

SEQ ID NO: 7600580 - DNA, 22 bp, Homo sapiens
cctttacacatggaatgggtct

SEQ ID NO: 7600581 - DNA, 22 bp, Homo sapiens
ccttgtttctctcccagataag

SEQ ID NO: 7600582 - DNA, 22 bp, Homo sapiens
cctttaaatggatgttcaactg

SEQ ID NO: 7600583 - DNA, 22 bp, Homo sapiens
cctttaagtcctcttttatatt

SEQ ID NO: 7600584 - DNA, 22 bp, Homo sapiens
cctttaaatggatgttcaactg

SEQ ID NO: 7600585 - DNA, 22 bp, Homo sapiens
cctttaaatggatgttcaactg

SEQ ID NO: 7600586 - DNA, 22 bp, Homo sapiens
cctttaaatggatgttcaactg

SEQ ID NO: 7600587 - DNA, 22 bp, Homo sapiens
cctttaaatggatgttcaactg

SEQ ID NO: 7600588 - DNA, 22 bp, Homo sapiens
cctttaatttacaatgttaatt

SEQ ID NO: 7600589 - DNA, 22 bp, Homo sapiens
cctttaatttacaatgttaatt

SEQ ID NO: 7600590 - DNA, 22 bp, Homo sapiens
ttatggcttaaatactacaggg

SEQ ID NO: 7600591 - DNA, 22 bp, Homo sapiens
ttatggcttaaatactacaggg

SEQ ID NO: 7600592 - DNA, 22 bp, Homo sapiens
ttatggcttctgtgaagaattt

SEQ ID NO: 7600593 - DNA, 22 bp, Homo sapiens
ttatggcttctgtgaagaattt

SEQ ID NO: 7600594 - DNA, 18 bp, Homo sapiens
ttatggctgtgaaagagt

SEQ ID NO: 7600595 - DNA, 18 bp, Homo sapiens
ttatggctgtgaaagagt

SEQ ID NO: 7600596 - DNA, 18 bp, Homo sapiens
ttatggctgtgaaagagt

SEQ ID NO: 7600597 - DNA, 22 bp, Homo sapiens
ttatggctagactagtttttga

SEQ ID NO: 7600598 - DNA, 22 bp, Homo sapiens
ttatggctgggacaaaagcttc

SEQ ID NO: 7600599 - DNA, 22 bp, Homo sapiens
ttatggctgaataaattatggt

SEQ ID NO: 7600600 - DNA, 22 bp, Homo sapiens
ttatggctgaataaattatggt

SEQ ID NO: 7600601 - DNA, 20 bp, Homo sapiens
ttatggctcctaccttgtga

SEQ ID NO: 7600602 - DNA, 20 bp, Homo sapiens
ttatggctcctaccttgtga

SEQ ID NO: 7600603 - DNA, 22 bp, Homo sapiens
ttatggctaggatatgtgtgta

SEQ ID NO: 7600604 - DNA, 22 bp, Homo sapiens
ttatggctaggatatgtgtgta

SEQ ID NO: 7600605 - DNA, 22 bp, Homo sapiens
ttatggctaaggcttgtcaggt

SEQ ID NO: 7600606 - DNA, 22 bp, Homo sapiens
ttatggcattcattggggcttt

SEQ ID NO: 7600607 - DNA, 22 bp, Homo sapiens
ttatggctaaatttcaatatta

SEQ ID NO: 7600608 - DNA, 22 bp, Homo sapiens
ttatggctaaatttcaatatta

SEQ ID NO: 7600609 - DNA, 22 bp, Homo sapiens
ttatcctgcatcctggaactca

SEQ ID NO: 7600610 - DNA, 17 bp, Homo sapiens
ttatctactgctactgt

SEQ ID NO: 7600611 - DNA, 22 bp, Homo sapiens
ttatctacgtatttaaactctt

SEQ ID NO: 7600612 - DNA, 22 bp, Homo sapiens
ttatcgtacgcttcagaaattt

SEQ ID NO: 7600613 - DNA, 22 bp, Homo sapiens
ttatcgtatctcttggtcttca

SEQ ID NO: 7600614 - DNA, 19 bp, Homo sapiens
ccttgtttggtctttgagc

SEQ ID NO: 7600615 - DNA, 19 bp, Homo sapiens
ccttgtttggtctttgagc

SEQ ID NO: 7600616 - DNA, 22 bp, Homo sapiens
ccttgttttcaaggtaggttct

SEQ ID NO: 7600617 - DNA, 22 bp, Homo sapiens
ccttgttttggaaccaaaggat

SEQ ID NO: 7600618 - DNA, 22 bp, Homo sapiens
ccttgtgtttacacctgtcttt

SEQ ID NO: 7600619 - DNA, 22 bp, Homo sapiens
cctttaaagactgcataacttc

SEQ ID NO: 7600620 - DNA, 22 bp, Homo sapiens
cctttaaagactgcataacttc

SEQ ID NO: 7600621 - DNA, 22 bp, Homo sapiens
cctttaaagactgcataacttc

SEQ ID NO: 7600622 - DNA, 22 bp, Homo sapiens
cctttaaagactgcataacttc

SEQ ID NO: 7600623 - DNA, 22 bp, Homo sapiens
cctttaaagactgcataacttc

SEQ ID NO: 7600624 - DNA, 22 bp, Homo sapiens
cctttaaagactgcataacttc

SEQ ID NO: 7600625 - DNA, 22 bp, Homo sapiens
cctttaaagactgcataacttc

SEQ ID NO: 7600626 - DNA, 22 bp, Homo sapiens
cctttaaatggatgttcaactg

SEQ ID NO: 7600627 - DNA, 22 bp, Homo sapiens
cctttaaagactgcataacttc

SEQ ID NO: 7600628 - DNA, 22 bp, Homo sapiens
cctttaaatggatgttcaactg

SEQ ID NO: 7600629 - DNA, 22 bp, Homo sapiens
ccttgtatcatatgctgggctt

SEQ ID NO: 7600630 - DNA, 22 bp, Homo sapiens
ccttgtcctctggtttcctgtt

SEQ ID NO: 7600631 - DNA, 22 bp, Homo sapiens
ccttgtcctctggtttcctgtt

SEQ ID NO: 7600632 - DNA, 23 bp, Homo sapiens
ccttgtctggctggctggacttt

SEQ ID NO: 7600633 - DNA, 22 bp, Homo sapiens
ccttgtcttgcacagatgcagc

SEQ ID NO: 7600634 - DNA, 22 bp, Homo sapiens
ccttgtgcaggttcatgatggg

SEQ ID NO: 7600635 - DNA, 22 bp, Homo sapiens
ccttgtgcaggttcatgatggg

SEQ ID NO: 7600636 - DNA, 22 bp, Homo sapiens
ccttgtcttgcacagatgcagc

SEQ ID NO: 7600637 - DNA, 19 bp, Homo sapiens
ccttgtctggtgaaggact

SEQ ID NO: 7600638 - DNA, 22 bp, Homo sapiens
ccttgtgtttacacctgtcttt

SEQ ID NO: 7600639 - DNA, 22 bp, Homo sapiens
ccttgtgtttacacctgtcttt

SEQ ID NO: 7600640 - DNA, 22 bp, Homo sapiens
ccttgtggatcatcaggtaggc

SEQ ID NO: 7600641 - DNA, 22 bp, Homo sapiens
ccttgtggatcatcaggtaggc

SEQ ID NO: 7600642 - DNA, 22 bp, Homo sapiens
ccttggggtgttggaggcagcc

SEQ ID NO: 7600643 - DNA, 22 bp, Homo sapiens
ccttggggtgttggaggcagcc

SEQ ID NO: 7600644 - DNA, 22 bp, Homo sapiens
ccttggggaatatccattcttc

SEQ ID NO: 7600645 - DNA, 22 bp, Homo sapiens
ccttggggaatatccattcttc

SEQ ID NO: 7600646 - DNA, 22 bp, Homo sapiens
ccttggggtgttggaggcagcc

SEQ ID NO: 7600647 - DNA, 22 bp, Homo sapiens
ccttggggtgttggaggcagcc

SEQ ID NO: 7600648 - DNA, 22 bp, Homo sapiens
ccttggggtgttggaggcagcc

SEQ ID NO: 7600649 - DNA, 22 bp, Homo sapiens
ccttggggtgttggaggcagcc

SEQ ID NO: 7600650 - DNA, 22 bp, Homo sapiens
ccttgggttccaagtcactgaa

SEQ ID NO: 7600651 - DNA, 22 bp, Homo sapiens
ccttgggttccaagtcactgaa

SEQ ID NO: 7600652 - DNA, 22 bp, Homo sapiens
ccttgggtgtttaatagatata

SEQ ID NO: 7600653 - DNA, 22 bp, Homo sapiens
ccttgggtctaggccagggagt

SEQ ID NO: 7600654 - DNA, 22 bp, Homo sapiens
ccttgggtctaggccagggagt

SEQ ID NO: 7600655 - DNA, 22 bp, Homo sapiens
ccttgggtctaggccagggagt

SEQ ID NO: 7600656 - DNA, 22 bp, Homo sapiens
ccttggttctgcctggcctgga

SEQ ID NO: 7600657 - DNA, 22 bp, Homo sapiens
ccttggttttaccaggtgttca

SEQ ID NO: 7600658 - DNA, 22 bp, Homo sapiens
ccttggtttccaggatgaggct

SEQ ID NO: 7600659 - DNA, 22 bp, Homo sapiens
ccttggtttccaggatgaggct

SEQ ID NO: 7600660 - DNA, 22 bp, Homo sapiens
ccttggtccctccccagaccaa

SEQ ID NO: 7600661 - DNA, 22 bp, Homo sapiens
ccttggtccaaccctgcacagc

SEQ ID NO: 7600662 - DNA, 22 bp, Homo sapiens
ccttgggttccaagtcactgaa

SEQ ID NO: 7600663 - DNA, 22 bp, Homo sapiens
ccttgggttccaagtcactgaa

SEQ ID NO: 7600664 - DNA, 22 bp, Homo sapiens
ccttggtccaaccctgcacagc

SEQ ID NO: 7600665 - DNA, 22 bp, Homo sapiens
ccttggtgatctgggctggaag

SEQ ID NO: 7600666 - DNA, 22 bp, Homo sapiens
ccttggtgatctgggctggaag

SEQ ID NO: 7600667 - DNA, 22 bp, Homo sapiens
ccttggtgctctgctgggatgg

SEQ ID NO: 7600668 - DNA, 22 bp, Homo sapiens
ccttggctgcttatatgtctgt

SEQ ID NO: 7600669 - DNA, 22 bp, Homo sapiens
ccttggctggaattactctggg

SEQ ID NO: 7600670 - DNA, 22 bp, Homo sapiens
ccttggctggaattactctggg

SEQ ID NO: 7600671 - DNA, 21 bp, Homo sapiens
ccttggctggcatctagcacc

SEQ ID NO: 7600672 - DNA, 22 bp, Homo sapiens
ccttggctggaattactctggg

SEQ ID NO: 7600673 - DNA, 22 bp, Homo sapiens
ccttggctggaattactctggg

SEQ ID NO: 7600674 - DNA, 19 bp, Homo sapiens
ccttgcctgtccctgcagc

SEQ ID NO: 7600675 - DNA, 19 bp, Homo sapiens
ccttgcctgtccctgcagc

SEQ ID NO: 7600676 - DNA, 22 bp, Homo sapiens
ccttggctgcttatatgtctgt

SEQ ID NO: 7600677 - DNA, 22 bp, Homo sapiens
ccttggctgaggagggagctga

SEQ ID NO: 7600678 - DNA, 22 bp, Homo sapiens
ccttggctgcttatatgtctgt

SEQ ID NO: 7600679 - DNA, 19 bp, Homo sapiens
ccttgcctgtccctgcagc

SEQ ID NO: 7600680 - DNA, 22 bp, Homo sapiens
ccttggctgtgttgcctgccct

SEQ ID NO: 7600681 - DNA, 22 bp, Homo sapiens
ccttggctgtgttgcctgccct

SEQ ID NO: 7600682 - DNA, 22 bp, Homo sapiens
ccttggctgtgttgcctgccct

SEQ ID NO: 7600683 - DNA, 20 bp, Homo sapiens
ccttggcttaataataggga

SEQ ID NO: 7600684 - DNA, 22 bp, Homo sapiens
ccttggctgtgttgcctgccct

SEQ ID NO: 7600685 - DNA, 22 bp, Homo sapiens
ccttggctgtgttgcctgccct

SEQ ID NO: 7600686 - DNA, 22 bp, Homo sapiens
ccttggctgtgctgccctttgc

SEQ ID NO: 7600687 - DNA, 22 bp, Homo sapiens
ccttggctgtgctgccctttgc

SEQ ID NO: 7600688 - DNA, 22 bp, Homo sapiens
ccttggctgtgctgccctttgc

SEQ ID NO: 7600689 - DNA, 21 bp, Homo sapiens
ccttggctggcatctagcacc

SEQ ID NO: 7600690 - DNA, 21 bp, Homo sapiens
ccttggctggcatctagcacc

SEQ ID NO: 7600691 - DNA, 21 bp, Homo sapiens
ccttggctggcatctagcacc

SEQ ID NO: 7600692 - DNA, 22 bp, Homo sapiens
ccttgcctcattgtgcttctcc

SEQ ID NO: 7600693 - DNA, 21 bp, Homo sapiens
ttactaaacaaaacatgcagg

SEQ ID NO: 7600694 - DNA, 21 bp, Homo sapiens
ttactaaacaaaacatgcagg

SEQ ID NO: 7600695 - DNA, 21 bp, Homo sapiens
ttactaaacaaaacatgcagg

SEQ ID NO: 7600696 - DNA, 21 bp, Homo sapiens
ttactaaacaaaacatgcagg

SEQ ID NO: 7600697 - DNA, 21 bp, Homo sapiens
ttactaaacaaaacatgcagg

SEQ ID NO: 7600698 - DNA, 22 bp, Homo sapiens
ttacgaatgttagattgcatct

SEQ ID NO: 7600699 - DNA, 22 bp, Homo sapiens
ttaccttttaggcaagcatctt

SEQ ID NO: 7600700 - DNA, 22 bp, Homo sapiens
ttaccttttaggcaagcatctt

SEQ ID NO: 7600701 - DNA, 22 bp, Homo sapiens
ttacctgtaaaactgcgatata

SEQ ID NO: 7600702 - DNA, 22 bp, Homo sapiens
ttacctgtgtcagtatatgaga

SEQ ID NO: 7600703 - DNA, 22 bp, Homo sapiens
ttacctgtgtgtttgatacata

SEQ ID NO: 7600704 - DNA, 22 bp, Homo sapiens
ttacctgcaactcccatggtga

SEQ ID NO: 7600705 - DNA, 22 bp, Homo sapiens
ttacctggtgtttatggtccat

SEQ ID NO: 7600706 - DNA, 22 bp, Homo sapiens
ttacctggtgtttatggtccat

SEQ ID NO: 7600707 - DNA, 22 bp, Homo sapiens
ttacctgttttacatgcacaac

SEQ ID NO: 7600708 - DNA, 22 bp, Homo sapiens
ttacctgttttacatgcacaac

SEQ ID NO: 7600709 - DNA, 22 bp, Homo sapiens
ttaccttggaccgggtatcaga

SEQ ID NO: 7600710 - DNA, 22 bp, Homo sapiens
ttaccttttaggcaagcatctt

SEQ ID NO: 7600711 - DNA, 22 bp, Homo sapiens
ccttggggaactggacgtgctg

SEQ ID NO: 7600712 - DNA, 22 bp, Homo sapiens
ccttggggaactggacgtgctg

SEQ ID NO: 7600713 - DNA, 22 bp, Homo sapiens
ccttgggcttgggcatagcttt

SEQ ID NO: 7600714 - DNA, 22 bp, Homo sapiens
ccttgggcttgggcatagcttt

SEQ ID NO: 7600715 - DNA, 22 bp, Homo sapiens
ccttgggcttgggcatagcttt

SEQ ID NO: 7600716 - DNA, 22 bp, Homo sapiens
ccttgggcttgggcatagcttt

SEQ ID NO: 7600717 - DNA, 22 bp, Homo sapiens
ccttgggcttgggcatagcttt

SEQ ID NO: 7600718 - DNA, 22 bp, Homo sapiens
ccttgggatttctcatgccaat

SEQ ID NO: 7600719 - DNA, 22 bp, Homo sapiens
ccttgggatgcataagagccca

SEQ ID NO: 7600720 - DNA, 22 bp, Homo sapiens
ccttgggatttctcatgccaat

SEQ ID NO: 7600721 - DNA, 22 bp, Homo sapiens
ccttgggagaaattgcagagtc

SEQ ID NO: 7600722 - DNA, 22 bp, Homo sapiens
ccttgggagaaattgcagagtc

SEQ ID NO: 7600723 - DNA, 22 bp, Homo sapiens
ccttgggaccctgctggaggtt

SEQ ID NO: 7600724 - DNA, 22 bp, Homo sapiens
ccttgggagaaattgcagagtc

SEQ ID NO: 7600725 - DNA, 22 bp, Homo sapiens
ccttgggacagccagcttcaga

SEQ ID NO: 7600726 - DNA, 22 bp, Homo sapiens
ccttggcttgtgggctgcagcc

SEQ ID NO: 7600727 - DNA, 19 bp, Homo sapiens
ccttggctttaactatgaa

SEQ ID NO: 7600728 - DNA, 22 bp, Homo sapiens
ccttgggacagccagcttcaga

SEQ ID NO: 7600729 - DNA, 22 bp, Homo sapiens
ccttggcttgtgggctgcagcc

SEQ ID NO: 7600730 - DNA, 22 bp, Homo sapiens
ccttggcttgtgggctgcagcc

SEQ ID NO: 7600731 - DNA, 19 bp, Homo sapiens
ccttggctttaactatgaa

SEQ ID NO: 7600732 - DNA, 22 bp, Homo sapiens
ccttggcttgtgggctgcagcc

SEQ ID NO: 7600733 - DNA, 22 bp, Homo sapiens
ccttggcttgcacacggccacc

SEQ ID NO: 7600734 - DNA, 22 bp, Homo sapiens
ccttggcttgcacacggccacc

SEQ ID NO: 7600735 - DNA, 22 bp, Homo sapiens
ccttggcttgcacacggccacc

SEQ ID NO: 7600736 - DNA, 22 bp, Homo sapiens
ccttggcttgtgggctgcagcc

SEQ ID NO: 7600737 - DNA, 22 bp, Homo sapiens
ccttggcttgcacacggccacc

SEQ ID NO: 7600738 - DNA, 22 bp, Homo sapiens
ccttggcttgtgggctgcagcc

SEQ ID NO: 7600739 - DNA, 22 bp, Homo sapiens
ccttggcttgtgggctgcagcc

SEQ ID NO: 7600740 - DNA, 22 bp, Homo sapiens
ccttggcttccttccctctaga

SEQ ID NO: 7600741 - DNA, 22 bp, Homo sapiens
ccttggcttccttccctctaga

SEQ ID NO: 7600742 - DNA, 22 bp, Homo sapiens
ccttggcttccttccctctaga

SEQ ID NO: 7600743 - DNA, 22 bp, Homo sapiens
ccttggcttaccttctgtgtgg

SEQ ID NO: 7600744 - DNA, 22 bp, Homo sapiens
ccttggcttaccttctgtgtgg

SEQ ID NO: 7600745 - DNA, 22 bp, Homo sapiens
ccttggcttaccttctgtgtgg

SEQ ID NO: 7600746 - DNA, 20 bp, Homo sapiens
ccttggcttaataataggga

SEQ ID NO: 7600747 - DNA, 22 bp, Homo sapiens
ccttggcttaccttctgtgtgg

SEQ ID NO: 7600748 - DNA, 22 bp, Homo sapiens
ccttggcttccttccctctaga

SEQ ID NO: 7600749 - DNA, 22 bp, Homo sapiens
ccttggcttccttccctctaga

SEQ ID NO: 7600750 - DNA, 21 bp, Homo sapiens
ccttctccacagggtctccgg

SEQ ID NO: 7600751 - DNA, 21 bp, Homo sapiens
ccttctccacagggtctccgg

SEQ ID NO: 7600752 - DNA, 20 bp, Homo sapiens
ccttctccagcttgttcttg

SEQ ID NO: 7600753 - DNA, 21 bp, Homo sapiens
ccttctccacagggtctccgg

SEQ ID NO: 7600754 - DNA, 21 bp, Homo sapiens
ccttctccacagggtctccgg

SEQ ID NO: 7600755 - DNA, 20 bp, Homo sapiens
ccttctctggaattgcctcc

SEQ ID NO: 7600756 - DNA, 20 bp, Homo sapiens
ccttctctggaattgcctcc

SEQ ID NO: 7600757 - DNA, 21 bp, Homo sapiens
ccttctcttgcttcagcttca

SEQ ID NO: 7600758 - DNA, 21 bp, Homo sapiens
ccttctcttgcttcagcttca

SEQ ID NO: 7600759 - DNA, 21 bp, Homo sapiens
ccttctcttgcttcagcttca

SEQ ID NO: 7600760 - DNA, 21 bp, Homo sapiens
ccttctcttgcttcagcttca

SEQ ID NO: 7600761 - DNA, 21 bp, Homo sapiens
ccttctcttgcttcagcttca

SEQ ID NO: 7600762 - DNA, 22 bp, Homo sapiens
ttacagaagagaaagaattcag

SEQ ID NO: 7600763 - DNA, 22 bp, Homo sapiens
ttacagaagagaaagaattcag

SEQ ID NO: 7600764 - DNA, 22 bp, Homo sapiens
ttacagaagagtaacttggcaa

SEQ ID NO: 7600765 - DNA, 22 bp, Homo sapiens
ttacagaagagaaagaattcag

SEQ ID NO: 7600766 - DNA, 22 bp, Homo sapiens
ttacagaagagaaagaattcag

SEQ ID NO: 7600767 - DNA, 22 bp, Homo sapiens
ttacagaagagaaagaattcag

SEQ ID NO: 7600768 - DNA, 22 bp, Homo sapiens
ttacagaagagaaagaattcag

SEQ ID NO: 7600769 - DNA, 22 bp, Homo sapiens
ttacagaagagaaagaattcag

SEQ ID NO: 7600770 - DNA, 22 bp, Homo sapiens
ttacagaactgtcttgaaattt

SEQ ID NO: 7600771 - DNA, 22 bp, Homo sapiens
ttacagaagtattgagagatcc

SEQ ID NO: 7600772 - DNA, 22 bp, Homo sapiens
ttacagaagtattgagagatcc

SEQ ID NO: 7600773 - DNA, 22 bp, Homo sapiens
ttacagaagtattgagagatcc

SEQ ID NO: 7600774 - DNA, 22 bp, Homo sapiens
ttacagaagtattgagagatcc

SEQ ID NO: 7600775 - DNA, 22 bp, Homo sapiens
ttacagaaggaacactactcag

SEQ ID NO: 7600776 - DNA, 22 bp, Homo sapiens
ttacagaaggaacactactcag

SEQ ID NO: 7600777 - DNA, 22 bp, Homo sapiens
ttacagaaggaacactactcag

SEQ ID NO: 7600778 - DNA, 22 bp, Homo sapiens
ttacagaaggaacactactcag

SEQ ID NO: 7600779 - DNA, 22 bp, Homo sapiens
ttacagaaggaacactactcag

SEQ ID NO: 7600780 - DNA, 22 bp, Homo sapiens
ttacagaaggaacactactcag

SEQ ID NO: 7600781 - DNA, 22 bp, Homo sapiens
ttacagaagagtaacttggcaa

SEQ ID NO: 7600782 - DNA, 22 bp, Homo sapiens
ttacagaagagtaacttggcaa

SEQ ID NO: 7600783 - DNA, 22 bp, Homo sapiens
ttacagaagagtaacttggcaa

SEQ ID NO: 7600784 - DNA, 22 bp, Homo sapiens
ttacagaaaggaaggactgact

SEQ ID NO: 7600785 - DNA, 22 bp, Homo sapiens
ttacagaaaggaaggactgact

SEQ ID NO: 7600786 - DNA, 22 bp, Homo sapiens
ttacaatgatgggattcagcca

SEQ ID NO: 7600787 - DNA, 22 bp, Homo sapiens
ttacaatgatgaataaatggca

SEQ ID NO: 7600788 - DNA, 22 bp, Homo sapiens
ttacaatgatgaataaatggca

SEQ ID NO: 7600789 - DNA, 19 bp, Homo sapiens
ttacaatgacccaatctgg

SEQ ID NO: 7600790 - DNA, 22 bp, Homo sapiens
ttacaatgagaaatggttggca

SEQ ID NO: 7600791 - DNA, 22 bp, Homo sapiens
ttacaatgagaaatggttggca

SEQ ID NO: 7600792 - DNA, 22 bp, Homo sapiens
ttacaatgatgaataaatggca

SEQ ID NO: 7600793 - DNA, 22 bp, Homo sapiens
ttacaatgagacgttcttatct

SEQ ID NO: 7600794 - DNA, 22 bp, Homo sapiens
ttacaatgagacgttcttatct

SEQ ID NO: 7600795 - DNA, 22 bp, Homo sapiens
ttacaatgagacgttcttatct

SEQ ID NO: 7600796 - DNA, 20 bp, Homo sapiens
ttacagaaatgatgttattt

SEQ ID NO: 7600797 - DNA, 20 bp, Homo sapiens
ttacagaaatgatgttattt

SEQ ID NO: 7600798 - DNA, 20 bp, Homo sapiens
ttacagaaatgatgttattt

SEQ ID NO: 7600799 - DNA, 20 bp, Homo sapiens
ttacagaaatgatgttattt

SEQ ID NO: 7600800 - DNA, 22 bp, Homo sapiens
ttacagaaagtttcccatgccg

SEQ ID NO: 7600801 - DNA, 22 bp, Homo sapiens
ttacagaaagtttcccatgccg

SEQ ID NO: 7600802 - DNA, 23 bp, Homo sapiens
ttacagaaagtatgcttttgttt

SEQ ID NO: 7600803 - DNA, 23 bp, Homo sapiens
ttacagaaagtatgcttttgttt

SEQ ID NO: 7600804 - DNA, 22 bp, Homo sapiens
ttacagaaaggttgtgggatag

SEQ ID NO: 7600805 - DNA, 22 bp, Homo sapiens
ttacagaaaggttgtgggatag

SEQ ID NO: 7600806 - DNA, 23 bp, Homo sapiens
ttacagaaagtatgcttttgttt

SEQ ID NO: 7600807 - DNA, 23 bp, Homo sapiens
ttacagaaagtatgcttttgttt

SEQ ID NO: 7600808 - DNA, 22 bp, Homo sapiens
ttacagaactgccctagttggc

SEQ ID NO: 7600809 - DNA, 22 bp, Homo sapiens
ttacagaactgccctagttggc

SEQ ID NO: 7600810 - DNA, 20 bp, Homo sapiens
ttacagaaatgatgttattt

SEQ ID NO: 7600811 - DNA, 20 bp, Homo sapiens
ttacagaaatgatgttattt

SEQ ID NO: 7600812 - DNA, 20 bp, Homo sapiens
ttacagaaatgatgttattt

SEQ ID NO: 7600813 - DNA, 20 bp, Homo sapiens
ttacagaaatgatgttattt

SEQ ID NO: 7600814 - DNA, 20 bp, Homo sapiens
ttacagaaatgatgttattt

SEQ ID NO: 7600815 - DNA, 22 bp, Homo sapiens
ttacagaactgtcttgaaattt

SEQ ID NO: 7600816 - DNA, 22 bp, Homo sapiens
ttacagaactgtcttgaaattt

SEQ ID NO: 7600817 - DNA, 22 bp, Homo sapiens
ttacagaactgtcttgaaattt

SEQ ID NO: 7600818 - DNA, 22 bp, Homo sapiens
ttacagaactgtcttgaaattt

SEQ ID NO: 7600819 - DNA, 22 bp, Homo sapiens
ttacagaactgtcttgaaattt

SEQ ID NO: 7600820 - DNA, 22 bp, Homo sapiens
ttacagaactgccctagttggc

SEQ ID NO: 7600821 - DNA, 22 bp, Homo sapiens
ttacagaactgtcttgaaattt

SEQ ID NO: 7600822 - DNA, 22 bp, Homo sapiens
ttacagaactgtcttgaaattt

SEQ ID NO: 7600823 - DNA, 22 bp, Homo sapiens
ttacagaactgtcttgaaattt

SEQ ID NO: 7600824 - DNA, 22 bp, Homo sapiens
ttacagaactgtcttgaaattt

SEQ ID NO: 7600825 - DNA, 22 bp, Homo sapiens
ttacctaaaatagctcaattta

SEQ ID NO: 7600826 - DNA, 22 bp, Homo sapiens
ttacctaaaatagctcaattta

SEQ ID NO: 7600827 - DNA, 22 bp, Homo sapiens
ttacctgaaaggttaatttcca

SEQ ID NO: 7600828 - DNA, 22 bp, Homo sapiens
ttacctgagcggatttgttgca

SEQ ID NO: 7600829 - DNA, 22 bp, Homo sapiens
ttacctgagcggatttgttgca

SEQ ID NO: 7600830 - DNA, 22 bp, Homo sapiens
ttacctgagcggatttgttgca

SEQ ID NO: 7600831 - DNA, 22 bp, Homo sapiens
ttacctgattccaactggcgcc

SEQ ID NO: 7600832 - DNA, 19 bp, Homo sapiens
ttaccgtgaaatggttcag

SEQ ID NO: 7600833 - DNA, 22 bp, Homo sapiens
ttacctaaaatagctcaattta

SEQ ID NO: 7600834 - DNA, 22 bp, Homo sapiens
ttaccattttataagttaaagt

SEQ ID NO: 7600835 - DNA, 22 bp, Homo sapiens
ttaccattgttccccatgtgta

SEQ ID NO: 7600836 - DNA, 22 bp, Homo sapiens
ttacccacctttctcatgccaa

SEQ ID NO: 7600837 - DNA, 22 bp, Homo sapiens
ttacccagggaccaagagaaac

SEQ ID NO: 7600838 - DNA, 22 bp, Homo sapiens
ttaccaattcagacatctcttc

SEQ ID NO: 7600839 - DNA, 22 bp, Homo sapiens
ttaccaatgtgcttttgctaca

SEQ ID NO: 7600840 - DNA, 22 bp, Homo sapiens
ttaccaattcagacatctcttc

SEQ ID NO: 7600841 - DNA, 22 bp, Homo sapiens
ttaccacacttatttacattgg

SEQ ID NO: 7600842 - DNA, 22 bp, Homo sapiens
ttaccaagctctgcatgttaag

SEQ ID NO: 7600843 - DNA, 21 bp, Homo sapiens
ttaccaatggcttctctttcc

SEQ ID NO: 7600844 - DNA, 22 bp, Homo sapiens
ttaccaagctctgcatgttaag

SEQ ID NO: 7600845 - DNA, 22 bp, Homo sapiens
ccttgaaaccacatcttagaaa

SEQ ID NO: 7600846 - DNA, 22 bp, Homo sapiens
ttaccacagtgcctgtctaatg

SEQ ID NO: 7600847 - DNA, 22 bp, Homo sapiens
ttaccataaagtttatctttct

SEQ ID NO: 7600848 - DNA, 22 bp, Homo sapiens
ttaccatagaaacttccttttt

SEQ ID NO: 7600849 - DNA, 22 bp, Homo sapiens
ttaccatagtactatcagttta

SEQ ID NO: 7600850 - DNA, 22 bp, Homo sapiens
ttaccatctgtgggaagtggct

SEQ ID NO: 7600851 - DNA, 22 bp, Homo sapiens
ttaccatgggcctgaatggagc

SEQ ID NO: 7600852 - DNA, 22 bp, Homo sapiens
ccttctgctccctggccagggc

SEQ ID NO: 7600853 - DNA, 22 bp, Homo sapiens
ccttctgctccctggccagggc

SEQ ID NO: 7600854 - DNA, 22 bp, Homo sapiens
ccttctgctggtcatcccagtg

SEQ ID NO: 7600855 - DNA, 22 bp, Homo sapiens
ccttctggagggtgtacgagag

SEQ ID NO: 7600856 - DNA, 22 bp, Homo sapiens
ccttctggagggtgtacgagag

SEQ ID NO: 7600857 - DNA, 22 bp, Homo sapiens
ccttctggatgtgctaaggaag

SEQ ID NO: 7600858 - DNA, 22 bp, Homo sapiens
ccttctgctggtcatcccagtg

SEQ ID NO: 7600859 - DNA, 22 bp, Homo sapiens
ccttctggaagctctaagggag

SEQ ID NO: 7600860 - DNA, 22 bp, Homo sapiens
ccttctggaagctctaagggag

SEQ ID NO: 7600861 - DNA, 21 bp, Homo sapiens
ccttctcttgcttcagcttca

SEQ ID NO: 7600862 - DNA, 22 bp, Homo sapiens
ccttctgagcttcaatttcagt

SEQ ID NO: 7600863 - DNA, 22 bp, Homo sapiens
ccttctgagcttcaatttcagt

SEQ ID NO: 7600864 - DNA, 22 bp, Homo sapiens
ccttctgataactgtgaaattg

SEQ ID NO: 7600865 - DNA, 22 bp, Homo sapiens
ccttctgatactgacatcattt

SEQ ID NO: 7600866 - DNA, 22 bp, Homo sapiens
ccttctgatactgacatcattt

SEQ ID NO: 7600867 - DNA, 22 bp, Homo sapiens
ccttcttcaccagtttacctga

SEQ ID NO: 7600868 - DNA, 22 bp, Homo sapiens
ccttcttgaggtagcacattct

SEQ ID NO: 7600869 - DNA, 22 bp, Homo sapiens
ccttcttgaggtagcacattct

SEQ ID NO: 7600870 - DNA, 22 bp, Homo sapiens
ccttcttgaggtagcacattct

SEQ ID NO: 7600871 - DNA, 23 bp, Homo sapiens
ccttctgttaaccatctgggggg

SEQ ID NO: 7600872 - DNA, 23 bp, Homo sapiens
ccttctgttaaccatctgggggg

SEQ ID NO: 7600873 - DNA, 22 bp, Homo sapiens
ccttcttaaacatcattttggc

SEQ ID NO: 7600874 - DNA, 22 bp, Homo sapiens
ccttctggatgtgctaaggaag

SEQ ID NO: 7600875 - DNA, 22 bp, Homo sapiens
ccttctggatgtgctaaggaag

SEQ ID NO: 7600876 - DNA, 22 bp, Homo sapiens
ccttctgggccaacttccagga

SEQ ID NO: 7600877 - DNA, 22 bp, Homo sapiens
ccttctgggccaacttccagga

SEQ ID NO: 7600878 - DNA, 22 bp, Homo sapiens
ccttctgtctccctcatattga

SEQ ID NO: 7600879 - DNA, 22 bp, Homo sapiens
ccttctgtgtgcccacgtttat

SEQ ID NO: 7600880 - DNA, 23 bp, Homo sapiens
ccttctgttaaccatctgggggg

SEQ ID NO: 7600881 - DNA, 22 bp, Homo sapiens
ccttctgtgtgcccacgtttat

SEQ ID NO: 7600882 - DNA, 22 bp, Homo sapiens
ccttctgtctccctcatattga

SEQ ID NO: 7600883 - DNA, 22 bp, Homo sapiens
ccttctgtctccctcatattga

SEQ ID NO: 7600884 - DNA, 22 bp, Homo sapiens
ccttctgtgtgcccacgtttat

SEQ ID NO: 7600885 - DNA, 22 bp, Homo sapiens
ttatttttaaaagttcacacag

SEQ ID NO: 7600886 - DNA, 22 bp, Homo sapiens
ttatttttaaaagttcacacag

SEQ ID NO: 7600887 - DNA, 22 bp, Homo sapiens
ttatttttaaaagttcacacag

SEQ ID NO: 7600888 - DNA, 17 bp, Homo sapiens
ttattttttgggctgag

SEQ ID NO: 7600889 - DNA, 17 bp, Homo sapiens
ttattttttgggctgag

SEQ ID NO: 7600890 - DNA, 17 bp, Homo sapiens
ttattttttgggctgag

SEQ ID NO: 7600891 - DNA, 17 bp, Homo sapiens
ttattttttgggctgag

SEQ ID NO: 7600892 - DNA, 22 bp, Homo sapiens
ttatttttaaaagttcacacag

SEQ ID NO: 7600893 - DNA, 17 bp, Homo sapiens
ttattttttgggctgag

SEQ ID NO: 7600894 - DNA, 17 bp, Homo sapiens
ttattttttgggctgag

SEQ ID NO: 7600895 - DNA, 17 bp, Homo sapiens
ttattttttgggctgag

SEQ ID NO: 7600896 - DNA, 22 bp, Homo sapiens
ttatttttaaaagttcacacag

SEQ ID NO: 7600897 - DNA, 22 bp, Homo sapiens
ttatttttaaaagttcacacag

SEQ ID NO: 7600898 - DNA, 22 bp, Homo sapiens
ttatttttaaaagttcacacag

SEQ ID NO: 7600899 - DNA, 22 bp, Homo sapiens
ttatttttaaaagttcacacag

SEQ ID NO: 7600900 - DNA, 22 bp, Homo sapiens
ttatttttaaaagttcacacag

SEQ ID NO: 7600901 - DNA, 22 bp, Homo sapiens
ttatttttaaaagttcacacag

SEQ ID NO: 7600902 - DNA, 22 bp, Homo sapiens
ttatttttaaaagttcacacag

SEQ ID NO: 7600903 - DNA, 17 bp, Homo sapiens
ttattttttgggctgag

SEQ ID NO: 7600904 - DNA, 22 bp, Homo sapiens
ttcaaaaaggtatgttcaagtc

SEQ ID NO: 7600905 - DNA, 22 bp, Homo sapiens
ttcaaaaaggtatgttcaagtc

SEQ ID NO: 7600906 - DNA, 22 bp, Homo sapiens
ttcaaaaaggtatgttcaagtc

SEQ ID NO: 7600907 - DNA, 22 bp, Homo sapiens
ttcaaaaaggtatgttcaagtc

SEQ ID NO: 7600908 - DNA, 17 bp, Homo sapiens
ttattttttgggctgag

SEQ ID NO: 7600909 - DNA, 17 bp, Homo sapiens
ttattttttgggctgag

SEQ ID NO: 7600910 - DNA, 17 bp, Homo sapiens
ttattttttgggctgag

SEQ ID NO: 7600911 - DNA, 22 bp, Homo sapiens
ttcaaaaaggtatgttcaagtc

SEQ ID NO: 7600912 - DNA, 22 bp, Homo sapiens
ttcaaaaaggtatgttcaagtc

SEQ ID NO: 7600913 - DNA, 22 bp, Homo sapiens
ttcaaaaaggtatgttcaagtc

SEQ ID NO: 7600914 - DNA, 22 bp, Homo sapiens
ttcaaaacaatctgtttgcatt

SEQ ID NO: 7600915 - DNA, 22 bp, Homo sapiens
ttcaaaaaggtatgttcaagtc

SEQ ID NO: 7600916 - DNA, 22 bp, Homo sapiens
ttcaaaaaggtatgttcaagtc

SEQ ID NO: 7600917 - DNA, 22 bp, Homo sapiens
ttcaaaaaggtatgttcaagtc

SEQ ID NO: 7600918 - DNA, 22 bp, Homo sapiens
cgcactggagctggaacgagtc

SEQ ID NO: 7600919 - DNA, 22 bp, Homo sapiens
cgcaccccactgtccctcaacc

SEQ ID NO: 7600920 - DNA, 22 bp, Homo sapiens
cgcagaagaggttgtctagtcc

SEQ ID NO: 7600921 - DNA, 22 bp, Homo sapiens
ttcaaaacagctagatattgga

SEQ ID NO: 7600922 - DNA, 22 bp, Homo sapiens
ttcaaaacaatctgtttgcatt

SEQ ID NO: 7600923 - DNA, 22 bp, Homo sapiens
ttcaaaacaatctgtttgcatt

SEQ ID NO: 7600924 - DNA, 22 bp, Homo sapiens
ttcaaaacaatctgtttgcatt

SEQ ID NO: 7600925 - DNA, 22 bp, Homo sapiens
ttcaaaacagctagatattgga

SEQ ID NO: 7600926 - DNA, 22 bp, Homo sapiens
ttcaaaacagctagatattgga

SEQ ID NO: 7600927 - DNA, 22 bp, Homo sapiens
ttcaaaacagctagatattgga

SEQ ID NO: 7600928 - DNA, 21 bp, Homo sapiens
cgcagagcgaacttgcggcgc

SEQ ID NO: 7600929 - DNA, 21 bp, Homo sapiens
cgcagagcgaacttgcggcgc

SEQ ID NO: 7600930 - DNA, 21 bp, Homo sapiens
cgcagagcgaacttgcggcgc

SEQ ID NO: 7600931 - DNA, 22 bp, Homo sapiens
cgcagagaaatgccgggggtac

SEQ ID NO: 7600932 - DNA, 22 bp, Homo sapiens
cgcagagaaatgccgggggtac

SEQ ID NO: 7600933 - DNA, 22 bp, Homo sapiens
cgcagagacatggcgacagaga

SEQ ID NO: 7600934 - DNA, 22 bp, Homo sapiens
cgcagagacatggcgacagaga

SEQ ID NO: 7600935 - DNA, 21 bp, Homo sapiens
cgcagagcgaacttgcggcgc

SEQ ID NO: 7600936 - DNA, 21 bp, Homo sapiens
cgcagagcgaacttgcggcgc

SEQ ID NO: 7600937 - DNA, 21 bp, Homo sapiens
cgcagagcgaacttgcggcgc

SEQ ID NO: 7600938 - DNA, 19 bp, Homo sapiens
cgcagagggcttctgagag

SEQ ID NO: 7600939 - DNA, 19 bp, Homo sapiens
cgcagagggcttctgagag

SEQ ID NO: 7600940 - DNA, 22 bp, Homo sapiens
cgcagcagccccgtggtaggtg

SEQ ID NO: 7600941 - DNA, 22 bp, Homo sapiens
cgcagcagccccgtggtaggtg

SEQ ID NO: 7600942 - DNA, 22 bp, Homo sapiens
cgcagagggcaggcagtgctgg

SEQ ID NO: 7600943 - DNA, 22 bp, Homo sapiens
cgcagagggcaggcagtgctgg

SEQ ID NO: 7600944 - DNA, 22 bp, Homo sapiens
cgcagagggagccgcgggctgc

SEQ ID NO: 7600945 - DNA, 22 bp, Homo sapiens
cgcagagggagccgcgggctgc

SEQ ID NO: 7600946 - DNA, 22 bp, Homo sapiens
cgcagagggagccgcgggctgc

SEQ ID NO: 7600947 - DNA, 22 bp, Homo sapiens
cgcagagggcaggcagtgctgg

SEQ ID NO: 7600948 - DNA, 22 bp, Homo sapiens
cgcagagggcaggcagtgctgg

SEQ ID NO: 7600949 - DNA, 22 bp, Homo sapiens
cgcagagggcaggcagtgctgg

SEQ ID NO: 7600950 - DNA, 22 bp, Homo sapiens
cgcagagggcaggcagtgctgg

SEQ ID NO: 7600951 - DNA, 22 bp, Homo sapiens
ttattcacctctattagactca

SEQ ID NO: 7600952 - DNA, 22 bp, Homo sapiens
ttattcacctctattagactca

SEQ ID NO: 7600953 - DNA, 22 bp, Homo sapiens
ttattcactcattaaagcagga

SEQ ID NO: 7600954 - DNA, 22 bp, Homo sapiens
ttattcaccagtgtaaaacact

SEQ ID NO: 7600955 - DNA, 22 bp, Homo sapiens
ttattcaccatttattatgtga

SEQ ID NO: 7600956 - DNA, 22 bp, Homo sapiens
ttattcaccatttattatgtga

SEQ ID NO: 7600957 - DNA, 22 bp, Homo sapiens
ttattcaccgcaggtgcttccc

SEQ ID NO: 7600958 - DNA, 22 bp, Homo sapiens
ttattcaccgcaggtgcttccc

SEQ ID NO: 7600959 - DNA, 22 bp, Homo sapiens
ttatttcatgtaaaatttatgt

SEQ ID NO: 7600960 - DNA, 22 bp, Homo sapiens
ttattcactctgaagccatcct

SEQ ID NO: 7600961 - DNA, 22 bp, Homo sapiens
ttattcactctgaagccatcct

SEQ ID NO: 7600962 - DNA, 22 bp, Homo sapiens
ttattcacttcttggtccctca

SEQ ID NO: 7600963 - DNA, 18 bp, Homo sapiens
ttattcagacgcatatga

SEQ ID NO: 7600964 - DNA, 18 bp, Homo sapiens
ttattcagacgcatatga

SEQ ID NO: 7600965 - DNA, 22 bp, Homo sapiens
ttattcactcatttaacattat

SEQ ID NO: 7600966 - DNA, 22 bp, Homo sapiens
ttattcactcattaaagcagga

SEQ ID NO: 7600967 - DNA, 22 bp, Homo sapiens
ttattcactcatttaacattat

SEQ ID NO: 7600968 - DNA, 22 bp, Homo sapiens
ttatttttaaaagttcacacag

SEQ ID NO: 7600969 - DNA, 22 bp, Homo sapiens
ttatttttaaaagttcacacag

SEQ ID NO: 7600970 - DNA, 22 bp, Homo sapiens
ttatttttaaaagttcacacag

SEQ ID NO: 7600971 - DNA, 22 bp, Homo sapiens
ttatttttaaaagttcacacag

SEQ ID NO: 7600972 - DNA, 22 bp, Homo sapiens
ttatttttaaaagttcacacag

SEQ ID NO: 7600973 - DNA, 22 bp, Homo sapiens
ttatttttaaaagttcacacag

SEQ ID NO: 7600974 - DNA, 22 bp, Homo sapiens
ttatttttaaaagttcacacag

SEQ ID NO: 7600975 - DNA, 22 bp, Homo sapiens
ttatttcattgatttctaagac

SEQ ID NO: 7600976 - DNA, 22 bp, Homo sapiens
ttatttttaaaagttcacacag

SEQ ID NO: 7600977 - DNA, 22 bp, Homo sapiens
ttatttttaaaagttcacacag

SEQ ID NO: 7600978 - DNA, 22 bp, Homo sapiens
ttatttttaaaagttcacacag

SEQ ID NO: 7600979 - DNA, 22 bp, Homo sapiens
ttatttttaaaagttcacacag

SEQ ID NO: 7600980 - DNA, 22 bp, Homo sapiens
ttatttttaaaagttcacacag

SEQ ID NO: 7600981 - DNA, 22 bp, Homo sapiens
ttatttttaaaagttcacacag

SEQ ID NO: 7600982 - DNA, 22 bp, Homo sapiens
ttatttcattgatttctaagac

SEQ ID NO: 7600983 - DNA, 22 bp, Homo sapiens
ttatttcattgatttctaagac

SEQ ID NO: 7600984 - DNA, 22 bp, Homo sapiens
ttatttcatgtaaaatttatgt

SEQ ID NO: 7600985 - DNA, 23 bp, Homo sapiens
ttattttgtcagaagggactttt

SEQ ID NO: 7600986 - DNA, 23 bp, Homo sapiens
ttattttgtcagaagggactttt

SEQ ID NO: 7600987 - DNA, 23 bp, Homo sapiens
ttattttgtcagaagggactttt

SEQ ID NO: 7600988 - DNA, 23 bp, Homo sapiens
ttattttgtcagaagggactttt

SEQ ID NO: 7600989 - DNA, 22 bp, Homo sapiens
ttatttcattgatttctaagac

SEQ ID NO: 7600990 - DNA, 22 bp, Homo sapiens
ttattattgtggttgcattatc

SEQ ID NO: 7600991 - DNA, 22 bp, Homo sapiens
ttattattgtggttgcattatc

SEQ ID NO: 7600992 - DNA, 22 bp, Homo sapiens
ttattattgtggttgcattatc

SEQ ID NO: 7600993 - DNA, 22 bp, Homo sapiens
ttattattgtggttgcattatc

SEQ ID NO: 7600994 - DNA, 22 bp, Homo sapiens
ttattattgtggttgcattatc

SEQ ID NO: 7600995 - DNA, 22 bp, Homo sapiens
ttattattgtggttgcattatc

SEQ ID NO: 7600996 - DNA, 22 bp, Homo sapiens
ttattattgtggttgcattatc

SEQ ID NO: 7600997 - DNA, 22 bp, Homo sapiens
ttattattgtggttgcattatc

SEQ ID NO: 7600998 - DNA, 22 bp, Homo sapiens
ttattattgtgacctgagaatg

SEQ ID NO: 7600999 - DNA, 22 bp, Homo sapiens
ttattattgtgacctgagaatg

SEQ ID NO: 7601000 - DNA, 22 bp, Homo sapiens
ttattattgtgacctgagaatg

SEQ ID NO: 7601001 - DNA, 22 bp, Homo sapiens
ttattattgtgacctgagaatg

SEQ ID NO: 7601002 - DNA, 22 bp, Homo sapiens
ttattattgtgacctgagaatg

SEQ ID NO: 7601003 - DNA, 22 bp, Homo sapiens
ttattattgtgacctgagaatg

SEQ ID NO: 7601004 - DNA, 22 bp, Homo sapiens
ttattattggtgagttaaggaa

SEQ ID NO: 7601005 - DNA, 22 bp, Homo sapiens
cgcaccactgaattccagcctg

SEQ ID NO: 7601006 - DNA, 22 bp, Homo sapiens
cgcaccactgaattccagcctg

SEQ ID NO: 7601007 - DNA, 22 bp, Homo sapiens
cgcaccactgaattccagcctg

SEQ ID NO: 7601008 - DNA, 22 bp, Homo sapiens
ttattcacatgggctcattcta

SEQ ID NO: 7601009 - DNA, 22 bp, Homo sapiens
ttattcaccagtgtaaaacact

SEQ ID NO: 7601010 - DNA, 22 bp, Homo sapiens
ttattattttgtgtacagcaaa

SEQ ID NO: 7601011 - DNA, 22 bp, Homo sapiens
ttattattttgtgtacagcaaa

SEQ ID NO: 7601012 - DNA, 22 bp, Homo sapiens
ttattattttgtgtacagcaaa

SEQ ID NO: 7601013 - DNA, 22 bp, Homo sapiens
ttattattttgtgtacagcaaa

SEQ ID NO: 7601014 - DNA, 22 bp, Homo sapiens
ttattattttgtgtacagcaaa

SEQ ID NO: 7601015 - DNA, 22 bp, Homo sapiens
ttattcacaaatgttgccctgt

SEQ ID NO: 7601016 - DNA, 22 bp, Homo sapiens
ttattattttgtgtacagcaaa

SEQ ID NO: 7601017 - DNA, 22 bp, Homo sapiens
ttattattttgtgtacagcaaa

SEQ ID NO: 7601018 - DNA, 22 bp, Homo sapiens
ttattattttgtgtacagcaaa

SEQ ID NO: 7601019 - DNA, 22 bp, Homo sapiens
ttattattttgtgtacagcaaa

SEQ ID NO: 7601020 - DNA, 22 bp, Homo sapiens
ttattattttgtgtacagcaaa

SEQ ID NO: 7601021 - DNA, 22 bp, Homo sapiens
ttattattttgtgtacagcaaa

SEQ ID NO: 7601022 - DNA, 22 bp, Homo sapiens
ttattattttgtgtacagcaaa

SEQ ID NO: 7601023 - DNA, 22 bp, Homo sapiens
ttattattttgtgtacagcaaa

SEQ ID NO: 7601024 - DNA, 22 bp, Homo sapiens
ttattattttgtgtacagcaaa

SEQ ID NO: 7601025 - DNA, 22 bp, Homo sapiens
cgcaaagagctctaaatcagac

SEQ ID NO: 7601026 - DNA, 20 bp, Homo sapiens
cgattcagtggagtttgaaa

SEQ ID NO: 7601027 - DNA, 22 bp, Homo sapiens
cgattgtcatattctgttggat

SEQ ID NO: 7601028 - DNA, 22 bp, Homo sapiens
cgatttccgcttgatctgatct

SEQ ID NO: 7601029 - DNA, 22 bp, Homo sapiens
cgatttccgcttgatctgatct

SEQ ID NO: 7601030 - DNA, 22 bp, Homo sapiens
cgattttgtggcaaattcttct

SEQ ID NO: 7601031 - DNA, 22 bp, Homo sapiens
cgcaactcagcaacttaactgc

SEQ ID NO: 7601032 - DNA, 22 bp, Homo sapiens
cgcaactcagcaacttaactgc

SEQ ID NO: 7601033 - DNA, 19 bp, Homo sapiens
cgcacagcctgccaggcgc

SEQ ID NO: 7601034 - DNA, 19 bp, Homo sapiens
cgcacagcctgccaggcgc

SEQ ID NO: 7601035 - DNA, 22 bp, Homo sapiens
cgcaactcagcaacttaactgc

SEQ ID NO: 7601036 - DNA, 22 bp, Homo sapiens
cgcaccactgaattccagcctg

SEQ ID NO: 7601037 - DNA, 22 bp, Homo sapiens
cgcaccactgaattccagcctg

SEQ ID NO: 7601038 - DNA, 22 bp, Homo sapiens
cgcacagctgcaaggagttgca

SEQ ID NO: 7601039 - DNA, 22 bp, Homo sapiens
cgcaccactgaattccagcctg

SEQ ID NO: 7601040 - DNA, 22 bp, Homo sapiens
cgagtgtccctaccatttccta

SEQ ID NO: 7601041 - DNA, 22 bp, Homo sapiens
cgagtgtccctaccatttccta

SEQ ID NO: 7601042 - DNA, 22 bp, Homo sapiens
cgagtgtccctaccatttccta

SEQ ID NO: 7601043 - DNA, 22 bp, Homo sapiens
cgagtgtctgctatgggctgag

SEQ ID NO: 7601044 - DNA, 22 bp, Homo sapiens
cgatgaatatttaacgctgtga

SEQ ID NO: 7601045 - DNA, 22 bp, Homo sapiens
cgatcaccgtggccactttgag

SEQ ID NO: 7601046 - DNA, 22 bp, Homo sapiens
cgatcaccgtggccactttgag

SEQ ID NO: 7601047 - DNA, 22 bp, Homo sapiens
cgagtgtctgctatgggctgag

SEQ ID NO: 7601048 - DNA, 22 bp, Homo sapiens
cgaggtgggcagatcacagagt

SEQ ID NO: 7601049 - DNA, 22 bp, Homo sapiens
cgaggtgatggcatttagactc

SEQ ID NO: 7601050 - DNA, 21 bp, Homo sapiens
cgaggtgagctcttggctcag

SEQ ID NO: 7601051 - DNA, 22 bp, Homo sapiens
cgaggtgatggcatttagactc

SEQ ID NO: 7601052 - DNA, 22 bp, Homo sapiens
cgaggtgggcagatcacagagt

SEQ ID NO: 7601053 - DNA, 18 bp, Homo sapiens
cgatgtgtatgtgatttg

SEQ ID NO: 7601054 - DNA, 18 bp, Homo sapiens
cgatgtgtatgtgatttg

SEQ ID NO: 7601055 - DNA, 22 bp, Homo sapiens
cgatgcttcttttggagaagtc

SEQ ID NO: 7601056 - DNA, 22 bp, Homo sapiens
cgatggaattggaaagaggaat

SEQ ID NO: 7601057 - DNA, 22 bp, Homo sapiens
cgatgggggcagtgttacattg

SEQ ID NO: 7601058 - DNA, 22 bp, Homo sapiens
cgatggagaggtcctgatagtt

SEQ ID NO: 7601059 - DNA, 22 bp, Homo sapiens
cgagcagaatggagggtgccga

SEQ ID NO: 7601060 - DNA, 22 bp, Homo sapiens
cgagcagaatggagggtgccga

SEQ ID NO: 7601061 - DNA, 22 bp, Homo sapiens
cgagcagaatggagggtgccga

SEQ ID NO: 7601062 - DNA, 22 bp, Homo sapiens
cctttgggtgaattcctctctt

SEQ ID NO: 7601063 - DNA, 22 bp, Homo sapiens
cgagcagaagcctggtggtctg

SEQ ID NO: 7601064 - DNA, 22 bp, Homo sapiens
cgagcagagcagagacgtctgg

SEQ ID NO: 7601065 - DNA, 22 bp, Homo sapiens
cgagcagagcagagacgtctgg

SEQ ID NO: 7601066 - DNA, 22 bp, Homo sapiens
cgagcagagcagagacgtctgg

SEQ ID NO: 7601067 - DNA, 22 bp, Homo sapiens
cgagggctgtgttgctctcctt

SEQ ID NO: 7601068 - DNA, 22 bp, Homo sapiens
cgaggctagaggcaggctcggc

SEQ ID NO: 7601069 - DNA, 22 bp, Homo sapiens
cgagggctgtgttgctctcctt

SEQ ID NO: 7601070 - DNA, 17 bp, Homo sapiens
cgagggcttgctggctc

SEQ ID NO: 7601071 - DNA, 17 bp, Homo sapiens
cgagggcttgctggctc

SEQ ID NO: 7601072 - DNA, 22 bp, Homo sapiens
cgagggctgtgttgctctcctt

SEQ ID NO: 7601073 - DNA, 17 bp, Homo sapiens
cgagggcttgctggctc

SEQ ID NO: 7601074 - DNA, 22 bp, Homo sapiens
cgagggtgtgctgacccagctc

SEQ ID NO: 7601075 - DNA, 17 bp, Homo sapiens
cgagggcttgctggctc

SEQ ID NO: 7601076 - DNA, 17 bp, Homo sapiens
cgagggcttgctggctc

SEQ ID NO: 7601077 - DNA, 22 bp, Homo sapiens
cgaggtgactttggtttagaca

SEQ ID NO: 7601078 - DNA, 21 bp, Homo sapiens
cgaggtgagctcttggctcag

SEQ ID NO: 7601079 - DNA, 22 bp, Homo sapiens
cgaggtgactttggtttagaca

SEQ ID NO: 7601080 - DNA, 22 bp, Homo sapiens
cctttgggaataggttccggct

SEQ ID NO: 7601081 - DNA, 22 bp, Homo sapiens
cctttggggctttactgtggaa

SEQ ID NO: 7601082 - DNA, 22 bp, Homo sapiens
cctttggggctttactgtggaa

SEQ ID NO: 7601083 - DNA, 22 bp, Homo sapiens
cctttggggtcctgcctgggct

SEQ ID NO: 7601084 - DNA, 22 bp, Homo sapiens
cctttggggtcctgcctgggct

SEQ ID NO: 7601085 - DNA, 22 bp, Homo sapiens
cctttggctgcatagggaaggg

SEQ ID NO: 7601086 - DNA, 22 bp, Homo sapiens
cctttggccgctttatggagga

SEQ ID NO: 7601087 - DNA, 22 bp, Homo sapiens
cctttggccctgagagatgatt

SEQ ID NO: 7601088 - DNA, 22 bp, Homo sapiens
cctttggccgctttatggagga

SEQ ID NO: 7601089 - DNA, 22 bp, Homo sapiens
cctttggctgcatagggaaggg

SEQ ID NO: 7601090 - DNA, 22 bp, Homo sapiens
cctttggccgctttatggagga

SEQ ID NO: 7601091 - DNA, 22 bp, Homo sapiens
cctttggctgcatagggaaggg

SEQ ID NO: 7601092 - DNA, 22 bp, Homo sapiens
cctttggccctgagagatgatt

SEQ ID NO: 7601093 - DNA, 22 bp, Homo sapiens
cctttggcattttgaggatgcg

SEQ ID NO: 7601094 - DNA, 22 bp, Homo sapiens
cctttggcattttgaggatgcg

SEQ ID NO: 7601095 - DNA, 19 bp, Homo sapiens
cctttggatttgtttagtc

SEQ ID NO: 7601096 - DNA, 22 bp, Homo sapiens
cctttggagagtttgttagggg

SEQ ID NO: 7601097 - DNA, 22 bp, Homo sapiens
cctttggagcaactgagagcta

SEQ ID NO: 7601098 - DNA, 22 bp, Homo sapiens
cctttggagcaactgagagcta

SEQ ID NO: 7601099 - DNA, 22 bp, Homo sapiens
cctttggaggaagtgtggccct

SEQ ID NO: 7601100 - DNA, 22 bp, Homo sapiens
ttatgtcatgtggtggtgaaga

SEQ ID NO: 7601101 - DNA, 22 bp, Homo sapiens
ttatgtcaaaatggttgagatt

SEQ ID NO: 7601102 - DNA, 22 bp, Homo sapiens
ttatgtatggatggctgaaagt

SEQ ID NO: 7601103 - DNA, 22 bp, Homo sapiens
ttatgtatggatggctgaaagt

SEQ ID NO: 7601104 - DNA, 22 bp, Homo sapiens
ttatgtatggatggctgaaagt

SEQ ID NO: 7601105 - DNA, 22 bp, Homo sapiens
ttatgtatgaatatagtagaag

SEQ ID NO: 7601106 - DNA, 22 bp, Homo sapiens
ttatgtatgaatatagtagaag

SEQ ID NO: 7601107 - DNA, 22 bp, Homo sapiens
ttatgtatgaatatagtagaag

SEQ ID NO: 7601108 - DNA, 17 bp, Homo sapiens
cctttcttcccagaggg

SEQ ID NO: 7601109 - DNA, 22 bp, Homo sapiens
cctttctgtgttgccctatttg

SEQ ID NO: 7601110 - DNA, 22 bp, Homo sapiens
cctttctggtatttaaccaaag

SEQ ID NO: 7601111 - DNA, 20 bp, Homo sapiens
cctttctggagtgctgttca

SEQ ID NO: 7601112 - DNA, 22 bp, Homo sapiens
cctttctgatggcctcccagcc

SEQ ID NO: 7601113 - DNA, 22 bp, Homo sapiens
cctttctgatggcctcccagcc

SEQ ID NO: 7601114 - DNA, 22 bp, Homo sapiens
cctttctgatggcctcccagcc

SEQ ID NO: 7601115 - DNA, 22 bp, Homo sapiens
cctttgcatttatgtgtccatt

SEQ ID NO: 7601116 - DNA, 22 bp, Homo sapiens
cctttgcattctagatgtttag

SEQ ID NO: 7601117 - DNA, 22 bp, Homo sapiens
cctttgcattctagatgtttag

SEQ ID NO: 7601118 - DNA, 18 bp, Homo sapiens
cctttgcaaagggggtta

SEQ ID NO: 7601119 - DNA, 22 bp, Homo sapiens
cctttgcaacagaaagacctga

SEQ ID NO: 7601120 - DNA, 22 bp, Homo sapiens
cctttcttgcttagtggctcat

SEQ ID NO: 7601121 - DNA, 22 bp, Homo sapiens
cctttcttgctaagagtttatg

SEQ ID NO: 7601122 - DNA, 22 bp, Homo sapiens
cctttcttgctaagagtttatg

SEQ ID NO: 7601123 - DNA, 22 bp, Homo sapiens
cctttcttgctaagagtttatg

SEQ ID NO: 7601124 - DNA, 22 bp, Homo sapiens
cctttcttttatccaccagcca

SEQ ID NO: 7601125 - DNA, 22 bp, Homo sapiens
cctttcttttatccaccagcca

SEQ ID NO: 7601126 - DNA, 19 bp, Homo sapiens
cctttgaatcaggacactt

SEQ ID NO: 7601127 - DNA, 19 bp, Homo sapiens
cctttgaatcaggacactt

SEQ ID NO: 7601128 - DNA, 23 bp, Homo sapiens
ttatggggaaggtgactgggaca

SEQ ID NO: 7601129 - DNA, 22 bp, Homo sapiens
ttatggtaattaaaacatgtat

SEQ ID NO: 7601130 - DNA, 22 bp, Homo sapiens
ttatgggagcaattggggaggt

SEQ ID NO: 7601131 - DNA, 22 bp, Homo sapiens
ttatgggagcaattggggaggt

SEQ ID NO: 7601132 - DNA, 22 bp, Homo sapiens
ttatgggagcaattggggaggt

SEQ ID NO: 7601133 - DNA, 22 bp, Homo sapiens
ttatgggagcaattggggaggt

SEQ ID NO: 7601134 - DNA, 22 bp, Homo sapiens
ttatggcttttatcctctcttg

SEQ ID NO: 7601135 - DNA, 22 bp, Homo sapiens
ttatggcttttatcctctcttg

SEQ ID NO: 7601136 - DNA, 22 bp, Homo sapiens
ttatggcttctgtgaagaattt

SEQ ID NO: 7601137 - DNA, 22 bp, Homo sapiens
ttatggcttgaaactctaagga

SEQ ID NO: 7601138 - DNA, 22 bp, Homo sapiens
ttatggcttgaaactctaagga

SEQ ID NO: 7601139 - DNA, 22 bp, Homo sapiens
ttatgtacaatgttaatgtaaa

SEQ ID NO: 7601140 - DNA, 22 bp, Homo sapiens
ttatgtacaatgttaatgtaaa

SEQ ID NO: 7601141 - DNA, 22 bp, Homo sapiens
ttatgtacaatgttaatgtaaa

SEQ ID NO: 7601142 - DNA, 22 bp, Homo sapiens
ttatgtacaatgttaatgtaaa

SEQ ID NO: 7601143 - DNA, 22 bp, Homo sapiens
ttatgtaatttgtttgctcttc

SEQ ID NO: 7601144 - DNA, 22 bp, Homo sapiens
ttatggtaggagctgtcagttt

SEQ ID NO: 7601145 - DNA, 22 bp, Homo sapiens
ttatgtaatttgtttgctcttc

SEQ ID NO: 7601146 - DNA, 22 bp, Homo sapiens
ttatgtaagtggagtcatatag

SEQ ID NO: 7601147 - DNA, 22 bp, Homo sapiens
ttatgtaagtggagtcatatag

SEQ ID NO: 7601148 - DNA, 22 bp, Homo sapiens
ttatggtaggagctgtcagttt

SEQ ID NO: 7601149 - DNA, 22 bp, Homo sapiens
ttatggtaattaaaacatgtat

SEQ ID NO: 7601150 - DNA, 22 bp, Homo sapiens
ttatggcttgtgcaggatctag

SEQ ID NO: 7601151 - DNA, 22 bp, Homo sapiens
ttatgtagtcactgtggtcttg

SEQ ID NO: 7601152 - DNA, 22 bp, Homo sapiens
ttatgtaggataatgaattgcc

SEQ ID NO: 7601153 - DNA, 22 bp, Homo sapiens
ttatgtactctgcaatgtttga

SEQ ID NO: 7601154 - DNA, 22 bp, Homo sapiens
ttatgtactctgcaatgtttga

SEQ ID NO: 7601155 - DNA, 22 bp, Homo sapiens
ttatgtactctgcaatgtttga

SEQ ID NO: 7601156 - DNA, 22 bp, Homo sapiens
ttatgtactctgcaatgtttga

SEQ ID NO: 7601157 - DNA, 22 bp, Homo sapiens
ttatgtacaatgttaatgtaaa

SEQ ID NO: 7601158 - DNA, 22 bp, Homo sapiens
ttatgtacaatgttaatgtaaa

SEQ ID NO: 7601159 - DNA, 22 bp, Homo sapiens
ttatgtacccactcatattccc

SEQ ID NO: 7601160 - DNA, 22 bp, Homo sapiens
ttatgtacccactcatattccc

SEQ ID NO: 7601161 - DNA, 22 bp, Homo sapiens
ttatgtacccactcatattccc

SEQ ID NO: 7601162 - DNA, 22 bp, Homo sapiens
ttatgtacccactcatattccc

SEQ ID NO: 7601163 - DNA, 22 bp, Homo sapiens
ttatgtacctgaattagtaaag

SEQ ID NO: 7601164 - DNA, 22 bp, Homo sapiens
ttatgtacctgaattagtaaag

SEQ ID NO: 7601165 - DNA, 22 bp, Homo sapiens
ttatgtacctgaattagtaaag

SEQ ID NO: 7601166 - DNA, 22 bp, Homo sapiens
ttatgtacctctttctgcttca

SEQ ID NO: 7601167 - DNA, 22 bp, Homo sapiens
ttatgtacctctttctgcttca

SEQ ID NO: 7601168 - DNA, 22 bp, Homo sapiens
ttcttcagtgacaaaggcaaaa

SEQ ID NO: 7601169 - DNA, 22 bp, Homo sapiens
ttcttcagtgacaaaggcaaaa

SEQ ID NO: 7601170 - DNA, 22 bp, Homo sapiens
ttcttcagtgcccctctagtag

SEQ ID NO: 7601171 - DNA, 22 bp, Homo sapiens
ttcttcagtgcccctctagtag

SEQ ID NO: 7601172 - DNA, 22 bp, Homo sapiens
ttcttcagtgtagcaactgtat

SEQ ID NO: 7601173 - DNA, 22 bp, Homo sapiens
ttcttcagtgtagcaactgtat

SEQ ID NO: 7601174 - DNA, 22 bp, Homo sapiens
ttcttcagtttggtaaatgtaa

SEQ ID NO: 7601175 - DNA, 21 bp, Homo sapiens
ttcttcatgatgattaatggc

SEQ ID NO: 7601176 - DNA, 21 bp, Homo sapiens
ttcttcatgatgattaatggc

SEQ ID NO: 7601177 - DNA, 22 bp, Homo sapiens
ttcttcagtttggtaaatgtaa

SEQ ID NO: 7601178 - DNA, 22 bp, Homo sapiens
ttcttcatctgtaagataagca

SEQ ID NO: 7601179 - DNA, 22 bp, Homo sapiens
ttcttcatctgtaagataagca

SEQ ID NO: 7601180 - DNA, 22 bp, Homo sapiens
ttcttcccttcattccaccacc

SEQ ID NO: 7601181 - DNA, 22 bp, Homo sapiens
ttcttcccttcattccaccacc

SEQ ID NO: 7601182 - DNA, 22 bp, Homo sapiens
ttcttcccagccagcacagccc

SEQ ID NO: 7601183 - DNA, 22 bp, Homo sapiens
ttcttcccagccagcacagccc

SEQ ID NO: 7601184 - DNA, 23 bp, Homo sapiens
ttcttccaaggtgctttgtggtt

SEQ ID NO: 7601185 - DNA, 23 bp, Homo sapiens
ttcttcattttcagagttgagca

SEQ ID NO: 7601186 - DNA, 22 bp, Homo sapiens
ttcttcattcccttacttccga

SEQ ID NO: 7601187 - DNA, 22 bp, Homo sapiens
ttcttcattcccttacttccga

SEQ ID NO: 7601188 - DNA, 23 bp, Homo sapiens
ttcttcattttcagagttgagca

SEQ ID NO: 7601189 - DNA, 23 bp, Homo sapiens
ttcttccaaggtgctttgtggtt

SEQ ID NO: 7601190 - DNA, 21 bp, Homo sapiens
ttcttcatgatgattaatggc

SEQ ID NO: 7601191 - DNA, 22 bp, Homo sapiens
ttcttcatgctgttgctgcttg

SEQ ID NO: 7601192 - DNA, 22 bp, Homo sapiens
ttcttcatgggttcttttagga

SEQ ID NO: 7601193 - DNA, 22 bp, Homo sapiens
ttcttcatgctgttgctgcttg

SEQ ID NO: 7601194 - DNA, 22 bp, Homo sapiens
ttcttcattcccttacttccga

SEQ ID NO: 7601195 - DNA, 22 bp, Homo sapiens
ttgaaatatcaagttattagtg

SEQ ID NO: 7601196 - DNA, 22 bp, Homo sapiens
ttgaaatatcaagttattagtg

SEQ ID NO: 7601197 - DNA, 22 bp, Homo sapiens
ttgaaatatcaagttattagtg

SEQ ID NO: 7601198 - DNA, 22 bp, Homo sapiens
ttgaaatatcaagttattagtg

SEQ ID NO: 7601199 - DNA, 22 bp, Homo sapiens
ttgaaatatcaagttattagtg

SEQ ID NO: 7601200 - DNA, 22 bp, Homo sapiens
ttcttcccttcattccaccacc

SEQ ID NO: 7601201 - DNA, 22 bp, Homo sapiens
ttgaaatatcaagttattagtg

SEQ ID NO: 7601202 - DNA, 22 bp, Homo sapiens
ttgaagtatagagtttaagaac

SEQ ID NO: 7601203 - DNA, 22 bp, Homo sapiens
ttgaagtagtatcttaaggaca

SEQ ID NO: 7601204 - DNA, 22 bp, Homo sapiens
ttgaaggtcctgtttctatcca

SEQ ID NO: 7601205 - DNA, 19 bp, Homo sapiens
ttgaaggttcggagatagg

SEQ ID NO: 7601206 - DNA, 21 bp, Homo sapiens
ttgaaggatcacttctgtacc

SEQ ID NO: 7601207 - DNA, 22 bp, Homo sapiens
ttgaaggaggcgaaaattggtc

SEQ ID NO: 7601208 - DNA, 18 bp, Homo sapiens
ttgaagttatttacattc

SEQ ID NO: 7601209 - DNA, 18 bp, Homo sapiens
ttgaagttatttacattc

SEQ ID NO: 7601210 - DNA, 22 bp, Homo sapiens
ttgaagtgagaggggctggggt

SEQ ID NO: 7601211 - DNA, 22 bp, Homo sapiens
ttgaagttctgcatttctaata

SEQ ID NO: 7601212 - DNA, 22 bp, Homo sapiens
ttgaagttctaagccccagtac

SEQ ID NO: 7601213 - DNA, 23 bp, Homo sapiens
ttgaagttctgctgtgttatagg

SEQ ID NO: 7601214 - DNA, 22 bp, Homo sapiens
ttgaagttgcacattataattt

SEQ ID NO: 7601215 - DNA, 22 bp, Homo sapiens
ttgaagttgcacattataattt

SEQ ID NO: 7601216 - DNA, 22 bp, Homo sapiens
ttgaagttgcacattataattt

SEQ ID NO: 7601217 - DNA, 22 bp, Homo sapiens
ttgaagtcagagttttcaagca

SEQ ID NO: 7601218 - DNA, 22 bp, Homo sapiens
ttgaataatatgcttcgttctc

SEQ ID NO: 7601219 - DNA, 22 bp, Homo sapiens
ttgaataatatgttcaggagga

SEQ ID NO: 7601220 - DNA, 22 bp, Homo sapiens
ttgaataatatgcttcgttctc

SEQ ID NO: 7601221 - DNA, 22 bp, Homo sapiens
ttgaagttggtgtggaaagtag

SEQ ID NO: 7601222 - DNA, 22 bp, Homo sapiens
ttgaagttgtagttcagtgaag

SEQ ID NO: 7601223 - DNA, 22 bp, Homo sapiens
ttgaagtttaatggtagattcc

SEQ ID NO: 7601224 - DNA, 22 bp, Homo sapiens
ttgaataatgtgtatgttgtta

SEQ ID NO: 7601225 - DNA, 22 bp, Homo sapiens
ttgaataatgtgtatgttgtta

SEQ ID NO: 7601226 - DNA, 16 bp, Homo sapiens
ttgaatactcatagca

SEQ ID NO: 7601227 - DNA, 22 bp, Homo sapiens
ttgaatactcagaaaatgacat

SEQ ID NO: 7601228 - DNA, 22 bp, Homo sapiens
ttgaatacaagtagagaagaca

SEQ ID NO: 7601229 - DNA, 22 bp, Homo sapiens
ttgaataattaattacactcag

SEQ ID NO: 7601230 - DNA, 22 bp, Homo sapiens
ttgaatactcagaaaatgacat

SEQ ID NO: 7601231 - DNA, 22 bp, Homo sapiens
ttgaatactcagaaaatgacat

SEQ ID NO: 7601232 - DNA, 22 bp, Homo sapiens
ttgaatgaagtccctttttact

SEQ ID NO: 7601233 - DNA, 22 bp, Homo sapiens
ttgaatgaaattgctgtgttat

SEQ ID NO: 7601234 - DNA, 22 bp, Homo sapiens
ttgaatgaagggatgaccgaag

SEQ ID NO: 7601235 - DNA, 22 bp, Homo sapiens
ttgaatgaagggatgaccgaag

SEQ ID NO: 7601236 - DNA, 22 bp, Homo sapiens
ttgaatctatgtattcagtgta

SEQ ID NO: 7601237 - DNA, 22 bp, Homo sapiens
ttgaatctataatttcagtatt

SEQ ID NO: 7601238 - DNA, 22 bp, Homo sapiens
ttgaatcattacaatagataag

SEQ ID NO: 7601239 - DNA, 22 bp, Homo sapiens
ttgaatcattacaatagataag

SEQ ID NO: 7601240 - DNA, 22 bp, Homo sapiens
ttgaatcattacaatagataag

SEQ ID NO: 7601241 - DNA, 22 bp, Homo sapiens
ttgaatctataatttcagtatt

SEQ ID NO: 7601242 - DNA, 19 bp, Homo sapiens
ttgaatatgcaaactgaag

SEQ ID NO: 7601243 - DNA, 22 bp, Homo sapiens
ttgaatcattacaatagataag

SEQ ID NO: 7601244 - DNA, 19 bp, Homo sapiens
ttgaatatgcaaactgaag

SEQ ID NO: 7601245 - DNA, 19 bp, Homo sapiens
ttgaatatgcaaactgaag

SEQ ID NO: 7601246 - DNA, 19 bp, Homo sapiens
ttgaatatgcaaactgaag

SEQ ID NO: 7601247 - DNA, 22 bp, Homo sapiens
ctcactgcaatctccgtctccc

SEQ ID NO: 7601248 - DNA, 22 bp, Homo sapiens
ctcactgcaagctctgcctccc

SEQ ID NO: 7601249 - DNA, 22 bp, Homo sapiens
ctcactggcaagactacaggtg

SEQ ID NO: 7601250 - DNA, 22 bp, Homo sapiens
ctcactggcaagactacaggtg

SEQ ID NO: 7601251 - DNA, 22 bp, Homo sapiens
ctcactgccctgaagttgggtt

SEQ ID NO: 7601252 - DNA, 22 bp, Homo sapiens
ctcactgcaagctctgcctccc

SEQ ID NO: 7601253 - DNA, 22 bp, Homo sapiens
ctcactgcaagctctgcctccc

SEQ ID NO: 7601254 - DNA, 22 bp, Homo sapiens
ctcactgcaagctctgcctccc

SEQ ID NO: 7601255 - DNA, 22 bp, Homo sapiens
ctcactgcaagctctgcctccc

SEQ ID NO: 7601256 - DNA, 22 bp, Homo sapiens
ctcactgcaagctccgcctccc

SEQ ID NO: 7601257 - DNA, 22 bp, Homo sapiens
ctcactgcaagctccgcctccc

SEQ ID NO: 7601258 - DNA, 22 bp, Homo sapiens
ctcactgcaagctctgcctcca

SEQ ID NO: 7601259 - DNA, 22 bp, Homo sapiens
ctcactgcaagctctgcctcca

SEQ ID NO: 7601260 - DNA, 22 bp, Homo sapiens
ctcactgcaagctctgcctcca

SEQ ID NO: 7601261 - DNA, 22 bp, Homo sapiens
ctcactgcaagctctgcctcca

SEQ ID NO: 7601262 - DNA, 22 bp, Homo sapiens
ctcactgcaagctccgcctccc

SEQ ID NO: 7601263 - DNA, 22 bp, Homo sapiens
ctcactgcaagctctgcctcca

SEQ ID NO: 7601264 - DNA, 22 bp, Homo sapiens
ctcactggcaagactacaggtg

SEQ ID NO: 7601265 - DNA, 22 bp, Homo sapiens
ctcactggcaagactacaggtg

SEQ ID NO: 7601266 - DNA, 22 bp, Homo sapiens
ctcactggcaagactacaggtg

SEQ ID NO: 7601267 - DNA, 22 bp, Homo sapiens
ctcagaaaacctctttcttgat

SEQ ID NO: 7601268 - DNA, 20 bp, Homo sapiens
ctcagaaaagctaaggagaa

SEQ ID NO: 7601269 - DNA, 20 bp, Homo sapiens
ctcagaaaagctaaggagaa

SEQ ID NO: 7601270 - DNA, 22 bp, Homo sapiens
ctcagaaacggagctgccattt

SEQ ID NO: 7601271 - DNA, 22 bp, Homo sapiens
ctcagaaacggagctgccattt

SEQ ID NO: 7601272 - DNA, 22 bp, Homo sapiens
ctcagaaacggagctgccattt

SEQ ID NO: 7601273 - DNA, 22 bp, Homo sapiens
ctcagaaacggagctgccattt

SEQ ID NO: 7601274 - DNA, 22 bp, Homo sapiens
ctcagaaaacctctttcttgat

SEQ ID NO: 7601275 - DNA, 22 bp, Homo sapiens
ctcagaaaacctctttcttgat

SEQ ID NO: 7601276 - DNA, 22 bp, Homo sapiens
ctcactgtttaatagctggatc

SEQ ID NO: 7601277 - DNA, 22 bp, Homo sapiens
ttcttaaagaggcaaaacacag

SEQ ID NO: 7601278 - DNA, 22 bp, Homo sapiens
ttcttaaagaggcaaaacacag

SEQ ID NO: 7601279 - DNA, 22 bp, Homo sapiens
ttcttaactcaaatatatatcc

SEQ ID NO: 7601280 - DNA, 22 bp, Homo sapiens
ttcttaactcaaatatatatcc

SEQ ID NO: 7601281 - DNA, 22 bp, Homo sapiens
ttcttaactggaaaatgtcaga

SEQ ID NO: 7601282 - DNA, 22 bp, Homo sapiens
ttcttaaagaggcaaaacacag

SEQ ID NO: 7601283 - DNA, 22 bp, Homo sapiens
ttcttaaagaggcaaaacacag

SEQ ID NO: 7601284 - DNA, 20 bp, Homo sapiens
ttcttaaagacctcactttg

SEQ ID NO: 7601285 - DNA, 20 bp, Homo sapiens
ttcttaaagacctcactttg

SEQ ID NO: 7601286 - DNA, 20 bp, Homo sapiens
ttcttaaagacctcactttg

SEQ ID NO: 7601287 - DNA, 20 bp, Homo sapiens
ttcttaaagacctcactttg

SEQ ID NO: 7601288 - DNA, 20 bp, Homo sapiens
ttcttaaagacctcactttg

SEQ ID NO: 7601289 - DNA, 20 bp, Homo sapiens
ttcttaaagacctcactttg

SEQ ID NO: 7601290 - DNA, 22 bp, Homo sapiens
ttcttaaagaggcaaaacacag

SEQ ID NO: 7601291 - DNA, 22 bp, Homo sapiens
ttcttaaagaggcaaaacacag

SEQ ID NO: 7601292 - DNA, 22 bp, Homo sapiens
ttcttaaagaggcaaaacacag

SEQ ID NO: 7601293 - DNA, 22 bp, Homo sapiens
ttcttaaagaggcaaaacacag

SEQ ID NO: 7601294 - DNA, 22 bp, Homo sapiens
ttcttaaagaggcaaaacacag

SEQ ID NO: 7601295 - DNA, 22 bp, Homo sapiens
ttcttaagcacctaaaaagtgg

SEQ ID NO: 7601296 - DNA, 22 bp, Homo sapiens
ttcttaagcacctaaaaagtgg

SEQ ID NO: 7601297 - DNA, 22 bp, Homo sapiens
ttcttaagcagtttggcatgtt

SEQ ID NO: 7601298 - DNA, 22 bp, Homo sapiens
ttcttaagcagtttggcatgtt

SEQ ID NO: 7601299 - DNA, 22 bp, Homo sapiens
ttcttaagcagtttggcatgtt

SEQ ID NO: 7601300 - DNA, 22 bp, Homo sapiens
ttcttaagcgtatgataatgaa

SEQ ID NO: 7601301 - DNA, 22 bp, Homo sapiens
ttcttaagcgtatgataatgaa

SEQ ID NO: 7601302 - DNA, 22 bp, Homo sapiens
ttcttaagtcagtaagatgcaa

SEQ ID NO: 7601303 - DNA, 22 bp, Homo sapiens
ttcttaagtcagtaagatgcaa

SEQ ID NO: 7601304 - DNA, 22 bp, Homo sapiens
ttcttaagtcagtaagatgcaa

SEQ ID NO: 7601305 - DNA, 22 bp, Homo sapiens
ttcttaagtatgatcttaacgg

SEQ ID NO: 7601306 - DNA, 22 bp, Homo sapiens
ttcttaagtatttcagagactg

SEQ ID NO: 7601307 - DNA, 22 bp, Homo sapiens
ttcttaagtatgatcttaacgg

SEQ ID NO: 7601308 - DNA, 22 bp, Homo sapiens
ttcttaagagggttaagtgaag

SEQ ID NO: 7601309 - DNA, 22 bp, Homo sapiens
ttcttaagaggaacatttttgt

SEQ ID NO: 7601310 - DNA, 22 bp, Homo sapiens
ttcttaagactgcaaatcaacc

SEQ ID NO: 7601311 - DNA, 22 bp, Homo sapiens
ttcttaagactgcaaatcaacc

SEQ ID NO: 7601312 - DNA, 22 bp, Homo sapiens
ttcttaagaggaacatttttgt

SEQ ID NO: 7601313 - DNA, 22 bp, Homo sapiens
ttcttaactggaaaatgtcaga

SEQ ID NO: 7601314 - DNA, 22 bp, Homo sapiens
ttcttaagaaaccatcacattc

SEQ ID NO: 7601315 - DNA, 22 bp, Homo sapiens
ttcttaagaaaccatcacattc

SEQ ID NO: 7601316 - DNA, 22 bp, Homo sapiens
ttcttaagaaaccatcacattc

SEQ ID NO: 7601317 - DNA, 22 bp, Homo sapiens
ttcttaagactgcaaatcaacc

SEQ ID NO: 7601318 - DNA, 22 bp, Homo sapiens
ttcttaagtttagcaacttgtg

SEQ ID NO: 7601319 - DNA, 22 bp, Homo sapiens
ttcttaagtgagaaagcaggag

SEQ ID NO: 7601320 - DNA, 22 bp, Homo sapiens
ttcttaagtttagcaacttgtg

SEQ ID NO: 7601321 - DNA, 22 bp, Homo sapiens
ttcttaatacctattttctacc

SEQ ID NO: 7601322 - DNA, 22 bp, Homo sapiens
ttcttaatacctattttctacc

SEQ ID NO: 7601323 - DNA, 22 bp, Homo sapiens
ttcttaagtttagcaacttgtg

SEQ ID NO: 7601324 - DNA, 22 bp, Homo sapiens
ttcttaatacctattttctacc

SEQ ID NO: 7601325 - DNA, 22 bp, Homo sapiens
ttcttaatcccacaaatcttca

SEQ ID NO: 7601326 - DNA, 22 bp, Homo sapiens
ttcttaatcccacaaatcttca

SEQ ID NO: 7601327 - DNA, 22 bp, Homo sapiens
ttcttaatcccacaaatcttca

SEQ ID NO: 7601328 - DNA, 22 bp, Homo sapiens
ttcttaatctgtgtgggttcga

SEQ ID NO: 7601329 - DNA, 22 bp, Homo sapiens
ttcttaatcccacaaatcttca

SEQ ID NO: 7601330 - DNA, 22 bp, Homo sapiens
ttcttaatcccacaaatcttca

SEQ ID NO: 7601331 - DNA, 22 bp, Homo sapiens
ttcttacaagtatgacgtagca

SEQ ID NO: 7601332 - DNA, 19 bp, Homo sapiens
ttcttacaacaccctggga

SEQ ID NO: 7601333 - DNA, 22 bp, Homo sapiens
ttcttacaaacaagatcattga

SEQ ID NO: 7601334 - DNA, 22 bp, Homo sapiens
ttcttaatggcaaaggatttta

SEQ ID NO: 7601335 - DNA, 22 bp, Homo sapiens
ttcttacaaacaagatcattga

SEQ ID NO: 7601336 - DNA, 22 bp, Homo sapiens
ttcttaatggcaaaggatttta

SEQ ID NO: 7601337 - DNA, 22 bp, Homo sapiens
ttcttaatggcaaaggatttta

SEQ ID NO: 7601338 - DNA, 22 bp, Homo sapiens
ttcttaatggcaaaggatttta

SEQ ID NO: 7601339 - DNA, 22 bp, Homo sapiens
ttcttcaggtggttttggtaac

SEQ ID NO: 7601340 - DNA, 22 bp, Homo sapiens
ttcttcagtcccactagccaca

SEQ ID NO: 7601341 - DNA, 22 bp, Homo sapiens
ttcttcagtctaggcctttctt

SEQ ID NO: 7601342 - DNA, 22 bp, Homo sapiens
ttcttcagtcccactagccaca

SEQ ID NO: 7601343 - DNA, 22 bp, Homo sapiens
ttcttcagggaagcttgttaat

SEQ ID NO: 7601344 - DNA, 22 bp, Homo sapiens
ttcttcagggaagcttgttaat

SEQ ID NO: 7601345 - DNA, 21 bp, Homo sapiens
ttcttcaggccaatgctcatt

SEQ ID NO: 7601346 - DNA, 21 bp, Homo sapiens
ttcttcaggccaatgctcatt

SEQ ID NO: 7601347 - DNA, 21 bp, Homo sapiens
ttcttcaggccaatgctcatt

SEQ ID NO: 7601348 - DNA, 21 bp, Homo sapiens
ttcttcaggccaatgctcatt

SEQ ID NO: 7601349 - DNA, 22 bp, Homo sapiens
ttcttcaggatacgtcatccag

SEQ ID NO: 7601350 - DNA, 22 bp, Homo sapiens
ttcttcaggaagagcctggact

SEQ ID NO: 7601351 - DNA, 22 bp, Homo sapiens
ttcttcagcttctacctgcgtc

SEQ ID NO: 7601352 - DNA, 22 bp, Homo sapiens
ttcttcagcttctacctgcgtc

SEQ ID NO: 7601353 - DNA, 22 bp, Homo sapiens
ttcttacaagtatgacgtagca

SEQ ID NO: 7601354 - DNA, 22 bp, Homo sapiens
ttcttacaagtattccaggtcc

SEQ ID NO: 7601355 - DNA, 22 bp, Homo sapiens
ttcttacaagtattccaggtcc

SEQ ID NO: 7601356 - DNA, 22 bp, Homo sapiens
ttctgtctctgtgtttacatta

SEQ ID NO: 7601357 - DNA, 22 bp, Homo sapiens
ttcttaaaattcaagctaggtt

SEQ ID NO: 7601358 - DNA, 22 bp, Homo sapiens
ttcttaaaattcaagctaggtt

SEQ ID NO: 7601359 - DNA, 22 bp, Homo sapiens
ttcttaaaattcaagctaggtt

SEQ ID NO: 7601360 - DNA, 20 bp, Homo sapiens
ttcttaaagacctcactttg

SEQ ID NO: 7601361 - DNA, 22 bp, Homo sapiens
ttctgtctctgtgtttacatta

SEQ ID NO: 7601362 - DNA, 22 bp, Homo sapiens
ttctgtctccctgatgtagagc

SEQ ID NO: 7601363 - DNA, 22 bp, Homo sapiens
ttctgtccttttgaattccaaa

SEQ ID NO: 7601364 - DNA, 22 bp, Homo sapiens
ttctgtcctgttggatgaatca

SEQ ID NO: 7601365 - DNA, 22 bp, Homo sapiens
ttctgtcctgttggatgaatca

SEQ ID NO: 7601366 - DNA, 22 bp, Homo sapiens
ttctgaaatttctgtagatctt

SEQ ID NO: 7601367 - DNA, 22 bp, Homo sapiens
ttctgaaatttcaactttacta

SEQ ID NO: 7601368 - DNA, 22 bp, Homo sapiens
ttctgaaattcgactatccaat

SEQ ID NO: 7601369 - DNA, 22 bp, Homo sapiens
ttctgaaatttcaactttacta

SEQ ID NO: 7601370 - DNA, 22 bp, Homo sapiens
ttctgaagctcccttttgtagt

SEQ ID NO: 7601371 - DNA, 22 bp, Homo sapiens
ttctgaagctcccttttgtagt

SEQ ID NO: 7601372 - DNA, 22 bp, Homo sapiens
ttctgaaccattgagcactgcc

SEQ ID NO: 7601373 - DNA, 22 bp, Homo sapiens
ttctgtccgcttgtttgttaga

SEQ ID NO: 7601374 - DNA, 22 bp, Homo sapiens
ttctgtccgcttgtttgttaga

SEQ ID NO: 7601375 - DNA, 22 bp, Homo sapiens
ttctgtccgcttgtttgttaga

SEQ ID NO: 7601376 - DNA, 22 bp, Homo sapiens
ttctgtcccactggtctgtttg

SEQ ID NO: 7601377 - DNA, 22 bp, Homo sapiens
ttctgaagctcccttttgtagt

SEQ ID NO: 7601378 - DNA, 22 bp, Homo sapiens
ttctgtccctctagagaaccat

SEQ ID NO: 7601379 - DNA, 22 bp, Homo sapiens
ttctgaaattcgactatccaat

SEQ ID NO: 7601380 - DNA, 22 bp, Homo sapiens
ttctgaaattcgactatccaat

SEQ ID NO: 7601381 - DNA, 22 bp, Homo sapiens
ttctgaaataggagatagctgt

SEQ ID NO: 7601382 - DNA, 22 bp, Homo sapiens
ttctgaaaggcatgtcaggtag

SEQ ID NO: 7601383 - DNA, 22 bp, Homo sapiens
ttctgaaagtctttttaagtta

SEQ ID NO: 7601384 - DNA, 22 bp, Homo sapiens
ttctgaaagtctttttaagtta

SEQ ID NO: 7601385 - DNA, 22 bp, Homo sapiens
ttctgaaagtctttttaagtta

SEQ ID NO: 7601386 - DNA, 22 bp, Homo sapiens
ttctgaaagtctttttaagtta

SEQ ID NO: 7601387 - DNA, 22 bp, Homo sapiens
ttctgaaaggcaggttgtttgc

SEQ ID NO: 7601388 - DNA, 22 bp, Homo sapiens
ttctgaaaggcaggttgtttgc

SEQ ID NO: 7601389 - DNA, 22 bp, Homo sapiens
ttctgaaagccaattcattgaa

SEQ ID NO: 7601390 - DNA, 22 bp, Homo sapiens
ttctgaaagccaattcattgaa

SEQ ID NO: 7601391 - DNA, 22 bp, Homo sapiens
ttctgaaaattgggtcatactt

SEQ ID NO: 7601392 - DNA, 22 bp, Homo sapiens
ttctgaaaattgggtcatactt

SEQ ID NO: 7601393 - DNA, 22 bp, Homo sapiens
ttctgaaaattgggtcatactt

SEQ ID NO: 7601394 - DNA, 22 bp, Homo sapiens
ttctgaaaacacactttgcagc

SEQ ID NO: 7601395 - DNA, 23 bp, Homo sapiens
ttctgaaaatagatagtggctcc

SEQ ID NO: 7601396 - DNA, 22 bp, Homo sapiens
ttctgaaaccttcagtatgaag

SEQ ID NO: 7601397 - DNA, 22 bp, Homo sapiens
ttctgaaaccttcagtatgaag

SEQ ID NO: 7601398 - DNA, 22 bp, Homo sapiens
ttctgaaaccttcagtatgaag

SEQ ID NO: 7601399 - DNA, 22 bp, Homo sapiens
ttctgaaaattgggtcatactt

SEQ ID NO: 7601400 - DNA, 22 bp, Homo sapiens
ttctgaaagccaattcattgaa

SEQ ID NO: 7601401 - DNA, 22 bp, Homo sapiens
ttctgaaagccaattcattgaa

SEQ ID NO: 7601402 - DNA, 20 bp, Homo sapiens
ttctgaaagcagcagaggga

SEQ ID NO: 7601403 - DNA, 22 bp, Homo sapiens
ctataaatctacccagcattgg

SEQ ID NO: 7601404 - DNA, 22 bp, Homo sapiens
ctataaatctacccagcattgg

SEQ ID NO: 7601405 - DNA, 22 bp, Homo sapiens
ttctcttttgtgatgtgagatg

SEQ ID NO: 7601406 - DNA, 22 bp, Homo sapiens
ctataaatctacccagcattgg

SEQ ID NO: 7601407 - DNA, 22 bp, Homo sapiens
ctataaatctacccagcattgg

SEQ ID NO: 7601408 - DNA, 22 bp, Homo sapiens
ctataaatctacccagcattgg

SEQ ID NO: 7601409 - DNA, 22 bp, Homo sapiens
ctataaatctacccagcattgg

SEQ ID NO: 7601410 - DNA, 22 bp, Homo sapiens
ctataaatctacccagcattgg

SEQ ID NO: 7601411 - DNA, 22 bp, Homo sapiens
ctataaatctacccagcattgg

SEQ ID NO: 7601412 - DNA, 22 bp, Homo sapiens
ttctgaaaacacactttgcagc

SEQ ID NO: 7601413 - DNA, 22 bp, Homo sapiens
ttctctttttgcatctcaacct

SEQ ID NO: 7601414 - DNA, 22 bp, Homo sapiens
ttctctttttgcatctcaacct

SEQ ID NO: 7601415 - DNA, 22 bp, Homo sapiens
ttctctttttgcatctcaacct

SEQ ID NO: 7601416 - DNA, 22 bp, Homo sapiens
ttctctttttgcatctcaacct

SEQ ID NO: 7601417 - DNA, 22 bp, Homo sapiens
ttctctttttgcatctcaacct

SEQ ID NO: 7601418 - DNA, 18 bp, Homo sapiens
ctcaggcctttccctgtg

SEQ ID NO: 7601419 - DNA, 20 bp, Homo sapiens
ttgcacagagaaggaggcag

SEQ ID NO: 7601420 - DNA, 22 bp, Homo sapiens
ctcaggctaagaaggccaagtg

SEQ ID NO: 7601421 - DNA, 22 bp, Homo sapiens
ttgcacagaaggatatgtcatc

SEQ ID NO: 7601422 - DNA, 22 bp, Homo sapiens
ttgcacagaatgacaatatgta

SEQ ID NO: 7601423 - DNA, 20 bp, Homo sapiens
ttgcacagagaaggaggcag

SEQ ID NO: 7601424 - DNA, 20 bp, Homo sapiens
ttgcacagaggtttcaagtg

SEQ ID NO: 7601425 - DNA, 22 bp, Homo sapiens
ctcaggcctgagtggcagtccc

SEQ ID NO: 7601426 - DNA, 22 bp, Homo sapiens
ttgcacagagtggatattcagt

SEQ ID NO: 7601427 - DNA, 22 bp, Homo sapiens
ttgcacagagtggatattcagt

SEQ ID NO: 7601428 - DNA, 22 bp, Homo sapiens
ttgcacagagtggatattcagt

SEQ ID NO: 7601429 - DNA, 18 bp, Homo sapiens
ctcaggcctttccctgtg

SEQ ID NO: 7601430 - DNA, 18 bp, Homo sapiens
ctcaggcctttccctgtg

SEQ ID NO: 7601431 - DNA, 22 bp, Homo sapiens
ctcaggccttgaagtcttttct

SEQ ID NO: 7601432 - DNA, 22 bp, Homo sapiens
ctcaggccttgaagtcttttct

SEQ ID NO: 7601433 - DNA, 22 bp, Homo sapiens
ctcaggccttgaagtcttttct

SEQ ID NO: 7601434 - DNA, 23 bp, Homo sapiens
ttgcacagtttcggaaactgagg

SEQ ID NO: 7601435 - DNA, 22 bp, Homo sapiens
ttgcacagtttgaagatgactc

SEQ ID NO: 7601436 - DNA, 23 bp, Homo sapiens
ttgcacagtgtatacacatattt

SEQ ID NO: 7601437 - DNA, 22 bp, Homo sapiens
ttgcacatgctatttatgtttt

SEQ ID NO: 7601438 - DNA, 22 bp, Homo sapiens
ttgcacatgctatttatgtttt

SEQ ID NO: 7601439 - DNA, 22 bp, Homo sapiens
ttgcacagtttgaagatgactc

SEQ ID NO: 7601440 - DNA, 22 bp, Homo sapiens
ttgcacagcaacgtgaatgtac

SEQ ID NO: 7601441 - DNA, 22 bp, Homo sapiens
ttgcacagatgcacatggttgc

SEQ ID NO: 7601442 - DNA, 22 bp, Homo sapiens
ttgcacagatgagggtgatgct

SEQ ID NO: 7601443 - DNA, 22 bp, Homo sapiens
ttgcacagatgagggtgatgct

SEQ ID NO: 7601444 - DNA, 22 bp, Homo sapiens
ttgcacagtggtttagagcctg

SEQ ID NO: 7601445 - DNA, 22 bp, Homo sapiens
ttgcacagtggtttagagcctg

SEQ ID NO: 7601446 - DNA, 22 bp, Homo sapiens
ttgcacagtagcgcgtgattgt

SEQ ID NO: 7601447 - DNA, 22 bp, Homo sapiens
ttgcacaggcagtaattgcttg

SEQ ID NO: 7601448 - DNA, 22 bp, Homo sapiens
ttgccgccgtctgctcgccccg

SEQ ID NO: 7601449 - DNA, 22 bp, Homo sapiens
ttgcctatgtaactttatattt

SEQ ID NO: 7601450 - DNA, 22 bp, Homo sapiens
ttgccgccgtctgctcgccccg

SEQ ID NO: 7601451 - DNA, 22 bp, Homo sapiens
ttgcccttgtggagtttacatg

SEQ ID NO: 7601452 - DNA, 22 bp, Homo sapiens
ttgccgtccttactccagcgga

SEQ ID NO: 7601453 - DNA, 22 bp, Homo sapiens
ttgccctgtggggcctccagcc

SEQ ID NO: 7601454 - DNA, 22 bp, Homo sapiens
ttgcccttggctgaaggcactg

SEQ ID NO: 7601455 - DNA, 22 bp, Homo sapiens
ttgcccttggctgaaggcactg

SEQ ID NO: 7601456 - DNA, 22 bp, Homo sapiens
ttgcactgtaagcatctgtgtc

SEQ ID NO: 7601457 - DNA, 22 bp, Homo sapiens
ttgcactgtaagcatctgtgtc

SEQ ID NO: 7601458 - DNA, 22 bp, Homo sapiens
ttgcacttaaggtaggtgtgaa

SEQ ID NO: 7601459 - DNA, 22 bp, Homo sapiens
ttgcactttatagaaacttttg

SEQ ID NO: 7601460 - DNA, 22 bp, Homo sapiens
ttgcacttatcctagcaaaagg

SEQ ID NO: 7601461 - DNA, 22 bp, Homo sapiens
ttgcactttatagaaacttttg

SEQ ID NO: 7601462 - DNA, 22 bp, Homo sapiens
ttgcactttatagaaacttttg

SEQ ID NO: 7601463 - DNA, 22 bp, Homo sapiens
ttgcacttatcctagcaaaagg

SEQ ID NO: 7601464 - DNA, 22 bp, Homo sapiens
ttgcactccagcccgagcaaca

SEQ ID NO: 7601465 - DNA, 22 bp, Homo sapiens
ttgcactccagcccgagcaaca

SEQ ID NO: 7601466 - DNA, 22 bp, Homo sapiens
ttgcactccagcccgagcaaca

SEQ ID NO: 7601467 - DNA, 22 bp, Homo sapiens
ttgcactccagcccgagcaaca

SEQ ID NO: 7601468 - DNA, 22 bp, Homo sapiens
ttgcacatgttggttcttgaaa

SEQ ID NO: 7601469 - DNA, 22 bp, Homo sapiens
ttgcacatgttggttcttgaaa

SEQ ID NO: 7601470 - DNA, 23 bp, Homo sapiens
ttgcacattggagctggtcttct

SEQ ID NO: 7601471 - DNA, 23 bp, Homo sapiens
ttgcacattggagctggtcttct

SEQ ID NO: 7601472 - DNA, 22 bp, Homo sapiens
ttgcacagtttgaagatgactc

SEQ ID NO: 7601473 - DNA, 22 bp, Homo sapiens
ttgcacatgttggttcttgaaa

SEQ ID NO: 7601474 - DNA, 22 bp, Homo sapiens
ttgcacatgttggttcttgaaa

SEQ ID NO: 7601475 - DNA, 22 bp, Homo sapiens
ttgcaccaaatgagttaaaatt

SEQ ID NO: 7601476 - DNA, 22 bp, Homo sapiens
ttgcacatttcctagaatttca

SEQ ID NO: 7601477 - DNA, 22 bp, Homo sapiens
ttgcacatttcctagaatttca

SEQ ID NO: 7601478 - DNA, 21 bp, Homo sapiens
ttgcaccatgataaattcaga

SEQ ID NO: 7601479 - DNA, 22 bp, Homo sapiens
ttgcactagtctcagaggcaaa

SEQ ID NO: 7601480 - DNA, 22 bp, Homo sapiens
ttgcactataggaaaatgtgtc

SEQ ID NO: 7601481 - DNA, 22 bp, Homo sapiens
ttgcactaggaaaaggcagcca

SEQ ID NO: 7601482 - DNA, 22 bp, Homo sapiens
ttgcactagtctcagaggcaaa

SEQ ID NO: 7601483 - DNA, 22 bp, Homo sapiens
ttgcactagacacatttcaagt

SEQ ID NO: 7601484 - DNA, 22 bp, Homo sapiens
ttgcactagacacatttcaagt

SEQ ID NO: 7601485 - DNA, 22 bp, Homo sapiens
ttgctgggtgctattatgaaca

SEQ ID NO: 7601486 - DNA, 22 bp, Homo sapiens
ttgctgggtgctattatgaaca

SEQ ID NO: 7601487 - DNA, 22 bp, Homo sapiens
ttgctgtaagtatctttctacc

SEQ ID NO: 7601488 - DNA, 22 bp, Homo sapiens
ttgctgtagctcatttcactct

SEQ ID NO: 7601489 - DNA, 22 bp, Homo sapiens
ttgctgtagctcatttcactct

SEQ ID NO: 7601490 - DNA, 22 bp, Homo sapiens
ttgctgtagctcatttcactct

SEQ ID NO: 7601491 - DNA, 22 bp, Homo sapiens
ttgctgtaggctgattgctgaa

SEQ ID NO: 7601492 - DNA, 22 bp, Homo sapiens
ttgctgtagtgttctgatgtca

SEQ ID NO: 7601493 - DNA, 22 bp, Homo sapiens
ctcaggctccagacttccgtcc

SEQ ID NO: 7601494 - DNA, 22 bp, Homo sapiens
ctcaggctcatatcccatcagc

SEQ ID NO: 7601495 - DNA, 22 bp, Homo sapiens
ctcaggctaagaaggccaagtg

SEQ ID NO: 7601496 - DNA, 22 bp, Homo sapiens
ctcaggctaagaaggccaagtg

SEQ ID NO: 7601497 - DNA, 22 bp, Homo sapiens
ctcaggctaagaaggccaagtg

SEQ ID NO: 7601498 - DNA, 22 bp, Homo sapiens
ctcaggctaagaaggccaagtg

SEQ ID NO: 7601499 - DNA, 22 bp, Homo sapiens
ctcaggctaagaaggccaagtg

SEQ ID NO: 7601500 - DNA, 22 bp, Homo sapiens
ctcaggctaagaaggccaagtg

SEQ ID NO: 7601501 - DNA, 22 bp, Homo sapiens
ctcaggctaagaaggccaagtg

SEQ ID NO: 7601502 - DNA, 22 bp, Homo sapiens
ttgctggcttgaagatagagga

SEQ ID NO: 7601503 - DNA, 20 bp, Homo sapiens
ttgctgggacctttttcaac

SEQ ID NO: 7601504 - DNA, 20 bp, Homo sapiens
ttgctgggacctttttcaac

SEQ ID NO: 7601505 - DNA, 22 bp, Homo sapiens
ttgctgggctcttcaacacaca

SEQ ID NO: 7601506 - DNA, 22 bp, Homo sapiens
ttgctggggtgtgaaatctgat

SEQ ID NO: 7601507 - DNA, 22 bp, Homo sapiens
ttgctgggcatgtcttaattct

SEQ ID NO: 7601508 - DNA, 22 bp, Homo sapiens
ttgctgggcatgtcttaattct

SEQ ID NO: 7601509 - DNA, 22 bp, Homo sapiens
ttgctgggctcttcaacacaca

SEQ ID NO: 7601510 - DNA, 22 bp, Homo sapiens
ttgctgggtcagaagccaggag

SEQ ID NO: 7601511 - DNA, 22 bp, Homo sapiens
ttgctgggtcagaagccaggag

SEQ ID NO: 7601512 - DNA, 22 bp, Homo sapiens
ttgctggggtgtgaaatctgat

SEQ ID NO: 7601513 - DNA, 22 bp, Homo sapiens
ttgctgggtcagaagccaggag

SEQ ID NO: 7601514 - DNA, 22 bp, Homo sapiens
ttgctgggtcagaagccaggag

SEQ ID NO: 7601515 - DNA, 22 bp, Homo sapiens
ttgctggcaatttagagatttc

SEQ ID NO: 7601516 - DNA, 22 bp, Homo sapiens
ttgctggatggcgtccaccagg

SEQ ID NO: 7601517 - DNA, 19 bp, Homo sapiens
ttgctggcatttgatctct

SEQ ID NO: 7601518 - DNA, 19 bp, Homo sapiens
ttgctggcatttgatctct

SEQ ID NO: 7601519 - DNA, 22 bp, Homo sapiens
ttgctggcttgaagatagagga

SEQ ID NO: 7601520 - DNA, 22 bp, Homo sapiens
ttgctggaggtgttccagatct

SEQ ID NO: 7601521 - DNA, 22 bp, Homo sapiens
ttgctggaggtgttccagatct

SEQ ID NO: 7601522 - DNA, 22 bp, Homo sapiens
ttgctggagcacaggactaagg

SEQ ID NO: 7601523 - DNA, 22 bp, Homo sapiens
ttgctggacagcttcacggaga

SEQ ID NO: 7601524 - DNA, 22 bp, Homo sapiens
ttgctggacatgaatcagatat

SEQ ID NO: 7601525 - DNA, 19 bp, Homo sapiens
ttgctggagaaaaaggaga

SEQ ID NO: 7601526 - DNA, 19 bp, Homo sapiens
ttgctggagaaaaaggaga

SEQ ID NO: 7601527 - DNA, 22 bp, Homo sapiens
ttgctgctttcatttatacagt

SEQ ID NO: 7601528 - DNA, 22 bp, Homo sapiens
ttgctgctctgccggtacagct

SEQ ID NO: 7601529 - DNA, 22 bp, Homo sapiens
ttgctggaaggtggctggaatc

SEQ ID NO: 7601530 - DNA, 22 bp, Homo sapiens
ttgctggacagcttcacggaga

SEQ ID NO: 7601531 - DNA, 22 bp, Homo sapiens
ttgctggacagcttcacggaga

SEQ ID NO: 7601532 - DNA, 22 bp, Homo sapiens
ttgctggacatgaatcagatat

SEQ ID NO: 7601533 - DNA, 21 bp, Homo sapiens
ttgctgccctccctttcctca

SEQ ID NO: 7601534 - DNA, 21 bp, Homo sapiens
ttgctgccctccctttcctca

SEQ ID NO: 7601535 - DNA, 22 bp, Homo sapiens
ttgctgatttgtttctattcca

SEQ ID NO: 7601536 - DNA, 22 bp, Homo sapiens
ttgctgccagcgccctgcaggg

SEQ ID NO: 7601537 - DNA, 22 bp, Homo sapiens
ttgctgccagcgccctgcaggg

SEQ ID NO: 7601538 - DNA, 22 bp, Homo sapiens
ttgctgatttgtttctattcca

SEQ ID NO: 7601539 - DNA, 22 bp, Homo sapiens
ttgctgatttatttttaacccg

SEQ ID NO: 7601540 - DNA, 22 bp, Homo sapiens
ttgctgatttccccttgagtgt

SEQ ID NO: 7601541 - DNA, 22 bp, Homo sapiens
ttgctgatttccccttgagtgt

SEQ ID NO: 7601542 - DNA, 22 bp, Homo sapiens
ttgctgatttagccatacacat

SEQ ID NO: 7601543 - DNA, 22 bp, Homo sapiens
ttgctgattgtagcatgatgat

SEQ ID NO: 7601544 - DNA, 22 bp, Homo sapiens
ttgctgattctgtatttaaggt

SEQ ID NO: 7601545 - DNA, 22 bp, Homo sapiens
ttgctgccttgtctcagggtct

SEQ ID NO: 7601546 - DNA, 22 bp, Homo sapiens
ttgctgcctttgtactctgatg

SEQ ID NO: 7601547 - DNA, 22 bp, Homo sapiens
ttgctgctcccaagaggcagct

SEQ ID NO: 7601548 - DNA, 22 bp, Homo sapiens
ttgctgctcccaagaggcagct

SEQ ID NO: 7601549 - DNA, 23 bp, Homo sapiens
ttgctgcctgagccttcctctgg

SEQ ID NO: 7601550 - DNA, 23 bp, Homo sapiens
ttgctgcctgagccttcctctgg

SEQ ID NO: 7601551 - DNA, 23 bp, Homo sapiens
ttgctgcctgagccttcctctgg

SEQ ID NO: 7601552 - DNA, 22 bp, Homo sapiens
ttgctgccttccgaatcctctc

SEQ ID NO: 7601553 - DNA, 22 bp, Homo sapiens
ttgctgcctgaggagcaacact

SEQ ID NO: 7601554 - DNA, 22 bp, Homo sapiens
ttgctgagctttggcaaggaag

SEQ ID NO: 7601555 - DNA, 22 bp, Homo sapiens
ttgctgaggacgcagtgcagtg

SEQ ID NO: 7601556 - DNA, 22 bp, Homo sapiens
ttgctgaggttgttttgaggag

SEQ ID NO: 7601557 - DNA, 22 bp, Homo sapiens
ttgctgaggttgttttgaggag

SEQ ID NO: 7601558 - DNA, 22 bp, Homo sapiens
ttgctgagtctctaggtatgat

SEQ ID NO: 7601559 - DNA, 22 bp, Homo sapiens
ttgctgagtctgaattcatact

SEQ ID NO: 7601560 - DNA, 22 bp, Homo sapiens
ttgctgagtctgaattcatact

SEQ ID NO: 7601561 - DNA, 22 bp, Homo sapiens
ttgctgagtgaccaataaatat

SEQ ID NO: 7601562 - DNA, 22 bp, Homo sapiens
ttgctgagtgaccaataaatat

SEQ ID NO: 7601563 - DNA, 22 bp, Homo sapiens
ttgctgataaaataaaccaaga

SEQ ID NO: 7601564 - DNA, 22 bp, Homo sapiens
ttgctgatacatagtgggcaaa

SEQ ID NO: 7601565 - DNA, 22 bp, Homo sapiens
ttgctgataccatgaatgttaa

SEQ ID NO: 7601566 - DNA, 22 bp, Homo sapiens
ttgctgatctgaaacgttactg

SEQ ID NO: 7601567 - DNA, 22 bp, Homo sapiens
ttgctgatctgaaacgttactg

SEQ ID NO: 7601568 - DNA, 22 bp, Homo sapiens
ttgctgatctgtgaatcagcca

SEQ ID NO: 7601569 - DNA, 22 bp, Homo sapiens
ttgctgatctgtgaatcagcca

SEQ ID NO: 7601570 - DNA, 22 bp, Homo sapiens
ttgctgatctgtgaatcagcca

SEQ ID NO: 7601571 - DNA, 22 bp, Homo sapiens
ttgctgatgagtcattggttta

SEQ ID NO: 7601572 - DNA, 22 bp, Homo sapiens
ttgctgatgcccttgtccaggc

SEQ ID NO: 7601573 - DNA, 22 bp, Homo sapiens
ttgctgatggagggaatgctca

SEQ ID NO: 7601574 - DNA, 22 bp, Homo sapiens
ttgctgatggtattatgctagt

SEQ ID NO: 7601575 - DNA, 22 bp, Homo sapiens
ttgctgatggtattatgctagt

SEQ ID NO: 7601576 - DNA, 22 bp, Homo sapiens
ttgctgattcatgatttgagaa

SEQ ID NO: 7601577 - DNA, 22 bp, Homo sapiens
ttgctgatggtattatgctagt

SEQ ID NO: 7601578 - DNA, 22 bp, Homo sapiens
ttgctgattcatgatttgagaa

SEQ ID NO: 7601579 - DNA, 22 bp, Homo sapiens
ttgctgattctgtatttaaggt

SEQ ID NO: 7601580 - DNA, 22 bp, Homo sapiens
ctcaggcccacagcagacccac

SEQ ID NO: 7601581 - DNA, 22 bp, Homo sapiens
ctcaggcccacagcagacccac

SEQ ID NO: 7601582 - DNA, 22 bp, Homo sapiens
ctcaggcccacagcagacccac

SEQ ID NO: 7601583 - DNA, 22 bp, Homo sapiens
ctcaggcctgagtggcagtccc

SEQ ID NO: 7601584 - DNA, 22 bp, Homo sapiens
ctcaggcctgagtggcagtccc

SEQ ID NO: 7601585 - DNA, 22 bp, Homo sapiens
ctcaggcctgagtggcagtccc

SEQ ID NO: 7601586 - DNA, 22 bp, Homo sapiens
ctcaggcctgagtggcagtccc

SEQ ID NO: 7601587 - DNA, 22 bp, Homo sapiens
ctcaggcccacagcagacccac

SEQ ID NO: 7601588 - DNA, 22 bp, Homo sapiens
ctcaggccattcttccagctgc

SEQ ID NO: 7601589 - DNA, 22 bp, Homo sapiens
ctcaggccattcttccagctgc

SEQ ID NO: 7601590 - DNA, 22 bp, Homo sapiens
ctcaggcccacagcagacccac

SEQ ID NO: 7601591 - DNA, 22 bp, Homo sapiens
ctcaggccattcttccagctgc

SEQ ID NO: 7601592 - DNA, 22 bp, Homo sapiens
ctcaggccattcttccagctgc

SEQ ID NO: 7601593 - DNA, 22 bp, Homo sapiens
ctcaggccattcttccagctgc

SEQ ID NO: 7601594 - DNA, 22 bp, Homo sapiens
ctcaggccattcttccagctgc

SEQ ID NO: 7601595 - DNA, 22 bp, Homo sapiens
ctcaggccattcttccagctgc

SEQ ID NO: 7601596 - DNA, 22 bp, Homo sapiens
ctcaggccaataagctccagcc

SEQ ID NO: 7601597 - DNA, 22 bp, Homo sapiens
ctcaggccaataagctccagcc

SEQ ID NO: 7601598 - DNA, 22 bp, Homo sapiens
ctcaggccaggtttctcccaca

SEQ ID NO: 7601599 - DNA, 22 bp, Homo sapiens
ctcaggccaggtttctcccaca

SEQ ID NO: 7601600 - DNA, 22 bp, Homo sapiens
ctcaggccaataagctccagcc

SEQ ID NO: 7601601 - DNA, 22 bp, Homo sapiens
ctcaggagtagttcagcagctg

SEQ ID NO: 7601602 - DNA, 22 bp, Homo sapiens
ctcaggagttggaggctacagt

SEQ ID NO: 7601603 - DNA, 22 bp, Homo sapiens
ctcaggagttggaggctacagt

SEQ ID NO: 7601604 - DNA, 22 bp, Homo sapiens
ctcaggagttggaggctacagt

SEQ ID NO: 7601605 - DNA, 22 bp, Homo sapiens
ctcaggagttggaggctacagt

SEQ ID NO: 7601606 - DNA, 22 bp, Homo sapiens
ctcaggccaataagctccagcc

SEQ ID NO: 7601607 - DNA, 22 bp, Homo sapiens
ctcaggccaggtttctcccaca

SEQ ID NO: 7601608 - DNA, 22 bp, Homo sapiens
ctcaggccaggtttctcccaca

SEQ ID NO: 7601609 - DNA, 22 bp, Homo sapiens
ctcaggccaggtttctcccaca

SEQ ID NO: 7601610 - DNA, 22 bp, Homo sapiens
ctcaggccaggtttctcccaca

SEQ ID NO: 7601611 - DNA, 22 bp, Homo sapiens
ctcaggccattcctaccaaggg

SEQ ID NO: 7601612 - DNA, 22 bp, Homo sapiens
ctcaggccattcttccagctgc

SEQ ID NO: 7601613 - DNA, 22 bp, Homo sapiens
ctcaggccattcctaccaaggg

SEQ ID NO: 7601614 - DNA, 22 bp, Homo sapiens
ctcaggccattcctaccaaggg

SEQ ID NO: 7601615 - DNA, 22 bp, Homo sapiens
ctcaggccattcctaccaaggg

SEQ ID NO: 7601616 - DNA, 22 bp, Homo sapiens
ctcagccaggagagtgttcaca

SEQ ID NO: 7601617 - DNA, 22 bp, Homo sapiens
ctcagccagacatgacccagtc

SEQ ID NO: 7601618 - DNA, 22 bp, Homo sapiens
ctcagccagacatgacccagtc

SEQ ID NO: 7601619 - DNA, 22 bp, Homo sapiens
ctcagccagacatgacccagtc

SEQ ID NO: 7601620 - DNA, 22 bp, Homo sapiens
ctcagcattcaatgtccagtcc

SEQ ID NO: 7601621 - DNA, 22 bp, Homo sapiens
ctcagcatggagggagaacaag

SEQ ID NO: 7601622 - DNA, 22 bp, Homo sapiens
ctcagcatcatggtatctgggg

SEQ ID NO: 7601623 - DNA, 22 bp, Homo sapiens
ctcagcatcatggtatctgggg

SEQ ID NO: 7601624 - DNA, 22 bp, Homo sapiens
ctcagccagtgatctttccttt

SEQ ID NO: 7601625 - DNA, 22 bp, Homo sapiens
ctcagccatgcaacatgctggg

SEQ ID NO: 7601626 - DNA, 22 bp, Homo sapiens
ctcagccagtgatctttccttt

SEQ ID NO: 7601627 - DNA, 22 bp, Homo sapiens
ctcagccatgcaacatgctggg

SEQ ID NO: 7601628 - DNA, 22 bp, Homo sapiens
ctcagccagtgatctttccttt

SEQ ID NO: 7601629 - DNA, 22 bp, Homo sapiens
ctcagccatgcaacatgctggg

SEQ ID NO: 7601630 - DNA, 22 bp, Homo sapiens
ctcagcccagcccaggaccagg

SEQ ID NO: 7601631 - DNA, 22 bp, Homo sapiens
ctcagccccaattctccccatt

SEQ ID NO: 7601632 - DNA, 22 bp, Homo sapiens
ctcagcccagctcaggtctttc

SEQ ID NO: 7601633 - DNA, 22 bp, Homo sapiens
ctcagccccaattctccccatt

SEQ ID NO: 7601634 - DNA, 22 bp, Homo sapiens
ctcaggagtagttcagcagctg

SEQ ID NO: 7601635 - DNA, 22 bp, Homo sapiens
ctcagccccaatttgccctctt

SEQ ID NO: 7601636 - DNA, 22 bp, Homo sapiens
ctcaggagtagttcagcagctg

SEQ ID NO: 7601637 - DNA, 22 bp, Homo sapiens
ctcagccatggggtggatcagc

SEQ ID NO: 7601638 - DNA, 22 bp, Homo sapiens
ctcagccatgtcatgcctacct

SEQ ID NO: 7601639 - DNA, 22 bp, Homo sapiens
ctcagccatggggtggatcagc

SEQ ID NO: 7601640 - DNA, 22 bp, Homo sapiens
ctcagccatggggtggatcagc

SEQ ID NO: 7601641 - DNA, 22 bp, Homo sapiens
ctcagcccagcccaggaccagg

SEQ ID NO: 7601642 - DNA, 22 bp, Homo sapiens
ctcagcccagcccaggaccagg

SEQ ID NO: 7601643 - DNA, 22 bp, Homo sapiens
ctcagcccagcccaggaccagg

SEQ ID NO: 7601644 - DNA, 22 bp, Homo sapiens
ctcagccatgtcatgcctacct

SEQ ID NO: 7601645 - DNA, 22 bp, Homo sapiens
ctcagcagtgacaagagagtat

SEQ ID NO: 7601646 - DNA, 22 bp, Homo sapiens
ctcagcagtgacaagagagtat

SEQ ID NO: 7601647 - DNA, 22 bp, Homo sapiens
ctcagcagtgacaagagagtat

SEQ ID NO: 7601648 - DNA, 22 bp, Homo sapiens
ttgcaaagaattttacattcta

SEQ ID NO: 7601649 - DNA, 23 bp, Homo sapiens
ttgcaaaatgcaattgagttaga

SEQ ID NO: 7601650 - DNA, 23 bp, Homo sapiens
ttgcaaaatgcaattgagttaga

SEQ ID NO: 7601651 - DNA, 23 bp, Homo sapiens
ttgcaaaatgcaattgagttaga

SEQ ID NO: 7601652 - DNA, 23 bp, Homo sapiens
ttgcaaaatgagtcttgagtgaa

SEQ ID NO: 7601653 - DNA, 23 bp, Homo sapiens
ttgcaaaatgagtcttgagtgaa

SEQ ID NO: 7601654 - DNA, 23 bp, Homo sapiens
ttgcaaaatgagtcttgagtgaa

SEQ ID NO: 7601655 - DNA, 22 bp, Homo sapiens
ttgcaaaatcatttctcaggat

SEQ ID NO: 7601656 - DNA, 22 bp, Homo sapiens
ttgcaaaatcatttctcaggat

SEQ ID NO: 7601657 - DNA, 22 bp, Homo sapiens
ttgcaaaagcaattgcagtttt

SEQ ID NO: 7601658 - DNA, 22 bp, Homo sapiens
ttgcaaaagcaattgcagtttt

SEQ ID NO: 7601659 - DNA, 22 bp, Homo sapiens
ttgcaaaaactgcaattacttt

SEQ ID NO: 7601660 - DNA, 22 bp, Homo sapiens
ttgcaaaaccatcctaagtaaa

SEQ ID NO: 7601661 - DNA, 22 bp, Homo sapiens
ttgcaaaaccatcctaagtaaa

SEQ ID NO: 7601662 - DNA, 22 bp, Homo sapiens
ttgcaaaaactgcaattacttt

SEQ ID NO: 7601663 - DNA, 22 bp, Homo sapiens
ttgcaaaaactgcaattacttt

SEQ ID NO: 7601664 - DNA, 22 bp, Homo sapiens
ttgcaaaaccatcctaagtaaa

SEQ ID NO: 7601665 - DNA, 22 bp, Homo sapiens
ttgcaaaaccatcctaagtaaa

SEQ ID NO: 7601666 - DNA, 22 bp, Homo sapiens
ttgcaaaaccatcctaagtaaa

SEQ ID NO: 7601667 - DNA, 22 bp, Homo sapiens
ttgcaaaagccgaggcactcca

SEQ ID NO: 7601668 - DNA, 22 bp, Homo sapiens
ttgcaaaagccgaggcactcca

SEQ ID NO: 7601669 - DNA, 22 bp, Homo sapiens
ttgcaaaatcatttctcaggat

SEQ ID NO: 7601670 - DNA, 22 bp, Homo sapiens
ttgcaaaatcatttctcaggat

SEQ ID NO: 7601671 - DNA, 22 bp, Homo sapiens
ttgcaaaagccgaggcactcca

SEQ ID NO: 7601672 - DNA, 22 bp, Homo sapiens
ttgcaaaagccgaggcactcca

SEQ ID NO: 7601673 - DNA, 22 bp, Homo sapiens
ttgcaaaagcaattgcagtttt

SEQ ID NO: 7601674 - DNA, 22 bp, Homo sapiens
ttgcaaaagcaattgcagtttt

SEQ ID NO: 7601675 - DNA, 22 bp, Homo sapiens
ttgcaaaagcaattgcagtttt

SEQ ID NO: 7601676 - DNA, 22 bp, Homo sapiens
ttgcaaaaaccacaattacttt

SEQ ID NO: 7601677 - DNA, 22 bp, Homo sapiens
ttgcaaaaaccacaattacttt

SEQ ID NO: 7601678 - DNA, 22 bp, Homo sapiens
ttgcaaaaaccacaattacttt

SEQ ID NO: 7601679 - DNA, 22 bp, Homo sapiens
ttgcaaaaaccacaattacttt

SEQ ID NO: 7601680 - DNA, 22 bp, Homo sapiens
ttgcaaaaaccacaattacttt

SEQ ID NO: 7601681 - DNA, 22 bp, Homo sapiens
ttgcaaaaactgcaattacttt

SEQ ID NO: 7601682 - DNA, 22 bp, Homo sapiens
ttgcaaaaactgcaattacttt

SEQ ID NO: 7601683 - DNA, 22 bp, Homo sapiens
ttgcaaaaactgcaattacttt

SEQ ID NO: 7601684 - DNA, 22 bp, Homo sapiens
ttgcaaaaactgcaattacttt

SEQ ID NO: 7601685 - DNA, 22 bp, Homo sapiens
ttgcaaaaactgcaattacttt

SEQ ID NO: 7601686 - DNA, 22 bp, Homo sapiens
ttgcaaaaaccacaattacttt

SEQ ID NO: 7601687 - DNA, 22 bp, Homo sapiens
ttgcaaaaaccacaattacttt

SEQ ID NO: 7601688 - DNA, 22 bp, Homo sapiens
ttgcaaaaaccacaattacttt

SEQ ID NO: 7601689 - DNA, 22 bp, Homo sapiens
ttgatttttttctactatgcgc

SEQ ID NO: 7601690 - DNA, 22 bp, Homo sapiens
ttgatttttttctactatgcgc

SEQ ID NO: 7601691 - DNA, 22 bp, Homo sapiens
ttgatttttttctactatgcgc

SEQ ID NO: 7601692 - DNA, 22 bp, Homo sapiens
ttgatttttttctactatgcgc

SEQ ID NO: 7601693 - DNA, 22 bp, Homo sapiens
ttgatttttttctactatgcgc

SEQ ID NO: 7601694 - DNA, 22 bp, Homo sapiens
ttgatttttttctactatgcgc

SEQ ID NO: 7601695 - DNA, 22 bp, Homo sapiens
ttgatttttttctactatgcgc

SEQ ID NO: 7601696 - DNA, 22 bp, Homo sapiens
ttgatttttttctactatgcgc

SEQ ID NO: 7601697 - DNA, 22 bp, Homo sapiens
ttgatttttccagcttctagag

SEQ ID NO: 7601698 - DNA, 22 bp, Homo sapiens
ttgatttttccagcttctagag

SEQ ID NO: 7601699 - DNA, 22 bp, Homo sapiens
ttgatcaagtgggaaatagtaa

SEQ ID NO: 7601700 - DNA, 22 bp, Homo sapiens
ttgatcaagtgggaaatagtaa

SEQ ID NO: 7601701 - DNA, 22 bp, Homo sapiens
ttgatttttccagcttctagag

SEQ ID NO: 7601702 - DNA, 22 bp, Homo sapiens
ttgatcaaatcagctactgagg

SEQ ID NO: 7601703 - DNA, 22 bp, Homo sapiens
ttgatcaaatcagctactgagg

SEQ ID NO: 7601704 - DNA, 22 bp, Homo sapiens
ttgatcaaatcagctactgagg

SEQ ID NO: 7601705 - DNA, 22 bp, Homo sapiens
ttgatcaaatcagctactgagg

SEQ ID NO: 7601706 - DNA, 22 bp, Homo sapiens
ttgatcaaatcagctactgagg

SEQ ID NO: 7601707 - DNA, 22 bp, Homo sapiens
ctcagaaagcaatctggtgagg

SEQ ID NO: 7601708 - DNA, 22 bp, Homo sapiens
ctcagaaagcaatctggtgagg

SEQ ID NO: 7601709 - DNA, 22 bp, Homo sapiens
ctcagaaagggttgctgagggc

SEQ ID NO: 7601710 - DNA, 22 bp, Homo sapiens
ctcagaaagggttgctgagggc

SEQ ID NO: 7601711 - DNA, 22 bp, Homo sapiens
ttgatattctgagaagctgaag

SEQ ID NO: 7601712 - DNA, 22 bp, Homo sapiens
ctcagaaagcaatctggtgagg

SEQ ID NO: 7601713 - DNA, 22 bp, Homo sapiens
ctcagaaacggagctgccattt

SEQ ID NO: 7601714 - DNA, 22 bp, Homo sapiens
ctcagaaacggagctgccattt

SEQ ID NO: 7601715 - DNA, 22 bp, Homo sapiens
ctcagaaacggagctgccattt

SEQ ID NO: 7601716 - DNA, 21 bp, Homo sapiens
cgggaaggaggttctgaccct

SEQ ID NO: 7601717 - DNA, 21 bp, Homo sapiens
cgggaaggaggttctgaccct

SEQ ID NO: 7601718 - DNA, 21 bp, Homo sapiens
cgggaaggaggttctgaccct

SEQ ID NO: 7601719 - DNA, 22 bp, Homo sapiens
cgggaaggtggaggttgcagtg

SEQ ID NO: 7601720 - DNA, 22 bp, Homo sapiens
cgggaaggtggaggttgcagtg

SEQ ID NO: 7601721 - DNA, 22 bp, Homo sapiens
cgggaaggtggaggttgcagtg

SEQ ID NO: 7601722 - DNA, 22 bp, Homo sapiens
cgggaaagttccacagatggat

SEQ ID NO: 7601723 - DNA, 22 bp, Homo sapiens
cgggaaagttccacagatggat

SEQ ID NO: 7601724 - DNA, 22 bp, Homo sapiens
cggcttcttcatcaggtcagca

SEQ ID NO: 7601725 - DNA, 22 bp, Homo sapiens
cggcttgctcacacccacctcc

SEQ ID NO: 7601726 - DNA, 22 bp, Homo sapiens
cggcttgttcaggaacctggct

SEQ ID NO: 7601727 - DNA, 22 bp, Homo sapiens
cggcttgttcgaggcctaatat

SEQ ID NO: 7601728 - DNA, 22 bp, Homo sapiens
cggcttgtttagacttttcaaa

SEQ ID NO: 7601729 - DNA, 22 bp, Homo sapiens
cgggagcacgggaggcggagct

SEQ ID NO: 7601730 - DNA, 20 bp, Homo sapiens
cgggacactcaagctctggg

SEQ ID NO: 7601731 - DNA, 22 bp, Homo sapiens
cgggagcacgggaggcggagct

SEQ ID NO: 7601732 - DNA, 22 bp, Homo sapiens
cgggagcctctgggtcacactg

SEQ ID NO: 7601733 - DNA, 22 bp, Homo sapiens
cgggagcacgggaggcggagct

SEQ ID NO: 7601734 - DNA, 22 bp, Homo sapiens
cgggaggaaaggcgaggctctg

SEQ ID NO: 7601735 - DNA, 22 bp, Homo sapiens
cgggaggaaaggcgaggctctg

SEQ ID NO: 7601736 - DNA, 22 bp, Homo sapiens
cgggaggaaaggcgaggctctg

SEQ ID NO: 7601737 - DNA, 22 bp, Homo sapiens
ttccactctatgatagaagggt

SEQ ID NO: 7601738 - DNA, 22 bp, Homo sapiens
ttccactctacacactgctggc

SEQ ID NO: 7601739 - DNA, 22 bp, Homo sapiens
ttccacggggctccccgctctt

SEQ ID NO: 7601740 - DNA, 22 bp, Homo sapiens
ttccacggtggcaaaggctgga

SEQ ID NO: 7601741 - DNA, 22 bp, Homo sapiens
ttccaaattaaaatgtacaatg

SEQ ID NO: 7601742 - DNA, 22 bp, Homo sapiens
ttccaaattaaaatgtacaatg

SEQ ID NO: 7601743 - DNA, 22 bp, Homo sapiens
ttccaaattaaaatgtacaatg

SEQ ID NO: 7601744 - DNA, 22 bp, Homo sapiens
ttccaaattaaaatgtacaatg

SEQ ID NO: 7601745 - DNA, 22 bp, Homo sapiens
ttccaaattccaatcccctgaa

SEQ ID NO: 7601746 - DNA, 22 bp, Homo sapiens
ttccaccaattctcctccaagg

SEQ ID NO: 7601747 - DNA, 22 bp, Homo sapiens
ttccaccaggagatatttcaaa

SEQ ID NO: 7601748 - DNA, 19 bp, Homo sapiens
ttccaccatcactctgttt

SEQ ID NO: 7601749 - DNA, 22 bp, Homo sapiens
ttccaccaggagatatttcaaa

SEQ ID NO: 7601750 - DNA, 22 bp, Homo sapiens
ttccaccaggagatatttcaaa

SEQ ID NO: 7601751 - DNA, 22 bp, Homo sapiens
ttccaccaggagatatttcaaa

SEQ ID NO: 7601752 - DNA, 22 bp, Homo sapiens
cggctgggttcggctgcaggcc

SEQ ID NO: 7601753 - DNA, 22 bp, Homo sapiens
cggctgggtagaggtgccgggt

SEQ ID NO: 7601754 - DNA, 22 bp, Homo sapiens
cggctgggtagaggtgccgggt

SEQ ID NO: 7601755 - DNA, 22 bp, Homo sapiens
cggctgggttcggctgcaggcc

SEQ ID NO: 7601756 - DNA, 22 bp, Homo sapiens
cggctgggttcggctgcaggcc

SEQ ID NO: 7601757 - DNA, 22 bp, Homo sapiens
cggctgggttcggctgcaggcc

SEQ ID NO: 7601758 - DNA, 22 bp, Homo sapiens
cggctgggttcggctgcaggcc

SEQ ID NO: 7601759 - DNA, 22 bp, Homo sapiens
cggctgggttcggctgcaggcc

SEQ ID NO: 7601760 - DNA, 22 bp, Homo sapiens
cggctgggttcggctgcaggcc

SEQ ID NO: 7601761 - DNA, 22 bp, Homo sapiens
cggctggtgtcgggcacagcaa

SEQ ID NO: 7601762 - DNA, 22 bp, Homo sapiens
cggctggtgtcgggcacagcaa

SEQ ID NO: 7601763 - DNA, 22 bp, Homo sapiens
cggctggtgtcgggcacagcaa

SEQ ID NO: 7601764 - DNA, 22 bp, Homo sapiens
cggctggtgtcgggcacagcaa

SEQ ID NO: 7601765 - DNA, 22 bp, Homo sapiens
cggctggtgtcgggcacagcaa

SEQ ID NO: 7601766 - DNA, 22 bp, Homo sapiens
cggctggtgtcgggcacagcaa

SEQ ID NO: 7601767 - DNA, 22 bp, Homo sapiens
cggcttccaacaagctttgctg

SEQ ID NO: 7601768 - DNA, 22 bp, Homo sapiens
cggcttccaacaagctttgctg

SEQ ID NO: 7601769 - DNA, 22 bp, Homo sapiens
cggcttccaacaagctttgctg

SEQ ID NO: 7601770 - DNA, 22 bp, Homo sapiens
cggcttctcgggtcggattccg

SEQ ID NO: 7601771 - DNA, 21 bp, Homo sapiens
cggcttctgcattccagagct

SEQ ID NO: 7601772 - DNA, 22 bp, Homo sapiens
cggctgtgtcttcacaggagcc

SEQ ID NO: 7601773 - DNA, 22 bp, Homo sapiens
cggctgtgtcttcacaggagcc

SEQ ID NO: 7601774 - DNA, 22 bp, Homo sapiens
cggctggtgtcgggcacagcaa

SEQ ID NO: 7601775 - DNA, 22 bp, Homo sapiens
cggctggtgtcgggcacagcaa

SEQ ID NO: 7601776 - DNA, 22 bp, Homo sapiens
cggctggtgtcgggcacagcaa

SEQ ID NO: 7601777 - DNA, 22 bp, Homo sapiens
cggctggtgtcgggcacagcaa

SEQ ID NO: 7601778 - DNA, 22 bp, Homo sapiens
cggctggtgtcgggcacagcaa

SEQ ID NO: 7601779 - DNA, 22 bp, Homo sapiens
cggctggtgtcgggcacagcaa

SEQ ID NO: 7601780 - DNA, 22 bp, Homo sapiens
cgcagctgaccttttacaaaac

SEQ ID NO: 7601781 - DNA, 22 bp, Homo sapiens
cgcagctgaccttttacaaaac

SEQ ID NO: 7601782 - DNA, 21 bp, Homo sapiens
cgcagctgagaaatatacaga

SEQ ID NO: 7601783 - DNA, 21 bp, Homo sapiens
cgcagctgagaaatatacaga

SEQ ID NO: 7601784 - DNA, 22 bp, Homo sapiens
cgcagctgcacggggctgagcc

SEQ ID NO: 7601785 - DNA, 22 bp, Homo sapiens
cgcagctgcacggggctgagcc

SEQ ID NO: 7601786 - DNA, 22 bp, Homo sapiens
cgcagctgcacggggctgagcc

SEQ ID NO: 7601787 - DNA, 22 bp, Homo sapiens
cgcagctgcaaaggaaacattt

SEQ ID NO: 7601788 - DNA, 22 bp, Homo sapiens
cgcagctgcaaaggaaacattt

SEQ ID NO: 7601789 - DNA, 22 bp, Homo sapiens
cgcagctgcacggggctgagcc

SEQ ID NO: 7601790 - DNA, 22 bp, Homo sapiens
cgcagctgcacggggctgagcc

SEQ ID NO: 7601791 - DNA, 20 bp, Homo sapiens
cgcagcagtggaagtggaat

SEQ ID NO: 7601792 - DNA, 20 bp, Homo sapiens
cgcagcagtggaagtggaat

SEQ ID NO: 7601793 - DNA, 22 bp, Homo sapiens
cgcagctcttaccctcccctta

SEQ ID NO: 7601794 - DNA, 22 bp, Homo sapiens
cgcagctcttaccctcccctta

SEQ ID NO: 7601795 - DNA, 22 bp, Homo sapiens
cgcagctctggccgagggcggc

SEQ ID NO: 7601796 - DNA, 22 bp, Homo sapiens
cgcagctctggccgagggcggc

SEQ ID NO: 7601797 - DNA, 22 bp, Homo sapiens
ttcagtttcagtcttgcaaaaa

SEQ ID NO: 7601798 - DNA, 22 bp, Homo sapiens
ttcagtttcagtcttgcaaaaa

SEQ ID NO: 7601799 - DNA, 22 bp, Homo sapiens
ttcagtttcagtcttgcaaaaa

SEQ ID NO: 7601800 - DNA, 22 bp, Homo sapiens
ttcagtttcaagtccctctggg

SEQ ID NO: 7601801 - DNA, 22 bp, Homo sapiens
ttcagtttcaagtccctctggg

SEQ ID NO: 7601802 - DNA, 22 bp, Homo sapiens
ttcagtttccacttacatttaa

SEQ ID NO: 7601803 - DNA, 22 bp, Homo sapiens
ttcagtttcagtcttgcaaaaa

SEQ ID NO: 7601804 - DNA, 22 bp, Homo sapiens
ttcagtttccacttacatttaa

SEQ ID NO: 7601805 - DNA, 22 bp, Homo sapiens
ttcagtttccacttacatttaa

SEQ ID NO: 7601806 - DNA, 22 bp, Homo sapiens
ttcagtttccacttacatttaa

SEQ ID NO: 7601807 - DNA, 22 bp, Homo sapiens
ttcagtttccacttacatttaa

SEQ ID NO: 7601808 - DNA, 22 bp, Homo sapiens
ttcagtttccacttacatttaa

SEQ ID NO: 7601809 - DNA, 22 bp, Homo sapiens
ttcagtttccacttacatttaa

SEQ ID NO: 7601810 - DNA, 22 bp, Homo sapiens
ttcagtttccacttacatttaa

SEQ ID NO: 7601811 - DNA, 22 bp, Homo sapiens
ttcagggcttagggaaatagtg

SEQ ID NO: 7601812 - DNA, 22 bp, Homo sapiens
ttcagtttcaaatcctgtgaag

SEQ ID NO: 7601813 - DNA, 22 bp, Homo sapiens
cgcagctgcacggggctgagcc

SEQ ID NO: 7601814 - DNA, 22 bp, Homo sapiens
ttcagggcgttgtggctgactg

SEQ ID NO: 7601815 - DNA, 22 bp, Homo sapiens
ttcagggcgttgtggctgactg

SEQ ID NO: 7601816 - DNA, 22 bp, Homo sapiens
ttcagggcgttgtggctgactg

SEQ ID NO: 7601817 - DNA, 22 bp, Homo sapiens
ttcagggccctgagagggcagt

SEQ ID NO: 7601818 - DNA, 22 bp, Homo sapiens
ttcagggccctgagagggcagt

SEQ ID NO: 7601819 - DNA, 22 bp, Homo sapiens
ttcagggccctgagagggcagt

SEQ ID NO: 7601820 - DNA, 23 bp, Homo sapiens
ttcagggcctcagaggtgaagct

SEQ ID NO: 7601821 - DNA, 19 bp, Homo sapiens
ttcagtttcctcatctgga

SEQ ID NO: 7601822 - DNA, 22 bp, Homo sapiens
ttcagtttcgttatctatgaga

SEQ ID NO: 7601823 - DNA, 22 bp, Homo sapiens
ttcagtttcgttatctatgaga

SEQ ID NO: 7601824 - DNA, 22 bp, Homo sapiens
ttcagtttcgttatctatgaga

SEQ ID NO: 7601825 - DNA, 22 bp, Homo sapiens
ttcagtttcgttatctatgaga

SEQ ID NO: 7601826 - DNA, 19 bp, Homo sapiens
ttcagtttcctcatctgga

SEQ ID NO: 7601827 - DNA, 22 bp, Homo sapiens
ttcagtttccctaaagccaatt

SEQ ID NO: 7601828 - DNA, 19 bp, Homo sapiens
ttcagtttcctcatctgga

SEQ ID NO: 7601829 - DNA, 19 bp, Homo sapiens
ttcagtttcctcatctgga

SEQ ID NO: 7601830 - DNA, 22 bp, Homo sapiens
ttcagtttccctaaagccaatt

SEQ ID NO: 7601831 - DNA, 22 bp, Homo sapiens
ttcagtttccctaaagccaatt

SEQ ID NO: 7601832 - DNA, 22 bp, Homo sapiens
ttcagtttccctaaagccaatt

SEQ ID NO: 7601833 - DNA, 22 bp, Homo sapiens
ttcagtttcgttatctatgaga

SEQ ID NO: 7601834 - DNA, 22 bp, Homo sapiens
ttcagtttcgttatctatgaga

SEQ ID NO: 7601835 - DNA, 22 bp, Homo sapiens
ttcagtttcgttatctatgaga

SEQ ID NO: 7601836 - DNA, 22 bp, Homo sapiens
ttcagtttcgttatctatgaga

SEQ ID NO: 7601837 - DNA, 22 bp, Homo sapiens
ttcagtttcgttatctatgaga

SEQ ID NO: 7601838 - DNA, 22 bp, Homo sapiens
ttcagtttctaaagatgttcct

SEQ ID NO: 7601839 - DNA, 22 bp, Homo sapiens
ttcagtttctaaagatgttcct

SEQ ID NO: 7601840 - DNA, 22 bp, Homo sapiens
ttcagtttctaaagatgttcct

SEQ ID NO: 7601841 - DNA, 22 bp, Homo sapiens
ttcagtttctaaatgctcctct

SEQ ID NO: 7601842 - DNA, 22 bp, Homo sapiens
ttcagtttctaaatgctcctct

SEQ ID NO: 7601843 - DNA, 21 bp, Homo sapiens
ttcagtttcttcctcatctat

SEQ ID NO: 7601844 - DNA, 21 bp, Homo sapiens
ttcagtttcttcctcatctat

SEQ ID NO: 7601845 - DNA, 22 bp, Homo sapiens
ttcagtttcttccctgtgaaat

SEQ ID NO: 7601846 - DNA, 22 bp, Homo sapiens
ttcagtttcttccctgtgaaat

SEQ ID NO: 7601847 - DNA, 22 bp, Homo sapiens
ttcagtttcttccctgtgaaat

SEQ ID NO: 7601848 - DNA, 22 bp, Homo sapiens
ttcagtttcttccctgtgaaat

SEQ ID NO: 7601849 - DNA, 22 bp, Homo sapiens
ttcagtttcttccctgtgaaat

SEQ ID NO: 7601850 - DNA, 18 bp, Homo sapiens
ttcagtttctagttcctt

SEQ ID NO: 7601851 - DNA, 18 bp, Homo sapiens
ttcagtttctagttcctt

SEQ ID NO: 7601852 - DNA, 18 bp, Homo sapiens
ttcagtttctagttcctt

SEQ ID NO: 7601853 - DNA, 22 bp, Homo sapiens
ttcagtttctaaatgctcctct

SEQ ID NO: 7601854 - DNA, 22 bp, Homo sapiens
ttcagtttctaaatgctcctct

SEQ ID NO: 7601855 - DNA, 18 bp, Homo sapiens
ttcagtttctagttcctt

SEQ ID NO: 7601856 - DNA, 22 bp, Homo sapiens
ttcagtttgctacaagcaacat

SEQ ID NO: 7601857 - DNA, 22 bp, Homo sapiens
ttcagtttgctacaagcaacat

SEQ ID NO: 7601858 - DNA, 22 bp, Homo sapiens
ttcagtttgaattctgtagaac

SEQ ID NO: 7601859 - DNA, 22 bp, Homo sapiens
ttcagtttgaattctgtagaac

SEQ ID NO: 7601860 - DNA, 22 bp, Homo sapiens
ttcagtttgaattctgtagaac

SEQ ID NO: 7601861 - DNA, 22 bp, Homo sapiens
ttcagtttgaattctgtagaac

SEQ ID NO: 7601862 - DNA, 21 bp, Homo sapiens
ttcagtttcttcctcatctat

SEQ ID NO: 7601863 - DNA, 22 bp, Homo sapiens
ttcagtttgaattctgtagaac

SEQ ID NO: 7601864 - DNA, 22 bp, Homo sapiens
ttcagtttgaattctgtagaac

SEQ ID NO: 7601865 - DNA, 22 bp, Homo sapiens
ttcagtttgaattctgtagaac

SEQ ID NO: 7601866 - DNA, 22 bp, Homo sapiens
cgtcatcacggcaagcatctcc

SEQ ID NO: 7601867 - DNA, 22 bp, Homo sapiens
cgtcatcacggcaagcatctcc

SEQ ID NO: 7601868 - DNA, 22 bp, Homo sapiens
ttccagaaatctttcagctcaa

SEQ ID NO: 7601869 - DNA, 22 bp, Homo sapiens
cgtcatcacggcaagcatctcc

SEQ ID NO: 7601870 - DNA, 22 bp, Homo sapiens
cgtcatttgtaaatgatcaaga

SEQ ID NO: 7601871 - DNA, 22 bp, Homo sapiens
cgtccagattcagcccctagag

SEQ ID NO: 7601872 - DNA, 22 bp, Homo sapiens
cgtccaggaagatcggccgatg

SEQ ID NO: 7601873 - DNA, 22 bp, Homo sapiens
cgtccagggcgggctcccctca

SEQ ID NO: 7601874 - DNA, 22 bp, Homo sapiens
cgtccagggcgggctcccctca

SEQ ID NO: 7601875 - DNA, 19 bp, Homo sapiens
cgtccaggtgctggaagat

SEQ ID NO: 7601876 - DNA, 22 bp, Homo sapiens
cgtccatattcatgagctgagt

SEQ ID NO: 7601877 - DNA, 22 bp, Homo sapiens
cgtccatattcctgagggctca

SEQ ID NO: 7601878 - DNA, 22 bp, Homo sapiens
cgtcccagcagataaatgagga

SEQ ID NO: 7601879 - DNA, 22 bp, Homo sapiens
cgtcccagttccagccgcgctg

SEQ ID NO: 7601880 - DNA, 22 bp, Homo sapiens
cgtcccctcgttcccactttgg

SEQ ID NO: 7601881 - DNA, 22 bp, Homo sapiens
cgtcccagttccagccgcgctg

SEQ ID NO: 7601882 - DNA, 20 bp, Homo sapiens
cgtccccttgagcaggtccc

SEQ ID NO: 7601883 - DNA, 20 bp, Homo sapiens
cgtccccttgagcaggtccc

SEQ ID NO: 7601884 - DNA, 22 bp, Homo sapiens
cgtcccctcgttcccactttgg

SEQ ID NO: 7601885 - DNA, 22 bp, Homo sapiens
cgtcccgggttcacgccattct

SEQ ID NO: 7601886 - DNA, 22 bp, Homo sapiens
cgtctgcctaaggactgccttc

SEQ ID NO: 7601887 - DNA, 22 bp, Homo sapiens
cgtctgcctaaggactgccttc

SEQ ID NO: 7601888 - DNA, 22 bp, Homo sapiens
cgtctgcccgactgttcttcac

SEQ ID NO: 7601889 - DNA, 22 bp, Homo sapiens
cgtctctccgcaggggccttca

SEQ ID NO: 7601890 - DNA, 22 bp, Homo sapiens
cgtcctttgaattgaggtcttt

SEQ ID NO: 7601891 - DNA, 22 bp, Homo sapiens
cgtctagacagtttccaaaaga

SEQ ID NO: 7601892 - DNA, 22 bp, Homo sapiens
cgtctaggccgtgccctgaggt

SEQ ID NO: 7601893 - DNA, 22 bp, Homo sapiens
cgtctcctgtgttcgagccatt

SEQ ID NO: 7601894 - DNA, 22 bp, Homo sapiens
cgtctcctgtgttcgagccatt

SEQ ID NO: 7601895 - DNA, 22 bp, Homo sapiens
cgtcctgctcggcgcgcctcgg

SEQ ID NO: 7601896 - DNA, 22 bp, Homo sapiens
cgtcctgggtctgggaaggcat

SEQ ID NO: 7601897 - DNA, 22 bp, Homo sapiens
cgtcctgggtctgggaaggcat

SEQ ID NO: 7601898 - DNA, 22 bp, Homo sapiens
cgtcccgggttcacgccattct

SEQ ID NO: 7601899 - DNA, 20 bp, Homo sapiens
cgtccccttgagcaggtccc

SEQ ID NO: 7601900 - DNA, 22 bp, Homo sapiens
cgtcccgggttcacgccattct

SEQ ID NO: 7601901 - DNA, 22 bp, Homo sapiens
ttccagaaaaaaatgtatatct

SEQ ID NO: 7601902 - DNA, 22 bp, Homo sapiens
ttccagaaaaaaatgtatatct

SEQ ID NO: 7601903 - DNA, 22 bp, Homo sapiens
ttccagaaaacgctttatttag

SEQ ID NO: 7601904 - DNA, 22 bp, Homo sapiens
ttccagaaaacgctttatttag

SEQ ID NO: 7601905 - DNA, 22 bp, Homo sapiens
ttccagaaaacgctttatttag

SEQ ID NO: 7601906 - DNA, 22 bp, Homo sapiens
ttccagaaaactctgcctggta

SEQ ID NO: 7601907 - DNA, 22 bp, Homo sapiens
ttccagaaaacgctttatttag

SEQ ID NO: 7601908 - DNA, 22 bp, Homo sapiens
ttccagaaaaaaatgtatatct

SEQ ID NO: 7601909 - DNA, 22 bp, Homo sapiens
ttccagaaaaaaatgtatatct

SEQ ID NO: 7601910 - DNA, 22 bp, Homo sapiens
ttccagaaaacgctttatttag

SEQ ID NO: 7601911 - DNA, 21 bp, Homo sapiens
ttccagaaatctctttcttca

SEQ ID NO: 7601912 - DNA, 21 bp, Homo sapiens
ttccagaaatctctttcttca

SEQ ID NO: 7601913 - DNA, 22 bp, Homo sapiens
ttccagaaatctttcagctcaa

SEQ ID NO: 7601914 - DNA, 21 bp, Homo sapiens
ttccagaaatctctttcttca

SEQ ID NO: 7601915 - DNA, 21 bp, Homo sapiens
ttccagaaatctctttcttca

SEQ ID NO: 7601916 - DNA, 22 bp, Homo sapiens
ttccagaaagttctggaactgg

SEQ ID NO: 7601917 - DNA, 22 bp, Homo sapiens
ttccagaaagttctggaactgg

SEQ ID NO: 7601918 - DNA, 22 bp, Homo sapiens
ttccagaaagttctggaactgg

SEQ ID NO: 7601919 - DNA, 22 bp, Homo sapiens
ttccagaaaactctgcctggta

SEQ ID NO: 7601920 - DNA, 22 bp, Homo sapiens
ttccagaaaactctgcctggta

SEQ ID NO: 7601921 - DNA, 22 bp, Homo sapiens
ttccagaaacctgaaagtttct

SEQ ID NO: 7601922 - DNA, 22 bp, Homo sapiens
ttccagaaacctgaaagtttct

SEQ ID NO: 7601923 - DNA, 22 bp, Homo sapiens
ttccagaaacctgaaagtttct

SEQ ID NO: 7601924 - DNA, 22 bp, Homo sapiens
ttccactctccagtcaatttca

SEQ ID NO: 7601925 - DNA, 22 bp, Homo sapiens
ttccactctatgatagaagggt

SEQ ID NO: 7601926 - DNA, 22 bp, Homo sapiens
ttccactctgtcccctgtggga

SEQ ID NO: 7601927 - DNA, 22 bp, Homo sapiens
ttccactctccagtcaatttca

SEQ ID NO: 7601928 - DNA, 22 bp, Homo sapiens
ttccactgaaggatctagggaa

SEQ ID NO: 7601929 - DNA, 22 bp, Homo sapiens
ttccactgaaggatctagggaa

SEQ ID NO: 7601930 - DNA, 22 bp, Homo sapiens
ttccactgattttggttgacct

SEQ ID NO: 7601931 - DNA, 19 bp, Homo sapiens
ttccacttgggttagaatt

SEQ ID NO: 7601932 - DNA, 19 bp, Homo sapiens
ttccacttgggttagaatt

SEQ ID NO: 7601933 - DNA, 22 bp, Homo sapiens
ttccactggctttcagtgatct

SEQ ID NO: 7601934 - DNA, 22 bp, Homo sapiens
ttccactggctttcagtgatct

SEQ ID NO: 7601935 - DNA, 22 bp, Homo sapiens
ttccacttttctctctcatgcc

SEQ ID NO: 7601936 - DNA, 22 bp, Homo sapiens
ttccacttttctctctcatgcc

SEQ ID NO: 7601937 - DNA, 22 bp, Homo sapiens
ttcctcctacgcttatcacttt

SEQ ID NO: 7601938 - DNA, 22 bp, Homo sapiens
ttcctcctacgcttatcacttt

SEQ ID NO: 7601939 - DNA, 22 bp, Homo sapiens
ttcctcctacgcttatcacttt

SEQ ID NO: 7601940 - DNA, 22 bp, Homo sapiens
ttcctccatccttagggagagc

SEQ ID NO: 7601941 - DNA, 22 bp, Homo sapiens
ttcctccatccttagggagagc

SEQ ID NO: 7601942 - DNA, 22 bp, Homo sapiens
ttcctccagtcagagctgtccc

SEQ ID NO: 7601943 - DNA, 22 bp, Homo sapiens
ttcctccatccttagggagagc

SEQ ID NO: 7601944 - DNA, 22 bp, Homo sapiens
ttcctccagtcagagctgtccc

SEQ ID NO: 7601945 - DNA, 22 bp, Homo sapiens
ttcctccagtcagagctgtccc

SEQ ID NO: 7601946 - DNA, 22 bp, Homo sapiens
ttcctccagcctggagcacttc

SEQ ID NO: 7601947 - DNA, 17 bp, Homo sapiens
ttcctcctcaccatgtt

SEQ ID NO: 7601948 - DNA, 17 bp, Homo sapiens
ttcctcctcaccatgtt

SEQ ID NO: 7601949 - DNA, 21 bp, Homo sapiens
ttcctcctctggagaagaaga

SEQ ID NO: 7601950 - DNA, 21 bp, Homo sapiens
ttcctcctctggagaagaaga

SEQ ID NO: 7601951 - DNA, 21 bp, Homo sapiens
ttcctcctctggagaagaaga

SEQ ID NO: 7601952 - DNA, 21 bp, Homo sapiens
ttcctcctctggagaagaaga

SEQ ID NO: 7601953 - DNA, 22 bp, Homo sapiens
ttcctccttcccattcctgggg

SEQ ID NO: 7601954 - DNA, 22 bp, Homo sapiens
ttcctccttcccattcctgggg

SEQ ID NO: 7601955 - DNA, 22 bp, Homo sapiens
ttcctcctctgtaaaacgggca

SEQ ID NO: 7601956 - DNA, 22 bp, Homo sapiens
ttcctccagcctggagcacttc

SEQ ID NO: 7601957 - DNA, 22 bp, Homo sapiens
cgtgacagggtctggctggtca

SEQ ID NO: 7601958 - DNA, 22 bp, Homo sapiens
ttcctaacaaacttcagtgaat

SEQ ID NO: 7601959 - DNA, 22 bp, Homo sapiens
ttcctaacaaacttcagtgaat

SEQ ID NO: 7601960 - DNA, 22 bp, Homo sapiens
cgtctggcttctccacggtaaa

SEQ ID NO: 7601961 - DNA, 22 bp, Homo sapiens
cgtctggcttctccacggtaaa

SEQ ID NO: 7601962 - DNA, 22 bp, Homo sapiens
cgtcttcacatccttcccatgg

SEQ ID NO: 7601963 - DNA, 23 bp, Homo sapiens
cgtcttgtcctcgggcgcctggg

SEQ ID NO: 7601964 - DNA, 19 bp, Homo sapiens
cgtgaacatgactgcatgg

SEQ ID NO: 7601965 - DNA, 22 bp, Homo sapiens
cgtgaagcaggaaggctgccca

SEQ ID NO: 7601966 - DNA, 22 bp, Homo sapiens
cgtgaagcaggaaggctgccca

SEQ ID NO: 7601967 - DNA, 22 bp, Homo sapiens
cgtctttattgattccttcaag

SEQ ID NO: 7601968 - DNA, 22 bp, Homo sapiens
cgtctttattgattccttcaag

SEQ ID NO: 7601969 - DNA, 22 bp, Homo sapiens
cgtctttattgattccttcaag

SEQ ID NO: 7601970 - DNA, 22 bp, Homo sapiens
cgtgaaatgagttgaattattg

SEQ ID NO: 7601971 - DNA, 22 bp, Homo sapiens
ttcctctcctcccaccaggtga

SEQ ID NO: 7601972 - DNA, 22 bp, Homo sapiens
ttcctctcctcacatgagtcac

SEQ ID NO: 7601973 - DNA, 22 bp, Homo sapiens
ttcctccttgtcctagttactg

SEQ ID NO: 7601974 - DNA, 22 bp, Homo sapiens
ttcctccttcccattcctgggg

SEQ ID NO: 7601975 - DNA, 22 bp, Homo sapiens
ttcctcctctgtaaaacgggca

SEQ ID NO: 7601976 - DNA, 22 bp, Homo sapiens
ttcctccttgtcctagttactg

SEQ ID NO: 7601977 - DNA, 22 bp, Homo sapiens
ttcctccttgtcctagttactg

SEQ ID NO: 7601978 - DNA, 22 bp, Homo sapiens
ttcctctcaacatgcctgccgg

SEQ ID NO: 7601979 - DNA, 22 bp, Homo sapiens
ttcctctcgctctccggggccc

SEQ ID NO: 7601980 - DNA, 22 bp, Homo sapiens
ttcctctctcttgccagaatgt

SEQ ID NO: 7601981 - DNA, 22 bp, Homo sapiens
ttcctctctcttgccagaatgt

SEQ ID NO: 7601982 - DNA, 22 bp, Homo sapiens
ttcctctgaaatggcttggaaa

SEQ ID NO: 7601983 - DNA, 22 bp, Homo sapiens
ttcctctgaaatggcttggaaa

SEQ ID NO: 7601984 - DNA, 22 bp, Homo sapiens
ttcctctgaaatggcttggaaa

SEQ ID NO: 7601985 - DNA, 22 bp, Homo sapiens
ttcctctggaggctctaggaga

SEQ ID NO: 7601986 - DNA, 22 bp, Homo sapiens
ttcctctggaggctctaggaga

SEQ ID NO: 7601987 - DNA, 22 bp, Homo sapiens
ttcctctggaggctctaggaga

SEQ ID NO: 7601988 - DNA, 22 bp, Homo sapiens
ctaaatgatggatttaaacttt

SEQ ID NO: 7601989 - DNA, 22 bp, Homo sapiens
ctaaatgatggatttaaacttt

SEQ ID NO: 7601990 - DNA, 22 bp, Homo sapiens
ctaaatgatggatttaaacttt

SEQ ID NO: 7601991 - DNA, 21 bp, Homo sapiens
ttcctctgcaactgatgctca

SEQ ID NO: 7601992 - DNA, 21 bp, Homo sapiens
ttcctctgcaactgatgctca

SEQ ID NO: 7601993 - DNA, 21 bp, Homo sapiens
ttcctctgcaactgatgctca

SEQ ID NO: 7601994 - DNA, 21 bp, Homo sapiens
ttctcctgttttgcaccacag

SEQ ID NO: 7601995 - DNA, 22 bp, Homo sapiens
ttctcctgggaggggttgccca

SEQ ID NO: 7601996 - DNA, 22 bp, Homo sapiens
ttctcctggggccgtgatgtga

SEQ ID NO: 7601997 - DNA, 22 bp, Homo sapiens
ttctccttattcatagttgtct

SEQ ID NO: 7601998 - DNA, 22 bp, Homo sapiens
ttctccttattcatagttgtct

SEQ ID NO: 7601999 - DNA, 22 bp, Homo sapiens
ttctccttattcatagttgtct

SEQ ID NO: 7602000 - DNA, 21 bp, Homo sapiens
ttctcctgttttgcaccacag

SEQ ID NO: 7602001 - DNA, 22 bp, Homo sapiens
ttctccttgaaaagctgcatct

SEQ ID NO: 7602002 - DNA, 21 bp, Homo sapiens
ttctccttcttgatccaagca

SEQ ID NO: 7602003 - DNA, 22 bp, Homo sapiens
ttctccttcctggttttcaggc

SEQ ID NO: 7602004 - DNA, 22 bp, Homo sapiens
ttctccttcctggttttcaggc

SEQ ID NO: 7602005 - DNA, 22 bp, Homo sapiens
ttctccttcctggttttcaggc

SEQ ID NO: 7602006 - DNA, 22 bp, Homo sapiens
ttctcctttgtaattctcatcc

SEQ ID NO: 7602007 - DNA, 22 bp, Homo sapiens
ttctcctttgtaattctcatcc

SEQ ID NO: 7602008 - DNA, 22 bp, Homo sapiens
ttctcctttgtaattctcatcc

SEQ ID NO: 7602009 - DNA, 22 bp, Homo sapiens
ttctccttgttcccttcaattg

SEQ ID NO: 7602010 - DNA, 22 bp, Homo sapiens
ttctcctttcattccctgtaga

SEQ ID NO: 7602011 - DNA, 22 bp, Homo sapiens
ttctccttgttcccttcaattg

SEQ ID NO: 7602012 - DNA, 22 bp, Homo sapiens
ttctccttggtttatgggacat

SEQ ID NO: 7602013 - DNA, 22 bp, Homo sapiens
ttctccttggtttatgggacat

SEQ ID NO: 7602014 - DNA, 22 bp, Homo sapiens
ctagggctcgcaagggctggag

SEQ ID NO: 7602015 - DNA, 22 bp, Homo sapiens
ctagggctcgcaagggctggag

SEQ ID NO: 7602016 - DNA, 22 bp, Homo sapiens
ctagggctcgcaagggctggag

SEQ ID NO: 7602017 - DNA, 22 bp, Homo sapiens
ttctcctttgtaattctcatcc

SEQ ID NO: 7602018 - DNA, 22 bp, Homo sapiens
ttctcctttgtaattctcatcc

SEQ ID NO: 7602019 - DNA, 22 bp, Homo sapiens
ttctcctttgtaattctcatcc

SEQ ID NO: 7602020 - DNA, 22 bp, Homo sapiens
ctagggcttccaagatgccttc

SEQ ID NO: 7602021 - DNA, 18 bp, Homo sapiens
ctagggctgtggctctca

SEQ ID NO: 7602022 - DNA, 18 bp, Homo sapiens
ctagggctgtggctctca

SEQ ID NO: 7602023 - DNA, 19 bp, Homo sapiens
ctagggcttggcagcaggc

SEQ ID NO: 7602024 - DNA, 22 bp, Homo sapiens
ctagggcttccaagatgccttc

SEQ ID NO: 7602025 - DNA, 22 bp, Homo sapiens
ctagtttaaagcagctgaaagg

SEQ ID NO: 7602026 - DNA, 22 bp, Homo sapiens
ctagtttaaagcagctgaaagg

SEQ ID NO: 7602027 - DNA, 22 bp, Homo sapiens
ctagttgtttaatattgattga

SEQ ID NO: 7602028 - DNA, 22 bp, Homo sapiens
ctagtttaaagcagctgaaagg

SEQ ID NO: 7602029 - DNA, 22 bp, Homo sapiens
ctagtttctccgttttctaccc

SEQ ID NO: 7602030 - DNA, 22 bp, Homo sapiens
ctagtttctccgttttctaccc

SEQ ID NO: 7602031 - DNA, 22 bp, Homo sapiens
ctagttgtttaatattgattga

SEQ ID NO: 7602032 - DNA, 22 bp, Homo sapiens
ctagttgaagaggctgtcatca

SEQ ID NO: 7602033 - DNA, 22 bp, Homo sapiens
ctagttcttaactgttatgatt

SEQ ID NO: 7602034 - DNA, 22 bp, Homo sapiens
ctagttctgccattcagtgtca

SEQ ID NO: 7602035 - DNA, 22 bp, Homo sapiens
ctagttctcctgaaatgtttgg

SEQ ID NO: 7602036 - DNA, 22 bp, Homo sapiens
ctagttctagatccctgaggaa

SEQ ID NO: 7602037 - DNA, 22 bp, Homo sapiens
ctagttctagatccctgaggaa

SEQ ID NO: 7602038 - DNA, 22 bp, Homo sapiens
ctagtgtacaagtggtggagat

SEQ ID NO: 7602039 - DNA, 22 bp, Homo sapiens
ctagtggaaactaactggaatt

SEQ ID NO: 7602040 - DNA, 22 bp, Homo sapiens
ctagtgctctaggggctgaagg

SEQ ID NO: 7602041 - DNA, 22 bp, Homo sapiens
ctagtgaacgtggtactatgga

SEQ ID NO: 7602042 - DNA, 19 bp, Homo sapiens
ctagggcttggcagcaggc

SEQ ID NO: 7602043 - DNA, 19 bp, Homo sapiens
ctagggcttggcagcaggc

SEQ ID NO: 7602044 - DNA, 22 bp, Homo sapiens
ctagtgcaatgatgaatacaag

SEQ ID NO: 7602045 - DNA, 22 bp, Homo sapiens
ctagtgctctaggggctgaagg

SEQ ID NO: 7602046 - DNA, 22 bp, Homo sapiens
ctagttctagatccctgaggaa

SEQ ID NO: 7602047 - DNA, 22 bp, Homo sapiens
ctagttctagatccctgaggaa

SEQ ID NO: 7602048 - DNA, 22 bp, Homo sapiens
ctagttctagatccctgaggaa

SEQ ID NO: 7602049 - DNA, 22 bp, Homo sapiens
ctagttctaaatctgttgtcca

SEQ ID NO: 7602050 - DNA, 22 bp, Homo sapiens
ctagttctagatccctgaggaa

SEQ ID NO: 7602051 - DNA, 22 bp, Homo sapiens
ctagttattagctactcattga

SEQ ID NO: 7602052 - DNA, 22 bp, Homo sapiens
ctagttattagctactcattga

SEQ ID NO: 7602053 - DNA, 22 bp, Homo sapiens
ctagttatttggtacctggccc

SEQ ID NO: 7602054 - DNA, 22 bp, Homo sapiens
ctagtgtttattaatcatgagg

SEQ ID NO: 7602055 - DNA, 22 bp, Homo sapiens
ctagtgtttggaagtcatagcc

SEQ ID NO: 7602056 - DNA, 22 bp, Homo sapiens
ctagttatagtctcactcatgt

SEQ ID NO: 7602057 - DNA, 22 bp, Homo sapiens
ctagttatcttatctcagtgta

SEQ ID NO: 7602058 - DNA, 22 bp, Homo sapiens
ttctcatgaaactcgcttcctc

SEQ ID NO: 7602059 - DNA, 22 bp, Homo sapiens
ttctcatgaaactcgcttcctc

SEQ ID NO: 7602060 - DNA, 22 bp, Homo sapiens
ttctcatatgcactctatttga

SEQ ID NO: 7602061 - DNA, 22 bp, Homo sapiens
ttctcatgaaactcgcttcctc

SEQ ID NO: 7602062 - DNA, 22 bp, Homo sapiens
ttctcatgaaactcgcttcctc

SEQ ID NO: 7602063 - DNA, 22 bp, Homo sapiens
ttctcatatgcactctatttga

SEQ ID NO: 7602064 - DNA, 22 bp, Homo sapiens
ttctcataggagcgcaaaccct

SEQ ID NO: 7602065 - DNA, 22 bp, Homo sapiens
ttctcatagatgctatagacag

SEQ ID NO: 7602066 - DNA, 22 bp, Homo sapiens
ttctcatagagacatgattata

SEQ ID NO: 7602067 - DNA, 22 bp, Homo sapiens
ttctcatgatgcaattcatccc

SEQ ID NO: 7602068 - DNA, 22 bp, Homo sapiens
ttctcatgaaactcgcttcctc

SEQ ID NO: 7602069 - DNA, 22 bp, Homo sapiens
ttctcatgtaaatgccatcatc

SEQ ID NO: 7602070 - DNA, 22 bp, Homo sapiens
ttctcatgtaaatgccatcatc

SEQ ID NO: 7602071 - DNA, 22 bp, Homo sapiens
ttctcattctgactcagtgtag

SEQ ID NO: 7602072 - DNA, 19 bp, Homo sapiens
ttctcattcctttccactt

SEQ ID NO: 7602073 - DNA, 22 bp, Homo sapiens
ttctcctgcgcaggcccaggga

SEQ ID NO: 7602074 - DNA, 22 bp, Homo sapiens
ttctcctgcccttggacttcca

SEQ ID NO: 7602075 - DNA, 22 bp, Homo sapiens
ttctcctgcgcaggcccaggga

SEQ ID NO: 7602076 - DNA, 22 bp, Homo sapiens
ttctcctgcgcaggcccaggga

SEQ ID NO: 7602077 - DNA, 22 bp, Homo sapiens
ttctcctggagtgcttgttggg

SEQ ID NO: 7602078 - DNA, 22 bp, Homo sapiens
ttctcctgcgcaggcccaggga

SEQ ID NO: 7602079 - DNA, 22 bp, Homo sapiens
ttctcctggagtgcttgttggg

SEQ ID NO: 7602080 - DNA, 20 bp, Homo sapiens
ttctccaaaggagacactag

SEQ ID NO: 7602081 - DNA, 22 bp, Homo sapiens
ttctcctgcccttggacttcca

SEQ ID NO: 7602082 - DNA, 22 bp, Homo sapiens
ttctcattctgactcagtgtag

SEQ ID NO: 7602083 - DNA, 22 bp, Homo sapiens
ttctatttttgtggaactgtag

SEQ ID NO: 7602084 - DNA, 22 bp, Homo sapiens
ttctcaggtcaccagggtgcca

SEQ ID NO: 7602085 - DNA, 22 bp, Homo sapiens
ttctcaaaactcagggtatctg

SEQ ID NO: 7602086 - DNA, 22 bp, Homo sapiens
ttctcaggtgaggctgaggctg

SEQ ID NO: 7602087 - DNA, 22 bp, Homo sapiens
ttctcaggtgaggctgaggctg

SEQ ID NO: 7602088 - DNA, 22 bp, Homo sapiens
ttctcaggtgaggctgaggctg

SEQ ID NO: 7602089 - DNA, 22 bp, Homo sapiens
ttctcaggtgaggctgaggctg

SEQ ID NO: 7602090 - DNA, 22 bp, Homo sapiens
ttctatttttgtggaactgtag

SEQ ID NO: 7602091 - DNA, 22 bp, Homo sapiens
ttctatttttgtggaactgtag

SEQ ID NO: 7602092 - DNA, 22 bp, Homo sapiens
ctacatttacacagttaggctt

SEQ ID NO: 7602093 - DNA, 22 bp, Homo sapiens
ctacatttacacagttaggctt

SEQ ID NO: 7602094 - DNA, 22 bp, Homo sapiens
ctacatttacacagttaggctt

SEQ ID NO: 7602095 - DNA, 22 bp, Homo sapiens
ctacattctgggaaatcagatg

SEQ ID NO: 7602096 - DNA, 18 bp, Homo sapiens
ctacattcataggaaagg

SEQ ID NO: 7602097 - DNA, 22 bp, Homo sapiens
ctacattctgggaaatcagatg

SEQ ID NO: 7602098 - DNA, 22 bp, Homo sapiens
ctacattgttatctgtaagtgt

SEQ ID NO: 7602099 - DNA, 22 bp, Homo sapiens
ctacatttacacagttaggctt

SEQ ID NO: 7602100 - DNA, 23 bp, Homo sapiens
ttctcagtcctgcccagggaggc

SEQ ID NO: 7602101 - DNA, 22 bp, Homo sapiens
ttctcagtattacatgctaatg

SEQ ID NO: 7602102 - DNA, 22 bp, Homo sapiens
ttctcagtattacatgctaatg

SEQ ID NO: 7602103 - DNA, 22 bp, Homo sapiens
ttctcaggtgaggctgaggctg

SEQ ID NO: 7602104 - DNA, 22 bp, Homo sapiens
ttctcaggtgaggctgaggctg

SEQ ID NO: 7602105 - DNA, 22 bp, Homo sapiens
ttctcagtagttagcatttgtg

SEQ ID NO: 7602106 - DNA, 22 bp, Homo sapiens
ttctcaggtgaggctgaggctg

SEQ ID NO: 7602107 - DNA, 22 bp, Homo sapiens
ttctcagtagttagcatttgtg

SEQ ID NO: 7602108 - DNA, 21 bp, Homo sapiens
ttctcagtgtccatgttagtt

SEQ ID NO: 7602109 - DNA, 21 bp, Homo sapiens
ttctcagtgtccatgttagtt

SEQ ID NO: 7602110 - DNA, 22 bp, Homo sapiens
ttctcagtttcactgataacag

SEQ ID NO: 7602111 - DNA, 22 bp, Homo sapiens
ttctcagtttcatagctgagca

SEQ ID NO: 7602112 - DNA, 22 bp, Homo sapiens
ttctcagtttcatagctgagca

SEQ ID NO: 7602113 - DNA, 22 bp, Homo sapiens
ttctcatagagacatgattata

SEQ ID NO: 7602114 - DNA, 18 bp, Homo sapiens
ttctcatacctcacttag

SEQ ID NO: 7602115 - DNA, 18 bp, Homo sapiens
ttctcatacctcacttag

SEQ ID NO: 7602116 - DNA, 22 bp, Homo sapiens
ctaaattatttgcacattagag

SEQ ID NO: 7602117 - DNA, 22 bp, Homo sapiens
ctaaattatttgcacattagag

SEQ ID NO: 7602118 - DNA, 22 bp, Homo sapiens
ctaaattatcatgagaattatg

SEQ ID NO: 7602119 - DNA, 22 bp, Homo sapiens
ctaaattatttgcacattagag

SEQ ID NO: 7602120 - DNA, 22 bp, Homo sapiens
ctaaattatcatgagaattatg

SEQ ID NO: 7602121 - DNA, 22 bp, Homo sapiens
ctaaattatttgcacattagag

SEQ ID NO: 7602122 - DNA, 22 bp, Homo sapiens
ctaacatttattgagcacttag

SEQ ID NO: 7602123 - DNA, 18 bp, Homo sapiens
ctaacagggaaaatagaa

SEQ ID NO: 7602124 - DNA, 22 bp, Homo sapiens
ctaaattatttgcacattagag

SEQ ID NO: 7602125 - DNA, 18 bp, Homo sapiens
ctaacagggaaaatagaa

SEQ ID NO: 7602126 - DNA, 22 bp, Homo sapiens
ctaaattatttgcacattagag

SEQ ID NO: 7602127 - DNA, 22 bp, Homo sapiens
ctaaattatttgcacattagag

SEQ ID NO: 7602128 - DNA, 22 bp, Homo sapiens
ctaaccatcttacaaatgtctg

SEQ ID NO: 7602129 - DNA, 22 bp, Homo sapiens
ctaacgaaatacctcagacttt

SEQ ID NO: 7602130 - DNA, 22 bp, Homo sapiens
ctaacgaatatgtatgcatgtt

SEQ ID NO: 7602131 - DNA, 20 bp, Homo sapiens
ctaactaaccactttctgat

SEQ ID NO: 7602132 - DNA, 22 bp, Homo sapiens
ctaactacaagcggggcatcct

SEQ ID NO: 7602133 - DNA, 22 bp, Homo sapiens
ctaacatttattgagcacttag

SEQ ID NO: 7602134 - DNA, 22 bp, Homo sapiens
ctaacatttattgagcacttag

SEQ ID NO: 7602135 - DNA, 22 bp, Homo sapiens
ctaacatttggaaggcttatga

SEQ ID NO: 7602136 - DNA, 22 bp, Homo sapiens
ctaacatttggaaggcttatga

SEQ ID NO: 7602137 - DNA, 22 bp, Homo sapiens
ctaaccagagattagatttagt

SEQ ID NO: 7602138 - DNA, 22 bp, Homo sapiens
ctaaatgttcacatgcaatttt

SEQ ID NO: 7602139 - DNA, 22 bp, Homo sapiens
ctaaatgtgctaatagcatgaa

SEQ ID NO: 7602140 - DNA, 22 bp, Homo sapiens
ctaaatgttttatcttcctggc

SEQ ID NO: 7602141 - DNA, 22 bp, Homo sapiens
ctaaattatcatgagaattatg

SEQ ID NO: 7602142 - DNA, 22 bp, Homo sapiens
ctaaattatcatgagaattatg

SEQ ID NO: 7602143 - DNA, 22 bp, Homo sapiens
ctaaattatcatgagaattatg

SEQ ID NO: 7602144 - DNA, 22 bp, Homo sapiens
ctaaattatcatgagaattatg

SEQ ID NO: 7602145 - DNA, 22 bp, Homo sapiens
ctaaatgttttatcttcctggc

SEQ ID NO: 7602146 - DNA, 22 bp, Homo sapiens
ctaaattatcatgagaattatg

SEQ ID NO: 7602147 - DNA, 22 bp, Homo sapiens
ctaaatgtgactcaccatctca

SEQ ID NO: 7602148 - DNA, 22 bp, Homo sapiens
ctaaatgtgctaatagcatgaa

SEQ ID NO: 7602149 - DNA, 22 bp, Homo sapiens
ctaaatgtcatggagttgtaga

SEQ ID NO: 7602150 - DNA, 22 bp, Homo sapiens
ctaaatgtcatggagttgtaga

SEQ ID NO: 7602151 - DNA, 22 bp, Homo sapiens
ctaaatgtcagagtagcttgca

SEQ ID NO: 7602152 - DNA, 22 bp, Homo sapiens
ctaaatgcctttcctacctaac

SEQ ID NO: 7602153 - DNA, 22 bp, Homo sapiens
ctaaatgtcagagtagcttgca

SEQ ID NO: 7602154 - DNA, 22 bp, Homo sapiens
ctaaatgtcagagtagcttgca

SEQ ID NO: 7602155 - DNA, 22 bp, Homo sapiens
ctaaatgccctacaatgactgg

SEQ ID NO: 7602156 - DNA, 22 bp, Homo sapiens
ctaaatgccctacaatgactgg

SEQ ID NO: 7602157 - DNA, 22 bp, Homo sapiens
ctaaatgcctttcctacctaac

SEQ ID NO: 7602158 - DNA, 22 bp, Homo sapiens
ctaaatgccctacaatgactgg

SEQ ID NO: 7602159 - DNA, 21 bp, Homo sapiens
ctaactttgagtcctggcccc

SEQ ID NO: 7602160 - DNA, 22 bp, Homo sapiens
ctaactttgtcatcttcccttt

SEQ ID NO: 7602161 - DNA, 22 bp, Homo sapiens
ctaactttgtcatcttcccttt

SEQ ID NO: 7602162 - DNA, 22 bp, Homo sapiens
ttccttttgcaaggtcctctag

SEQ ID NO: 7602163 - DNA, 22 bp, Homo sapiens
ttccttttgcaaggtcctctag

SEQ ID NO: 7602164 - DNA, 22 bp, Homo sapiens
ttccttttgcaaggtcctctag

SEQ ID NO: 7602165 - DNA, 22 bp, Homo sapiens
ctaactttagcttagattatca

SEQ ID NO: 7602166 - DNA, 22 bp, Homo sapiens
ctaactttagcttagattatca

SEQ ID NO: 7602167 - DNA, 22 bp, Homo sapiens
ctaactgtcatgcacatgtgtt

SEQ ID NO: 7602168 - DNA, 22 bp, Homo sapiens
ctaactttagcttagattatca

SEQ ID NO: 7602169 - DNA, 22 bp, Homo sapiens
ctaactttatttgctaagtaga

SEQ ID NO: 7602170 - DNA, 21 bp, Homo sapiens
ttcctttttatggcttagtgg

SEQ ID NO: 7602171 - DNA, 21 bp, Homo sapiens
ttcctttttatggcttagtgg

SEQ ID NO: 7602172 - DNA, 22 bp, Homo sapiens
ttcctttttacataatcacatt

SEQ ID NO: 7602173 - DNA, 22 bp, Homo sapiens
ttcctttttacataatcacatt

SEQ ID NO: 7602174 - DNA, 22 bp, Homo sapiens
ttcctttttacataatcacatt

SEQ ID NO: 7602175 - DNA, 22 bp, Homo sapiens
ttcctttttacataatcacatt

SEQ ID NO: 7602176 - DNA, 22 bp, Homo sapiens
ttcctttttacataatcacatt

SEQ ID NO: 7602177 - DNA, 22 bp, Homo sapiens
ttcctttttacataatcacatt

SEQ ID NO: 7602178 - DNA, 22 bp, Homo sapiens
ttctacatagtctcttggagct

SEQ ID NO: 7602179 - DNA, 22 bp, Homo sapiens
ttctacatatatttttctcact

SEQ ID NO: 7602180 - DNA, 22 bp, Homo sapiens
ttctacaggtactgaagtacat

SEQ ID NO: 7602181 - DNA, 22 bp, Homo sapiens
ttctacaggtactgaagtacat

SEQ ID NO: 7602182 - DNA, 22 bp, Homo sapiens
ttctacaggtactgaagtacat

SEQ ID NO: 7602183 - DNA, 23 bp, Homo sapiens
ttctacagcttcttcagttaagg

SEQ ID NO: 7602184 - DNA, 21 bp, Homo sapiens
ttctacaggatgaatgaaaac

SEQ ID NO: 7602185 - DNA, 21 bp, Homo sapiens
ttctacaggatgaatgaaaac

SEQ ID NO: 7602186 - DNA, 22 bp, Homo sapiens
ttctacagaataaatgtttaca

SEQ ID NO: 7602187 - DNA, 22 bp, Homo sapiens
ttctacacttttcattagctag

SEQ ID NO: 7602188 - DNA, 22 bp, Homo sapiens
ttctacagaataaatgtttaca

SEQ ID NO: 7602189 - DNA, 22 bp, Homo sapiens
ttctacagaataaatgtttaca

SEQ ID NO: 7602190 - DNA, 22 bp, Homo sapiens
ctacatagatggatgattgtaa

SEQ ID NO: 7602191 - DNA, 22 bp, Homo sapiens
ctacatactgtgtgtaaagaat

SEQ ID NO: 7602192 - DNA, 22 bp, Homo sapiens
ctacatcaagtaatcttcaaaa

SEQ ID NO: 7602193 - DNA, 22 bp, Homo sapiens
ctacatactgtgtgtaaagaat

SEQ ID NO: 7602194 - DNA, 22 bp, Homo sapiens
ctacatactgtgtgtaaagaat

SEQ ID NO: 7602195 - DNA, 22 bp, Homo sapiens
ctacatcacttaattcttagaa

SEQ ID NO: 7602196 - DNA, 22 bp, Homo sapiens
ctacatcagaacatttacccta

SEQ ID NO: 7602197 - DNA, 22 bp, Homo sapiens
ctacatacatatacatgcagtt

SEQ ID NO: 7602198 - DNA, 22 bp, Homo sapiens
ctacatacatatacatgcagtt

SEQ ID NO: 7602199 - DNA, 22 bp, Homo sapiens
ctacataaatatttatgtgtct

SEQ ID NO: 7602200 - DNA, 22 bp, Homo sapiens
ctacataaatatttatgtgtct

SEQ ID NO: 7602201 - DNA, 22 bp, Homo sapiens
ctacataaatttatcacagact

SEQ ID NO: 7602202 - DNA, 22 bp, Homo sapiens
ctacagtgtcgtgtggtttctg

SEQ ID NO: 7602203 - DNA, 22 bp, Homo sapiens
ctacagtgtgacaggcttggtg

SEQ ID NO: 7602204 - DNA, 22 bp, Homo sapiens
ctacagtgtcgtgtggtttctg

SEQ ID NO: 7602205 - DNA, 22 bp, Homo sapiens
ctacagttcttaattaagtagt

SEQ ID NO: 7602206 - DNA, 17 bp, Homo sapiens
ctacagtgtgtttcctg

SEQ ID NO: 7602207 - DNA, 17 bp, Homo sapiens
ctacagtgtgtttcctg

SEQ ID NO: 7602208 - DNA, 22 bp, Homo sapiens
ctacagtgtgacaggcttggtg

SEQ ID NO: 7602209 - DNA, 17 bp, Homo sapiens
ctacagtgtgtttcctg

SEQ ID NO: 7602210 - DNA, 20 bp, Homo sapiens
ctacatgttctgcttctctc

SEQ ID NO: 7602211 - DNA, 22 bp, Homo sapiens
ctacatgtaggtttccttaatt

SEQ ID NO: 7602212 - DNA, 22 bp, Homo sapiens
ctacatgaatgggtgtattact

SEQ ID NO: 7602213 - DNA, 22 bp, Homo sapiens
ctacatctcaccttccaggaca

SEQ ID NO: 7602214 - DNA, 22 bp, Homo sapiens
ctacatgaactcttaagtcaca

SEQ ID NO: 7602215 - DNA, 22 bp, Homo sapiens
ctacatgaaaataagtttgaaa

SEQ ID NO: 7602216 - DNA, 22 bp, Homo sapiens
ctacatgaaaataagtttgaaa

SEQ ID NO: 7602217 - DNA, 22 bp, Homo sapiens
ctacatctcaccttccaggaca

SEQ ID NO: 7602218 - DNA, 22 bp, Homo sapiens
ctacattaaattggcttactta

SEQ ID NO: 7602219 - DNA, 22 bp, Homo sapiens
ctacattaaattggcttactta

SEQ ID NO: 7602220 - DNA, 22 bp, Homo sapiens
ctacattcaacagcagagtttt

SEQ ID NO: 7602221 - DNA, 22 bp, Homo sapiens
ctacattcaacagcagagtttt

SEQ ID NO: 7602222 - DNA, 22 bp, Homo sapiens
ctacattcaacagcagagtttt

SEQ ID NO: 7602223 - DNA, 18 bp, Homo sapiens
ctacattcataggaaagg

SEQ ID NO: 7602224 - DNA, 22 bp, Homo sapiens
ctacattaaattggcttactta

SEQ ID NO: 7602225 - DNA, 22 bp, Homo sapiens
ctacattaaattggcttactta

SEQ ID NO: 7602226 - DNA, 22 bp, Homo sapiens
ctacattaaattggcttactta

SEQ ID NO: 7602227 - DNA, 22 bp, Homo sapiens
ctacattaaattggcttactta

SEQ ID NO: 7602228 - DNA, 22 bp, Homo sapiens
ctacattaaattggcttactta

SEQ ID NO: 7602229 - DNA, 22 bp, Homo sapiens
ctacattaaattggcttactta

SEQ ID NO: 7602230 - DNA, 22 bp, Homo sapiens
ttctacctcctagaaaatctgg

SEQ ID NO: 7602231 - DNA, 19 bp, Homo sapiens
ttctaccttactgtaggct

SEQ ID NO: 7602232 - DNA, 22 bp, Homo sapiens
ttctacctcagtttcccactta

SEQ ID NO: 7602233 - DNA, 22 bp, Homo sapiens
ttctaccagctactcactgata

SEQ ID NO: 7602234 - DNA, 22 bp, Homo sapiens
ttctaccattgggaaaacagcc

SEQ ID NO: 7602235 - DNA, 22 bp, Homo sapiens
ttctacccgttgagagaatgct

SEQ ID NO: 7602236 - DNA, 22 bp, Homo sapiens
ttctacctaccctctgcataca

SEQ ID NO: 7602237 - DNA, 22 bp, Homo sapiens
ctacagtgactgtgacagagca

SEQ ID NO: 7602238 - DNA, 22 bp, Homo sapiens
ctacagtgactgtgacagagca

SEQ ID NO: 7602239 - DNA, 22 bp, Homo sapiens
ctacagtgactgtgacagagca

SEQ ID NO: 7602240 - DNA, 22 bp, Homo sapiens
ctacagtgacagaattaaacag

SEQ ID NO: 7602241 - DNA, 22 bp, Homo sapiens
ctacagtgacagaattaaacag

SEQ ID NO: 7602242 - DNA, 22 bp, Homo sapiens
ctacagtgaagactagctatag

SEQ ID NO: 7602243 - DNA, 22 bp, Homo sapiens
ctacagtgaagactagctatag

SEQ ID NO: 7602244 - DNA, 22 bp, Homo sapiens
ctacagtgaagactagctatag

SEQ ID NO: 7602245 - DNA, 22 bp, Homo sapiens
ctacagtctggcaggaatgtta

SEQ ID NO: 7602246 - DNA, 22 bp, Homo sapiens
ttctacctcagtttcccactta

SEQ ID NO: 7602247 - DNA, 22 bp, Homo sapiens
ttctacctcctagaaaatctgg

SEQ ID NO: 7602248 - DNA, 22 bp, Homo sapiens
ttctacatttaaaaggaaaatc

SEQ ID NO: 7602249 - DNA, 22 bp, Homo sapiens
ttctacatttaaaaggaaaatc

SEQ ID NO: 7602250 - DNA, 22 bp, Homo sapiens
ttctacattgtgaagttcttta

SEQ ID NO: 7602251 - DNA, 22 bp, Homo sapiens
ttctacatttaaaaggaaaatc

SEQ ID NO: 7602252 - DNA, 22 bp, Homo sapiens
ttctaccagaccccagacttgt

SEQ ID NO: 7602253 - DNA, 22 bp, Homo sapiens
ttctacatttaaaaggaaaatc

SEQ ID NO: 7602254 - DNA, 22 bp, Homo sapiens
ttctacatttgaggagagtcag

SEQ ID NO: 7602255 - DNA, 22 bp, Homo sapiens
ttctaccagaccccagacttgt

SEQ ID NO: 7602256 - DNA, 22 bp, Homo sapiens
ttctaccagaccccagacttgt

SEQ ID NO: 7602257 - DNA, 22 bp, Homo sapiens
ttctaccagaccccagacttgt

SEQ ID NO: 7602258 - DNA, 22 bp, Homo sapiens
ttctaccagctactcactgata

SEQ ID NO: 7602259 - DNA, 22 bp, Homo sapiens
ttctaccattgggaaaacagcc

SEQ ID NO: 7602260 - DNA, 22 bp, Homo sapiens
ttctacatgagaaaatgtattt

SEQ ID NO: 7602261 - DNA, 22 bp, Homo sapiens
ttctacatgagaaaatgtattt

SEQ ID NO: 7602262 - DNA, 22 bp, Homo sapiens
ttctacatgagaaaatgtattt

SEQ ID NO: 7602263 - DNA, 22 bp, Homo sapiens
ttctacatgagaaaatgtattt

SEQ ID NO: 7602264 - DNA, 22 bp, Homo sapiens
ttctacatatatttttctcact

SEQ ID NO: 7602265 - DNA, 22 bp, Homo sapiens
ttctacatcacttaacatgcta

SEQ ID NO: 7602266 - DNA, 22 bp, Homo sapiens
ttctacatcacttaacatgcta

SEQ ID NO: 7602267 - DNA, 22 bp, Homo sapiens
ttctacatcacttaacatgcta

SEQ ID NO: 7602268 - DNA, 22 bp, Homo sapiens
ttctacatggttgctcagaggg

SEQ ID NO: 7602269 - DNA, 22 bp, Homo sapiens
ttctacatgagaaaatgtattt

SEQ ID NO: 7602270 - DNA, 22 bp, Homo sapiens
ttctacatggttgctcagaggg

SEQ ID NO: 7602271 - DNA, 22 bp, Homo sapiens
ttctacattcatgtattacctc

SEQ ID NO: 7602272 - DNA, 22 bp, Homo sapiens
ttctacattgtgaagttcttta

SEQ ID NO: 7602273 - DNA, 22 bp, Homo sapiens
ttctacattcatgtattacctc

SEQ ID NO: 7602274 - DNA, 22 bp, Homo sapiens
ttctacattgtgaagttcttta

SEQ ID NO: 7602275 - DNA, 22 bp, Homo sapiens
ctgagggagctgctggccttgg

SEQ ID NO: 7602276 - DNA, 22 bp, Homo sapiens
ctgagggagctgctggccttgg

SEQ ID NO: 7602277 - DNA, 22 bp, Homo sapiens
ctgagggaggagaattgcttga

SEQ ID NO: 7602278 - DNA, 22 bp, Homo sapiens
ctgagggagctgctggccttgg

SEQ ID NO: 7602279 - DNA, 22 bp, Homo sapiens
ctgagggagctgctggccttgg

SEQ ID NO: 7602280 - DNA, 22 bp, Homo sapiens
ctgagggagagaatggggcaaa

SEQ ID NO: 7602281 - DNA, 22 bp, Homo sapiens
ctgagggagagaatggggcaaa

SEQ ID NO: 7602282 - DNA, 22 bp, Homo sapiens
ctgagggagagaatggggcaaa

SEQ ID NO: 7602283 - DNA, 22 bp, Homo sapiens
ctgagggagagaatggggcaaa

SEQ ID NO: 7602284 - DNA, 22 bp, Homo sapiens
ctgagggagagaatggggcaaa

SEQ ID NO: 7602285 - DNA, 22 bp, Homo sapiens
ctgagggagagaatggggcaaa

SEQ ID NO: 7602286 - DNA, 22 bp, Homo sapiens
ctgagggagagaatggggcaaa

SEQ ID NO: 7602287 - DNA, 22 bp, Homo sapiens
ctgagggagagaatggggcaaa

SEQ ID NO: 7602288 - DNA, 22 bp, Homo sapiens
ctgagggagacagtgcggacta

SEQ ID NO: 7602289 - DNA, 22 bp, Homo sapiens
ctgagggagaagtcacgggcag

SEQ ID NO: 7602290 - DNA, 22 bp, Homo sapiens
ctgagggagaagtcacgggcag

SEQ ID NO: 7602291 - DNA, 22 bp, Homo sapiens
ctgagggagaagtcacgggcag

SEQ ID NO: 7602292 - DNA, 22 bp, Homo sapiens
ctgagggagaagtcacgggcag

SEQ ID NO: 7602293 - DNA, 22 bp, Homo sapiens
ctgagggagaagtcacgggcag

SEQ ID NO: 7602294 - DNA, 22 bp, Homo sapiens
ctgagggaccctgtgagtacct

SEQ ID NO: 7602295 - DNA, 22 bp, Homo sapiens
ctgagggagacagtgcggacta

SEQ ID NO: 7602296 - DNA, 22 bp, Homo sapiens
ctgagggagacagtgcggacta

SEQ ID NO: 7602297 - DNA, 22 bp, Homo sapiens
ctgagggagaagtcacgggcag

SEQ ID NO: 7602298 - DNA, 22 bp, Homo sapiens
ctgagggagaagtgatctctac

SEQ ID NO: 7602299 - DNA, 22 bp, Homo sapiens
ctgagggagaagtgatctctac

SEQ ID NO: 7602300 - DNA, 22 bp, Homo sapiens
ctgagggagaagtgatctctac

SEQ ID NO: 7602301 - DNA, 22 bp, Homo sapiens
ctgagggaaggggtacatggct

SEQ ID NO: 7602302 - DNA, 22 bp, Homo sapiens
ctgagggaaggggtacatggct

SEQ ID NO: 7602303 - DNA, 22 bp, Homo sapiens
ctgagggaccctgtgagtacct

SEQ ID NO: 7602304 - DNA, 22 bp, Homo sapiens
ctgagggaccctgtgagtacct

SEQ ID NO: 7602305 - DNA, 22 bp, Homo sapiens
ctgagggaccctgtgagtacct

SEQ ID NO: 7602306 - DNA, 22 bp, Homo sapiens
ctgaggctgggcatggggtcca

SEQ ID NO: 7602307 - DNA, 22 bp, Homo sapiens
ctgaggctgggctgagggtata

SEQ ID NO: 7602308 - DNA, 22 bp, Homo sapiens
ctgagggaacttgggcaagtct

SEQ ID NO: 7602309 - DNA, 22 bp, Homo sapiens
ctgagggaaggcagtcagttgg

SEQ ID NO: 7602310 - DNA, 22 bp, Homo sapiens
ctgagggaaggcagtcagttgg

SEQ ID NO: 7602311 - DNA, 22 bp, Homo sapiens
ctgaggctgggcatggggtcca

SEQ ID NO: 7602312 - DNA, 22 bp, Homo sapiens
ctgaggctgggcatggggtcca

SEQ ID NO: 7602313 - DNA, 22 bp, Homo sapiens
ctgaggctgggctgagggtata

SEQ ID NO: 7602314 - DNA, 18 bp, Homo sapiens
ctgaggctggcaggagcc

SEQ ID NO: 7602315 - DNA, 22 bp, Homo sapiens
ctgaggctgggcatggggtcca

SEQ ID NO: 7602316 - DNA, 18 bp, Homo sapiens
ctgaggctggcaggagcc

SEQ ID NO: 7602317 - DNA, 18 bp, Homo sapiens
ctgaggctggcaggagcc

SEQ ID NO: 7602318 - DNA, 18 bp, Homo sapiens
ctgaggctggcaggagcc

SEQ ID NO: 7602319 - DNA, 18 bp, Homo sapiens
ctgaggctggcaggagcc

SEQ ID NO: 7602320 - DNA, 18 bp, Homo sapiens
ctgaggctggcaggagcc

SEQ ID NO: 7602321 - DNA, 18 bp, Homo sapiens
ctgagggcagcccctggg

SEQ ID NO: 7602322 - DNA, 18 bp, Homo sapiens
ctgagggcagcccctggg

SEQ ID NO: 7602323 - DNA, 18 bp, Homo sapiens
ctgagggcagcccctggg

SEQ ID NO: 7602324 - DNA, 18 bp, Homo sapiens
ctgagggcagcccctggg

SEQ ID NO: 7602325 - DNA, 22 bp, Homo sapiens
ctgagggcaccgacagagtgga

SEQ ID NO: 7602326 - DNA, 22 bp, Homo sapiens
ctgagggcagtgatgaaggtga

SEQ ID NO: 7602327 - DNA, 22 bp, Homo sapiens
ctgagggcagtgatgaaggtga

SEQ ID NO: 7602328 - DNA, 22 bp, Homo sapiens
ctgagggcagtgatgaaggtga

SEQ ID NO: 7602329 - DNA, 22 bp, Homo sapiens
ctgagggcagtgatgaaggtga

SEQ ID NO: 7602330 - DNA, 22 bp, Homo sapiens
ctgagggcagtgatgaaggtga

SEQ ID NO: 7602331 - DNA, 22 bp, Homo sapiens
ctgagggccctgaagcttggca

SEQ ID NO: 7602332 - DNA, 21 bp, Homo sapiens
ctgagggccgcagctgggctc

SEQ ID NO: 7602333 - DNA, 21 bp, Homo sapiens
ctgagggccgcagctgggctc

SEQ ID NO: 7602334 - DNA, 21 bp, Homo sapiens
ctgagggccgcagctgggctc

SEQ ID NO: 7602335 - DNA, 21 bp, Homo sapiens
ctgagggccgcagctgggctc

SEQ ID NO: 7602336 - DNA, 22 bp, Homo sapiens
ctgagggcatgaacattccata

SEQ ID NO: 7602337 - DNA, 22 bp, Homo sapiens
ctgagggccctgaagcttggca

SEQ ID NO: 7602338 - DNA, 22 bp, Homo sapiens
ctgagggccctgaagcttggca

SEQ ID NO: 7602339 - DNA, 22 bp, Homo sapiens
ctgagggcatgaacattccata

SEQ ID NO: 7602340 - DNA, 22 bp, Homo sapiens
ctgagggccctgaagcttggca

SEQ ID NO: 7602341 - DNA, 22 bp, Homo sapiens
ctgagggccctgaagcttggca

SEQ ID NO: 7602342 - DNA, 22 bp, Homo sapiens
ctgagggcaccgacagagtgga

SEQ ID NO: 7602343 - DNA, 22 bp, Homo sapiens
ctgagggcaccgacagagtgga

SEQ ID NO: 7602344 - DNA, 22 bp, Homo sapiens
ctgagggcaccgacagagtgga

SEQ ID NO: 7602345 - DNA, 18 bp, Homo sapiens
ctgagggcaacagaggct

SEQ ID NO: 7602346 - DNA, 22 bp, Homo sapiens
ctgagggcaccgacagagtgga

SEQ ID NO: 7602347 - DNA, 22 bp, Homo sapiens
ctgagggcaccgacagagtgga

SEQ ID NO: 7602348 - DNA, 18 bp, Homo sapiens
ctgagggcaacagaggct

SEQ ID NO: 7602349 - DNA, 18 bp, Homo sapiens
ctgagggcaacagaggct

SEQ ID NO: 7602350 - DNA, 18 bp, Homo sapiens
ctgagggcaacagaggct

SEQ ID NO: 7602351 - DNA, 22 bp, Homo sapiens
ctgagggatgggctgggccgcc

SEQ ID NO: 7602352 - DNA, 22 bp, Homo sapiens
ctgagggatgtggattttggtc

SEQ ID NO: 7602353 - DNA, 18 bp, Homo sapiens
ctgagggcaacagaggct

SEQ ID NO: 7602354 - DNA, 18 bp, Homo sapiens
ctgagggcaacagaggct

SEQ ID NO: 7602355 - DNA, 18 bp, Homo sapiens
ctgagggcaacagaggct

SEQ ID NO: 7602356 - DNA, 22 bp, Homo sapiens
ctgagggatgtggattttggtc

SEQ ID NO: 7602357 - DNA, 22 bp, Homo sapiens
ctgagggagttcctgagcccac

SEQ ID NO: 7602358 - DNA, 22 bp, Homo sapiens
ctgagggaggagaattgcttga

SEQ ID NO: 7602359 - DNA, 22 bp, Homo sapiens
ctgagggagggactttgagact

SEQ ID NO: 7602360 - DNA, 22 bp, Homo sapiens
ctgagggatgggctgggccgcc

SEQ ID NO: 7602361 - DNA, 22 bp, Homo sapiens
ctgagggagttcctgagcccac

SEQ ID NO: 7602362 - DNA, 22 bp, Homo sapiens
ctgagggagttcctgagcccac

SEQ ID NO: 7602363 - DNA, 22 bp, Homo sapiens
ctgagggagttcctgagcccac

SEQ ID NO: 7602364 - DNA, 22 bp, Homo sapiens
ctgagggagttcctgagcccac

SEQ ID NO: 7602365 - DNA, 22 bp, Homo sapiens
ctgaggaagacagcagctgtgt

SEQ ID NO: 7602366 - DNA, 22 bp, Homo sapiens
ctgaggaagaggtaccatttgt

SEQ ID NO: 7602367 - DNA, 22 bp, Homo sapiens
ctgaggaaggagttaggcagtt

SEQ ID NO: 7602368 - DNA, 22 bp, Homo sapiens
ctgaggaaggagttaggcagtt

SEQ ID NO: 7602369 - DNA, 22 bp, Homo sapiens
ctgaggaaagctgcagcggtac

SEQ ID NO: 7602370 - DNA, 22 bp, Homo sapiens
ctgaggaaagtattgcctggtg

SEQ ID NO: 7602371 - DNA, 22 bp, Homo sapiens
ctgaggaaagtattgcctggtg

SEQ ID NO: 7602372 - DNA, 22 bp, Homo sapiens
ctgaggaagacagcagctgtgt

SEQ ID NO: 7602373 - DNA, 22 bp, Homo sapiens
ctgaggaagacagcagctgtgt

SEQ ID NO: 7602374 - DNA, 22 bp, Homo sapiens
ctgaggaagacagcagctgtgt

SEQ ID NO: 7602375 - DNA, 22 bp, Homo sapiens
ctgaggacattgatgaggcaat

SEQ ID NO: 7602376 - DNA, 22 bp, Homo sapiens
ctgaggacattgatgaggcaat

SEQ ID NO: 7602377 - DNA, 22 bp, Homo sapiens
ctgaggacattgatgaggcaat

SEQ ID NO: 7602378 - DNA, 22 bp, Homo sapiens
ctgaggaatgagtgaggagcca

SEQ ID NO: 7602379 - DNA, 22 bp, Homo sapiens
ctgaggaatgagtgaggagcca

SEQ ID NO: 7602380 - DNA, 22 bp, Homo sapiens
ctgaggaatgagtgaggagcca

SEQ ID NO: 7602381 - DNA, 22 bp, Homo sapiens
ctgaggaaggctgggggcatcc

SEQ ID NO: 7602382 - DNA, 22 bp, Homo sapiens
ctgaggaaggagttaggcagtt

SEQ ID NO: 7602383 - DNA, 22 bp, Homo sapiens
ctgaggaatgagtgaggagcca

SEQ ID NO: 7602384 - DNA, 22 bp, Homo sapiens
ctgaggaaggctgggggcatcc

SEQ ID NO: 7602385 - DNA, 22 bp, Homo sapiens
ctgaggaaggagttaggcagtt

SEQ ID NO: 7602386 - DNA, 22 bp, Homo sapiens
ctgagctgtttaatcccagata

SEQ ID NO: 7602387 - DNA, 22 bp, Homo sapiens
ctgagctgttactctgtcctcg

SEQ ID NO: 7602388 - DNA, 22 bp, Homo sapiens
ctgagctgtttaatcccagata

SEQ ID NO: 7602389 - DNA, 22 bp, Homo sapiens
ctgagctgttactctgtcctcg

SEQ ID NO: 7602390 - DNA, 21 bp, Homo sapiens
ctgagcttattgaaaggaaga

SEQ ID NO: 7602391 - DNA, 22 bp, Homo sapiens
ctgagctgtttaatcccagata

SEQ ID NO: 7602392 - DNA, 22 bp, Homo sapiens
ctgagcttccagttcctccagg

SEQ ID NO: 7602393 - DNA, 22 bp, Homo sapiens
ctgagcttggcttatctccagc

SEQ ID NO: 7602394 - DNA, 22 bp, Homo sapiens
ctgagcttggcttatctccagc

SEQ ID NO: 7602395 - DNA, 22 bp, Homo sapiens
ctgaggaaagctgcagcggtac

SEQ ID NO: 7602396 - DNA, 22 bp, Homo sapiens
ctgaggaaagctgcagcggtac

SEQ ID NO: 7602397 - DNA, 22 bp, Homo sapiens
ctgagcttggccaggaatgaat

SEQ ID NO: 7602398 - DNA, 22 bp, Homo sapiens
ctgagctgtcaggaatggaaag

SEQ ID NO: 7602399 - DNA, 22 bp, Homo sapiens
ctgagctgtcaggaatggaaag

SEQ ID NO: 7602400 - DNA, 22 bp, Homo sapiens
ctgagctgtcaggaatggaaag

SEQ ID NO: 7602401 - DNA, 22 bp, Homo sapiens
ctgagctgtgctaagtgaaatg

SEQ ID NO: 7602402 - DNA, 22 bp, Homo sapiens
ctgagctgtgctaagtgaaatg

SEQ ID NO: 7602403 - DNA, 22 bp, Homo sapiens
ctgagctgtgctaagtgaaatg

SEQ ID NO: 7602404 - DNA, 22 bp, Homo sapiens
ctgagctgtgctaagtgaaatg

SEQ ID NO: 7602405 - DNA, 22 bp, Homo sapiens
ctgagctgtgctaagtgaaatg

SEQ ID NO: 7602406 - DNA, 22 bp, Homo sapiens
ctgagctgtggaataaacactg

SEQ ID NO: 7602407 - DNA, 22 bp, Homo sapiens
ctgagctgtggaataaacactg

SEQ ID NO: 7602408 - DNA, 22 bp, Homo sapiens
ctgagctggttctcttgtgaaa

SEQ ID NO: 7602409 - DNA, 22 bp, Homo sapiens
ctgagctgtcaggaatggaaag

SEQ ID NO: 7602410 - DNA, 22 bp, Homo sapiens
ctgagctggttctcttgtgaaa

SEQ ID NO: 7602411 - DNA, 22 bp, Homo sapiens
ctgagctggttctcttgtgaaa

SEQ ID NO: 7602412 - DNA, 22 bp, Homo sapiens
ctgagctgtgtggtcctgggca

SEQ ID NO: 7602413 - DNA, 22 bp, Homo sapiens
ctgagctgtgtggtcctgggca

SEQ ID NO: 7602414 - DNA, 22 bp, Homo sapiens
ctgagctgtggaataaacactg

SEQ ID NO: 7602415 - DNA, 22 bp, Homo sapiens
ctgagctgtggaataaacactg

SEQ ID NO: 7602416 - DNA, 22 bp, Homo sapiens
ctgagctgtggccaccaattta

SEQ ID NO: 7602417 - DNA, 22 bp, Homo sapiens
ctgagctgttactctgtcctcg

SEQ ID NO: 7602418 - DNA, 22 bp, Homo sapiens
ctgagctgttactctgtcctcg

SEQ ID NO: 7602419 - DNA, 22 bp, Homo sapiens
ctgagctgttactctgtcctcg

SEQ ID NO: 7602420 - DNA, 22 bp, Homo sapiens
ctgagctggtgtttcagggtca

SEQ ID NO: 7602421 - DNA, 22 bp, Homo sapiens
ctgagctggtgtttcagggtca

SEQ ID NO: 7602422 - DNA, 22 bp, Homo sapiens
ctgagctggtgtttcagggtca

SEQ ID NO: 7602423 - DNA, 22 bp, Homo sapiens
ctgagctggtggaagcatgcag

SEQ ID NO: 7602424 - DNA, 22 bp, Homo sapiens
ctgagctggtgtttcagggtca

SEQ ID NO: 7602425 - DNA, 22 bp, Homo sapiens
ctgagctggtggaagcatgcag

SEQ ID NO: 7602426 - DNA, 22 bp, Homo sapiens
ctgagctggtggaagcatgcag

SEQ ID NO: 7602427 - DNA, 22 bp, Homo sapiens
ctgagctggtggaagcatgcag

SEQ ID NO: 7602428 - DNA, 22 bp, Homo sapiens
ctgagctggtctatggacttgg

SEQ ID NO: 7602429 - DNA, 21 bp, Homo sapiens
ctgagctggggtgaaggttgc

SEQ ID NO: 7602430 - DNA, 21 bp, Homo sapiens
ctgagctggggtgaaggttgc

SEQ ID NO: 7602431 - DNA, 22 bp, Homo sapiens
ctgagctgggctctcttgaggg

SEQ ID NO: 7602432 - DNA, 21 bp, Homo sapiens
ctgagctggggtgaaggttgc

SEQ ID NO: 7602433 - DNA, 22 bp, Homo sapiens
ctgagcgaggagttggagcttt

SEQ ID NO: 7602434 - DNA, 22 bp, Homo sapiens
ctgagcgacaagtagcttttga

SEQ ID NO: 7602435 - DNA, 22 bp, Homo sapiens
ctgagcgcatggttgctgggga

SEQ ID NO: 7602436 - DNA, 22 bp, Homo sapiens
ctgagcgcgggacctgaggctg

SEQ ID NO: 7602437 - DNA, 20 bp, Homo sapiens
ctgagcgtctaagaggtgag

SEQ ID NO: 7602438 - DNA, 22 bp, Homo sapiens
ctgagccttgatgtcccttgtc

SEQ ID NO: 7602439 - DNA, 22 bp, Homo sapiens
ctgagccttattcaccagccct

SEQ ID NO: 7602440 - DNA, 22 bp, Homo sapiens
ctgagcctgtgtttctctggca

SEQ ID NO: 7602441 - DNA, 22 bp, Homo sapiens
ctgagccttattcaccagccct

SEQ ID NO: 7602442 - DNA, 22 bp, Homo sapiens
ctgagcacctgctgtgtgccag

SEQ ID NO: 7602443 - DNA, 22 bp, Homo sapiens
ctgagcaccccaggacctgcgc

SEQ ID NO: 7602444 - DNA, 23 bp, Homo sapiens
ctgagcacagctctgtgggcctc

SEQ ID NO: 7602445 - DNA, 22 bp, Homo sapiens
ctgagcacagaaataagatatt

SEQ ID NO: 7602446 - DNA, 22 bp, Homo sapiens
ctgagcaatttcagctctcact

SEQ ID NO: 7602447 - DNA, 22 bp, Homo sapiens
ctgagctgggagcctggcacca

SEQ ID NO: 7602448 - DNA, 22 bp, Homo sapiens
ctgagctgggagcctggcacca

SEQ ID NO: 7602449 - DNA, 22 bp, Homo sapiens
ctgagctgggagcctggcacca

SEQ ID NO: 7602450 - DNA, 22 bp, Homo sapiens
ctgagctgggagtagagactct

SEQ ID NO: 7602451 - DNA, 22 bp, Homo sapiens
ctgagctgggagtagagactct

SEQ ID NO: 7602452 - DNA, 22 bp, Homo sapiens
ctgagctgggagtagagactct

SEQ ID NO: 7602453 - DNA, 22 bp, Homo sapiens
ctgagctgggagtagagactct

SEQ ID NO: 7602454 - DNA, 22 bp, Homo sapiens
ctgagctgggcaactcttagat

SEQ ID NO: 7602455 - DNA, 22 bp, Homo sapiens
ctgagctgggctctcttgaggg

SEQ ID NO: 7602456 - DNA, 22 bp, Homo sapiens
ctgagctgggctctcttgaggg

SEQ ID NO: 7602457 - DNA, 22 bp, Homo sapiens
ctgagctgggctctcttgaggg

SEQ ID NO: 7602458 - DNA, 22 bp, Homo sapiens
ctgagctgggcaactcttagat

SEQ ID NO: 7602459 - DNA, 22 bp, Homo sapiens
ctgagctgggcaactcttagat

SEQ ID NO: 7602460 - DNA, 22 bp, Homo sapiens
ctgagctgggcaactcttagat

SEQ ID NO: 7602461 - DNA, 22 bp, Homo sapiens
ctgagctgggagtggatagtgg

SEQ ID NO: 7602462 - DNA, 22 bp, Homo sapiens
ctgagctgggagtggatagtgg

SEQ ID NO: 7602463 - DNA, 22 bp, Homo sapiens
ctgagctgggagtggatagtgg

SEQ ID NO: 7602464 - DNA, 22 bp, Homo sapiens
ctgagctgggagtggatagtgg

SEQ ID NO: 7602465 - DNA, 22 bp, Homo sapiens
ctgagatctttatacgaggcac

SEQ ID NO: 7602466 - DNA, 22 bp, Homo sapiens
ctgagatctttatacgaggcac

SEQ ID NO: 7602467 - DNA, 22 bp, Homo sapiens
ctgagatctttatacgaggcac

SEQ ID NO: 7602468 - DNA, 22 bp, Homo sapiens
ctgagatcccaggcagggtggc

SEQ ID NO: 7602469 - DNA, 22 bp, Homo sapiens
ctgagatctttatacgaggcac

SEQ ID NO: 7602470 - DNA, 22 bp, Homo sapiens
ctgagatctttatacgaggcac

SEQ ID NO: 7602471 - DNA, 22 bp, Homo sapiens
ctgagatcccaggcagggtggc

SEQ ID NO: 7602472 - DNA, 22 bp, Homo sapiens
ctgagatattaagctctggctt

SEQ ID NO: 7602473 - DNA, 22 bp, Homo sapiens
ctgagatggagtttcgctcttc

SEQ ID NO: 7602474 - DNA, 22 bp, Homo sapiens
ctgagatggagttttgctcttg

SEQ ID NO: 7602475 - DNA, 22 bp, Homo sapiens
ctgagatggccactgggtctca

SEQ ID NO: 7602476 - DNA, 22 bp, Homo sapiens
ctgagataaatgcctccagtca

SEQ ID NO: 7602477 - DNA, 22 bp, Homo sapiens
ctgagagttcgttccaccctcc

SEQ ID NO: 7602478 - DNA, 22 bp, Homo sapiens
ctgagagttcgttccaccctcc

SEQ ID NO: 7602479 - DNA, 22 bp, Homo sapiens
ctgagagttcgttccaccctcc

SEQ ID NO: 7602480 - DNA, 22 bp, Homo sapiens
ctgagagttaagagatggggct

SEQ ID NO: 7602481 - DNA, 22 bp, Homo sapiens
ctgagagtgtggcttccaggcc

SEQ ID NO: 7602482 - DNA, 22 bp, Homo sapiens
ctgagagtgtggcttccaggcc

SEQ ID NO: 7602483 - DNA, 22 bp, Homo sapiens
ctgagagtgcttgaaaggccag

SEQ ID NO: 7602484 - DNA, 22 bp, Homo sapiens
ctgagagttaagagatggggct

SEQ ID NO: 7602485 - DNA, 22 bp, Homo sapiens
ctgagagtgtggcttccaggcc

SEQ ID NO: 7602486 - DNA, 22 bp, Homo sapiens
ctgagagtgcttgaaaggccag

SEQ ID NO: 7602487 - DNA, 20 bp, Homo sapiens
ctgagagtctgtgcttagtc

SEQ ID NO: 7602488 - DNA, 22 bp, Homo sapiens
ctgagagtctgcatttctaaca

SEQ ID NO: 7602489 - DNA, 22 bp, Homo sapiens
ctgagagtctgcatttctaaca

SEQ ID NO: 7602490 - DNA, 22 bp, Homo sapiens
ctgagagtctacatttttagca

SEQ ID NO: 7602491 - DNA, 22 bp, Homo sapiens
ctgagagtcagtggagtggtgt

SEQ ID NO: 7602492 - DNA, 22 bp, Homo sapiens
ctgagagtcagcttctcctcct

SEQ ID NO: 7602493 - DNA, 20 bp, Homo sapiens
ctgagagtctgtgcttagtc

SEQ ID NO: 7602494 - DNA, 22 bp, Homo sapiens
ctgagagtgctctttgatgtca

SEQ ID NO: 7602495 - DNA, 22 bp, Homo sapiens
ctgagagtgctctttgatgtca

SEQ ID NO: 7602496 - DNA, 22 bp, Homo sapiens
ctgaataatattccattatgag

SEQ ID NO: 7602497 - DNA, 22 bp, Homo sapiens
ctgaataatattccattatgag

SEQ ID NO: 7602498 - DNA, 22 bp, Homo sapiens
ctgaataatgttctcttgtatg

SEQ ID NO: 7602499 - DNA, 22 bp, Homo sapiens
ctgaataatacagactagcttc

SEQ ID NO: 7602500 - DNA, 22 bp, Homo sapiens
ctgaagttttgacatctcattt

SEQ ID NO: 7602501 - DNA, 22 bp, Homo sapiens
ctgaataattttatagttgctg

SEQ ID NO: 7602502 - DNA, 22 bp, Homo sapiens
ctgagagatcaagccacaggat

SEQ ID NO: 7602503 - DNA, 22 bp, Homo sapiens
ctgaatagtgttatatgggtga

SEQ ID NO: 7602504 - DNA, 22 bp, Homo sapiens
ctgaataattttctgttgtatg

SEQ ID NO: 7602505 - DNA, 22 bp, Homo sapiens
ctgaatatcatttacatttgga

SEQ ID NO: 7602506 - DNA, 19 bp, Homo sapiens
ctgagagatgcttcacaca

SEQ ID NO: 7602507 - DNA, 22 bp, Homo sapiens
ctgagagatgatatagcttaat

SEQ ID NO: 7602508 - DNA, 22 bp, Homo sapiens
ctgagagatcaagccacaggat

SEQ ID NO: 7602509 - DNA, 22 bp, Homo sapiens
ctgagagatgatatagcttaat

SEQ ID NO: 7602510 - DNA, 22 bp, Homo sapiens
ctgagagatcaagccacaggat

SEQ ID NO: 7602511 - DNA, 22 bp, Homo sapiens
ctgagaggtgacagcgtgctgg

SEQ ID NO: 7602512 - DNA, 22 bp, Homo sapiens
ctgagaggtgacagcgtgctgg

SEQ ID NO: 7602513 - DNA, 22 bp, Homo sapiens
ctgagaggtgacagcgtgctgg

SEQ ID NO: 7602514 - DNA, 22 bp, Homo sapiens
ctgagaggtgctggtggctgca

SEQ ID NO: 7602515 - DNA, 22 bp, Homo sapiens
ctgagaggtgctggtggctgca

SEQ ID NO: 7602516 - DNA, 22 bp, Homo sapiens
ctgagaggtgacagcgtgctgg

SEQ ID NO: 7602517 - DNA, 22 bp, Homo sapiens
ctgagaggtgctggtggctgca

SEQ ID NO: 7602518 - DNA, 22 bp, Homo sapiens
ctgagaggtgctggtggctgca

SEQ ID NO: 7602519 - DNA, 22 bp, Homo sapiens
ctgagaggtgctggtggctgca

SEQ ID NO: 7602520 - DNA, 22 bp, Homo sapiens
ctgagagtaattttctacttga

SEQ ID NO: 7602521 - DNA, 22 bp, Homo sapiens
ctgagagtagctggagaacatt

SEQ ID NO: 7602522 - DNA, 22 bp, Homo sapiens
ctgagagtagctggagaacatt

SEQ ID NO: 7602523 - DNA, 22 bp, Homo sapiens
ctgagagtattggcaggcttgg

SEQ ID NO: 7602524 - DNA, 22 bp, Homo sapiens
ctgagagtagctggagaacatt

SEQ ID NO: 7602525 - DNA, 22 bp, Homo sapiens
ctgagagtattggcaggcttgg

SEQ ID NO: 7602526 - DNA, 22 bp, Homo sapiens
ctgagagtattggcaggcttgg

SEQ ID NO: 7602527 - DNA, 22 bp, Homo sapiens
ctgagagtattggcaggcttgg

SEQ ID NO: 7602528 - DNA, 22 bp, Homo sapiens
ctgagagtcagcttctcctcct

SEQ ID NO: 7602529 - DNA, 22 bp, Homo sapiens
ctgagagtattggcaggcttgg

SEQ ID NO: 7602530 - DNA, 22 bp, Homo sapiens
ctgagagtcagtggagtggtgt

SEQ ID NO: 7602531 - DNA, 22 bp, Homo sapiens
ctgagaggtaagcagcgcagtg

SEQ ID NO: 7602532 - DNA, 22 bp, Homo sapiens
ctgagaggtaagcagcgcagtg

SEQ ID NO: 7602533 - DNA, 22 bp, Homo sapiens
ctgagaggtaagcagcgcagtg

SEQ ID NO: 7602534 - DNA, 22 bp, Homo sapiens
ctgagaggtaagcagcgcagtg

SEQ ID NO: 7602535 - DNA, 22 bp, Homo sapiens
ctgagaggggaccagggtgttt

SEQ ID NO: 7602536 - DNA, 22 bp, Homo sapiens
ctgagaggggaccagggtgttt

SEQ ID NO: 7602537 - DNA, 22 bp, Homo sapiens
ctgagaggggaccagggtgttt

SEQ ID NO: 7602538 - DNA, 22 bp, Homo sapiens
ctgagaggggaccagggtgttt

SEQ ID NO: 7602539 - DNA, 22 bp, Homo sapiens
ctgagaggggaccagggtgttt

SEQ ID NO: 7602540 - DNA, 22 bp, Homo sapiens
ctgagaggtgacagcgtgctgg

SEQ ID NO: 7602541 - DNA, 22 bp, Homo sapiens
ctgagaggtaagcagcgcagtg

SEQ ID NO: 7602542 - DNA, 22 bp, Homo sapiens
ctgagaggtaagcagcgcagtg

SEQ ID NO: 7602543 - DNA, 22 bp, Homo sapiens
ctgagaggtaagcagcgcagtg

SEQ ID NO: 7602544 - DNA, 22 bp, Homo sapiens
ctgagaggtaagcagcgcagtg

SEQ ID NO: 7602545 - DNA, 22 bp, Homo sapiens
ctgagaggtaagcagcgcagtg

SEQ ID NO: 7602546 - DNA, 22 bp, Homo sapiens
ctgagaggtaagcagcgcagtg

SEQ ID NO: 7602547 - DNA, 22 bp, Homo sapiens
tttttctgtctcttacattgca

SEQ ID NO: 7602548 - DNA, 22 bp, Homo sapiens
tttttctgtctcttacattgca

SEQ ID NO: 7602549 - DNA, 22 bp, Homo sapiens
tttttctgtctcttacattgca

SEQ ID NO: 7602550 - DNA, 22 bp, Homo sapiens
tttttctgtctcttacattgca

SEQ ID NO: 7602551 - DNA, 22 bp, Homo sapiens
tttttcttaaatgtgggttggc

SEQ ID NO: 7602552 - DNA, 22 bp, Homo sapiens
tttttcttaaatgtgggttggc

SEQ ID NO: 7602553 - DNA, 22 bp, Homo sapiens
tttttcttaaatgtgggttggc

SEQ ID NO: 7602554 - DNA, 22 bp, Homo sapiens
tttttcttaaatgtgggttggc

SEQ ID NO: 7602555 - DNA, 22 bp, Homo sapiens
tttttcttaaatgtgggttggc

SEQ ID NO: 7602556 - DNA, 22 bp, Homo sapiens
tttttctgtaaagggccagaga

SEQ ID NO: 7602557 - DNA, 20 bp, Homo sapiens
tttttctgggcttccatagc

SEQ ID NO: 7602558 - DNA, 22 bp, Homo sapiens
tttttctggataactgtatctc

SEQ ID NO: 7602559 - DNA, 22 bp, Homo sapiens
tttttctggataactgtatctc

SEQ ID NO: 7602560 - DNA, 20 bp, Homo sapiens
tttttctgggcttccatagc

SEQ ID NO: 7602561 - DNA, 20 bp, Homo sapiens
tttttctgggcttccatagc

SEQ ID NO: 7602562 - DNA, 22 bp, Homo sapiens
tttttcttgtgctggatctaat

SEQ ID NO: 7602563 - DNA, 22 bp, Homo sapiens
tttttcttgtgctggatctaat

SEQ ID NO: 7602564 - DNA, 22 bp, Homo sapiens
tttttcttgtgctggatctaat

SEQ ID NO: 7602565 - DNA, 22 bp, Homo sapiens
tttttcttgtgctggatctaat

SEQ ID NO: 7602566 - DNA, 22 bp, Homo sapiens
tttttcttaaatgtgggttggc

SEQ ID NO: 7602567 - DNA, 22 bp, Homo sapiens
tttttcttaaatgtgggttggc

SEQ ID NO: 7602568 - DNA, 22 bp, Homo sapiens
tttttcttaaatgtgggttggc

SEQ ID NO: 7602569 - DNA, 22 bp, Homo sapiens
tttttcttaaatgtgggttggc

SEQ ID NO: 7602570 - DNA, 22 bp, Homo sapiens
tttttcttgtgctggatctaat

SEQ ID NO: 7602571 - DNA, 22 bp, Homo sapiens
tttttcttgtgctggatctaat

SEQ ID NO: 7602572 - DNA, 22 bp, Homo sapiens
tttttcttgtgctggatctaat

SEQ ID NO: 7602573 - DNA, 22 bp, Homo sapiens
tttttcttgtgctggatctaat

SEQ ID NO: 7602574 - DNA, 22 bp, Homo sapiens
tttttcttgtgctggatctaat

SEQ ID NO: 7602575 - DNA, 22 bp, Homo sapiens
tttttcttgtgctggatctaat

SEQ ID NO: 7602576 - DNA, 22 bp, Homo sapiens
ttttttgttgggtagaacggaa

SEQ ID NO: 7602577 - DNA, 22 bp, Homo sapiens
ttttttgttgggtagaacggaa

SEQ ID NO: 7602578 - DNA, 22 bp, Homo sapiens
ttttttgttgggtagaacggaa

SEQ ID NO: 7602579 - DNA, 22 bp, Homo sapiens
ttttttgttgggtagaacggaa

SEQ ID NO: 7602580 - DNA, 22 bp, Homo sapiens
ctgaaaaacgggatttggctgg

SEQ ID NO: 7602581 - DNA, 22 bp, Homo sapiens
ctgaaaaacgggatttggctgg

SEQ ID NO: 7602582 - DNA, 22 bp, Homo sapiens
ctgaaaagctttgaaccgttaa

SEQ ID NO: 7602583 - DNA, 22 bp, Homo sapiens
ctgaaaaatatgttttggagaa

SEQ ID NO: 7602584 - DNA, 22 bp, Homo sapiens
ctgaaaaatatgttttggagaa

SEQ ID NO: 7602585 - DNA, 19 bp, Homo sapiens
ctgaaacacagagagggct

SEQ ID NO: 7602586 - DNA, 22 bp, Homo sapiens
ctgaaaatgttagtgatacgaa

SEQ ID NO: 7602587 - DNA, 22 bp, Homo sapiens
ctgaaaatgttagtgatacgaa

SEQ ID NO: 7602588 - DNA, 22 bp, Homo sapiens
ctgaaaatgttacacaggaaga

SEQ ID NO: 7602589 - DNA, 22 bp, Homo sapiens
ctgaaaatgttacacaggaaga

SEQ ID NO: 7602590 - DNA, 22 bp, Homo sapiens
ctgaaaatgttacacaggaaga

SEQ ID NO: 7602591 - DNA, 22 bp, Homo sapiens
ctgaaaatgttacacaggaaga

SEQ ID NO: 7602592 - DNA, 22 bp, Homo sapiens
ctgaaactccatgagaaattgc

SEQ ID NO: 7602593 - DNA, 22 bp, Homo sapiens
ctgaaactccatgagaaattgc

SEQ ID NO: 7602594 - DNA, 22 bp, Homo sapiens
ctgaaactccatgagaaattgc

SEQ ID NO: 7602595 - DNA, 22 bp, Homo sapiens
ctgaaacattgcaataacaaag

SEQ ID NO: 7602596 - DNA, 22 bp, Homo sapiens
ctgaaacattgcaataacaaag

SEQ ID NO: 7602597 - DNA, 20 bp, Homo sapiens
ctgaaagacgtaacagtgca

SEQ ID NO: 7602598 - DNA, 20 bp, Homo sapiens
ctgaaagacgtaacagtgca

SEQ ID NO: 7602599 - DNA, 20 bp, Homo sapiens
ctgaaagacgtaacagtgca

SEQ ID NO: 7602600 - DNA, 22 bp, Homo sapiens
ctgaaactggtcaattaatctg

SEQ ID NO: 7602601 - DNA, 22 bp, Homo sapiens
ctgaaactggtcaattaatctg

SEQ ID NO: 7602602 - DNA, 22 bp, Homo sapiens
ctgaaactttagttctgcaaca

SEQ ID NO: 7602603 - DNA, 22 bp, Homo sapiens
ctgaagattataaacagacata

SEQ ID NO: 7602604 - DNA, 22 bp, Homo sapiens
ctgaagatgttctttttggttc

SEQ ID NO: 7602605 - DNA, 22 bp, Homo sapiens
ctgaagattataaacagacata

SEQ ID NO: 7602606 - DNA, 22 bp, Homo sapiens
ctgaagattcgcctttgtttat

SEQ ID NO: 7602607 - DNA, 22 bp, Homo sapiens
ctgaaagcaaagtaattcttaa

SEQ ID NO: 7602608 - DNA, 22 bp, Homo sapiens
ctgaaagagccccaggggcctg

SEQ ID NO: 7602609 - DNA, 20 bp, Homo sapiens
ctgaaagacgtaacagtgca

SEQ ID NO: 7602610 - DNA, 22 bp, Homo sapiens
ctgaaagcaaagtaattcttaa

SEQ ID NO: 7602611 - DNA, 22 bp, Homo sapiens
ctgaagattcgcctttgtttat

SEQ ID NO: 7602612 - DNA, 22 bp, Homo sapiens
ctgaagatttttggtaatcatg

SEQ ID NO: 7602613 - DNA, 22 bp, Homo sapiens
ctgaagatttttggtaatcatg

SEQ ID NO: 7602614 - DNA, 22 bp, Homo sapiens
ctgaagatttggctgtaaagca

SEQ ID NO: 7602615 - DNA, 22 bp, Homo sapiens
ctgaagatttggctgtaaagca

SEQ ID NO: 7602616 - DNA, 22 bp, Homo sapiens
ctgaagatttggctgtaaagca

SEQ ID NO: 7602617 - DNA, 22 bp, Homo sapiens
ctgaaggaagcaggtggcctgt

SEQ ID NO: 7602618 - DNA, 22 bp, Homo sapiens
ctgaagcaaaggatcgagctaa

SEQ ID NO: 7602619 - DNA, 22 bp, Homo sapiens
ctgaagcaaaggatcgagctaa

SEQ ID NO: 7602620 - DNA, 22 bp, Homo sapiens
ctgaagatttttggtaatcatg

SEQ ID NO: 7602621 - DNA, 22 bp, Homo sapiens
ctgaagatttttggtaatcatg

SEQ ID NO: 7602622 - DNA, 22 bp, Homo sapiens
ctgaaggattagagagcactta

SEQ ID NO: 7602623 - DNA, 22 bp, Homo sapiens
ctgaaggatgtgtggtgggagt

SEQ ID NO: 7602624 - DNA, 22 bp, Homo sapiens
ctgaaggatgtgtggtgggagt

SEQ ID NO: 7602625 - DNA, 22 bp, Homo sapiens
ctgaaggattcaaaatggcagg

SEQ ID NO: 7602626 - DNA, 22 bp, Homo sapiens
ctgaaggattagagagcactta

SEQ ID NO: 7602627 - DNA, 22 bp, Homo sapiens
ctgaaggaggtagagtgacata

SEQ ID NO: 7602628 - DNA, 18 bp, Homo sapiens
ctgaaggatccaggtgta

SEQ ID NO: 7602629 - DNA, 18 bp, Homo sapiens
ctgaaggatccaggtgta

SEQ ID NO: 7602630 - DNA, 22 bp, Homo sapiens
ctgaaggacacgtgaggagcca

SEQ ID NO: 7602631 - DNA, 22 bp, Homo sapiens
ctgaaggacacgtgaggagcca

SEQ ID NO: 7602632 - DNA, 22 bp, Homo sapiens
ctgaaggacttggtgatagttg

SEQ ID NO: 7602633 - DNA, 22 bp, Homo sapiens
ctgaaggacttggtgatagttg

SEQ ID NO: 7602634 - DNA, 22 bp, Homo sapiens
ctgaaggagaaggccactgttc

SEQ ID NO: 7602635 - DNA, 22 bp, Homo sapiens
ctgaaggagaaggccactgttc

SEQ ID NO: 7602636 - DNA, 22 bp, Homo sapiens
ctgaaggagcatagtcagtttt

SEQ ID NO: 7602637 - DNA, 22 bp, Homo sapiens
ctgaaggaggtagagtgacata

SEQ ID NO: 7602638 - DNA, 22 bp, Homo sapiens
ctgaaggagcatagtcagtttt

SEQ ID NO: 7602639 - DNA, 22 bp, Homo sapiens
ctgaaggagcatagtcagtttt

SEQ ID NO: 7602640 - DNA, 22 bp, Homo sapiens
ctgaaggcaccaggggtgccag

SEQ ID NO: 7602641 - DNA, 22 bp, Homo sapiens
ctgaaggctaaaatggactgaa

SEQ ID NO: 7602642 - DNA, 22 bp, Homo sapiens
ctgaaggctaaaatggactgaa

SEQ ID NO: 7602643 - DNA, 22 bp, Homo sapiens
ctgaaggatttagttctttgct

SEQ ID NO: 7602644 - DNA, 18 bp, Homo sapiens
ctgaaggcaccagggcag

SEQ ID NO: 7602645 - DNA, 22 bp, Homo sapiens
ctgaagggggtttcactgagct

SEQ ID NO: 7602646 - DNA, 22 bp, Homo sapiens
ctgaagggatgtgatttctaca

SEQ ID NO: 7602647 - DNA, 22 bp, Homo sapiens
ctgaagtcagatggcacaaggt

SEQ ID NO: 7602648 - DNA, 22 bp, Homo sapiens
ctgaagggtctggggctgtgcc

SEQ ID NO: 7602649 - DNA, 22 bp, Homo sapiens
ctgaagggtctggggctgtgcc

SEQ ID NO: 7602650 - DNA, 22 bp, Homo sapiens
ctgaagtcagatggcacaaggt

SEQ ID NO: 7602651 - DNA, 22 bp, Homo sapiens
ctgaagttcatacaatggccat

SEQ ID NO: 7602652 - DNA, 22 bp, Homo sapiens
ctgaagttattgtacaaatttg

SEQ ID NO: 7602653 - DNA, 22 bp, Homo sapiens
ctgaagttattgtacaaatttg

SEQ ID NO: 7602654 - DNA, 22 bp, Homo sapiens
ctgaagttaatcagaggtacaa

SEQ ID NO: 7602655 - DNA, 22 bp, Homo sapiens
ctgaagttagttatgcctaaaa

SEQ ID NO: 7602656 - DNA, 19 bp, Homo sapiens
ctgaagtcttttcagctgg

SEQ ID NO: 7602657 - DNA, 22 bp, Homo sapiens
ctgaagtgccaaatcataatca

SEQ ID NO: 7602658 - DNA, 22 bp, Homo sapiens
ctgaagtccagagtaagggact

SEQ ID NO: 7602659 - DNA, 22 bp, Homo sapiens
ctgaagtccctgttttgtttac

SEQ ID NO: 7602660 - DNA, 22 bp, Homo sapiens
ctgaagtggacaaatggagtgg

SEQ ID NO: 7602661 - DNA, 22 bp, Homo sapiens
tttttctagctcaaagattcta

SEQ ID NO: 7602662 - DNA, 22 bp, Homo sapiens
tttttctagctcaaagattcta

SEQ ID NO: 7602663 - DNA, 22 bp, Homo sapiens
tttttctagaccttaaaggcca

SEQ ID NO: 7602664 - DNA, 22 bp, Homo sapiens
tttttctagctcaaagattcta

SEQ ID NO: 7602665 - DNA, 22 bp, Homo sapiens
tttttctagctcaaagattcta

SEQ ID NO: 7602666 - DNA, 22 bp, Homo sapiens
tttttctagctcaaagattcta

SEQ ID NO: 7602667 - DNA, 22 bp, Homo sapiens
tttttctagctcaaagattcta

SEQ ID NO: 7602668 - DNA, 22 bp, Homo sapiens
tttttctagctcaaagattcta

SEQ ID NO: 7602669 - DNA, 22 bp, Homo sapiens
tttttctctatgccaggggcct

SEQ ID NO: 7602670 - DNA, 22 bp, Homo sapiens
tttttctagctcaaagattcta

SEQ ID NO: 7602671 - DNA, 22 bp, Homo sapiens
tttttctagctcaaagattcta

SEQ ID NO: 7602672 - DNA, 22 bp, Homo sapiens
tttttctagctcaaagattcta

SEQ ID NO: 7602673 - DNA, 19 bp, Homo sapiens
tttttacaagtaggtgtga

SEQ ID NO: 7602674 - DNA, 19 bp, Homo sapiens
tttttacaagtaggtgtga

SEQ ID NO: 7602675 - DNA, 19 bp, Homo sapiens
tttttaatgggctggagca

SEQ ID NO: 7602676 - DNA, 19 bp, Homo sapiens
tttttaatgggctggagca

SEQ ID NO: 7602677 - DNA, 22 bp, Homo sapiens
tttttctagaccttaaaggcca

SEQ ID NO: 7602678 - DNA, 19 bp, Homo sapiens
tttttacaagtaggtgtga

SEQ ID NO: 7602679 - DNA, 19 bp, Homo sapiens
tttttacaagtaggtgtga

SEQ ID NO: 7602680 - DNA, 19 bp, Homo sapiens
tttttacaagtaggtgtga

SEQ ID NO: 7602681 - DNA, 22 bp, Homo sapiens
tttttctgccattcaaagagga

SEQ ID NO: 7602682 - DNA, 22 bp, Homo sapiens
tttttctgccattcaaagagga

SEQ ID NO: 7602683 - DNA, 22 bp, Homo sapiens
tttttctgccattcaaagagga

SEQ ID NO: 7602684 - DNA, 22 bp, Homo sapiens
tttttctgccattcaaagagga

SEQ ID NO: 7602685 - DNA, 18 bp, Homo sapiens
tttttctgataaaacaag

SEQ ID NO: 7602686 - DNA, 18 bp, Homo sapiens
tttttctgataaaacaag

SEQ ID NO: 7602687 - DNA, 22 bp, Homo sapiens
tttttctgagcggtaatcatca

SEQ ID NO: 7602688 - DNA, 22 bp, Homo sapiens
tttttctgagaatatgagagga

SEQ ID NO: 7602689 - DNA, 22 bp, Homo sapiens
tttttctgagaatatgagagga

SEQ ID NO: 7602690 - DNA, 22 bp, Homo sapiens
tttttctgagaatatgagagga

SEQ ID NO: 7602691 - DNA, 22 bp, Homo sapiens
tttttctcttctgtaaagtggt

SEQ ID NO: 7602692 - DNA, 22 bp, Homo sapiens
tttttctcttctgtaaagtggt

SEQ ID NO: 7602693 - DNA, 22 bp, Homo sapiens
tttttctcttctgtaaagtggt

SEQ ID NO: 7602694 - DNA, 22 bp, Homo sapiens
tttttctctatgccaggggcct

SEQ ID NO: 7602695 - DNA, 22 bp, Homo sapiens
tttttctcttctgtaaagtggt

SEQ ID NO: 7602696 - DNA, 22 bp, Homo sapiens
ttttctctacaaaataaccagc

SEQ ID NO: 7602697 - DNA, 22 bp, Homo sapiens
ttttctctacaaaataaccagc

SEQ ID NO: 7602698 - DNA, 22 bp, Homo sapiens
ttttctctacaaaataaccagc

SEQ ID NO: 7602699 - DNA, 22 bp, Homo sapiens
ttttctcctttctaggtcacat

SEQ ID NO: 7602700 - DNA, 22 bp, Homo sapiens
ttttctctacaaaataaccagc

SEQ ID NO: 7602701 - DNA, 22 bp, Homo sapiens
ttttctcctttctaggtcacat

SEQ ID NO: 7602702 - DNA, 22 bp, Homo sapiens
ttttctcctttctaggtcacat

SEQ ID NO: 7602703 - DNA, 22 bp, Homo sapiens
ttttctcctttcaagatagcat

SEQ ID NO: 7602704 - DNA, 22 bp, Homo sapiens
ttttctcctttcaagatagcat

SEQ ID NO: 7602705 - DNA, 22 bp, Homo sapiens
ttttctctatattgtctgtgaa

SEQ ID NO: 7602706 - DNA, 22 bp, Homo sapiens
ttttctctatattgtctgtgaa

SEQ ID NO: 7602707 - DNA, 22 bp, Homo sapiens
ttttctctatattgtctgtgaa

SEQ ID NO: 7602708 - DNA, 22 bp, Homo sapiens
ttttctctatattgtctgtgaa

SEQ ID NO: 7602709 - DNA, 22 bp, Homo sapiens
ttttctctatattgtctgtgaa

SEQ ID NO: 7602710 - DNA, 22 bp, Homo sapiens
ttttctctatattgtctgtgaa

SEQ ID NO: 7602711 - DNA, 22 bp, Homo sapiens
ttttctctacaaaataaccagc

SEQ ID NO: 7602712 - DNA, 22 bp, Homo sapiens
ttttctctacaaaataaccagc

SEQ ID NO: 7602713 - DNA, 22 bp, Homo sapiens
ttttctcctttcaagatagcat

SEQ ID NO: 7602714 - DNA, 17 bp, Homo sapiens
ttttctcctgcccattc

SEQ ID NO: 7602715 - DNA, 22 bp, Homo sapiens
ttttctcctttcaagatagcat

SEQ ID NO: 7602716 - DNA, 17 bp, Homo sapiens
ttttctcctgcccattc

SEQ ID NO: 7602717 - DNA, 17 bp, Homo sapiens
ttttctcctgcccattc

SEQ ID NO: 7602718 - DNA, 17 bp, Homo sapiens
ttttctcctgcccattc

SEQ ID NO: 7602719 - DNA, 17 bp, Homo sapiens
ttttctcctgcccattc

SEQ ID NO: 7602720 - DNA, 17 bp, Homo sapiens
ttttctcctgcccattc

SEQ ID NO: 7602721 - DNA, 17 bp, Homo sapiens
ttttctcctgcccattc

SEQ ID NO: 7602722 - DNA, 22 bp, Homo sapiens
ttttctcctaagacccttcacc

SEQ ID NO: 7602723 - DNA, 22 bp, Homo sapiens
ttttctcctaagacccttcacc

SEQ ID NO: 7602724 - DNA, 22 bp, Homo sapiens
ttttctcctaagacccttcacc

SEQ ID NO: 7602725 - DNA, 22 bp, Homo sapiens
ttttctcccgctggctgctctt

SEQ ID NO: 7602726 - DNA, 22 bp, Homo sapiens
ttttctcccgctggctgctctt

SEQ ID NO: 7602727 - DNA, 22 bp, Homo sapiens
ttttctcccgctggctgctctt

SEQ ID NO: 7602728 - DNA, 22 bp, Homo sapiens
ttttctcccgctggctgctctt

SEQ ID NO: 7602729 - DNA, 22 bp, Homo sapiens
ttttctcccgctggctgctctt

SEQ ID NO: 7602730 - DNA, 22 bp, Homo sapiens
ttttctcccgctggctgctctt

SEQ ID NO: 7602731 - DNA, 22 bp, Homo sapiens
ttttctccagggaacaaggtga

SEQ ID NO: 7602732 - DNA, 22 bp, Homo sapiens
ttttctccagggaacaaggtga

SEQ ID NO: 7602733 - DNA, 22 bp, Homo sapiens
ttttctccccagagaccatcat

SEQ ID NO: 7602734 - DNA, 22 bp, Homo sapiens
ttttctccccagagaccatcat

SEQ ID NO: 7602735 - DNA, 22 bp, Homo sapiens
ttttctccccagagaccatcat

SEQ ID NO: 7602736 - DNA, 22 bp, Homo sapiens
ttttcctggggcttctggactc

SEQ ID NO: 7602737 - DNA, 22 bp, Homo sapiens
ttttcctggggcttctggactc

SEQ ID NO: 7602738 - DNA, 22 bp, Homo sapiens
ttttcctggggcttctggactc

SEQ ID NO: 7602739 - DNA, 22 bp, Homo sapiens
ttttcctgggctttctgtgtaa

SEQ ID NO: 7602740 - DNA, 22 bp, Homo sapiens
ttttcctggagatggagttgtt

SEQ ID NO: 7602741 - DNA, 22 bp, Homo sapiens
ttttcctggagatggagttgtt

SEQ ID NO: 7602742 - DNA, 22 bp, Homo sapiens
ttttcctgggctttctgtgtaa

SEQ ID NO: 7602743 - DNA, 22 bp, Homo sapiens
ttttcctgggctttctgtgtaa

SEQ ID NO: 7602744 - DNA, 22 bp, Homo sapiens
ttttcctggagatggagttgtt

SEQ ID NO: 7602745 - DNA, 22 bp, Homo sapiens
ttttcctgcctttgctcaggga

SEQ ID NO: 7602746 - DNA, 22 bp, Homo sapiens
ttttcctgcctttgctcaggga

SEQ ID NO: 7602747 - DNA, 22 bp, Homo sapiens
ttttcctggagatggagttgtt

SEQ ID NO: 7602748 - DNA, 23 bp, Homo sapiens
ttttcctgtggagacatgactgg

SEQ ID NO: 7602749 - DNA, 23 bp, Homo sapiens
ttttcctgtggagacatgactgg

SEQ ID NO: 7602750 - DNA, 23 bp, Homo sapiens
ttttcctgtggagacatgactgg

SEQ ID NO: 7602751 - DNA, 20 bp, Homo sapiens
ttttcctgtggtttgatatg

SEQ ID NO: 7602752 - DNA, 23 bp, Homo sapiens
ttttcctgtggagacatgactgg

SEQ ID NO: 7602753 - DNA, 23 bp, Homo sapiens
ttttcctgtggagacatgactgg

SEQ ID NO: 7602754 - DNA, 23 bp, Homo sapiens
ttttcctgtggagacatgactgg

SEQ ID NO: 7602755 - DNA, 23 bp, Homo sapiens
ttttcctgtggagacatgactgg

SEQ ID NO: 7602756 - DNA, 22 bp, Homo sapiens
ttttcctgtccaggcaattatt

SEQ ID NO: 7602757 - DNA, 22 bp, Homo sapiens
ttttcctgtccaggcaattatt

SEQ ID NO: 7602758 - DNA, 22 bp, Homo sapiens
ttttcctgtccaggcaattatt

SEQ ID NO: 7602759 - DNA, 22 bp, Homo sapiens
ttttcctgtccaggcaattatt

SEQ ID NO: 7602760 - DNA, 22 bp, Homo sapiens
ttttccttaacagagggagaaa

SEQ ID NO: 7602761 - DNA, 22 bp, Homo sapiens
ttttcctgttaaatctgggcac

SEQ ID NO: 7602762 - DNA, 22 bp, Homo sapiens
ttttcctgttaaatctgggcac

SEQ ID NO: 7602763 - DNA, 22 bp, Homo sapiens
ttttctcaggtgcttatctaag

SEQ ID NO: 7602764 - DNA, 22 bp, Homo sapiens
ttttctcaggtgcttatctaag

SEQ ID NO: 7602765 - DNA, 20 bp, Homo sapiens
ttttcctgtggtttgatatg

SEQ ID NO: 7602766 - DNA, 20 bp, Homo sapiens
ttttcctgtggtttgatatg

SEQ ID NO: 7602767 - DNA, 20 bp, Homo sapiens
ttttcctgtggtttgatatg

SEQ ID NO: 7602768 - DNA, 22 bp, Homo sapiens
ttttcctgttaaatctgggcac

SEQ ID NO: 7602769 - DNA, 22 bp, Homo sapiens
ttttctcaggtgcttatctaag

SEQ ID NO: 7602770 - DNA, 22 bp, Homo sapiens
ttttctcaggtgcttatctaag

SEQ ID NO: 7602771 - DNA, 21 bp, Homo sapiens
ttttctccagctgtgatttta

SEQ ID NO: 7602772 - DNA, 21 bp, Homo sapiens
ttttctccagctgtgatttta

SEQ ID NO: 7602773 - DNA, 22 bp, Homo sapiens
ttttctcaggtgcttatctaag

SEQ ID NO: 7602774 - DNA, 22 bp, Homo sapiens
ttttctccaactcaaaggaaag

SEQ ID NO: 7602775 - DNA, 22 bp, Homo sapiens
ttttctccaactcaaaggaaag

SEQ ID NO: 7602776 - DNA, 22 bp, Homo sapiens
ttttctccaactcaaaggaaag

SEQ ID NO: 7602777 - DNA, 22 bp, Homo sapiens
ttttctccaactcaaaggaaag

SEQ ID NO: 7602778 - DNA, 22 bp, Homo sapiens
ctctggagtgcagcctggtggc

SEQ ID NO: 7602779 - DNA, 22 bp, Homo sapiens
ctctggagtgcagcctggtggc

SEQ ID NO: 7602780 - DNA, 22 bp, Homo sapiens
ttttcctctgtatttgaaatgc

SEQ ID NO: 7602781 - DNA, 22 bp, Homo sapiens
ctctggagtcctgtatcactcc

SEQ ID NO: 7602782 - DNA, 22 bp, Homo sapiens
ctctggagtgcagcctggtggc

SEQ ID NO: 7602783 - DNA, 22 bp, Homo sapiens
ctctggagtgcagcctggtggc

SEQ ID NO: 7602784 - DNA, 22 bp, Homo sapiens
ctctggagtgcagcctggtggc

SEQ ID NO: 7602785 - DNA, 22 bp, Homo sapiens
ctctggagtgcagcctggtggc

SEQ ID NO: 7602786 - DNA, 22 bp, Homo sapiens
ctctggagtgcagcctggtggc

SEQ ID NO: 7602787 - DNA, 22 bp, Homo sapiens
ctctggagtgcagcctggtggc

SEQ ID NO: 7602788 - DNA, 22 bp, Homo sapiens
ttttcctgcctgtctctagagg

SEQ ID NO: 7602789 - DNA, 22 bp, Homo sapiens
ttttcctgcctgtctctagagg

SEQ ID NO: 7602790 - DNA, 22 bp, Homo sapiens
ttttcctgcctgtctctagagg

SEQ ID NO: 7602791 - DNA, 19 bp, Homo sapiens
ttttcctgcctcattgttt

SEQ ID NO: 7602792 - DNA, 19 bp, Homo sapiens
ttttcctgcctcattgttt

SEQ ID NO: 7602793 - DNA, 19 bp, Homo sapiens
ttttcctgcctcattgttt

SEQ ID NO: 7602794 - DNA, 22 bp, Homo sapiens
ttttcctgcctgtctctagagg

SEQ ID NO: 7602795 - DNA, 22 bp, Homo sapiens
ttttcctgcctgtctctagagg

SEQ ID NO: 7602796 - DNA, 22 bp, Homo sapiens
ttttcctgcctgtctctagagg

SEQ ID NO: 7602797 - DNA, 22 bp, Homo sapiens
ttttcctgcctgtctctagagg

SEQ ID NO: 7602798 - DNA, 22 bp, Homo sapiens
ttttcctgcctttgctcaggga

SEQ ID NO: 7602799 - DNA, 22 bp, Homo sapiens
ttttcctgcctttgctcaggga

SEQ ID NO: 7602800 - DNA, 22 bp, Homo sapiens
ttttcctctgtatttgaaatgc

SEQ ID NO: 7602801 - DNA, 22 bp, Homo sapiens
ttttcctctgtatttgaaatgc

SEQ ID NO: 7602802 - DNA, 22 bp, Homo sapiens
ttttcctctgtatttgaaatgc

SEQ ID NO: 7602803 - DNA, 22 bp, Homo sapiens
ttttcctctgtatttgaaatgc

SEQ ID NO: 7602804 - DNA, 22 bp, Homo sapiens
ttttcctctgtatttgaaatgc

SEQ ID NO: 7602805 - DNA, 22 bp, Homo sapiens
ttttcctctgtatttgaaatgc

SEQ ID NO: 7602806 - DNA, 22 bp, Homo sapiens
ttttcctctgttattagtgtga

SEQ ID NO: 7602807 - DNA, 22 bp, Homo sapiens
ttttcctctgttattagtgtga

SEQ ID NO: 7602808 - DNA, 19 bp, Homo sapiens
ttttcctgcctcattgttt

SEQ ID NO: 7602809 - DNA, 19 bp, Homo sapiens
ttttcctgcctcattgttt

SEQ ID NO: 7602810 - DNA, 22 bp, Homo sapiens
ttttcctctgttattagtgtga

SEQ ID NO: 7602811 - DNA, 19 bp, Homo sapiens
ttttcctgcctcattgttt

SEQ ID NO: 7602812 - DNA, 22 bp, Homo sapiens
ctgcagtgttctggaatgcatt

SEQ ID NO: 7602813 - DNA, 22 bp, Homo sapiens
ctgcagtgttctggaatgcatt

SEQ ID NO: 7602814 - DNA, 22 bp, Homo sapiens
ctgcagttggataaagatactt

SEQ ID NO: 7602815 - DNA, 22 bp, Homo sapiens
ctgcagttgactccctgtttgc

SEQ ID NO: 7602816 - DNA, 22 bp, Homo sapiens
ctgcagttgactccctgtttgc

SEQ ID NO: 7602817 - DNA, 22 bp, Homo sapiens
ctgcagttctttggcttttaga

SEQ ID NO: 7602818 - DNA, 22 bp, Homo sapiens
ctgcagttcttctcctcaaggc

SEQ ID NO: 7602819 - DNA, 22 bp, Homo sapiens
ctgcagttctttggcttttaga

SEQ ID NO: 7602820 - DNA, 22 bp, Homo sapiens
ctgcagttcttctcctcaaggc

SEQ ID NO: 7602821 - DNA, 22 bp, Homo sapiens
ctgcagttctcaatttctattg

SEQ ID NO: 7602822 - DNA, 22 bp, Homo sapiens
ctgcagttctcaatttctattg

SEQ ID NO: 7602823 - DNA, 22 bp, Homo sapiens
ctgcagttctcaatttctattg

SEQ ID NO: 7602824 - DNA, 22 bp, Homo sapiens
ctgcagttctcaatttctattg

SEQ ID NO: 7602825 - DNA, 22 bp, Homo sapiens
ctgcagttctcaatttctattg

SEQ ID NO: 7602826 - DNA, 22 bp, Homo sapiens
ctgcagtttcagcctttctggc

SEQ ID NO: 7602827 - DNA, 22 bp, Homo sapiens
ctgcagttgggtgacccaatat

SEQ ID NO: 7602828 - DNA, 22 bp, Homo sapiens
ctgcagttggtgggtcctcggt

SEQ ID NO: 7602829 - DNA, 22 bp, Homo sapiens
ctgcagttggtgggtcctcggt

SEQ ID NO: 7602830 - DNA, 22 bp, Homo sapiens
ctgcagttgggtgacccaatat

SEQ ID NO: 7602831 - DNA, 22 bp, Homo sapiens
ctgcagttggctgagacccccc

SEQ ID NO: 7602832 - DNA, 22 bp, Homo sapiens
ctgcagttggctgagacccccc

SEQ ID NO: 7602833 - DNA, 22 bp, Homo sapiens
ctgcagttggataaagatactt

SEQ ID NO: 7602834 - DNA, 22 bp, Homo sapiens
ctgcagtttgtaaacattttaa

SEQ ID NO: 7602835 - DNA, 22 bp, Homo sapiens
ctgcagtttgctaagagacaaa

SEQ ID NO: 7602836 - DNA, 22 bp, Homo sapiens
ctgcagtttgtaaacattttaa

SEQ ID NO: 7602837 - DNA, 22 bp, Homo sapiens
ctgcagtttgaccttgttttct

SEQ ID NO: 7602838 - DNA, 22 bp, Homo sapiens
ctgcagtttcagcctttctggc

SEQ ID NO: 7602839 - DNA, 22 bp, Homo sapiens
ctgcagtttgaccttgttttct

SEQ ID NO: 7602840 - DNA, 22 bp, Homo sapiens
ctgcagtttgctaagagacaaa

SEQ ID NO: 7602841 - DNA, 22 bp, Homo sapiens
ctgcagtttgaccttgttttct

SEQ ID NO: 7602842 - DNA, 22 bp, Homo sapiens
ctgcagtttcagcctttctggc

SEQ ID NO: 7602843 - DNA, 22 bp, Homo sapiens
ctgcccctggctggtgaagcag

SEQ ID NO: 7602844 - DNA, 22 bp, Homo sapiens
ctgcccctggctggtgaagcag

SEQ ID NO: 7602845 - DNA, 22 bp, Homo sapiens
ctgcccctggctggtgaagcag

SEQ ID NO: 7602846 - DNA, 22 bp, Homo sapiens
ctgcccctgctcatggctgtcc

SEQ ID NO: 7602847 - DNA, 22 bp, Homo sapiens
ctgcccctgctcatggctgtcc

SEQ ID NO: 7602848 - DNA, 22 bp, Homo sapiens
ctgcccctgctcatggctgtcc

SEQ ID NO: 7602849 - DNA, 22 bp, Homo sapiens
ctgcatcacagcaggaggcaca

SEQ ID NO: 7602850 - DNA, 22 bp, Homo sapiens
ctgcccctgctcatggctgtcc

SEQ ID NO: 7602851 - DNA, 22 bp, Homo sapiens
ctgcccctgctcatggctgtcc

SEQ ID NO: 7602852 - DNA, 22 bp, Homo sapiens
ctgcccctgctcatggctgtcc

SEQ ID NO: 7602853 - DNA, 22 bp, Homo sapiens
ctgcccctgctcatggctgtcc

SEQ ID NO: 7602854 - DNA, 22 bp, Homo sapiens
ctgcatatgatagatgccttgc

SEQ ID NO: 7602855 - DNA, 23 bp, Homo sapiens
ctgcatatggaggttagcaactc

SEQ ID NO: 7602856 - DNA, 22 bp, Homo sapiens
ctgcatatgatagatgccttgc

SEQ ID NO: 7602857 - DNA, 22 bp, Homo sapiens
ctgcatatgatagatgccttgc

SEQ ID NO: 7602858 - DNA, 22 bp, Homo sapiens
ctgcatatgagaataggagaaa

SEQ ID NO: 7602859 - DNA, 22 bp, Homo sapiens
ctgcatatcaaattactcctgg

SEQ ID NO: 7602860 - DNA, 22 bp, Homo sapiens
ctgcatatgagaataggagaaa

SEQ ID NO: 7602861 - DNA, 22 bp, Homo sapiens
ctgcatatgagaataggagaaa

SEQ ID NO: 7602862 - DNA, 22 bp, Homo sapiens
ctgcagtgaggattcttaggtg

SEQ ID NO: 7602863 - DNA, 22 bp, Homo sapiens
ctgcagtgaggattcttaggtg

SEQ ID NO: 7602864 - DNA, 22 bp, Homo sapiens
ctgcagtgcaagcccagatgga

SEQ ID NO: 7602865 - DNA, 22 bp, Homo sapiens
ctgcagtgcaagcccagatgga

SEQ ID NO: 7602866 - DNA, 22 bp, Homo sapiens
ctgcagtgcaagcccagatgga

SEQ ID NO: 7602867 - DNA, 22 bp, Homo sapiens
ctgcagtctgacatacgaggac

SEQ ID NO: 7602868 - DNA, 22 bp, Homo sapiens
ctgcagtcttccttccttaggc

SEQ ID NO: 7602869 - DNA, 22 bp, Homo sapiens
ctgcagtcttccttccttaggc

SEQ ID NO: 7602870 - DNA, 22 bp, Homo sapiens
ctgcagtgaaatcaggaagcaa

SEQ ID NO: 7602871 - DNA, 22 bp, Homo sapiens
ctgcagtgaaatcaggaagcaa

SEQ ID NO: 7602872 - DNA, 22 bp, Homo sapiens
ctgcagtgcctgccactgagcc

SEQ ID NO: 7602873 - DNA, 22 bp, Homo sapiens
ctgcagtgcctgccactgagcc

SEQ ID NO: 7602874 - DNA, 22 bp, Homo sapiens
ctgcagtgcaagcccagatgga

SEQ ID NO: 7602875 - DNA, 22 bp, Homo sapiens
ctgcagtgcctgccactgagcc

SEQ ID NO: 7602876 - DNA, 22 bp, Homo sapiens
ctgcagtgcaagcccagatgga

SEQ ID NO: 7602877 - DNA, 22 bp, Homo sapiens
ctgcagtgcctgccactgagcc

SEQ ID NO: 7602878 - DNA, 22 bp, Homo sapiens
ctgcagtgttctggaatgcatt

SEQ ID NO: 7602879 - DNA, 22 bp, Homo sapiens
ctgcagtgcctgccactgagcc

SEQ ID NO: 7602880 - DNA, 22 bp, Homo sapiens
ctgcagtgcctgccactgagcc

SEQ ID NO: 7602881 - DNA, 22 bp, Homo sapiens
ctgcagtagcagagctgagtag

SEQ ID NO: 7602882 - DNA, 22 bp, Homo sapiens
ctgcagtagcagagctgagtag

SEQ ID NO: 7602883 - DNA, 22 bp, Homo sapiens
ctgcagtatgagctacccaggt

SEQ ID NO: 7602884 - DNA, 22 bp, Homo sapiens
ctgcagtcagtgctaatgggta

SEQ ID NO: 7602885 - DNA, 22 bp, Homo sapiens
ctgcagtatgagctacccaggt

SEQ ID NO: 7602886 - DNA, 22 bp, Homo sapiens
ctgcagtcaagctcaccagttc

SEQ ID NO: 7602887 - DNA, 22 bp, Homo sapiens
ctgcagtcaagctcaccagttc

SEQ ID NO: 7602888 - DNA, 22 bp, Homo sapiens
ctgcagtcacattttctcacga

SEQ ID NO: 7602889 - DNA, 23 bp, Homo sapiens
ctgcagtcgccggcctgggtgcc

SEQ ID NO: 7602890 - DNA, 23 bp, Homo sapiens
ctgcagtcgccggcctgggtgcc

SEQ ID NO: 7602891 - DNA, 23 bp, Homo sapiens
ctgcagtcgccggcctgggtgcc

SEQ ID NO: 7602892 - DNA, 20 bp, Homo sapiens
ctgcagtcccctctgaatca

SEQ ID NO: 7602893 - DNA, 22 bp, Homo sapiens
ctgcagtcagtgctaatgggta

SEQ ID NO: 7602894 - DNA, 22 bp, Homo sapiens
ctgcagtctacctggattttta

SEQ ID NO: 7602895 - DNA, 22 bp, Homo sapiens
ctgcagtctgacatacgaggac

SEQ ID NO: 7602896 - DNA, 22 bp, Homo sapiens
ctgcagtctacctggattttta

SEQ ID NO: 7602897 - DNA, 22 bp, Homo sapiens
ctgcagtctacctggattttta

SEQ ID NO: 7602898 - DNA, 23 bp, Homo sapiens
ctgcagtcgccggcctgggtgcc

SEQ ID NO: 7602899 - DNA, 22 bp, Homo sapiens
ctgagggctggagctgaggcct

SEQ ID NO: 7602900 - DNA, 22 bp, Homo sapiens
ctgagggccttggctcctgccc

SEQ ID NO: 7602901 - DNA, 22 bp, Homo sapiens
ctgagggccttggctcctgccc

SEQ ID NO: 7602902 - DNA, 22 bp, Homo sapiens
ctgagggctggagctgaggcct

SEQ ID NO: 7602903 - DNA, 22 bp, Homo sapiens
ctgagggctggagctgaggcct

SEQ ID NO: 7602904 - DNA, 22 bp, Homo sapiens
ctgagggctggagctgaggcct

SEQ ID NO: 7602905 - DNA, 22 bp, Homo sapiens
ctgagggctggagctgaggcct

SEQ ID NO: 7602906 - DNA, 22 bp, Homo sapiens
ctgagggctggagctgaggcct

SEQ ID NO: 7602907 - DNA, 23 bp, Homo sapiens
ctgagggctggtctgaagtctgc

SEQ ID NO: 7602908 - DNA, 23 bp, Homo sapiens
ctgagggctggtctgaagtctgc

SEQ ID NO: 7602909 - DNA, 23 bp, Homo sapiens
ctgagggctggtctgaagtctgc

SEQ ID NO: 7602910 - DNA, 22 bp, Homo sapiens
ctgagggctggagctgaggcct

SEQ ID NO: 7602911 - DNA, 22 bp, Homo sapiens
ctgagggctggagctgaggcct

SEQ ID NO: 7602912 - DNA, 23 bp, Homo sapiens
ctgagggctggtctgaagtctgc

SEQ ID NO: 7602913 - DNA, 23 bp, Homo sapiens
ctgagggctggtctgaagtctgc

SEQ ID NO: 7602914 - DNA, 22 bp, Homo sapiens
ctgagggcttccttgtcccggg

SEQ ID NO: 7602915 - DNA, 22 bp, Homo sapiens
ctgagggcttccttgtcccggg

SEQ ID NO: 7602916 - DNA, 22 bp, Homo sapiens
ctgagggcttccttgtcccggg

SEQ ID NO: 7602917 - DNA, 21 bp, Homo sapiens
ctgagggccgcagctgggctc

SEQ ID NO: 7602918 - DNA, 22 bp, Homo sapiens
ctgagggcctgaggacctagat

SEQ ID NO: 7602919 - DNA, 22 bp, Homo sapiens
ctgagggcctgaggacctagat

SEQ ID NO: 7602920 - DNA, 22 bp, Homo sapiens
ctgagggccgggacccagtttc

SEQ ID NO: 7602921 - DNA, 22 bp, Homo sapiens
ctgagggccgggacccagtttc

SEQ ID NO: 7602922 - DNA, 21 bp, Homo sapiens
ctgagggccgcagctgggctc

SEQ ID NO: 7602923 - DNA, 21 bp, Homo sapiens
ctgagggccgcagctgggctc

SEQ ID NO: 7602924 - DNA, 21 bp, Homo sapiens
ctgagggccgcagctgggctc

SEQ ID NO: 7602925 - DNA, 21 bp, Homo sapiens
ctgagggccgcagctgggctc

SEQ ID NO: 7602926 - DNA, 21 bp, Homo sapiens
ctgagggccgcagctgggctc

SEQ ID NO: 7602927 - DNA, 22 bp, Homo sapiens
ctgagggccttctatgctgagc

SEQ ID NO: 7602928 - DNA, 22 bp, Homo sapiens
ctgagggccttctatgctgagc

SEQ ID NO: 7602929 - DNA, 22 bp, Homo sapiens
ctgagggccttggctcctgccc

SEQ ID NO: 7602930 - DNA, 22 bp, Homo sapiens
ctgagggccttctatgctgagc

SEQ ID NO: 7602931 - DNA, 22 bp, Homo sapiens
ctgagggccttggctcctgccc

SEQ ID NO: 7602932 - DNA, 22 bp, Homo sapiens
ctgagggccttctatgctgagc

SEQ ID NO: 7602933 - DNA, 22 bp, Homo sapiens
ctgagggccttctatgctgagc

SEQ ID NO: 7602934 - DNA, 22 bp, Homo sapiens
ctgagggcctgaggacctagat

SEQ ID NO: 7602935 - DNA, 22 bp, Homo sapiens
ctgagggcctgaggacctagat

SEQ ID NO: 7602936 - DNA, 22 bp, Homo sapiens
ctgcagggtttttcaaggacaa

SEQ ID NO: 7602937 - DNA, 22 bp, Homo sapiens
ctgcagggtttttcaaggacaa

SEQ ID NO: 7602938 - DNA, 22 bp, Homo sapiens
ctgcagggtttttcaaggacaa

SEQ ID NO: 7602939 - DNA, 22 bp, Homo sapiens
ctgcaggttaggagcactcctt

SEQ ID NO: 7602940 - DNA, 22 bp, Homo sapiens
ctgcaggttaggagcactcctt

SEQ ID NO: 7602941 - DNA, 22 bp, Homo sapiens
ctgcaggtctctgtgtgcattc

SEQ ID NO: 7602942 - DNA, 22 bp, Homo sapiens
ctgcagggtttttcaaggacaa

SEQ ID NO: 7602943 - DNA, 22 bp, Homo sapiens
ctgcaggttgactgaagtttgg

SEQ ID NO: 7602944 - DNA, 22 bp, Homo sapiens
ctgcaggttgagcagccaggtt

SEQ ID NO: 7602945 - DNA, 22 bp, Homo sapiens
ctgcaggttgagcagccaggtt

SEQ ID NO: 7602946 - DNA, 22 bp, Homo sapiens
ctgcaggttgagcagccaggtt

SEQ ID NO: 7602947 - DNA, 22 bp, Homo sapiens
ctgcagtaaccactgtaggtgt

SEQ ID NO: 7602948 - DNA, 22 bp, Homo sapiens
ctgcagtacaagaagcatctct

SEQ ID NO: 7602949 - DNA, 22 bp, Homo sapiens
ctgcagtacaagaagcatctct

SEQ ID NO: 7602950 - DNA, 22 bp, Homo sapiens
ctgcaggtttattttcttacct

SEQ ID NO: 7602951 - DNA, 22 bp, Homo sapiens
ctgcagtaacgatcatggtgcc

SEQ ID NO: 7602952 - DNA, 22 bp, Homo sapiens
ctgcaggggcctcgagcacagg

SEQ ID NO: 7602953 - DNA, 22 bp, Homo sapiens
ctgcaggggcctcgagcacagg

SEQ ID NO: 7602954 - DNA, 22 bp, Homo sapiens
ctgcaggggctggagttggctt

SEQ ID NO: 7602955 - DNA, 22 bp, Homo sapiens
ctgcaggggctggagttggctt

SEQ ID NO: 7602956 - DNA, 22 bp, Homo sapiens
ctgcaggggctggagttggctt

SEQ ID NO: 7602957 - DNA, 22 bp, Homo sapiens
ctgcaggggctggagttggctt

SEQ ID NO: 7602958 - DNA, 22 bp, Homo sapiens
ctgcaggggcctcgagcacagg

SEQ ID NO: 7602959 - DNA, 21 bp, Homo sapiens
ctgagggctttgaatccagac

SEQ ID NO: 7602960 - DNA, 21 bp, Homo sapiens
ctgagggctttgaatccagac

SEQ ID NO: 7602961 - DNA, 23 bp, Homo sapiens
ctgaggggaaaagggcttcaggc

SEQ ID NO: 7602962 - DNA, 23 bp, Homo sapiens
ctgaggggaaaagggcttcaggc

SEQ ID NO: 7602963 - DNA, 23 bp, Homo sapiens
ctgaggggaaaagggcttcaggc

SEQ ID NO: 7602964 - DNA, 23 bp, Homo sapiens
ctgaggggaaaagggcttcaggc

SEQ ID NO: 7602965 - DNA, 23 bp, Homo sapiens
ctgaggggaaaagggcttcaggc

SEQ ID NO: 7602966 - DNA, 22 bp, Homo sapiens
ctgcctctggttttggtccctg

SEQ ID NO: 7602967 - DNA, 22 bp, Homo sapiens
ctgcctctggttttggtccctg

SEQ ID NO: 7602968 - DNA, 22 bp, Homo sapiens
ctgcctctggttttggtccctg

SEQ ID NO: 7602969 - DNA, 22 bp, Homo sapiens
ctgcctctgttgggcatggtct

SEQ ID NO: 7602970 - DNA, 22 bp, Homo sapiens
ctgcctctgttgggcatggtct

SEQ ID NO: 7602971 - DNA, 22 bp, Homo sapiens
ctgcctctgttgggcatggtct

SEQ ID NO: 7602972 - DNA, 22 bp, Homo sapiens
ctgcctctggttttggtccctg

SEQ ID NO: 7602973 - DNA, 22 bp, Homo sapiens
ctgcctctggcctcaggcccag

SEQ ID NO: 7602974 - DNA, 22 bp, Homo sapiens
ctgcctctggcctcaggcccag

SEQ ID NO: 7602975 - DNA, 22 bp, Homo sapiens
ctgcctctggcctcaggcccag

SEQ ID NO: 7602976 - DNA, 22 bp, Homo sapiens
ctgcctctggcctcaggcccag

SEQ ID NO: 7602977 - DNA, 22 bp, Homo sapiens
ctgcctctggttttggtccctg

SEQ ID NO: 7602978 - DNA, 22 bp, Homo sapiens
ctgcctctggcctcaggcccag

SEQ ID NO: 7602979 - DNA, 22 bp, Homo sapiens
ctgccctgggccaggaagcggc

SEQ ID NO: 7602980 - DNA, 22 bp, Homo sapiens
ctgcctctataggagtccacca

SEQ ID NO: 7602981 - DNA, 22 bp, Homo sapiens
ctgccctgggatggtctgtgcg

SEQ ID NO: 7602982 - DNA, 22 bp, Homo sapiens
ctgccctgggatggtctgtgcg

SEQ ID NO: 7602983 - DNA, 22 bp, Homo sapiens
ctgccctgggccaggaagcggc

SEQ ID NO: 7602984 - DNA, 22 bp, Homo sapiens
ctgccctgggccaggaagcggc

SEQ ID NO: 7602985 - DNA, 22 bp, Homo sapiens
ctgcctctattcactgaggcag

SEQ ID NO: 7602986 - DNA, 22 bp, Homo sapiens
ctgcctctattcactgaggcag

SEQ ID NO: 7602987 - DNA, 22 bp, Homo sapiens
ctgcctctattcactgaggcag

SEQ ID NO: 7602988 - DNA, 22 bp, Homo sapiens
ctgcctctattcactgaggcag

SEQ ID NO: 7602989 - DNA, 22 bp, Homo sapiens
ctgcctctataggagtccacca

SEQ ID NO: 7602990 - DNA, 22 bp, Homo sapiens
ctgcctctattcactgaggcag

SEQ ID NO: 7602991 - DNA, 22 bp, Homo sapiens
ctgcctctattcactgaggcag

SEQ ID NO: 7602992 - DNA, 22 bp, Homo sapiens
ctgcctctattcactgaggcag

SEQ ID NO: 7602993 - DNA, 22 bp, Homo sapiens
ctgcctctattcactgaggcag

SEQ ID NO: 7602994 - DNA, 22 bp, Homo sapiens
ctgcctctattcactgaggcag

SEQ ID NO: 7602995 - DNA, 22 bp, Homo sapiens
ctgcctctattcactgaggcag

SEQ ID NO: 7602996 - DNA, 22 bp, Homo sapiens
ctgccctgcttgtttccagtgg

SEQ ID NO: 7602997 - DNA, 22 bp, Homo sapiens
ctgccctgcttgatgacagcga

SEQ ID NO: 7602998 - DNA, 22 bp, Homo sapiens
ctgccctgcttgatgacagcga

SEQ ID NO: 7602999 - DNA, 22 bp, Homo sapiens
ctgccctgcttgatgacagcga

SEQ ID NO: 7603000 - DNA, 22 bp, Homo sapiens
ctgccctgcttgatgacagcga

SEQ ID NO: 7603001 - DNA, 22 bp, Homo sapiens
ctgccctggcagcctaccatgg

SEQ ID NO: 7603002 - DNA, 22 bp, Homo sapiens
ctgccctggcagcctaccatgg

SEQ ID NO: 7603003 - DNA, 22 bp, Homo sapiens
ctgccctggcagcctaccatgg

SEQ ID NO: 7603004 - DNA, 22 bp, Homo sapiens
ctgccctgcttgtttccagtgg

SEQ ID NO: 7603005 - DNA, 22 bp, Homo sapiens
ctgccctgcttgtttccagtgg

SEQ ID NO: 7603006 - DNA, 22 bp, Homo sapiens
ctgccctgcttgtttccagtgg

SEQ ID NO: 7603007 - DNA, 22 bp, Homo sapiens
ctgccctggaaaacgtatctta

SEQ ID NO: 7603008 - DNA, 22 bp, Homo sapiens
ctgccctggaaaacgtatctta

SEQ ID NO: 7603009 - DNA, 22 bp, Homo sapiens
ctgccctggaaaacgtatctta

SEQ ID NO: 7603010 - DNA, 22 bp, Homo sapiens
ctgccctggccactgtgcccag

SEQ ID NO: 7603011 - DNA, 22 bp, Homo sapiens
ctgccctggcagcctaccatgg

SEQ ID NO: 7603012 - DNA, 22 bp, Homo sapiens
ctgccctggcagcctaccatgg

SEQ ID NO: 7603013 - DNA, 22 bp, Homo sapiens
ctgccctgggagtacctgtcct

SEQ ID NO: 7603014 - DNA, 22 bp, Homo sapiens
ctgccctgggagtacctgtcct

SEQ ID NO: 7603015 - DNA, 22 bp, Homo sapiens
ctgccctggccactgtgcccag

SEQ ID NO: 7603016 - DNA, 22 bp, Homo sapiens
ctgccctggccactgtgcccag

SEQ ID NO: 7603017 - DNA, 22 bp, Homo sapiens
ctgccctgggatggtctgtgcg

SEQ ID NO: 7603018 - DNA, 22 bp, Homo sapiens
ctgccctgggatggtctgtgcg

SEQ ID NO: 7603019 - DNA, 22 bp, Homo sapiens
ctgccctgggatggtctgtgcg

SEQ ID NO: 7603020 - DNA, 22 bp, Homo sapiens
ctgccctgggatggtctgtgcg

SEQ ID NO: 7603021 - DNA, 22 bp, Homo sapiens
ctgccctgggagtacctgtcct

SEQ ID NO: 7603022 - DNA, 22 bp, Homo sapiens
ctgccctgggagtacctgtcct

SEQ ID NO: 7603023 - DNA, 22 bp, Homo sapiens
ctgccctgggagtacctgtcct

SEQ ID NO: 7603024 - DNA, 22 bp, Homo sapiens
ctgccctgatatgatttagaac

SEQ ID NO: 7603025 - DNA, 22 bp, Homo sapiens
ctgccctgatatgatttagaac

SEQ ID NO: 7603026 - DNA, 22 bp, Homo sapiens
ctgccctgagtcatgccagatg

SEQ ID NO: 7603027 - DNA, 22 bp, Homo sapiens
ctgccctgagtcatgccagatg

SEQ ID NO: 7603028 - DNA, 22 bp, Homo sapiens
ctgccctgagtcatgccagatg

SEQ ID NO: 7603029 - DNA, 22 bp, Homo sapiens
ctgccctgagtcatgccagatg

SEQ ID NO: 7603030 - DNA, 22 bp, Homo sapiens
ctgccctgagtcatgccagatg

SEQ ID NO: 7603031 - DNA, 22 bp, Homo sapiens
ctgccctgagtcatgccagatg

SEQ ID NO: 7603032 - DNA, 22 bp, Homo sapiens
ctgccctgagggcctgtgtgtt

SEQ ID NO: 7603033 - DNA, 22 bp, Homo sapiens
ctgccctgcagctccacggact

SEQ ID NO: 7603034 - DNA, 22 bp, Homo sapiens
ctgccctgcagctccacggact

SEQ ID NO: 7603035 - DNA, 23 bp, Homo sapiens
ctgccctgatcttgatctattgt

SEQ ID NO: 7603036 - DNA, 23 bp, Homo sapiens
ctgccctgatcttgatctattgt

SEQ ID NO: 7603037 - DNA, 22 bp, Homo sapiens
ctgccctgcagctccacggact

SEQ ID NO: 7603038 - DNA, 22 bp, Homo sapiens
ctgccctgagggcctgtgtgtt

SEQ ID NO: 7603039 - DNA, 22 bp, Homo sapiens
ctgccctgagggcctgtgtgtt

SEQ ID NO: 7603040 - DNA, 22 bp, Homo sapiens
ctgccctgagggcctgtgtgtt

SEQ ID NO: 7603041 - DNA, 22 bp, Homo sapiens
ctgccctgagggcctgtgtgtt

SEQ ID NO: 7603042 - DNA, 18 bp, Homo sapiens
ctgccccttctctgagat

SEQ ID NO: 7603043 - DNA, 18 bp, Homo sapiens
ctgccccttctctgagat

SEQ ID NO: 7603044 - DNA, 22 bp, Homo sapiens
ctgccctgactgaccttttgaa

SEQ ID NO: 7603045 - DNA, 22 bp, Homo sapiens
ctgccctgagggcctgtgtgtt

SEQ ID NO: 7603046 - DNA, 18 bp, Homo sapiens
ctgccccttctctgagat

SEQ ID NO: 7603047 - DNA, 18 bp, Homo sapiens
ctgccccttctctgagat

SEQ ID NO: 7603048 - DNA, 22 bp, Homo sapiens
ctgcccctggtgatggacgcca

SEQ ID NO: 7603049 - DNA, 22 bp, Homo sapiens
ctgcccctggctggtgaagcag

SEQ ID NO: 7603050 - DNA, 22 bp, Homo sapiens
ctgcccctggctggtgaagcag

SEQ ID NO: 7603051 - DNA, 22 bp, Homo sapiens
ctgcccctggtgatggacgcca

SEQ ID NO: 7603052 - DNA, 22 bp, Homo sapiens
ctgcccctggtgatggacgcca

SEQ ID NO: 7603053 - DNA, 22 bp, Homo sapiens
ctgcccctggtgatggacgcca

SEQ ID NO: 7603054 - DNA, 20 bp, Homo sapiens
ctgccctgccctgggtcctg

SEQ ID NO: 7603055 - DNA, 20 bp, Homo sapiens
ctgccctgccctgggtcctg

SEQ ID NO: 7603056 - DNA, 20 bp, Homo sapiens
ctgccctgccctgggtcctg

SEQ ID NO: 7603057 - DNA, 22 bp, Homo sapiens
ctgccctgcctggccagtgtgg

SEQ ID NO: 7603058 - DNA, 22 bp, Homo sapiens
ctgccctgcctggccagtgtgg

SEQ ID NO: 7603059 - DNA, 22 bp, Homo sapiens
ctgccctgcctggccagtgtgg

SEQ ID NO: 7603060 - DNA, 22 bp, Homo sapiens
ctgccctgcccaggccttgggc

SEQ ID NO: 7603061 - DNA, 22 bp, Homo sapiens
ctgccctgcccaggccttgggc

SEQ ID NO: 7603062 - DNA, 22 bp, Homo sapiens
ctgccctgcccaggccttgggc

SEQ ID NO: 7603063 - DNA, 22 bp, Homo sapiens
ctgccctgcccaggccttgggc

SEQ ID NO: 7603064 - DNA, 22 bp, Homo sapiens
ctgccctgcccaggccttgggc

SEQ ID NO: 7603065 - DNA, 22 bp, Homo sapiens
ctgccctgcccaggccttgggc

SEQ ID NO: 7603066 - DNA, 22 bp, Homo sapiens
ctgccctgcccaggccttgggc

SEQ ID NO: 7603067 - DNA, 22 bp, Homo sapiens
ctgccctgcccaggccttgggc

SEQ ID NO: 7603068 - DNA, 22 bp, Homo sapiens
ctgccctgcccaggccttgggc

SEQ ID NO: 7603069 - DNA, 22 bp, Homo sapiens
ctgccctgctctccgggatctt

SEQ ID NO: 7603070 - DNA, 22 bp, Homo sapiens
ctgccctgctggagatcacagt

SEQ ID NO: 7603071 - DNA, 22 bp, Homo sapiens
ctgccctgctggagatcacagt

SEQ ID NO: 7603072 - DNA, 22 bp, Homo sapiens
ctgccctgctctccgggatctt

SEQ ID NO: 7603073 - DNA, 22 bp, Homo sapiens
ctgccctgcctggccagtgtgg

SEQ ID NO: 7603074 - DNA, 22 bp, Homo sapiens
ctgccctgctaatgagttccaa

SEQ ID NO: 7603075 - DNA, 22 bp, Homo sapiens
ctgccctgctaatgagttccaa

SEQ ID NO: 7603076 - DNA, 22 bp, Homo sapiens
ctgccctgctaatgagttccaa

SEQ ID NO: 7603077 - DNA, 22 bp, Homo sapiens
ctgccctgcttctgagggaagc

SEQ ID NO: 7603078 - DNA, 22 bp, Homo sapiens
ctgccctgcttctgagggaagc

SEQ ID NO: 7603079 - DNA, 22 bp, Homo sapiens
ctgccctgcttgatgacagcga

SEQ ID NO: 7603080 - DNA, 22 bp, Homo sapiens
ctgccctgcttgatgacagcga

SEQ ID NO: 7603081 - DNA, 22 bp, Homo sapiens
ctgccctgcttctgagggaagc

SEQ ID NO: 7603082 - DNA, 22 bp, Homo sapiens
ctgctgccggcgagcctccctt

SEQ ID NO: 7603083 - DNA, 22 bp, Homo sapiens
ctgctgcctagtccaagacgtg

SEQ ID NO: 7603084 - DNA, 22 bp, Homo sapiens
ctgctgccggcgagcctccctt

SEQ ID NO: 7603085 - DNA, 22 bp, Homo sapiens
ctgctgccggcgagcctccctt

SEQ ID NO: 7603086 - DNA, 22 bp, Homo sapiens
ctgctgccggcgagcctccctt

SEQ ID NO: 7603087 - DNA, 22 bp, Homo sapiens
ctgctgccggcgagcctccctt

SEQ ID NO: 7603088 - DNA, 22 bp, Homo sapiens
ctgctgccggcgagcctccctt

SEQ ID NO: 7603089 - DNA, 20 bp, Homo sapiens
ctgctgccctgtcagcctct

SEQ ID NO: 7603090 - DNA, 20 bp, Homo sapiens
ctgctgccctgtcagcctct

SEQ ID NO: 7603091 - DNA, 20 bp, Homo sapiens
ctgctgccctgtcagcctct

SEQ ID NO: 7603092 - DNA, 22 bp, Homo sapiens
ctgctgccctagacccagtcct

SEQ ID NO: 7603093 - DNA, 20 bp, Homo sapiens
ctgctgccctgtcagcctct

SEQ ID NO: 7603094 - DNA, 20 bp, Homo sapiens
ctgctgccctgtcagcctct

SEQ ID NO: 7603095 - DNA, 19 bp, Homo sapiens
ctgctgccggagactcgtc

SEQ ID NO: 7603096 - DNA, 19 bp, Homo sapiens
ctgctgccggagactcgtc

SEQ ID NO: 7603097 - DNA, 22 bp, Homo sapiens
ctgctgagccgcacccaggagc

SEQ ID NO: 7603098 - DNA, 22 bp, Homo sapiens
ctgctgagcctggtgcgggatg

SEQ ID NO: 7603099 - DNA, 22 bp, Homo sapiens
ctgctgagccctggcacaggtg

SEQ ID NO: 7603100 - DNA, 22 bp, Homo sapiens
ctgctgagccctggcacaggtg

SEQ ID NO: 7603101 - DNA, 22 bp, Homo sapiens
ctgctgccctagacccagtcct

SEQ ID NO: 7603102 - DNA, 22 bp, Homo sapiens
ctgctgccctagacccagtcct

SEQ ID NO: 7603103 - DNA, 22 bp, Homo sapiens
ctgctgcccctgagctcagcct

SEQ ID NO: 7603104 - DNA, 22 bp, Homo sapiens
ctgctgccctagacccagtcct

SEQ ID NO: 7603105 - DNA, 20 bp, Homo sapiens
ctgctgccctgtcagcctct

SEQ ID NO: 7603106 - DNA, 22 bp, Homo sapiens
ctgctgcccctgagctcagcct

SEQ ID NO: 7603107 - DNA, 22 bp, Homo sapiens
ctgctgcccctgagctcagcct

SEQ ID NO: 7603108 - DNA, 22 bp, Homo sapiens
ctgctgcccctgagctcagcct

SEQ ID NO: 7603109 - DNA, 22 bp, Homo sapiens
ctgctgcccctgagctcagcct

SEQ ID NO: 7603110 - DNA, 22 bp, Homo sapiens
ctgctgcccctgagctcagcct

SEQ ID NO: 7603111 - DNA, 22 bp, Homo sapiens
ctgctctccccaggccagtctg

SEQ ID NO: 7603112 - DNA, 22 bp, Homo sapiens
ctgctctccccaggccagtctg

SEQ ID NO: 7603113 - DNA, 22 bp, Homo sapiens
ctgctctaggttcctgcatatg

SEQ ID NO: 7603114 - DNA, 22 bp, Homo sapiens
ctgctctaatatcagatagact

SEQ ID NO: 7603115 - DNA, 22 bp, Homo sapiens
ctgctcggcgcgcatggctgcc

SEQ ID NO: 7603116 - DNA, 22 bp, Homo sapiens
ctgctcggcgcgcatggctgcc

SEQ ID NO: 7603117 - DNA, 22 bp, Homo sapiens
ctgctcctgtgggccagtggcc

SEQ ID NO: 7603118 - DNA, 22 bp, Homo sapiens
ctgctcctgtgggccagtggcc

SEQ ID NO: 7603119 - DNA, 22 bp, Homo sapiens
ctgctcctgtgggccagtggcc

SEQ ID NO: 7603120 - DNA, 22 bp, Homo sapiens
ctgctcctgtgggccagtggcc

SEQ ID NO: 7603121 - DNA, 22 bp, Homo sapiens
ctgctcctgtgggccagtggcc

SEQ ID NO: 7603122 - DNA, 22 bp, Homo sapiens
ctgctcctgtgggccagtggcc

SEQ ID NO: 7603123 - DNA, 22 bp, Homo sapiens
ctgctctgaagccaggattctg

SEQ ID NO: 7603124 - DNA, 22 bp, Homo sapiens
ctgctgagcatttgcagggaca

SEQ ID NO: 7603125 - DNA, 22 bp, Homo sapiens
ctgctgagcatttgcagggaca

SEQ ID NO: 7603126 - DNA, 22 bp, Homo sapiens
ctgctgagcatttgcagggaca

SEQ ID NO: 7603127 - DNA, 21 bp, Homo sapiens
ctgctctgacagtgaggccag

SEQ ID NO: 7603128 - DNA, 21 bp, Homo sapiens
ctgctctgacagtgaggccag

SEQ ID NO: 7603129 - DNA, 21 bp, Homo sapiens
ctgctctgacagtgaggccag

SEQ ID NO: 7603130 - DNA, 22 bp, Homo sapiens
ctgctctgaagccaggattctg

SEQ ID NO: 7603131 - DNA, 22 bp, Homo sapiens
ctgctctgaagccaggattctg

SEQ ID NO: 7603132 - DNA, 22 bp, Homo sapiens
ctgctctgaagccaggattctg

SEQ ID NO: 7603133 - DNA, 22 bp, Homo sapiens
ctgctctgaagccaggattctg

SEQ ID NO: 7603134 - DNA, 22 bp, Homo sapiens
ctgctctgaagccaggattctg

SEQ ID NO: 7603135 - DNA, 19 bp, Homo sapiens
ctgctctccttgacttgga

SEQ ID NO: 7603136 - DNA, 19 bp, Homo sapiens
ctgctctccttgacttgga

SEQ ID NO: 7603137 - DNA, 22 bp, Homo sapiens
ctgctctctttcagagacaggt

SEQ ID NO: 7603138 - DNA, 22 bp, Homo sapiens
ctgctctctgttcccctggatc

SEQ ID NO: 7603139 - DNA, 22 bp, Homo sapiens
ctgctggcctagcccatcctct

SEQ ID NO: 7603140 - DNA, 22 bp, Homo sapiens
ctgctggcctagcccatcctct

SEQ ID NO: 7603141 - DNA, 22 bp, Homo sapiens
ctgctggcctagcccatcctct

SEQ ID NO: 7603142 - DNA, 22 bp, Homo sapiens
ctgctggcccccatttcagggt

SEQ ID NO: 7603143 - DNA, 22 bp, Homo sapiens
ctgctggcccccatttcagggt

SEQ ID NO: 7603144 - DNA, 22 bp, Homo sapiens
ctgctggcaccgatgaaagaca

SEQ ID NO: 7603145 - DNA, 17 bp, Homo sapiens
ctgctggctggggcttg

SEQ ID NO: 7603146 - DNA, 17 bp, Homo sapiens
ctgctggctggggcttg

SEQ ID NO: 7603147 - DNA, 17 bp, Homo sapiens
ctgctggctggggcttg

SEQ ID NO: 7603148 - DNA, 17 bp, Homo sapiens
ctgctggctggggcttg

SEQ ID NO: 7603149 - DNA, 22 bp, Homo sapiens
ctgctggcctcggccatgcctg

SEQ ID NO: 7603150 - DNA, 22 bp, Homo sapiens
ctgctggcctcggccatgcctg

SEQ ID NO: 7603151 - DNA, 22 bp, Homo sapiens
ctgctggcctcggccatgcctg

SEQ ID NO: 7603152 - DNA, 22 bp, Homo sapiens
ctgctggcctcggccatgcctg

SEQ ID NO: 7603153 - DNA, 17 bp, Homo sapiens
ctgctggctggggcttg

SEQ ID NO: 7603154 - DNA, 22 bp, Homo sapiens
ctgctgggaaggtctgctcagt

SEQ ID NO: 7603155 - DNA, 22 bp, Homo sapiens
ctgctggcttctagtcattcaa

SEQ ID NO: 7603156 - DNA, 22 bp, Homo sapiens
ctgctgtgagtttggaggtcta

SEQ ID NO: 7603157 - DNA, 22 bp, Homo sapiens
ctgctggaagtttgctgtggat

SEQ ID NO: 7603158 - DNA, 22 bp, Homo sapiens
ctgctggaagtttgctgtggat

SEQ ID NO: 7603159 - DNA, 22 bp, Homo sapiens
ctgctggaagtttgctgtggat

SEQ ID NO: 7603160 - DNA, 22 bp, Homo sapiens
ctgctggagggagctgatagtg

SEQ ID NO: 7603161 - DNA, 22 bp, Homo sapiens
ctgctggactacaggaagagtt

SEQ ID NO: 7603162 - DNA, 22 bp, Homo sapiens
ctgctggcaagcccagttggag

SEQ ID NO: 7603163 - DNA, 22 bp, Homo sapiens
ctgctggcaagcccagttggag

SEQ ID NO: 7603164 - DNA, 22 bp, Homo sapiens
ctgctggcaagcccagttggag

SEQ ID NO: 7603165 - DNA, 22 bp, Homo sapiens
ctgctggcaagcccagttggag

SEQ ID NO: 7603166 - DNA, 22 bp, Homo sapiens
ctgctggcaagcccagttggag

SEQ ID NO: 7603167 - DNA, 22 bp, Homo sapiens
ctgctggcaagcccagttggag

SEQ ID NO: 7603168 - DNA, 22 bp, Homo sapiens
ctgctggcaagcccagttggag

SEQ ID NO: 7603169 - DNA, 22 bp, Homo sapiens
ctgctggcaccgatgaaagaca

SEQ ID NO: 7603170 - DNA, 22 bp, Homo sapiens
ctgctggcaccgatgaaagaca

SEQ ID NO: 7603171 - DNA, 22 bp, Homo sapiens
ctgctggaggttggagcatgca

SEQ ID NO: 7603172 - DNA, 22 bp, Homo sapiens
ctgctggaggttggagcatgca

SEQ ID NO: 7603173 - DNA, 22 bp, Homo sapiens
ctgctggagggagctgatagtg

SEQ ID NO: 7603174 - DNA, 22 bp, Homo sapiens
ctgctggaggttggagcatgca

SEQ ID NO: 7603175 - DNA, 22 bp, Homo sapiens
ctgctggaggttggagcatgca

SEQ ID NO: 7603176 - DNA, 22 bp, Homo sapiens
ctgctgccttccaaaggccagg

SEQ ID NO: 7603177 - DNA, 22 bp, Homo sapiens
ctgctgctcagtgtcatcatgt

SEQ ID NO: 7603178 - DNA, 22 bp, Homo sapiens
ctgctgctcgaccagtcccagg

SEQ ID NO: 7603179 - DNA, 22 bp, Homo sapiens
ctgctgctcagtgtcatcatgt

SEQ ID NO: 7603180 - DNA, 22 bp, Homo sapiens
ctgctgctcgaccagtcccagg

SEQ ID NO: 7603181 - DNA, 22 bp, Homo sapiens
ctgctgctgagaatgcctcagg

SEQ ID NO: 7603182 - DNA, 22 bp, Homo sapiens
ctgctgctgactcatcccagct

SEQ ID NO: 7603183 - DNA, 22 bp, Homo sapiens
ctgctgctcttgtgcattagtg

SEQ ID NO: 7603184 - DNA, 22 bp, Homo sapiens
ctgctgctgactcatcccagct

SEQ ID NO: 7603185 - DNA, 22 bp, Homo sapiens
ctgctgctgactcatcccagct

SEQ ID NO: 7603186 - DNA, 22 bp, Homo sapiens
ctgctgcctcgacattgggaca

SEQ ID NO: 7603187 - DNA, 22 bp, Homo sapiens
ctgctgcctcgacattgggaca

SEQ ID NO: 7603188 - DNA, 22 bp, Homo sapiens
ctgctgcctgacaatttaggtt

SEQ ID NO: 7603189 - DNA, 22 bp, Homo sapiens
ctgctgcctcgacattgggaca

SEQ ID NO: 7603190 - DNA, 22 bp, Homo sapiens
ctgctgcctgattgcagacctc

SEQ ID NO: 7603191 - DNA, 22 bp, Homo sapiens
ctgctgcctgattgcagacctc

SEQ ID NO: 7603192 - DNA, 22 bp, Homo sapiens
ctgctgccttccaaaggccagg

SEQ ID NO: 7603193 - DNA, 22 bp, Homo sapiens
ctgctgcctgattgcagacctc

SEQ ID NO: 7603194 - DNA, 22 bp, Homo sapiens
ctgctgcctgattgcagacctc

SEQ ID NO: 7603195 - DNA, 22 bp, Homo sapiens
ctgctgctgagaatgcctcagg

SEQ ID NO: 7603196 - DNA, 22 bp, Homo sapiens
ctgctgctgagaatgcctcagg

SEQ ID NO: 7603197 - DNA, 22 bp, Homo sapiens
ctgctgctgagagctcagcctg

SEQ ID NO: 7603198 - DNA, 22 bp, Homo sapiens
ctgctgctgagagctcagcctg

SEQ ID NO: 7603199 - DNA, 22 bp, Homo sapiens
ctgctgctgagagctcagcctg

SEQ ID NO: 7603200 - DNA, 22 bp, Homo sapiens
ctgctgctgagagctcagcctg

SEQ ID NO: 7603201 - DNA, 22 bp, Homo sapiens
ctgctgctgctatctacccagg

SEQ ID NO: 7603202 - DNA, 22 bp, Homo sapiens
ctgctgctgctatctacccagg

SEQ ID NO: 7603203 - DNA, 22 bp, Homo sapiens
ctgctgctgagagctcagcctg

SEQ ID NO: 7603204 - DNA, 22 bp, Homo sapiens
ctgctgctgtaaggcagaatta

SEQ ID NO: 7603205 - DNA, 22 bp, Homo sapiens
ctgctgctgtaaggcagaatta

SEQ ID NO: 7603206 - DNA, 22 bp, Homo sapiens
ctgctgctgtaaggcagaatta

SEQ ID NO: 7603207 - DNA, 22 bp, Homo sapiens
ctgctgcttagcatagcagagg

SEQ ID NO: 7603208 - DNA, 21 bp, Homo sapiens
ctgctgctggggtctgggcag

SEQ ID NO: 7603209 - DNA, 21 bp, Homo sapiens
ctgctgctggggtctgggcag

SEQ ID NO: 7603210 - DNA, 21 bp, Homo sapiens
ctgctgctggggtctgggcag

SEQ ID NO: 7603211 - DNA, 21 bp, Homo sapiens
ctgctgctggggtctgggcag

SEQ ID NO: 7603212 - DNA, 22 bp, Homo sapiens
ctgctgcttttgcgggagaaca

SEQ ID NO: 7603213 - DNA, 22 bp, Homo sapiens
ctgctgcttttgcgggagaaca

SEQ ID NO: 7603214 - DNA, 22 bp, Homo sapiens
ctgctgcttttgcgggagaaca

SEQ ID NO: 7603215 - DNA, 22 bp, Homo sapiens
ctgctgcttagcatagcagagg

SEQ ID NO: 7603216 - DNA, 22 bp, Homo sapiens
ctgctgcttagcatagcagagg

SEQ ID NO: 7603217 - DNA, 22 bp, Homo sapiens
ctgctgcttagcatagcagagg

SEQ ID NO: 7603218 - DNA, 22 bp, Homo sapiens
ctgctcctccccatcaggcagc

SEQ ID NO: 7603219 - DNA, 22 bp, Homo sapiens
ctgctcctccccatcaggcagc

SEQ ID NO: 7603220 - DNA, 22 bp, Homo sapiens
ctgctcctccccatcaggcagc

SEQ ID NO: 7603221 - DNA, 22 bp, Homo sapiens
ctgctcctccccatcaggcagc

SEQ ID NO: 7603222 - DNA, 22 bp, Homo sapiens
ctgctcctccccatcaggcagc

SEQ ID NO: 7603223 - DNA, 19 bp, Homo sapiens
ctgctccctccttctggca

SEQ ID NO: 7603224 - DNA, 19 bp, Homo sapiens
ctgctccctccttctggca

SEQ ID NO: 7603225 - DNA, 22 bp, Homo sapiens
ctgctccccagcctgcgccttt

SEQ ID NO: 7603226 - DNA, 19 bp, Homo sapiens
ctgctccctccttctggca

SEQ ID NO: 7603227 - DNA, 18 bp, Homo sapiens
ctgctccagtctggccag

SEQ ID NO: 7603228 - DNA, 22 bp, Homo sapiens
ctgctccagtagccccatgtgg

SEQ ID NO: 7603229 - DNA, 22 bp, Homo sapiens
ctgctccagtagccccatgtgg

SEQ ID NO: 7603230 - DNA, 22 bp, Homo sapiens
ctgctccccagcctgcgccttt

SEQ ID NO: 7603231 - DNA, 18 bp, Homo sapiens
ctgctccagtctggccag

SEQ ID NO: 7603232 - DNA, 22 bp, Homo sapiens
ctgctccccagcctgcgccttt

SEQ ID NO: 7603233 - DNA, 22 bp, Homo sapiens
ctgctccccagcctgcgccttt

SEQ ID NO: 7603234 - DNA, 22 bp, Homo sapiens
ctgctcctgtccagcagggcca

SEQ ID NO: 7603235 - DNA, 22 bp, Homo sapiens
ctgctcctgtccagcagggcca

SEQ ID NO: 7603236 - DNA, 22 bp, Homo sapiens
ctgctcctgtccagcagggcca

SEQ ID NO: 7603237 - DNA, 22 bp, Homo sapiens
ctgctcctgtccagcagggcca

SEQ ID NO: 7603238 - DNA, 22 bp, Homo sapiens
ctgctcctgtccagcagggcca

SEQ ID NO: 7603239 - DNA, 22 bp, Homo sapiens
ctgctcctgtccagcagggcca

SEQ ID NO: 7603240 - DNA, 22 bp, Homo sapiens
ctgctcctggtcatcctccact

SEQ ID NO: 7603241 - DNA, 22 bp, Homo sapiens
ctgctcctggtcatcctccact

SEQ ID NO: 7603242 - DNA, 22 bp, Homo sapiens
ctgctcctggtcatcctccact

SEQ ID NO: 7603243 - DNA, 22 bp, Homo sapiens
ctgctcctggtcatcctccact

SEQ ID NO: 7603244 - DNA, 22 bp, Homo sapiens
ctgctcctggtcatcctccact

SEQ ID NO: 7603245 - DNA, 22 bp, Homo sapiens
ctgctcctggtcatcctccact

SEQ ID NO: 7603246 - DNA, 22 bp, Homo sapiens
ctgctcctggtcatcctccact

SEQ ID NO: 7603247 - DNA, 22 bp, Homo sapiens
ctgctcctccccatcaggcagc

SEQ ID NO: 7603248 - DNA, 22 bp, Homo sapiens
ctgctcctccccatcaggcagc

SEQ ID NO: 7603249 - DNA, 22 bp, Homo sapiens
ctgctcctctgaggtagccaca

SEQ ID NO: 7603250 - DNA, 22 bp, Homo sapiens
ctgctcctccccatcaggcagc

SEQ ID NO: 7603251 - DNA, 22 bp, Homo sapiens
ctgctcctctgaggtagccaca

SEQ ID NO: 7603252 - DNA, 22 bp, Homo sapiens
ctgctcctctgaggtagccaca

SEQ ID NO: 7603253 - DNA, 19 bp, Homo sapiens
ctgctccaggagctgggga

SEQ ID NO: 7603254 - DNA, 23 bp, Homo sapiens
ctgctccaggacagcatggaggt

SEQ ID NO: 7603255 - DNA, 19 bp, Homo sapiens
ctgctccaggagctgggga

SEQ ID NO: 7603256 - DNA, 19 bp, Homo sapiens
ctgctccaggagctgggga

SEQ ID NO: 7603257 - DNA, 22 bp, Homo sapiens
ctgctccaggatttcaggccag

SEQ ID NO: 7603258 - DNA, 22 bp, Homo sapiens
ctgctccaggatttcaggccag

SEQ ID NO: 7603259 - DNA, 19 bp, Homo sapiens
ctgctccaggagctgggga

SEQ ID NO: 7603260 - DNA, 19 bp, Homo sapiens
ctgctccaggagctgggga

SEQ ID NO: 7603261 - DNA, 19 bp, Homo sapiens
ctgctccaggagctgggga

SEQ ID NO: 7603262 - DNA, 23 bp, Homo sapiens
ctgctccaggacagcatggaggt

SEQ ID NO: 7603263 - DNA, 23 bp, Homo sapiens
ctgctccaggacagcatggaggt

SEQ ID NO: 7603264 - DNA, 23 bp, Homo sapiens
ctgctccaggacagcatggaggt

SEQ ID NO: 7603265 - DNA, 22 bp, Homo sapiens
ctgctccaggaacagagctgct

SEQ ID NO: 7603266 - DNA, 23 bp, Homo sapiens
ctgctccaggacagcatggaggt

SEQ ID NO: 7603267 - DNA, 23 bp, Homo sapiens
ctgctccaggacagcatggaggt

SEQ ID NO: 7603268 - DNA, 22 bp, Homo sapiens
ctgctccagacacctgcagggg

SEQ ID NO: 7603269 - DNA, 22 bp, Homo sapiens
ctgctccagacacctgcagggg

SEQ ID NO: 7603270 - DNA, 22 bp, Homo sapiens
ctgctccagacacctgcagggg

SEQ ID NO: 7603271 - DNA, 22 bp, Homo sapiens
ctgctccagacacctgcagggg

SEQ ID NO: 7603272 - DNA, 22 bp, Homo sapiens
ctgctccagacacctgcagggg

SEQ ID NO: 7603273 - DNA, 22 bp, Homo sapiens
ctgctccaggaacagagctgct

SEQ ID NO: 7603274 - DNA, 22 bp, Homo sapiens
ctgctccaggaacagagctgct

SEQ ID NO: 7603275 - DNA, 22 bp, Homo sapiens
ctgctccaggaacagagctgct

SEQ ID NO: 7603276 - DNA, 22 bp, Homo sapiens
ctgctccaggaacagagctgct

SEQ ID NO: 7603277 - DNA, 22 bp, Homo sapiens
ctgctccaggaacagagctgct

SEQ ID NO: 7603278 - DNA, 22 bp, Homo sapiens
ctgctccacctccgggtcaggc

SEQ ID NO: 7603279 - DNA, 22 bp, Homo sapiens
ctgctccacctccgggtcaggc

SEQ ID NO: 7603280 - DNA, 22 bp, Homo sapiens
ctgctccacctccgggtcaggc

SEQ ID NO: 7603281 - DNA, 20 bp, Homo sapiens
ctgctccacccggctctcag

SEQ ID NO: 7603282 - DNA, 20 bp, Homo sapiens
ctgctccacccggctctcag

SEQ ID NO: 7603283 - DNA, 20 bp, Homo sapiens
ctgctccacccggctctcag

SEQ ID NO: 7603284 - DNA, 22 bp, Homo sapiens
ctgctccacaccgtccatactc

SEQ ID NO: 7603285 - DNA, 22 bp, Homo sapiens
ctgctccaagccagccctgcag

SEQ ID NO: 7603286 - DNA, 22 bp, Homo sapiens
ctgcgtgtctctgtctcatggc

SEQ ID NO: 7603287 - DNA, 22 bp, Homo sapiens
ctgcgtgttcctgaagcgcgct

SEQ ID NO: 7603288 - DNA, 22 bp, Homo sapiens
ctgcgtgtttgcaccctgtctg

SEQ ID NO: 7603289 - DNA, 22 bp, Homo sapiens
ctgcgtgtttgcaccctgtctg

SEQ ID NO: 7603290 - DNA, 22 bp, Homo sapiens
ctgcctcttgacagatcgtggc

SEQ ID NO: 7603291 - DNA, 22 bp, Homo sapiens
ctgcctcttaagtggatggagt

SEQ ID NO: 7603292 - DNA, 22 bp, Homo sapiens
ctgcctcttgacagatcgtggc

SEQ ID NO: 7603293 - DNA, 22 bp, Homo sapiens
ctgcctcttgacagatcgtggc

SEQ ID NO: 7603294 - DNA, 22 bp, Homo sapiens
ctgcctcttgacagatcgtggc

SEQ ID NO: 7603295 - DNA, 22 bp, Homo sapiens
ctgcctgaactgggtgagcaag

SEQ ID NO: 7603296 - DNA, 22 bp, Homo sapiens
ctgcctctgttgggcatggtct

SEQ ID NO: 7603297 - DNA, 22 bp, Homo sapiens
ctgcctctgttgggcatggtct

SEQ ID NO: 7603298 - DNA, 22 bp, Homo sapiens
ctgcctctgttgggcatggtct

SEQ ID NO: 7603299 - DNA, 22 bp, Homo sapiens
ctgcctcttaagtggatggagt

SEQ ID NO: 7603300 - DNA, 22 bp, Homo sapiens
ctgcctctgttgggcatggtct

SEQ ID NO: 7603301 - DNA, 22 bp, Homo sapiens
ctgcctctgttgggcatggtct

SEQ ID NO: 7603302 - DNA, 22 bp, Homo sapiens
ctgcctgcactgcctggctcca

SEQ ID NO: 7603303 - DNA, 22 bp, Homo sapiens
ctgcctgcactgcctggctcca

SEQ ID NO: 7603304 - DNA, 22 bp, Homo sapiens
ctgcctgcactgcctggctcca

SEQ ID NO: 7603305 - DNA, 22 bp, Homo sapiens
ctgcctgcactgcctggctcca

SEQ ID NO: 7603306 - DNA, 22 bp, Homo sapiens
ctgcctgcactgcctggctcca

SEQ ID NO: 7603307 - DNA, 22 bp, Homo sapiens
ctgcctgcactgcctggctcca

SEQ ID NO: 7603308 - DNA, 22 bp, Homo sapiens
ctgcctgagtggaggtcgaggg

SEQ ID NO: 7603309 - DNA, 22 bp, Homo sapiens
ctgcctgagtggaggtcgaggg

SEQ ID NO: 7603310 - DNA, 22 bp, Homo sapiens
ctgcctgagtacaagtcccaga

SEQ ID NO: 7603311 - DNA, 22 bp, Homo sapiens
ctgcctgcatcccacagtgggg

SEQ ID NO: 7603312 - DNA, 22 bp, Homo sapiens
ctgcctgcatcccacagtgggg

SEQ ID NO: 7603313 - DNA, 22 bp, Homo sapiens
ctgcctgcactgcctggctcca

SEQ ID NO: 7603314 - DNA, 22 bp, Homo sapiens
ctgcctgcaggacacctcgcta

SEQ ID NO: 7603315 - DNA, 22 bp, Homo sapiens
ctgcctgcaggacacctcgcta

SEQ ID NO: 7603316 - DNA, 22 bp, Homo sapiens
ctgcctgcactgcctggctcca

SEQ ID NO: 7603317 - DNA, 22 bp, Homo sapiens
ctgcctgcactgcctggctcca

SEQ ID NO: 7603318 - DNA, 22 bp, Homo sapiens
ctgcctgcactgcctggctcca

SEQ ID NO: 7603319 - DNA, 22 bp, Homo sapiens
ctgcctgcactgcctggctcca

SEQ ID NO: 7603320 - DNA, 22 bp, Homo sapiens
ctgcctgcaggacacctcgcta

SEQ ID NO: 7603321 - DNA, 22 bp, Homo sapiens
ctgcctgccacgttcagctgta

SEQ ID NO: 7603322 - DNA, 22 bp, Homo sapiens
ctgcctgccacgttcagctgta

SEQ ID NO: 7603323 - DNA, 22 bp, Homo sapiens
ctgcctgcatgctgccatagct

SEQ ID NO: 7603324 - DNA, 22 bp, Homo sapiens
ctgcctgcatgctgccatagct

SEQ ID NO: 7603325 - DNA, 22 bp, Homo sapiens
ctgcctgcatgctgccatagct

SEQ ID NO: 7603326 - DNA, 22 bp, Homo sapiens
ctgcctgcatcccacagtgggg

SEQ ID NO: 7603327 - DNA, 22 bp, Homo sapiens
ctgcctgcatgctgccatagct

SEQ ID NO: 7603328 - DNA, 22 bp, Homo sapiens
ctgcctgcatcccacagtgggg

SEQ ID NO: 7603329 - DNA, 22 bp, Homo sapiens
ctgcctgcctggagacagatgg

SEQ ID NO: 7603330 - DNA, 22 bp, Homo sapiens
ctgcctgcctggagacagatgg

SEQ ID NO: 7603331 - DNA, 22 bp, Homo sapiens
ctgcctgccttggcctccagga

SEQ ID NO: 7603332 - DNA, 22 bp, Homo sapiens
ctgcctgccttggcctccagga

SEQ ID NO: 7603333 - DNA, 22 bp, Homo sapiens
ctgcctgccttggcctccagga

SEQ ID NO: 7603334 - DNA, 22 bp, Homo sapiens
ctgcctgccttggcctccagga

SEQ ID NO: 7603335 - DNA, 22 bp, Homo sapiens
ctgcctgccttggcctccagga

SEQ ID NO: 7603336 - DNA, 22 bp, Homo sapiens
ctgcctgccttggcctccagga

SEQ ID NO: 7603337 - DNA, 22 bp, Homo sapiens
ctgcctgccacgttcagctgta

SEQ ID NO: 7603338 - DNA, 22 bp, Homo sapiens
ctgcctgccacgttcagctgta

SEQ ID NO: 7603339 - DNA, 22 bp, Homo sapiens
ctgcctgcctggagacagatgg

SEQ ID NO: 7603340 - DNA, 22 bp, Homo sapiens
ctgcctgcctggagacagatgg

SEQ ID NO: 7603341 - DNA, 22 bp, Homo sapiens
ctgcggtgggctgggctgtccc

SEQ ID NO: 7603342 - DNA, 22 bp, Homo sapiens
ctgcggtgggctgggctgtccc

SEQ ID NO: 7603343 - DNA, 22 bp, Homo sapiens
ctgcggtgggctgggctgtccc

SEQ ID NO: 7603344 - DNA, 22 bp, Homo sapiens
ctgcgtgagcgtgcccgtcttg

SEQ ID NO: 7603345 - DNA, 22 bp, Homo sapiens
ctgcgtgcatgtctgcgtgcat

SEQ ID NO: 7603346 - DNA, 22 bp, Homo sapiens
ctgcgtgcattaatatttcctt

SEQ ID NO: 7603347 - DNA, 22 bp, Homo sapiens
ctgcgtgtctccttggggcaga

SEQ ID NO: 7603348 - DNA, 22 bp, Homo sapiens
ctgcgtgtctccttggggcaga

SEQ ID NO: 7603349 - DNA, 22 bp, Homo sapiens
ctgcgtgagcgtgcccgtcttg

SEQ ID NO: 7603350 - DNA, 22 bp, Homo sapiens
ctgcgtgtctctgtctcatggc

SEQ ID NO: 7603351 - DNA, 22 bp, Homo sapiens
ctgcctgccttggcctccagga

SEQ ID NO: 7603352 - DNA, 22 bp, Homo sapiens
ctgcctgccttggcctccagga

SEQ ID NO: 7603353 - DNA, 22 bp, Homo sapiens
ctgcctgccttggcctccagga

SEQ ID NO: 7603354 - DNA, 22 bp, Homo sapiens
ctgcctgccttggcctccagga

SEQ ID NO: 7603355 - DNA, 22 bp, Homo sapiens
ctgcgggctgtcaggcgtgcca

SEQ ID NO: 7603356 - DNA, 22 bp, Homo sapiens
ctgcctgcgccaccaccacgtc

SEQ ID NO: 7603357 - DNA, 22 bp, Homo sapiens
ctgcctgcgccaccaccacgtc

SEQ ID NO: 7603358 - DNA, 22 bp, Homo sapiens
ctgcctgcgccaccaccacgtc

SEQ ID NO: 7603359 - DNA, 22 bp, Homo sapiens
ctccctggaggtgagctggcac

SEQ ID NO: 7603360 - DNA, 22 bp, Homo sapiens
ctccctggaggtgagctggcac

SEQ ID NO: 7603361 - DNA, 22 bp, Homo sapiens
ctccctggaggtgagctggcac

SEQ ID NO: 7603362 - DNA, 22 bp, Homo sapiens
ctccctggaggtgagctggcac

SEQ ID NO: 7603363 - DNA, 22 bp, Homo sapiens
ctccctggaggcccagacctgg

SEQ ID NO: 7603364 - DNA, 22 bp, Homo sapiens
ctccctggaggcccagacctgg

SEQ ID NO: 7603365 - DNA, 22 bp, Homo sapiens
ctccctggaggcccagacctgg

SEQ ID NO: 7603366 - DNA, 22 bp, Homo sapiens
ctccctggaggcccagacctgg

SEQ ID NO: 7603367 - DNA, 22 bp, Homo sapiens
ctccctggaggcccagacctgg

SEQ ID NO: 7603368 - DNA, 22 bp, Homo sapiens
ctccctggaggcccagacctgg

SEQ ID NO: 7603369 - DNA, 22 bp, Homo sapiens
ctccctggaggcccagacctgg

SEQ ID NO: 7603370 - DNA, 22 bp, Homo sapiens
ctccctgcttgtttcccttcag

SEQ ID NO: 7603371 - DNA, 22 bp, Homo sapiens
ctccctgcttgtttcccttcag

SEQ ID NO: 7603372 - DNA, 22 bp, Homo sapiens
ctccctgcttgtttcccttcag

SEQ ID NO: 7603373 - DNA, 22 bp, Homo sapiens
ctccctgcttgtttcccttcag

SEQ ID NO: 7603374 - DNA, 22 bp, Homo sapiens
ctccctcacacccttgcccaga

SEQ ID NO: 7603375 - DNA, 22 bp, Homo sapiens
ctccctcacacccttgcccaga

SEQ ID NO: 7603376 - DNA, 22 bp, Homo sapiens
ctccctcacacccttgcccaga

SEQ ID NO: 7603377 - DNA, 22 bp, Homo sapiens
ctccctcacacccttgcccaga

SEQ ID NO: 7603378 - DNA, 22 bp, Homo sapiens
ctccctctgtcttgtccagaaa

SEQ ID NO: 7603379 - DNA, 22 bp, Homo sapiens
ctccctctgtcttgtccagaaa

SEQ ID NO: 7603380 - DNA, 22 bp, Homo sapiens
ctccctcacacccttgcccaga

SEQ ID NO: 7603381 - DNA, 22 bp, Homo sapiens
ctccctctgtcttgtccagaaa

SEQ ID NO: 7603382 - DNA, 22 bp, Homo sapiens
ctccctcacacccttgcccaga

SEQ ID NO: 7603383 - DNA, 22 bp, Homo sapiens
ctccctctgtcttgtccagaaa

SEQ ID NO: 7603384 - DNA, 22 bp, Homo sapiens
ctccctctgtcttgtccagaaa

SEQ ID NO: 7603385 - DNA, 22 bp, Homo sapiens
ctccctctgtcttgtccagaaa

SEQ ID NO: 7603386 - DNA, 22 bp, Homo sapiens
ctccctctgtcttgtccagaaa

SEQ ID NO: 7603387 - DNA, 22 bp, Homo sapiens
ctccctctgtcttgtccagaaa

SEQ ID NO: 7603388 - DNA, 22 bp, Homo sapiens
ctccctgaaattcagatgcctc

SEQ ID NO: 7603389 - DNA, 22 bp, Homo sapiens
ctccctgccctgtgagttggcc

SEQ ID NO: 7603390 - DNA, 22 bp, Homo sapiens
ctccctgccctgtgagttggcc

SEQ ID NO: 7603391 - DNA, 22 bp, Homo sapiens
ctccctgaggacaggccctgtc

SEQ ID NO: 7603392 - DNA, 22 bp, Homo sapiens
ctccctgacctggattccaggc

SEQ ID NO: 7603393 - DNA, 22 bp, Homo sapiens
ctccctgacctggattccaggc

SEQ ID NO: 7603394 - DNA, 22 bp, Homo sapiens
ctccctgaggacaggccctgtc

SEQ ID NO: 7603395 - DNA, 22 bp, Homo sapiens
ctccctgacctggattccaggc

SEQ ID NO: 7603396 - DNA, 22 bp, Homo sapiens
ctccctgaaattcagatgcctc

SEQ ID NO: 7603397 - DNA, 23 bp, Homo sapiens
ctccctgaacatgacacaccaga

SEQ ID NO: 7603398 - DNA, 23 bp, Homo sapiens
ctccctgaacatgacacaccaga

SEQ ID NO: 7603399 - DNA, 22 bp, Homo sapiens
ctccctgacaggccatgggctt

SEQ ID NO: 7603400 - DNA, 22 bp, Homo sapiens
ctccctgggcagatgtggctct

SEQ ID NO: 7603401 - DNA, 22 bp, Homo sapiens
ctccctggctttgtcctgaggc

SEQ ID NO: 7603402 - DNA, 22 bp, Homo sapiens
ctccctggggctcctcctattt

SEQ ID NO: 7603403 - DNA, 22 bp, Homo sapiens
ctccctggggctcctcctattt

SEQ ID NO: 7603404 - DNA, 22 bp, Homo sapiens
ctccctgggcctcagtttctct

SEQ ID NO: 7603405 - DNA, 22 bp, Homo sapiens
ctccctgggcctcagtttctct

SEQ ID NO: 7603406 - DNA, 22 bp, Homo sapiens
ctccctgggcagatgtggctct

SEQ ID NO: 7603407 - DNA, 22 bp, Homo sapiens
ctccctgggcagatgtggctct

SEQ ID NO: 7603408 - DNA, 22 bp, Homo sapiens
ctccctggctttgtcctgaggc

SEQ ID NO: 7603409 - DNA, 23 bp, Homo sapiens
ctccctggcccttgggagacctg

SEQ ID NO: 7603410 - DNA, 23 bp, Homo sapiens
ctccctggcccttgggagacctg

SEQ ID NO: 7603411 - DNA, 22 bp, Homo sapiens
ctccctgggcagatgtggctct

SEQ ID NO: 7603412 - DNA, 22 bp, Homo sapiens
ctccctgggcagatgtggctct

SEQ ID NO: 7603413 - DNA, 22 bp, Homo sapiens
ctccctggctttgtcctgaggc

SEQ ID NO: 7603414 - DNA, 22 bp, Homo sapiens
ctccctgggcagatgtggctct

SEQ ID NO: 7603415 - DNA, 23 bp, Homo sapiens
ctccctggcccttgggagacctg

SEQ ID NO: 7603416 - DNA, 23 bp, Homo sapiens
ctccctggcccttgggagacctg

SEQ ID NO: 7603417 - DNA, 22 bp, Homo sapiens
ctccctggcagccgcactcctg

SEQ ID NO: 7603418 - DNA, 22 bp, Homo sapiens
ctccctggcagccgcactcctg

SEQ ID NO: 7603419 - DNA, 22 bp, Homo sapiens
ctccctggcagccgcactcctg

SEQ ID NO: 7603420 - DNA, 22 bp, Homo sapiens
ctccctggcagccgcactcctg

SEQ ID NO: 7603421 - DNA, 22 bp, Homo sapiens
ctccctggcagccgcactcctg

SEQ ID NO: 7603422 - DNA, 22 bp, Homo sapiens
ctccctggcacagcgagaggtt

SEQ ID NO: 7603423 - DNA, 22 bp, Homo sapiens
ctccctggcacagcgagaggtt

SEQ ID NO: 7603424 - DNA, 22 bp, Homo sapiens
ctccctggcacagcgagaggtt

SEQ ID NO: 7603425 - DNA, 22 bp, Homo sapiens
ctccctggcacagcgagaggtt

SEQ ID NO: 7603426 - DNA, 23 bp, Homo sapiens
ctccctggagtttctggaagatg

SEQ ID NO: 7603427 - DNA, 22 bp, Homo sapiens
ctccctggcacagcgagaggtt

SEQ ID NO: 7603428 - DNA, 23 bp, Homo sapiens
ctccctggagtttctggaagatg

SEQ ID NO: 7603429 - DNA, 23 bp, Homo sapiens
ctccctggagtttctggaagatg

SEQ ID NO: 7603430 - DNA, 23 bp, Homo sapiens
ctccctggagtttctggaagatg

SEQ ID NO: 7603431 - DNA, 22 bp, Homo sapiens
ctccctggtctttcccatcatt

SEQ ID NO: 7603432 - DNA, 22 bp, Homo sapiens
ctccctggtctttcccatcatt

SEQ ID NO: 7603433 - DNA, 22 bp, Homo sapiens
ctccctggtctttcccatcatt

SEQ ID NO: 7603434 - DNA, 22 bp, Homo sapiens
ctccctggggctcctcctattt

SEQ ID NO: 7603435 - DNA, 22 bp, Homo sapiens
ctccctggggctcctcctattt

SEQ ID NO: 7603436 - DNA, 22 bp, Homo sapiens
ctccctggggctcctcctattt

SEQ ID NO: 7603437 - DNA, 22 bp, Homo sapiens
ctccctggtgactcccaaagct

SEQ ID NO: 7603438 - DNA, 22 bp, Homo sapiens
ctccctggtctttcccatcatt

SEQ ID NO: 7603439 - DNA, 22 bp, Homo sapiens
ctccctggtctttcccatcatt

SEQ ID NO: 7603440 - DNA, 22 bp, Homo sapiens
ctccctggtgactcccaaagct

SEQ ID NO: 7603441 - DNA, 22 bp, Homo sapiens
ctccctggtgactcccaaagct

SEQ ID NO: 7603442 - DNA, 22 bp, Homo sapiens
ctccctgtgctcagagccctgc

SEQ ID NO: 7603443 - DNA, 22 bp, Homo sapiens
ctccctggtgtcccctccagga

SEQ ID NO: 7603444 - DNA, 22 bp, Homo sapiens
ctccctggtgtcccctccagga

SEQ ID NO: 7603445 - DNA, 22 bp, Homo sapiens
ctccctggtgtcccctccagga

SEQ ID NO: 7603446 - DNA, 22 bp, Homo sapiens
ctccctggtgtcccctccagga

SEQ ID NO: 7603447 - DNA, 22 bp, Homo sapiens
ctccctggtgtcccctccagga

SEQ ID NO: 7603448 - DNA, 22 bp, Homo sapiens
ctccctggtgtcccctccagga

SEQ ID NO: 7603449 - DNA, 22 bp, Homo sapiens
ctccctggtgtcccctccagga

SEQ ID NO: 7603450 - DNA, 22 bp, Homo sapiens
ctcccttcaggagaggctcaca

SEQ ID NO: 7603451 - DNA, 22 bp, Homo sapiens
ctccctgtgtcttcacttggcc

SEQ ID NO: 7603452 - DNA, 22 bp, Homo sapiens
ctcccttcaggagaggctcaca

SEQ ID NO: 7603453 - DNA, 22 bp, Homo sapiens
ctcccttcaggagaggctcaca

SEQ ID NO: 7603454 - DNA, 22 bp, Homo sapiens
ctcccttcaggagaggctcaca

SEQ ID NO: 7603455 - DNA, 22 bp, Homo sapiens
ctcccttccaatgactatgctt

SEQ ID NO: 7603456 - DNA, 22 bp, Homo sapiens
ctcccttcaggagaggctcaca

SEQ ID NO: 7603457 - DNA, 22 bp, Homo sapiens
ctcccttcaggagaggctcaca

SEQ ID NO: 7603458 - DNA, 22 bp, Homo sapiens
ctcccttctgagccttttgtta

SEQ ID NO: 7603459 - DNA, 22 bp, Homo sapiens
ctcccttctgagccttttgtta

SEQ ID NO: 7603460 - DNA, 22 bp, Homo sapiens
ctcccttttggatatggggaga

SEQ ID NO: 7603461 - DNA, 22 bp, Homo sapiens
ctcccttgcttctggcattttg

SEQ ID NO: 7603462 - DNA, 22 bp, Homo sapiens
ctcccttgcttctggcattttg

SEQ ID NO: 7603463 - DNA, 22 bp, Homo sapiens
ctccgagactcgagtgtcctca

SEQ ID NO: 7603464 - DNA, 22 bp, Homo sapiens
ctccgcagcgggccaatccgga

SEQ ID NO: 7603465 - DNA, 22 bp, Homo sapiens
ctccgcagcgggccaatccgga

SEQ ID NO: 7603466 - DNA, 22 bp, Homo sapiens
ctccgcagcgggccaatccgga

SEQ ID NO: 7603467 - DNA, 22 bp, Homo sapiens
ctccggagagcagacgagggca

SEQ ID NO: 7603468 - DNA, 22 bp, Homo sapiens
ctcctcagctgggaggagtccc

SEQ ID NO: 7603469 - DNA, 21 bp, Homo sapiens
ctcctcaggaccagccacagg

SEQ ID NO: 7603470 - DNA, 21 bp, Homo sapiens
ctcctcaggaccagccacagg

SEQ ID NO: 7603471 - DNA, 21 bp, Homo sapiens
ctcctcaggaccagccacagg

SEQ ID NO: 7603472 - DNA, 21 bp, Homo sapiens
ctcctcaggaccagccacagg

SEQ ID NO: 7603473 - DNA, 21 bp, Homo sapiens
ctcctcaggaccagccacagg

SEQ ID NO: 7603474 - DNA, 21 bp, Homo sapiens
ctcctcaggaccagccacagg

SEQ ID NO: 7603475 - DNA, 21 bp, Homo sapiens
ctcctcaggaccagccacagg

SEQ ID NO: 7603476 - DNA, 22 bp, Homo sapiens
ctcctcaggaagtagcatgtgt

SEQ ID NO: 7603477 - DNA, 22 bp, Homo sapiens
ctcctcaggaagtagcatgtgt

SEQ ID NO: 7603478 - DNA, 22 bp, Homo sapiens
ctcctcaggaagtagcatgtgt

SEQ ID NO: 7603479 - DNA, 22 bp, Homo sapiens
ctcctcaggaagtagcatgtgt

SEQ ID NO: 7603480 - DNA, 21 bp, Homo sapiens
ctcctcaggaccagccacagg

SEQ ID NO: 7603481 - DNA, 22 bp, Homo sapiens
ctcctcaggaagtagcatgtgt

SEQ ID NO: 7603482 - DNA, 22 bp, Homo sapiens
ctcctcagtcaggtctagggtc

SEQ ID NO: 7603483 - DNA, 22 bp, Homo sapiens
ctcctcagtcaggtctagggtc

SEQ ID NO: 7603484 - DNA, 22 bp, Homo sapiens
ctcctcagtcaggtctagggtc

SEQ ID NO: 7603485 - DNA, 22 bp, Homo sapiens
ctcctcagtcaggtctagggtc

SEQ ID NO: 7603486 - DNA, 22 bp, Homo sapiens
ctcctcagtcaggtctagggtc

SEQ ID NO: 7603487 - DNA, 22 bp, Homo sapiens
ctcctcagggctggttacatgg

SEQ ID NO: 7603488 - DNA, 21 bp, Homo sapiens
ctcctcaggaccagccacagg

SEQ ID NO: 7603489 - DNA, 21 bp, Homo sapiens
ctcctcaggaccagccacagg

SEQ ID NO: 7603490 - DNA, 19 bp, Homo sapiens
ctcctcagtcccagaggtc

SEQ ID NO: 7603491 - DNA, 19 bp, Homo sapiens
ctcctcagtcccagaggtc

SEQ ID NO: 7603492 - DNA, 19 bp, Homo sapiens
ctcctcagtcccagaggtc

SEQ ID NO: 7603493 - DNA, 19 bp, Homo sapiens
ctcctcagtcccagaggtc

SEQ ID NO: 7603494 - DNA, 22 bp, Homo sapiens
ctcctcagtcaggtctagggtc

SEQ ID NO: 7603495 - DNA, 22 bp, Homo sapiens
ctcctcagtcaggtctagggtc

SEQ ID NO: 7603496 - DNA, 19 bp, Homo sapiens
ctcctcagtcccagaggtc

SEQ ID NO: 7603497 - DNA, 22 bp, Homo sapiens
ctccggagaggtcggaaaacag

SEQ ID NO: 7603498 - DNA, 19 bp, Homo sapiens
ctcctcagtcccagaggtc

SEQ ID NO: 7603499 - DNA, 19 bp, Homo sapiens
ctcctcagtcccagaggtc

SEQ ID NO: 7603500 - DNA, 19 bp, Homo sapiens
ctcctcagtcccagaggtc

SEQ ID NO: 7603501 - DNA, 20 bp, Homo sapiens
ctcctcagttccatgggagg

SEQ ID NO: 7603502 - DNA, 20 bp, Homo sapiens
ctcctcagttccatgggagg

SEQ ID NO: 7603503 - DNA, 20 bp, Homo sapiens
ctcctcagttccatgggagg

SEQ ID NO: 7603504 - DNA, 20 bp, Homo sapiens
ctcctcagttccatgggagg

SEQ ID NO: 7603505 - DNA, 20 bp, Homo sapiens
ctcctcagttccatgggagg

SEQ ID NO: 7603506 - DNA, 20 bp, Homo sapiens
ctcctcagttccatgggagg

SEQ ID NO: 7603507 - DNA, 20 bp, Homo sapiens
ctcctcagttccatgggagg

SEQ ID NO: 7603508 - DNA, 20 bp, Homo sapiens
ctcctcagttccatgggagg

SEQ ID NO: 7603509 - DNA, 19 bp, Homo sapiens
ctcctcagtcccagaggtc

SEQ ID NO: 7603510 - DNA, 19 bp, Homo sapiens
ctcctcagtcccagaggtc

SEQ ID NO: 7603511 - DNA, 19 bp, Homo sapiens
ctcctcagtcccagaggtc

SEQ ID NO: 7603512 - DNA, 22 bp, Homo sapiens
ttgtttattagcaattatcctg

SEQ ID NO: 7603513 - DNA, 20 bp, Homo sapiens
ttgtttattatgttctgatc

SEQ ID NO: 7603514 - DNA, 22 bp, Homo sapiens
ttgtttatgtgttgtctatggc

SEQ ID NO: 7603515 - DNA, 22 bp, Homo sapiens
ttgtttatgtgttgtctatggc

SEQ ID NO: 7603516 - DNA, 22 bp, Homo sapiens
ttgtttatggattgtagaaact

SEQ ID NO: 7603517 - DNA, 22 bp, Homo sapiens
ttgtttatggattgtagaaact

SEQ ID NO: 7603518 - DNA, 22 bp, Homo sapiens
ttgtttatgtgttgtctatggc

SEQ ID NO: 7603519 - DNA, 22 bp, Homo sapiens
ttgtttacactgcagaattggg

SEQ ID NO: 7603520 - DNA, 22 bp, Homo sapiens
ttgtttacactgcagaattggg

SEQ ID NO: 7603521 - DNA, 22 bp, Homo sapiens
ttgtttacactgcagaattggg

SEQ ID NO: 7603522 - DNA, 22 bp, Homo sapiens
ttgtttacaagttactcagtct

SEQ ID NO: 7603523 - DNA, 22 bp, Homo sapiens
ttgtttacaagttactcagtct

SEQ ID NO: 7603524 - DNA, 22 bp, Homo sapiens
ttgtttatcgcttgctcacata

SEQ ID NO: 7603525 - DNA, 22 bp, Homo sapiens
ttgtttatcgcttgctcacata

SEQ ID NO: 7603526 - DNA, 22 bp, Homo sapiens
ttgtttactaagaacctggtca

SEQ ID NO: 7603527 - DNA, 23 bp, Homo sapiens
ttgtttaccgtaggacttttaac

SEQ ID NO: 7603528 - DNA, 22 bp, Homo sapiens
ttgtttcagctgtatgctatgt

SEQ ID NO: 7603529 - DNA, 22 bp, Homo sapiens
ttgtttcagctgtatgctatgt

SEQ ID NO: 7603530 - DNA, 22 bp, Homo sapiens
ctccctcacaaagcattctctt

SEQ ID NO: 7603531 - DNA, 22 bp, Homo sapiens
ttgtttcagctgtatgctatgt

SEQ ID NO: 7603532 - DNA, 22 bp, Homo sapiens
ttgtttcagctgtatgctatgt

SEQ ID NO: 7603533 - DNA, 22 bp, Homo sapiens
ttgtttcagctgtatgctatgt

SEQ ID NO: 7603534 - DNA, 22 bp, Homo sapiens
ttgtttcagcccagatctttac

SEQ ID NO: 7603535 - DNA, 22 bp, Homo sapiens
ttgtttcagcccagatctttac

SEQ ID NO: 7603536 - DNA, 22 bp, Homo sapiens
ttgtttcagcccagatctttac

SEQ ID NO: 7603537 - DNA, 22 bp, Homo sapiens
ttgtttcagcccagatctttac

SEQ ID NO: 7603538 - DNA, 22 bp, Homo sapiens
ttgtttcaaggaagaattagga

SEQ ID NO: 7603539 - DNA, 22 bp, Homo sapiens
ttgtttcaaggaagaattagga

SEQ ID NO: 7603540 - DNA, 22 bp, Homo sapiens
ttgtttcaaatatttcagaata

SEQ ID NO: 7603541 - DNA, 22 bp, Homo sapiens
ttgtttcaaatatttcagaata

SEQ ID NO: 7603542 - DNA, 22 bp, Homo sapiens
ttgtttcaaatatttcagaata

SEQ ID NO: 7603543 - DNA, 22 bp, Homo sapiens
ttgtttcaaatatttcagaata

SEQ ID NO: 7603544 - DNA, 22 bp, Homo sapiens
ttgtttattagcaattatcctg

SEQ ID NO: 7603545 - DNA, 20 bp, Homo sapiens
ttgtttattatgttctgatc

SEQ ID NO: 7603546 - DNA, 20 bp, Homo sapiens
ttgtttattatgttctgatc

SEQ ID NO: 7603547 - DNA, 22 bp, Homo sapiens
ctccccagccctggtattctga

SEQ ID NO: 7603548 - DNA, 22 bp, Homo sapiens
ctccccagccctggtattctga

SEQ ID NO: 7603549 - DNA, 22 bp, Homo sapiens
ctccccagcattctgacttcct

SEQ ID NO: 7603550 - DNA, 22 bp, Homo sapiens
ctccccagccctggtattctga

SEQ ID NO: 7603551 - DNA, 22 bp, Homo sapiens
ctccccagccctggtattctga

SEQ ID NO: 7603552 - DNA, 22 bp, Homo sapiens
ctccccagcattctgacttcct

SEQ ID NO: 7603553 - DNA, 22 bp, Homo sapiens
ctccccagcattctgacttcct

SEQ ID NO: 7603554 - DNA, 22 bp, Homo sapiens
ctccccagcattctgacttcct

SEQ ID NO: 7603555 - DNA, 22 bp, Homo sapiens
ctccccagcattctgacttcct

SEQ ID NO: 7603556 - DNA, 22 bp, Homo sapiens
ctccccagcattctgacttcct

SEQ ID NO: 7603557 - DNA, 18 bp, Homo sapiens
ctccccagctgcccccag

SEQ ID NO: 7603558 - DNA, 18 bp, Homo sapiens
ctccccagctgcccccag

SEQ ID NO: 7603559 - DNA, 18 bp, Homo sapiens
ctccccagctgcccccag

SEQ ID NO: 7603560 - DNA, 18 bp, Homo sapiens
ctccccagctgcccccag

SEQ ID NO: 7603561 - DNA, 18 bp, Homo sapiens
ctccccagctgcccccag

SEQ ID NO: 7603562 - DNA, 18 bp, Homo sapiens
ctccccagctgcccccag

SEQ ID NO: 7603563 - DNA, 22 bp, Homo sapiens
ctccccagctcgcgggtgacgg

SEQ ID NO: 7603564 - DNA, 22 bp, Homo sapiens
ctccccagctcgcgggtgacgg

SEQ ID NO: 7603565 - DNA, 22 bp, Homo sapiens
ctccccagctcgcgggtgacgg

SEQ ID NO: 7603566 - DNA, 22 bp, Homo sapiens
ctccccagctcgcgggtgacgg

SEQ ID NO: 7603567 - DNA, 22 bp, Homo sapiens
ctccccagctcgcgggtgacgg

SEQ ID NO: 7603568 - DNA, 22 bp, Homo sapiens
ctccccagctcgcgggtgacgg

SEQ ID NO: 7603569 - DNA, 22 bp, Homo sapiens
ttgtttaatgcctcatacatct

SEQ ID NO: 7603570 - DNA, 22 bp, Homo sapiens
ttgtttaatgcctcatacatct

SEQ ID NO: 7603571 - DNA, 22 bp, Homo sapiens
ttgtttaatgcctcatacatct

SEQ ID NO: 7603572 - DNA, 22 bp, Homo sapiens
ttgtttaatgcctcatacatct

SEQ ID NO: 7603573 - DNA, 22 bp, Homo sapiens
ttgtttaatgcctcatacatct

SEQ ID NO: 7603574 - DNA, 22 bp, Homo sapiens
ttgtttaatgcctcatacatct

SEQ ID NO: 7603575 - DNA, 22 bp, Homo sapiens
ttgtttaatgcctcatacatct

SEQ ID NO: 7603576 - DNA, 22 bp, Homo sapiens
ttgtttaatgcctcatacatct

SEQ ID NO: 7603577 - DNA, 22 bp, Homo sapiens
ttgtttaatgcctcatacatct

SEQ ID NO: 7603578 - DNA, 22 bp, Homo sapiens
ttgtttaatatcgtgaagtact

SEQ ID NO: 7603579 - DNA, 22 bp, Homo sapiens
ttgtttaatatcgtgaagtact

SEQ ID NO: 7603580 - DNA, 22 bp, Homo sapiens
ttgtttaatatcgtgaagtact

SEQ ID NO: 7603581 - DNA, 22 bp, Homo sapiens
ttgtttaatatcgtgaagtact

SEQ ID NO: 7603582 - DNA, 22 bp, Homo sapiens
ttgtttaatatcgtgaagtact

SEQ ID NO: 7603583 - DNA, 23 bp, Homo sapiens
ctccccagtgtcctcatgcatct

SEQ ID NO: 7603584 - DNA, 23 bp, Homo sapiens
ctccccagtgtcctcatgcatct

SEQ ID NO: 7603585 - DNA, 22 bp, Homo sapiens
ctccccaggttcaggaggtggg

SEQ ID NO: 7603586 - DNA, 22 bp, Homo sapiens
ctccccaggttcaggaggtggg

SEQ ID NO: 7603587 - DNA, 22 bp, Homo sapiens
ctccccaggttcaggaggtggg

SEQ ID NO: 7603588 - DNA, 22 bp, Homo sapiens
ctccccaggttcaggaggtggg

SEQ ID NO: 7603589 - DNA, 22 bp, Homo sapiens
ctccccaggttcaggaggtggg

SEQ ID NO: 7603590 - DNA, 18 bp, Homo sapiens
ctccccagctgcccccag

SEQ ID NO: 7603591 - DNA, 22 bp, Homo sapiens
ctccccaggttcaggaggtggg

SEQ ID NO: 7603592 - DNA, 22 bp, Homo sapiens
ctccccaggttcaggaggtggg

SEQ ID NO: 7603593 - DNA, 22 bp, Homo sapiens
ctccccaggttcaggaggtggg

SEQ ID NO: 7603594 - DNA, 22 bp, Homo sapiens
ctccccaggttcaggaggtggg

SEQ ID NO: 7603595 - DNA, 22 bp, Homo sapiens
ctccccaggttcaggaggtggg

SEQ ID NO: 7603596 - DNA, 22 bp, Homo sapiens
ctccccaccttcgcggtccctg

SEQ ID NO: 7603597 - DNA, 22 bp, Homo sapiens
ctccccacgcctggactaagag

SEQ ID NO: 7603598 - DNA, 22 bp, Homo sapiens
ctccccacgcctggactaagag

SEQ ID NO: 7603599 - DNA, 22 bp, Homo sapiens
ctccccacgcctggactaagag

SEQ ID NO: 7603600 - DNA, 22 bp, Homo sapiens
ctccccaccttcgcggtccctg

SEQ ID NO: 7603601 - DNA, 22 bp, Homo sapiens
ctccccaccttcgcggtccctg

SEQ ID NO: 7603602 - DNA, 22 bp, Homo sapiens
ctccccacatttctccctgtct

SEQ ID NO: 7603603 - DNA, 22 bp, Homo sapiens
ctccccaccttcgcggtccctg

SEQ ID NO: 7603604 - DNA, 22 bp, Homo sapiens
ctccccaccttcgcggtccctg

SEQ ID NO: 7603605 - DNA, 22 bp, Homo sapiens
ctccccacatttctccctgtct

SEQ ID NO: 7603606 - DNA, 22 bp, Homo sapiens
ctccccacatttctccctgtct

SEQ ID NO: 7603607 - DNA, 22 bp, Homo sapiens
ctccccacatttctccctgtct

SEQ ID NO: 7603608 - DNA, 22 bp, Homo sapiens
ctccccacatttctccctgtct

SEQ ID NO: 7603609 - DNA, 22 bp, Homo sapiens
ctccccacatttctccctgtct

SEQ ID NO: 7603610 - DNA, 22 bp, Homo sapiens
ctccccacatttctccctgtct

SEQ ID NO: 7603611 - DNA, 22 bp, Homo sapiens
ctccccacacactaggcctgat

SEQ ID NO: 7603612 - DNA, 22 bp, Homo sapiens
ctccccacacactaggcctgat

SEQ ID NO: 7603613 - DNA, 22 bp, Homo sapiens
ctccccacacactaggcctgat

SEQ ID NO: 7603614 - DNA, 22 bp, Homo sapiens
ctccccacacactaggcctgat

SEQ ID NO: 7603615 - DNA, 22 bp, Homo sapiens
ctccccacacactaggcctgat

SEQ ID NO: 7603616 - DNA, 22 bp, Homo sapiens
ctccccaagtcatggagccagg

SEQ ID NO: 7603617 - DNA, 22 bp, Homo sapiens
ctccccaagtcatggagccagg

SEQ ID NO: 7603618 - DNA, 22 bp, Homo sapiens
ctccccaagtcatggagccagg

SEQ ID NO: 7603619 - DNA, 22 bp, Homo sapiens
ctccccaagtcatggagccagg

SEQ ID NO: 7603620 - DNA, 22 bp, Homo sapiens
ctcccatgctctctctgagaag

SEQ ID NO: 7603621 - DNA, 22 bp, Homo sapiens
ctccccaaagataacggcttct

SEQ ID NO: 7603622 - DNA, 22 bp, Homo sapiens
ctccccaagccttggcttctcc

SEQ ID NO: 7603623 - DNA, 22 bp, Homo sapiens
ctccccaactcagccgaggctt

SEQ ID NO: 7603624 - DNA, 22 bp, Homo sapiens
ctccccaaatgggttgagttct

SEQ ID NO: 7603625 - DNA, 22 bp, Homo sapiens
ctccccaaatgggttgagttct

SEQ ID NO: 7603626 - DNA, 22 bp, Homo sapiens
ctcccagggccatcgagtcact

SEQ ID NO: 7603627 - DNA, 22 bp, Homo sapiens
ctcccagggccatcgagtcact

SEQ ID NO: 7603628 - DNA, 22 bp, Homo sapiens
ctcccagggccatcgagtcact

SEQ ID NO: 7603629 - DNA, 22 bp, Homo sapiens
ctcccagggccatcgagtcact

SEQ ID NO: 7603630 - DNA, 22 bp, Homo sapiens
ctcccagggccatcgagtcact

SEQ ID NO: 7603631 - DNA, 22 bp, Homo sapiens
ctcccaggggaactatcaagta

SEQ ID NO: 7603632 - DNA, 22 bp, Homo sapiens
ctcccagtgttgttttctgatg

SEQ ID NO: 7603633 - DNA, 22 bp, Homo sapiens
ctcccaggggaactatcaagta

SEQ ID NO: 7603634 - DNA, 22 bp, Homo sapiens
ctcccataattctcatatgtca

SEQ ID NO: 7603635 - DNA, 22 bp, Homo sapiens
ctcccatgctctctctgagaag

SEQ ID NO: 7603636 - DNA, 21 bp, Homo sapiens
ctcaggctggcagcaggctag

SEQ ID NO: 7603637 - DNA, 21 bp, Homo sapiens
ctcaggctggcagcaggctag

SEQ ID NO: 7603638 - DNA, 21 bp, Homo sapiens
ctcaggctggcagcaggctag

SEQ ID NO: 7603639 - DNA, 22 bp, Homo sapiens
ctcaggctgccctgacagcccc

SEQ ID NO: 7603640 - DNA, 22 bp, Homo sapiens
ctcaggctgccctgacagcccc

SEQ ID NO: 7603641 - DNA, 22 bp, Homo sapiens
ctcaggctgccctgacagcccc

SEQ ID NO: 7603642 - DNA, 21 bp, Homo sapiens
ctcaggctggcagcaggctag

SEQ ID NO: 7603643 - DNA, 21 bp, Homo sapiens
ctcaggctggcagcaggctag

SEQ ID NO: 7603644 - DNA, 21 bp, Homo sapiens
ctcaggctggcagcaggctag

SEQ ID NO: 7603645 - DNA, 21 bp, Homo sapiens
ctcaggctggcagcaggctag

SEQ ID NO: 7603646 - DNA, 22 bp, Homo sapiens
ctcaggctgccctgacagcccc

SEQ ID NO: 7603647 - DNA, 22 bp, Homo sapiens
ctcaggctgccctgacagcccc

SEQ ID NO: 7603648 - DNA, 22 bp, Homo sapiens
ctcaggctctggccatccaagg

SEQ ID NO: 7603649 - DNA, 22 bp, Homo sapiens
ctcaggctctgtactccctttg

SEQ ID NO: 7603650 - DNA, 22 bp, Homo sapiens
ctcaggctctgtactccctttg

SEQ ID NO: 7603651 - DNA, 22 bp, Homo sapiens
ctcaggctccagacttccgtcc

SEQ ID NO: 7603652 - DNA, 22 bp, Homo sapiens
ctcaggctcatatcccatcagc

SEQ ID NO: 7603653 - DNA, 22 bp, Homo sapiens
ctcaggctctggccatccaagg

SEQ ID NO: 7603654 - DNA, 22 bp, Homo sapiens
ctcaggctctggccatccaagg

SEQ ID NO: 7603655 - DNA, 22 bp, Homo sapiens
ctcaggcttgggaggaggccca

SEQ ID NO: 7603656 - DNA, 22 bp, Homo sapiens
ctcaggcttgggaggaggccca

SEQ ID NO: 7603657 - DNA, 22 bp, Homo sapiens
ctcaggcttgggaggaggccca

SEQ ID NO: 7603658 - DNA, 22 bp, Homo sapiens
ctcaggctgtgccacctgtgtg

SEQ ID NO: 7603659 - DNA, 22 bp, Homo sapiens
ctcaggcttgggaggaggccca

SEQ ID NO: 7603660 - DNA, 22 bp, Homo sapiens
ctcagggaagctatggtgaggg

SEQ ID NO: 7603661 - DNA, 22 bp, Homo sapiens
ctcaggcttgggaggaggccca

SEQ ID NO: 7603662 - DNA, 22 bp, Homo sapiens
ctcagggaagctatggtgaggg

SEQ ID NO: 7603663 - DNA, 22 bp, Homo sapiens
ctcccagggccatcgagtcact

SEQ ID NO: 7603664 - DNA, 22 bp, Homo sapiens
ctcaggctggtccttagtgaca

SEQ ID NO: 7603665 - DNA, 22 bp, Homo sapiens
ctcaggctggtccttagtgaca

SEQ ID NO: 7603666 - DNA, 22 bp, Homo sapiens
ctcaggctggtccttagtgaca

SEQ ID NO: 7603667 - DNA, 22 bp, Homo sapiens
ctcaggctgtgatgtgatggca

SEQ ID NO: 7603668 - DNA, 22 bp, Homo sapiens
ctcaggctgtgatgtgatggca

SEQ ID NO: 7603669 - DNA, 22 bp, Homo sapiens
tttcaaagtcaagaaggatact

SEQ ID NO: 7603670 - DNA, 22 bp, Homo sapiens
tttcaaagtcaatatcattacc

SEQ ID NO: 7603671 - DNA, 22 bp, Homo sapiens
tttcaaagtcaatatcattacc

SEQ ID NO: 7603672 - DNA, 22 bp, Homo sapiens
tttcaaagtcaatatcattacc

SEQ ID NO: 7603673 - DNA, 22 bp, Homo sapiens
tttcaaagtcaatatcattacc

SEQ ID NO: 7603674 - DNA, 22 bp, Homo sapiens
tttcaaagtcaagaaggatact

SEQ ID NO: 7603675 - DNA, 22 bp, Homo sapiens
ctcctgtggtcaagggtgggac

SEQ ID NO: 7603676 - DNA, 22 bp, Homo sapiens
ctcctgtggtcaagggtgggac

SEQ ID NO: 7603677 - DNA, 22 bp, Homo sapiens
ctcctgtggtactcccagggcc

SEQ ID NO: 7603678 - DNA, 22 bp, Homo sapiens
ctcctgtgggtcaccaataggc

SEQ ID NO: 7603679 - DNA, 22 bp, Homo sapiens
ctcctgtggtactcccagggcc

SEQ ID NO: 7603680 - DNA, 22 bp, Homo sapiens
ctcctgtggtactcccagggcc

SEQ ID NO: 7603681 - DNA, 22 bp, Homo sapiens
ctcctgtggtactcccagggcc

SEQ ID NO: 7603682 - DNA, 22 bp, Homo sapiens
ctcctgtcagaagcatcctgag

SEQ ID NO: 7603683 - DNA, 22 bp, Homo sapiens
ctcctgtcccggggaccgccga

SEQ ID NO: 7603684 - DNA, 22 bp, Homo sapiens
ctcctgtgattcatttaacata

SEQ ID NO: 7603685 - DNA, 22 bp, Homo sapiens
ctcctgtgattcatttaacata

SEQ ID NO: 7603686 - DNA, 22 bp, Homo sapiens
ctcctgtgcatgcatctcccta

SEQ ID NO: 7603687 - DNA, 22 bp, Homo sapiens
ctcctgtgcacctccagcggca

SEQ ID NO: 7603688 - DNA, 22 bp, Homo sapiens
ctcctgtgcacctccagcggca

SEQ ID NO: 7603689 - DNA, 20 bp, Homo sapiens
ctcctgtgcctctctgggcc

SEQ ID NO: 7603690 - DNA, 22 bp, Homo sapiens
ctcctgtgcatgcatctcccta

SEQ ID NO: 7603691 - DNA, 20 bp, Homo sapiens
ctcctgtgcctctctgggcc

SEQ ID NO: 7603692 - DNA, 20 bp, Homo sapiens
ctcctgtgcctctctgggcc

SEQ ID NO: 7603693 - DNA, 22 bp, Homo sapiens
ctcctgtgggtcaccaataggc

SEQ ID NO: 7603694 - DNA, 22 bp, Homo sapiens
ctcctgtggctttctgatttca

SEQ ID NO: 7603695 - DNA, 22 bp, Homo sapiens
ctcctgtggctttctgatttca

SEQ ID NO: 7603696 - DNA, 22 bp, Homo sapiens
tttatattacctggaatagctt

SEQ ID NO: 7603697 - DNA, 22 bp, Homo sapiens
tttatattacctggaatagctt

SEQ ID NO: 7603698 - DNA, 22 bp, Homo sapiens
tttatattacctggaatagctt

SEQ ID NO: 7603699 - DNA, 22 bp, Homo sapiens
tttatattacctggaatagctt

SEQ ID NO: 7603700 - DNA, 22 bp, Homo sapiens
tttatatgtttgtacaattaag

SEQ ID NO: 7603701 - DNA, 22 bp, Homo sapiens
tttatatgtttgtacaattaag

SEQ ID NO: 7603702 - DNA, 22 bp, Homo sapiens
tttatatgtttgtacaattaag

SEQ ID NO: 7603703 - DNA, 22 bp, Homo sapiens
tttatattacctggaatagctt

SEQ ID NO: 7603704 - DNA, 22 bp, Homo sapiens
ctcctgggcttcgaaggctccc

SEQ ID NO: 7603705 - DNA, 22 bp, Homo sapiens
ctcctgggcttcgaaggctccc

SEQ ID NO: 7603706 - DNA, 22 bp, Homo sapiens
tttatattacctggaatagctt

SEQ ID NO: 7603707 - DNA, 22 bp, Homo sapiens
ctcctgggcttcgaaggctccc

SEQ ID NO: 7603708 - DNA, 22 bp, Homo sapiens
ctcctgggcttcgaaggctccc

SEQ ID NO: 7603709 - DNA, 22 bp, Homo sapiens
ctcctggttcctgtcttaaata

SEQ ID NO: 7603710 - DNA, 22 bp, Homo sapiens
ctcctgtcaataggctcctggc

SEQ ID NO: 7603711 - DNA, 22 bp, Homo sapiens
ctcctgtcagaagcatcctgag

SEQ ID NO: 7603712 - DNA, 22 bp, Homo sapiens
ctcctgtcagaagcatcctgag

SEQ ID NO: 7603713 - DNA, 22 bp, Homo sapiens
ctcctgtcagaagcatcctgag

SEQ ID NO: 7603714 - DNA, 22 bp, Homo sapiens
ctcctgtcagaagcatcctgag

SEQ ID NO: 7603715 - DNA, 22 bp, Homo sapiens
ctcctgtcagaagcatcctgag

SEQ ID NO: 7603716 - DNA, 22 bp, Homo sapiens
ctcctgtcagaagcatcctgag

SEQ ID NO: 7603717 - DNA, 22 bp, Homo sapiens
ctcctgtcaataggctcctggc

SEQ ID NO: 7603718 - DNA, 22 bp, Homo sapiens
ctcctgtcaataggctcctggc

SEQ ID NO: 7603719 - DNA, 22 bp, Homo sapiens
ctcctgtcaataggctcctggc

SEQ ID NO: 7603720 - DNA, 22 bp, Homo sapiens
ctcctgtcaataggctcctggc

SEQ ID NO: 7603721 - DNA, 22 bp, Homo sapiens
ctcctgtcaataggctcctggc

SEQ ID NO: 7603722 - DNA, 22 bp, Homo sapiens
ctcctgtatgttgggcttcaca

SEQ ID NO: 7603723 - DNA, 22 bp, Homo sapiens
ctcctgtcaataggctcctggc

SEQ ID NO: 7603724 - DNA, 22 bp, Homo sapiens
ctcctgtcaataggctcctggc

SEQ ID NO: 7603725 - DNA, 22 bp, Homo sapiens
ctcctgtcaataggctcctggc

SEQ ID NO: 7603726 - DNA, 22 bp, Homo sapiens
ctctaagtgtcaaacagatatg

SEQ ID NO: 7603727 - DNA, 22 bp, Homo sapiens
ctctaaggaactcccccaaact

SEQ ID NO: 7603728 - DNA, 21 bp, Homo sapiens
ctctacattcccagcaactct

SEQ ID NO: 7603729 - DNA, 22 bp, Homo sapiens
ctctacagctgctgcccctggt

SEQ ID NO: 7603730 - DNA, 22 bp, Homo sapiens
ctctaaatccaaataagtgtcc

SEQ ID NO: 7603731 - DNA, 22 bp, Homo sapiens
ctctaaatccacggtatagttg

SEQ ID NO: 7603732 - DNA, 22 bp, Homo sapiens
ctctaaatgtggtctgcagata

SEQ ID NO: 7603733 - DNA, 22 bp, Homo sapiens
ctctaaatccaaataagtgtcc

SEQ ID NO: 7603734 - DNA, 22 bp, Homo sapiens
ctcgttgctgaagccaaagtca

SEQ ID NO: 7603735 - DNA, 22 bp, Homo sapiens
ctctaaaggcttgttattgcat

SEQ ID NO: 7603736 - DNA, 22 bp, Homo sapiens
ctctaaaggcttgttattgcat

SEQ ID NO: 7603737 - DNA, 22 bp, Homo sapiens
ctctaaatccaaataagtgtcc

SEQ ID NO: 7603738 - DNA, 22 bp, Homo sapiens
ctcgggtaccatgctaggcact

SEQ ID NO: 7603739 - DNA, 22 bp, Homo sapiens
ctcgggttgtaagtatctatta

SEQ ID NO: 7603740 - DNA, 22 bp, Homo sapiens
ctcggtggacatttcagaggtg

SEQ ID NO: 7603741 - DNA, 22 bp, Homo sapiens
ctcgtgatccgcccacctcagc

SEQ ID NO: 7603742 - DNA, 22 bp, Homo sapiens
ctcgtatgtgacttaatttagt

SEQ ID NO: 7603743 - DNA, 22 bp, Homo sapiens
ctcgtgatccgcccacctcagc

SEQ ID NO: 7603744 - DNA, 22 bp, Homo sapiens
ctcgtgatccgcccacctcagc

SEQ ID NO: 7603745 - DNA, 22 bp, Homo sapiens
ctcgttgctgaagccaaagtca

SEQ ID NO: 7603746 - DNA, 22 bp, Homo sapiens
ctctaaaggcttgttattgcat

SEQ ID NO: 7603747 - DNA, 22 bp, Homo sapiens
tttcaaatggagtcgtgaaatg

SEQ ID NO: 7603748 - DNA, 22 bp, Homo sapiens
ctcggggatccatccacgtggc

SEQ ID NO: 7603749 - DNA, 22 bp, Homo sapiens
ctccttcctggttagcacctta

SEQ ID NO: 7603750 - DNA, 22 bp, Homo sapiens
ctccttcctggttagcacctta

SEQ ID NO: 7603751 - DNA, 22 bp, Homo sapiens
ctccttcctggttagcacctta

SEQ ID NO: 7603752 - DNA, 22 bp, Homo sapiens
tttcaaatggagtcgtgaaatg

SEQ ID NO: 7603753 - DNA, 22 bp, Homo sapiens
ctccttcctggttagcacctta

SEQ ID NO: 7603754 - DNA, 22 bp, Homo sapiens
ctccttcctggttagcacctta

SEQ ID NO: 7603755 - DNA, 22 bp, Homo sapiens
ctccttcctggttagcacctta

SEQ ID NO: 7603756 - DNA, 22 bp, Homo sapiens
tttcaaatggagtcgtgaaatg

SEQ ID NO: 7603757 - DNA, 22 bp, Homo sapiens
tttcaaatgcatgtctttcctc

SEQ ID NO: 7603758 - DNA, 22 bp, Homo sapiens
tttcaaatgcatgtctttcctc

SEQ ID NO: 7603759 - DNA, 22 bp, Homo sapiens
tttcaaatgcatgtctttcctc

SEQ ID NO: 7603760 - DNA, 22 bp, Homo sapiens
tttcaaatagaatctttccaaa

SEQ ID NO: 7603761 - DNA, 22 bp, Homo sapiens
tttcaaatagaatctttccaaa

SEQ ID NO: 7603762 - DNA, 22 bp, Homo sapiens
tttcaaatagaatctttccaaa

SEQ ID NO: 7603763 - DNA, 22 bp, Homo sapiens
tttcaaatagaatctttccaaa

SEQ ID NO: 7603764 - DNA, 22 bp, Homo sapiens
tttcaaataccataaacctaat

SEQ ID NO: 7603765 - DNA, 22 bp, Homo sapiens
tttcaaataccataaacctaat

SEQ ID NO: 7603766 - DNA, 22 bp, Homo sapiens
tttcaaataccataaacctaat

SEQ ID NO: 7603767 - DNA, 22 bp, Homo sapiens
tttcaaataccataaacctaat

SEQ ID NO: 7603768 - DNA, 22 bp, Homo sapiens
tttcaaataccataaacctaat

SEQ ID NO: 7603769 - DNA, 22 bp, Homo sapiens
tttcaaataccataaacctaat

SEQ ID NO: 7603770 - DNA, 22 bp, Homo sapiens
tttcaaagtggagaattagaca

SEQ ID NO: 7603771 - DNA, 22 bp, Homo sapiens
tttcaaagttgggaattgtaat

SEQ ID NO: 7603772 - DNA, 22 bp, Homo sapiens
tttcaaagtggagggatggtat

SEQ ID NO: 7603773 - DNA, 22 bp, Homo sapiens
tttcaaagttgggaattgtaat

SEQ ID NO: 7603774 - DNA, 22 bp, Homo sapiens
tttcaaagtggagaattagaca

SEQ ID NO: 7603775 - DNA, 22 bp, Homo sapiens
tttcaaagtggagaattagaca

SEQ ID NO: 7603776 - DNA, 22 bp, Homo sapiens
tttcaaagtggagaattagaca

SEQ ID NO: 7603777 - DNA, 22 bp, Homo sapiens
tttcaaagtggagaattagaca

SEQ ID NO: 7603778 - DNA, 22 bp, Homo sapiens
tttcaaagttgggaattgtaat

SEQ ID NO: 7603779 - DNA, 22 bp, Homo sapiens
tttcaaataccataaacctaat

SEQ ID NO: 7603780 - DNA, 22 bp, Homo sapiens
tttcaaataccataaacctaat

SEQ ID NO: 7603781 - DNA, 22 bp, Homo sapiens
tttcaaataccataaacctaat

SEQ ID NO: 7603782 - DNA, 22 bp, Homo sapiens
tttcaaataccataaacctaat

SEQ ID NO: 7603783 - DNA, 22 bp, Homo sapiens
tttcaaataccataaacctaat

SEQ ID NO: 7603784 - DNA, 22 bp, Homo sapiens
tttcaaataccataaacctaat

SEQ ID NO: 7603785 - DNA, 22 bp, Homo sapiens
tttacacaaaagatagcacacc

SEQ ID NO: 7603786 - DNA, 22 bp, Homo sapiens
tttacacaaaagatagcacacc

SEQ ID NO: 7603787 - DNA, 22 bp, Homo sapiens
tttacacaaaagatagcacacc

SEQ ID NO: 7603788 - DNA, 22 bp, Homo sapiens
tttacacaaaagatagcacacc

SEQ ID NO: 7603789 - DNA, 22 bp, Homo sapiens
tttacacaaaagatagcacacc

SEQ ID NO: 7603790 - DNA, 22 bp, Homo sapiens
tttacacaaaagatagcacacc

SEQ ID NO: 7603791 - DNA, 22 bp, Homo sapiens
tttacacaaaagatagcacacc

SEQ ID NO: 7603792 - DNA, 22 bp, Homo sapiens
tttacacaaaagatagcacacc

SEQ ID NO: 7603793 - DNA, 22 bp, Homo sapiens
tttacaattggttttctctaat

SEQ ID NO: 7603794 - DNA, 22 bp, Homo sapiens
tttacaattggttttctctaat

SEQ ID NO: 7603795 - DNA, 22 bp, Homo sapiens
tttacaattggttttctctaat

SEQ ID NO: 7603796 - DNA, 22 bp, Homo sapiens
tttacaattggttttctctaat

SEQ ID NO: 7603797 - DNA, 22 bp, Homo sapiens
tttacaattggttttctctaat

SEQ ID NO: 7603798 - DNA, 22 bp, Homo sapiens
tttacaattctctaccagtgtt

SEQ ID NO: 7603799 - DNA, 22 bp, Homo sapiens
tttacaattctggtgccagcta

SEQ ID NO: 7603800 - DNA, 22 bp, Homo sapiens
tttacaattggttttctctaat

SEQ ID NO: 7603801 - DNA, 22 bp, Homo sapiens
tttacaattggttttctctaat

SEQ ID NO: 7603802 - DNA, 22 bp, Homo sapiens
tttacaattggttttctctaat

SEQ ID NO: 7603803 - DNA, 22 bp, Homo sapiens
tttacaattggttttctctaat

SEQ ID NO: 7603804 - DNA, 22 bp, Homo sapiens
tttacaattggttttctctaat

SEQ ID NO: 7603805 - DNA, 22 bp, Homo sapiens
ctcctcagttgtcccatggaga

SEQ ID NO: 7603806 - DNA, 22 bp, Homo sapiens
ctcctcagttgtcccatggaga

SEQ ID NO: 7603807 - DNA, 22 bp, Homo sapiens
ctcctcagttgtcccatggaga

SEQ ID NO: 7603808 - DNA, 22 bp, Homo sapiens
ctcctcagttgtcccatggaga

SEQ ID NO: 7603809 - DNA, 22 bp, Homo sapiens
ctcctcagttgtcccatggaga

SEQ ID NO: 7603810 - DNA, 20 bp, Homo sapiens
ctcctcagttccatgggagg

SEQ ID NO: 7603811 - DNA, 20 bp, Homo sapiens
ctcctcagttccatgggagg

SEQ ID NO: 7603812 - DNA, 20 bp, Homo sapiens
ctcctcagttccatgggagg

SEQ ID NO: 7603813 - DNA, 22 bp, Homo sapiens
tttacaatagggtctgaatgaa

SEQ ID NO: 7603814 - DNA, 22 bp, Homo sapiens
tttacaatagggtctgaatgaa

SEQ ID NO: 7603815 - DNA, 22 bp, Homo sapiens
tttacaatagggtctgaatgaa

SEQ ID NO: 7603816 - DNA, 22 bp, Homo sapiens
tttacaagtttacagaatgatg

SEQ ID NO: 7603817 - DNA, 22 bp, Homo sapiens
tttacaattctctaccagtgtt

SEQ ID NO: 7603818 - DNA, 22 bp, Homo sapiens
tttacaattctctaccagtgtt

SEQ ID NO: 7603819 - DNA, 22 bp, Homo sapiens
tttacaattctctaccagtgtt

SEQ ID NO: 7603820 - DNA, 22 bp, Homo sapiens
tttacaattctctaccagtgtt

SEQ ID NO: 7603821 - DNA, 22 bp, Homo sapiens
ctcctgcttcacgggcaccgcc

SEQ ID NO: 7603822 - DNA, 22 bp, Homo sapiens
ctcctggaagcccgccctgctg

SEQ ID NO: 7603823 - DNA, 22 bp, Homo sapiens
ctcctgctcctgcttgcaagga

SEQ ID NO: 7603824 - DNA, 22 bp, Homo sapiens
ctcctgcggtactactgtgctt

SEQ ID NO: 7603825 - DNA, 22 bp, Homo sapiens
ctcctgctgaatggccaggagc

SEQ ID NO: 7603826 - DNA, 22 bp, Homo sapiens
ctcctgctgaatggccaggagc

SEQ ID NO: 7603827 - DNA, 22 bp, Homo sapiens
ctcctgctgaatggccaggagc

SEQ ID NO: 7603828 - DNA, 22 bp, Homo sapiens
ctcctgctgaatggccaggagc

SEQ ID NO: 7603829 - DNA, 22 bp, Homo sapiens
ctcctgcgggagctccgcctag

SEQ ID NO: 7603830 - DNA, 22 bp, Homo sapiens
ctcctgcggtactactgtgctt

SEQ ID NO: 7603831 - DNA, 22 bp, Homo sapiens
ctcctgcctgtgggactgagga

SEQ ID NO: 7603832 - DNA, 22 bp, Homo sapiens
ctcctgagctgcagccttgtgt

SEQ ID NO: 7603833 - DNA, 22 bp, Homo sapiens
tttacacatacctctttaaagt

SEQ ID NO: 7603834 - DNA, 22 bp, Homo sapiens
ctcctgagctctgaggaagctt

SEQ ID NO: 7603835 - DNA, 22 bp, Homo sapiens
ctcctgagctgcagccttgtgt

SEQ ID NO: 7603836 - DNA, 22 bp, Homo sapiens
ctcctgagctgcagccttgtgt

SEQ ID NO: 7603837 - DNA, 22 bp, Homo sapiens
tttacacagaggacactgggct

SEQ ID NO: 7603838 - DNA, 22 bp, Homo sapiens
tttacacataaatgtgtagaca

SEQ ID NO: 7603839 - DNA, 22 bp, Homo sapiens
tttacacataaatgtgtagaca

SEQ ID NO: 7603840 - DNA, 22 bp, Homo sapiens
tttacacataaatgtgtagaca

SEQ ID NO: 7603841 - DNA, 22 bp, Homo sapiens
tttacacagaggacactgggct

SEQ ID NO: 7603842 - DNA, 22 bp, Homo sapiens
tttacacatacctctttaaagt

SEQ ID NO: 7603843 - DNA, 22 bp, Homo sapiens
tttacacatacctctttaaagt

SEQ ID NO: 7603844 - DNA, 22 bp, Homo sapiens
tttacacatacctctttaaagt

SEQ ID NO: 7603845 - DNA, 22 bp, Homo sapiens
tttacacatacctctttaaagt

SEQ ID NO: 7603846 - DNA, 22 bp, Homo sapiens
ctcctgagctctgaggaagctt

SEQ ID NO: 7603847 - DNA, 22 bp, Homo sapiens
tttacacaaaagatagcacacc

SEQ ID NO: 7603848 - DNA, 22 bp, Homo sapiens
tttacacaaaagatagcacacc

SEQ ID NO: 7603849 - DNA, 22 bp, Homo sapiens
tttacacaaaatgttagtagat

SEQ ID NO: 7603850 - DNA, 22 bp, Homo sapiens
tttacacaaaatgttagtagat

SEQ ID NO: 7603851 - DNA, 22 bp, Homo sapiens
tttacacaaaatgttagtagat

SEQ ID NO: 7603852 - DNA, 22 bp, Homo sapiens
tttacacaaaatgttagtagat

SEQ ID NO: 7603853 - DNA, 22 bp, Homo sapiens
tttacacagaggacactgggct

SEQ ID NO: 7603854 - DNA, 22 bp, Homo sapiens
tttatatggttgactatgagtt

SEQ ID NO: 7603855 - DNA, 22 bp, Homo sapiens
tttatatgtattgactttgatg

SEQ ID NO: 7603856 - DNA, 22 bp, Homo sapiens
tttatatgtattgactttgatg

SEQ ID NO: 7603857 - DNA, 22 bp, Homo sapiens
tttatatgtgaaggtttgcaga

SEQ ID NO: 7603858 - DNA, 22 bp, Homo sapiens
tttatatgtattgactttgatg

SEQ ID NO: 7603859 - DNA, 22 bp, Homo sapiens
tttatatgtttgtacaattaag

SEQ ID NO: 7603860 - DNA, 22 bp, Homo sapiens
tttatatgtttgtacaattaag

SEQ ID NO: 7603861 - DNA, 22 bp, Homo sapiens
tttatatgtttgtacaattaag

SEQ ID NO: 7603862 - DNA, 22 bp, Homo sapiens
tttatatgtttgtacaattaag

SEQ ID NO: 7603863 - DNA, 22 bp, Homo sapiens
tttatatgtttgtacaattaag

SEQ ID NO: 7603864 - DNA, 22 bp, Homo sapiens
tttatatgtttgtacaattaag

SEQ ID NO: 7603865 - DNA, 22 bp, Homo sapiens
tttatatgtttgtacaattaag

SEQ ID NO: 7603866 - DNA, 22 bp, Homo sapiens
tttatatgtttgtacaattaag

SEQ ID NO: 7603867 - DNA, 22 bp, Homo sapiens
ctcctggatcttagccagattc

SEQ ID NO: 7603868 - DNA, 22 bp, Homo sapiens
tttatatccatctttgaagtaa

SEQ ID NO: 7603869 - DNA, 22 bp, Homo sapiens
tttatatccatctttgaagtaa

SEQ ID NO: 7603870 - DNA, 22 bp, Homo sapiens
tttatatctggagttgctagga

SEQ ID NO: 7603871 - DNA, 22 bp, Homo sapiens
tttatatccatctttgaagtaa

SEQ ID NO: 7603872 - DNA, 22 bp, Homo sapiens
tttatatcttatgtcatttcaa

SEQ ID NO: 7603873 - DNA, 22 bp, Homo sapiens
tttatatcttatgtcatttcaa

SEQ ID NO: 7603874 - DNA, 22 bp, Homo sapiens
tttatatccatctttgaagtaa

SEQ ID NO: 7603875 - DNA, 22 bp, Homo sapiens
tttatatctggagttgctagga

SEQ ID NO: 7603876 - DNA, 22 bp, Homo sapiens
tttatatggttgactatgagtt

SEQ ID NO: 7603877 - DNA, 18 bp, Homo sapiens
tttatatggatagagacc

SEQ ID NO: 7603878 - DNA, 18 bp, Homo sapiens
tttatatggatagagacc

SEQ ID NO: 7603879 - DNA, 18 bp, Homo sapiens
tttatatggatagagacc

SEQ ID NO: 7603880 - DNA, 22 bp, Homo sapiens
tttatatgaaagtgaccagtgg

SEQ ID NO: 7603881 - DNA, 22 bp, Homo sapiens
tttatatgaaagtgaccagtgg

SEQ ID NO: 7603882 - DNA, 22 bp, Homo sapiens
ctcctggaggatagtgactggg

SEQ ID NO: 7603883 - DNA, 22 bp, Homo sapiens
ctcctggagcagcaggcgcagg

SEQ ID NO: 7603884 - DNA, 22 bp, Homo sapiens
ctcctggagcagcaggcgcagg

SEQ ID NO: 7603885 - DNA, 22 bp, Homo sapiens
ctcctggagcagcaggcgcagg

SEQ ID NO: 7603886 - DNA, 22 bp, Homo sapiens
ctcctggagcagcaggcgcagg

SEQ ID NO: 7603887 - DNA, 22 bp, Homo sapiens
ctcctggagcagcaggcgcagg

SEQ ID NO: 7603888 - DNA, 22 bp, Homo sapiens
ctcctggaccagggctattggg

SEQ ID NO: 7603889 - DNA, 22 bp, Homo sapiens
ctcctggaccaccttgtggcca

SEQ ID NO: 7603890 - DNA, 22 bp, Homo sapiens
ctcctggaccagggctattggg

SEQ ID NO: 7603891 - DNA, 22 bp, Homo sapiens
ctcctggacatggagcggagga

SEQ ID NO: 7603892 - DNA, 22 bp, Homo sapiens
ctcctggacatggagcggagga

SEQ ID NO: 7603893 - DNA, 22 bp, Homo sapiens
ctcctggaagcccgccctgctg

SEQ ID NO: 7603894 - DNA, 22 bp, Homo sapiens
ctcctggaagcccgccctgctg

SEQ ID NO: 7603895 - DNA, 22 bp, Homo sapiens
ctcctggaccaccttgtggcca

SEQ ID NO: 7603896 - DNA, 22 bp, Homo sapiens
ctcctggacatggagcggagga

SEQ ID NO: 7603897 - DNA, 22 bp, Homo sapiens
ctcctggacatggagcggagga

SEQ ID NO: 7603898 - DNA, 22 bp, Homo sapiens
ctcctggaggctccaagggaga

SEQ ID NO: 7603899 - DNA, 22 bp, Homo sapiens
ctcctggaggctccaagggaga

SEQ ID NO: 7603900 - DNA, 22 bp, Homo sapiens
ctcctggaggatagtgactggg

SEQ ID NO: 7603901 - DNA, 22 bp, Homo sapiens
ctcctggaggatagtgactggg

SEQ ID NO: 7603902 - DNA, 23 bp, Homo sapiens
ctcctggagggtccggccctgcc

SEQ ID NO: 7603903 - DNA, 23 bp, Homo sapiens
ctcctggagggtccggccctgcc

SEQ ID NO: 7603904 - DNA, 22 bp, Homo sapiens
ctcctggaggctccaagggaga

SEQ ID NO: 7603905 - DNA, 22 bp, Homo sapiens
ctcctggaggctccaagggaga

SEQ ID NO: 7603906 - DNA, 22 bp, Homo sapiens
ctcctggagggccaaagaaata

SEQ ID NO: 7603907 - DNA, 22 bp, Homo sapiens
ctcctggatcttagccagattc

SEQ ID NO: 7603908 - DNA, 22 bp, Homo sapiens
ctcctggatcttagccagattc

SEQ ID NO: 7603909 - DNA, 22 bp, Homo sapiens
ctcctggatgcaggctgtctgc

SEQ ID NO: 7603910 - DNA, 22 bp, Homo sapiens
ctcctggatcttagccagattc

SEQ ID NO: 7603911 - DNA, 23 bp, Homo sapiens
ctcctggagggtccggccctgcc

SEQ ID NO: 7603912 - DNA, 23 bp, Homo sapiens
ctcctggagggtccggccctgcc

SEQ ID NO: 7603913 - DNA, 23 bp, Homo sapiens
ctcctggagggtccggccctgcc

SEQ ID NO: 7603914 - DNA, 22 bp, Homo sapiens
ctcctggagtcctttcctattc

SEQ ID NO: 7603915 - DNA, 22 bp, Homo sapiens
ctcctggagtcctttcctattc

SEQ ID NO: 7603916 - DNA, 22 bp, Homo sapiens
ctctatttatggcatctttatg

SEQ ID NO: 7603917 - DNA, 22 bp, Homo sapiens
ctctcaaagaaattgcctgtca

SEQ ID NO: 7603918 - DNA, 22 bp, Homo sapiens
ctctcaaagaaattgcctgtca

SEQ ID NO: 7603919 - DNA, 22 bp, Homo sapiens
ctctatttttcttggctagtgt

SEQ ID NO: 7603920 - DNA, 22 bp, Homo sapiens
ctctatttatggcatctttatg

SEQ ID NO: 7603921 - DNA, 20 bp, Homo sapiens
ctctattattaatttcttaa

SEQ ID NO: 7603922 - DNA, 20 bp, Homo sapiens
ctctattattaatttcttaa

SEQ ID NO: 7603923 - DNA, 22 bp, Homo sapiens
ctctattagtctttgctaaata

SEQ ID NO: 7603924 - DNA, 22 bp, Homo sapiens
ctctatgttatgcagaattaag

SEQ ID NO: 7603925 - DNA, 22 bp, Homo sapiens
ctctagtgtagtgcaggaagga

SEQ ID NO: 7603926 - DNA, 22 bp, Homo sapiens
ctctatattctgaaacagttag

SEQ ID NO: 7603927 - DNA, 22 bp, Homo sapiens
ctctagtagctgagattacagg

SEQ ID NO: 7603928 - DNA, 22 bp, Homo sapiens
ctctagggtgcaggccccagga

SEQ ID NO: 7603929 - DNA, 22 bp, Homo sapiens
ctctagtgtagtgcaggaagga

SEQ ID NO: 7603930 - DNA, 19 bp, Homo sapiens
ctctagggtctaagggcag

SEQ ID NO: 7603931 - DNA, 22 bp, Homo sapiens
ctctaggggctggtcagcgtct

SEQ ID NO: 7603932 - DNA, 22 bp, Homo sapiens
ctctagggtgcaggccccagga

SEQ ID NO: 7603933 - DNA, 22 bp, Homo sapiens
ctctagggtgcaggccccagga

SEQ ID NO: 7603934 - DNA, 22 bp, Homo sapiens
ctctagggctctgtgaggttgg

SEQ ID NO: 7603935 - DNA, 22 bp, Homo sapiens
ctctagggaagaatgagagccc

SEQ ID NO: 7603936 - DNA, 22 bp, Homo sapiens
ctctagggaagaatgagagccc

SEQ ID NO: 7603937 - DNA, 20 bp, Homo sapiens
tttctcagaacagtggctgc

SEQ ID NO: 7603938 - DNA, 18 bp, Homo sapiens
tttctcagactctctttc

SEQ ID NO: 7603939 - DNA, 18 bp, Homo sapiens
tttctcagactctctttc

SEQ ID NO: 7603940 - DNA, 22 bp, Homo sapiens
tttctcacccaagagttatttt

SEQ ID NO: 7603941 - DNA, 22 bp, Homo sapiens
tttctcacccaagagttatttt

SEQ ID NO: 7603942 - DNA, 22 bp, Homo sapiens
tttctcacccaagagttatttt

SEQ ID NO: 7603943 - DNA, 20 bp, Homo sapiens
tttctcagaacagtggctgc

SEQ ID NO: 7603944 - DNA, 20 bp, Homo sapiens
tttctcagaacagtggctgc

SEQ ID NO: 7603945 - DNA, 20 bp, Homo sapiens
tttctcagaacagtggctgc

SEQ ID NO: 7603946 - DNA, 22 bp, Homo sapiens
tttctctattaggggctagctt

SEQ ID NO: 7603947 - DNA, 18 bp, Homo sapiens
tttctcagactctctttc

SEQ ID NO: 7603948 - DNA, 22 bp, Homo sapiens
tttctctagctattcattaaat

SEQ ID NO: 7603949 - DNA, 22 bp, Homo sapiens
tttctctattaggggctagctt

SEQ ID NO: 7603950 - DNA, 22 bp, Homo sapiens
tttctctcagcctgtagaaact

SEQ ID NO: 7603951 - DNA, 22 bp, Homo sapiens
tttctctcagcctgtagaaact

SEQ ID NO: 7603952 - DNA, 22 bp, Homo sapiens
ctctcaaatgtcattcctctat

SEQ ID NO: 7603953 - DNA, 22 bp, Homo sapiens
ctctcaaatgtcattcctctat

SEQ ID NO: 7603954 - DNA, 22 bp, Homo sapiens
ctctcaaatgtcattcctctat

SEQ ID NO: 7603955 - DNA, 22 bp, Homo sapiens
ctctcaaagtaaggtgtataca

SEQ ID NO: 7603956 - DNA, 22 bp, Homo sapiens
ctctcaaagtaaggtgtataca

SEQ ID NO: 7603957 - DNA, 20 bp, Homo sapiens
ctctcacagctccctcagcc

SEQ ID NO: 7603958 - DNA, 20 bp, Homo sapiens
ctctcacagctccctcagcc

SEQ ID NO: 7603959 - DNA, 21 bp, Homo sapiens
tttctcaccatggtatggaaa

SEQ ID NO: 7603960 - DNA, 22 bp, Homo sapiens
ctctagcttttgataccagtgt

SEQ ID NO: 7603961 - DNA, 22 bp, Homo sapiens
ctctagcttttgataccagtgt

SEQ ID NO: 7603962 - DNA, 22 bp, Homo sapiens
ctctagctgaggtcactgctat

SEQ ID NO: 7603963 - DNA, 22 bp, Homo sapiens
ctctaggccatccagggccatt

SEQ ID NO: 7603964 - DNA, 22 bp, Homo sapiens
ctctaggctgcccaggagctga

SEQ ID NO: 7603965 - DNA, 22 bp, Homo sapiens
ctctagggaagaatgagagccc

SEQ ID NO: 7603966 - DNA, 22 bp, Homo sapiens
ctctagcttttgataccagtgt

SEQ ID NO: 7603967 - DNA, 22 bp, Homo sapiens
ctctaggctgcccaggagctga

SEQ ID NO: 7603968 - DNA, 22 bp, Homo sapiens
ctctaggctgcccaggagctga

SEQ ID NO: 7603969 - DNA, 22 bp, Homo sapiens
ctctagagtacgggctggcatg

SEQ ID NO: 7603970 - DNA, 22 bp, Homo sapiens
ctctagacaacttgctgtgggt

SEQ ID NO: 7603971 - DNA, 22 bp, Homo sapiens
ctctagctgaggtcactgctat

SEQ ID NO: 7603972 - DNA, 22 bp, Homo sapiens
ctctagctgaggtcactgctat

SEQ ID NO: 7603973 - DNA, 22 bp, Homo sapiens
ctctagcagcagcccttcctta

SEQ ID NO: 7603974 - DNA, 18 bp, Homo sapiens
ctctagaatgggagattt

SEQ ID NO: 7603975 - DNA, 22 bp, Homo sapiens
ctctagaatgaattagcgcagg

SEQ ID NO: 7603976 - DNA, 22 bp, Homo sapiens
ctctagaatgaattagcgcagg

SEQ ID NO: 7603977 - DNA, 22 bp, Homo sapiens
ctctagaaggtctccctgccag

SEQ ID NO: 7603978 - DNA, 22 bp, Homo sapiens
ctctagaagctgaggggcccaa

SEQ ID NO: 7603979 - DNA, 22 bp, Homo sapiens
ctctagaactgattgggaagaa

SEQ ID NO: 7603980 - DNA, 22 bp, Homo sapiens
ctctagaacagtgctgagcctt

SEQ ID NO: 7603981 - DNA, 22 bp, Homo sapiens
ctctagaactgattgggaagaa

SEQ ID NO: 7603982 - DNA, 22 bp, Homo sapiens
ctctactgagagcagcagatat

SEQ ID NO: 7603983 - DNA, 21 bp, Homo sapiens
ctctagaaatcgaataacctt

SEQ ID NO: 7603984 - DNA, 22 bp, Homo sapiens
ctctagaaagattgttgaccaa

SEQ ID NO: 7603985 - DNA, 22 bp, Homo sapiens
ctctagaacagtgctgagcctt

SEQ ID NO: 7603986 - DNA, 21 bp, Homo sapiens
ctctagaaatcgaataacctt

SEQ ID NO: 7603987 - DNA, 22 bp, Homo sapiens
ctctactcttaacacagctagg

SEQ ID NO: 7603988 - DNA, 22 bp, Homo sapiens
ctctactcttaacacagctagg

SEQ ID NO: 7603989 - DNA, 22 bp, Homo sapiens
ctctactccaaaaggctacaat

SEQ ID NO: 7603990 - DNA, 22 bp, Homo sapiens
ctctaccttcctgtccactgaa

SEQ ID NO: 7603991 - DNA, 22 bp, Homo sapiens
ctctaccaggagtctccaccgt

SEQ ID NO: 7603992 - DNA, 22 bp, Homo sapiens
tttctctgccagttattttcct

SEQ ID NO: 7603993 - DNA, 23 bp, Homo sapiens
tttctctgagaagcagttctcta

SEQ ID NO: 7603994 - DNA, 22 bp, Homo sapiens
tttctctgagttgttacaaaac

SEQ ID NO: 7603995 - DNA, 22 bp, Homo sapiens
tttctctgagttgttacaaaac

SEQ ID NO: 7603996 - DNA, 22 bp, Homo sapiens
tttctctgcagagccccaagga

SEQ ID NO: 7603997 - DNA, 22 bp, Homo sapiens
tttctctgcagagccccaagga

SEQ ID NO: 7603998 - DNA, 22 bp, Homo sapiens
tttctctgcagagccccaagga

SEQ ID NO: 7603999 - DNA, 22 bp, Homo sapiens
tttctctggcattaggtataaa

SEQ ID NO: 7604000 - DNA, 22 bp, Homo sapiens
tttctctggcctcagtttaaca

SEQ ID NO: 7604001 - DNA, 22 bp, Homo sapiens
tttctctggcctcagtttaaca

SEQ ID NO: 7604002 - DNA, 22 bp, Homo sapiens
ctctctggaagggggagctgat

SEQ ID NO: 7604003 - DNA, 22 bp, Homo sapiens
tttctctggcctcagtttaaca

SEQ ID NO: 7604004 - DNA, 22 bp, Homo sapiens
tttctctggcctcagtttaaca

SEQ ID NO: 7604005 - DNA, 20 bp, Homo sapiens
ctctctggaaggtgggagcc

SEQ ID NO: 7604006 - DNA, 20 bp, Homo sapiens
ctctctggaaggtgggagcc

SEQ ID NO: 7604007 - DNA, 20 bp, Homo sapiens
ctctctggaaggtgggagcc

SEQ ID NO: 7604008 - DNA, 22 bp, Homo sapiens
ctctctggaattaaagcccaat

SEQ ID NO: 7604009 - DNA, 22 bp, Homo sapiens
ctctctggaattaaagcccaat

SEQ ID NO: 7604010 - DNA, 22 bp, Homo sapiens
ctctctggaattaaagcccaat

SEQ ID NO: 7604011 - DNA, 20 bp, Homo sapiens
ctctctggaaggtgggagcc

SEQ ID NO: 7604012 - DNA, 20 bp, Homo sapiens
ctctctggaaggtgggagcc

SEQ ID NO: 7604013 - DNA, 22 bp, Homo sapiens
ctctctggaattaaagcccaat

SEQ ID NO: 7604014 - DNA, 22 bp, Homo sapiens
ctctctggacctcaactatttt

SEQ ID NO: 7604015 - DNA, 22 bp, Homo sapiens
ctctctggacttgagtatcagc

SEQ ID NO: 7604016 - DNA, 22 bp, Homo sapiens
ctctctggacttgagtatcagc

SEQ ID NO: 7604017 - DNA, 22 bp, Homo sapiens
ctctctggacttgagtatcagc

SEQ ID NO: 7604018 - DNA, 22 bp, Homo sapiens
ctctctggacttgagtatcagc

SEQ ID NO: 7604019 - DNA, 22 bp, Homo sapiens
ctctctggacttgagtatcagc

SEQ ID NO: 7604020 - DNA, 22 bp, Homo sapiens
ctctctggacttgagtatcagc

SEQ ID NO: 7604021 - DNA, 22 bp, Homo sapiens
tttctctcagcctgtagaaact

SEQ ID NO: 7604022 - DNA, 22 bp, Homo sapiens
tttctctccccaagtggaattg

SEQ ID NO: 7604023 - DNA, 22 bp, Homo sapiens
tttctctcagcctgtagaaact

SEQ ID NO: 7604024 - DNA, 22 bp, Homo sapiens
tttctctcagcctgtagaaact

SEQ ID NO: 7604025 - DNA, 18 bp, Homo sapiens
tttctcagactctctttc

SEQ ID NO: 7604026 - DNA, 19 bp, Homo sapiens
tttctctccctcatcccga

SEQ ID NO: 7604027 - DNA, 19 bp, Homo sapiens
tttctctccctcatcccga

SEQ ID NO: 7604028 - DNA, 22 bp, Homo sapiens
tttctctccccaagtggaattg

SEQ ID NO: 7604029 - DNA, 22 bp, Homo sapiens
tttctctccccaagtggaattg

SEQ ID NO: 7604030 - DNA, 22 bp, Homo sapiens
tttctctcagcctgtagaaact

SEQ ID NO: 7604031 - DNA, 22 bp, Homo sapiens
tttctctctacagtactttcat

SEQ ID NO: 7604032 - DNA, 22 bp, Homo sapiens
tttctctctacagtactttcat

SEQ ID NO: 7604033 - DNA, 22 bp, Homo sapiens
tttctctctacagtactttcat

SEQ ID NO: 7604034 - DNA, 19 bp, Homo sapiens
tttctctccctcatcccga

SEQ ID NO: 7604035 - DNA, 19 bp, Homo sapiens
tttctctccctcatcccga

SEQ ID NO: 7604036 - DNA, 23 bp, Homo sapiens
tttctctgagaagcagttctcta

SEQ ID NO: 7604037 - DNA, 23 bp, Homo sapiens
tttctctgagaagcagttctcta

SEQ ID NO: 7604038 - DNA, 22 bp, Homo sapiens
tttctctcttaaggagtttaaa

SEQ ID NO: 7604039 - DNA, 23 bp, Homo sapiens
tttctctgagaagcagttctcta

SEQ ID NO: 7604040 - DNA, 23 bp, Homo sapiens
tttctctgagaagcagttctcta

SEQ ID NO: 7604041 - DNA, 22 bp, Homo sapiens
tttctctctggccctgattgtc

SEQ ID NO: 7604042 - DNA, 22 bp, Homo sapiens
tttctctcttaaggagtttaaa

SEQ ID NO: 7604043 - DNA, 22 bp, Homo sapiens
tttctctctggccctgattgtc

SEQ ID NO: 7604044 - DNA, 16 bp, Homo sapiens
tttctctctgctattt

SEQ ID NO: 7604045 - DNA, 22 bp, Homo sapiens
tttctctcttaaggagtttaaa

SEQ ID NO: 7604046 - DNA, 22 bp, Homo sapiens
tttctctctacagtactttcat

SEQ ID NO: 7604047 - DNA, 22 bp, Homo sapiens
tttctctctatttagacaggta

SEQ ID NO: 7604048 - DNA, 22 bp, Homo sapiens
tttctctctatttagacaggta

SEQ ID NO: 7604049 - DNA, 22 bp, Homo sapiens
tttctctctatttagacaggta

SEQ ID NO: 7604050 - DNA, 22 bp, Homo sapiens
tttctctctgactgggagctga

SEQ ID NO: 7604051 - DNA, 22 bp, Homo sapiens
tttctctctggccctgattgtc

SEQ ID NO: 7604052 - DNA, 22 bp, Homo sapiens
tttctctctggccctgattgtc

SEQ ID NO: 7604053 - DNA, 22 bp, Homo sapiens
ctctgaggtcagggcccggcaa

SEQ ID NO: 7604054 - DNA, 20 bp, Homo sapiens
ctctgaggtatctgtaaagt

SEQ ID NO: 7604055 - DNA, 22 bp, Homo sapiens
ctctgaggtcagggcccggcaa

SEQ ID NO: 7604056 - DNA, 22 bp, Homo sapiens
ctctgaggtcagggcccggcaa

SEQ ID NO: 7604057 - DNA, 22 bp, Homo sapiens
ctctgaggtcagggcccggcaa

SEQ ID NO: 7604058 - DNA, 22 bp, Homo sapiens
ctctgagggtctaaggagtcac

SEQ ID NO: 7604059 - DNA, 22 bp, Homo sapiens
ctctgagggtctaaggagtcac

SEQ ID NO: 7604060 - DNA, 22 bp, Homo sapiens
ctctgagggtctaaggagtcac

SEQ ID NO: 7604061 - DNA, 22 bp, Homo sapiens
ctctgaggtcctacagtgaccc

SEQ ID NO: 7604062 - DNA, 22 bp, Homo sapiens
ctctgaggtcctacagtgaccc

SEQ ID NO: 7604063 - DNA, 22 bp, Homo sapiens
ctctgaggtcctacagtgaccc

SEQ ID NO: 7604064 - DNA, 22 bp, Homo sapiens
ctctgaggtcctacagtgaccc

SEQ ID NO: 7604065 - DNA, 22 bp, Homo sapiens
ctctgaggtcagggcccggcaa

SEQ ID NO: 7604066 - DNA, 22 bp, Homo sapiens
ctctgagggctcgagggacgcg

SEQ ID NO: 7604067 - DNA, 22 bp, Homo sapiens
ctctgagggctcgagggacgcg

SEQ ID NO: 7604068 - DNA, 22 bp, Homo sapiens
ctctgagggctcgagggacgcg

SEQ ID NO: 7604069 - DNA, 22 bp, Homo sapiens
ctctgagggctcgagggacgcg

SEQ ID NO: 7604070 - DNA, 22 bp, Homo sapiens
ctctgagggctcgagggacgcg

SEQ ID NO: 7604071 - DNA, 22 bp, Homo sapiens
ctctgagggtctaaggagtcac

SEQ ID NO: 7604072 - DNA, 22 bp, Homo sapiens
ctctgagggtctaaggagtcac

SEQ ID NO: 7604073 - DNA, 22 bp, Homo sapiens
ctctgagggtctaaggagtcac

SEQ ID NO: 7604074 - DNA, 22 bp, Homo sapiens
ctctgagggtctaaggagtcac

SEQ ID NO: 7604075 - DNA, 22 bp, Homo sapiens
ctctgagggctgtcaggaaagg

SEQ ID NO: 7604076 - DNA, 22 bp, Homo sapiens
ctctgagggctcgagggacgcg

SEQ ID NO: 7604077 - DNA, 22 bp, Homo sapiens
ctctgaggcttgttctatgtat

SEQ ID NO: 7604078 - DNA, 20 bp, Homo sapiens
ctctgaggctgagaagggag

SEQ ID NO: 7604079 - DNA, 20 bp, Homo sapiens
ctctgaggctgagaagggag

SEQ ID NO: 7604080 - DNA, 20 bp, Homo sapiens
ctctgaggctgagaagggag

SEQ ID NO: 7604081 - DNA, 22 bp, Homo sapiens
ctctgaggctccatgcaggctt

SEQ ID NO: 7604082 - DNA, 22 bp, Homo sapiens
ctctgaggctccatgcaggctt

SEQ ID NO: 7604083 - DNA, 22 bp, Homo sapiens
ctctgaggctccatgcaggctt

SEQ ID NO: 7604084 - DNA, 22 bp, Homo sapiens
ctctgaggctccatgcaggctt

SEQ ID NO: 7604085 - DNA, 22 bp, Homo sapiens
ctctgaggagaaagagcttggt

SEQ ID NO: 7604086 - DNA, 22 bp, Homo sapiens
ctctgaggagaaagagcttggt

SEQ ID NO: 7604087 - DNA, 22 bp, Homo sapiens
ctctgagctttgcagcccctgg

SEQ ID NO: 7604088 - DNA, 22 bp, Homo sapiens
ctctgaggaagtcaagtagcca

SEQ ID NO: 7604089 - DNA, 22 bp, Homo sapiens
ctctgaggctccatgcaggctt

SEQ ID NO: 7604090 - DNA, 22 bp, Homo sapiens
ctctgaggctccatgcaggctt

SEQ ID NO: 7604091 - DNA, 19 bp, Homo sapiens
ctctgaggattagctgtgg

SEQ ID NO: 7604092 - DNA, 19 bp, Homo sapiens
ctctgaggattagctgtgg

SEQ ID NO: 7604093 - DNA, 22 bp, Homo sapiens
ctctgagctttgcagcccctgg

SEQ ID NO: 7604094 - DNA, 22 bp, Homo sapiens
ctctgagctttgcagcccctgg

SEQ ID NO: 7604095 - DNA, 22 bp, Homo sapiens
ctctgagcttagtgaaatgata

SEQ ID NO: 7604096 - DNA, 22 bp, Homo sapiens
ctctgagctgaaacatgagcat

SEQ ID NO: 7604097 - DNA, 22 bp, Homo sapiens
ctctgagctgccttttgagctt

SEQ ID NO: 7604098 - DNA, 22 bp, Homo sapiens
ctctgagctgtgggaaatgaga

SEQ ID NO: 7604099 - DNA, 22 bp, Homo sapiens
ctctctggatatttgtatgctg

SEQ ID NO: 7604100 - DNA, 22 bp, Homo sapiens
ctctctggatatttgtatgctg

SEQ ID NO: 7604101 - DNA, 22 bp, Homo sapiens
ctctctggcacttcattgctgt

SEQ ID NO: 7604102 - DNA, 22 bp, Homo sapiens
ctctctggcacttcattgctgt

SEQ ID NO: 7604103 - DNA, 22 bp, Homo sapiens
ctctctggatatttgtatgctg

SEQ ID NO: 7604104 - DNA, 22 bp, Homo sapiens
ctctctggatatttgtatgctg

SEQ ID NO: 7604105 - DNA, 22 bp, Homo sapiens
ctctctggcacttcattgctgt

SEQ ID NO: 7604106 - DNA, 22 bp, Homo sapiens
ctctctggcacttcattgctgt

SEQ ID NO: 7604107 - DNA, 22 bp, Homo sapiens
ctctctggcccatcctgttgcc

SEQ ID NO: 7604108 - DNA, 22 bp, Homo sapiens
ctctctggcccatcctgttgcc

SEQ ID NO: 7604109 - DNA, 22 bp, Homo sapiens
ctctctggcccatcctgttgcc

SEQ ID NO: 7604110 - DNA, 22 bp, Homo sapiens
ctctgacagccttcattatgca

SEQ ID NO: 7604111 - DNA, 22 bp, Homo sapiens
ctctgacagccttcattatgca

SEQ ID NO: 7604112 - DNA, 22 bp, Homo sapiens
ctctctggcacttcattgctgt

SEQ ID NO: 7604113 - DNA, 22 bp, Homo sapiens
ctctctggcacttcattgctgt

SEQ ID NO: 7604114 - DNA, 22 bp, Homo sapiens
ctctctggcacttcattgctgt

SEQ ID NO: 7604115 - DNA, 22 bp, Homo sapiens
ctctctggcccatcctgttgcc

SEQ ID NO: 7604116 - DNA, 22 bp, Homo sapiens
ctctgagctgaaacatgagcat

SEQ ID NO: 7604117 - DNA, 22 bp, Homo sapiens
ctctgagctgaaacatgagcat

SEQ ID NO: 7604118 - DNA, 22 bp, Homo sapiens
ctctgagctgaaacatgagcat

SEQ ID NO: 7604119 - DNA, 22 bp, Homo sapiens
ctctgagctgaaacatgagcat

SEQ ID NO: 7604120 - DNA, 22 bp, Homo sapiens
ctctgagctgaaacatgagcat

SEQ ID NO: 7604121 - DNA, 22 bp, Homo sapiens
ctctgagctgaaacatgagcat

SEQ ID NO: 7604122 - DNA, 22 bp, Homo sapiens
ctctgagctgaaacatgagcat

SEQ ID NO: 7604123 - DNA, 22 bp, Homo sapiens
ctctgagctcgtgcagtacttc

SEQ ID NO: 7604124 - DNA, 22 bp, Homo sapiens
ctctgacagccttcattatgca

SEQ ID NO: 7604125 - DNA, 22 bp, Homo sapiens
ctctgagctcgtgcagtacttc

SEQ ID NO: 7604126 - DNA, 22 bp, Homo sapiens
ctctgagctcgtgcagtacttc

SEQ ID NO: 7604127 - DNA, 22 bp, Homo sapiens
ctctgagctcgtgcagtacttc

SEQ ID NO: 7604128 - DNA, 22 bp, Homo sapiens
ctctgagctcctggaagcgtgc

SEQ ID NO: 7604129 - DNA, 22 bp, Homo sapiens
ctctgacaggtggcattatctc

SEQ ID NO: 7604130 - DNA, 22 bp, Homo sapiens
ctctgagctcctaggtaaaact

SEQ ID NO: 7604131 - DNA, 22 bp, Homo sapiens
ctctgagctcctaggtaaaact

SEQ ID NO: 7604132 - DNA, 22 bp, Homo sapiens
ctctgacagccttcattatgca

SEQ ID NO: 7604133 - DNA, 22 bp, Homo sapiens
ctctgacagccacatagaggct

SEQ ID NO: 7604134 - DNA, 22 bp, Homo sapiens
ctctgacagccttcattatgca

SEQ ID NO: 7604135 - DNA, 22 bp, Homo sapiens
tttctgtttagcataaagtggc

SEQ ID NO: 7604136 - DNA, 22 bp, Homo sapiens
tttctgtttagcataaagtggc

SEQ ID NO: 7604137 - DNA, 22 bp, Homo sapiens
tttctgtttagcataaagtggc

SEQ ID NO: 7604138 - DNA, 22 bp, Homo sapiens
tttctgtttagcataaagtggc

SEQ ID NO: 7604139 - DNA, 19 bp, Homo sapiens
tttctgtttgcttctggtt

SEQ ID NO: 7604140 - DNA, 19 bp, Homo sapiens
tttctgtttgcttctggtt

SEQ ID NO: 7604141 - DNA, 19 bp, Homo sapiens
tttctgtttgcttctggtt

SEQ ID NO: 7604142 - DNA, 22 bp, Homo sapiens
tttctgttgttggtgtctggct

SEQ ID NO: 7604143 - DNA, 22 bp, Homo sapiens
tttctgttgttggtgtctggct

SEQ ID NO: 7604144 - DNA, 22 bp, Homo sapiens
tttctgttgtatggcttctgca

SEQ ID NO: 7604145 - DNA, 22 bp, Homo sapiens
tttctgcatctctacagttgtt

SEQ ID NO: 7604146 - DNA, 22 bp, Homo sapiens
tttctgttgtatggcttctgca

SEQ ID NO: 7604147 - DNA, 22 bp, Homo sapiens
tttctgttgtatggcttctgca

SEQ ID NO: 7604148 - DNA, 22 bp, Homo sapiens
tttctgcagtctctcagaagcc

SEQ ID NO: 7604149 - DNA, 22 bp, Homo sapiens
tttctgcatatgtatgtatgga

SEQ ID NO: 7604150 - DNA, 22 bp, Homo sapiens
tttctgcagtctctcagaagcc

SEQ ID NO: 7604151 - DNA, 19 bp, Homo sapiens
tttctgcagcccagcagca

SEQ ID NO: 7604152 - DNA, 22 bp, Homo sapiens
tttctgcatatgtatgtatgga

SEQ ID NO: 7604153 - DNA, 22 bp, Homo sapiens
tttctgttgtacttaaactagg

SEQ ID NO: 7604154 - DNA, 22 bp, Homo sapiens
tttctgcagcagactcagtgtg

SEQ ID NO: 7604155 - DNA, 19 bp, Homo sapiens
tttctgcagcccagcagca

SEQ ID NO: 7604156 - DNA, 20 bp, Homo sapiens
tttctgcagatgtttacatg

SEQ ID NO: 7604157 - DNA, 20 bp, Homo sapiens
tttctgcagatgtttacatg

SEQ ID NO: 7604158 - DNA, 20 bp, Homo sapiens
tttctgcagatgtttacatg

SEQ ID NO: 7604159 - DNA, 22 bp, Homo sapiens
tttctgcaaacttccacgtctc

SEQ ID NO: 7604160 - DNA, 22 bp, Homo sapiens
tttctgcaggtattgcataagt

SEQ ID NO: 7604161 - DNA, 22 bp, Homo sapiens
tttctgcaggtattgcataagt

SEQ ID NO: 7604162 - DNA, 20 bp, Homo sapiens
tttctgcagggagctgggct

SEQ ID NO: 7604163 - DNA, 22 bp, Homo sapiens
tttctgcaggtattgcataagt

SEQ ID NO: 7604164 - DNA, 19 bp, Homo sapiens
tttctgcagcccagcagca

SEQ ID NO: 7604165 - DNA, 20 bp, Homo sapiens
tttctgcagatgtttacatg

SEQ ID NO: 7604166 - DNA, 19 bp, Homo sapiens
tttctgcagctcagagaag

SEQ ID NO: 7604167 - DNA, 19 bp, Homo sapiens
tttctgcagctcagagaag

SEQ ID NO: 7604168 - DNA, 22 bp, Homo sapiens
ctctgaggtccttcccagctct

SEQ ID NO: 7604169 - DNA, 22 bp, Homo sapiens
ctctgaggtccttcccagctct

SEQ ID NO: 7604170 - DNA, 22 bp, Homo sapiens
ctctgaggtccttcccagctct

SEQ ID NO: 7604171 - DNA, 22 bp, Homo sapiens
ctctgaggtcctacagtgaccc

SEQ ID NO: 7604172 - DNA, 22 bp, Homo sapiens
ctctgaggtcctacagtgaccc

SEQ ID NO: 7604173 - DNA, 22 bp, Homo sapiens
ctctgaggtctaggaccatggc

SEQ ID NO: 7604174 - DNA, 22 bp, Homo sapiens
tttctgataattttgtgaaatc

SEQ ID NO: 7604175 - DNA, 22 bp, Homo sapiens
tttctgataattttgtgaaatc

SEQ ID NO: 7604176 - DNA, 22 bp, Homo sapiens
ctctgaggtctaggaccatggc

SEQ ID NO: 7604177 - DNA, 22 bp, Homo sapiens
ctctgaggtctaggaccatggc

SEQ ID NO: 7604178 - DNA, 22 bp, Homo sapiens
tttctgatattcatttagaaga

SEQ ID NO: 7604179 - DNA, 22 bp, Homo sapiens
tttctgatattcatttagaaga

SEQ ID NO: 7604180 - DNA, 22 bp, Homo sapiens
tttctgatatactgtagaatcc

SEQ ID NO: 7604181 - DNA, 22 bp, Homo sapiens
tttctgatattcatttagaaga

SEQ ID NO: 7604182 - DNA, 22 bp, Homo sapiens
tttctgatattcatttagaaga

SEQ ID NO: 7604183 - DNA, 22 bp, Homo sapiens
tttctgatattcatttagaaga

SEQ ID NO: 7604184 - DNA, 22 bp, Homo sapiens
tttctgatttgacttgaagtat

SEQ ID NO: 7604185 - DNA, 22 bp, Homo sapiens
tttctgcaaacttccacgtctc

SEQ ID NO: 7604186 - DNA, 22 bp, Homo sapiens
tttctgcaaaatctaagttaga

SEQ ID NO: 7604187 - DNA, 22 bp, Homo sapiens
tttctgcaaaatctaagttaga

SEQ ID NO: 7604188 - DNA, 22 bp, Homo sapiens
tttctgcaaaataaatagtgac

SEQ ID NO: 7604189 - DNA, 22 bp, Homo sapiens
tttctgcacatttctaaagttg

SEQ ID NO: 7604190 - DNA, 22 bp, Homo sapiens
tttctgcacatttctaaagttg

SEQ ID NO: 7604191 - DNA, 22 bp, Homo sapiens
tttctgcacatttctaaagttg

SEQ ID NO: 7604192 - DNA, 21 bp, Homo sapiens
tttctgcaatgcacgttgagg

SEQ ID NO: 7604193 - DNA, 22 bp, Homo sapiens
tttctgcaagtgtagataccca

SEQ ID NO: 7604194 - DNA, 22 bp, Homo sapiens
tttctgcaacgagtctttgact

SEQ ID NO: 7604195 - DNA, 22 bp, Homo sapiens
tttctgcaagtgtagataccca

SEQ ID NO: 7604196 - DNA, 22 bp, Homo sapiens
tttctgcaagtgtagataccca

SEQ ID NO: 7604197 - DNA, 22 bp, Homo sapiens
tttctgcaagtgtagataccca

SEQ ID NO: 7604198 - DNA, 22 bp, Homo sapiens
tttctgcaacgagtctttgact

SEQ ID NO: 7604199 - DNA, 22 bp, Homo sapiens
tttctgcaacgagtctttgact

SEQ ID NO: 7604200 - DNA, 22 bp, Homo sapiens
tttgaagtcaaagattgattcc

SEQ ID NO: 7604201 - DNA, 22 bp, Homo sapiens
tttgaagtcaaagattgattcc

SEQ ID NO: 7604202 - DNA, 22 bp, Homo sapiens
tttgaagtacctggttctgact

SEQ ID NO: 7604203 - DNA, 20 bp, Homo sapiens
ctctgctttaggagagtcag

SEQ ID NO: 7604204 - DNA, 22 bp, Homo sapiens
tttgaagggcacgacaatagtt

SEQ ID NO: 7604205 - DNA, 22 bp, Homo sapiens
tttgaagggcacgacaatagtt

SEQ ID NO: 7604206 - DNA, 22 bp, Homo sapiens
tttgaagggcacgacaatagtt

SEQ ID NO: 7604207 - DNA, 22 bp, Homo sapiens
ctctgcttgtgtcaggcatgct

SEQ ID NO: 7604208 - DNA, 22 bp, Homo sapiens
ctctgcttgtgtcaggcatgct

SEQ ID NO: 7604209 - DNA, 20 bp, Homo sapiens
ctctgctttaggagagtcag

SEQ ID NO: 7604210 - DNA, 23 bp, Homo sapiens
tttgaagcattttgtatcttagt

SEQ ID NO: 7604211 - DNA, 18 bp, Homo sapiens
tttgaaggatggcctgga

SEQ ID NO: 7604212 - DNA, 22 bp, Homo sapiens
tttgaagtgtatgaaaatacag

SEQ ID NO: 7604213 - DNA, 22 bp, Homo sapiens
tttgaagtgggcattagaacct

SEQ ID NO: 7604214 - DNA, 22 bp, Homo sapiens
tttgaagtggaaaaggatttaa

SEQ ID NO: 7604215 - DNA, 22 bp, Homo sapiens
tttgaagtgctctggtgatctg

SEQ ID NO: 7604216 - DNA, 22 bp, Homo sapiens
tttgaagtgcctcttgtggatt

SEQ ID NO: 7604217 - DNA, 22 bp, Homo sapiens
tttgaagtggatcccttcagtg

SEQ ID NO: 7604218 - DNA, 22 bp, Homo sapiens
tttgaagtcaggctttctaccc

SEQ ID NO: 7604219 - DNA, 22 bp, Homo sapiens
tttgaagtcagatggtctgagt

SEQ ID NO: 7604220 - DNA, 22 bp, Homo sapiens
tttgaagtcagacactgctttg

SEQ ID NO: 7604221 - DNA, 22 bp, Homo sapiens
tttgaagtgcctcttgtggatt

SEQ ID NO: 7604222 - DNA, 22 bp, Homo sapiens
tttgaagtgcaatgaggattct

SEQ ID NO: 7604223 - DNA, 22 bp, Homo sapiens
ctctggagcatttcacctacat

SEQ ID NO: 7604224 - DNA, 22 bp, Homo sapiens
ctctggagcatttcacctacat

SEQ ID NO: 7604225 - DNA, 22 bp, Homo sapiens
ctctggagcatttcacctacat

SEQ ID NO: 7604226 - DNA, 22 bp, Homo sapiens
ctctggagcatttcacctacat

SEQ ID NO: 7604227 - DNA, 22 bp, Homo sapiens
ctctggagcatttcacctacat

SEQ ID NO: 7604228 - DNA, 22 bp, Homo sapiens
ctctggagcgctgcttcccgcg

SEQ ID NO: 7604229 - DNA, 22 bp, Homo sapiens
ctctggagcgctgcttcccgcg

SEQ ID NO: 7604230 - DNA, 22 bp, Homo sapiens
ctctggagcgctgcttcccgcg

SEQ ID NO: 7604231 - DNA, 22 bp, Homo sapiens
ctctggaattgacctgggaggg

SEQ ID NO: 7604232 - DNA, 22 bp, Homo sapiens
ctctggaattgacctgggaggg

SEQ ID NO: 7604233 - DNA, 22 bp, Homo sapiens
ctctggaattgacctgggaggg

SEQ ID NO: 7604234 - DNA, 19 bp, Homo sapiens
ctctggagcagacactgga

SEQ ID NO: 7604235 - DNA, 19 bp, Homo sapiens
ctctggagcagacactgga

SEQ ID NO: 7604236 - DNA, 19 bp, Homo sapiens
ctctggagcagacactgga

SEQ ID NO: 7604237 - DNA, 22 bp, Homo sapiens
ctctggaattgacctgggaggg

SEQ ID NO: 7604238 - DNA, 22 bp, Homo sapiens
tttgaataaacggttaatgttc

SEQ ID NO: 7604239 - DNA, 22 bp, Homo sapiens
tttgaataatcactgggcatta

SEQ ID NO: 7604240 - DNA, 22 bp, Homo sapiens
tttgaataaacggttaatgttc

SEQ ID NO: 7604241 - DNA, 22 bp, Homo sapiens
tttgaataaacggttaatgttc

SEQ ID NO: 7604242 - DNA, 22 bp, Homo sapiens
tttgaataatcactgggcatta

SEQ ID NO: 7604243 - DNA, 22 bp, Homo sapiens
tttgaataaacggttaatgttc

SEQ ID NO: 7604244 - DNA, 22 bp, Homo sapiens
tttgaagttcccccatatcaga

SEQ ID NO: 7604245 - DNA, 22 bp, Homo sapiens
tttgaagtgtatgaaaatacag

SEQ ID NO: 7604246 - DNA, 22 bp, Homo sapiens
tttgaagtgttatttctatcac

SEQ ID NO: 7604247 - DNA, 22 bp, Homo sapiens
tttgaagtgttatttctatcac

SEQ ID NO: 7604248 - DNA, 19 bp, Homo sapiens
ctctggagtcattgctccc

SEQ ID NO: 7604249 - DNA, 19 bp, Homo sapiens
ctctggagtcattgctccc

SEQ ID NO: 7604250 - DNA, 22 bp, Homo sapiens
ctctggagtcctgtatcactcc

SEQ ID NO: 7604251 - DNA, 19 bp, Homo sapiens
ctctggagtcattgctccc

SEQ ID NO: 7604252 - DNA, 19 bp, Homo sapiens
ctctggagtcattgctccc

SEQ ID NO: 7604253 - DNA, 22 bp, Homo sapiens
ctctggagtcaggcagccctgg

SEQ ID NO: 7604254 - DNA, 22 bp, Homo sapiens
ctctggagtcaggcagccctgg

SEQ ID NO: 7604255 - DNA, 21 bp, Homo sapiens
ctctggagtcaagagcttcca

SEQ ID NO: 7604256 - DNA, 22 bp, Homo sapiens
ctctggagtcaggcagccctgg

SEQ ID NO: 7604257 - DNA, 22 bp, Homo sapiens
ctctggagtcaggcagccctgg

SEQ ID NO: 7604258 - DNA, 22 bp, Homo sapiens
ctctggagtcaggcagccctgg

SEQ ID NO: 7604259 - DNA, 21 bp, Homo sapiens
ctctggagtcaagagcttcca

SEQ ID NO: 7604260 - DNA, 22 bp, Homo sapiens
ctctggagtaagagctatgaaa

SEQ ID NO: 7604261 - DNA, 22 bp, Homo sapiens
ctctggagtaagagctatgaaa

SEQ ID NO: 7604262 - DNA, 21 bp, Homo sapiens
ctctggagtcaagagcttcca

SEQ ID NO: 7604263 - DNA, 21 bp, Homo sapiens
ctctggagtcaagagcttcca

SEQ ID NO: 7604264 - DNA, 21 bp, Homo sapiens
ctctggagtcaagagcttcca

SEQ ID NO: 7604265 - DNA, 22 bp, Homo sapiens
ctctggagtaagagctatgaaa

SEQ ID NO: 7604266 - DNA, 22 bp, Homo sapiens
ctctggaggttgagcccagcaa

SEQ ID NO: 7604267 - DNA, 22 bp, Homo sapiens
ctctggagtaagagctatgaaa

SEQ ID NO: 7604268 - DNA, 22 bp, Homo sapiens
ctctggaggtggaggttgcagt

SEQ ID NO: 7604269 - DNA, 22 bp, Homo sapiens
ctctggaggttgagcccagcaa

SEQ ID NO: 7604270 - DNA, 22 bp, Homo sapiens
ctctggaggttgagcccagcaa

SEQ ID NO: 7604271 - DNA, 22 bp, Homo sapiens
ctctggaggttgagcccagcaa

SEQ ID NO: 7604272 - DNA, 22 bp, Homo sapiens
ctctggaggtggaggttgcagt

SEQ ID NO: 7604273 - DNA, 22 bp, Homo sapiens
ctctggaggtggaggttgcagt

SEQ ID NO: 7604274 - DNA, 22 bp, Homo sapiens
ctctggaggtggaggttgcagt

SEQ ID NO: 7604275 - DNA, 22 bp, Homo sapiens
ctctggaggtcaggtgtggtgg

SEQ ID NO: 7604276 - DNA, 22 bp, Homo sapiens
ctctggaggtcaggtgtggtgg

SEQ ID NO: 7604277 - DNA, 22 bp, Homo sapiens
ctctggagggaggctgagctgg

SEQ ID NO: 7604278 - DNA, 22 bp, Homo sapiens
ctctggaggtcaggtgtggtgg

SEQ ID NO: 7604279 - DNA, 22 bp, Homo sapiens
ctctggaggtcaggtgtggtgg

SEQ ID NO: 7604280 - DNA, 21 bp, Homo sapiens
ctctggaggcaagggagagtg

SEQ ID NO: 7604281 - DNA, 21 bp, Homo sapiens
ctctggaggcaagggagagtg

SEQ ID NO: 7604282 - DNA, 21 bp, Homo sapiens
ctctggaggcaagggagagtg

SEQ ID NO: 7604283 - DNA, 21 bp, Homo sapiens
ctctggaggcaagggagagtg

SEQ ID NO: 7604284 - DNA, 21 bp, Homo sapiens
ctctggaggcaagggagagtg

SEQ ID NO: 7604285 - DNA, 21 bp, Homo sapiens
ctctggaggcaagggagagtg

SEQ ID NO: 7604286 - DNA, 22 bp, Homo sapiens
ctctggaggcagcaccagccag

SEQ ID NO: 7604287 - DNA, 22 bp, Homo sapiens
ctctggaggcagcaccagccag

SEQ ID NO: 7604288 - DNA, 22 bp, Homo sapiens
ctctggaggcagcaccagccag

SEQ ID NO: 7604289 - DNA, 22 bp, Homo sapiens
ctctggaggccgttggccctta

SEQ ID NO: 7604290 - DNA, 22 bp, Homo sapiens
ctctggaggccgttggccctta

SEQ ID NO: 7604291 - DNA, 22 bp, Homo sapiens
ctctggaggccgttggccctta

SEQ ID NO: 7604292 - DNA, 22 bp, Homo sapiens
ctctggaggcagcaccagccag

SEQ ID NO: 7604293 - DNA, 22 bp, Homo sapiens
ctctggaggccgttggccctta

SEQ ID NO: 7604294 - DNA, 22 bp, Homo sapiens
ctctggaggccgttggccctta

SEQ ID NO: 7604295 - DNA, 22 bp, Homo sapiens
ctctggaggcctaaggaagtgg

SEQ ID NO: 7604296 - DNA, 22 bp, Homo sapiens
ctctggaggcctaaggaagtgg

SEQ ID NO: 7604297 - DNA, 19 bp, Homo sapiens
ctctggagggaccgccgtt

SEQ ID NO: 7604298 - DNA, 19 bp, Homo sapiens
ctctggagggaccgccgtt

SEQ ID NO: 7604299 - DNA, 22 bp, Homo sapiens
ctctggaggcctaaggaagtgg

SEQ ID NO: 7604300 - DNA, 22 bp, Homo sapiens
ctctggaggccgttggccctta

SEQ ID NO: 7604301 - DNA, 22 bp, Homo sapiens
ctctggaggcctaaggaagtgg

SEQ ID NO: 7604302 - DNA, 22 bp, Homo sapiens
ctctggaggcctaaggaagtgg

SEQ ID NO: 7604303 - DNA, 22 bp, Homo sapiens
ctctggagggaggctgagctgg

SEQ ID NO: 7604304 - DNA, 22 bp, Homo sapiens
ctctggagggaggctgagctgg

SEQ ID NO: 7604305 - DNA, 22 bp, Homo sapiens
ctctggagggaggctgagctgg

SEQ ID NO: 7604306 - DNA, 22 bp, Homo sapiens
ctctggagggaggctgagctgg

SEQ ID NO: 7604307 - DNA, 22 bp, Homo sapiens
ctctggagggaggctgagctgg

SEQ ID NO: 7604308 - DNA, 22 bp, Homo sapiens
ctctggagggaggctgagctgg

SEQ ID NO: 7604309 - DNA, 21 bp, Homo sapiens
ctctgctgtctaccagctgtt

SEQ ID NO: 7604310 - DNA, 22 bp, Homo sapiens
ctctgctgtctcagatgggcca

SEQ ID NO: 7604311 - DNA, 22 bp, Homo sapiens
ctctgctgtctcagatgggcca

SEQ ID NO: 7604312 - DNA, 22 bp, Homo sapiens
ctctgctgtctcagatgggcca

SEQ ID NO: 7604313 - DNA, 22 bp, Homo sapiens
ctctgctgtctcagatgggcca

SEQ ID NO: 7604314 - DNA, 22 bp, Homo sapiens
ctctgctgtctccagggcagtc

SEQ ID NO: 7604315 - DNA, 22 bp, Homo sapiens
ctctgctgtctcagatgggcca

SEQ ID NO: 7604316 - DNA, 22 bp, Homo sapiens
ctctgctgtgccgccagggcct

SEQ ID NO: 7604317 - DNA, 22 bp, Homo sapiens
ctctgctgtctccagggcagtc

SEQ ID NO: 7604318 - DNA, 22 bp, Homo sapiens
ctctgctgtgccgccagggcct

SEQ ID NO: 7604319 - DNA, 22 bp, Homo sapiens
ctctgctgtgccgccagggcct

SEQ ID NO: 7604320 - DNA, 22 bp, Homo sapiens
ctctgctggtgaccactgggcc

SEQ ID NO: 7604321 - DNA, 22 bp, Homo sapiens
ctctgctggtgaccactgggcc

SEQ ID NO: 7604322 - DNA, 22 bp, Homo sapiens
ctctgctggtgaccactgggcc

SEQ ID NO: 7604323 - DNA, 22 bp, Homo sapiens
ctctgctggtgaccactgggcc

SEQ ID NO: 7604324 - DNA, 22 bp, Homo sapiens
ctctgctggtagctcattccat

SEQ ID NO: 7604325 - DNA, 21 bp, Homo sapiens
ctctgctgtctaccagctgtt

SEQ ID NO: 7604326 - DNA, 21 bp, Homo sapiens
ctctgctgtctaccagctgtt

SEQ ID NO: 7604327 - DNA, 21 bp, Homo sapiens
ctctgctgtctaccagctgtt

SEQ ID NO: 7604328 - DNA, 21 bp, Homo sapiens
ctctgctgtctaccagctgtt

SEQ ID NO: 7604329 - DNA, 21 bp, Homo sapiens
ctctgctgtctaccagctgtt

SEQ ID NO: 7604330 - DNA, 22 bp, Homo sapiens
ctctgcttgtatcacatttgct

SEQ ID NO: 7604331 - DNA, 22 bp, Homo sapiens
ctctgcttgtatcacatttgct

SEQ ID NO: 7604332 - DNA, 22 bp, Homo sapiens
ctctgcttgtatcacatttgct

SEQ ID NO: 7604333 - DNA, 19 bp, Homo sapiens
ctctgcttggtccatatgc

SEQ ID NO: 7604334 - DNA, 22 bp, Homo sapiens
ctctgcttggaactggacagaa

SEQ ID NO: 7604335 - DNA, 22 bp, Homo sapiens
ctctgcttggaacaggggtttg

SEQ ID NO: 7604336 - DNA, 22 bp, Homo sapiens
ctctgcttggaacaggggtttg

SEQ ID NO: 7604337 - DNA, 22 bp, Homo sapiens
ctctgcttggaactggacagaa

SEQ ID NO: 7604338 - DNA, 22 bp, Homo sapiens
ctctgcttggaactggacagaa

SEQ ID NO: 7604339 - DNA, 22 bp, Homo sapiens
ctctgctgttcttatgtgtcct

SEQ ID NO: 7604340 - DNA, 22 bp, Homo sapiens
ctctgctgttttgtatacaggc

SEQ ID NO: 7604341 - DNA, 22 bp, Homo sapiens
ctctgctgttcttatgtgtcct

SEQ ID NO: 7604342 - DNA, 22 bp, Homo sapiens
ctctgctgtgccgccagggcct

SEQ ID NO: 7604343 - DNA, 22 bp, Homo sapiens
ctctgctgtgccgccagggcct

SEQ ID NO: 7604344 - DNA, 22 bp, Homo sapiens
ctctgcttcatccaccactggc

SEQ ID NO: 7604345 - DNA, 22 bp, Homo sapiens
ctctgcttctgagatggaagct

SEQ ID NO: 7604346 - DNA, 22 bp, Homo sapiens
ctctgcttctgagatggaagct

SEQ ID NO: 7604347 - DNA, 22 bp, Homo sapiens
ctctgctgctttgccagtggaa

SEQ ID NO: 7604348 - DNA, 22 bp, Homo sapiens
ctctgctgctttgccagtggaa

SEQ ID NO: 7604349 - DNA, 22 bp, Homo sapiens
ctctgctgcttgccagtcattg

SEQ ID NO: 7604350 - DNA, 22 bp, Homo sapiens
ctctgctgcttgccagtcattg

SEQ ID NO: 7604351 - DNA, 22 bp, Homo sapiens
ctctgctgcttgccagtcattg

SEQ ID NO: 7604352 - DNA, 20 bp, Homo sapiens
ctctgctgcgcatcccactt

SEQ ID NO: 7604353 - DNA, 20 bp, Homo sapiens
ctctgctgcgcatcccactt

SEQ ID NO: 7604354 - DNA, 20 bp, Homo sapiens
ctctgctgcgcatcccactt

SEQ ID NO: 7604355 - DNA, 20 bp, Homo sapiens
ctctgctgcgcatcccactt

SEQ ID NO: 7604356 - DNA, 22 bp, Homo sapiens
ctctgctgcccatgatggtata

SEQ ID NO: 7604357 - DNA, 20 bp, Homo sapiens
ctctgctgcccgccggctgc

SEQ ID NO: 7604358 - DNA, 20 bp, Homo sapiens
ctctgctgcccgccggctgc

SEQ ID NO: 7604359 - DNA, 22 bp, Homo sapiens
ctctgctggcagcccccgggcc

SEQ ID NO: 7604360 - DNA, 22 bp, Homo sapiens
ctctgctgctttgccagtggaa

SEQ ID NO: 7604361 - DNA, 22 bp, Homo sapiens
ctctgctggccatgaagagaga

SEQ ID NO: 7604362 - DNA, 22 bp, Homo sapiens
ctctgctggccatgaagagaga

SEQ ID NO: 7604363 - DNA, 22 bp, Homo sapiens
ctctgctgctttgccagtggaa

SEQ ID NO: 7604364 - DNA, 22 bp, Homo sapiens
ctctgctgctttgccagtggaa

SEQ ID NO: 7604365 - DNA, 22 bp, Homo sapiens
ctctgctgctttgccagtggaa

SEQ ID NO: 7604366 - DNA, 22 bp, Homo sapiens
ctctgctgctttgccagtggaa

SEQ ID NO: 7604367 - DNA, 22 bp, Homo sapiens
ctctgctgctttgccagtggaa

SEQ ID NO: 7604368 - DNA, 22 bp, Homo sapiens
ctctgctgctttgccagtggaa

SEQ ID NO: 7604369 - DNA, 22 bp, Homo sapiens
ctctgctgcccaggcctgctag

SEQ ID NO: 7604370 - DNA, 22 bp, Homo sapiens
ctctgctgcccaggcctgctag

SEQ ID NO: 7604371 - DNA, 19 bp, Homo sapiens
ctctgcctctggctgtggc

SEQ ID NO: 7604372 - DNA, 19 bp, Homo sapiens
ctctgcctctggctgtggc

SEQ ID NO: 7604373 - DNA, 19 bp, Homo sapiens
ctctgcctctggctgtggc

SEQ ID NO: 7604374 - DNA, 22 bp, Homo sapiens
tttcttgagtgatgcttagtgt

SEQ ID NO: 7604375 - DNA, 22 bp, Homo sapiens
tttcttgagtgatgcttagtgt

SEQ ID NO: 7604376 - DNA, 19 bp, Homo sapiens
ctctgcctctggctgtggc

SEQ ID NO: 7604377 - DNA, 19 bp, Homo sapiens
ctctgcctctggctgtggc

SEQ ID NO: 7604378 - DNA, 22 bp, Homo sapiens
tttcttgattagctgtggctca

SEQ ID NO: 7604379 - DNA, 22 bp, Homo sapiens
tttcttgagtgatgcttagtgt

SEQ ID NO: 7604380 - DNA, 19 bp, Homo sapiens
ctctgcctctggctgtggc

SEQ ID NO: 7604381 - DNA, 22 bp, Homo sapiens
tttcttgactgcttaggaatgc

SEQ ID NO: 7604382 - DNA, 22 bp, Homo sapiens
tttcttgactgcttaggaatgc

SEQ ID NO: 7604383 - DNA, 22 bp, Homo sapiens
tttcttgagcccaggaggtgga

SEQ ID NO: 7604384 - DNA, 22 bp, Homo sapiens
tttcttgagcccaggaggtgga

SEQ ID NO: 7604385 - DNA, 22 bp, Homo sapiens
tttcttgagctaggaacctggg

SEQ ID NO: 7604386 - DNA, 22 bp, Homo sapiens
tttcttgagctaggaacctggg

SEQ ID NO: 7604387 - DNA, 22 bp, Homo sapiens
tttcttcttgagtaaccagatt

SEQ ID NO: 7604388 - DNA, 22 bp, Homo sapiens
tttcttcttgagtaaccagatt

SEQ ID NO: 7604389 - DNA, 22 bp, Homo sapiens
tttcttcttgagtaaccagatt

SEQ ID NO: 7604390 - DNA, 22 bp, Homo sapiens
tttcttcttgagtaaccagatt

SEQ ID NO: 7604391 - DNA, 22 bp, Homo sapiens
tttcttcttgagtaaccagatt

SEQ ID NO: 7604392 - DNA, 22 bp, Homo sapiens
tttcttcttgagtaaccagatt

SEQ ID NO: 7604393 - DNA, 22 bp, Homo sapiens
tttcttcttgatttaaacaggg

SEQ ID NO: 7604394 - DNA, 22 bp, Homo sapiens
tttcttcttgagtaaccagatt

SEQ ID NO: 7604395 - DNA, 22 bp, Homo sapiens
tttcttcttgatttaaacaggg

SEQ ID NO: 7604396 - DNA, 22 bp, Homo sapiens
tttcttcttgatttaaacaggg

SEQ ID NO: 7604397 - DNA, 22 bp, Homo sapiens
tttcttcttgatttaaacaggg

SEQ ID NO: 7604398 - DNA, 22 bp, Homo sapiens
tttcttcttgatttaaacaggg

SEQ ID NO: 7604399 - DNA, 22 bp, Homo sapiens
tttcttcttgatttaaacaggg

SEQ ID NO: 7604400 - DNA, 22 bp, Homo sapiens
tttcttcttaatactggctgct

SEQ ID NO: 7604401 - DNA, 22 bp, Homo sapiens
tttcttcttaatactggctgct

SEQ ID NO: 7604402 - DNA, 22 bp, Homo sapiens
tttcttctgtttgtagttacac

SEQ ID NO: 7604403 - DNA, 22 bp, Homo sapiens
tttcttctgtttgtagttacac

SEQ ID NO: 7604404 - DNA, 22 bp, Homo sapiens
tttcttcttaatactggctgct

SEQ ID NO: 7604405 - DNA, 22 bp, Homo sapiens
tttcttcttaatactggctgct

SEQ ID NO: 7604406 - DNA, 22 bp, Homo sapiens
tttcttcttaatactggctgct

SEQ ID NO: 7604407 - DNA, 22 bp, Homo sapiens
tttcttcttaatactggctgct

SEQ ID NO: 7604408 - DNA, 22 bp, Homo sapiens
tttcttcttgagtaaccagatt

SEQ ID NO: 7604409 - DNA, 22 bp, Homo sapiens
tttcttcttgatttaaacaggg

SEQ ID NO: 7604410 - DNA, 22 bp, Homo sapiens
tttcttcttgatttaaacaggg

SEQ ID NO: 7604411 - DNA, 22 bp, Homo sapiens
tttcttcttgatttaaacaggg

SEQ ID NO: 7604412 - DNA, 22 bp, Homo sapiens
tttcttcttgatttaaacaggg

SEQ ID NO: 7604413 - DNA, 22 bp, Homo sapiens
tttcttcttgatttaaacaggg

SEQ ID NO: 7604414 - DNA, 22 bp, Homo sapiens
tttcttcttgatttaaacaggg

SEQ ID NO: 7604415 - DNA, 22 bp, Homo sapiens
tttcttcttgatttaaacaggg

SEQ ID NO: 7604416 - DNA, 22 bp, Homo sapiens
tttcttcttgatttaaacaggg

SEQ ID NO: 7604417 - DNA, 22 bp, Homo sapiens
tttcttcttgatttaaacaggg

SEQ ID NO: 7604418 - DNA, 22 bp, Homo sapiens
tttcttcttgatttaaacaggg

SEQ ID NO: 7604419 - DNA, 22 bp, Homo sapiens
tttcttgaccactatgttgata

SEQ ID NO: 7604420 - DNA, 22 bp, Homo sapiens
tttcttgaccactatgttgata

SEQ ID NO: 7604421 - DNA, 22 bp, Homo sapiens
tttcttgaccactatgttgata

SEQ ID NO: 7604422 - DNA, 22 bp, Homo sapiens
tttcttctttcccagtgatggg

SEQ ID NO: 7604423 - DNA, 22 bp, Homo sapiens
tttcttgaatatgggttaaact

SEQ ID NO: 7604424 - DNA, 22 bp, Homo sapiens
tttcttgaagtcctaaccctca

SEQ ID NO: 7604425 - DNA, 22 bp, Homo sapiens
tttcttgaagtcctaaccctca

SEQ ID NO: 7604426 - DNA, 22 bp, Homo sapiens
tttcttctttcccagtgatggg

SEQ ID NO: 7604427 - DNA, 22 bp, Homo sapiens
tttcttctttcccagtgatggg

SEQ ID NO: 7604428 - DNA, 22 bp, Homo sapiens
tttcttctttcccagtgatggg

SEQ ID NO: 7604429 - DNA, 22 bp, Homo sapiens
tttcttagggactgtaaaatag

SEQ ID NO: 7604430 - DNA, 22 bp, Homo sapiens
tttcttagggactgtaaaatag

SEQ ID NO: 7604431 - DNA, 22 bp, Homo sapiens
tttcttaggctctaaaatgact

SEQ ID NO: 7604432 - DNA, 21 bp, Homo sapiens
tttcttaggctctaaaatgac

SEQ ID NO: 7604433 - DNA, 21 bp, Homo sapiens
tttcttaggctctaaaatgac

SEQ ID NO: 7604434 - DNA, 22 bp, Homo sapiens
tttcttaggctctaaaatgact

SEQ ID NO: 7604435 - DNA, 22 bp, Homo sapiens
tttcttaggctctaaaatgact

SEQ ID NO: 7604436 - DNA, 22 bp, Homo sapiens
tttcttaaatatttgcaggaca

SEQ ID NO: 7604437 - DNA, 22 bp, Homo sapiens
tttcttaaatatttgcaggaca

SEQ ID NO: 7604438 - DNA, 22 bp, Homo sapiens
tttcttaaatatttgcaggaca

SEQ ID NO: 7604439 - DNA, 22 bp, Homo sapiens
tttcttaaatatttgcaggaca

SEQ ID NO: 7604440 - DNA, 22 bp, Homo sapiens
tttcttaaatatttgcaggaca

SEQ ID NO: 7604441 - DNA, 22 bp, Homo sapiens
tttcttaatttgagttccacta

SEQ ID NO: 7604442 - DNA, 22 bp, Homo sapiens
tttcttaatttgagttccacta

SEQ ID NO: 7604443 - DNA, 22 bp, Homo sapiens
tttcttagcgatgcttgataaa

SEQ ID NO: 7604444 - DNA, 22 bp, Homo sapiens
tttcttaatttgagttccacta

SEQ ID NO: 7604445 - DNA, 22 bp, Homo sapiens
tttcttatactatattgtcatc

SEQ ID NO: 7604446 - DNA, 22 bp, Homo sapiens
tttcttatactatattgtcatc

SEQ ID NO: 7604447 - DNA, 22 bp, Homo sapiens
tttcttatactatattgtcatc

SEQ ID NO: 7604448 - DNA, 22 bp, Homo sapiens
tttcttatactatattgtcatc

SEQ ID NO: 7604449 - DNA, 22 bp, Homo sapiens
tttcttatactatattgtcatc

SEQ ID NO: 7604450 - DNA, 22 bp, Homo sapiens
tttcttatactatattgtcatc

SEQ ID NO: 7604451 - DNA, 22 bp, Homo sapiens
tttcttatactatattgtcatc

SEQ ID NO: 7604452 - DNA, 22 bp, Homo sapiens
tttcttatactatattgtcatc

SEQ ID NO: 7604453 - DNA, 22 bp, Homo sapiens
tttcttatattctgtcattgtt

SEQ ID NO: 7604454 - DNA, 22 bp, Homo sapiens
tttcttatattctgtcattgtt

SEQ ID NO: 7604455 - DNA, 22 bp, Homo sapiens
tttcttatattctgtcattgtt

SEQ ID NO: 7604456 - DNA, 22 bp, Homo sapiens
tttcttatattctgtcattgtt

SEQ ID NO: 7604457 - DNA, 22 bp, Homo sapiens
tttcttatactatattgtcatc

SEQ ID NO: 7604458 - DNA, 22 bp, Homo sapiens
tttcttctgtttgtagttacac

SEQ ID NO: 7604459 - DNA, 22 bp, Homo sapiens
tttcttctgtttgtagttacac

SEQ ID NO: 7604460 - DNA, 22 bp, Homo sapiens
tttcttctgtttgtagttacac

SEQ ID NO: 7604461 - DNA, 22 bp, Homo sapiens
tttcttctgtttgtagttacac

SEQ ID NO: 7604462 - DNA, 22 bp, Homo sapiens
ctttgaaaacttaaataacagc

SEQ ID NO: 7604463 - DNA, 22 bp, Homo sapiens
ctttgaaaacttaaataacagc

SEQ ID NO: 7604464 - DNA, 22 bp, Homo sapiens
ctttgaaaacttaaataacagc

SEQ ID NO: 7604465 - DNA, 22 bp, Homo sapiens
ctttgaaaacttaaataacagc

SEQ ID NO: 7604466 - DNA, 22 bp, Homo sapiens
ctttgaaaacttaaataacagc

SEQ ID NO: 7604467 - DNA, 22 bp, Homo sapiens
ctttgaaaacttaaataacagc

SEQ ID NO: 7604468 - DNA, 22 bp, Homo sapiens
ctttgaaaacttaaataacagc

SEQ ID NO: 7604469 - DNA, 22 bp, Homo sapiens
ctttgaaaacttaaataacagc

SEQ ID NO: 7604470 - DNA, 22 bp, Homo sapiens
ctttgaaaacttaaataacagc

SEQ ID NO: 7604471 - DNA, 22 bp, Homo sapiens
ctttgaaaacacacgaatagac

SEQ ID NO: 7604472 - DNA, 22 bp, Homo sapiens
ctttgaaaacacacgaatagac

SEQ ID NO: 7604473 - DNA, 22 bp, Homo sapiens
ctttgaaaacacacgaatagac

SEQ ID NO: 7604474 - DNA, 22 bp, Homo sapiens
ctttgaaaacacacgaatagac

SEQ ID NO: 7604475 - DNA, 22 bp, Homo sapiens
ctttgaaaaatggtttcctaga

SEQ ID NO: 7604476 - DNA, 22 bp, Homo sapiens
ctttgaaaaatggtttcctaga

SEQ ID NO: 7604477 - DNA, 22 bp, Homo sapiens
ctttgaaaaatggtttcctaga

SEQ ID NO: 7604478 - DNA, 22 bp, Homo sapiens
ctttgaaaaatggtttcctaga

SEQ ID NO: 7604479 - DNA, 22 bp, Homo sapiens
ctttgaaaaatggtttcctaga

SEQ ID NO: 7604480 - DNA, 22 bp, Homo sapiens
ctttgaaaaatggtttcctaga

SEQ ID NO: 7604481 - DNA, 22 bp, Homo sapiens
ctttctttgtccaccaacaatg

SEQ ID NO: 7604482 - DNA, 22 bp, Homo sapiens
ctttctttgtccaccaacaatg

SEQ ID NO: 7604483 - DNA, 22 bp, Homo sapiens
ctttctttgtccaccaacaatg

SEQ ID NO: 7604484 - DNA, 22 bp, Homo sapiens
ctttctttgtccaccaacaatg

SEQ ID NO: 7604485 - DNA, 22 bp, Homo sapiens
ctttctttgtccaccaacaatg

SEQ ID NO: 7604486 - DNA, 22 bp, Homo sapiens
ctttctttgtccaccaacaatg

SEQ ID NO: 7604487 - DNA, 22 bp, Homo sapiens
ctttctttgtccaccaacaatg

SEQ ID NO: 7604488 - DNA, 22 bp, Homo sapiens
ctttctttgtccaccaacaatg

SEQ ID NO: 7604489 - DNA, 22 bp, Homo sapiens
ctttctttgtccaccaacaatg

SEQ ID NO: 7604490 - DNA, 22 bp, Homo sapiens
ctttctttgtccaccaacaatg

SEQ ID NO: 7604491 - DNA, 22 bp, Homo sapiens
ctttctttgtccaccaacaatg

SEQ ID NO: 7604492 - DNA, 22 bp, Homo sapiens
ctttctcttcgaaaacctgccc

SEQ ID NO: 7604493 - DNA, 22 bp, Homo sapiens
ctttctcttcagcacccagccc

SEQ ID NO: 7604494 - DNA, 22 bp, Homo sapiens
ctttctcttcagcacccagccc

SEQ ID NO: 7604495 - DNA, 22 bp, Homo sapiens
ctttctttgcagtgagccagag

SEQ ID NO: 7604496 - DNA, 22 bp, Homo sapiens
ctttctttgcagtgagccagag

SEQ ID NO: 7604497 - DNA, 22 bp, Homo sapiens
ctttctttgcagtgagccagag

SEQ ID NO: 7604498 - DNA, 22 bp, Homo sapiens
ctttctcttcgaaaacctgccc

SEQ ID NO: 7604499 - DNA, 22 bp, Homo sapiens
ctttctttgcagtgagccagag

SEQ ID NO: 7604500 - DNA, 22 bp, Homo sapiens
ctttctttgcagtgagccagag

SEQ ID NO: 7604501 - DNA, 22 bp, Homo sapiens
ctttctttgcagtgagccagag

SEQ ID NO: 7604502 - DNA, 22 bp, Homo sapiens
ctttgatgagcatgcaatattt

SEQ ID NO: 7604503 - DNA, 22 bp, Homo sapiens
ctttgatgagcatgcaatattt

SEQ ID NO: 7604504 - DNA, 22 bp, Homo sapiens
ctttgattatcggtgtgaatgt

SEQ ID NO: 7604505 - DNA, 22 bp, Homo sapiens
ctttgattatcggtgtgaatgt

SEQ ID NO: 7604506 - DNA, 22 bp, Homo sapiens
ctttgatataagtatacatagt

SEQ ID NO: 7604507 - DNA, 22 bp, Homo sapiens
ctttgatataagtatacatagt

SEQ ID NO: 7604508 - DNA, 22 bp, Homo sapiens
ctttgactccatctctctttgt

SEQ ID NO: 7604509 - DNA, 22 bp, Homo sapiens
ctttgagcaattctgagatgca

SEQ ID NO: 7604510 - DNA, 22 bp, Homo sapiens
ctttgagtaataattctgcctt

SEQ ID NO: 7604511 - DNA, 22 bp, Homo sapiens
ctttgatataagtatacatagt

SEQ ID NO: 7604512 - DNA, 22 bp, Homo sapiens
ctttgacctcatatgacacatt

SEQ ID NO: 7604513 - DNA, 22 bp, Homo sapiens
ctttgactttgtcctcaggaaa

SEQ ID NO: 7604514 - DNA, 22 bp, Homo sapiens
ctttgactttgtcctcaggaaa

SEQ ID NO: 7604515 - DNA, 22 bp, Homo sapiens
ctttgaattccagtacaataac

SEQ ID NO: 7604516 - DNA, 22 bp, Homo sapiens
ctttgaattccagtacaataac

SEQ ID NO: 7604517 - DNA, 22 bp, Homo sapiens
ctttgaattccagtacaataac

SEQ ID NO: 7604518 - DNA, 22 bp, Homo sapiens
ctttgaaattcttcagctgaag

SEQ ID NO: 7604519 - DNA, 22 bp, Homo sapiens
ctttgaaattcttcagctgaag

SEQ ID NO: 7604520 - DNA, 22 bp, Homo sapiens
ctttgaaattcttcagctgaag

SEQ ID NO: 7604521 - DNA, 22 bp, Homo sapiens
ctttgaagatcacatgttgctc

SEQ ID NO: 7604522 - DNA, 22 bp, Homo sapiens
ctttgaagatggcaaatttaga

SEQ ID NO: 7604523 - DNA, 22 bp, Homo sapiens
ctttgaagatggcaaatttaga

SEQ ID NO: 7604524 - DNA, 22 bp, Homo sapiens
ctttgaattaacgacacaagtg

SEQ ID NO: 7604525 - DNA, 22 bp, Homo sapiens
ctttgaagatcacatgttgctc

SEQ ID NO: 7604526 - DNA, 22 bp, Homo sapiens
ctttgaagagattactgtgctc

SEQ ID NO: 7604527 - DNA, 22 bp, Homo sapiens
ctttgaagatcacatgttgctc

SEQ ID NO: 7604528 - DNA, 22 bp, Homo sapiens
ctttgaaagctcccaggactta

SEQ ID NO: 7604529 - DNA, 22 bp, Homo sapiens
ctttgaaaggaagccacacagc

SEQ ID NO: 7604530 - DNA, 22 bp, Homo sapiens
ctttgaaagctcccaggactta

SEQ ID NO: 7604531 - DNA, 22 bp, Homo sapiens
ctttgaaacctgctctgcagaa

SEQ ID NO: 7604532 - DNA, 22 bp, Homo sapiens
ctttgaaacctgctctgcagaa

SEQ ID NO: 7604533 - DNA, 22 bp, Homo sapiens
ctttgaaaacttaaataacagc

SEQ ID NO: 7604534 - DNA, 22 bp, Homo sapiens
ctttgaaaatgtggttaagggt

SEQ ID NO: 7604535 - DNA, 22 bp, Homo sapiens
ctttaattctcaggtgcacata

SEQ ID NO: 7604536 - DNA, 22 bp, Homo sapiens
ctttaattctcaggtgcacata

SEQ ID NO: 7604537 - DNA, 22 bp, Homo sapiens
ctttaattctcaggtgcacata

SEQ ID NO: 7604538 - DNA, 22 bp, Homo sapiens
ctttaattcagatttgaaggga

SEQ ID NO: 7604539 - DNA, 22 bp, Homo sapiens
ctttaattcagatttgaaggga

SEQ ID NO: 7604540 - DNA, 22 bp, Homo sapiens
ctttaattaggaagtataatga

SEQ ID NO: 7604541 - DNA, 22 bp, Homo sapiens
ctttaattaggaagtataatga

SEQ ID NO: 7604542 - DNA, 22 bp, Homo sapiens
ctttaattcagatttgaaggga

SEQ ID NO: 7604543 - DNA, 22 bp, Homo sapiens
ctttaattaggaagtataatga

SEQ ID NO: 7604544 - DNA, 22 bp, Homo sapiens
ctttaattaggaagtataatga

SEQ ID NO: 7604545 - DNA, 22 bp, Homo sapiens
ctttaatgagtctttctgctgt

SEQ ID NO: 7604546 - DNA, 22 bp, Homo sapiens
ctttaatgagtctttctgctgt

SEQ ID NO: 7604547 - DNA, 22 bp, Homo sapiens
ctttaattaggaagtataatga

SEQ ID NO: 7604548 - DNA, 23 bp, Homo sapiens
ctttaatgaaattctctgtgaag

SEQ ID NO: 7604549 - DNA, 23 bp, Homo sapiens
ctttaatgaaattctctgtgaag

SEQ ID NO: 7604550 - DNA, 23 bp, Homo sapiens
ctttaatgaaattctctgtgaag

SEQ ID NO: 7604551 - DNA, 22 bp, Homo sapiens
ctttaatcaagataagtatact

SEQ ID NO: 7604552 - DNA, 22 bp, Homo sapiens
ctttaagagatcaccaatcaca

SEQ ID NO: 7604553 - DNA, 22 bp, Homo sapiens
ctttaaataatacaaggtccag

SEQ ID NO: 7604554 - DNA, 22 bp, Homo sapiens
ctttaaataatacaaggtccag

SEQ ID NO: 7604555 - DNA, 22 bp, Homo sapiens
ctttaaataatacaaggtccag

SEQ ID NO: 7604556 - DNA, 22 bp, Homo sapiens
ctttaaataatacaaggtccag

SEQ ID NO: 7604557 - DNA, 22 bp, Homo sapiens
ctttaaataatacaaggtccag

SEQ ID NO: 7604558 - DNA, 22 bp, Homo sapiens
ctttaaataatacaaggtccag

SEQ ID NO: 7604559 - DNA, 22 bp, Homo sapiens
ctttaaataatacaaggtccag

SEQ ID NO: 7604560 - DNA, 22 bp, Homo sapiens
ctttaaataatacaaggtccag

SEQ ID NO: 7604561 - DNA, 22 bp, Homo sapiens
ctttaacaaatgactcttgtct

SEQ ID NO: 7604562 - DNA, 22 bp, Homo sapiens
ctttaacaaatgactcttgtct

SEQ ID NO: 7604563 - DNA, 22 bp, Homo sapiens
ctttaacagttccattcaattt

SEQ ID NO: 7604564 - DNA, 22 bp, Homo sapiens
ctttaacagttccattcaattt

SEQ ID NO: 7604565 - DNA, 22 bp, Homo sapiens
ctttaagactaaattagagttt

SEQ ID NO: 7604566 - DNA, 22 bp, Homo sapiens
ctttaagactaaattagagttt

SEQ ID NO: 7604567 - DNA, 22 bp, Homo sapiens
ctttaagactaaattagagttt

SEQ ID NO: 7604568 - DNA, 22 bp, Homo sapiens
ctttaaggtgatgagagatgct

SEQ ID NO: 7604569 - DNA, 22 bp, Homo sapiens
ctttaacagttccattcaattt

SEQ ID NO: 7604570 - DNA, 22 bp, Homo sapiens
ctttaacagttccattcaattt

SEQ ID NO: 7604571 - DNA, 22 bp, Homo sapiens
ctttaagactaaattagagttt

SEQ ID NO: 7604572 - DNA, 22 bp, Homo sapiens
ctttacaaatagggagggagtg

SEQ ID NO: 7604573 - DNA, 22 bp, Homo sapiens
ctttacaaatagggagggagtg

SEQ ID NO: 7604574 - DNA, 22 bp, Homo sapiens
ctttacaaatagggagggagtg

SEQ ID NO: 7604575 - DNA, 22 bp, Homo sapiens
ctttacaaatagggagggagtg

SEQ ID NO: 7604576 - DNA, 22 bp, Homo sapiens
ctttacaaatagggagggagtg

SEQ ID NO: 7604577 - DNA, 22 bp, Homo sapiens
ctttacaaatagggagggagtg

SEQ ID NO: 7604578 - DNA, 22 bp, Homo sapiens
ctttacaaatagggagggagtg

SEQ ID NO: 7604579 - DNA, 22 bp, Homo sapiens
ctttacaaatagggagggagtg

SEQ ID NO: 7604580 - DNA, 22 bp, Homo sapiens
ctttacaaatagggagggagtg

SEQ ID NO: 7604581 - DNA, 22 bp, Homo sapiens
ctttacaaattagctctcggga

SEQ ID NO: 7604582 - DNA, 22 bp, Homo sapiens
ctttacaaattagctctcggga

SEQ ID NO: 7604583 - DNA, 22 bp, Homo sapiens
ctttacaaattagctctcggga

SEQ ID NO: 7604584 - DNA, 22 bp, Homo sapiens
ctttacaaattagctctcggga

SEQ ID NO: 7604585 - DNA, 22 bp, Homo sapiens
ctttctcttcactgtcatgatc

SEQ ID NO: 7604586 - DNA, 22 bp, Homo sapiens
ctttctcttcagcacccagccc

SEQ ID NO: 7604587 - DNA, 22 bp, Homo sapiens
ctttctcttcagcacccagccc

SEQ ID NO: 7604588 - DNA, 22 bp, Homo sapiens
ctttacaaattagctctcggga

SEQ ID NO: 7604589 - DNA, 22 bp, Homo sapiens
ctttacaaattagctctcggga

SEQ ID NO: 7604590 - DNA, 22 bp, Homo sapiens
ctttctcttcactgtcatgatc

SEQ ID NO: 7604591 - DNA, 22 bp, Homo sapiens
ctttctcttcactgtcatgatc

SEQ ID NO: 7604592 - DNA, 22 bp, Homo sapiens
ctttacaaagcaattttgtctc

SEQ ID NO: 7604593 - DNA, 22 bp, Homo sapiens
ctttacaaagcaattttgtctc

SEQ ID NO: 7604594 - DNA, 22 bp, Homo sapiens
ctttacaaagcaattttgtctc

SEQ ID NO: 7604595 - DNA, 22 bp, Homo sapiens
ctttacaaagcaattttgtctc

SEQ ID NO: 7604596 - DNA, 22 bp, Homo sapiens
ctttacaaagcaattttgtctc

SEQ ID NO: 7604597 - DNA, 22 bp, Homo sapiens
ctttacaaagcaattttgtctc

SEQ ID NO: 7604598 - DNA, 22 bp, Homo sapiens
ctttacaaagcaattttgtctc

SEQ ID NO: 7604599 - DNA, 22 bp, Homo sapiens
ctttacaaagcaattttgtctc

SEQ ID NO: 7604600 - DNA, 22 bp, Homo sapiens
ctttacaaagcaattttgtctc

SEQ ID NO: 7604601 - DNA, 22 bp, Homo sapiens
ctttaattgtagctcccataat

SEQ ID NO: 7604602 - DNA, 22 bp, Homo sapiens
ctttaattctcaggtgcacata

SEQ ID NO: 7604603 - DNA, 22 bp, Homo sapiens
ctttaattctcaggtgcacata

SEQ ID NO: 7604604 - DNA, 22 bp, Homo sapiens
ctttaattgtagctcccataat

SEQ ID NO: 7604605 - DNA, 22 bp, Homo sapiens
ctttaattgtagctcccataat

SEQ ID NO: 7604606 - DNA, 22 bp, Homo sapiens
ctttacaaactataaagtgcgg

SEQ ID NO: 7604607 - DNA, 22 bp, Homo sapiens
ctttacaaactataaagtgcgg

SEQ ID NO: 7604608 - DNA, 22 bp, Homo sapiens
ctttacaaactataaagtgcgg

SEQ ID NO: 7604609 - DNA, 22 bp, Homo sapiens
ctttacaaactataaagtgcgg

SEQ ID NO: 7604610 - DNA, 22 bp, Homo sapiens
ctttacaaactataaagtgcgg

SEQ ID NO: 7604611 - DNA, 22 bp, Homo sapiens
ctttacaaactataaagtgcgg

SEQ ID NO: 7604612 - DNA, 22 bp, Homo sapiens
ctttacaaactataaagtgcgg

SEQ ID NO: 7604613 - DNA, 22 bp, Homo sapiens
ctttacaaactataaagtgcgg

SEQ ID NO: 7604614 - DNA, 22 bp, Homo sapiens
ctttacaaactataaagtgcgg

SEQ ID NO: 7604615 - DNA, 23 bp, Homo sapiens
cttctggctctatatcagaattc

SEQ ID NO: 7604616 - DNA, 23 bp, Homo sapiens
cttctggctctatatcagaattc

SEQ ID NO: 7604617 - DNA, 20 bp, Homo sapiens
cttctggctggtcaaggact

SEQ ID NO: 7604618 - DNA, 22 bp, Homo sapiens
cttctgggagagcttttgcttc

SEQ ID NO: 7604619 - DNA, 22 bp, Homo sapiens
cttctgggattaatttttcctg

SEQ ID NO: 7604620 - DNA, 22 bp, Homo sapiens
cttctgggatttttgaagactc

SEQ ID NO: 7604621 - DNA, 22 bp, Homo sapiens
cttctggcaatcccagggtctt

SEQ ID NO: 7604622 - DNA, 22 bp, Homo sapiens
cttctggcaatcccagggtctt

SEQ ID NO: 7604623 - DNA, 19 bp, Homo sapiens
cttctggccctgagccacc

SEQ ID NO: 7604624 - DNA, 19 bp, Homo sapiens
cttctggccctgagccacc

SEQ ID NO: 7604625 - DNA, 22 bp, Homo sapiens
cttctggcaaaacaggcagaaa

SEQ ID NO: 7604626 - DNA, 22 bp, Homo sapiens
cttctggcaaaacaggcagaaa

SEQ ID NO: 7604627 - DNA, 22 bp, Homo sapiens
cttctggcgttggaggtctgag

SEQ ID NO: 7604628 - DNA, 22 bp, Homo sapiens
cttctggcgttggaggtctgag

SEQ ID NO: 7604629 - DNA, 22 bp, Homo sapiens
cttctggcgttggaggtctgag

SEQ ID NO: 7604630 - DNA, 22 bp, Homo sapiens
cttctggcgttggaggtctgag

SEQ ID NO: 7604631 - DNA, 22 bp, Homo sapiens
cttctgggcattcagctgcaca

SEQ ID NO: 7604632 - DNA, 22 bp, Homo sapiens
cttctgggcattcagctgcaca

SEQ ID NO: 7604633 - DNA, 22 bp, Homo sapiens
cttctgggcatggcagagcctg

SEQ ID NO: 7604634 - DNA, 22 bp, Homo sapiens
cttctgggcattcagctgcaca

SEQ ID NO: 7604635 - DNA, 22 bp, Homo sapiens
cttctgggcatggcagagcctg

SEQ ID NO: 7604636 - DNA, 22 bp, Homo sapiens
cttctgggcatggcagagcctg

SEQ ID NO: 7604637 - DNA, 22 bp, Homo sapiens
cttctgggcatggcagagcctg

SEQ ID NO: 7604638 - DNA, 22 bp, Homo sapiens
cttctgggcatggcagagcctg

SEQ ID NO: 7604639 - DNA, 22 bp, Homo sapiens
cttctgggcatggcagagcctg

SEQ ID NO: 7604640 - DNA, 22 bp, Homo sapiens
cttctggggatggagcccagaa

SEQ ID NO: 7604641 - DNA, 22 bp, Homo sapiens
cttctggggatggagcccagaa

SEQ ID NO: 7604642 - DNA, 22 bp, Homo sapiens
cttctgggcattcagctgcaca

SEQ ID NO: 7604643 - DNA, 22 bp, Homo sapiens
cttctgggcattcagctgcaca

SEQ ID NO: 7604644 - DNA, 22 bp, Homo sapiens
cttctggggatggagcccagaa

SEQ ID NO: 7604645 - DNA, 22 bp, Homo sapiens
cttctggggatggagcccagaa

SEQ ID NO: 7604646 - DNA, 22 bp, Homo sapiens
cttctgggccatggccttcctc

SEQ ID NO: 7604647 - DNA, 22 bp, Homo sapiens
cttctggcaaaacaggcagaaa

SEQ ID NO: 7604648 - DNA, 22 bp, Homo sapiens
cttctggatttattcattcctt

SEQ ID NO: 7604649 - DNA, 22 bp, Homo sapiens
cttctggatttattcattcctt

SEQ ID NO: 7604650 - DNA, 19 bp, Homo sapiens
cttctggatccgcagggcc

SEQ ID NO: 7604651 - DNA, 22 bp, Homo sapiens
cttctggatttattcattcctt

SEQ ID NO: 7604652 - DNA, 22 bp, Homo sapiens
cttctggataattgtgtgatta

SEQ ID NO: 7604653 - DNA, 19 bp, Homo sapiens
cttctggatccgcagggcc

SEQ ID NO: 7604654 - DNA, 22 bp, Homo sapiens
cttctggaggctccagggaggt

SEQ ID NO: 7604655 - DNA, 22 bp, Homo sapiens
cttctggataattgtgtgatta

SEQ ID NO: 7604656 - DNA, 22 bp, Homo sapiens
cttctggaggctccagggaggt

SEQ ID NO: 7604657 - DNA, 22 bp, Homo sapiens
cttctggaggctccagggaggt

SEQ ID NO: 7604658 - DNA, 22 bp, Homo sapiens
cttctggaggacactggcccca

SEQ ID NO: 7604659 - DNA, 22 bp, Homo sapiens
cttctggagctcaccaacttcc

SEQ ID NO: 7604660 - DNA, 22 bp, Homo sapiens
cttctggagctcaccaacttcc

SEQ ID NO: 7604661 - DNA, 22 bp, Homo sapiens
cttctggaaacttttccaattt

SEQ ID NO: 7604662 - DNA, 22 bp, Homo sapiens
cttctggaggacactggcccca

SEQ ID NO: 7604663 - DNA, 22 bp, Homo sapiens
cttctggaggctccagggaggt

SEQ ID NO: 7604664 - DNA, 22 bp, Homo sapiens
cttctggaggctccagggaggt

SEQ ID NO: 7604665 - DNA, 22 bp, Homo sapiens
cttctgaagtgtttgatgattg

SEQ ID NO: 7604666 - DNA, 22 bp, Homo sapiens
cttctgaagaggttatcataga

SEQ ID NO: 7604667 - DNA, 22 bp, Homo sapiens
cttctgaagtgtttgatgattg

SEQ ID NO: 7604668 - DNA, 22 bp, Homo sapiens
cttctgaagtgtttgatgattg

SEQ ID NO: 7604669 - DNA, 22 bp, Homo sapiens
cttctgaagtgtttgatgattg

SEQ ID NO: 7604670 - DNA, 22 bp, Homo sapiens
cttctgaagtgtttgatgattg

SEQ ID NO: 7604671 - DNA, 22 bp, Homo sapiens
cttctgctgctgttcatggttg

SEQ ID NO: 7604672 - DNA, 22 bp, Homo sapiens
cttctgaatggctgtgtatgct

SEQ ID NO: 7604673 - DNA, 22 bp, Homo sapiens
cttctgaaacccccagtgtggg

SEQ ID NO: 7604674 - DNA, 22 bp, Homo sapiens
cttctgaaacccccagtgtggg

SEQ ID NO: 7604675 - DNA, 22 bp, Homo sapiens
cttctgaaacccccagtgtggg

SEQ ID NO: 7604676 - DNA, 22 bp, Homo sapiens
cttctgaaatgtgagcaaaatc

SEQ ID NO: 7604677 - DNA, 22 bp, Homo sapiens
cttctgaaacccccagtgtggg

SEQ ID NO: 7604678 - DNA, 22 bp, Homo sapiens
cttctgaagaggttatcataga

SEQ ID NO: 7604679 - DNA, 22 bp, Homo sapiens
cttctgaagaggttatcataga

SEQ ID NO: 7604680 - DNA, 22 bp, Homo sapiens
cttctgaagaggttatcataga

SEQ ID NO: 7604681 - DNA, 22 bp, Homo sapiens
cttgtggacactcgtgatctcc

SEQ ID NO: 7604682 - DNA, 23 bp, Homo sapiens
cttgtggacagtagcttcagcct

SEQ ID NO: 7604683 - DNA, 22 bp, Homo sapiens
cttgtgcatttcattcctcagg

SEQ ID NO: 7604684 - DNA, 22 bp, Homo sapiens
cttgtgcaattgacattgaatc

SEQ ID NO: 7604685 - DNA, 22 bp, Homo sapiens
cttgtgcagcctcctcttgcag

SEQ ID NO: 7604686 - DNA, 22 bp, Homo sapiens
cttctggttccagcttctgttg

SEQ ID NO: 7604687 - DNA, 22 bp, Homo sapiens
cttctggttccagcttctgttg

SEQ ID NO: 7604688 - DNA, 22 bp, Homo sapiens
cttgtgcaattgacattgaatc

SEQ ID NO: 7604689 - DNA, 22 bp, Homo sapiens
cttgtgcaagaaacctggaatg

SEQ ID NO: 7604690 - DNA, 22 bp, Homo sapiens
cttctgggttgcaggtcttggc

SEQ ID NO: 7604691 - DNA, 22 bp, Homo sapiens
cttctgggtgtggagtgaggac

SEQ ID NO: 7604692 - DNA, 22 bp, Homo sapiens
cttctgggtgtggagtgaggac

SEQ ID NO: 7604693 - DNA, 22 bp, Homo sapiens
cttctgggtgtggagtgaggac

SEQ ID NO: 7604694 - DNA, 22 bp, Homo sapiens
cttctgggtgtggagtgaggac

SEQ ID NO: 7604695 - DNA, 22 bp, Homo sapiens
cttctgggtgtggagtgaggac

SEQ ID NO: 7604696 - DNA, 22 bp, Homo sapiens
cttctgggtgtggagtgaggac

SEQ ID NO: 7604697 - DNA, 22 bp, Homo sapiens
cttctgggtgtggagtgaggac

SEQ ID NO: 7604698 - DNA, 22 bp, Homo sapiens
cttctgggtgcctgtgagtgtt

SEQ ID NO: 7604699 - DNA, 22 bp, Homo sapiens
cttctgggtgcctgtgagtgtt

SEQ ID NO: 7604700 - DNA, 22 bp, Homo sapiens
cttctgggtgcctgtgagtgtt

SEQ ID NO: 7604701 - DNA, 22 bp, Homo sapiens
cttctgggtattccagatacct

SEQ ID NO: 7604702 - DNA, 22 bp, Homo sapiens
cttctgggtaattcttcttcat

SEQ ID NO: 7604703 - DNA, 22 bp, Homo sapiens
cttctgggtaattcttcttcat

SEQ ID NO: 7604704 - DNA, 22 bp, Homo sapiens
cttctggggatggagcccagaa

SEQ ID NO: 7604705 - DNA, 22 bp, Homo sapiens
cttctgggtattccagatacct

SEQ ID NO: 7604706 - DNA, 22 bp, Homo sapiens
cttctgggtattccagatacct

SEQ ID NO: 7604707 - DNA, 22 bp, Homo sapiens
cttctgggtattccagatacct

SEQ ID NO: 7604708 - DNA, 22 bp, Homo sapiens
cttgtttttaagagatgtttac

SEQ ID NO: 7604709 - DNA, 22 bp, Homo sapiens
cttgtttttaagagatgtttac

SEQ ID NO: 7604710 - DNA, 22 bp, Homo sapiens
cttgtttttaagagatgtttac

SEQ ID NO: 7604711 - DNA, 22 bp, Homo sapiens
cttgtttttaagagatgtttac

SEQ ID NO: 7604712 - DNA, 22 bp, Homo sapiens
cttgtttttaagagatgtttac

SEQ ID NO: 7604713 - DNA, 22 bp, Homo sapiens
ctttaaataatacaaggtccag

SEQ ID NO: 7604714 - DNA, 22 bp, Homo sapiens
ctttaaataatacaaggtccag

SEQ ID NO: 7604715 - DNA, 22 bp, Homo sapiens
ctttaaataatacaaggtccag

SEQ ID NO: 7604716 - DNA, 22 bp, Homo sapiens
cttgttttggctagtatgatgt

SEQ ID NO: 7604717 - DNA, 22 bp, Homo sapiens
cttgttttggctagtatgatgt

SEQ ID NO: 7604718 - DNA, 22 bp, Homo sapiens
cttgttttggctagtatgatgt

SEQ ID NO: 7604719 - DNA, 22 bp, Homo sapiens
cttgttttggctagtatgatgt

SEQ ID NO: 7604720 - DNA, 22 bp, Homo sapiens
cttgttttggctagtatgatgt

SEQ ID NO: 7604721 - DNA, 22 bp, Homo sapiens
cttgttttggaacagagtgaat

SEQ ID NO: 7604722 - DNA, 22 bp, Homo sapiens
cttgttttggctagtatgatgt

SEQ ID NO: 7604723 - DNA, 22 bp, Homo sapiens
cttgttttggctagtatgatgt

SEQ ID NO: 7604724 - DNA, 22 bp, Homo sapiens
cttgttttggctagtatgatgt

SEQ ID NO: 7604725 - DNA, 22 bp, Homo sapiens
cttgttttggaacagagtgaat

SEQ ID NO: 7604726 - DNA, 22 bp, Homo sapiens
cttgttttggaacagagtgaat

SEQ ID NO: 7604727 - DNA, 22 bp, Homo sapiens
cttgttttggaacagagtgaat

SEQ ID NO: 7604728 - DNA, 22 bp, Homo sapiens
cttgttttggaacagagtgaat

SEQ ID NO: 7604729 - DNA, 22 bp, Homo sapiens
cttgttttggaacagagtgaat

SEQ ID NO: 7604730 - DNA, 22 bp, Homo sapiens
cttgttttgaaagcagtggcca

SEQ ID NO: 7604731 - DNA, 22 bp, Homo sapiens
cttgttttgaaagcagtggcca

SEQ ID NO: 7604732 - DNA, 22 bp, Homo sapiens
cttgttttgaaagcagtggcca

SEQ ID NO: 7604733 - DNA, 22 bp, Homo sapiens
cttgttttgaaagcagtggcca

SEQ ID NO: 7604734 - DNA, 21 bp, Homo sapiens
cttgttttgaaaggactggcc

SEQ ID NO: 7604735 - DNA, 21 bp, Homo sapiens
cttgttttgaaaggactggcc

SEQ ID NO: 7604736 - DNA, 22 bp, Homo sapiens
cttgttttcttctgcagtctat

SEQ ID NO: 7604737 - DNA, 22 bp, Homo sapiens
cttgttttcttctgcagtctat

SEQ ID NO: 7604738 - DNA, 22 bp, Homo sapiens
cttgttttcttctgcagtctat

SEQ ID NO: 7604739 - DNA, 22 bp, Homo sapiens
cttgttttctaaaacatcattt

SEQ ID NO: 7604740 - DNA, 22 bp, Homo sapiens
cttgtggagatatccatgtctg

SEQ ID NO: 7604741 - DNA, 22 bp, Homo sapiens
cttttctgtatcaaaaggatta

SEQ ID NO: 7604742 - DNA, 22 bp, Homo sapiens
cttttctgggccccacgctgga

SEQ ID NO: 7604743 - DNA, 22 bp, Homo sapiens
cttttctggccaggaacttgcc

SEQ ID NO: 7604744 - DNA, 22 bp, Homo sapiens
cttttctgtatcaaaaggatta

SEQ ID NO: 7604745 - DNA, 22 bp, Homo sapiens
cttttctgtatcaaaaggatta

SEQ ID NO: 7604746 - DNA, 22 bp, Homo sapiens
cttttctgtgatgctgacagtc

SEQ ID NO: 7604747 - DNA, 22 bp, Homo sapiens
cttttctgtgatgctgacagtc

SEQ ID NO: 7604748 - DNA, 22 bp, Homo sapiens
cttttctgagagggccaagatt

SEQ ID NO: 7604749 - DNA, 22 bp, Homo sapiens
cttttctcttacattccactgg

SEQ ID NO: 7604750 - DNA, 22 bp, Homo sapiens
cttttctggaatcatctctaac

SEQ ID NO: 7604751 - DNA, 22 bp, Homo sapiens
cttttctggaatcatctctaac

SEQ ID NO: 7604752 - DNA, 22 bp, Homo sapiens
cttttctcttacattccactgg

SEQ ID NO: 7604753 - DNA, 22 bp, Homo sapiens
cttttctcttacattccactgg

SEQ ID NO: 7604754 - DNA, 22 bp, Homo sapiens
cttttctctgcgggtctttcat

SEQ ID NO: 7604755 - DNA, 22 bp, Homo sapiens
cttttctctgtaccgtatatct

SEQ ID NO: 7604756 - DNA, 22 bp, Homo sapiens
cttttctctgtaccgtatatct

SEQ ID NO: 7604757 - DNA, 22 bp, Homo sapiens
cttttctcttacattccactgg

SEQ ID NO: 7604758 - DNA, 22 bp, Homo sapiens
cttttctcttacattccactgg

SEQ ID NO: 7604759 - DNA, 22 bp, Homo sapiens
cttttctcttacattccactgg

SEQ ID NO: 7604760 - DNA, 22 bp, Homo sapiens
cttttctcttacattccactgg

SEQ ID NO: 7604761 - DNA, 22 bp, Homo sapiens
cttttctctgcaccatgtgtga

SEQ ID NO: 7604762 - DNA, 22 bp, Homo sapiens
cttttctctgcaccatgtgtga

SEQ ID NO: 7604763 - DNA, 21 bp, Homo sapiens
cttttctagtcccagccccgc

SEQ ID NO: 7604764 - DNA, 22 bp, Homo sapiens
cttttctctgcgggtctttcat

SEQ ID NO: 7604765 - DNA, 22 bp, Homo sapiens
cttttctctgcgggtctttcat

SEQ ID NO: 7604766 - DNA, 22 bp, Homo sapiens
cttttctctgcgggtctttcat

SEQ ID NO: 7604767 - DNA, 22 bp, Homo sapiens
cttttctctgcaccatgtgtga

SEQ ID NO: 7604768 - DNA, 22 bp, Homo sapiens
cttttctagagccgcagcccta

SEQ ID NO: 7604769 - DNA, 22 bp, Homo sapiens
cttttctagagccgcagcccta

SEQ ID NO: 7604770 - DNA, 22 bp, Homo sapiens
cttttctagagccgcagcccta

SEQ ID NO: 7604771 - DNA, 21 bp, Homo sapiens
cttttctagtcccagccccgc

SEQ ID NO: 7604772 - DNA, 21 bp, Homo sapiens
cttttctagtcccagccccgc

SEQ ID NO: 7604773 - DNA, 22 bp, Homo sapiens
cttttcctcaggaggagacgcg

SEQ ID NO: 7604774 - DNA, 22 bp, Homo sapiens
cttttctactaatgagtagcta

SEQ ID NO: 7604775 - DNA, 22 bp, Homo sapiens
cttttctactaatgagtagcta

SEQ ID NO: 7604776 - DNA, 22 bp, Homo sapiens
cttttctactaatgagtagcta

SEQ ID NO: 7604777 - DNA, 22 bp, Homo sapiens
cttttctactaatgagtagcta

SEQ ID NO: 7604778 - DNA, 22 bp, Homo sapiens
cttttcctcaggaggagacgcg

SEQ ID NO: 7604779 - DNA, 22 bp, Homo sapiens
cttttcctcaggaggagacgcg

SEQ ID NO: 7604780 - DNA, 22 bp, Homo sapiens
cttttcctcaggaggagacgcg

SEQ ID NO: 7604781 - DNA, 22 bp, Homo sapiens
cttttcctcaggaggagacgcg

SEQ ID NO: 7604782 - DNA, 22 bp, Homo sapiens
cttttcctcaggaggagacgcg

SEQ ID NO: 7604783 - DNA, 22 bp, Homo sapiens
cttttcctattgattctgttac

SEQ ID NO: 7604784 - DNA, 22 bp, Homo sapiens
cttttcctattgattctgttac

SEQ ID NO: 7604785 - DNA, 22 bp, Homo sapiens
cttttcctattgattctgttac

SEQ ID NO: 7604786 - DNA, 22 bp, Homo sapiens
cttttcttgtattggatgcccc

SEQ ID NO: 7604787 - DNA, 22 bp, Homo sapiens
cttttcttgtattggatgcccc

SEQ ID NO: 7604788 - DNA, 22 bp, Homo sapiens
cttttcttgtattggatgcccc

SEQ ID NO: 7604789 - DNA, 22 bp, Homo sapiens
cttttgattgagcagtttcaaa

SEQ ID NO: 7604790 - DNA, 22 bp, Homo sapiens
cttttgattgagcagtttcaaa

SEQ ID NO: 7604791 - DNA, 22 bp, Homo sapiens
cttttgcacccagagttatttg

SEQ ID NO: 7604792 - DNA, 22 bp, Homo sapiens
cttttgcacccagagttatttg

SEQ ID NO: 7604793 - DNA, 22 bp, Homo sapiens
cttttcttgtattggatgcccc

SEQ ID NO: 7604794 - DNA, 22 bp, Homo sapiens
cttttcttgtattggatgcccc

SEQ ID NO: 7604795 - DNA, 22 bp, Homo sapiens
cttttcttgtattggatgcccc

SEQ ID NO: 7604796 - DNA, 22 bp, Homo sapiens
cttttcttgtattggatgcccc

SEQ ID NO: 7604797 - DNA, 22 bp, Homo sapiens
cttttcttgtattggatgcccc

SEQ ID NO: 7604798 - DNA, 22 bp, Homo sapiens
cttttcttgtattggatgcccc

SEQ ID NO: 7604799 - DNA, 22 bp, Homo sapiens
cttttcttgtattggatgcccc

SEQ ID NO: 7604800 - DNA, 22 bp, Homo sapiens
cttttcttctcacggctgtcag

SEQ ID NO: 7604801 - DNA, 22 bp, Homo sapiens
cttttcttctcacggctgtcag

SEQ ID NO: 7604802 - DNA, 22 bp, Homo sapiens
cttttcttctcacggctgtcag

SEQ ID NO: 7604803 - DNA, 22 bp, Homo sapiens
cttttcttctcacggctgtcag

SEQ ID NO: 7604804 - DNA, 22 bp, Homo sapiens
cttttcttctcacggctgtcag

SEQ ID NO: 7604805 - DNA, 22 bp, Homo sapiens
cttttcttctcacggctgtcag

SEQ ID NO: 7604806 - DNA, 22 bp, Homo sapiens
cttttcttatgtggacgtacct

SEQ ID NO: 7604807 - DNA, 22 bp, Homo sapiens
cttttcttatgtggacgtacct

SEQ ID NO: 7604808 - DNA, 22 bp, Homo sapiens
cttttcttactcccgcaaggca

SEQ ID NO: 7604809 - DNA, 22 bp, Homo sapiens
cttttcttactcccgcaaggca

SEQ ID NO: 7604810 - DNA, 22 bp, Homo sapiens
cttttcttatgtggacgtacct

SEQ ID NO: 7604811 - DNA, 22 bp, Homo sapiens
cttttcttatgtggacgtacct

SEQ ID NO: 7604812 - DNA, 22 bp, Homo sapiens
cttttcttatgtggacgtacct

SEQ ID NO: 7604813 - DNA, 22 bp, Homo sapiens
cttttcttctcacggctgtcag

SEQ ID NO: 7604814 - DNA, 22 bp, Homo sapiens
cttttcttctcacggctgtcag

SEQ ID NO: 7604815 - DNA, 22 bp, Homo sapiens
cttttcttatgtggacgtacct

SEQ ID NO: 7604816 - DNA, 22 bp, Homo sapiens
cttttcttatgtggacgtacct

SEQ ID NO: 7604817 - DNA, 22 bp, Homo sapiens
cttttcttatgtggacgtacct

SEQ ID NO: 7604818 - DNA, 22 bp, Homo sapiens
cttttcttatgtggacgtacct

SEQ ID NO: 7604819 - DNA, 22 bp, Homo sapiens
cttttcttatgtggacgtacct

SEQ ID NO: 7604820 - DNA, 22 bp, Homo sapiens
cttttcttactcccgcaaggca

SEQ ID NO: 7604821 - DNA, 22 bp, Homo sapiens
cttttcttactcccgcaaggca

SEQ ID NO: 7604822 - DNA, 22 bp, Homo sapiens
cttttcttactcccgcaaggca

SEQ ID NO: 7604823 - DNA, 22 bp, Homo sapiens
cttttcttactcccgcaaggca

SEQ ID NO: 7604824 - DNA, 22 bp, Homo sapiens
cttttcttactcccgcaaggca

SEQ ID NO: 7604825 - DNA, 22 bp, Homo sapiens
cttttcttactcccgcaaggca

SEQ ID NO: 7604826 - DNA, 22 bp, Homo sapiens
cttttcttactcccgcaaggca

SEQ ID NO: 7604827 - DNA, 21 bp, Homo sapiens
cttttctgtgttcctccctgt

SEQ ID NO: 7604828 - DNA, 21 bp, Homo sapiens
cttttctgtgttcctccctgt

SEQ ID NO: 7604829 - DNA, 22 bp, Homo sapiens
ctttgcagtgaatccataaata

SEQ ID NO: 7604830 - DNA, 18 bp, Homo sapiens
ctttgcagttacagggca

SEQ ID NO: 7604831 - DNA, 18 bp, Homo sapiens
ctttgcagttacagggca

SEQ ID NO: 7604832 - DNA, 22 bp, Homo sapiens
ctttgcagtatagcctagtaga

SEQ ID NO: 7604833 - DNA, 19 bp, Homo sapiens
ctttgcaggggatgggtga

SEQ ID NO: 7604834 - DNA, 22 bp, Homo sapiens
ctttgcaggagtatgtgataat

SEQ ID NO: 7604835 - DNA, 20 bp, Homo sapiens
ctttgcaggagaacagagaa

SEQ ID NO: 7604836 - DNA, 20 bp, Homo sapiens
ctttgcaggagaacagagaa

SEQ ID NO: 7604837 - DNA, 22 bp, Homo sapiens
ctttgcagctctaggtggaagc

SEQ ID NO: 7604838 - DNA, 22 bp, Homo sapiens
cttttacactcatctgggaggg

SEQ ID NO: 7604839 - DNA, 22 bp, Homo sapiens
cttttacagtggacctgccatt

SEQ ID NO: 7604840 - DNA, 22 bp, Homo sapiens
cttttacagtggacctgccatt

SEQ ID NO: 7604841 - DNA, 21 bp, Homo sapiens
cttttacattcagtcatgatg

SEQ ID NO: 7604842 - DNA, 21 bp, Homo sapiens
cttttacattcagtcatgatg

SEQ ID NO: 7604843 - DNA, 22 bp, Homo sapiens
cttttccaaagtccatctggtc

SEQ ID NO: 7604844 - DNA, 22 bp, Homo sapiens
cttttccaaagtccatctggtc

SEQ ID NO: 7604845 - DNA, 22 bp, Homo sapiens
cttttccaaagtccatctggtc

SEQ ID NO: 7604846 - DNA, 22 bp, Homo sapiens
cttttccactgagcctcacaaa

SEQ ID NO: 7604847 - DNA, 22 bp, Homo sapiens
cttttccactgagcctcacaaa

SEQ ID NO: 7604848 - DNA, 22 bp, Homo sapiens
cttttccactgagcctcacaaa

SEQ ID NO: 7604849 - DNA, 18 bp, Homo sapiens
cttttcccctttggactc

SEQ ID NO: 7604850 - DNA, 22 bp, Homo sapiens
cttttccactgagcctcacaaa

SEQ ID NO: 7604851 - DNA, 22 bp, Homo sapiens
cttttcctattgattctgttac

SEQ ID NO: 7604852 - DNA, 22 bp, Homo sapiens
cttttcctattgattctgttac

SEQ ID NO: 7604853 - DNA, 18 bp, Homo sapiens
cttttcccctttggactc

SEQ ID NO: 7604854 - DNA, 22 bp, Homo sapiens
cttttcctattgattctgttac

SEQ ID NO: 7604855 - DNA, 22 bp, Homo sapiens
cttttacatttgttgaagagta

SEQ ID NO: 7604856 - DNA, 22 bp, Homo sapiens
cttttacatttgttgaagagta

SEQ ID NO: 7604857 - DNA, 22 bp, Homo sapiens
cttttcattgtttgtacatgca

SEQ ID NO: 7604858 - DNA, 22 bp, Homo sapiens
cttttcattgtttgtacatgca

SEQ ID NO: 7604859 - DNA, 22 bp, Homo sapiens
cttttcattgtttgtacatgca

SEQ ID NO: 7604860 - DNA, 22 bp, Homo sapiens
cttttcattgtttgtacatgca

SEQ ID NO: 7604861 - DNA, 22 bp, Homo sapiens
cttttcattgtttgtacatgca

SEQ ID NO: 7604862 - DNA, 21 bp, Homo sapiens
cttttacattcagtcatgatg

SEQ ID NO: 7604863 - DNA, 22 bp, Homo sapiens
cttttacatttgttgaagagta

SEQ ID NO: 7604864 - DNA, 22 bp, Homo sapiens
cttttacatttgttgaagagta

SEQ ID NO: 7604865 - DNA, 22 bp, Homo sapiens
cttttacatttgttgaagagta

SEQ ID NO: 7604866 - DNA, 22 bp, Homo sapiens
ctttgattccaggcacatgttt

SEQ ID NO: 7604867 - DNA, 22 bp, Homo sapiens
ctttgattcagagagaattagc

SEQ ID NO: 7604868 - DNA, 22 bp, Homo sapiens
ctttgattcagactttgtcggc

SEQ ID NO: 7604869 - DNA, 22 bp, Homo sapiens
ctttgattcagagagaattagc

SEQ ID NO: 7604870 - DNA, 22 bp, Homo sapiens
ctttgattcagagagaattagc

SEQ ID NO: 7604871 - DNA, 22 bp, Homo sapiens
ctttgattcagagagaattagc

SEQ ID NO: 7604872 - DNA, 22 bp, Homo sapiens
ctttgattccaggcacatgttt

SEQ ID NO: 7604873 - DNA, 22 bp, Homo sapiens
ctttgattccaggcacatgttt

SEQ ID NO: 7604874 - DNA, 22 bp, Homo sapiens
ctttgatttctctggtccaatc

SEQ ID NO: 7604875 - DNA, 23 bp, Homo sapiens
ctttgcaaaaacattagtcagtg

SEQ ID NO: 7604876 - DNA, 23 bp, Homo sapiens
ctttgcaaaaacattagtcagtg

SEQ ID NO: 7604877 - DNA, 22 bp, Homo sapiens
ctttgcaaactgtcacactttc

SEQ ID NO: 7604878 - DNA, 22 bp, Homo sapiens
ctttgcaaactgtcacactttc

SEQ ID NO: 7604879 - DNA, 22 bp, Homo sapiens
ctttgcaaacgattaccacatg

SEQ ID NO: 7604880 - DNA, 23 bp, Homo sapiens
ctttgcaaaaacattagtcagtg

SEQ ID NO: 7604881 - DNA, 21 bp, Homo sapiens
ctttgcaagatgtctatgaaa

SEQ ID NO: 7604882 - DNA, 22 bp, Homo sapiens
ctttgcaaagtctttggcaaga

SEQ ID NO: 7604883 - DNA, 22 bp, Homo sapiens
ctttgcaaagtctttggcaaga

SEQ ID NO: 7604884 - DNA, 22 bp, Homo sapiens
ctttgcaaactgtcacactttc

SEQ ID NO: 7604885 - DNA, 22 bp, Homo sapiens
ctttgcaagggatttcatgtct

SEQ ID NO: 7604886 - DNA, 21 bp, Homo sapiens
ctttgcaagatgtctatgaaa

SEQ ID NO: 7604887 - DNA, 21 bp, Homo sapiens
ctttgcaagatgtctatgaaa

SEQ ID NO: 7604888 - DNA, 22 bp, Homo sapiens
ctttgcaagtgctttgtagtcc

SEQ ID NO: 7604889 - DNA, 22 bp, Homo sapiens
ctttgcaatagaggcacacatg

SEQ ID NO: 7604890 - DNA, 22 bp, Homo sapiens
ctttgcaatagaggcacacatg

SEQ ID NO: 7604891 - DNA, 22 bp, Homo sapiens
ctttgcagaaataaacttgatg

SEQ ID NO: 7604892 - DNA, 22 bp, Homo sapiens
ctttgcactccagtctcctgct

SEQ ID NO: 7604893 - DNA, 22 bp, Homo sapiens
ctttgcaatagaggcacacatg

SEQ ID NO: 7604894 - DNA, 22 bp, Homo sapiens
ctttgcaatagaggcacacatg

SEQ ID NO: 7604895 - DNA, 17 bp, Homo sapiens
ctttgcagcagacatgt

SEQ ID NO: 7604896 - DNA, 17 bp, Homo sapiens
ctttgcagcagacatgt

SEQ ID NO: 7604897 - DNA, 22 bp, Homo sapiens
ctttgcagcaatttctgttaaa

SEQ ID NO: 7604898 - DNA, 22 bp, Homo sapiens
ctttgcagcaatttctgttaaa

SEQ ID NO: 7604899 - DNA, 22 bp, Homo sapiens
ctttgcagatttgtttagtgct

SEQ ID NO: 7604900 - DNA, 22 bp, Homo sapiens
ctttgcagagggggtgggagct

SEQ ID NO: 7604901 - DNA, 22 bp, Homo sapiens
ctttgcagagggggtgggagct

SEQ ID NO: 7604902 - DNA, 22 bp, Homo sapiens
ctttgcagaagaaacctacaaa

SEQ ID NO: 7604903 - DNA, 22 bp, Homo sapiens
ctttgcagaaataaacttgatg

SEQ ID NO: 7604904 - DNA, 22 bp, Homo sapiens
ctttgcagaaataaacttgatg

SEQ ID NO: 7604905 - DNA, 22 bp, Homo sapiens
gaaacacatgcagctccataga

SEQ ID NO: 7604906 - DNA, 22 bp, Homo sapiens
gaaacacatgcagctccataga

SEQ ID NO: 7604907 - DNA, 22 bp, Homo sapiens
gaaacacatatgaacagttgat

SEQ ID NO: 7604908 - DNA, 22 bp, Homo sapiens
gaaacacatatgaacagttgat

SEQ ID NO: 7604909 - DNA, 22 bp, Homo sapiens
gaaacacatgcagctccataga

SEQ ID NO: 7604910 - DNA, 22 bp, Homo sapiens
gaaacacatgcagctccataga

SEQ ID NO: 7604911 - DNA, 22 bp, Homo sapiens
gaaacacatgcagctccataga

SEQ ID NO: 7604912 - DNA, 22 bp, Homo sapiens
gaaacacatgcagctccataga

SEQ ID NO: 7604913 - DNA, 22 bp, Homo sapiens
gaaacaatttttgttgtctaag

SEQ ID NO: 7604914 - DNA, 22 bp, Homo sapiens
gaaacaatttttgttgtctaag

SEQ ID NO: 7604915 - DNA, 22 bp, Homo sapiens
gaaacaatttttgttgtctaag

SEQ ID NO: 7604916 - DNA, 22 bp, Homo sapiens
gaaacaatttttgttgtctaag

SEQ ID NO: 7604917 - DNA, 22 bp, Homo sapiens
gaaacaatttttgttgtctaag

SEQ ID NO: 7604918 - DNA, 22 bp, Homo sapiens
gaaacaatttttgttgtctaag

SEQ ID NO: 7604919 - DNA, 22 bp, Homo sapiens
gaaacacatatgaacagttgat

SEQ ID NO: 7604920 - DNA, 22 bp, Homo sapiens
gaaacacatatgaacagttgat

SEQ ID NO: 7604921 - DNA, 22 bp, Homo sapiens
gaaacacatatgaacagttgat

SEQ ID NO: 7604922 - DNA, 22 bp, Homo sapiens
gaaacacatatgaacagttgat

SEQ ID NO: 7604923 - DNA, 22 bp, Homo sapiens
gaaacacatatgaacagttgat

SEQ ID NO: 7604924 - DNA, 22 bp, Homo sapiens
gaaacactggtaaagactgccg

SEQ ID NO: 7604925 - DNA, 22 bp, Homo sapiens
gaaacagattaacagcatattt

SEQ ID NO: 7604926 - DNA, 22 bp, Homo sapiens
gaaacagattaacagcatattt

SEQ ID NO: 7604927 - DNA, 22 bp, Homo sapiens
gaaacagattaacagcatattt

SEQ ID NO: 7604928 - DNA, 22 bp, Homo sapiens
gaaacagcacgtttggagagat

SEQ ID NO: 7604929 - DNA, 22 bp, Homo sapiens
gaaacagcacgtttggagagat

SEQ ID NO: 7604930 - DNA, 22 bp, Homo sapiens
gaaacagcacgtttggagagat

SEQ ID NO: 7604931 - DNA, 22 bp, Homo sapiens
gaaacagattaacagcatattt

SEQ ID NO: 7604932 - DNA, 22 bp, Homo sapiens
gaaacagattaacagcatattt

SEQ ID NO: 7604933 - DNA, 22 bp, Homo sapiens
gaaacagattaacagcatattt

SEQ ID NO: 7604934 - DNA, 22 bp, Homo sapiens
gaaacactatgccaagacaggg

SEQ ID NO: 7604935 - DNA, 22 bp, Homo sapiens
gaaacactatgccaagacaggg

SEQ ID NO: 7604936 - DNA, 22 bp, Homo sapiens
gaaacactatgccaagacaggg

SEQ ID NO: 7604937 - DNA, 22 bp, Homo sapiens
gaaacactatgccaagacaggg

SEQ ID NO: 7604938 - DNA, 22 bp, Homo sapiens
gaaacactatgccaagacaggg

SEQ ID NO: 7604939 - DNA, 22 bp, Homo sapiens
gaaacacatgcagctccataga

SEQ ID NO: 7604940 - DNA, 22 bp, Homo sapiens
gaaacacatgcagctccataga

SEQ ID NO: 7604941 - DNA, 22 bp, Homo sapiens
gaaacacatgcagctccataga

SEQ ID NO: 7604942 - DNA, 22 bp, Homo sapiens
gaaacactcaatttagtaattc

SEQ ID NO: 7604943 - DNA, 22 bp, Homo sapiens
gaaacactggtaaagactgccg

SEQ ID NO: 7604944 - DNA, 22 bp, Homo sapiens
gaaacactatgccaagacaggg

SEQ ID NO: 7604945 - DNA, 22 bp, Homo sapiens
gaaagagaggggctgagatgca

SEQ ID NO: 7604946 - DNA, 22 bp, Homo sapiens
gaaagagaggggctgagatgca

SEQ ID NO: 7604947 - DNA, 22 bp, Homo sapiens
gaaagagaggggctgagatgca

SEQ ID NO: 7604948 - DNA, 22 bp, Homo sapiens
gaaagagaggggctgagatgca

SEQ ID NO: 7604949 - DNA, 22 bp, Homo sapiens
gaaagagaggggctgagatgca

SEQ ID NO: 7604950 - DNA, 22 bp, Homo sapiens
gaaagagaggggctgagatgca

SEQ ID NO: 7604951 - DNA, 22 bp, Homo sapiens
gaaagagaggggctgagatgca

SEQ ID NO: 7604952 - DNA, 22 bp, Homo sapiens
gaaagagaggggctgagatgca

SEQ ID NO: 7604953 - DNA, 22 bp, Homo sapiens
gaaagagaacctgggcctagat

SEQ ID NO: 7604954 - DNA, 22 bp, Homo sapiens
gaaacagcacgtttggagagat

SEQ ID NO: 7604955 - DNA, 22 bp, Homo sapiens
gaaagcatccgcctggaggtgg

SEQ ID NO: 7604956 - DNA, 22 bp, Homo sapiens
gaaagatatttattggcaacag

SEQ ID NO: 7604957 - DNA, 22 bp, Homo sapiens
gaaagatatttattggcaacag

SEQ ID NO: 7604958 - DNA, 22 bp, Homo sapiens
gaaagatatttattggcaacag

SEQ ID NO: 7604959 - DNA, 22 bp, Homo sapiens
gaaagatatttattggcaacag

SEQ ID NO: 7604960 - DNA, 22 bp, Homo sapiens
gaaagataatcaattactcctt

SEQ ID NO: 7604961 - DNA, 22 bp, Homo sapiens
gaaagataatcaattactcctt

SEQ ID NO: 7604962 - DNA, 22 bp, Homo sapiens
gaaagaggaaggagatgtatta

SEQ ID NO: 7604963 - DNA, 22 bp, Homo sapiens
gaaagagtatgggagctttact

SEQ ID NO: 7604964 - DNA, 22 bp, Homo sapiens
gaaagaggaaggagatgtatta

SEQ ID NO: 7604965 - DNA, 22 bp, Homo sapiens
gaaagaggaaggagatgtatta

SEQ ID NO: 7604966 - DNA, 22 bp, Homo sapiens
gaaagagtatgggagctttact

SEQ ID NO: 7604967 - DNA, 22 bp, Homo sapiens
gaaagagtatgggagctttact

SEQ ID NO: 7604968 - DNA, 22 bp, Homo sapiens
gaaagccagagagaaagggctc

SEQ ID NO: 7604969 - DNA, 22 bp, Homo sapiens
gaaagccagagagaaagggctc

SEQ ID NO: 7604970 - DNA, 22 bp, Homo sapiens
gaaagccagagagaaagggctc

SEQ ID NO: 7604971 - DNA, 22 bp, Homo sapiens
gaaagccatagcccagctttac

SEQ ID NO: 7604972 - DNA, 22 bp, Homo sapiens
gaaagccagagagaaagggctc

SEQ ID NO: 7604973 - DNA, 22 bp, Homo sapiens
gaaagccatctggctgctggga

SEQ ID NO: 7604974 - DNA, 22 bp, Homo sapiens
gaaagccatctggctgctggga

SEQ ID NO: 7604975 - DNA, 18 bp, Homo sapiens
gaaagccatgcagcagtg

SEQ ID NO: 7604976 - DNA, 18 bp, Homo sapiens
gaaagccatgcagcagtg

SEQ ID NO: 7604977 - DNA, 18 bp, Homo sapiens
gaaagccatgcagcagtg

SEQ ID NO: 7604978 - DNA, 18 bp, Homo sapiens
gaaagccatgcagcagtg

SEQ ID NO: 7604979 - DNA, 23 bp, Homo sapiens
gaaagctctctcctcaggacctt

SEQ ID NO: 7604980 - DNA, 22 bp, Homo sapiens
gaaagctctgcttcagcctgca

SEQ ID NO: 7604981 - DNA, 22 bp, Homo sapiens
gaaagcccattgacaaagaagt

SEQ ID NO: 7604982 - DNA, 22 bp, Homo sapiens
gaaagcccattgacaaagaagt

SEQ ID NO: 7604983 - DNA, 22 bp, Homo sapiens
gaaagctaaatgaggtcttaca

SEQ ID NO: 7604984 - DNA, 22 bp, Homo sapiens
gaaaattattgaaaatggctct

SEQ ID NO: 7604985 - DNA, 22 bp, Homo sapiens
gaaaatttaattctcttctgtg

SEQ ID NO: 7604986 - DNA, 22 bp, Homo sapiens
gaaaatttaattctcttctgtg

SEQ ID NO: 7604987 - DNA, 22 bp, Homo sapiens
gaaaatttaattctcttctgtg

SEQ ID NO: 7604988 - DNA, 22 bp, Homo sapiens
gaaaatttaattctcttctgtg

SEQ ID NO: 7604989 - DNA, 22 bp, Homo sapiens
gaaaatttaattctcttctgtg

SEQ ID NO: 7604990 - DNA, 22 bp, Homo sapiens
gaaaatttctgccacatgtgtg

SEQ ID NO: 7604991 - DNA, 22 bp, Homo sapiens
gaaaatttctgccacatgtgtg

SEQ ID NO: 7604992 - DNA, 22 bp, Homo sapiens
gaaaatttctgccacatgtgtg

SEQ ID NO: 7604993 - DNA, 22 bp, Homo sapiens
gaaaatttagaactgaacttct

SEQ ID NO: 7604994 - DNA, 22 bp, Homo sapiens
gaaaatttagaactgaacttct

SEQ ID NO: 7604995 - DNA, 22 bp, Homo sapiens
gaaaatttagaactgaacttct

SEQ ID NO: 7604996 - DNA, 22 bp, Homo sapiens
gaaaatttagaactgaacttct

SEQ ID NO: 7604997 - DNA, 22 bp, Homo sapiens
gaaaatttagaactgaacttct

SEQ ID NO: 7604998 - DNA, 22 bp, Homo sapiens
gaaacaatcatcatgtgatttg

SEQ ID NO: 7604999 - DNA, 22 bp, Homo sapiens
gaaacaatcatcatgtgatttg

SEQ ID NO: 7605000 - DNA, 22 bp, Homo sapiens
gaaacaatcatcatgtgatttg

SEQ ID NO: 7605001 - DNA, 22 bp, Homo sapiens
gaaacaatcatcatgtgatttg

SEQ ID NO: 7605002 - DNA, 22 bp, Homo sapiens
gaaacaatacttgtcctcacta

SEQ ID NO: 7605003 - DNA, 22 bp, Homo sapiens
gaaacaatacttgtcctcacta

SEQ ID NO: 7605004 - DNA, 22 bp, Homo sapiens
gaaaatttctgccacatgtgtg

SEQ ID NO: 7605005 - DNA, 22 bp, Homo sapiens
gaaaatttctgccacatgtgtg

SEQ ID NO: 7605006 - DNA, 22 bp, Homo sapiens
gaaaatttctgccacatgtgtg

SEQ ID NO: 7605007 - DNA, 22 bp, Homo sapiens
gaaaatttctgccacatgtgtg

SEQ ID NO: 7605008 - DNA, 22 bp, Homo sapiens
gaaacaactactattgatttct

SEQ ID NO: 7605009 - DNA, 22 bp, Homo sapiens
gaaaatttctgccacatgtgtg

SEQ ID NO: 7605010 - DNA, 22 bp, Homo sapiens
gaaacaactactattgatttct

SEQ ID NO: 7605011 - DNA, 22 bp, Homo sapiens
gaaacaactactattgatttct

SEQ ID NO: 7605012 - DNA, 22 bp, Homo sapiens
gaaacaactactattgatttct

SEQ ID NO: 7605013 - DNA, 22 bp, Homo sapiens
gaaacaactactattgatttct

SEQ ID NO: 7605014 - DNA, 22 bp, Homo sapiens
gaaaatagcagatagaccaatg

SEQ ID NO: 7605015 - DNA, 22 bp, Homo sapiens
gaaaatacttcagtgttctggc

SEQ ID NO: 7605016 - DNA, 22 bp, Homo sapiens
gaaaatacttcagtgttctggc

SEQ ID NO: 7605017 - DNA, 22 bp, Homo sapiens
gaaaatacttcagtgttctggc

SEQ ID NO: 7605018 - DNA, 22 bp, Homo sapiens
gaaaatacttcagtgttctggc

SEQ ID NO: 7605019 - DNA, 22 bp, Homo sapiens
gaaaatacttcagtgttctggc

SEQ ID NO: 7605020 - DNA, 22 bp, Homo sapiens
gaaaatacttcagtgttctggc

SEQ ID NO: 7605021 - DNA, 22 bp, Homo sapiens
gaaaatacttcagtgttctggc

SEQ ID NO: 7605022 - DNA, 22 bp, Homo sapiens
cttttgcagccattattgctgc

SEQ ID NO: 7605023 - DNA, 22 bp, Homo sapiens
cttttgcaccttttaagtaatg

SEQ ID NO: 7605024 - DNA, 22 bp, Homo sapiens
cttttgcagccattattgctgc

SEQ ID NO: 7605025 - DNA, 22 bp, Homo sapiens
cttttgcagccattattgctgc

SEQ ID NO: 7605026 - DNA, 22 bp, Homo sapiens
cttttgcagccattattgctgc

SEQ ID NO: 7605027 - DNA, 22 bp, Homo sapiens
gaaaatacttcagtgttctggc

SEQ ID NO: 7605028 - DNA, 22 bp, Homo sapiens
gaaaatacttcagtgttctggc

SEQ ID NO: 7605029 - DNA, 22 bp, Homo sapiens
cttttgcaccttttaagtaatg

SEQ ID NO: 7605030 - DNA, 22 bp, Homo sapiens
cttttgcaccttttaagtaatg

SEQ ID NO: 7605031 - DNA, 22 bp, Homo sapiens
cttttgcacccagagttatttg

SEQ ID NO: 7605032 - DNA, 22 bp, Homo sapiens
cttttgcacccagagttatttg

SEQ ID NO: 7605033 - DNA, 22 bp, Homo sapiens
cttttgcacccagagttatttg

SEQ ID NO: 7605034 - DNA, 22 bp, Homo sapiens
gaaaatgtttcctgttatttgc

SEQ ID NO: 7605035 - DNA, 22 bp, Homo sapiens
gaaaatgtttcctgttatttgc

SEQ ID NO: 7605036 - DNA, 22 bp, Homo sapiens
gaaaatgtttcctgttatttgc

SEQ ID NO: 7605037 - DNA, 22 bp, Homo sapiens
gaaaatgtttcctgttatttgc

SEQ ID NO: 7605038 - DNA, 22 bp, Homo sapiens
gaaaatagcagatagaccaatg

SEQ ID NO: 7605039 - DNA, 22 bp, Homo sapiens
gaaaatagcagatagaccaatg

SEQ ID NO: 7605040 - DNA, 22 bp, Homo sapiens
gaaaatgttagcttcatagtca

SEQ ID NO: 7605041 - DNA, 22 bp, Homo sapiens
gaaaatgttagcttcatagtca

SEQ ID NO: 7605042 - DNA, 22 bp, Homo sapiens
gaaaatgttagcttcatagtca

SEQ ID NO: 7605043 - DNA, 22 bp, Homo sapiens
gaaaattattgaaaatggctct

SEQ ID NO: 7605044 - DNA, 22 bp, Homo sapiens
gaaaattattgaaaatggctct

SEQ ID NO: 7605045 - DNA, 22 bp, Homo sapiens
gaaaattattgaaaatggctct

SEQ ID NO: 7605046 - DNA, 22 bp, Homo sapiens
gaaaattattgaaaatggctct

SEQ ID NO: 7605047 - DNA, 22 bp, Homo sapiens
gaaaattattgaaaatggctct

SEQ ID NO: 7605048 - DNA, 22 bp, Homo sapiens
gaaaattattgaaaatggctct

SEQ ID NO: 7605049 - DNA, 22 bp, Homo sapiens
gaaaatgtttgtccggagctga

SEQ ID NO: 7605050 - DNA, 22 bp, Homo sapiens
gaaaatgtttgtccggagctga

SEQ ID NO: 7605051 - DNA, 22 bp, Homo sapiens
gaaaatgtttgtccggagctga

SEQ ID NO: 7605052 - DNA, 22 bp, Homo sapiens
gaaaattattgaaaatggctct

SEQ ID NO: 7605053 - DNA, 22 bp, Homo sapiens
ctgtttataaatagaggggagt

SEQ ID NO: 7605054 - DNA, 22 bp, Homo sapiens
ctgtttatactcaaaagataca

SEQ ID NO: 7605055 - DNA, 22 bp, Homo sapiens
ctgtttatacgacaggtggagg

SEQ ID NO: 7605056 - DNA, 22 bp, Homo sapiens
ctgtttatcatgtacatttcca

SEQ ID NO: 7605057 - DNA, 22 bp, Homo sapiens
ctgtttatcatgtacatttcca

SEQ ID NO: 7605058 - DNA, 21 bp, Homo sapiens
ctgtttcttgtgaagtgacac

SEQ ID NO: 7605059 - DNA, 21 bp, Homo sapiens
ctgtttcttgtgaagtgacac

SEQ ID NO: 7605060 - DNA, 19 bp, Homo sapiens
ctgtttctgagcttgcttt

SEQ ID NO: 7605061 - DNA, 19 bp, Homo sapiens
ctgtttctgagcttgcttt

SEQ ID NO: 7605062 - DNA, 19 bp, Homo sapiens
ctgtttctgagcttgcttt

SEQ ID NO: 7605063 - DNA, 22 bp, Homo sapiens
ctgtttaatgcaatgaaatgag

SEQ ID NO: 7605064 - DNA, 22 bp, Homo sapiens
ctgtttaatgcaatgaaatgag

SEQ ID NO: 7605065 - DNA, 22 bp, Homo sapiens
ctgtttacttattggtaaagag

SEQ ID NO: 7605066 - DNA, 22 bp, Homo sapiens
ctgtttataaaccaccagttta

SEQ ID NO: 7605067 - DNA, 22 bp, Homo sapiens
ctgtttaatgaggtgtaacaac

SEQ ID NO: 7605068 - DNA, 21 bp, Homo sapiens
ctgtggaagggaactagaggg

SEQ ID NO: 7605069 - DNA, 22 bp, Homo sapiens
ctgtttaatgaggtgtaacaac

SEQ ID NO: 7605070 - DNA, 22 bp, Homo sapiens
ctgtttaatgaggtgtaacaac

SEQ ID NO: 7605071 - DNA, 22 bp, Homo sapiens
ctgtggaaggacttagcgatac

SEQ ID NO: 7605072 - DNA, 22 bp, Homo sapiens
ctgtggaaggacttagcgatac

SEQ ID NO: 7605073 - DNA, 21 bp, Homo sapiens
ctgtggaagggaactagaggg

SEQ ID NO: 7605074 - DNA, 21 bp, Homo sapiens
ctgtggaagggaactagaggg

SEQ ID NO: 7605075 - DNA, 22 bp, Homo sapiens
ctgtgcttgcgggtgtggagcc

SEQ ID NO: 7605076 - DNA, 22 bp, Homo sapiens
ctgtgcttgcgggtgtggagcc

SEQ ID NO: 7605077 - DNA, 22 bp, Homo sapiens
ctgtgcttgcgggtgtggagcc

SEQ ID NO: 7605078 - DNA, 22 bp, Homo sapiens
ctgtgcttgtgttcattgttaa

SEQ ID NO: 7605079 - DNA, 22 bp, Homo sapiens
ctgtgcttgtgttcattgttaa

SEQ ID NO: 7605080 - DNA, 22 bp, Homo sapiens
ctgtgctttcaaaagaagggtt

SEQ ID NO: 7605081 - DNA, 22 bp, Homo sapiens
ctgtgcttccaggatggcagct

SEQ ID NO: 7605082 - DNA, 22 bp, Homo sapiens
ctgtgcttcgcaactccaaggt

SEQ ID NO: 7605083 - DNA, 22 bp, Homo sapiens
ctgtgcttcgcaactccaaggt

SEQ ID NO: 7605084 - DNA, 22 bp, Homo sapiens
ctgtgcttgacagtgggaagca

SEQ ID NO: 7605085 - DNA, 22 bp, Homo sapiens
ctgtgcttgacagtgggaagca

SEQ ID NO: 7605086 - DNA, 22 bp, Homo sapiens
ctgtgcttcgcaactccaaggt

SEQ ID NO: 7605087 - DNA, 21 bp, Homo sapiens
ctgtgcttcttcctaagccag

SEQ ID NO: 7605088 - DNA, 21 bp, Homo sapiens
ctgtgctttttaagtgtgatg

SEQ ID NO: 7605089 - DNA, 20 bp, Homo sapiens
ctgtgctttggaacctggaa

SEQ ID NO: 7605090 - DNA, 22 bp, Homo sapiens
ctgtgctttcgagatgtgatct

SEQ ID NO: 7605091 - DNA, 22 bp, Homo sapiens
ctgtgctttcaggccgctgtgt

SEQ ID NO: 7605092 - DNA, 22 bp, Homo sapiens
ctgtgctttcgagatgtgatct

SEQ ID NO: 7605093 - DNA, 22 bp, Homo sapiens
ctgtggaacttagtgggagaca

SEQ ID NO: 7605094 - DNA, 22 bp, Homo sapiens
ctgtggaacttagtgggagaca

SEQ ID NO: 7605095 - DNA, 22 bp, Homo sapiens
ctgtggaaataaacaatgctaa

SEQ ID NO: 7605096 - DNA, 22 bp, Homo sapiens
ctgtggaaaatttgtatgtaat

SEQ ID NO: 7605097 - DNA, 22 bp, Homo sapiens
ctgtggaaaatgctttacatat

SEQ ID NO: 7605098 - DNA, 22 bp, Homo sapiens
cttaaaatctggcagttagcta

SEQ ID NO: 7605099 - DNA, 22 bp, Homo sapiens
cttaaaatctggcagttagcta

SEQ ID NO: 7605100 - DNA, 22 bp, Homo sapiens
cttaaaatctggcagttagcta

SEQ ID NO: 7605101 - DNA, 22 bp, Homo sapiens
cttaaaatctggcagttagcta

SEQ ID NO: 7605102 - DNA, 22 bp, Homo sapiens
cttaaaatctggcagttagcta

SEQ ID NO: 7605103 - DNA, 22 bp, Homo sapiens
cttaaaagttgcttccctaact

SEQ ID NO: 7605104 - DNA, 22 bp, Homo sapiens
cttaaaatctggcagttagcta

SEQ ID NO: 7605105 - DNA, 20 bp, Homo sapiens
cttaaaacctctttttctgt

SEQ ID NO: 7605106 - DNA, 22 bp, Homo sapiens
cttaaaagagatgacggcaggg

SEQ ID NO: 7605107 - DNA, 22 bp, Homo sapiens
cttaaaagttgcttccctaact

SEQ ID NO: 7605108 - DNA, 22 bp, Homo sapiens
ctgtttttgtgctgtgtctccc

SEQ ID NO: 7605109 - DNA, 20 bp, Homo sapiens
cttaaaacctctttttctgt

SEQ ID NO: 7605110 - DNA, 22 bp, Homo sapiens
ctgtttttgtgctgtgtctccc

SEQ ID NO: 7605111 - DNA, 22 bp, Homo sapiens
ctgtttttgtgctgtgtctccc

SEQ ID NO: 7605112 - DNA, 22 bp, Homo sapiens
ctgttttctagggctgaggtga

SEQ ID NO: 7605113 - DNA, 22 bp, Homo sapiens
ctgttttgtaggtgagcacctt

SEQ ID NO: 7605114 - DNA, 22 bp, Homo sapiens
ctgtttttcagaaggtaaggga

SEQ ID NO: 7605115 - DNA, 22 bp, Homo sapiens
ctgtttttcagaaggtaaggga

SEQ ID NO: 7605116 - DNA, 22 bp, Homo sapiens
cttaaacaggaaagagccaggt

SEQ ID NO: 7605117 - DNA, 22 bp, Homo sapiens
cttaaacaggaaagagccaggt

SEQ ID NO: 7605118 - DNA, 22 bp, Homo sapiens
cttaaactgggcattcagagaa

SEQ ID NO: 7605119 - DNA, 22 bp, Homo sapiens
cttaaagaaattgaggagagga

SEQ ID NO: 7605120 - DNA, 22 bp, Homo sapiens
cttaaagaaattgaggagagga

SEQ ID NO: 7605121 - DNA, 22 bp, Homo sapiens
cttaaacaggaaagagccaggt

SEQ ID NO: 7605122 - DNA, 20 bp, Homo sapiens
cttaaacacagagatagatt

SEQ ID NO: 7605123 - DNA, 20 bp, Homo sapiens
cttaaacacagagatagatt

SEQ ID NO: 7605124 - DNA, 20 bp, Homo sapiens
cttaaacacagagatagatt

SEQ ID NO: 7605125 - DNA, 20 bp, Homo sapiens
cttaaacacagagatagatt

SEQ ID NO: 7605126 - DNA, 22 bp, Homo sapiens
cttaaaatctggcagttagcta

SEQ ID NO: 7605127 - DNA, 22 bp, Homo sapiens
cttaaaatctggcagttagcta

SEQ ID NO: 7605128 - DNA, 22 bp, Homo sapiens
ctgttttccctggagttcagca

SEQ ID NO: 7605129 - DNA, 22 bp, Homo sapiens
ctgttttcaaagagagagaatg

SEQ ID NO: 7605130 - DNA, 22 bp, Homo sapiens
ctgttttcaaagagagagaatg

SEQ ID NO: 7605131 - DNA, 22 bp, Homo sapiens
ctgttttcaaagagagagaatg

SEQ ID NO: 7605132 - DNA, 22 bp, Homo sapiens
ctgttttatgaagggaatgaga

SEQ ID NO: 7605133 - DNA, 22 bp, Homo sapiens
ctgttttatgaagggaatgaga

SEQ ID NO: 7605134 - DNA, 22 bp, Homo sapiens
ctgttttctagggctgaggtga

SEQ ID NO: 7605135 - DNA, 22 bp, Homo sapiens
ctgttttcctgggttccatgag

SEQ ID NO: 7605136 - DNA, 22 bp, Homo sapiens
ctgttttctacagtctgggtct

SEQ ID NO: 7605137 - DNA, 22 bp, Homo sapiens
ctgttttcctgggttccatgag

SEQ ID NO: 7605138 - DNA, 22 bp, Homo sapiens
ctgttttccctggagttcagca

SEQ ID NO: 7605139 - DNA, 22 bp, Homo sapiens
ctgttttatctcaagagttcaa

SEQ ID NO: 7605140 - DNA, 22 bp, Homo sapiens
ctgttttatctcaagagttcaa

SEQ ID NO: 7605141 - DNA, 22 bp, Homo sapiens
ctgttttatctcaagagttcaa

SEQ ID NO: 7605142 - DNA, 22 bp, Homo sapiens
ctgttttataaagtccaaaagt

SEQ ID NO: 7605143 - DNA, 22 bp, Homo sapiens
ctgttttataaagtccaaaagt

SEQ ID NO: 7605144 - DNA, 22 bp, Homo sapiens
ctgttttataaagtccaaaagt

SEQ ID NO: 7605145 - DNA, 22 bp, Homo sapiens
ctgttttaatggagactgatgt

SEQ ID NO: 7605146 - DNA, 22 bp, Homo sapiens
ctgttttaagtggcgtgtggta

SEQ ID NO: 7605147 - DNA, 22 bp, Homo sapiens
ctgttttaatggagactgatgt

SEQ ID NO: 7605148 - DNA, 22 bp, Homo sapiens
ctgttttaagtggcgtgtggta

SEQ ID NO: 7605149 - DNA, 20 bp, Homo sapiens
ctgtttgctatcatgagctg

SEQ ID NO: 7605150 - DNA, 20 bp, Homo sapiens
ctgtttgctatcatgagctg

SEQ ID NO: 7605151 - DNA, 22 bp, Homo sapiens
ctgtttgctggctatgaactcc

SEQ ID NO: 7605152 - DNA, 22 bp, Homo sapiens
ctgtttctttgctgtcagagag

SEQ ID NO: 7605153 - DNA, 21 bp, Homo sapiens
ctgtttcttgtgaagtgacac

SEQ ID NO: 7605154 - DNA, 22 bp, Homo sapiens
ctgtttctttgctgtcagagag

SEQ ID NO: 7605155 - DNA, 22 bp, Homo sapiens
ctgtttgcccacatttttatta

SEQ ID NO: 7605156 - DNA, 22 bp, Homo sapiens
ctgtttgcattaaagtatatga

SEQ ID NO: 7605157 - DNA, 21 bp, Homo sapiens
ctgtttgcaagcctatgtgtc

SEQ ID NO: 7605158 - DNA, 17 bp, Homo sapiens
ctgtttgttctgggagc

SEQ ID NO: 7605159 - DNA, 22 bp, Homo sapiens
ctgtttgttggctattgacagt

SEQ ID NO: 7605160 - DNA, 22 bp, Homo sapiens
ctgtttgttggctattgacagt

SEQ ID NO: 7605161 - DNA, 22 bp, Homo sapiens
ctgtttgttggctattgacagt

SEQ ID NO: 7605162 - DNA, 22 bp, Homo sapiens
ctgtttgtgatttctacgattt

SEQ ID NO: 7605163 - DNA, 22 bp, Homo sapiens
cttacaaatacacttaggagag

SEQ ID NO: 7605164 - DNA, 22 bp, Homo sapiens
cttacaaatacacttaggagag

SEQ ID NO: 7605165 - DNA, 22 bp, Homo sapiens
cttacaaatacacttaggagag

SEQ ID NO: 7605166 - DNA, 22 bp, Homo sapiens
cttacaaatacacttaggagag

SEQ ID NO: 7605167 - DNA, 22 bp, Homo sapiens
cttacaaatacacttaggagag

SEQ ID NO: 7605168 - DNA, 22 bp, Homo sapiens
cttacaaatacacttaggagag

SEQ ID NO: 7605169 - DNA, 22 bp, Homo sapiens
cttacaaatacacttaggagag

SEQ ID NO: 7605170 - DNA, 22 bp, Homo sapiens
cttacaaatacacttaggagag

SEQ ID NO: 7605171 - DNA, 22 bp, Homo sapiens
cttacaaaggagaggagatagg

SEQ ID NO: 7605172 - DNA, 22 bp, Homo sapiens
cttacaaaggagaggagatagg

SEQ ID NO: 7605173 - DNA, 22 bp, Homo sapiens
cttacaaaggagaggagatagg

SEQ ID NO: 7605174 - DNA, 22 bp, Homo sapiens
cttacaaaggagaggagatagg

SEQ ID NO: 7605175 - DNA, 22 bp, Homo sapiens
cttacaaatacacttaggagag

SEQ ID NO: 7605176 - DNA, 22 bp, Homo sapiens
cttacaaatacacttaggagag

SEQ ID NO: 7605177 - DNA, 22 bp, Homo sapiens
cttaatttttgtagtagatgga

SEQ ID NO: 7605178 - DNA, 22 bp, Homo sapiens
cttaatttcaaactgctagtga

SEQ ID NO: 7605179 - DNA, 22 bp, Homo sapiens
cttaatttcaaactgctagtga

SEQ ID NO: 7605180 - DNA, 22 bp, Homo sapiens
cttaatttttgtagtagatgga

SEQ ID NO: 7605181 - DNA, 22 bp, Homo sapiens
cttaatttttgtagtagatgga

SEQ ID NO: 7605182 - DNA, 22 bp, Homo sapiens
cttacaaaggagaggagatagg

SEQ ID NO: 7605183 - DNA, 22 bp, Homo sapiens
cttacaaaggagaggagatagg

SEQ ID NO: 7605184 - DNA, 22 bp, Homo sapiens
cttacaaaggagaggagatagg

SEQ ID NO: 7605185 - DNA, 22 bp, Homo sapiens
cttacaaaggagaggagatagg

SEQ ID NO: 7605186 - DNA, 22 bp, Homo sapiens
cttacaaaggagaggagatagg

SEQ ID NO: 7605187 - DNA, 22 bp, Homo sapiens
cttacaaaggagaggagatagg

SEQ ID NO: 7605188 - DNA, 22 bp, Homo sapiens
cttacaaaggagaggagatagg

SEQ ID NO: 7605189 - DNA, 22 bp, Homo sapiens
cttaatttaagcctagaatgca

SEQ ID NO: 7605190 - DNA, 22 bp, Homo sapiens
cttaatttaagcctagaatgca

SEQ ID NO: 7605191 - DNA, 22 bp, Homo sapiens
cttaatttaagcctagaatgca

SEQ ID NO: 7605192 - DNA, 22 bp, Homo sapiens
cttaatttcaaactgctagtga

SEQ ID NO: 7605193 - DNA, 22 bp, Homo sapiens
cttaatttcaaactgctagtga

SEQ ID NO: 7605194 - DNA, 22 bp, Homo sapiens
cttaatttcaaactgctagtga

SEQ ID NO: 7605195 - DNA, 22 bp, Homo sapiens
cttaatttaaaatagttcaggc

SEQ ID NO: 7605196 - DNA, 22 bp, Homo sapiens
cttaatttaaaatagttcaggc

SEQ ID NO: 7605197 - DNA, 22 bp, Homo sapiens
cttaatttaaaatagttcaggc

SEQ ID NO: 7605198 - DNA, 22 bp, Homo sapiens
cttaatttaaaatagttcaggc

SEQ ID NO: 7605199 - DNA, 22 bp, Homo sapiens
cttaatttaaaatagttcaggc

SEQ ID NO: 7605200 - DNA, 22 bp, Homo sapiens
cttaatttaaaatagttcaggc

SEQ ID NO: 7605201 - DNA, 22 bp, Homo sapiens
cttaaattttcatctacaagaa

SEQ ID NO: 7605202 - DNA, 22 bp, Homo sapiens
cttaattacccaatgtggtagg

SEQ ID NO: 7605203 - DNA, 22 bp, Homo sapiens
cttaattacccaatgtggtagg

SEQ ID NO: 7605204 - DNA, 22 bp, Homo sapiens
cttaattacccaatgtggtagg

SEQ ID NO: 7605205 - DNA, 22 bp, Homo sapiens
cttaattactgtccaatatgca

SEQ ID NO: 7605206 - DNA, 22 bp, Homo sapiens
cttaaattggatgagttaagtt

SEQ ID NO: 7605207 - DNA, 22 bp, Homo sapiens
cttaaattggatgagttaagtt

SEQ ID NO: 7605208 - DNA, 22 bp, Homo sapiens
cttaaattttcatctacaagaa

SEQ ID NO: 7605209 - DNA, 22 bp, Homo sapiens
cttaaattttcatctacaagaa

SEQ ID NO: 7605210 - DNA, 22 bp, Homo sapiens
cttaaattcttaatgccctcat

SEQ ID NO: 7605211 - DNA, 22 bp, Homo sapiens
cttaaatccatcatttctaatc

SEQ ID NO: 7605212 - DNA, 22 bp, Homo sapiens
cttaaagttgacacagtccctg

SEQ ID NO: 7605213 - DNA, 22 bp, Homo sapiens
cttaaagtctatcctttctaga

SEQ ID NO: 7605214 - DNA, 22 bp, Homo sapiens
cttaaagtctatcctttctaga

SEQ ID NO: 7605215 - DNA, 22 bp, Homo sapiens
cttaaagtctatcctttctaga

SEQ ID NO: 7605216 - DNA, 22 bp, Homo sapiens
cttaaagtattggtttaaccaa

SEQ ID NO: 7605217 - DNA, 22 bp, Homo sapiens
cttaaagtattggtttaaccaa

SEQ ID NO: 7605218 - DNA, 22 bp, Homo sapiens
cttaaagtagaatacaagacct

SEQ ID NO: 7605219 - DNA, 22 bp, Homo sapiens
cttaaagagtatttaatataat

SEQ ID NO: 7605220 - DNA, 22 bp, Homo sapiens
cttaaagagtatttaatataat

SEQ ID NO: 7605221 - DNA, 22 bp, Homo sapiens
cttaaagagtatttaatataat

SEQ ID NO: 7605222 - DNA, 22 bp, Homo sapiens
cttaaagatgtcaaggctgttt

SEQ ID NO: 7605223 - DNA, 22 bp, Homo sapiens
cttaaagtagaatacaagacct

SEQ ID NO: 7605224 - DNA, 22 bp, Homo sapiens
cttaaagtagaatacaagacct

SEQ ID NO: 7605225 - DNA, 22 bp, Homo sapiens
cttaaagatgtcaaggctgttt

SEQ ID NO: 7605226 - DNA, 22 bp, Homo sapiens
cttacatatgcaagacaaaggg

SEQ ID NO: 7605227 - DNA, 22 bp, Homo sapiens
cttacatatgcaagacaaaggg

SEQ ID NO: 7605228 - DNA, 22 bp, Homo sapiens
cttacatatgcaagacaaaggg

SEQ ID NO: 7605229 - DNA, 22 bp, Homo sapiens
cttacatactgagaaaatatcc

SEQ ID NO: 7605230 - DNA, 22 bp, Homo sapiens
cttacattaagtaagagattga

SEQ ID NO: 7605231 - DNA, 22 bp, Homo sapiens
cttacattaagtaagagattga

SEQ ID NO: 7605232 - DNA, 22 bp, Homo sapiens
cttacattaagtaagagattga

SEQ ID NO: 7605233 - DNA, 22 bp, Homo sapiens
cttacattgtctcttgctgagc

SEQ ID NO: 7605234 - DNA, 22 bp, Homo sapiens
cttacattgtctcttgctgagc

SEQ ID NO: 7605235 - DNA, 22 bp, Homo sapiens
cttacattgtctcttgctgagc

SEQ ID NO: 7605236 - DNA, 22 bp, Homo sapiens
cttacattgtcttagttttcaa

SEQ ID NO: 7605237 - DNA, 22 bp, Homo sapiens
cttacagtgatcaacacaaaga

SEQ ID NO: 7605238 - DNA, 22 bp, Homo sapiens
cttacagtgatcaacacaaaga

SEQ ID NO: 7605239 - DNA, 22 bp, Homo sapiens
cttacagtgatcaacacaaaga

SEQ ID NO: 7605240 - DNA, 22 bp, Homo sapiens
cttacatactgagaaaatatcc

SEQ ID NO: 7605241 - DNA, 22 bp, Homo sapiens
cttacatactgagaaaatatcc

SEQ ID NO: 7605242 - DNA, 22 bp, Homo sapiens
cttacatactgagaaaatatcc

SEQ ID NO: 7605243 - DNA, 22 bp, Homo sapiens
cttacactttccgaaagcttgt

SEQ ID NO: 7605244 - DNA, 22 bp, Homo sapiens
cttacacttcatctcatccagg

SEQ ID NO: 7605245 - DNA, 22 bp, Homo sapiens
cttacagagaagaaaatgtagt

SEQ ID NO: 7605246 - DNA, 22 bp, Homo sapiens
cttacagagaagaaaatgtagt

SEQ ID NO: 7605247 - DNA, 22 bp, Homo sapiens
cttacagtgaccctgcagattt

SEQ ID NO: 7605248 - DNA, 22 bp, Homo sapiens
cttacagtacttctaatatgat

SEQ ID NO: 7605249 - DNA, 22 bp, Homo sapiens
cttacagtacttctaatatgat

SEQ ID NO: 7605250 - DNA, 22 bp, Homo sapiens
cttacaggaaagaagaaagcat

SEQ ID NO: 7605251 - DNA, 22 bp, Homo sapiens
cttacaacttgtatgtgattgt

SEQ ID NO: 7605252 - DNA, 22 bp, Homo sapiens
cttacaacttgtatgtgattgt

SEQ ID NO: 7605253 - DNA, 22 bp, Homo sapiens
cttacaagcaaaacaactgtag

SEQ ID NO: 7605254 - DNA, 22 bp, Homo sapiens
cttacaagaccaaagaaaggat

SEQ ID NO: 7605255 - DNA, 22 bp, Homo sapiens
cttacaagaccaaagaaaggat

SEQ ID NO: 7605256 - DNA, 22 bp, Homo sapiens
cttacaagcaaaacaactgtag

SEQ ID NO: 7605257 - DNA, 22 bp, Homo sapiens
cttacaagcaaaacaactgtag

SEQ ID NO: 7605258 - DNA, 22 bp, Homo sapiens
cttacacagtctggcacttctt

SEQ ID NO: 7605259 - DNA, 22 bp, Homo sapiens
cttagaaatgcagattctcagg

SEQ ID NO: 7605260 - DNA, 22 bp, Homo sapiens
cttagaaatgcagattctcagg

SEQ ID NO: 7605261 - DNA, 22 bp, Homo sapiens
cttagaaatgcagattctcagg

SEQ ID NO: 7605262 - DNA, 22 bp, Homo sapiens
cttagaaatgcagattctcagg

SEQ ID NO: 7605263 - DNA, 22 bp, Homo sapiens
cttagaaatgcagattctcagg

SEQ ID NO: 7605264 - DNA, 22 bp, Homo sapiens
cttagaaatcgaactcaggtta

SEQ ID NO: 7605265 - DNA, 22 bp, Homo sapiens
cttagaaatcgaactcaggtta

SEQ ID NO: 7605266 - DNA, 22 bp, Homo sapiens
cttagaaatgcagattctcagg

SEQ ID NO: 7605267 - DNA, 20 bp, Homo sapiens
cttagcaccagcaggacagg

SEQ ID NO: 7605268 - DNA, 22 bp, Homo sapiens
cttagcagaattccaagcttga

SEQ ID NO: 7605269 - DNA, 22 bp, Homo sapiens
cttagcagagcagagtggatca

SEQ ID NO: 7605270 - DNA, 22 bp, Homo sapiens
cttagcagataaaaaccttcag

SEQ ID NO: 7605271 - DNA, 22 bp, Homo sapiens
cttagaaattgttactcattca

SEQ ID NO: 7605272 - DNA, 22 bp, Homo sapiens
cttagcaaggctgcctggagaa

SEQ ID NO: 7605273 - DNA, 22 bp, Homo sapiens
cttagcacatatcagaaaatag

SEQ ID NO: 7605274 - DNA, 22 bp, Homo sapiens
cttagcaatttaactgactcta

SEQ ID NO: 7605275 - DNA, 22 bp, Homo sapiens
cttagaaatcgaactcaggtta

SEQ ID NO: 7605276 - DNA, 22 bp, Homo sapiens
cttagaaatcgaactcaggtta

SEQ ID NO: 7605277 - DNA, 22 bp, Homo sapiens
cttagaaatcgaactcaggtta

SEQ ID NO: 7605278 - DNA, 22 bp, Homo sapiens
cttagaaatcgaactcaggtta

SEQ ID NO: 7605279 - DNA, 22 bp, Homo sapiens
cttagaaataatggtttcagtt

SEQ ID NO: 7605280 - DNA, 22 bp, Homo sapiens
cttagaaagagttttctcccct

SEQ ID NO: 7605281 - DNA, 22 bp, Homo sapiens
cttagaaagagttttctcccct

SEQ ID NO: 7605282 - DNA, 22 bp, Homo sapiens
cttactgcagcagcccatggac

SEQ ID NO: 7605283 - DNA, 22 bp, Homo sapiens
cttagaaataatggtttcagtt

SEQ ID NO: 7605284 - DNA, 22 bp, Homo sapiens
cttagaaataatggtttcagtt

SEQ ID NO: 7605285 - DNA, 22 bp, Homo sapiens
cttagaaataatggtttcagtt

SEQ ID NO: 7605286 - DNA, 22 bp, Homo sapiens
cttagaaataatggtttcagtt

SEQ ID NO: 7605287 - DNA, 22 bp, Homo sapiens
cttacattgtcttagttttcaa

SEQ ID NO: 7605288 - DNA, 22 bp, Homo sapiens
cttacattgtcttagttttcaa

SEQ ID NO: 7605289 - DNA, 22 bp, Homo sapiens
cttacatttaatcatgtgtcat

SEQ ID NO: 7605290 - DNA, 22 bp, Homo sapiens
cttacattgtgtgcatgagggg

SEQ ID NO: 7605291 - DNA, 22 bp, Homo sapiens
cttacatttaatcatgtgtcat

SEQ ID NO: 7605292 - DNA, 22 bp, Homo sapiens
cttacatttaatcatgtgtcat

SEQ ID NO: 7605293 - DNA, 22 bp, Homo sapiens
cttacattgtgtgcatgagggg

SEQ ID NO: 7605294 - DNA, 22 bp, Homo sapiens
cttacccttcatcagattttgg

SEQ ID NO: 7605295 - DNA, 22 bp, Homo sapiens
cttacgtgataacttctcaaaa

SEQ ID NO: 7605296 - DNA, 22 bp, Homo sapiens
cttacttgaaattccaagcagg

SEQ ID NO: 7605297 - DNA, 22 bp, Homo sapiens
cttagtgagaaggagcccatgc

SEQ ID NO: 7605298 - DNA, 22 bp, Homo sapiens
cttagtttaggtaaacccagca

SEQ ID NO: 7605299 - DNA, 22 bp, Homo sapiens
cttagtttctctgtatgtttac

SEQ ID NO: 7605300 - DNA, 22 bp, Homo sapiens
cttagtttctctgtatgtttac

SEQ ID NO: 7605301 - DNA, 22 bp, Homo sapiens
cttagtttctgtttctgattaa

SEQ ID NO: 7605302 - DNA, 22 bp, Homo sapiens
cttagggaatcttagagctgga

SEQ ID NO: 7605303 - DNA, 22 bp, Homo sapiens
cttaggcaagcagagcccatcc

SEQ ID NO: 7605304 - DNA, 22 bp, Homo sapiens
cttaggcagtttaggaaagaga

SEQ ID NO: 7605305 - DNA, 22 bp, Homo sapiens
cttagttttattaaggaggatt

SEQ ID NO: 7605306 - DNA, 22 bp, Homo sapiens
cttagtttttgccctggagttt

SEQ ID NO: 7605307 - DNA, 22 bp, Homo sapiens
cttagtttctgttgcgttctgt

SEQ ID NO: 7605308 - DNA, 22 bp, Homo sapiens
cttataaagtccatctgaacaa

SEQ ID NO: 7605309 - DNA, 22 bp, Homo sapiens
cttataaagtccatctgaacaa

SEQ ID NO: 7605310 - DNA, 22 bp, Homo sapiens
cttataaagtccatctgaacaa

SEQ ID NO: 7605311 - DNA, 22 bp, Homo sapiens
cttataaagtccatctgaacaa

SEQ ID NO: 7605312 - DNA, 22 bp, Homo sapiens
cttataaagtccatctgaacaa

SEQ ID NO: 7605313 - DNA, 22 bp, Homo sapiens
cttataaagtccatctgaacaa

SEQ ID NO: 7605314 - DNA, 22 bp, Homo sapiens
cttataaagtccatctgaacaa

SEQ ID NO: 7605315 - DNA, 22 bp, Homo sapiens
cttataaagtccatctgaacaa

SEQ ID NO: 7605316 - DNA, 22 bp, Homo sapiens
cttataaagtccatctgaacaa

SEQ ID NO: 7605317 - DNA, 22 bp, Homo sapiens
cttatacacgaacacaaggtgt

SEQ ID NO: 7605318 - DNA, 22 bp, Homo sapiens
cttatacagatcaagggaaaag

SEQ ID NO: 7605319 - DNA, 22 bp, Homo sapiens
cttatacacgaacacaaggtgt

SEQ ID NO: 7605320 - DNA, 22 bp, Homo sapiens
cttatacacgaacacaaggtgt

SEQ ID NO: 7605321 - DNA, 22 bp, Homo sapiens
cttatacaccctcttcccaggc

SEQ ID NO: 7605322 - DNA, 22 bp, Homo sapiens
cttatacaccctcttcccaggc

SEQ ID NO: 7605323 - DNA, 22 bp, Homo sapiens
cttataaagtccatctgaacaa

SEQ ID NO: 7605324 - DNA, 22 bp, Homo sapiens
cttatacaccctcttcccaggc

SEQ ID NO: 7605325 - DNA, 22 bp, Homo sapiens
cttaggaagttgttacacactt

SEQ ID NO: 7605326 - DNA, 22 bp, Homo sapiens
cttaggaagcttttgaggacaa

SEQ ID NO: 7605327 - DNA, 22 bp, Homo sapiens
cttaggaaatatatactaaact

SEQ ID NO: 7605328 - DNA, 22 bp, Homo sapiens
cttaggaagcttttgaggacaa

SEQ ID NO: 7605329 - DNA, 22 bp, Homo sapiens
cttaggaatatccacagcaggt

SEQ ID NO: 7605330 - DNA, 22 bp, Homo sapiens
cttaggaagttgttacacactt

SEQ ID NO: 7605331 - DNA, 22 bp, Homo sapiens
cttaggaatatccacagcaggt

SEQ ID NO: 7605332 - DNA, 22 bp, Homo sapiens
cttaggaaatatatactaaact

SEQ ID NO: 7605333 - DNA, 22 bp, Homo sapiens
cttaggaaatatatactaaact

SEQ ID NO: 7605334 - DNA, 22 bp, Homo sapiens
cttagctttgtttaacacaggg

SEQ ID NO: 7605335 - DNA, 22 bp, Homo sapiens
cttagcttttccagcttctaga

SEQ ID NO: 7605336 - DNA, 22 bp, Homo sapiens
cttaggaaagtttctgcttatg

SEQ ID NO: 7605337 - DNA, 22 bp, Homo sapiens
cttaggaaagttggctgatttc

SEQ ID NO: 7605338 - DNA, 22 bp, Homo sapiens
cttagcttctctgcatctgtgt

SEQ ID NO: 7605339 - DNA, 22 bp, Homo sapiens
cttagcttctctgcatctgtgt

SEQ ID NO: 7605340 - DNA, 22 bp, Homo sapiens
cttagctttaaaagtgagatct

SEQ ID NO: 7605341 - DNA, 22 bp, Homo sapiens
cttagcttgttttcacctaaga

SEQ ID NO: 7605342 - DNA, 22 bp, Homo sapiens
cttagcttgttttcacctaaga

SEQ ID NO: 7605343 - DNA, 22 bp, Homo sapiens
cttagctgcgggccctcctcgc

SEQ ID NO: 7605344 - DNA, 22 bp, Homo sapiens
cttagcttcactgggtctcagt

SEQ ID NO: 7605345 - DNA, 22 bp, Homo sapiens
cttagcttctctgcatctgtgt

SEQ ID NO: 7605346 - DNA, 20 bp, Homo sapiens
cttagcttctaaggttctgg

SEQ ID NO: 7605347 - DNA, 22 bp, Homo sapiens
cttagcagtgggtaccagggct

SEQ ID NO: 7605348 - DNA, 22 bp, Homo sapiens
cttagcagtttgcctggcacag

SEQ ID NO: 7605349 - DNA, 22 bp, Homo sapiens
cttagcatgcagtgttctgccc

SEQ ID NO: 7605350 - DNA, 22 bp, Homo sapiens
cttatatttgtcaactttacaa

SEQ ID NO: 7605351 - DNA, 22 bp, Homo sapiens
cttatatttgtcaactttacaa

SEQ ID NO: 7605352 - DNA, 22 bp, Homo sapiens
cttcagtgttgccagggcctag

SEQ ID NO: 7605353 - DNA, 22 bp, Homo sapiens
cttcagtgttggttcattacga

SEQ ID NO: 7605354 - DNA, 22 bp, Homo sapiens
cttatatttgtcaactttacaa

SEQ ID NO: 7605355 - DNA, 22 bp, Homo sapiens
cttatatttgtcaactttacaa

SEQ ID NO: 7605356 - DNA, 22 bp, Homo sapiens
cttatagtatgatgttgagaat

SEQ ID NO: 7605357 - DNA, 22 bp, Homo sapiens
cttatagatggcgatcttcttg

SEQ ID NO: 7605358 - DNA, 22 bp, Homo sapiens
cttatagtatgatgttgagaat

SEQ ID NO: 7605359 - DNA, 22 bp, Homo sapiens
cttatagaatgtttttatatgt

SEQ ID NO: 7605360 - DNA, 22 bp, Homo sapiens
cttatagaatgtttttatatgt

SEQ ID NO: 7605361 - DNA, 22 bp, Homo sapiens
cttatagaattagagagatttt

SEQ ID NO: 7605362 - DNA, 22 bp, Homo sapiens
cttatagactcttgttgttaga

SEQ ID NO: 7605363 - DNA, 22 bp, Homo sapiens
cttatagagttcagtgattttc

SEQ ID NO: 7605364 - DNA, 22 bp, Homo sapiens
cttatagagttcagtgattttc

SEQ ID NO: 7605365 - DNA, 22 bp, Homo sapiens
cttatagatggcgatcttcttg

SEQ ID NO: 7605366 - DNA, 22 bp, Homo sapiens
cttatagatggcgatcttcttg

SEQ ID NO: 7605367 - DNA, 22 bp, Homo sapiens
cttatactgaaaaattatttgt

SEQ ID NO: 7605368 - DNA, 22 bp, Homo sapiens
cttatacataaaatgggtgtag

SEQ ID NO: 7605369 - DNA, 22 bp, Homo sapiens
cttatacataaaatgggtgtag

SEQ ID NO: 7605370 - DNA, 22 bp, Homo sapiens
cttatacagatcaagggaaaag

SEQ ID NO: 7605371 - DNA, 22 bp, Homo sapiens
cttatacagatcaagggaaaag

SEQ ID NO: 7605372 - DNA, 19 bp, Homo sapiens
cttatacagattttctcat

SEQ ID NO: 7605373 - DNA, 19 bp, Homo sapiens
cttatacagattttctcat

SEQ ID NO: 7605374 - DNA, 22 bp, Homo sapiens
cttcattggcttccatagatgc

SEQ ID NO: 7605375 - DNA, 22 bp, Homo sapiens
cttcattacttgctcgtagcac

SEQ ID NO: 7605376 - DNA, 22 bp, Homo sapiens
cttcattacttgctcgtagcac

SEQ ID NO: 7605377 - DNA, 19 bp, Homo sapiens
cttcattcttcagcttttg

SEQ ID NO: 7605378 - DNA, 22 bp, Homo sapiens
cttcatttcaggctgaagaata

SEQ ID NO: 7605379 - DNA, 22 bp, Homo sapiens
cttcatttcaggctgaagaata

SEQ ID NO: 7605380 - DNA, 22 bp, Homo sapiens
cttcatttcaggctgaagaata

SEQ ID NO: 7605381 - DNA, 22 bp, Homo sapiens
cttcatttcaggctgaagaata

SEQ ID NO: 7605382 - DNA, 22 bp, Homo sapiens
cttcatttcaggctgaagaata

SEQ ID NO: 7605383 - DNA, 23 bp, Homo sapiens
cttcattgtagtgttggggagat

SEQ ID NO: 7605384 - DNA, 22 bp, Homo sapiens
cttcattggcttccatagatgc

SEQ ID NO: 7605385 - DNA, 22 bp, Homo sapiens
cttcagttagccaattcaggtc

SEQ ID NO: 7605386 - DNA, 22 bp, Homo sapiens
cttcagttagtttcatgtgagc

SEQ ID NO: 7605387 - DNA, 22 bp, Homo sapiens
cttcagttagtttcatgtgagc

SEQ ID NO: 7605388 - DNA, 22 bp, Homo sapiens
cttcagttagtttcatgtgagc

SEQ ID NO: 7605389 - DNA, 22 bp, Homo sapiens
cttcagttagtttcatgtgagc

SEQ ID NO: 7605390 - DNA, 22 bp, Homo sapiens
cttcagttagagtttacaaagt

SEQ ID NO: 7605391 - DNA, 22 bp, Homo sapiens
cttcagttagagtttacaaagt

SEQ ID NO: 7605392 - DNA, 22 bp, Homo sapiens
cttcagtgttggttcattacga

SEQ ID NO: 7605393 - DNA, 22 bp, Homo sapiens
cttcagttagccaattcaggtc

SEQ ID NO: 7605394 - DNA, 22 bp, Homo sapiens
cttcagttagagtttacaaagt

SEQ ID NO: 7605395 - DNA, 22 bp, Homo sapiens
cttcagttagccaattcaggtc

SEQ ID NO: 7605396 - DNA, 22 bp, Homo sapiens
cttcagttagccaattcaggtc

SEQ ID NO: 7605397 - DNA, 22 bp, Homo sapiens
cttcagttagagtttacaaagt

SEQ ID NO: 7605398 - DNA, 22 bp, Homo sapiens
cttccaaaatttatatgttgaa

SEQ ID NO: 7605399 - DNA, 18 bp, Homo sapiens
cttcatttgtagagttcc

SEQ ID NO: 7605400 - DNA, 18 bp, Homo sapiens
cttcatttgtagagttcc

SEQ ID NO: 7605401 - DNA, 18 bp, Homo sapiens
cttcatttgtagagttcc

SEQ ID NO: 7605402 - DNA, 18 bp, Homo sapiens
cttcatttgtagagttcc

SEQ ID NO: 7605403 - DNA, 18 bp, Homo sapiens
cttcatttgtagagttcc

SEQ ID NO: 7605404 - DNA, 22 bp, Homo sapiens
cttccaaaatttatatgttgaa

SEQ ID NO: 7605405 - DNA, 22 bp, Homo sapiens
cttccaaaatttatatgttgaa

SEQ ID NO: 7605406 - DNA, 22 bp, Homo sapiens
cttccaaaatttatatgttgaa

SEQ ID NO: 7605407 - DNA, 22 bp, Homo sapiens
cttccaaatgtaaataagtttc

SEQ ID NO: 7605408 - DNA, 22 bp, Homo sapiens
cttccaaatgtaaataagtttc

SEQ ID NO: 7605409 - DNA, 19 bp, Homo sapiens
cttccaactgtgatctaga

SEQ ID NO: 7605410 - DNA, 22 bp, Homo sapiens
cttccaaatgtaaataagtttc

SEQ ID NO: 7605411 - DNA, 22 bp, Homo sapiens
cttccaaagcactttatggacc

SEQ ID NO: 7605412 - DNA, 22 bp, Homo sapiens
cttccaaagcactttatggacc

SEQ ID NO: 7605413 - DNA, 22 bp, Homo sapiens
cttccaaagcactttatggacc

SEQ ID NO: 7605414 - DNA, 22 bp, Homo sapiens
cttccaaacccagggtatgggc

SEQ ID NO: 7605415 - DNA, 22 bp, Homo sapiens
cttcatttcaggctgaagaata

SEQ ID NO: 7605416 - DNA, 22 bp, Homo sapiens
cttcatttcaggctgaagaata

SEQ ID NO: 7605417 - DNA, 22 bp, Homo sapiens
cttcatttcaggctgaagaata

SEQ ID NO: 7605418 - DNA, 22 bp, Homo sapiens
cttcatttcaggctgaagaata

SEQ ID NO: 7605419 - DNA, 22 bp, Homo sapiens
cttcatttcaggctgaagaata

SEQ ID NO: 7605420 - DNA, 22 bp, Homo sapiens
cttcatttcaggctgaagaata

SEQ ID NO: 7605421 - DNA, 22 bp, Homo sapiens
cttcatttcaggctgaagaata

SEQ ID NO: 7605422 - DNA, 22 bp, Homo sapiens
cttcatttccatccaactggga

SEQ ID NO: 7605423 - DNA, 22 bp, Homo sapiens
cttcatttccatccaactggga

SEQ ID NO: 7605424 - DNA, 22 bp, Homo sapiens
cttcatttccatccaactggga

SEQ ID NO: 7605425 - DNA, 22 bp, Homo sapiens
cttcatttcaggctgaagaata

SEQ ID NO: 7605426 - DNA, 22 bp, Homo sapiens
cttcatttccatccaactggga

SEQ ID NO: 7605427 - DNA, 22 bp, Homo sapiens
cttcatttggagaactgtgctt

SEQ ID NO: 7605428 - DNA, 22 bp, Homo sapiens
cttcatttggagaactgtgctt

SEQ ID NO: 7605429 - DNA, 22 bp, Homo sapiens
cttcatttggagaactgtgctt

SEQ ID NO: 7605430 - DNA, 22 bp, Homo sapiens
cttcatttccatccaactggga

SEQ ID NO: 7605431 - DNA, 22 bp, Homo sapiens
cttcatttggagaactgtgctt

SEQ ID NO: 7605432 - DNA, 22 bp, Homo sapiens
cttcatttggagaactgtgctt

SEQ ID NO: 7605433 - DNA, 22 bp, Homo sapiens
cttcatttggagaactgtgctt

SEQ ID NO: 7605434 - DNA, 22 bp, Homo sapiens
cttcatttggagaactgtgctt

SEQ ID NO: 7605435 - DNA, 22 bp, Homo sapiens
cttcatttggcaggctggcctc

SEQ ID NO: 7605436 - DNA, 22 bp, Homo sapiens
cttcatttggagaactgtgctt

SEQ ID NO: 7605437 - DNA, 22 bp, Homo sapiens
cttcatttggcaggctggcctc

SEQ ID NO: 7605438 - DNA, 22 bp, Homo sapiens
cttcatttggcaggctggcctc

SEQ ID NO: 7605439 - DNA, 18 bp, Homo sapiens
cttcatttgtagagttcc

SEQ ID NO: 7605440 - DNA, 18 bp, Homo sapiens
cttcatttgtagagttcc

SEQ ID NO: 7605441 - DNA, 22 bp, Homo sapiens
cttctagagtaaggaacaaatg

SEQ ID NO: 7605442 - DNA, 17 bp, Homo sapiens
cttctagaggtcaccca

SEQ ID NO: 7605443 - DNA, 22 bp, Homo sapiens
cttctagagctggagcaaatgt

SEQ ID NO: 7605444 - DNA, 22 bp, Homo sapiens
cttctagagctggagcaaatgt

SEQ ID NO: 7605445 - DNA, 22 bp, Homo sapiens
cttctatgaggagagacatgca

SEQ ID NO: 7605446 - DNA, 22 bp, Homo sapiens
cttctataggttgttgtgactt

SEQ ID NO: 7605447 - DNA, 22 bp, Homo sapiens
cttctataaactgtgatctttc

SEQ ID NO: 7605448 - DNA, 22 bp, Homo sapiens
cttctataaactgtgatctttc

SEQ ID NO: 7605449 - DNA, 22 bp, Homo sapiens
cttctataaactgtgatctttc

SEQ ID NO: 7605450 - DNA, 22 bp, Homo sapiens
cttctaggtcttgattgaatgt

SEQ ID NO: 7605451 - DNA, 22 bp, Homo sapiens
cttctagggcatcatgacaaat

SEQ ID NO: 7605452 - DNA, 22 bp, Homo sapiens
cttctaggcttctcagggggca

SEQ ID NO: 7605453 - DNA, 22 bp, Homo sapiens
cttctaggcttgacatctccct

SEQ ID NO: 7605454 - DNA, 22 bp, Homo sapiens
cttctaagctgagaatgccttt

SEQ ID NO: 7605455 - DNA, 22 bp, Homo sapiens
cttctaatataaagtctttgca

SEQ ID NO: 7605456 - DNA, 22 bp, Homo sapiens
cttctaatataaagtctttgca

SEQ ID NO: 7605457 - DNA, 22 bp, Homo sapiens
cttctaatataaagtctttgca

SEQ ID NO: 7605458 - DNA, 22 bp, Homo sapiens
cttctaattcttatgtaagctt

SEQ ID NO: 7605459 - DNA, 22 bp, Homo sapiens
cttctaattcttatgtaagctt

SEQ ID NO: 7605460 - DNA, 22 bp, Homo sapiens
cttctaattcttatgtaagctt

SEQ ID NO: 7605461 - DNA, 22 bp, Homo sapiens
cttctaattcttatgtaagctt

SEQ ID NO: 7605462 - DNA, 22 bp, Homo sapiens
cttctacacatccctcttgctt

SEQ ID NO: 7605463 - DNA, 22 bp, Homo sapiens
cttctacaaggttgtcctctat

SEQ ID NO: 7605464 - DNA, 22 bp, Homo sapiens
cttctaattcttatgtaagctt

SEQ ID NO: 7605465 - DNA, 22 bp, Homo sapiens
cttctaattcttatgtaagctt

SEQ ID NO: 7605466 - DNA, 22 bp, Homo sapiens
cttctaattttctttcccgcaa

SEQ ID NO: 7605467 - DNA, 22 bp, Homo sapiens
cttctaattttctttcccgcaa

SEQ ID NO: 7605468 - DNA, 17 bp, Homo sapiens
cttctagaaggcaaact

SEQ ID NO: 7605469 - DNA, 22 bp, Homo sapiens
cttctaccttagtgtttagatg

SEQ ID NO: 7605470 - DNA, 22 bp, Homo sapiens
cttctagaaatgtgggtgatag

SEQ ID NO: 7605471 - DNA, 22 bp, Homo sapiens
cttctagaaccctctattcttt

SEQ ID NO: 7605472 - DNA, 17 bp, Homo sapiens
cttctagaaggcaaact

SEQ ID NO: 7605473 - DNA, 22 bp, Homo sapiens
cttctacaggcccagcgagtgt

SEQ ID NO: 7605474 - DNA, 22 bp, Homo sapiens
cttctacacgtggctgtgccaa

SEQ ID NO: 7605475 - DNA, 22 bp, Homo sapiens
cttctacaaggttgtcctctat

SEQ ID NO: 7605476 - DNA, 22 bp, Homo sapiens
cttctacacatccctcttgctt

SEQ ID NO: 7605477 - DNA, 22 bp, Homo sapiens
cttctcaaagttgtgaatcagg

SEQ ID NO: 7605478 - DNA, 22 bp, Homo sapiens
cttctcaaagttgtgaatcagg

SEQ ID NO: 7605479 - DNA, 23 bp, Homo sapiens
cttctcagaagtctgtgccagga

SEQ ID NO: 7605480 - DNA, 23 bp, Homo sapiens
cttctcagaagtctgtgccagga

SEQ ID NO: 7605481 - DNA, 22 bp, Homo sapiens
cttctcagagcttccagaaaac

SEQ ID NO: 7605482 - DNA, 22 bp, Homo sapiens
cttctcaaacctgaaaggacaa

SEQ ID NO: 7605483 - DNA, 22 bp, Homo sapiens
cttctcaaacctgaaaggacaa

SEQ ID NO: 7605484 - DNA, 22 bp, Homo sapiens
cttctcaaactgagactgtcta

SEQ ID NO: 7605485 - DNA, 22 bp, Homo sapiens
cttctcaaactgagactgtcta

SEQ ID NO: 7605486 - DNA, 22 bp, Homo sapiens
cttctcaaacctgaaaggacaa

SEQ ID NO: 7605487 - DNA, 22 bp, Homo sapiens
cttctattcactggtcacagtt

SEQ ID NO: 7605488 - DNA, 22 bp, Homo sapiens
cttctattcactggtcacagtt

SEQ ID NO: 7605489 - DNA, 22 bp, Homo sapiens
cttctattcactggtcacagtt

SEQ ID NO: 7605490 - DNA, 22 bp, Homo sapiens
cttctcagaggccagaagctat

SEQ ID NO: 7605491 - DNA, 22 bp, Homo sapiens
cttctcagatctcagctttgag

SEQ ID NO: 7605492 - DNA, 22 bp, Homo sapiens
cttctcagcatggttactgtga

SEQ ID NO: 7605493 - DNA, 22 bp, Homo sapiens
cttctcagcatggttactgtga

SEQ ID NO: 7605494 - DNA, 22 bp, Homo sapiens
cttctcagtcacctgtgagtct

SEQ ID NO: 7605495 - DNA, 22 bp, Homo sapiens
cttctcagtcacctgtgagtct

SEQ ID NO: 7605496 - DNA, 22 bp, Homo sapiens
cttctcagcttaggtatggttt

SEQ ID NO: 7605497 - DNA, 22 bp, Homo sapiens
cttctcagcattttgtcagtct

SEQ ID NO: 7605498 - DNA, 22 bp, Homo sapiens
cttctcagcattttgtcagtct

SEQ ID NO: 7605499 - DNA, 22 bp, Homo sapiens
cttctcagcattttgtcagtct

SEQ ID NO: 7605500 - DNA, 22 bp, Homo sapiens
cttcctggtttgaagctcgccg

SEQ ID NO: 7605501 - DNA, 22 bp, Homo sapiens
cttccaggacaccagggtagta

SEQ ID NO: 7605502 - DNA, 22 bp, Homo sapiens
cttccaggacaccagggtagta

SEQ ID NO: 7605503 - DNA, 22 bp, Homo sapiens
cttccagctgattacaggctat

SEQ ID NO: 7605504 - DNA, 22 bp, Homo sapiens
cttccagctgattggcatccag

SEQ ID NO: 7605505 - DNA, 22 bp, Homo sapiens
cttccagctgattggcatccag

SEQ ID NO: 7605506 - DNA, 22 bp, Homo sapiens
cttccagcttgtggcgctttcc

SEQ ID NO: 7605507 - DNA, 22 bp, Homo sapiens
cttccttccacaccttcagaat

SEQ ID NO: 7605508 - DNA, 22 bp, Homo sapiens
cttccttcaatataatttttac

SEQ ID NO: 7605509 - DNA, 22 bp, Homo sapiens
cttccttcaatataatttttac

SEQ ID NO: 7605510 - DNA, 22 bp, Homo sapiens
cttccttcaatataatttttac

SEQ ID NO: 7605511 - DNA, 22 bp, Homo sapiens
cttcctggtttgaagctcgccg

SEQ ID NO: 7605512 - DNA, 22 bp, Homo sapiens
cttcctggtttgaagctcgccg

SEQ ID NO: 7605513 - DNA, 22 bp, Homo sapiens
cttcctgttgtcacagtctgcg

SEQ ID NO: 7605514 - DNA, 22 bp, Homo sapiens
cttcctttccccaatcatatcg

SEQ ID NO: 7605515 - DNA, 22 bp, Homo sapiens
cttcctttccccaatcatatcg

SEQ ID NO: 7605516 - DNA, 22 bp, Homo sapiens
cttcctttgctgttcggaggtt

SEQ ID NO: 7605517 - DNA, 22 bp, Homo sapiens
cttcctttgctgttcggaggtt

SEQ ID NO: 7605518 - DNA, 22 bp, Homo sapiens
cttcctttgctgttcggaggtt

SEQ ID NO: 7605519 - DNA, 22 bp, Homo sapiens
cttcctttccccaatcatatcg

SEQ ID NO: 7605520 - DNA, 22 bp, Homo sapiens
cttcctttccccaatcatatcg

SEQ ID NO: 7605521 - DNA, 22 bp, Homo sapiens
cttcctttccccaatcatatcg

SEQ ID NO: 7605522 - DNA, 22 bp, Homo sapiens
cttcctttccccaatcatatcg

SEQ ID NO: 7605523 - DNA, 22 bp, Homo sapiens
cttccttccacaccttcagaat

SEQ ID NO: 7605524 - DNA, 22 bp, Homo sapiens
cttccttccacaccttcagaat

SEQ ID NO: 7605525 - DNA, 22 bp, Homo sapiens
cttccttccacaccttcagaat

SEQ ID NO: 7605526 - DNA, 22 bp, Homo sapiens
cttccttccacaccttcagaat

SEQ ID NO: 7605527 - DNA, 22 bp, Homo sapiens
cttcctttggttggagcgccgt

SEQ ID NO: 7605528 - DNA, 22 bp, Homo sapiens
cttcctttgctgttcggaggtt

SEQ ID NO: 7605529 - DNA, 22 bp, Homo sapiens
cttcctttggttggagcgccgt

SEQ ID NO: 7605530 - DNA, 22 bp, Homo sapiens
cttcctttgctgttcggaggtt

SEQ ID NO: 7605531 - DNA, 22 bp, Homo sapiens
cttcctttggttggagcgccgt

SEQ ID NO: 7605532 - DNA, 20 bp, Homo sapiens
cttccttttccttcgtcaaa

SEQ ID NO: 7605533 - DNA, 20 bp, Homo sapiens
cttccttttccttcgtcaaa

SEQ ID NO: 7605534 - DNA, 20 bp, Homo sapiens
cttccttttccttcgtcaaa

SEQ ID NO: 7605535 - DNA, 22 bp, Homo sapiens
cttccaagtggggcacgtgcca

SEQ ID NO: 7605536 - DNA, 22 bp, Homo sapiens
cttccaagtggggcacgtgcca

SEQ ID NO: 7605537 - DNA, 22 bp, Homo sapiens
cttccaatagcaacaaagatta

SEQ ID NO: 7605538 - DNA, 22 bp, Homo sapiens
cttccaatagcaacaaagatta

SEQ ID NO: 7605539 - DNA, 20 bp, Homo sapiens
cttccacacaagaagcacag

SEQ ID NO: 7605540 - DNA, 20 bp, Homo sapiens
cttccacacaagaagcacag

SEQ ID NO: 7605541 - DNA, 20 bp, Homo sapiens
cttccacacaagaagcacag

SEQ ID NO: 7605542 - DNA, 20 bp, Homo sapiens
cttccacacaagaagcacag

SEQ ID NO: 7605543 - DNA, 22 bp, Homo sapiens
cttccacattatttaggaatcc

SEQ ID NO: 7605544 - DNA, 20 bp, Homo sapiens
cttccacacaagaagcacag

SEQ ID NO: 7605545 - DNA, 20 bp, Homo sapiens
cttccacacaagaagcacag

SEQ ID NO: 7605546 - DNA, 22 bp, Homo sapiens
cttccacattatttaggaatcc

SEQ ID NO: 7605547 - DNA, 22 bp, Homo sapiens
cttccacattatttaggaatcc

SEQ ID NO: 7605548 - DNA, 22 bp, Homo sapiens
cttccaagcccaggagccattt

SEQ ID NO: 7605549 - DNA, 22 bp, Homo sapiens
cttccaagcccaggagccattt

SEQ ID NO: 7605550 - DNA, 22 bp, Homo sapiens
cttccaagcccaggagccattt

SEQ ID NO: 7605551 - DNA, 22 bp, Homo sapiens
cttccaagatgaacagcaagcg

SEQ ID NO: 7605552 - DNA, 22 bp, Homo sapiens
cttccaagatgaacagcaagcg

SEQ ID NO: 7605553 - DNA, 22 bp, Homo sapiens
cttccaagatgaacagcaagcg

SEQ ID NO: 7605554 - DNA, 22 bp, Homo sapiens
cttccaagatgaacagcaagcg

SEQ ID NO: 7605555 - DNA, 22 bp, Homo sapiens
cttccaagatgaacagcaagcg

SEQ ID NO: 7605556 - DNA, 22 bp, Homo sapiens
cttccaagtggggcacgtgcca

SEQ ID NO: 7605557 - DNA, 22 bp, Homo sapiens
cttccaagttgctctgctgacc

SEQ ID NO: 7605558 - DNA, 22 bp, Homo sapiens
cttccaagttgctctgctgacc

SEQ ID NO: 7605559 - DNA, 22 bp, Homo sapiens
cttccaagttgctctgctgacc

SEQ ID NO: 7605560 - DNA, 22 bp, Homo sapiens
cttccagagatccatgaatacc

SEQ ID NO: 7605561 - DNA, 22 bp, Homo sapiens
cttccagagctgggctgacctt

SEQ ID NO: 7605562 - DNA, 22 bp, Homo sapiens
cttccagagctgggctgacctt

SEQ ID NO: 7605563 - DNA, 22 bp, Homo sapiens
cttccagagctgggctgacctt

SEQ ID NO: 7605564 - DNA, 22 bp, Homo sapiens
cttccagagatagggcctcaag

SEQ ID NO: 7605565 - DNA, 22 bp, Homo sapiens
cttccagagatagggcctcaag

SEQ ID NO: 7605566 - DNA, 22 bp, Homo sapiens
cttccagagatagggcctcaag

SEQ ID NO: 7605567 - DNA, 22 bp, Homo sapiens
cttccagagatccatgaatacc

SEQ ID NO: 7605568 - DNA, 22 bp, Homo sapiens
cttccagagatccatgaatacc

SEQ ID NO: 7605569 - DNA, 22 bp, Homo sapiens
cttccagagaagcactacgggt

SEQ ID NO: 7605570 - DNA, 22 bp, Homo sapiens
cttccactctgagtccaccctg

SEQ ID NO: 7605571 - DNA, 22 bp, Homo sapiens
cttccactctgagtccaccctg

SEQ ID NO: 7605572 - DNA, 22 bp, Homo sapiens
cttccagagttgcgttctcggt

SEQ ID NO: 7605573 - DNA, 22 bp, Homo sapiens
cttccagagttgcgttctcggt

SEQ ID NO: 7605574 - DNA, 22 bp, Homo sapiens
cttccagattctgaaattttca

SEQ ID NO: 7605575 - DNA, 22 bp, Homo sapiens
cttccagctgattacaggctat

SEQ ID NO: 7605576 - DNA, 22 bp, Homo sapiens
cttccagctgattacaggctat

SEQ ID NO: 7605577 - DNA, 22 bp, Homo sapiens
cttccagctgattacaggctat

SEQ ID NO: 7605578 - DNA, 22 bp, Homo sapiens
cttccagctgattacaggctat

SEQ ID NO: 7605579 - DNA, 22 bp, Homo sapiens
cttccagaggaactctgcagtg

SEQ ID NO: 7605580 - DNA, 22 bp, Homo sapiens
cttccagaggaactctgcagtg

SEQ ID NO: 7605581 - DNA, 22 bp, Homo sapiens
cttccagaggaactctgcagtg

SEQ ID NO: 7605582 - DNA, 22 bp, Homo sapiens
cttccagaggaactctgcagtg

SEQ ID NO: 7605583 - DNA, 22 bp, Homo sapiens
cttccagaggaactctgcagtg

SEQ ID NO: 7605584 - DNA, 22 bp, Homo sapiens
cttccagaggaactctgcagtg

SEQ ID NO: 7605585 - DNA, 22 bp, Homo sapiens
cttccagagctgggctgacctt

SEQ ID NO: 7605586 - DNA, 22 bp, Homo sapiens
cttccagagctgggctgacctt

SEQ ID NO: 7605587 - DNA, 22 bp, Homo sapiens
ctggtcagctgaagccccacac

SEQ ID NO: 7605588 - DNA, 22 bp, Homo sapiens
ctggtcagctgaagccccacac

SEQ ID NO: 7605589 - DNA, 23 bp, Homo sapiens
ctggtcagaggctgctggaaggg

SEQ ID NO: 7605590 - DNA, 22 bp, Homo sapiens
ctggtcagctgaagccccacac

SEQ ID NO: 7605591 - DNA, 22 bp, Homo sapiens
ctggtcactggtctcatccagc

SEQ ID NO: 7605592 - DNA, 22 bp, Homo sapiens
ctggtcactgagttggcaaagt

SEQ ID NO: 7605593 - DNA, 23 bp, Homo sapiens
ctggtcagaggctgctggaaggg

SEQ ID NO: 7605594 - DNA, 23 bp, Homo sapiens
ctggtcagaggctgctggaaggg

SEQ ID NO: 7605595 - DNA, 18 bp, Homo sapiens
ctggtctcccttcgcttt

SEQ ID NO: 7605596 - DNA, 22 bp, Homo sapiens
ctggtctgaaaaggaggcatgc

SEQ ID NO: 7605597 - DNA, 22 bp, Homo sapiens
ctggtctgaaaaggaggcatgc

SEQ ID NO: 7605598 - DNA, 18 bp, Homo sapiens
ctggtctcccttcgcttt

SEQ ID NO: 7605599 - DNA, 22 bp, Homo sapiens
ctggtccttgctacccagcaag

SEQ ID NO: 7605600 - DNA, 22 bp, Homo sapiens
ctggtccttgctacccagcaag

SEQ ID NO: 7605601 - DNA, 22 bp, Homo sapiens
ctggtccttgctacccagcaag

SEQ ID NO: 7605602 - DNA, 22 bp, Homo sapiens
ctggtccttgctacccagcaag

SEQ ID NO: 7605603 - DNA, 20 bp, Homo sapiens
ctggggagcctcgcggtggc

SEQ ID NO: 7605604 - DNA, 20 bp, Homo sapiens
ctggggagcctcgcggtggc

SEQ ID NO: 7605605 - DNA, 20 bp, Homo sapiens
ctggggagcctcgcggtggc

SEQ ID NO: 7605606 - DNA, 20 bp, Homo sapiens
ctggggagcctcgcggtggc

SEQ ID NO: 7605607 - DNA, 20 bp, Homo sapiens
ctggggagcctcgcggtggc

SEQ ID NO: 7605608 - DNA, 20 bp, Homo sapiens
ctggggagcctcgcggtggc

SEQ ID NO: 7605609 - DNA, 20 bp, Homo sapiens
ctggggagcctcgcggtggc

SEQ ID NO: 7605610 - DNA, 20 bp, Homo sapiens
ctggggagcctcgcggtggc

SEQ ID NO: 7605611 - DNA, 20 bp, Homo sapiens
ctggggagcctcgcggtggc

SEQ ID NO: 7605612 - DNA, 20 bp, Homo sapiens
ctggggagcctcgcggtggc

SEQ ID NO: 7605613 - DNA, 20 bp, Homo sapiens
ctggggagcctcgcggtggc

SEQ ID NO: 7605614 - DNA, 20 bp, Homo sapiens
ctggggagctgctcccacga

SEQ ID NO: 7605615 - DNA, 20 bp, Homo sapiens
ctggggagctgctcccacga

SEQ ID NO: 7605616 - DNA, 20 bp, Homo sapiens
ctggggagctgctcccacga

SEQ ID NO: 7605617 - DNA, 22 bp, Homo sapiens
ctggtcactcctccacctgctt

SEQ ID NO: 7605618 - DNA, 22 bp, Homo sapiens
ctggtcactcctccacctgctt

SEQ ID NO: 7605619 - DNA, 22 bp, Homo sapiens
ctggtcactcctccacctgctt

SEQ ID NO: 7605620 - DNA, 22 bp, Homo sapiens
ctggtctgagggctcttgaggc

SEQ ID NO: 7605621 - DNA, 22 bp, Homo sapiens
ctggtctgaggttgcccttgaa

SEQ ID NO: 7605622 - DNA, 20 bp, Homo sapiens
ctggtctgccactcacagtt

SEQ ID NO: 7605623 - DNA, 22 bp, Homo sapiens
ctggtctgcgggaaggcgtggg

SEQ ID NO: 7605624 - DNA, 20 bp, Homo sapiens
ctggtctgccactcacagtt

SEQ ID NO: 7605625 - DNA, 22 bp, Homo sapiens
ctggtctgcgggaaggcgtggg

SEQ ID NO: 7605626 - DNA, 22 bp, Homo sapiens
ctggtctgctagaaagatgcat

SEQ ID NO: 7605627 - DNA, 19 bp, Homo sapiens
ctggtctgctgcttccagg

SEQ ID NO: 7605628 - DNA, 19 bp, Homo sapiens
ctggtctgctgcttccagg

SEQ ID NO: 7605629 - DNA, 19 bp, Homo sapiens
ctggtctgctgcttccagg

SEQ ID NO: 7605630 - DNA, 19 bp, Homo sapiens
ctggtctgctgcttccagg

SEQ ID NO: 7605631 - DNA, 19 bp, Homo sapiens
ctggtctgtcatgctcccc

SEQ ID NO: 7605632 - DNA, 19 bp, Homo sapiens
ctggtctgtcatgctcccc

SEQ ID NO: 7605633 - DNA, 19 bp, Homo sapiens
ctggtctgtcatgctcccc

SEQ ID NO: 7605634 - DNA, 22 bp, Homo sapiens
ctggtctgtccgcaggtcacct

SEQ ID NO: 7605635 - DNA, 22 bp, Homo sapiens
ctggtctgtccgcaggtcacct

SEQ ID NO: 7605636 - DNA, 16 bp, Homo sapiens
ctggtcttgctgccga

SEQ ID NO: 7605637 - DNA, 22 bp, Homo sapiens
ctggtgaatattggaggcattg

SEQ ID NO: 7605638 - DNA, 22 bp, Homo sapiens
ctggtgaatggataaactgttg

SEQ ID NO: 7605639 - DNA, 22 bp, Homo sapiens
ctggtctgggatgagggatgta

SEQ ID NO: 7605640 - DNA, 22 bp, Homo sapiens
ctggtctggctacccagcgaat

SEQ ID NO: 7605641 - DNA, 21 bp, Homo sapiens
ctggtctggccaataaggtcc

SEQ ID NO: 7605642 - DNA, 22 bp, Homo sapiens
ctggggagacgatcgatgttct

SEQ ID NO: 7605643 - DNA, 22 bp, Homo sapiens
ctggggagacgatcgatgttct

SEQ ID NO: 7605644 - DNA, 22 bp, Homo sapiens
ctggggagacgatcgatgttct

SEQ ID NO: 7605645 - DNA, 22 bp, Homo sapiens
ctggggagacgatcgatgttct

SEQ ID NO: 7605646 - DNA, 22 bp, Homo sapiens
ctggggagaagcgactcggctg

SEQ ID NO: 7605647 - DNA, 22 bp, Homo sapiens
ctggggagaagcgactcggctg

SEQ ID NO: 7605648 - DNA, 22 bp, Homo sapiens
ctggggagaagcgactcggctg

SEQ ID NO: 7605649 - DNA, 22 bp, Homo sapiens
ctggggagaagcgactcggctg

SEQ ID NO: 7605650 - DNA, 22 bp, Homo sapiens
ctggggagaagcgactcggctg

SEQ ID NO: 7605651 - DNA, 22 bp, Homo sapiens
ctggggactgaaggatgttgct

SEQ ID NO: 7605652 - DNA, 22 bp, Homo sapiens
ctggggactttggttctccatg

SEQ ID NO: 7605653 - DNA, 22 bp, Homo sapiens
ctggggactgaaggatgttgct

SEQ ID NO: 7605654 - DNA, 22 bp, Homo sapiens
ctggggactttggttctccatg

SEQ ID NO: 7605655 - DNA, 22 bp, Homo sapiens
ctggggagaagcgactcggctg

SEQ ID NO: 7605656 - DNA, 22 bp, Homo sapiens
ctggggagaagcgactcggctg

SEQ ID NO: 7605657 - DNA, 22 bp, Homo sapiens
ctggggactttggttctccatg

SEQ ID NO: 7605658 - DNA, 22 bp, Homo sapiens
ctggggagaagcgactcggctg

SEQ ID NO: 7605659 - DNA, 22 bp, Homo sapiens
ctggggagaagcgactcggctg

SEQ ID NO: 7605660 - DNA, 22 bp, Homo sapiens
ctggggaatagagctggagacc

SEQ ID NO: 7605661 - DNA, 22 bp, Homo sapiens
ctggggaaggcggtgactgcgc

SEQ ID NO: 7605662 - DNA, 22 bp, Homo sapiens
ctggggaaggcggtgactgcgc

SEQ ID NO: 7605663 - DNA, 22 bp, Homo sapiens
ctggggaatagagctggagacc

SEQ ID NO: 7605664 - DNA, 20 bp, Homo sapiens
ctggggacagcaatggctgt

SEQ ID NO: 7605665 - DNA, 20 bp, Homo sapiens
ctggggacagcaatggctgt

SEQ ID NO: 7605666 - DNA, 22 bp, Homo sapiens
ctggggaccgagcaagctctgg

SEQ ID NO: 7605667 - DNA, 22 bp, Homo sapiens
ctggggaccgagcaagctctgg

SEQ ID NO: 7605668 - DNA, 22 bp, Homo sapiens
ctggggaccgagcaagctctgg

SEQ ID NO: 7605669 - DNA, 22 bp, Homo sapiens
ctggggacgtcgggcagtgttc

SEQ ID NO: 7605670 - DNA, 22 bp, Homo sapiens
ctggggacgtcgggcagtgttc

SEQ ID NO: 7605671 - DNA, 22 bp, Homo sapiens
ctggggacgtcgggcagtgttc

SEQ ID NO: 7605672 - DNA, 22 bp, Homo sapiens
ctggggactcattcagagcata

SEQ ID NO: 7605673 - DNA, 22 bp, Homo sapiens
ctggggactcattcagagcata

SEQ ID NO: 7605674 - DNA, 22 bp, Homo sapiens
ctggggactcattcagagcata

SEQ ID NO: 7605675 - DNA, 22 bp, Homo sapiens
ctggggactcattcagagcata

SEQ ID NO: 7605676 - DNA, 22 bp, Homo sapiens
ctggggaacgcagcgagcagcg

SEQ ID NO: 7605677 - DNA, 22 bp, Homo sapiens
ctggggaacgcagcgagcagcg

SEQ ID NO: 7605678 - DNA, 22 bp, Homo sapiens
ctggggaacaatttgccacact

SEQ ID NO: 7605679 - DNA, 22 bp, Homo sapiens
ctggggaacaatttgccacact

SEQ ID NO: 7605680 - DNA, 22 bp, Homo sapiens
ctggggaacgcagcgagcagcg

SEQ ID NO: 7605681 - DNA, 22 bp, Homo sapiens
ctggggaacgcagcgagcagcg

SEQ ID NO: 7605682 - DNA, 22 bp, Homo sapiens
ctgggctttgaagccaggctgc

SEQ ID NO: 7605683 - DNA, 22 bp, Homo sapiens
ctgggcttttgagtcacaaggg

SEQ ID NO: 7605684 - DNA, 22 bp, Homo sapiens
ctgggcttttgagtcacaaggg

SEQ ID NO: 7605685 - DNA, 22 bp, Homo sapiens
ctgggcttttgagtcacaaggg

SEQ ID NO: 7605686 - DNA, 22 bp, Homo sapiens
ctgggctttgaagccaggctgc

SEQ ID NO: 7605687 - DNA, 21 bp, Homo sapiens
ctgggctttctctcaaagaca

SEQ ID NO: 7605688 - DNA, 21 bp, Homo sapiens
ctgggctttctctcaaagaca

SEQ ID NO: 7605689 - DNA, 21 bp, Homo sapiens
ctgggctttctctcaaagaca

SEQ ID NO: 7605690 - DNA, 22 bp, Homo sapiens
ctgggcttgcactgcagcgaga

SEQ ID NO: 7605691 - DNA, 22 bp, Homo sapiens
ctgggcttgtgttagctgacaa

SEQ ID NO: 7605692 - DNA, 22 bp, Homo sapiens
ctgggcttgtgttagctgacaa

SEQ ID NO: 7605693 - DNA, 22 bp, Homo sapiens
ctgggcttgtgttagctgacaa

SEQ ID NO: 7605694 - DNA, 22 bp, Homo sapiens
ctgggctgtttgtttagaatgg

SEQ ID NO: 7605695 - DNA, 22 bp, Homo sapiens
ctgggcttgtgttagctgacaa

SEQ ID NO: 7605696 - DNA, 22 bp, Homo sapiens
ctgggcttaggacctggtgcgg

SEQ ID NO: 7605697 - DNA, 22 bp, Homo sapiens
ctgggcttaggacctggtgcgg

SEQ ID NO: 7605698 - DNA, 22 bp, Homo sapiens
ctgggcttctccccctggcaga

SEQ ID NO: 7605699 - DNA, 22 bp, Homo sapiens
ctgggcttctccccctggcaga

SEQ ID NO: 7605700 - DNA, 22 bp, Homo sapiens
ctgggcttctccccctggcaga

SEQ ID NO: 7605701 - DNA, 22 bp, Homo sapiens
ctgggcttctccccctggcaga

SEQ ID NO: 7605702 - DNA, 22 bp, Homo sapiens
ctgggcttgagttcctgctcgt

SEQ ID NO: 7605703 - DNA, 19 bp, Homo sapiens
ctgggcttgatgttgagtt

SEQ ID NO: 7605704 - DNA, 22 bp, Homo sapiens
ctgggcttgagttcctgctcgt

SEQ ID NO: 7605705 - DNA, 22 bp, Homo sapiens
ctgggcttgagttcctgctcgt

SEQ ID NO: 7605706 - DNA, 22 bp, Homo sapiens
ctggtgccctgtgtggcaggag

SEQ ID NO: 7605707 - DNA, 22 bp, Homo sapiens
ctggtgccctgtgtggcaggag

SEQ ID NO: 7605708 - DNA, 22 bp, Homo sapiens
ctggtgccctgtgtggcaggag

SEQ ID NO: 7605709 - DNA, 22 bp, Homo sapiens
ctggtgccctgtgtggcaggag

SEQ ID NO: 7605710 - DNA, 22 bp, Homo sapiens
ctggtgccctgtgtggcaggag

SEQ ID NO: 7605711 - DNA, 22 bp, Homo sapiens
ctggtgccctgtgtggcaggag

SEQ ID NO: 7605712 - DNA, 22 bp, Homo sapiens
ctggtgccctgtgtggcaggag

SEQ ID NO: 7605713 - DNA, 22 bp, Homo sapiens
ctggtgccattctgtggcctag

SEQ ID NO: 7605714 - DNA, 22 bp, Homo sapiens
ctggtgccctgtgtggcaggag

SEQ ID NO: 7605715 - DNA, 22 bp, Homo sapiens
ctggtgccattctgtggcctag

SEQ ID NO: 7605716 - DNA, 22 bp, Homo sapiens
ctggtgccattctgtggcctag

SEQ ID NO: 7605717 - DNA, 22 bp, Homo sapiens
ctgtaaaacactgtagtatctg

SEQ ID NO: 7605718 - DNA, 22 bp, Homo sapiens
ctgtaaaacactgtagtatctg

SEQ ID NO: 7605719 - DNA, 22 bp, Homo sapiens
ctgtaaaactgcttaagtatgc

SEQ ID NO: 7605720 - DNA, 22 bp, Homo sapiens
ctgtaaaactgcttaagtatgc

SEQ ID NO: 7605721 - DNA, 22 bp, Homo sapiens
ctgtaaaactgcttaagtatgc

SEQ ID NO: 7605722 - DNA, 22 bp, Homo sapiens
ctgtaaaacactgtagtatctg

SEQ ID NO: 7605723 - DNA, 22 bp, Homo sapiens
ctgtaaaactgcttaagtatgc

SEQ ID NO: 7605724 - DNA, 22 bp, Homo sapiens
ctgtacaaagtagctgctggga

SEQ ID NO: 7605725 - DNA, 22 bp, Homo sapiens
ctgtacaaaagaaagttcctat

SEQ ID NO: 7605726 - DNA, 22 bp, Homo sapiens
ctgtacaaagtagctgctggga

SEQ ID NO: 7605727 - DNA, 22 bp, Homo sapiens
ctgtaaaatgaacctagtcatc

SEQ ID NO: 7605728 - DNA, 22 bp, Homo sapiens
ctgtaaaatgaacctagtcatc

SEQ ID NO: 7605729 - DNA, 22 bp, Homo sapiens
ctgtaaaactgcttaagtatgc

SEQ ID NO: 7605730 - DNA, 22 bp, Homo sapiens
ctgtaaaactgcttaagtatgc

SEQ ID NO: 7605731 - DNA, 22 bp, Homo sapiens
ctgtacaaaagaaagttcctat

SEQ ID NO: 7605732 - DNA, 22 bp, Homo sapiens
ctgtacaaaagaaagttcctat

SEQ ID NO: 7605733 - DNA, 22 bp, Homo sapiens
ctgtaattttccagccaatatg

SEQ ID NO: 7605734 - DNA, 22 bp, Homo sapiens
ctgtaattttccagccaatatg

SEQ ID NO: 7605735 - DNA, 20 bp, Homo sapiens
ctgtaaaccaggcttcttgg

SEQ ID NO: 7605736 - DNA, 22 bp, Homo sapiens
ctgtaattctctagttcggagt

SEQ ID NO: 7605737 - DNA, 22 bp, Homo sapiens
ctgtaattgttctatgtgttca

SEQ ID NO: 7605738 - DNA, 22 bp, Homo sapiens
ctgtaattgttctatgtgttca

SEQ ID NO: 7605739 - DNA, 22 bp, Homo sapiens
ctggtgccattctgtggcctag

SEQ ID NO: 7605740 - DNA, 22 bp, Homo sapiens
ctggtgccattctgtggcctag

SEQ ID NO: 7605741 - DNA, 22 bp, Homo sapiens
ctggtgccattctgtggcctag

SEQ ID NO: 7605742 - DNA, 22 bp, Homo sapiens
ctggtgcatgtggccttgctct

SEQ ID NO: 7605743 - DNA, 22 bp, Homo sapiens
ctggtgcactacagcctggaac

SEQ ID NO: 7605744 - DNA, 22 bp, Homo sapiens
ctggtgcaggaaggagctggca

SEQ ID NO: 7605745 - DNA, 22 bp, Homo sapiens
ctggtgcaggaaggagctggca

SEQ ID NO: 7605746 - DNA, 22 bp, Homo sapiens
ctggtgcacgtggctgcagtcg

SEQ ID NO: 7605747 - DNA, 22 bp, Homo sapiens
ctggtgcaggaaggagctggca

SEQ ID NO: 7605748 - DNA, 22 bp, Homo sapiens
ctggtgcaggaaggagctggca

SEQ ID NO: 7605749 - DNA, 22 bp, Homo sapiens
ctggtgcactacagcctggaac

SEQ ID NO: 7605750 - DNA, 22 bp, Homo sapiens
ctggtgcacattcgctctcata

SEQ ID NO: 7605751 - DNA, 22 bp, Homo sapiens
ctggtgcaaaagtaattgtggt

SEQ ID NO: 7605752 - DNA, 22 bp, Homo sapiens
ctggtgcaagattccctgcttc

SEQ ID NO: 7605753 - DNA, 22 bp, Homo sapiens
ctggtgcacattcgctctcata

SEQ ID NO: 7605754 - DNA, 22 bp, Homo sapiens
ctggtgcacattcgctctcata

SEQ ID NO: 7605755 - DNA, 22 bp, Homo sapiens
ctggtgcacgtggctgcagtcg

SEQ ID NO: 7605756 - DNA, 22 bp, Homo sapiens
ctggtgcacattcgctctcata

SEQ ID NO: 7605757 - DNA, 22 bp, Homo sapiens
ctggtgaccttgccccaggtca

SEQ ID NO: 7605758 - DNA, 22 bp, Homo sapiens
ctggtgagacggttgacaggag

SEQ ID NO: 7605759 - DNA, 22 bp, Homo sapiens
ctggtgacttcatctcctcccc

SEQ ID NO: 7605760 - DNA, 22 bp, Homo sapiens
ctggtgagacggttgacaggag

SEQ ID NO: 7605761 - DNA, 22 bp, Homo sapiens
ctggtgagactcagggatgctt

SEQ ID NO: 7605762 - DNA, 22 bp, Homo sapiens
ctggtgagactcagggatgctt

SEQ ID NO: 7605763 - DNA, 22 bp, Homo sapiens
ctggtgagactcagggatgctt

SEQ ID NO: 7605764 - DNA, 22 bp, Homo sapiens
ctggtgagactcagggatgctt

SEQ ID NO: 7605765 - DNA, 22 bp, Homo sapiens
ctggtgagacggttgacaggag

SEQ ID NO: 7605766 - DNA, 22 bp, Homo sapiens
ctggtgcaaggctttggaatcc

SEQ ID NO: 7605767 - DNA, 22 bp, Homo sapiens
ctggtgcaaggctttggaatcc

SEQ ID NO: 7605768 - DNA, 22 bp, Homo sapiens
ctggtgcaagattccctgcttc

SEQ ID NO: 7605769 - DNA, 22 bp, Homo sapiens
ctggtgatcttgggcaagtcac

SEQ ID NO: 7605770 - DNA, 22 bp, Homo sapiens
ctggtgagactcagggatgctt

SEQ ID NO: 7605771 - DNA, 19 bp, Homo sapiens
ctgtacaggttgcttctgg

SEQ ID NO: 7605772 - DNA, 19 bp, Homo sapiens
ctgtacaggttgcttctgg

SEQ ID NO: 7605773 - DNA, 19 bp, Homo sapiens
ctgtacaggttgcttctgg

SEQ ID NO: 7605774 - DNA, 19 bp, Homo sapiens
ctgtacaggttgcttctgg

SEQ ID NO: 7605775 - DNA, 19 bp, Homo sapiens
ctgtacaggttgcttctgg

SEQ ID NO: 7605776 - DNA, 22 bp, Homo sapiens
ctgtacaggtgaggagggggct

SEQ ID NO: 7605777 - DNA, 22 bp, Homo sapiens
ctgtacaggtgaggagggggct

SEQ ID NO: 7605778 - DNA, 22 bp, Homo sapiens
ctgtacaggtgaggagggggct

SEQ ID NO: 7605779 - DNA, 22 bp, Homo sapiens
ctgtacataaaggaataggtgt

SEQ ID NO: 7605780 - DNA, 22 bp, Homo sapiens
ctgtacatatacatttttttcc

SEQ ID NO: 7605781 - DNA, 22 bp, Homo sapiens
ctgtacataaaggaataggtgt

SEQ ID NO: 7605782 - DNA, 22 bp, Homo sapiens
ctgtacataaaggaataggtgt

SEQ ID NO: 7605783 - DNA, 22 bp, Homo sapiens
ctgtacagcaagttcaccttgg

SEQ ID NO: 7605784 - DNA, 22 bp, Homo sapiens
ctgtacagcaagttcaccttgg

SEQ ID NO: 7605785 - DNA, 22 bp, Homo sapiens
ctgtacagattgcacacgggga

SEQ ID NO: 7605786 - DNA, 22 bp, Homo sapiens
ctgtacagattgcacacgggga

SEQ ID NO: 7605787 - DNA, 22 bp, Homo sapiens
ctgtacagcaagttcaccttgg

SEQ ID NO: 7605788 - DNA, 22 bp, Homo sapiens
ctgtacaggagacgtctgtgca

SEQ ID NO: 7605789 - DNA, 22 bp, Homo sapiens
ctgtacaggagacgtctgtgca

SEQ ID NO: 7605790 - DNA, 22 bp, Homo sapiens
ctgtacagagttctgagtgtac

SEQ ID NO: 7605791 - DNA, 22 bp, Homo sapiens
ctgtacagagttctgagtgtac

SEQ ID NO: 7605792 - DNA, 22 bp, Homo sapiens
ctgtacagacctattagcccag

SEQ ID NO: 7605793 - DNA, 22 bp, Homo sapiens
ctgtacagagttctgagtgtac

SEQ ID NO: 7605794 - DNA, 22 bp, Homo sapiens
ctgtacagagttctgagtgtac

SEQ ID NO: 7605795 - DNA, 22 bp, Homo sapiens
ctgtacaggagacgtctgtgca

SEQ ID NO: 7605796 - DNA, 22 bp, Homo sapiens
ctgtacaggagacgtctgtgca

SEQ ID NO: 7605797 - DNA, 22 bp, Homo sapiens
ctgtacaggtcaatgataagat

SEQ ID NO: 7605798 - DNA, 22 bp, Homo sapiens
ctgtacaggtcaatgataagat

SEQ ID NO: 7605799 - DNA, 22 bp, Homo sapiens
ctgtacaggtcaatgataagat

SEQ ID NO: 7605800 - DNA, 22 bp, Homo sapiens
ctgtacaggtcaatgataagat

SEQ ID NO: 7605801 - DNA, 22 bp, Homo sapiens
ctgtacaagtccttcatcaggg

SEQ ID NO: 7605802 - DNA, 22 bp, Homo sapiens
ctgtacaagtccttcatcaggg

SEQ ID NO: 7605803 - DNA, 22 bp, Homo sapiens
ctgtacaatgttacctatttat

SEQ ID NO: 7605804 - DNA, 22 bp, Homo sapiens
ctgtacaatgttacctatttat

SEQ ID NO: 7605805 - DNA, 22 bp, Homo sapiens
ctgtacaatgttacctatttat

SEQ ID NO: 7605806 - DNA, 22 bp, Homo sapiens
ctgtacagacctattagcccag

SEQ ID NO: 7605807 - DNA, 22 bp, Homo sapiens
ctgtacagacctattagcccag

SEQ ID NO: 7605808 - DNA, 22 bp, Homo sapiens
ctgtacagagttctgagtgtac

SEQ ID NO: 7605809 - DNA, 22 bp, Homo sapiens
ctgtacagaagctagagcaaat

SEQ ID NO: 7605810 - DNA, 22 bp, Homo sapiens
ctgtacagaagctagagcaaat

SEQ ID NO: 7605811 - DNA, 22 bp, Homo sapiens
ctgtacagaagctagagcaaat

SEQ ID NO: 7605812 - DNA, 22 bp, Homo sapiens
ctgtacagaagctagagcaaat

SEQ ID NO: 7605813 - DNA, 22 bp, Homo sapiens
ctgtacagaagctagagcaaat

SEQ ID NO: 7605814 - DNA, 22 bp, Homo sapiens
ctgtacagaagctagagcaaat

SEQ ID NO: 7605815 - DNA, 22 bp, Homo sapiens
ctgtacagaagctagagcaaat

SEQ ID NO: 7605816 - DNA, 22 bp, Homo sapiens
ctgtacacttcagtgagttttg

SEQ ID NO: 7605817 - DNA, 22 bp, Homo sapiens
ctgtacacttcagtgagttttg

SEQ ID NO: 7605818 - DNA, 23 bp, Homo sapiens
ctgtacacaaactgcctgcctgt

SEQ ID NO: 7605819 - DNA, 23 bp, Homo sapiens
ctgtacacaaactgcctgcctgt

SEQ ID NO: 7605820 - DNA, 22 bp, Homo sapiens
ctgtacatcccgagagccagta

SEQ ID NO: 7605821 - DNA, 22 bp, Homo sapiens
ctgtacatatgtctccagagtg

SEQ ID NO: 7605822 - DNA, 20 bp, Homo sapiens
ctgtacatcaccaaggtgac

SEQ ID NO: 7605823 - DNA, 20 bp, Homo sapiens
ctgtacatcaccaaggtgac

SEQ ID NO: 7605824 - DNA, 22 bp, Homo sapiens
ctgtacatatgtctccagagtg

SEQ ID NO: 7605825 - DNA, 22 bp, Homo sapiens
ctgtacatatacatttttttcc

SEQ ID NO: 7605826 - DNA, 22 bp, Homo sapiens
ctgtacatcccgagagccagta

SEQ ID NO: 7605827 - DNA, 22 bp, Homo sapiens
ctgtacatctctgaggacagta

SEQ ID NO: 7605828 - DNA, 22 bp, Homo sapiens
ctgtacatcccgagagccagta

SEQ ID NO: 7605829 - DNA, 18 bp, Homo sapiens
ctgtacttcagcctgggt

SEQ ID NO: 7605830 - DNA, 22 bp, Homo sapiens
ctgtactaattgctttacatgt

SEQ ID NO: 7605831 - DNA, 22 bp, Homo sapiens
ctgtacctcagctttgctccca

SEQ ID NO: 7605832 - DNA, 22 bp, Homo sapiens
ctgtactaattgctttacatgt

SEQ ID NO: 7605833 - DNA, 22 bp, Homo sapiens
ctgtacatcttaaatggaaaaa

SEQ ID NO: 7605834 - DNA, 22 bp, Homo sapiens
ctgtacatcttaaatggaaaaa

SEQ ID NO: 7605835 - DNA, 18 bp, Homo sapiens
ctgtaccaccctgagggc

SEQ ID NO: 7605836 - DNA, 18 bp, Homo sapiens
ctgtaccaccctgagggc

SEQ ID NO: 7605837 - DNA, 22 bp, Homo sapiens
ctgtagaggaacaagagctctt

SEQ ID NO: 7605838 - DNA, 22 bp, Homo sapiens
ctgtagaggaacaagagctctt

SEQ ID NO: 7605839 - DNA, 22 bp, Homo sapiens
ctgtagaggaacaagagctctt

SEQ ID NO: 7605840 - DNA, 20 bp, Homo sapiens
ctgtagagcacaagtggagg

SEQ ID NO: 7605841 - DNA, 20 bp, Homo sapiens
ctgtagagcacaagtggagg

SEQ ID NO: 7605842 - DNA, 22 bp, Homo sapiens
ctgtagcaagttattcaataaa

SEQ ID NO: 7605843 - DNA, 22 bp, Homo sapiens
ctgtagcaagttattcaataaa

SEQ ID NO: 7605844 - DNA, 22 bp, Homo sapiens
ctgtagagaaagcatggaagct

SEQ ID NO: 7605845 - DNA, 22 bp, Homo sapiens
ctgtagagaaagcatggaagct

SEQ ID NO: 7605846 - DNA, 22 bp, Homo sapiens
ctgtagagaaagcatggaagct

SEQ ID NO: 7605847 - DNA, 22 bp, Homo sapiens
ctgtacttctttcagagcaccc

SEQ ID NO: 7605848 - DNA, 22 bp, Homo sapiens
ctgtagcatttgttatggcaat

SEQ ID NO: 7605849 - DNA, 22 bp, Homo sapiens
ctgtagcagtgttccagcattg

SEQ ID NO: 7605850 - DNA, 22 bp, Homo sapiens
ctgtagcagtgtgctctttttc

SEQ ID NO: 7605851 - DNA, 22 bp, Homo sapiens
ctgtagccagaagcagaaggcc

SEQ ID NO: 7605852 - DNA, 23 bp, Homo sapiens
ctgtagctaaaagctgggatttg

SEQ ID NO: 7605853 - DNA, 22 bp, Homo sapiens
ctgtctgtcccgtcaccgcccc

SEQ ID NO: 7605854 - DNA, 22 bp, Homo sapiens
ctgtctgtcctgagttcaacca

SEQ ID NO: 7605855 - DNA, 22 bp, Homo sapiens
ctgtctgtcctgagttcaacca

SEQ ID NO: 7605856 - DNA, 22 bp, Homo sapiens
ctgtctgtcccgtcaccgcccc

SEQ ID NO: 7605857 - DNA, 22 bp, Homo sapiens
ctgtctgtcaccaaaacagact

SEQ ID NO: 7605858 - DNA, 22 bp, Homo sapiens
ctgtctgtcaagttcatctcca

SEQ ID NO: 7605859 - DNA, 22 bp, Homo sapiens
ctgtctgtcaagttcatctcca

SEQ ID NO: 7605860 - DNA, 22 bp, Homo sapiens
ctgtctgtcaccaaaacagact

SEQ ID NO: 7605861 - DNA, 22 bp, Homo sapiens
ctgtctgtgacctctgcatgtc

SEQ ID NO: 7605862 - DNA, 22 bp, Homo sapiens
ctgtctgtgacctctgcatgtc

SEQ ID NO: 7605863 - DNA, 22 bp, Homo sapiens
ctgtctgtgacctctgcatgtc

SEQ ID NO: 7605864 - DNA, 22 bp, Homo sapiens
ctgtctgtgacctctgcatgtc

SEQ ID NO: 7605865 - DNA, 19 bp, Homo sapiens
ctgtctgtgcagagatgtg

SEQ ID NO: 7605866 - DNA, 22 bp, Homo sapiens
ctgtctgtgacctctgcatgtc

SEQ ID NO: 7605867 - DNA, 22 bp, Homo sapiens
ctgtctgtcccgtcaccgcccc

SEQ ID NO: 7605868 - DNA, 19 bp, Homo sapiens
ctgtctgtgcagagatgtg

SEQ ID NO: 7605869 - DNA, 19 bp, Homo sapiens
ctgtctgtgcagagatgtg

SEQ ID NO: 7605870 - DNA, 19 bp, Homo sapiens
ctgtctgtgcagagatgtg

SEQ ID NO: 7605871 - DNA, 22 bp, Homo sapiens
ctgtctgtgcctcttctcccag

SEQ ID NO: 7605872 - DNA, 19 bp, Homo sapiens
ctgtctggttcatgtgttc

SEQ ID NO: 7605873 - DNA, 19 bp, Homo sapiens
ctgtctggttcatgtgttc

SEQ ID NO: 7605874 - DNA, 22 bp, Homo sapiens
ctgtctgtacaaatgtggggcc

SEQ ID NO: 7605875 - DNA, 22 bp, Homo sapiens
ctgtctggtgtccctgtctaca

SEQ ID NO: 7605876 - DNA, 19 bp, Homo sapiens
ctgtctggttcatgtgttc

SEQ ID NO: 7605877 - DNA, 22 bp, Homo sapiens
ctgtctggtgtccctgtctaca

SEQ ID NO: 7605878 - DNA, 22 bp, Homo sapiens
ctgtctgtactgagagttctgt

SEQ ID NO: 7605879 - DNA, 22 bp, Homo sapiens
ctgtctgtactgagagttctgt

SEQ ID NO: 7605880 - DNA, 22 bp, Homo sapiens
ctgtctgtactgagagttctgt

SEQ ID NO: 7605881 - DNA, 22 bp, Homo sapiens
ctgtctgtactgagagttctgt

SEQ ID NO: 7605882 - DNA, 22 bp, Homo sapiens
ctgtctgtagacatttttggtt

SEQ ID NO: 7605883 - DNA, 22 bp, Homo sapiens
ctgtctgtatccctgttggtaa

SEQ ID NO: 7605884 - DNA, 22 bp, Homo sapiens
ctgtctgtcaagttcatctcca

SEQ ID NO: 7605885 - DNA, 22 bp, Homo sapiens
ctgtctgtcaagttcatctcca

SEQ ID NO: 7605886 - DNA, 22 bp, Homo sapiens
ctgtctgtcaagttcatctcca

SEQ ID NO: 7605887 - DNA, 21 bp, Homo sapiens
ctgtctggccgcgggctccgc

SEQ ID NO: 7605888 - DNA, 22 bp, Homo sapiens
ctgtctgggtctacatcctctg

SEQ ID NO: 7605889 - DNA, 22 bp, Homo sapiens
ctgtctgggtctacatcctctg

SEQ ID NO: 7605890 - DNA, 22 bp, Homo sapiens
ctgtctggccggcccagcttcc

SEQ ID NO: 7605891 - DNA, 22 bp, Homo sapiens
ctgtctgggtctacatcctctg

SEQ ID NO: 7605892 - DNA, 22 bp, Homo sapiens
ctgtctgggtctacatcctctg

SEQ ID NO: 7605893 - DNA, 22 bp, Homo sapiens
ctgtctgggtctacatcctctg

SEQ ID NO: 7605894 - DNA, 22 bp, Homo sapiens
ctgtctgggtctacatcctctg

SEQ ID NO: 7605895 - DNA, 22 bp, Homo sapiens
ctgtctggtcaacaactgagtg

SEQ ID NO: 7605896 - DNA, 22 bp, Homo sapiens
ctgtctgggtctacatcctctg

SEQ ID NO: 7605897 - DNA, 22 bp, Homo sapiens
ctgtctggccggcccagcttcc

SEQ ID NO: 7605898 - DNA, 22 bp, Homo sapiens
ctgtctggccggcccagcttcc

SEQ ID NO: 7605899 - DNA, 21 bp, Homo sapiens
ctgtctggccgcgggctccgc

SEQ ID NO: 7605900 - DNA, 21 bp, Homo sapiens
ctgtctggccgcgggctccgc

SEQ ID NO: 7605901 - DNA, 22 bp, Homo sapiens
ctgtctggatataccttggcca

SEQ ID NO: 7605902 - DNA, 22 bp, Homo sapiens
ctgtctggatgtgagtcaccta

SEQ ID NO: 7605903 - DNA, 22 bp, Homo sapiens
ctgtctggatataccttggcca

SEQ ID NO: 7605904 - DNA, 22 bp, Homo sapiens
ctgtctggaatgcagtacatag

SEQ ID NO: 7605905 - DNA, 17 bp, Homo sapiens
ctgtctgctgcttcctc

SEQ ID NO: 7605906 - DNA, 22 bp, Homo sapiens
ctgtctggaatgcagtacatag

SEQ ID NO: 7605907 - DNA, 22 bp, Homo sapiens
ctgtctggagttatgtaaatag

SEQ ID NO: 7605908 - DNA, 22 bp, Homo sapiens
ctgtctggatataccttggcca

SEQ ID NO: 7605909 - DNA, 22 bp, Homo sapiens
ctgtctggaatgcagtacatag

SEQ ID NO: 7605910 - DNA, 17 bp, Homo sapiens
ctgtctgctgcttcctc

SEQ ID NO: 7605911 - DNA, 22 bp, Homo sapiens
ctgtctgctcataatggagggc

SEQ ID NO: 7605912 - DNA, 22 bp, Homo sapiens
ctgtctgctcataatggagggc

SEQ ID NO: 7605913 - DNA, 17 bp, Homo sapiens
ctgtctgctgcttcctc

SEQ ID NO: 7605914 - DNA, 22 bp, Homo sapiens
ctgtctgctagaacatctatac

SEQ ID NO: 7605915 - DNA, 22 bp, Homo sapiens
ctgtctgctagaacatctatac

SEQ ID NO: 7605916 - DNA, 22 bp, Homo sapiens
ctgtctgctatgcttgttgtca

SEQ ID NO: 7605917 - DNA, 22 bp, Homo sapiens
ctgtctgctatgcttgttgtca

SEQ ID NO: 7605918 - DNA, 19 bp, Homo sapiens
ctgtctgcggggcctgttc

SEQ ID NO: 7605919 - DNA, 17 bp, Homo sapiens
ctgtctgcgcatgaggt

SEQ ID NO: 7605920 - DNA, 19 bp, Homo sapiens
ctgtctgcggggcctgttc

SEQ ID NO: 7605921 - DNA, 17 bp, Homo sapiens
ctgtctgcgcatgaggt

SEQ ID NO: 7605922 - DNA, 17 bp, Homo sapiens
ctgtctgcgcatgaggt

SEQ ID NO: 7605923 - DNA, 17 bp, Homo sapiens
ctgtctgcgcatgaggt

SEQ ID NO: 7605924 - DNA, 17 bp, Homo sapiens
ctgtctgcgcatgaggt

SEQ ID NO: 7605925 - DNA, 22 bp, Homo sapiens
ctgtctgtgcctcttctcccag

SEQ ID NO: 7605926 - DNA, 22 bp, Homo sapiens
ctgtctgtggagcttctgatgt

SEQ ID NO: 7605927 - DNA, 22 bp, Homo sapiens
ctgtctgtggagcttctgatgt

SEQ ID NO: 7605928 - DNA, 22 bp, Homo sapiens
ctgtgccctggccaggcctctc

SEQ ID NO: 7605929 - DNA, 18 bp, Homo sapiens
ctgtgccctgctcctact

SEQ ID NO: 7605930 - DNA, 18 bp, Homo sapiens
ctgtgccctgctcctact

SEQ ID NO: 7605931 - DNA, 22 bp, Homo sapiens
ctgtgccctggccaggcctctc

SEQ ID NO: 7605932 - DNA, 22 bp, Homo sapiens
ctgtgccctggccaggcctctc

SEQ ID NO: 7605933 - DNA, 22 bp, Homo sapiens
ctgtgccctggccaggcctctc

SEQ ID NO: 7605934 - DNA, 22 bp, Homo sapiens
ctgtgccctgtggctggcacct

SEQ ID NO: 7605935 - DNA, 22 bp, Homo sapiens
ctgtgccctgtggctggcacct

SEQ ID NO: 7605936 - DNA, 22 bp, Homo sapiens
ctgtgccctggccaggcctctc

SEQ ID NO: 7605937 - DNA, 22 bp, Homo sapiens
ctgtgccctttcgctgcactgt

SEQ ID NO: 7605938 - DNA, 22 bp, Homo sapiens
ctgtgccctttcgctgcactgt

SEQ ID NO: 7605939 - DNA, 17 bp, Homo sapiens
ctgtgctcgagtgatgg

SEQ ID NO: 7605940 - DNA, 22 bp, Homo sapiens
ctgtgccctgtggctggcacct

SEQ ID NO: 7605941 - DNA, 22 bp, Homo sapiens
ctgtgccctgtggctggcacct

SEQ ID NO: 7605942 - DNA, 22 bp, Homo sapiens
ctgtgctgattcagcacaggcc

SEQ ID NO: 7605943 - DNA, 22 bp, Homo sapiens
ctgtgctgattcagcacaggcc

SEQ ID NO: 7605944 - DNA, 22 bp, Homo sapiens
ctgtgctgattcagcacaggcc

SEQ ID NO: 7605945 - DNA, 22 bp, Homo sapiens
ctgtgctgagtgatgtgactta

SEQ ID NO: 7605946 - DNA, 22 bp, Homo sapiens
ctgtgctgagtgatgtgactta

SEQ ID NO: 7605947 - DNA, 22 bp, Homo sapiens
ctgtgctgagtgatgtgactta

SEQ ID NO: 7605948 - DNA, 22 bp, Homo sapiens
ctgtgctgattcagcacaggcc

SEQ ID NO: 7605949 - DNA, 22 bp, Homo sapiens
ctgtgctgattcagcacaggcc

SEQ ID NO: 7605950 - DNA, 22 bp, Homo sapiens
ctgtgctgaggatgcagtttct

SEQ ID NO: 7605951 - DNA, 22 bp, Homo sapiens
ctgtgctgaggatgcagtttct

SEQ ID NO: 7605952 - DNA, 22 bp, Homo sapiens
ctgtgctgaacaattctgcatt

SEQ ID NO: 7605953 - DNA, 22 bp, Homo sapiens
ctgtgctgaacaattctgcatt

SEQ ID NO: 7605954 - DNA, 22 bp, Homo sapiens
ctgtgctgaacaattctgcatt

SEQ ID NO: 7605955 - DNA, 22 bp, Homo sapiens
ctgtgctgaacaattctgcatt

SEQ ID NO: 7605956 - DNA, 22 bp, Homo sapiens
ctgtgctgaacaattctgcatt

SEQ ID NO: 7605957 - DNA, 22 bp, Homo sapiens
ctgtgctctggcatcgctgcaa

SEQ ID NO: 7605958 - DNA, 22 bp, Homo sapiens
ctgtgctctgagcgtggggttg

SEQ ID NO: 7605959 - DNA, 22 bp, Homo sapiens
ctgtgctctgagcgtggggttg

SEQ ID NO: 7605960 - DNA, 17 bp, Homo sapiens
ctgtgctcgagtgatgg

SEQ ID NO: 7605961 - DNA, 22 bp, Homo sapiens
ctgtgctgctagacctggattc

SEQ ID NO: 7605962 - DNA, 22 bp, Homo sapiens
ctgtgctgctagacctggattc

SEQ ID NO: 7605963 - DNA, 22 bp, Homo sapiens
ctgtgctgctagacctggattc

SEQ ID NO: 7605964 - DNA, 22 bp, Homo sapiens
ctgtgctggagatgggccagag

SEQ ID NO: 7605965 - DNA, 22 bp, Homo sapiens
ctgtgctggagatgggccagag

SEQ ID NO: 7605966 - DNA, 22 bp, Homo sapiens
ctgtgctggagatgggccagag

SEQ ID NO: 7605967 - DNA, 22 bp, Homo sapiens
ctgtgctggagatgggccagag

SEQ ID NO: 7605968 - DNA, 22 bp, Homo sapiens
ctgtgctggagatgggccagag

SEQ ID NO: 7605969 - DNA, 22 bp, Homo sapiens
ctgtgctgcagacgcagtagct

SEQ ID NO: 7605970 - DNA, 22 bp, Homo sapiens
ctgtgctgcagacgcagtagct

SEQ ID NO: 7605971 - DNA, 22 bp, Homo sapiens
ctgtgctgcagacgcagtagct

SEQ ID NO: 7605972 - DNA, 22 bp, Homo sapiens
ctgtgctgattcagcacaggcc

SEQ ID NO: 7605973 - DNA, 22 bp, Homo sapiens
ctgtgctgctagacctggattc

SEQ ID NO: 7605974 - DNA, 22 bp, Homo sapiens
ctgtgctgcagacgcagtagct

SEQ ID NO: 7605975 - DNA, 22 bp, Homo sapiens
ctgtgctggattctgaggctac

SEQ ID NO: 7605976 - DNA, 22 bp, Homo sapiens
ctgtgctggattctgaggctac

SEQ ID NO: 7605977 - DNA, 22 bp, Homo sapiens
ctgtgctggattctgaggctac

SEQ ID NO: 7605978 - DNA, 22 bp, Homo sapiens
ctgtgctggattctgaggctac

SEQ ID NO: 7605979 - DNA, 22 bp, Homo sapiens
ctgtgctggagatgggccagag

SEQ ID NO: 7605980 - DNA, 22 bp, Homo sapiens
ctgtgctggagatgggccagag

SEQ ID NO: 7605981 - DNA, 22 bp, Homo sapiens
ctgtgctggcagacctggagtt

SEQ ID NO: 7605982 - DNA, 22 bp, Homo sapiens
ctgtgctggcagacctggagtt

SEQ ID NO: 7605983 - DNA, 22 bp, Homo sapiens
ctgtgctggcagacctggagtt

SEQ ID NO: 7605984 - DNA, 22 bp, Homo sapiens
ctgtgctggattctgaggctac

SEQ ID NO: 7605985 - DNA, 22 bp, Homo sapiens
ctgtgctggcagcaatcaagga

SEQ ID NO: 7605986 - DNA, 23 bp, Homo sapiens
ctgtgctgggtcccatcttgggc

SEQ ID NO: 7605987 - DNA, 22 bp, Homo sapiens
ctgtgctgggtccttcttttga

SEQ ID NO: 7605988 - DNA, 22 bp, Homo sapiens
ctgtgctgggtgtgcttatgat

SEQ ID NO: 7605989 - DNA, 22 bp, Homo sapiens
ctgtgctggtccagggagctgg

SEQ ID NO: 7605990 - DNA, 22 bp, Homo sapiens
ctgtgctggtccagggagctgg

SEQ ID NO: 7605991 - DNA, 22 bp, Homo sapiens
ctgtgctggtccagggagctgg

SEQ ID NO: 7605992 - DNA, 22 bp, Homo sapiens
ctgtgctggtgaaacccacaga

SEQ ID NO: 7605993 - DNA, 22 bp, Homo sapiens
ctgtgctggtccagggagctgg

SEQ ID NO: 7605994 - DNA, 22 bp, Homo sapiens
ctgtgctggtccagggagctgg

SEQ ID NO: 7605995 - DNA, 22 bp, Homo sapiens
ctgtgctgtcttgggagcctta

SEQ ID NO: 7605996 - DNA, 22 bp, Homo sapiens
ctgtgctgtcttgggagcctta

SEQ ID NO: 7605997 - DNA, 22 bp, Homo sapiens
ctgtgctggtgaaacccacaga

SEQ ID NO: 7605998 - DNA, 22 bp, Homo sapiens
ctgtgctgtcttgggagcctta

SEQ ID NO: 7605999 - DNA, 22 bp, Homo sapiens
ctgtgctgtcttgggagcctta

SEQ ID NO: 7606000 - DNA, 22 bp, Homo sapiens
ctgtgcttacctgcccaggtga

SEQ ID NO: 7606001 - DNA, 22 bp, Homo sapiens
ctgtgcttagccatcacattca

SEQ ID NO: 7606002 - DNA, 22 bp, Homo sapiens
ctgtgcttcagagtcagtgctg

SEQ ID NO: 7606003 - DNA, 22 bp, Homo sapiens
ctgtgcttcagagtcagtgctg

SEQ ID NO: 7606004 - DNA, 22 bp, Homo sapiens
ctgtcactctggcaacccagta

SEQ ID NO: 7606005 - DNA, 22 bp, Homo sapiens
ctgtcacctgttcactgcagca

SEQ ID NO: 7606006 - DNA, 22 bp, Homo sapiens
ctgtcacctgttcactgcagca

SEQ ID NO: 7606007 - DNA, 22 bp, Homo sapiens
ctgtcacctgttcactgcagca

SEQ ID NO: 7606008 - DNA, 22 bp, Homo sapiens
ctgtcacctgttcactgcagca

SEQ ID NO: 7606009 - DNA, 22 bp, Homo sapiens
ctgtcacctgccagcataccca

SEQ ID NO: 7606010 - DNA, 21 bp, Homo sapiens
ctgtcacctgctcagagaggg

SEQ ID NO: 7606011 - DNA, 21 bp, Homo sapiens
ctgtcacctgctcagagaggg

SEQ ID NO: 7606012 - DNA, 22 bp, Homo sapiens
ctgtcacctctgtggacccact

SEQ ID NO: 7606013 - DNA, 22 bp, Homo sapiens
ctgtcacctctgccctttgccc

SEQ ID NO: 7606014 - DNA, 18 bp, Homo sapiens
ctgtcaccgccaccacac

SEQ ID NO: 7606015 - DNA, 22 bp, Homo sapiens
ctgtcactgatgggctcaccag

SEQ ID NO: 7606016 - DNA, 22 bp, Homo sapiens
ctgtcactgatgctcctgccac

SEQ ID NO: 7606017 - DNA, 22 bp, Homo sapiens
ctgtcactgatgctcctgccac

SEQ ID NO: 7606018 - DNA, 22 bp, Homo sapiens
ctgtcacttaaattcaggctga

SEQ ID NO: 7606019 - DNA, 22 bp, Homo sapiens
ctgtcagcttctcctggccaga

SEQ ID NO: 7606020 - DNA, 22 bp, Homo sapiens
ctgtcagcttctcctggccaga

SEQ ID NO: 7606021 - DNA, 18 bp, Homo sapiens
ctgtcagcagcttcacga

SEQ ID NO: 7606022 - DNA, 18 bp, Homo sapiens
ctgtcagcagcttcacga

SEQ ID NO: 7606023 - DNA, 22 bp, Homo sapiens
ctgtcagcactctactacagat

SEQ ID NO: 7606024 - DNA, 22 bp, Homo sapiens
ctgtcagcactctactacagat

SEQ ID NO: 7606025 - DNA, 22 bp, Homo sapiens
ctgtcaggggcgggtggagcgg

SEQ ID NO: 7606026 - DNA, 22 bp, Homo sapiens
ctgtcaggggcgggtggagcgg

SEQ ID NO: 7606027 - DNA, 22 bp, Homo sapiens
ctgtcagcttctcctggccaga

SEQ ID NO: 7606028 - DNA, 22 bp, Homo sapiens
ctgtcaggaagctgggcatcca

SEQ ID NO: 7606029 - DNA, 22 bp, Homo sapiens
ctgtcaggttggtctcagagct

SEQ ID NO: 7606030 - DNA, 22 bp, Homo sapiens
ctgtcaggttggtctcagagct

SEQ ID NO: 7606031 - DNA, 22 bp, Homo sapiens
ctgtcagggggcctggccatca

SEQ ID NO: 7606032 - DNA, 19 bp, Homo sapiens
ctgtcaggggctggatgtt

SEQ ID NO: 7606033 - DNA, 19 bp, Homo sapiens
ctgtcaggggctggatgtt

SEQ ID NO: 7606034 - DNA, 19 bp, Homo sapiens
ctgtcaggggctggatgtt

SEQ ID NO: 7606035 - DNA, 19 bp, Homo sapiens
ctgtcaggggctggatgtt

SEQ ID NO: 7606036 - DNA, 22 bp, Homo sapiens
ctgtcaggggcgggtggagcgg

SEQ ID NO: 7606037 - DNA, 22 bp, Homo sapiens
ctgtctgcaggatagtaccctc

SEQ ID NO: 7606038 - DNA, 22 bp, Homo sapiens
ctgtctgcaggatagtaccctc

SEQ ID NO: 7606039 - DNA, 22 bp, Homo sapiens
ctgtctgccaataatctatggc

SEQ ID NO: 7606040 - DNA, 22 bp, Homo sapiens
ctgtctgcaggatagtaccctc

SEQ ID NO: 7606041 - DNA, 22 bp, Homo sapiens
ctgtctgagtgatgtcattcct

SEQ ID NO: 7606042 - DNA, 22 bp, Homo sapiens
ctgtctgcaggatagtaccctc

SEQ ID NO: 7606043 - DNA, 22 bp, Homo sapiens
ctgtctgccctggccagagccc

SEQ ID NO: 7606044 - DNA, 22 bp, Homo sapiens
ctgtctgccctggccagagccc

SEQ ID NO: 7606045 - DNA, 22 bp, Homo sapiens
ctgtctgccctggccagagccc

SEQ ID NO: 7606046 - DNA, 22 bp, Homo sapiens
ctgtctgccaataatctatggc

SEQ ID NO: 7606047 - DNA, 22 bp, Homo sapiens
ctgtctgccctggccagagccc

SEQ ID NO: 7606048 - DNA, 22 bp, Homo sapiens
ctgtctgccctggccagagccc

SEQ ID NO: 7606049 - DNA, 22 bp, Homo sapiens
ctgtctgccctggccagagccc

SEQ ID NO: 7606050 - DNA, 19 bp, Homo sapiens
ctgtccttggctgcactgt

SEQ ID NO: 7606051 - DNA, 19 bp, Homo sapiens
ctgtccttggctgcactgt

SEQ ID NO: 7606052 - DNA, 22 bp, Homo sapiens
ctgtctctgttgcctgtaggtg

SEQ ID NO: 7606053 - DNA, 22 bp, Homo sapiens
ctgtctctgttgcctgtaggtg

SEQ ID NO: 7606054 - DNA, 22 bp, Homo sapiens
ctgtctctgttgcctgtaggtg

SEQ ID NO: 7606055 - DNA, 22 bp, Homo sapiens
ctgtctctgttgcctgtaggtg

SEQ ID NO: 7606056 - DNA, 22 bp, Homo sapiens
ctgtctgaatcctaagcttcct

SEQ ID NO: 7606057 - DNA, 22 bp, Homo sapiens
ctgtcctgtggtgacaggtaca

SEQ ID NO: 7606058 - DNA, 22 bp, Homo sapiens
ctgtcctgtggtgacaggtaca

SEQ ID NO: 7606059 - DNA, 22 bp, Homo sapiens
ctgtcctgtggtgacaggtaca

SEQ ID NO: 7606060 - DNA, 22 bp, Homo sapiens
ctgtcctgtggtgacaggtaca

SEQ ID NO: 7606061 - DNA, 22 bp, Homo sapiens
ctgtcctgtggacctgaggacg

SEQ ID NO: 7606062 - DNA, 22 bp, Homo sapiens
ctgtcctgtggacctgaggacg

SEQ ID NO: 7606063 - DNA, 22 bp, Homo sapiens
ctgtccttactgcttctggctt

SEQ ID NO: 7606064 - DNA, 22 bp, Homo sapiens
ctgtcctgtgtcagcctgaaat

SEQ ID NO: 7606065 - DNA, 22 bp, Homo sapiens
ctgtcctgtgtcagcctgaaat

SEQ ID NO: 7606066 - DNA, 22 bp, Homo sapiens
ctgtcctgtgtcagcctgaaat

SEQ ID NO: 7606067 - DNA, 22 bp, Homo sapiens
ctgtccttactgcttctggctt

SEQ ID NO: 7606068 - DNA, 22 bp, Homo sapiens
ctgtcagtaggctcccatcatt

SEQ ID NO: 7606069 - DNA, 22 bp, Homo sapiens
ctgtcaggtttcccggctcacg

SEQ ID NO: 7606070 - DNA, 22 bp, Homo sapiens
ctgtcaggtttcccggctcacg

SEQ ID NO: 7606071 - DNA, 22 bp, Homo sapiens
ctgtcagtagaccccaagctag

SEQ ID NO: 7606072 - DNA, 22 bp, Homo sapiens
ctgtcaggtttcccatctgcaa

SEQ ID NO: 7606073 - DNA, 22 bp, Homo sapiens
ctgtcaggtttcccatctgcaa

SEQ ID NO: 7606074 - DNA, 22 bp, Homo sapiens
ctgtcaggtttcccatctgcaa

SEQ ID NO: 7606075 - DNA, 22 bp, Homo sapiens
ctgtcaggttggtctcagagct

SEQ ID NO: 7606076 - DNA, 22 bp, Homo sapiens
ctgtatttgaaagaaaagattt

SEQ ID NO: 7606077 - DNA, 22 bp, Homo sapiens
ctgtatatggcttactttatat

SEQ ID NO: 7606078 - DNA, 22 bp, Homo sapiens
ctgtatttgaaagaaaagattt

SEQ ID NO: 7606079 - DNA, 22 bp, Homo sapiens
ctgtatatggcttactttatat

SEQ ID NO: 7606080 - DNA, 22 bp, Homo sapiens
ctgtatatcatggttttgcagt

SEQ ID NO: 7606081 - DNA, 22 bp, Homo sapiens
ctgtatacatggtccatgttat

SEQ ID NO: 7606082 - DNA, 22 bp, Homo sapiens
ctgtatttgaaagaaaagattt

SEQ ID NO: 7606083 - DNA, 23 bp, Homo sapiens
ctgtatttgacttgagcggaaat

SEQ ID NO: 7606084 - DNA, 23 bp, Homo sapiens
ctgtatttgacttgagcggaaat

SEQ ID NO: 7606085 - DNA, 23 bp, Homo sapiens
ctgtatttgacttgagcggaaat

SEQ ID NO: 7606086 - DNA, 22 bp, Homo sapiens
ctgtatttgtcctctatttatt

SEQ ID NO: 7606087 - DNA, 22 bp, Homo sapiens
ctgtatttgtcctctatttatt

SEQ ID NO: 7606088 - DNA, 22 bp, Homo sapiens
ctgtatttgtcctctatttatt

SEQ ID NO: 7606089 - DNA, 22 bp, Homo sapiens
ctgtatttgtcctctatttatt

SEQ ID NO: 7606090 - DNA, 22 bp, Homo sapiens
ctgtaggagtgggaatttattg

SEQ ID NO: 7606091 - DNA, 22 bp, Homo sapiens
ctgtagctgacaggatcactta

SEQ ID NO: 7606092 - DNA, 20 bp, Homo sapiens
ctgtagggtgcagcaggctc

SEQ ID NO: 7606093 - DNA, 22 bp, Homo sapiens
ctgtaggcttagctagaagtga

SEQ ID NO: 7606094 - DNA, 20 bp, Homo sapiens
ctgtagggtgcagcaggctc

SEQ ID NO: 7606095 - DNA, 22 bp, Homo sapiens
ctgtagttgggcattataatag

SEQ ID NO: 7606096 - DNA, 22 bp, Homo sapiens
ctgtataaacatattttcaagt

SEQ ID NO: 7606097 - DNA, 22 bp, Homo sapiens
ctgtataacatcttttgtttcc

SEQ ID NO: 7606098 - DNA, 22 bp, Homo sapiens
ctgtataacatcttttgtttcc

SEQ ID NO: 7606099 - DNA, 22 bp, Homo sapiens
ctgtataaacatattttcaagt

SEQ ID NO: 7606100 - DNA, 22 bp, Homo sapiens
ctgtatacatggtccatgttat

SEQ ID NO: 7606101 - DNA, 22 bp, Homo sapiens
ctgtataattcatgctcttatt

SEQ ID NO: 7606102 - DNA, 22 bp, Homo sapiens
ctgtataaccccatgcgactgt

SEQ ID NO: 7606103 - DNA, 22 bp, Homo sapiens
ctgtataagataccacactgaa

SEQ ID NO: 7606104 - DNA, 22 bp, Homo sapiens
ctgtataagataccacactgaa

SEQ ID NO: 7606105 - DNA, 22 bp, Homo sapiens
ctgtattttttaagaatatctc

SEQ ID NO: 7606106 - DNA, 22 bp, Homo sapiens
ctgtattttttaagtgatctgg

SEQ ID NO: 7606107 - DNA, 22 bp, Homo sapiens
ctgtattttttaagaatatctc

SEQ ID NO: 7606108 - DNA, 22 bp, Homo sapiens
ctgtattttttaagaatatctc

SEQ ID NO: 7606109 - DNA, 22 bp, Homo sapiens
ctgtattttcatgcctacgtac

SEQ ID NO: 7606110 - DNA, 22 bp, Homo sapiens
ctgtattttcatgcctacgtac

SEQ ID NO: 7606111 - DNA, 22 bp, Homo sapiens
ctgtcaaattcataacacttat

SEQ ID NO: 7606112 - DNA, 22 bp, Homo sapiens
ctgtcaacacgggtgtgcgtgc

SEQ ID NO: 7606113 - DNA, 22 bp, Homo sapiens
ctgtcaacacgggtgtgcgtgc

SEQ ID NO: 7606114 - DNA, 22 bp, Homo sapiens
ctgtcaaattcataacacttat

SEQ ID NO: 7606115 - DNA, 22 bp, Homo sapiens
ctgtcaaagactaaggttctta

SEQ ID NO: 7606116 - DNA, 22 bp, Homo sapiens
ctgtcaaagactaaggttctta

SEQ ID NO: 7606117 - DNA, 22 bp, Homo sapiens
ctgtattttttaagtgatctgg

SEQ ID NO: 7606118 - DNA, 22 bp, Homo sapiens
ctgtattttttaagtgatctgg

SEQ ID NO: 7606119 - DNA, 22 bp, Homo sapiens
ctgtattttttaagtgatctgg

SEQ ID NO: 7606120 - DNA, 18 bp, Homo sapiens
ctgtcaccgccaccacac

SEQ ID NO: 7606121 - DNA, 22 bp, Homo sapiens
ctgtcacaggttcaaactcccc

SEQ ID NO: 7606122 - DNA, 22 bp, Homo sapiens
ctgtcacccacccagcctgtca

SEQ ID NO: 7606123 - DNA, 22 bp, Homo sapiens
ctgtcaccatttgagccctgga

SEQ ID NO: 7606124 - DNA, 22 bp, Homo sapiens
ctgtcaccatttgagccctgga

SEQ ID NO: 7606125 - DNA, 22 bp, Homo sapiens
ctgtcacccacccagcctgtca

SEQ ID NO: 7606126 - DNA, 22 bp, Homo sapiens
ctgtcacccacccagcctgtca

SEQ ID NO: 7606127 - DNA, 22 bp, Homo sapiens
ctgtcacagcccgcgtctcctc

SEQ ID NO: 7606128 - DNA, 22 bp, Homo sapiens
ctgtcacagcccgcgtctcctc

SEQ ID NO: 7606129 - DNA, 22 bp, Homo sapiens
ctgtcacactgatatcaggctt

SEQ ID NO: 7606130 - DNA, 22 bp, Homo sapiens
ctgtcacactgatatcaggctt

SEQ ID NO: 7606131 - DNA, 22 bp, Homo sapiens
ctgtcacactgatatcaggctt

SEQ ID NO: 7606132 - DNA, 22 bp, Homo sapiens
ctgtcacaggttcaaactcccc

SEQ ID NO: 7606133 - DNA, 22 bp, Homo sapiens
ctgtcaccatttgagccctgga

SEQ ID NO: 7606134 - DNA, 22 bp, Homo sapiens
ctgtcaccatttgagccctgga

SEQ ID NO: 7606135 - DNA, 17 bp, Homo sapiens
ctgtcacaatacctcgc

SEQ ID NO: 7606136 - DNA, 20 bp, Homo sapiens
ctgtcacaaaggatgtgtca

SEQ ID NO: 7606137 - DNA, 22 bp, Homo sapiens
ctgtcaatttatgttgacatgc

SEQ ID NO: 7606138 - DNA, 19 bp, Homo sapiens
ctgtcaaccccatgggagt

SEQ ID NO: 7606139 - DNA, 22 bp, Homo sapiens
ctgtcaatgacagttatttggg

SEQ ID NO: 7606140 - DNA, 17 bp, Homo sapiens
ctgtcacaatacctcgc

SEQ ID NO: 7606141 - DNA, 22 bp, Homo sapiens
ctgtcacactaaaacaagaagt

SEQ ID NO: 7606142 - DNA, 17 bp, Homo sapiens
ctgtcacaatacctcgc

SEQ ID NO: 7606143 - DNA, 22 bp, Homo sapiens
ctgggagcctggcagttgctga

SEQ ID NO: 7606144 - DNA, 22 bp, Homo sapiens
ctgggagccctgactagcctgg

SEQ ID NO: 7606145 - DNA, 22 bp, Homo sapiens
ctgggagcctggcagttgctga

SEQ ID NO: 7606146 - DNA, 22 bp, Homo sapiens
ctgggagcctggcagttgctga

SEQ ID NO: 7606147 - DNA, 22 bp, Homo sapiens
ctgggagcctggcagttgctga

SEQ ID NO: 7606148 - DNA, 22 bp, Homo sapiens
ctgggagccctgactagcctgg

SEQ ID NO: 7606149 - DNA, 22 bp, Homo sapiens
ctgggagcccgcgtcctggtgg

SEQ ID NO: 7606150 - DNA, 22 bp, Homo sapiens
ctgggagccctgactagcctgg

SEQ ID NO: 7606151 - DNA, 22 bp, Homo sapiens
ctgggagccctgactagcctgg

SEQ ID NO: 7606152 - DNA, 22 bp, Homo sapiens
ctgggagcgcagcaggcacaac

SEQ ID NO: 7606153 - DNA, 22 bp, Homo sapiens
ctgggagcgcagcaggcacaac

SEQ ID NO: 7606154 - DNA, 22 bp, Homo sapiens
ctgggagcgcagcaggcacaac

SEQ ID NO: 7606155 - DNA, 22 bp, Homo sapiens
ctgggagcgcagcaggcacaac

SEQ ID NO: 7606156 - DNA, 22 bp, Homo sapiens
ctgggagcgcagcaggcacaac

SEQ ID NO: 7606157 - DNA, 22 bp, Homo sapiens
ctgggagcgcagcaggcacaac

SEQ ID NO: 7606158 - DNA, 22 bp, Homo sapiens
ctgggagcgcagcaggcacaac

SEQ ID NO: 7606159 - DNA, 22 bp, Homo sapiens
ctgggagcgcagcaggcacaac

SEQ ID NO: 7606160 - DNA, 22 bp, Homo sapiens
ctgggagcgcagcaggcacaac

SEQ ID NO: 7606161 - DNA, 22 bp, Homo sapiens
ctgggagcccgcgtcctggtgg

SEQ ID NO: 7606162 - DNA, 22 bp, Homo sapiens
ctgggagcccgcgtcctggtgg

SEQ ID NO: 7606163 - DNA, 22 bp, Homo sapiens
ctgggagcccgcgtcctggtgg

SEQ ID NO: 7606164 - DNA, 22 bp, Homo sapiens
ctgggagcccgcgtcctggtgg

SEQ ID NO: 7606165 - DNA, 22 bp, Homo sapiens
ctgggagcaccatacttgtttc

SEQ ID NO: 7606166 - DNA, 22 bp, Homo sapiens
ctgggagcaagtcaggaaaggt

SEQ ID NO: 7606167 - DNA, 22 bp, Homo sapiens
ctgggagcaagtcaggaaaggt

SEQ ID NO: 7606168 - DNA, 22 bp, Homo sapiens
ctgggagcaagtcaggaaaggt

SEQ ID NO: 7606169 - DNA, 22 bp, Homo sapiens
ctgggagcaagtcaggaaaggt

SEQ ID NO: 7606170 - DNA, 22 bp, Homo sapiens
ctgggagattgctagagatgca

SEQ ID NO: 7606171 - DNA, 22 bp, Homo sapiens
ctgggagcaagaggctgcaaat

SEQ ID NO: 7606172 - DNA, 22 bp, Homo sapiens
ctgggagcaagaggctgcaaat

SEQ ID NO: 7606173 - DNA, 22 bp, Homo sapiens
ctgggagcaagaggctgcaaat

SEQ ID NO: 7606174 - DNA, 22 bp, Homo sapiens
ctgggagcaagaggctgcaaat

SEQ ID NO: 7606175 - DNA, 22 bp, Homo sapiens
ctgggagattgctagagatgca

SEQ ID NO: 7606176 - DNA, 22 bp, Homo sapiens
ctgggagattgctagagatgca

SEQ ID NO: 7606177 - DNA, 22 bp, Homo sapiens
ctgggagattgctagagatgca

SEQ ID NO: 7606178 - DNA, 22 bp, Homo sapiens
ctgggagattgctagagatgca

SEQ ID NO: 7606179 - DNA, 22 bp, Homo sapiens
ctgggagattgctagagatgca

SEQ ID NO: 7606180 - DNA, 22 bp, Homo sapiens
ctgggagattgctagagatgca

SEQ ID NO: 7606181 - DNA, 22 bp, Homo sapiens
ctgggcaaattgtgccagctat

SEQ ID NO: 7606182 - DNA, 17 bp, Homo sapiens
ctgggatgtggactctt

SEQ ID NO: 7606183 - DNA, 22 bp, Homo sapiens
ctgggcaatatgctgggcctgg

SEQ ID NO: 7606184 - DNA, 17 bp, Homo sapiens
ctgggatgtggactctt

SEQ ID NO: 7606185 - DNA, 22 bp, Homo sapiens
ctgggatgtgaggagcgcctct

SEQ ID NO: 7606186 - DNA, 22 bp, Homo sapiens
ctgggagcggctgtcactggtt

SEQ ID NO: 7606187 - DNA, 22 bp, Homo sapiens
ctgggagcggctgtcactggtt

SEQ ID NO: 7606188 - DNA, 22 bp, Homo sapiens
ctgggagcggctgtcactggtt

SEQ ID NO: 7606189 - DNA, 22 bp, Homo sapiens
ctgggagcggctgtcactggtt

SEQ ID NO: 7606190 - DNA, 22 bp, Homo sapiens
ctgggagcggctgtcactggtt

SEQ ID NO: 7606191 - DNA, 22 bp, Homo sapiens
ctgggatgtgaggagcgcctct

SEQ ID NO: 7606192 - DNA, 22 bp, Homo sapiens
ctgggagcggctgtcactggtt

SEQ ID NO: 7606193 - DNA, 22 bp, Homo sapiens
ctgggcactgcagcaggcatca

SEQ ID NO: 7606194 - DNA, 22 bp, Homo sapiens
ctgggcactgcagcaggcatca

SEQ ID NO: 7606195 - DNA, 22 bp, Homo sapiens
ctgggcactgcagcaggcatca

SEQ ID NO: 7606196 - DNA, 22 bp, Homo sapiens
ctgggcactgcagcaggcatca

SEQ ID NO: 7606197 - DNA, 22 bp, Homo sapiens
ctgggcaaattgtgccagctat

SEQ ID NO: 7606198 - DNA, 22 bp, Homo sapiens
ctgggcacctttgcagcaggct

SEQ ID NO: 7606199 - DNA, 22 bp, Homo sapiens
ctgggcacctttgcagcaggct

SEQ ID NO: 7606200 - DNA, 22 bp, Homo sapiens
ctgggcactgcagcaggcatca

SEQ ID NO: 7606201 - DNA, 22 bp, Homo sapiens
ctgggcactgcagcaggcatca

SEQ ID NO: 7606202 - DNA, 22 bp, Homo sapiens
ctgggcactgcagggtgttgag

SEQ ID NO: 7606203 - DNA, 22 bp, Homo sapiens
ctgggcacttgctcacagctct

SEQ ID NO: 7606204 - DNA, 22 bp, Homo sapiens
ctgggcacttgctcacagctct

SEQ ID NO: 7606205 - DNA, 22 bp, Homo sapiens
ctgggcacttgctcacagctct

SEQ ID NO: 7606206 - DNA, 22 bp, Homo sapiens
ctgggcacttgctcacagctct

SEQ ID NO: 7606207 - DNA, 22 bp, Homo sapiens
ctgggcacttgctcacagctct

SEQ ID NO: 7606208 - DNA, 22 bp, Homo sapiens
ctgggcacttgctcacagctct

SEQ ID NO: 7606209 - DNA, 22 bp, Homo sapiens
ctgggcagaattttaggatggc

SEQ ID NO: 7606210 - DNA, 22 bp, Homo sapiens
ctgggcagaattttaggatggc

SEQ ID NO: 7606211 - DNA, 22 bp, Homo sapiens
ctgggcactttggggagcctac

SEQ ID NO: 7606212 - DNA, 22 bp, Homo sapiens
ctgggcactttggggagcctac

SEQ ID NO: 7606213 - DNA, 22 bp, Homo sapiens
ctgggcactttggggagcctac

SEQ ID NO: 7606214 - DNA, 22 bp, Homo sapiens
ctgggcactttggggagcctac

SEQ ID NO: 7606215 - DNA, 22 bp, Homo sapiens
ctgggcactttggggagcctac

SEQ ID NO: 7606216 - DNA, 22 bp, Homo sapiens
ctgggcagagctaacacctgag

SEQ ID NO: 7606217 - DNA, 22 bp, Homo sapiens
ctgggcagagctaacacctgag

SEQ ID NO: 7606218 - DNA, 22 bp, Homo sapiens
ctgggcagagctaacacctgag

SEQ ID NO: 7606219 - DNA, 22 bp, Homo sapiens
ctgggcagaattttaggatggc

SEQ ID NO: 7606220 - DNA, 22 bp, Homo sapiens
ctgggcagaattttaggatggc

SEQ ID NO: 7606221 - DNA, 22 bp, Homo sapiens
ctgggcagaattttaggatggc

SEQ ID NO: 7606222 - DNA, 22 bp, Homo sapiens
ctgggcagaattttaggatggc

SEQ ID NO: 7606223 - DNA, 22 bp, Homo sapiens
ctgggcagaattttaggatggc

SEQ ID NO: 7606224 - DNA, 22 bp, Homo sapiens
ctgggcagaattttaggatggc

SEQ ID NO: 7606225 - DNA, 22 bp, Homo sapiens
ctgggcagagtccggaagatgg

SEQ ID NO: 7606226 - DNA, 22 bp, Homo sapiens
ctgggcagagtccggaagatgg

SEQ ID NO: 7606227 - DNA, 22 bp, Homo sapiens
ctgggcagagtccggaagatgg

SEQ ID NO: 7606228 - DNA, 22 bp, Homo sapiens
ctgggcagagtccggaagatgg

SEQ ID NO: 7606229 - DNA, 22 bp, Homo sapiens
ctgggcagagtccggaagatgg

SEQ ID NO: 7606230 - DNA, 22 bp, Homo sapiens
ctgggcagcctcacacaatgtt

SEQ ID NO: 7606231 - DNA, 22 bp, Homo sapiens
ctgggcagcacatcatcgtatc

SEQ ID NO: 7606232 - DNA, 22 bp, Homo sapiens
ctgggcagagctaacacctgag

SEQ ID NO: 7606233 - DNA, 22 bp, Homo sapiens
ctgggcagagctaacacctgag

SEQ ID NO: 7606234 - DNA, 22 bp, Homo sapiens
ctgggcagagctaacacctgag

SEQ ID NO: 7606235 - DNA, 22 bp, Homo sapiens
ctgggcagagtccggaagatgg

SEQ ID NO: 7606236 - DNA, 22 bp, Homo sapiens
ctgggcagagtccggaagatgg

SEQ ID NO: 7606237 - DNA, 22 bp, Homo sapiens
ctgggcagagctaacacctgag

SEQ ID NO: 7606238 - DNA, 22 bp, Homo sapiens
ctgggcagagctaacacctgag

SEQ ID NO: 7606239 - DNA, 22 bp, Homo sapiens
ctgggcagagctaacacctgag

SEQ ID NO: 7606240 - DNA, 22 bp, Homo sapiens
ctgggcagctgtgcaaacaata

SEQ ID NO: 7606241 - DNA, 22 bp, Homo sapiens
ctgggcagctgtgcaaacaata

SEQ ID NO: 7606242 - DNA, 22 bp, Homo sapiens
ctgggcagctgtgcaaacaata

SEQ ID NO: 7606243 - DNA, 22 bp, Homo sapiens
ctgggcagctgtgcaaacaata

SEQ ID NO: 7606244 - DNA, 22 bp, Homo sapiens
ctgggcctccagctctgccagc

SEQ ID NO: 7606245 - DNA, 22 bp, Homo sapiens
ctgggcctccagctctgccagc

SEQ ID NO: 7606246 - DNA, 22 bp, Homo sapiens
ctgggcagctgtgcaaacaata

SEQ ID NO: 7606247 - DNA, 22 bp, Homo sapiens
ctgggcagctgtatcagggagt

SEQ ID NO: 7606248 - DNA, 22 bp, Homo sapiens
ctgggcagctgtatcagggagt

SEQ ID NO: 7606249 - DNA, 22 bp, Homo sapiens
ctgggcagctgtatcagggagt

SEQ ID NO: 7606250 - DNA, 22 bp, Homo sapiens
ctgggcagctgtatcagggagt

SEQ ID NO: 7606251 - DNA, 22 bp, Homo sapiens
ctgggcagctgtatcagggagt

SEQ ID NO: 7606252 - DNA, 22 bp, Homo sapiens
ctgggcagctgtatcagggagt

SEQ ID NO: 7606253 - DNA, 22 bp, Homo sapiens
ctgggcagctgtatcagggagt

SEQ ID NO: 7606254 - DNA, 22 bp, Homo sapiens
ctgggcagctgtatcagggagt

SEQ ID NO: 7606255 - DNA, 22 bp, Homo sapiens
ctgggcagctgtatcagggagt

SEQ ID NO: 7606256 - DNA, 22 bp, Homo sapiens
ctgggcagctgtatcagggagt

SEQ ID NO: 7606257 - DNA, 22 bp, Homo sapiens
ctgggcagctccataccaccca

SEQ ID NO: 7606258 - DNA, 22 bp, Homo sapiens
ctgggcagctccataccaccca

SEQ ID NO: 7606259 - DNA, 22 bp, Homo sapiens
ctgggcagctaccaccactgct

SEQ ID NO: 7606260 - DNA, 22 bp, Homo sapiens
ctgggcagctaccaccactgct

SEQ ID NO: 7606261 - DNA, 22 bp, Homo sapiens
ctgggcagctccataccaccca

SEQ ID NO: 7606262 - DNA, 22 bp, Homo sapiens
ctgggcagctccataccaccca

SEQ ID NO: 7606263 - DNA, 22 bp, Homo sapiens
ctgggcagctccataccaccca

SEQ ID NO: 7606264 - DNA, 22 bp, Homo sapiens
ctgggcagctccataccaccca

SEQ ID NO: 7606265 - DNA, 22 bp, Homo sapiens
ctgggcagctaccaccactgct

SEQ ID NO: 7606266 - DNA, 22 bp, Homo sapiens
ctgggcagctaccaccactgct

SEQ ID NO: 7606267 - DNA, 22 bp, Homo sapiens
ctgggcagctaccaccactgct

SEQ ID NO: 7606268 - DNA, 22 bp, Homo sapiens
ctgggcagctaccaccactgct

SEQ ID NO: 7606269 - DNA, 22 bp, Homo sapiens
ctgggcagcctcacacaatgtt

SEQ ID NO: 7606270 - DNA, 22 bp, Homo sapiens
ctgggcagcctcacacaatgtt

SEQ ID NO: 7606271 - DNA, 22 bp, Homo sapiens
ctgggcagcctcacacaatgtt

SEQ ID NO: 7606272 - DNA, 22 bp, Homo sapiens
ctgggcagctaccaccactgct

SEQ ID NO: 7606273 - DNA, 17 bp, Homo sapiens
ctgggcctcccctgtcc

SEQ ID NO: 7606274 - DNA, 17 bp, Homo sapiens
ctgggcctcccctgtcc

SEQ ID NO: 7606275 - DNA, 17 bp, Homo sapiens
ctgggcctcccctgtcc

SEQ ID NO: 7606276 - DNA, 22 bp, Homo sapiens
ctgggcctccagctctgccagc

SEQ ID NO: 7606277 - DNA, 22 bp, Homo sapiens
ctgggcctcctctgcccaagct

SEQ ID NO: 7606278 - DNA, 22 bp, Homo sapiens
ctgggcctcctctgcccaagct

SEQ ID NO: 7606279 - DNA, 22 bp, Homo sapiens
ctgggcctcctctgcccaagct

SEQ ID NO: 7606280 - DNA, 22 bp, Homo sapiens
ctgggcctcctctgcccaagct

SEQ ID NO: 7606281 - DNA, 22 bp, Homo sapiens
ctgggcctcctctgcccaagct

SEQ ID NO: 7606282 - DNA, 17 bp, Homo sapiens
ctgggcctcccctgtcc

SEQ ID NO: 7606283 - DNA, 22 bp, Homo sapiens
ctgggcctggtgtggcacctgc

SEQ ID NO: 7606284 - DNA, 22 bp, Homo sapiens
ctgggcctggtgtggcacctgc

SEQ ID NO: 7606285 - DNA, 22 bp, Homo sapiens
ctgggcctggtgtggcacctgc

SEQ ID NO: 7606286 - DNA, 22 bp, Homo sapiens
ctgggcctggtgtggcacctgc

SEQ ID NO: 7606287 - DNA, 22 bp, Homo sapiens
ctgggcctggtgtggcacctgc

SEQ ID NO: 7606288 - DNA, 22 bp, Homo sapiens
ctgggcctggtgtggcacctgc

SEQ ID NO: 7606289 - DNA, 22 bp, Homo sapiens
ctgggcctcctctgcccaagct

SEQ ID NO: 7606290 - DNA, 22 bp, Homo sapiens
ctgggcctgtcagggctttttg

SEQ ID NO: 7606291 - DNA, 22 bp, Homo sapiens
ctgggcctgtcagggctttttg

SEQ ID NO: 7606292 - DNA, 22 bp, Homo sapiens
ctgggcctgtcagggctttttg

SEQ ID NO: 7606293 - DNA, 22 bp, Homo sapiens
ctgggcctgtcagggctttttg

SEQ ID NO: 7606294 - DNA, 22 bp, Homo sapiens
ctgggcctgtcagggctttttg

SEQ ID NO: 7606295 - DNA, 22 bp, Homo sapiens
ctgggcctgtcagggctttttg

SEQ ID NO: 7606296 - DNA, 22 bp, Homo sapiens
ctgggcctgtgactcccatcct

SEQ ID NO: 7606297 - DNA, 22 bp, Homo sapiens
ctgggcctgtgactcccatcct

SEQ ID NO: 7606298 - DNA, 22 bp, Homo sapiens
ctgggcctgtgactcccatcct

SEQ ID NO: 7606299 - DNA, 22 bp, Homo sapiens
ctgggcctgtgactcccatcct

SEQ ID NO: 7606300 - DNA, 22 bp, Homo sapiens
ctgggcctgtccctgattgagg

SEQ ID NO: 7606301 - DNA, 22 bp, Homo sapiens
ctgggcctgtccctgattgagg

SEQ ID NO: 7606302 - DNA, 22 bp, Homo sapiens
ctgggcctgtccctgattgagg

SEQ ID NO: 7606303 - DNA, 22 bp, Homo sapiens
ctgggcctgtccctgattgagg

SEQ ID NO: 7606304 - DNA, 22 bp, Homo sapiens
ctgggcctgtgggcacacggac

SEQ ID NO: 7606305 - DNA, 22 bp, Homo sapiens
ctgggcctgtgggcacacggac

SEQ ID NO: 7606306 - DNA, 22 bp, Homo sapiens
ctgggcctgtgggcacacggac

SEQ ID NO: 7606307 - DNA, 22 bp, Homo sapiens
ctgggcctgtgactcccatcct

SEQ ID NO: 7606308 - DNA, 22 bp, Homo sapiens
ctgggcctgtgactcccatcct

SEQ ID NO: 7606309 - DNA, 22 bp, Homo sapiens
ctgggccttagggcactccctt

SEQ ID NO: 7606310 - DNA, 22 bp, Homo sapiens
ctgggccttagggcactccctt

SEQ ID NO: 7606311 - DNA, 22 bp, Homo sapiens
ctgggccttagggcactccctt

SEQ ID NO: 7606312 - DNA, 22 bp, Homo sapiens
ctgggcctgtgggcacacggac

SEQ ID NO: 7606313 - DNA, 22 bp, Homo sapiens
ctgggcctgtgggcacacggac

SEQ ID NO: 7606314 - DNA, 22 bp, Homo sapiens
ctgggccttatgagtacctgga

SEQ ID NO: 7606315 - DNA, 22 bp, Homo sapiens
ctgggccttatgagtacctgga

SEQ ID NO: 7606316 - DNA, 22 bp, Homo sapiens
ctgggccttatgagtacctgga

SEQ ID NO: 7606317 - DNA, 22 bp, Homo sapiens
ctgggccttatgagtacctgga

SEQ ID NO: 7606318 - DNA, 22 bp, Homo sapiens
ctgggccttagggcactccctt

SEQ ID NO: 7606319 - DNA, 22 bp, Homo sapiens
ctgggccttagggcactccctt

SEQ ID NO: 7606320 - DNA, 22 bp, Homo sapiens
ctgggccttagggcactccctt

SEQ ID NO: 7606321 - DNA, 22 bp, Homo sapiens
ctgggccttcattgctctccca

SEQ ID NO: 7606322 - DNA, 22 bp, Homo sapiens
ctgggccttcattgctctccca

SEQ ID NO: 7606323 - DNA, 22 bp, Homo sapiens
ctgggccttcattgctctccca

SEQ ID NO: 7606324 - DNA, 22 bp, Homo sapiens
ctgggccttcattgctctccca

SEQ ID NO: 7606325 - DNA, 22 bp, Homo sapiens
ctgggccttatgagtacctgga

SEQ ID NO: 7606326 - DNA, 22 bp, Homo sapiens
ctgggccttatgagtacctgga

SEQ ID NO: 7606327 - DNA, 22 bp, Homo sapiens
ctgggccttatgagtacctgga

SEQ ID NO: 7606328 - DNA, 22 bp, Homo sapiens
ctgggccttgagaatcatgttt

SEQ ID NO: 7606329 - DNA, 22 bp, Homo sapiens
ctgggccttgagaatcatgttt

SEQ ID NO: 7606330 - DNA, 22 bp, Homo sapiens
ctgggccttgagaatcatgttt

SEQ ID NO: 7606331 - DNA, 22 bp, Homo sapiens
ctgggccttgagaatcatgttt

SEQ ID NO: 7606332 - DNA, 22 bp, Homo sapiens
ctgggccttgagaatcatgttt

SEQ ID NO: 7606333 - DNA, 22 bp, Homo sapiens
ctgggccttcattgctctccca

SEQ ID NO: 7606334 - DNA, 22 bp, Homo sapiens
ctgggccttcattgctctccca

SEQ ID NO: 7606335 - DNA, 22 bp, Homo sapiens
ctgggccttcattgctctccca

SEQ ID NO: 7606336 - DNA, 22 bp, Homo sapiens
ctgggccttcattgctctccca

SEQ ID NO: 7606337 - DNA, 22 bp, Homo sapiens
ctgggccttgcatcccagagcc

SEQ ID NO: 7606338 - DNA, 22 bp, Homo sapiens
ctgggccttgcatcccagagcc

SEQ ID NO: 7606339 - DNA, 22 bp, Homo sapiens
ctgggccttgcatcccagagcc

SEQ ID NO: 7606340 - DNA, 22 bp, Homo sapiens
ctgggccttgcatcccagagcc

SEQ ID NO: 7606341 - DNA, 22 bp, Homo sapiens
ctgggccttgcatcccagagcc

SEQ ID NO: 7606342 - DNA, 22 bp, Homo sapiens
ctgggccttgcatcccagagcc

SEQ ID NO: 7606343 - DNA, 22 bp, Homo sapiens
ctgggccttgatcacacaggtg

SEQ ID NO: 7606344 - DNA, 22 bp, Homo sapiens
ctgggccttgatcacacaggtg

SEQ ID NO: 7606345 - DNA, 22 bp, Homo sapiens
ctgggccttgatcacacaggtg

SEQ ID NO: 7606346 - DNA, 22 bp, Homo sapiens
ctgggccttgatcacacaggtg

SEQ ID NO: 7606347 - DNA, 22 bp, Homo sapiens
ctgggccttgatcacacaggtg

SEQ ID NO: 7606348 - DNA, 22 bp, Homo sapiens
ctgggccttgatcacacaggtg

SEQ ID NO: 7606349 - DNA, 22 bp, Homo sapiens
ctgggccttgccaggggtgtct

SEQ ID NO: 7606350 - DNA, 22 bp, Homo sapiens
ctgggccttgccaggggtgtct

SEQ ID NO: 7606351 - DNA, 22 bp, Homo sapiens
ctgggccttgccaggggtgtct

SEQ ID NO: 7606352 - DNA, 22 bp, Homo sapiens
ctgggccttgccttgcccacag

SEQ ID NO: 7606353 - DNA, 22 bp, Homo sapiens
ctgggccttgccttgcccacag

SEQ ID NO: 7606354 - DNA, 22 bp, Homo sapiens
ctgggccttgccaggggtgtct

SEQ ID NO: 7606355 - DNA, 22 bp, Homo sapiens
ctgggccttgccaggggtgtct

SEQ ID NO: 7606356 - DNA, 22 bp, Homo sapiens
ctgggccttgccttgcccacag

SEQ ID NO: 7606357 - DNA, 22 bp, Homo sapiens
ctgggccttgccttgcccacag

SEQ ID NO: 7606358 - DNA, 22 bp, Homo sapiens
ctgggccttgccttgcccacag

SEQ ID NO: 7606359 - DNA, 22 bp, Homo sapiens
ctgggccttgccttgcccacag

SEQ ID NO: 7606360 - DNA, 22 bp, Homo sapiens
ctgggccttgccttgcccacag

SEQ ID NO: 7606361 - DNA, 22 bp, Homo sapiens
ctgggctcaaatcctatctcca

SEQ ID NO: 7606362 - DNA, 22 bp, Homo sapiens
ctgggctcaaatcctatctcca

SEQ ID NO: 7606363 - DNA, 22 bp, Homo sapiens
ctgggctggagtgcaatggcgc

SEQ ID NO: 7606364 - DNA, 22 bp, Homo sapiens
ctgggctggagtgcaatggcgc

SEQ ID NO: 7606365 - DNA, 22 bp, Homo sapiens
ctgggctggagtgcaatggcgc

SEQ ID NO: 7606366 - DNA, 22 bp, Homo sapiens
ctgggctggagtgcaatggcgc

SEQ ID NO: 7606367 - DNA, 22 bp, Homo sapiens
ctgggctagaaggaccaggatg

SEQ ID NO: 7606368 - DNA, 22 bp, Homo sapiens
ctgggctagaaggaccaggatg

SEQ ID NO: 7606369 - DNA, 22 bp, Homo sapiens
ctgggctcaaatcctatctcca

SEQ ID NO: 7606370 - DNA, 22 bp, Homo sapiens
ctgggctagaaggaccaggatg

SEQ ID NO: 7606371 - DNA, 22 bp, Homo sapiens
ctgggctggagtgcaatggcgc

SEQ ID NO: 7606372 - DNA, 22 bp, Homo sapiens
ctgggctggagtgcaatggcgc

SEQ ID NO: 7606373 - DNA, 22 bp, Homo sapiens
ctgggctggagtgcaatggcgc

SEQ ID NO: 7606374 - DNA, 22 bp, Homo sapiens
ctgggctggataattctttgct

SEQ ID NO: 7606375 - DNA, 22 bp, Homo sapiens
ctgggctggataattctttgct

SEQ ID NO: 7606376 - DNA, 22 bp, Homo sapiens
ctgggctggataattctttgct

SEQ ID NO: 7606377 - DNA, 21 bp, Homo sapiens
ctgggctggcaggcattacct

SEQ ID NO: 7606378 - DNA, 21 bp, Homo sapiens
ctgggctggcaggcattacct

SEQ ID NO: 7606379 - DNA, 21 bp, Homo sapiens
ctgggctggcaggcattacct

SEQ ID NO: 7606380 - DNA, 22 bp, Homo sapiens
ctgggcttagcagctcctggtc

SEQ ID NO: 7606381 - DNA, 22 bp, Homo sapiens
ctgggcttaggacctggtgcgg

SEQ ID NO: 7606382 - DNA, 22 bp, Homo sapiens
ctgggcttagcagctcctggtc

SEQ ID NO: 7606383 - DNA, 22 bp, Homo sapiens
ctgggcttagcagctcctggtc

SEQ ID NO: 7606384 - DNA, 22 bp, Homo sapiens
ctgggcttagcagctcctggtc

SEQ ID NO: 7606385 - DNA, 22 bp, Homo sapiens
ctgggcttagcagctcctggtc

SEQ ID NO: 7606386 - DNA, 22 bp, Homo sapiens
ctgggcttagcagctcctggtc

SEQ ID NO: 7606387 - DNA, 22 bp, Homo sapiens
ctgggctgtttgttctggtctc

SEQ ID NO: 7606388 - DNA, 22 bp, Homo sapiens
ctgggctgtttgtttagaatgg

SEQ ID NO: 7606389 - DNA, 22 bp, Homo sapiens
ctgggctgtttgttctggtctc

SEQ ID NO: 7606390 - DNA, 22 bp, Homo sapiens
ctgggctgtttgttctggtctc

SEQ ID NO: 7606391 - DNA, 22 bp, Homo sapiens
ctgggctgtttgttctggtctc

SEQ ID NO: 7606392 - DNA, 22 bp, Homo sapiens
ctgggctgtttgttctggtctc

SEQ ID NO: 7606393 - DNA, 22 bp, Homo sapiens
ctgggctggcgcatccgacacg

SEQ ID NO: 7606394 - DNA, 22 bp, Homo sapiens
ctgggctgtttgttctggtctc

SEQ ID NO: 7606395 - DNA, 22 bp, Homo sapiens
ctgggctggcgcatccgacacg

SEQ ID NO: 7606396 - DNA, 22 bp, Homo sapiens
ctgggctggcgcatccgacacg

SEQ ID NO: 7606397 - DNA, 22 bp, Homo sapiens
ctgggctggcgcatccgacacg

SEQ ID NO: 7606398 - DNA, 22 bp, Homo sapiens
ctgggctggcgcatccgacacg

SEQ ID NO: 7606399 - DNA, 22 bp, Homo sapiens
ctgggctagaaggaccaggatg

SEQ ID NO: 7606400 - DNA, 22 bp, Homo sapiens
ctgggctagaaggaccaggatg

SEQ ID NO: 7606401 - DNA, 22 bp, Homo sapiens
ctgggctagaaggaccaggatg

SEQ ID NO: 7606402 - DNA, 22 bp, Homo sapiens
ctgggctagaaggaccaggatg

SEQ ID NO: 7606403 - DNA, 22 bp, Homo sapiens
ctgggctagaaggaccaggatg

SEQ ID NO: 7606404 - DNA, 22 bp, Homo sapiens
ctgggctagaaggaccaggatg

SEQ ID NO: 7606405 - DNA, 22 bp, Homo sapiens
ctgggctagaaggaccaggatg

SEQ ID NO: 7606406 - DNA, 22 bp, Homo sapiens
ctgggctagaaggaccaggatg

SEQ ID NO: 7606407 - DNA, 22 bp, Homo sapiens
ctgggctacgtgttgacagcat

SEQ ID NO: 7606408 - DNA, 22 bp, Homo sapiens
ctgggctacgtgttgacagcat

SEQ ID NO: 7606409 - DNA, 22 bp, Homo sapiens
ctgggctaattaagcacagctg

SEQ ID NO: 7606410 - DNA, 22 bp, Homo sapiens
ctgggctaattaagcacagctg

SEQ ID NO: 7606411 - DNA, 22 bp, Homo sapiens
ctgggcgcgtcccctgaggcgg

SEQ ID NO: 7606412 - DNA, 18 bp, Homo sapiens
ctgggcctttgtattttt

SEQ ID NO: 7606413 - DNA, 18 bp, Homo sapiens
ctgggcctttgtattttt

SEQ ID NO: 7606414 - DNA, 18 bp, Homo sapiens
ctgggcctttgtattttt

SEQ ID NO: 7606415 - DNA, 22 bp, Homo sapiens
ctgggcgcgtcccctgaggcgg

SEQ ID NO: 7606416 - DNA, 22 bp, Homo sapiens
ctgggcgcgtcccctgaggcgg

SEQ ID NO: 7606417 - DNA, 22 bp, Homo sapiens
ctgggcgcgtcccctgaggcgg

SEQ ID NO: 7606418 - DNA, 22 bp, Homo sapiens
ctgggcgtgtcttccagctggc

SEQ ID NO: 7606419 - DNA, 22 bp, Homo sapiens
ctgggcgtgtcttccagctggc

SEQ ID NO: 7606420 - DNA, 22 bp, Homo sapiens
ctgggcgtgtcttccagctggc

SEQ ID NO: 7606421 - DNA, 22 bp, Homo sapiens
ctgggctaattaagcacagctg

SEQ ID NO: 7606422 - DNA, 22 bp, Homo sapiens
ctgggcctttacctacggagtt

SEQ ID NO: 7606423 - DNA, 22 bp, Homo sapiens
ctgggccttggattgacactgt

SEQ ID NO: 7606424 - DNA, 22 bp, Homo sapiens
ctgggccttggattgacactgt

SEQ ID NO: 7606425 - DNA, 22 bp, Homo sapiens
ctgggccttggattgacactgt

SEQ ID NO: 7606426 - DNA, 22 bp, Homo sapiens
ctgggccttggattgacactgt

SEQ ID NO: 7606427 - DNA, 22 bp, Homo sapiens
ctgggccttggattgacactgt

SEQ ID NO: 7606428 - DNA, 22 bp, Homo sapiens
ctgggccttggattgacactgt

SEQ ID NO: 7606429 - DNA, 22 bp, Homo sapiens
ctgggccttggattgacactgt

SEQ ID NO: 7606430 - DNA, 22 bp, Homo sapiens
ctgggccttgccttgcccacag

SEQ ID NO: 7606431 - DNA, 22 bp, Homo sapiens
ctgggccttggattgacactgt

SEQ ID NO: 7606432 - DNA, 22 bp, Homo sapiens
ctgggccttggattgacactgt

SEQ ID NO: 7606433 - DNA, 22 bp, Homo sapiens
ctgggcctttgggagttcggtg

SEQ ID NO: 7606434 - DNA, 18 bp, Homo sapiens
ctgggcctttgtattttt

SEQ ID NO: 7606435 - DNA, 22 bp, Homo sapiens
ctgggcctttgggagttcggtg

SEQ ID NO: 7606436 - DNA, 22 bp, Homo sapiens
ctgggcctttgggagttcggtg

SEQ ID NO: 7606437 - DNA, 22 bp, Homo sapiens
ctgggcctttgggagttcggtg

SEQ ID NO: 7606438 - DNA, 22 bp, Homo sapiens
ctgggcctttgcttattaattt

SEQ ID NO: 7606439 - DNA, 22 bp, Homo sapiens
ctgggcctttgcttattaattt

SEQ ID NO: 7606440 - DNA, 22 bp, Homo sapiens
ctgggcctttgcttattaattt

SEQ ID NO: 7606441 - DNA, 22 bp, Homo sapiens
ctgggcctttgcttattaattt

SEQ ID NO: 7606442 - DNA, 22 bp, Homo sapiens
ctgggcctttacctacggagtt

SEQ ID NO: 7606443 - DNA, 22 bp, Homo sapiens
ctgggcctttacctacggagtt

SEQ ID NO: 7606444 - DNA, 22 bp, Homo sapiens
ctgggcctttacctacggagtt

SEQ ID NO: 7606445 - DNA, 22 bp, Homo sapiens
ctgggacagctgagacaggaga

SEQ ID NO: 7606446 - DNA, 22 bp, Homo sapiens
ctgggacagctgagacaggaga

SEQ ID NO: 7606447 - DNA, 22 bp, Homo sapiens
ctgggacagctgagacaggaga

SEQ ID NO: 7606448 - DNA, 22 bp, Homo sapiens
ctgggacagctgagacaggaga

SEQ ID NO: 7606449 - DNA, 22 bp, Homo sapiens
ctgggacagctgagacaggaga

SEQ ID NO: 7606450 - DNA, 22 bp, Homo sapiens
ctgggacagagcagcagtgggg

SEQ ID NO: 7606451 - DNA, 22 bp, Homo sapiens
ctgggacagctgagacaggaga

SEQ ID NO: 7606452 - DNA, 22 bp, Homo sapiens
ctgggacatattgctagtgttg

SEQ ID NO: 7606453 - DNA, 22 bp, Homo sapiens
ctgggacatattgctagtgttg

SEQ ID NO: 7606454 - DNA, 22 bp, Homo sapiens
ctgggacatattgctagtgttg

SEQ ID NO: 7606455 - DNA, 22 bp, Homo sapiens
ctgggacatattgctagtgttg

SEQ ID NO: 7606456 - DNA, 22 bp, Homo sapiens
ctgggacatagatcagcctttt

SEQ ID NO: 7606457 - DNA, 22 bp, Homo sapiens
ctgggacagttcaggtagggca

SEQ ID NO: 7606458 - DNA, 22 bp, Homo sapiens
ctgggacagttcaggtagggca

SEQ ID NO: 7606459 - DNA, 22 bp, Homo sapiens
ctgggacagttcaggtagggca

SEQ ID NO: 7606460 - DNA, 22 bp, Homo sapiens
ctgggacagttcaggtagggca

SEQ ID NO: 7606461 - DNA, 22 bp, Homo sapiens
ctgggacatgatagaaacagat

SEQ ID NO: 7606462 - DNA, 22 bp, Homo sapiens
ctgggacatgatagaaacagat

SEQ ID NO: 7606463 - DNA, 22 bp, Homo sapiens
ctgggacatgatagaaacagat

SEQ ID NO: 7606464 - DNA, 22 bp, Homo sapiens
ctgggacatgatagaaacagat

SEQ ID NO: 7606465 - DNA, 22 bp, Homo sapiens
ctgggacatgatagaaacagat

SEQ ID NO: 7606466 - DNA, 23 bp, Homo sapiens
ctgggacatggtaggggcacaac

SEQ ID NO: 7606467 - DNA, 23 bp, Homo sapiens
ctgggacatggtaggggcacaac

SEQ ID NO: 7606468 - DNA, 22 bp, Homo sapiens
ctgggacattataagaaacatt

SEQ ID NO: 7606469 - DNA, 22 bp, Homo sapiens
ctgggaccagtgaagcaactca

SEQ ID NO: 7606470 - DNA, 22 bp, Homo sapiens
ctgggacattataagaaacatt

SEQ ID NO: 7606471 - DNA, 22 bp, Homo sapiens
ctgggacatggtgctgtcttta

SEQ ID NO: 7606472 - DNA, 22 bp, Homo sapiens
ctgggacatggtgctgtcttta

SEQ ID NO: 7606473 - DNA, 22 bp, Homo sapiens
ctgggacatggtgctgtcttta

SEQ ID NO: 7606474 - DNA, 22 bp, Homo sapiens
ctgggacatggtgctgtcttta

SEQ ID NO: 7606475 - DNA, 23 bp, Homo sapiens
ctgggacatggtaggggcacaac

SEQ ID NO: 7606476 - DNA, 19 bp, Homo sapiens
ctgggactcctgatacctt

SEQ ID NO: 7606477 - DNA, 19 bp, Homo sapiens
ctgggactcctgatacctt

SEQ ID NO: 7606478 - DNA, 22 bp, Homo sapiens
ctgggactgccattcacagcca

SEQ ID NO: 7606479 - DNA, 22 bp, Homo sapiens
ctgggactggacctctgcctgg

SEQ ID NO: 7606480 - DNA, 22 bp, Homo sapiens
ctgggactgccattcacagcca

SEQ ID NO: 7606481 - DNA, 22 bp, Homo sapiens
ctgggactcagaccagttctgt

SEQ ID NO: 7606482 - DNA, 22 bp, Homo sapiens
ctgggactcagaccagttctgt

SEQ ID NO: 7606483 - DNA, 22 bp, Homo sapiens
ctgggactcagaccagttctgt

SEQ ID NO: 7606484 - DNA, 18 bp, Homo sapiens
ctgggactcaatgctact

SEQ ID NO: 7606485 - DNA, 22 bp, Homo sapiens
ctgggacctgtgtgcctgggcc

SEQ ID NO: 7606486 - DNA, 22 bp, Homo sapiens
ctgggacctgtgtgcctgggcc

SEQ ID NO: 7606487 - DNA, 22 bp, Homo sapiens
ctgggacctgtgtgcctgggcc

SEQ ID NO: 7606488 - DNA, 22 bp, Homo sapiens
ctgggacctgtgtgcctgggcc

SEQ ID NO: 7606489 - DNA, 22 bp, Homo sapiens
ctgggacctcctgaggtggagc

SEQ ID NO: 7606490 - DNA, 22 bp, Homo sapiens
ctgggacctcctgaggtggagc

SEQ ID NO: 7606491 - DNA, 22 bp, Homo sapiens
ctgggacctcctgaggtggagc

SEQ ID NO: 7606492 - DNA, 22 bp, Homo sapiens
ctgggacctcctgaggtggagc

SEQ ID NO: 7606493 - DNA, 22 bp, Homo sapiens
ctgggacctgtgtgcctgggcc

SEQ ID NO: 7606494 - DNA, 22 bp, Homo sapiens
ctgggacctcggggtgatcaaa

SEQ ID NO: 7606495 - DNA, 22 bp, Homo sapiens
ctgggacctcggggtgatcaaa

SEQ ID NO: 7606496 - DNA, 22 bp, Homo sapiens
ctgggacctcggggtgatcaaa

SEQ ID NO: 7606497 - DNA, 22 bp, Homo sapiens
ctgggacctcctcactgttcta

SEQ ID NO: 7606498 - DNA, 22 bp, Homo sapiens
ctgggacctcctcactgttcta

SEQ ID NO: 7606499 - DNA, 22 bp, Homo sapiens
ctgggacctcctcactgttcta

SEQ ID NO: 7606500 - DNA, 22 bp, Homo sapiens
ctgggacctcctcactgttcta

SEQ ID NO: 7606501 - DNA, 22 bp, Homo sapiens
ctgggaccctgccctgtggcct

SEQ ID NO: 7606502 - DNA, 22 bp, Homo sapiens
ctgggaccctgccctgtggcct

SEQ ID NO: 7606503 - DNA, 22 bp, Homo sapiens
ctgggaccctgccctgtggcct

SEQ ID NO: 7606504 - DNA, 22 bp, Homo sapiens
ctgggaccctgccctgtggcct

SEQ ID NO: 7606505 - DNA, 22 bp, Homo sapiens
ctgggaccctgccctgtggcct

SEQ ID NO: 7606506 - DNA, 22 bp, Homo sapiens
ctgggacccccactgcgtagct

SEQ ID NO: 7606507 - DNA, 22 bp, Homo sapiens
ctgggacccccactgcgtagct

SEQ ID NO: 7606508 - DNA, 22 bp, Homo sapiens
ctgggaccatctgtgtctactt

SEQ ID NO: 7606509 - DNA, 22 bp, Homo sapiens
ctgggacccccactgcgtagct

SEQ ID NO: 7606510 - DNA, 22 bp, Homo sapiens
ctgggacccccactgcgtagct

SEQ ID NO: 7606511 - DNA, 22 bp, Homo sapiens
ctgggacccacacctggaatct

SEQ ID NO: 7606512 - DNA, 22 bp, Homo sapiens
ctgggaccatctgtgtctactt

SEQ ID NO: 7606513 - DNA, 22 bp, Homo sapiens
ctgggacccacacctggaatct

SEQ ID NO: 7606514 - DNA, 22 bp, Homo sapiens
ctgggacccacacctggaatct

SEQ ID NO: 7606515 - DNA, 22 bp, Homo sapiens
ctgggaccagtgaagcaactca

SEQ ID NO: 7606516 - DNA, 22 bp, Homo sapiens
ctgggaccatctgtgtctactt

SEQ ID NO: 7606517 - DNA, 22 bp, Homo sapiens
ctgggagatctcctgagggcag

SEQ ID NO: 7606518 - DNA, 22 bp, Homo sapiens
ctgggagatctcctgagggcag

SEQ ID NO: 7606519 - DNA, 22 bp, Homo sapiens
ctgggagatctcctgagggcag

SEQ ID NO: 7606520 - DNA, 22 bp, Homo sapiens
ctgggagatctcctgagggcag

SEQ ID NO: 7606521 - DNA, 22 bp, Homo sapiens
ctgggagatctcctgagggcag

SEQ ID NO: 7606522 - DNA, 22 bp, Homo sapiens
ctgggagatctcctgagggcag

SEQ ID NO: 7606523 - DNA, 22 bp, Homo sapiens
ctgggagatctcctgagggcag

SEQ ID NO: 7606524 - DNA, 22 bp, Homo sapiens
ctgggagatctcctgagggcag

SEQ ID NO: 7606525 - DNA, 22 bp, Homo sapiens
ctgggagatatgaggatctgga

SEQ ID NO: 7606526 - DNA, 22 bp, Homo sapiens
ctgggagatatgaggatctgga

SEQ ID NO: 7606527 - DNA, 22 bp, Homo sapiens
ctgggagaggtggtgggaagta

SEQ ID NO: 7606528 - DNA, 22 bp, Homo sapiens
ctgggagatatgaggatctgga

SEQ ID NO: 7606529 - DNA, 22 bp, Homo sapiens
ctgggagatatgaggatctgga

SEQ ID NO: 7606530 - DNA, 22 bp, Homo sapiens
ctgggagatatgaggatctgga

SEQ ID NO: 7606531 - DNA, 22 bp, Homo sapiens
ctgggagatatgaggatctgga

SEQ ID NO: 7606532 - DNA, 22 bp, Homo sapiens
ctgggagaggtggtgggaagta

SEQ ID NO: 7606533 - DNA, 22 bp, Homo sapiens
ctgggagaggtggtgggaagta

SEQ ID NO: 7606534 - DNA, 22 bp, Homo sapiens
ctgggagaggtggtgggaagta

SEQ ID NO: 7606535 - DNA, 22 bp, Homo sapiens
ctgggagaggtggtgggaagta

SEQ ID NO: 7606536 - DNA, 22 bp, Homo sapiens
ctgggagaggtggtgggaagta

SEQ ID NO: 7606537 - DNA, 22 bp, Homo sapiens
ctgggactgggtcctcaggaca

SEQ ID NO: 7606538 - DNA, 22 bp, Homo sapiens
ctgggactgggtcctcaggaca

SEQ ID NO: 7606539 - DNA, 22 bp, Homo sapiens
ctgggactgggtcctcaggaca

SEQ ID NO: 7606540 - DNA, 22 bp, Homo sapiens
ctgggacttgatgaaatgactg

SEQ ID NO: 7606541 - DNA, 22 bp, Homo sapiens
ctgggacttgcagagcaggagg

SEQ ID NO: 7606542 - DNA, 22 bp, Homo sapiens
ctgggagaggctgctccgctct

SEQ ID NO: 7606543 - DNA, 22 bp, Homo sapiens
ctgggagaggctgctccgctct

SEQ ID NO: 7606544 - DNA, 22 bp, Homo sapiens
ctgggacttgcagagcaggagg

SEQ ID NO: 7606545 - DNA, 22 bp, Homo sapiens
ctgggacttgtagtctcggcgc

SEQ ID NO: 7606546 - DNA, 22 bp, Homo sapiens
ctgggacttgcagagcaggagg

SEQ ID NO: 7606547 - DNA, 22 bp, Homo sapiens
ctgggacttgcagagcaggagg

SEQ ID NO: 7606548 - DNA, 22 bp, Homo sapiens
ctgggacttgcagagcaggagg

SEQ ID NO: 7606549 - DNA, 22 bp, Homo sapiens
ctgggacttgcagagcaggagg

SEQ ID NO: 7606550 - DNA, 22 bp, Homo sapiens
ctgggacttgggctatgctctg

SEQ ID NO: 7606551 - DNA, 22 bp, Homo sapiens
ctgggagattgctagagatgca

SEQ ID NO: 7606552 - DNA, 22 bp, Homo sapiens
ctgggagattgctagagatgca

SEQ ID NO: 7606553 - DNA, 22 bp, Homo sapiens
ctgggagattgctagagatgca

SEQ ID NO: 7606554 - DNA, 22 bp, Homo sapiens
ctgggagattgaggccatggtg

SEQ ID NO: 7606555 - DNA, 22 bp, Homo sapiens
ctgggagattgaggccatggtg

SEQ ID NO: 7606556 - DNA, 22 bp, Homo sapiens
ctgggagattcaggtgaagttt

SEQ ID NO: 7606557 - DNA, 22 bp, Homo sapiens
ctgggagattcaggtgaagttt

SEQ ID NO: 7606558 - DNA, 22 bp, Homo sapiens
ctgggagattgaggccatggtg

SEQ ID NO: 7606559 - DNA, 22 bp, Homo sapiens
ctgggagattgaggccatggtg

SEQ ID NO: 7606560 - DNA, 22 bp, Homo sapiens
ctgggagattgaggccatggtg

SEQ ID NO: 7606561 - DNA, 22 bp, Homo sapiens
ctgggagattcaggtgaagttt

SEQ ID NO: 7606562 - DNA, 22 bp, Homo sapiens
ctgggagattcaggtgaagttt

SEQ ID NO: 7606563 - DNA, 22 bp, Homo sapiens
ctgggagatctgttgggactgg

SEQ ID NO: 7606564 - DNA, 22 bp, Homo sapiens
ctgggagatctgttgggactgg

SEQ ID NO: 7606565 - DNA, 22 bp, Homo sapiens
ctgggagatctgttgggactgg

SEQ ID NO: 7606566 - DNA, 22 bp, Homo sapiens
ctgggagatctgttgggactgg

SEQ ID NO: 7606567 - DNA, 22 bp, Homo sapiens
ctgggagatctcctgagggcag

SEQ ID NO: 7606568 - DNA, 22 bp, Homo sapiens
ctgggagatctcctgagggcag

SEQ ID NO: 7606569 - DNA, 22 bp, Homo sapiens
ctgggagatgactcagagcagg

SEQ ID NO: 7606570 - DNA, 22 bp, Homo sapiens
ctgggagatgactcagagcagg

SEQ ID NO: 7606571 - DNA, 22 bp, Homo sapiens
ctgggagatgactcagagcagg

SEQ ID NO: 7606572 - DNA, 22 bp, Homo sapiens
ctgggagatgactcagagcagg

SEQ ID NO: 7606573 - DNA, 22 bp, Homo sapiens
ctgggagatctgttgggactgg

SEQ ID NO: 7606574 - DNA, 22 bp, Homo sapiens
ctgggagatctgttgggactgg

SEQ ID NO: 7606575 - DNA, 22 bp, Homo sapiens
ctgggagatgactcagagcagg

SEQ ID NO: 7606576 - DNA, 22 bp, Homo sapiens
ctgggagatgactcagagcagg

SEQ ID NO: 7606577 - DNA, 22 bp, Homo sapiens
ctgggagatgactcagagcagg

SEQ ID NO: 7606578 - DNA, 22 bp, Homo sapiens
ctgcttatggagatgagtaaga

SEQ ID NO: 7606579 - DNA, 18 bp, Homo sapiens
ctgcttacaaaaataccc

SEQ ID NO: 7606580 - DNA, 22 bp, Homo sapiens
ctgcttaagcaagaaagcagca

SEQ ID NO: 7606581 - DNA, 22 bp, Homo sapiens
ctgcttaatttaatagttgcaa

SEQ ID NO: 7606582 - DNA, 22 bp, Homo sapiens
ctgcttatggaattgtatactg

SEQ ID NO: 7606583 - DNA, 22 bp, Homo sapiens
ctgcttcacccaactttgggat

SEQ ID NO: 7606584 - DNA, 22 bp, Homo sapiens
ctgcttcacccaactttgggat

SEQ ID NO: 7606585 - DNA, 22 bp, Homo sapiens
ctgcttatggagatgagtaaga

SEQ ID NO: 7606586 - DNA, 22 bp, Homo sapiens
ctgcttcaaggaaatgaatcgg

SEQ ID NO: 7606587 - DNA, 22 bp, Homo sapiens
ctgcttcaaggaaatgaatcgg

SEQ ID NO: 7606588 - DNA, 22 bp, Homo sapiens
ctgcttcaaggaaatgaatcgg

SEQ ID NO: 7606589 - DNA, 22 bp, Homo sapiens
ctgcttaaaatgcagattctgt

SEQ ID NO: 7606590 - DNA, 20 bp, Homo sapiens
ctgcttaagtaagtgacaca

SEQ ID NO: 7606591 - DNA, 22 bp, Homo sapiens
ctgcttaaaatgcagattctgt

SEQ ID NO: 7606592 - DNA, 20 bp, Homo sapiens
ctgcttaagtaagtgacaca

SEQ ID NO: 7606593 - DNA, 20 bp, Homo sapiens
ctgcttaagtaagtgacaca

SEQ ID NO: 7606594 - DNA, 22 bp, Homo sapiens
ctgctgtttctcaaaattaagt

SEQ ID NO: 7606595 - DNA, 23 bp, Homo sapiens
ctgctgttttctgtacctgaagc

SEQ ID NO: 7606596 - DNA, 22 bp, Homo sapiens
ctgctgtgttggcattggatag

SEQ ID NO: 7606597 - DNA, 22 bp, Homo sapiens
ctgctgtgttggcattggatag

SEQ ID NO: 7606598 - DNA, 23 bp, Homo sapiens
ctgctgtgttggtctcgatggga

SEQ ID NO: 7606599 - DNA, 23 bp, Homo sapiens
ctgctgtgttggtctcgatggga

SEQ ID NO: 7606600 - DNA, 23 bp, Homo sapiens
ctgctgtgttggtctcgatggga

SEQ ID NO: 7606601 - DNA, 22 bp, Homo sapiens
ctgctgttgccacctgcatgga

SEQ ID NO: 7606602 - DNA, 22 bp, Homo sapiens
ctgctgttctgaagcaacaagc

SEQ ID NO: 7606603 - DNA, 22 bp, Homo sapiens
ctgctgttctgaagcaacaagc

SEQ ID NO: 7606604 - DNA, 22 bp, Homo sapiens
ctgctgttccacctctgaatgc

SEQ ID NO: 7606605 - DNA, 22 bp, Homo sapiens
ctgctgtgtttcacacctctgg

SEQ ID NO: 7606606 - DNA, 22 bp, Homo sapiens
ctgctgtgtttcacacctctgg

SEQ ID NO: 7606607 - DNA, 22 bp, Homo sapiens
ctgctgtgtttctgctagaaaa

SEQ ID NO: 7606608 - DNA, 22 bp, Homo sapiens
ctgctgtgtttcacacctctgg

SEQ ID NO: 7606609 - DNA, 20 bp, Homo sapiens
ctgctgtgtgtgcctcagcc

SEQ ID NO: 7606610 - DNA, 20 bp, Homo sapiens
ctgctgtgtgtgcctcagcc

SEQ ID NO: 7606611 - DNA, 20 bp, Homo sapiens
ctgctgtgtgtgcctcagcc

SEQ ID NO: 7606612 - DNA, 20 bp, Homo sapiens
ctgctgtgtgtgcctcagcc

SEQ ID NO: 7606613 - DNA, 22 bp, Homo sapiens
ctgctgtgttagcaggtttagt

SEQ ID NO: 7606614 - DNA, 22 bp, Homo sapiens
ctgctgtgttcctcctgcatct

SEQ ID NO: 7606615 - DNA, 22 bp, Homo sapiens
ctgctgtgttgccagtgtcacc

SEQ ID NO: 7606616 - DNA, 22 bp, Homo sapiens
ctgctgtgttgccagtgtcacc

SEQ ID NO: 7606617 - DNA, 22 bp, Homo sapiens
ctgctgtgttcctcctgcatct

SEQ ID NO: 7606618 - DNA, 22 bp, Homo sapiens
ctgctgtgttcctcctgcatct

SEQ ID NO: 7606619 - DNA, 22 bp, Homo sapiens
ctgctgtgttcctcctgcatct

SEQ ID NO: 7606620 - DNA, 20 bp, Homo sapiens
ctgctgtgttattgtagaac

SEQ ID NO: 7606621 - DNA, 20 bp, Homo sapiens
ctgctgtgttattgtagaac

SEQ ID NO: 7606622 - DNA, 22 bp, Homo sapiens
ctgctgtgttcctcctgcatct

SEQ ID NO: 7606623 - DNA, 22 bp, Homo sapiens
ctgctgtgtggattcaatggct

SEQ ID NO: 7606624 - DNA, 22 bp, Homo sapiens
ctgctgtgcacccaggaaggct

SEQ ID NO: 7606625 - DNA, 22 bp, Homo sapiens
ctgctgtgcagacagactctct

SEQ ID NO: 7606626 - DNA, 22 bp, Homo sapiens
ctgctgtgcagacagactctct

SEQ ID NO: 7606627 - DNA, 22 bp, Homo sapiens
ctgctgtgcaacattgcaccta

SEQ ID NO: 7606628 - DNA, 22 bp, Homo sapiens
ctgctgtgcacccaggaaggct

SEQ ID NO: 7606629 - DNA, 22 bp, Homo sapiens
ctgctgtgtgcttacttgggtt

SEQ ID NO: 7606630 - DNA, 22 bp, Homo sapiens
ctgctgtgtggattcaatggct

SEQ ID NO: 7606631 - DNA, 22 bp, Homo sapiens
ctgctgtgtggattcaatggct

SEQ ID NO: 7606632 - DNA, 22 bp, Homo sapiens
ctgctgtgtggattcaatggct

SEQ ID NO: 7606633 - DNA, 22 bp, Homo sapiens
ctgctgtgcaacattgcaccta

SEQ ID NO: 7606634 - DNA, 20 bp, Homo sapiens
ctgctgtgattccctcctcc

SEQ ID NO: 7606635 - DNA, 20 bp, Homo sapiens
ctgctgtgattccctcctcc

SEQ ID NO: 7606636 - DNA, 22 bp, Homo sapiens
ctgctgtgcacccaggaaggct

SEQ ID NO: 7606637 - DNA, 22 bp, Homo sapiens
ctgcttccataaataatgtgct

SEQ ID NO: 7606638 - DNA, 20 bp, Homo sapiens
ctgcttccaggctcaccccc

SEQ ID NO: 7606639 - DNA, 20 bp, Homo sapiens
ctgcttccaggctcaccccc

SEQ ID NO: 7606640 - DNA, 20 bp, Homo sapiens
ctgcttccaggctcaccccc

SEQ ID NO: 7606641 - DNA, 22 bp, Homo sapiens
ctgcttccatggtctggagact

SEQ ID NO: 7606642 - DNA, 21 bp, Homo sapiens
ctgcttcctctcttcatggca

SEQ ID NO: 7606643 - DNA, 21 bp, Homo sapiens
ctgcttcctctcttcatggca

SEQ ID NO: 7606644 - DNA, 21 bp, Homo sapiens
ctgcttcctctcttcatggca

SEQ ID NO: 7606645 - DNA, 22 bp, Homo sapiens
ctgcttcctccctgtaaaggca

SEQ ID NO: 7606646 - DNA, 22 bp, Homo sapiens
ctgcttccatggtctggagact

SEQ ID NO: 7606647 - DNA, 22 bp, Homo sapiens
ctgcttccaagaaagagatagg

SEQ ID NO: 7606648 - DNA, 22 bp, Homo sapiens
ctgcttcatatttcatagtgat

SEQ ID NO: 7606649 - DNA, 22 bp, Homo sapiens
ctgcttcatatttcatagtgat

SEQ ID NO: 7606650 - DNA, 22 bp, Homo sapiens
ctgcttccaagaaagagatagg

SEQ ID NO: 7606651 - DNA, 22 bp, Homo sapiens
ctgcttcatatttcatagtgat

SEQ ID NO: 7606652 - DNA, 22 bp, Homo sapiens
ctgcttcatatttcatagtgat

SEQ ID NO: 7606653 - DNA, 22 bp, Homo sapiens
ctgcttcatatttcatagtgat

SEQ ID NO: 7606654 - DNA, 19 bp, Homo sapiens
ctgcttcaggcgccttgcc

SEQ ID NO: 7606655 - DNA, 22 bp, Homo sapiens
ctgcttcatagccctggtctct

SEQ ID NO: 7606656 - DNA, 22 bp, Homo sapiens
ctgcttcacgttgtgccttgtt

SEQ ID NO: 7606657 - DNA, 22 bp, Homo sapiens
ctgcttcacgttgtgccttgtt

SEQ ID NO: 7606658 - DNA, 22 bp, Homo sapiens
ctgcttcaccctgcctgagaac

SEQ ID NO: 7606659 - DNA, 22 bp, Homo sapiens
ctgcttcaccctgcctgagaac

SEQ ID NO: 7606660 - DNA, 22 bp, Homo sapiens
ctgcttcaccctgcctgagaac

SEQ ID NO: 7606661 - DNA, 22 bp, Homo sapiens
ctgcttcagcaaagctatttgc

SEQ ID NO: 7606662 - DNA, 19 bp, Homo sapiens
ctgcttcaggcgccttgcc

SEQ ID NO: 7606663 - DNA, 22 bp, Homo sapiens
ctgcttcacttcggttgcatag

SEQ ID NO: 7606664 - DNA, 22 bp, Homo sapiens
ctgcttcacttcggttgcatag

SEQ ID NO: 7606665 - DNA, 22 bp, Homo sapiens
ctgcttcacttcggttgcatag

SEQ ID NO: 7606666 - DNA, 22 bp, Homo sapiens
ctgggacagagcagcagtgggg

SEQ ID NO: 7606667 - DNA, 22 bp, Homo sapiens
ctgggacagagcagcagtgggg

SEQ ID NO: 7606668 - DNA, 22 bp, Homo sapiens
ctgggacagagcagcagtgggg

SEQ ID NO: 7606669 - DNA, 22 bp, Homo sapiens
ctgggacagagcagcagtgggg

SEQ ID NO: 7606670 - DNA, 22 bp, Homo sapiens
ctgggacagagcagcagtgggg

SEQ ID NO: 7606671 - DNA, 22 bp, Homo sapiens
ctgggacacgttgtgctttaac

SEQ ID NO: 7606672 - DNA, 22 bp, Homo sapiens
ctgggacagagcagcagtgggg

SEQ ID NO: 7606673 - DNA, 22 bp, Homo sapiens
ctgggacagagcagcagtgggg

SEQ ID NO: 7606674 - DNA, 22 bp, Homo sapiens
ctgggacagagcagcagtgggg

SEQ ID NO: 7606675 - DNA, 22 bp, Homo sapiens
ctgggacacccagagctgcaga

SEQ ID NO: 7606676 - DNA, 22 bp, Homo sapiens
ctgggacacccagagctgcaga

SEQ ID NO: 7606677 - DNA, 22 bp, Homo sapiens
ctgggacacccagagctgcaga

SEQ ID NO: 7606678 - DNA, 22 bp, Homo sapiens
ctgggacacgttctattccaaa

SEQ ID NO: 7606679 - DNA, 22 bp, Homo sapiens
ctgggacacccaaggaaagagc

SEQ ID NO: 7606680 - DNA, 22 bp, Homo sapiens
ctgggacacccagagctgcaga

SEQ ID NO: 7606681 - DNA, 22 bp, Homo sapiens
ctgggacacccagagctgcaga

SEQ ID NO: 7606682 - DNA, 22 bp, Homo sapiens
ctgggaagaagtgggctacatt

SEQ ID NO: 7606683 - DNA, 22 bp, Homo sapiens
ctgggaagaagtgggctacatt

SEQ ID NO: 7606684 - DNA, 22 bp, Homo sapiens
ctgggaagaagtgggctacatt

SEQ ID NO: 7606685 - DNA, 22 bp, Homo sapiens
ctgggaagaagtgggctacatt

SEQ ID NO: 7606686 - DNA, 22 bp, Homo sapiens
ctgggaagaagtgggctacatt

SEQ ID NO: 7606687 - DNA, 22 bp, Homo sapiens
ctgggaagaagtgggctacatt

SEQ ID NO: 7606688 - DNA, 22 bp, Homo sapiens
ctgcttcctgctgggatactga

SEQ ID NO: 7606689 - DNA, 22 bp, Homo sapiens
ctgcttcctgctgggatactga

SEQ ID NO: 7606690 - DNA, 22 bp, Homo sapiens
ctgggaagaagggacaacagcg

SEQ ID NO: 7606691 - DNA, 22 bp, Homo sapiens
ctgggaagaagggacaacagcg

SEQ ID NO: 7606692 - DNA, 19 bp, Homo sapiens
ctgcttccttccctcactg

SEQ ID NO: 7606693 - DNA, 19 bp, Homo sapiens
ctgcttccttccctcactg

SEQ ID NO: 7606694 - DNA, 22 bp, Homo sapiens
ctgggaagaagggacaacagcg

SEQ ID NO: 7606695 - DNA, 22 bp, Homo sapiens
ctgggaagaagggacaacagcg

SEQ ID NO: 7606696 - DNA, 22 bp, Homo sapiens
ctgggaagaatccaagggccct

SEQ ID NO: 7606697 - DNA, 22 bp, Homo sapiens
ctgggaagaatccaagggccct

SEQ ID NO: 7606698 - DNA, 22 bp, Homo sapiens
ctgggaagaatccaagggccct

SEQ ID NO: 7606699 - DNA, 22 bp, Homo sapiens
ctgggaagaatccaagggccct

SEQ ID NO: 7606700 - DNA, 22 bp, Homo sapiens
ctgggaagatggtgacagaatt

SEQ ID NO: 7606701 - DNA, 22 bp, Homo sapiens
ctgggaagatggtgacagaatt

SEQ ID NO: 7606702 - DNA, 22 bp, Homo sapiens
ctgggaagatggtgacagaatt

SEQ ID NO: 7606703 - DNA, 22 bp, Homo sapiens
gagggagctatgaatagaagaa

SEQ ID NO: 7606704 - DNA, 22 bp, Homo sapiens
gagggagctatgaatagaagaa

SEQ ID NO: 7606705 - DNA, 22 bp, Homo sapiens
gagggagctatgaatagaagaa

SEQ ID NO: 7606706 - DNA, 22 bp, Homo sapiens
gagggagccgccacagactggg

SEQ ID NO: 7606707 - DNA, 22 bp, Homo sapiens
gagggagccgccacagactggg

SEQ ID NO: 7606708 - DNA, 22 bp, Homo sapiens
gagggagccgccacagactggg

SEQ ID NO: 7606709 - DNA, 22 bp, Homo sapiens
gagggagccgccacagactggg

SEQ ID NO: 7606710 - DNA, 22 bp, Homo sapiens
gagggagagtgatggaccattg

SEQ ID NO: 7606711 - DNA, 22 bp, Homo sapiens
gagggagagtgatggaccattg

SEQ ID NO: 7606712 - DNA, 22 bp, Homo sapiens
gagggagagtgatggaccattg

SEQ ID NO: 7606713 - DNA, 22 bp, Homo sapiens
gagggagagtgatggaccattg

SEQ ID NO: 7606714 - DNA, 22 bp, Homo sapiens
gagggagaattgcagccagcgt

SEQ ID NO: 7606715 - DNA, 22 bp, Homo sapiens
gagggagaattgcagccagcgt

SEQ ID NO: 7606716 - DNA, 22 bp, Homo sapiens
gagggagagtgatggaccattg

SEQ ID NO: 7606717 - DNA, 22 bp, Homo sapiens
gagggagagtgatggaccattg

SEQ ID NO: 7606718 - DNA, 22 bp, Homo sapiens
gagggagagtgatggaccattg

SEQ ID NO: 7606719 - DNA, 22 bp, Homo sapiens
gagggagagtgatggaccattg

SEQ ID NO: 7606720 - DNA, 22 bp, Homo sapiens
gagggagctggagcagacgccg

SEQ ID NO: 7606721 - DNA, 22 bp, Homo sapiens
gagggagctggagcagacgccg

SEQ ID NO: 7606722 - DNA, 22 bp, Homo sapiens
gagggagctggagcagacgccg

SEQ ID NO: 7606723 - DNA, 22 bp, Homo sapiens
gagggagctggagcagacgccg

SEQ ID NO: 7606724 - DNA, 22 bp, Homo sapiens
gagggagctatgaatagaagaa

SEQ ID NO: 7606725 - DNA, 22 bp, Homo sapiens
gagggagctggagcagacgccg

SEQ ID NO: 7606726 - DNA, 22 bp, Homo sapiens
gagggagctggagcagacgccg

SEQ ID NO: 7606727 - DNA, 22 bp, Homo sapiens
gagggagcttgatggatgtttg

SEQ ID NO: 7606728 - DNA, 22 bp, Homo sapiens
gagggagctggagcagacgccg

SEQ ID NO: 7606729 - DNA, 22 bp, Homo sapiens
gagggagcttgatggatgtttg

SEQ ID NO: 7606730 - DNA, 22 bp, Homo sapiens
gagggaggcatcatgaatccag

SEQ ID NO: 7606731 - DNA, 22 bp, Homo sapiens
gagggaggcatcatgaatccag

SEQ ID NO: 7606732 - DNA, 22 bp, Homo sapiens
gagggaggcatcatgaatccag

SEQ ID NO: 7606733 - DNA, 22 bp, Homo sapiens
gagggaggcatcatgaatccag

SEQ ID NO: 7606734 - DNA, 22 bp, Homo sapiens
gagggaggcatcatgaatccag

SEQ ID NO: 7606735 - DNA, 22 bp, Homo sapiens
gagggaggcatcatgaatccag

SEQ ID NO: 7606736 - DNA, 22 bp, Homo sapiens
gagggaggcatcatgaatccag

SEQ ID NO: 7606737 - DNA, 22 bp, Homo sapiens
gagggaggcatcatgaatccag

SEQ ID NO: 7606738 - DNA, 22 bp, Homo sapiens
gagggaggcatcatgaatccag

SEQ ID NO: 7606739 - DNA, 22 bp, Homo sapiens
gagggagggaaagtttaacact

SEQ ID NO: 7606740 - DNA, 22 bp, Homo sapiens
gagggagggaaagtttaacact

SEQ ID NO: 7606741 - DNA, 22 bp, Homo sapiens
gagggagggaaagtttaacact

SEQ ID NO: 7606742 - DNA, 22 bp, Homo sapiens
gagggagggaaagtttaacact

SEQ ID NO: 7606743 - DNA, 22 bp, Homo sapiens
gagggagggaaagtttaacact

SEQ ID NO: 7606744 - DNA, 22 bp, Homo sapiens
gagggagggaaagtttaacact

SEQ ID NO: 7606745 - DNA, 22 bp, Homo sapiens
gagggagggactagcattctct

SEQ ID NO: 7606746 - DNA, 22 bp, Homo sapiens
gagggagggactagcattctct

SEQ ID NO: 7606747 - DNA, 22 bp, Homo sapiens
gagggagggactagcattctct

SEQ ID NO: 7606748 - DNA, 22 bp, Homo sapiens
gagggagggaaagtttaacact

SEQ ID NO: 7606749 - DNA, 22 bp, Homo sapiens
gagggagggccaggtcccaacc

SEQ ID NO: 7606750 - DNA, 22 bp, Homo sapiens
gagggagggactagcattctct

SEQ ID NO: 7606751 - DNA, 22 bp, Homo sapiens
gagggagggactagcattctct

SEQ ID NO: 7606752 - DNA, 22 bp, Homo sapiens
gagggagggactagcattctct

SEQ ID NO: 7606753 - DNA, 22 bp, Homo sapiens
gagggagggactagcattctct

SEQ ID NO: 7606754 - DNA, 22 bp, Homo sapiens
gagggagggactagcattctct

SEQ ID NO: 7606755 - DNA, 22 bp, Homo sapiens
gagggagggactagcattctct

SEQ ID NO: 7606756 - DNA, 22 bp, Homo sapiens
gagggagggactagcattctct

SEQ ID NO: 7606757 - DNA, 22 bp, Homo sapiens
gagggagggactagcattctct

SEQ ID NO: 7606758 - DNA, 22 bp, Homo sapiens
gagggagggactagcattctct

SEQ ID NO: 7606759 - DNA, 22 bp, Homo sapiens
gagggagggactagcattctct

SEQ ID NO: 7606760 - DNA, 22 bp, Homo sapiens
gagggaggggagctccaccctc

SEQ ID NO: 7606761 - DNA, 22 bp, Homo sapiens
gagggaggggagctccaccctc

SEQ ID NO: 7606762 - DNA, 22 bp, Homo sapiens
gagggaggggagctccaccctc

SEQ ID NO: 7606763 - DNA, 22 bp, Homo sapiens
gagggaggggagctccaccctc

SEQ ID NO: 7606764 - DNA, 22 bp, Homo sapiens
gagggaggggagctccaccctc

SEQ ID NO: 7606765 - DNA, 22 bp, Homo sapiens
gagggaggggagctccaccctc

SEQ ID NO: 7606766 - DNA, 22 bp, Homo sapiens
gagggaggggagctccaccctc

SEQ ID NO: 7606767 - DNA, 22 bp, Homo sapiens
gagggaggggagctccaccctc

SEQ ID NO: 7606768 - DNA, 22 bp, Homo sapiens
gagggaggggagctccaccctc

SEQ ID NO: 7606769 - DNA, 22 bp, Homo sapiens
gagggaggggagctccaccctc

SEQ ID NO: 7606770 - DNA, 22 bp, Homo sapiens
gagggaggggagctccaccctc

SEQ ID NO: 7606771 - DNA, 22 bp, Homo sapiens
gagggagggccaggtcccaacc

SEQ ID NO: 7606772 - DNA, 22 bp, Homo sapiens
gagggagggccaggtcccaacc

SEQ ID NO: 7606773 - DNA, 22 bp, Homo sapiens
gagggagggccaggtcccaacc

SEQ ID NO: 7606774 - DNA, 22 bp, Homo sapiens
gagggagggccaggtcccaacc

SEQ ID NO: 7606775 - DNA, 22 bp, Homo sapiens
gagggagggccaggtcccaacc

SEQ ID NO: 7606776 - DNA, 22 bp, Homo sapiens
gagggagggccaggtcccaacc

SEQ ID NO: 7606777 - DNA, 22 bp, Homo sapiens
gagggagggccaggtcccaacc

SEQ ID NO: 7606778 - DNA, 22 bp, Homo sapiens
gagggagggccaggtcccaacc

SEQ ID NO: 7606779 - DNA, 22 bp, Homo sapiens
gagggagggccaggtcccaacc

SEQ ID NO: 7606780 - DNA, 22 bp, Homo sapiens
gagggagggccaggtcccaacc

SEQ ID NO: 7606781 - DNA, 22 bp, Homo sapiens
gagggagggccaggtcccaacc

SEQ ID NO: 7606782 - DNA, 22 bp, Homo sapiens
gaggctgagtagctttgtgctc

SEQ ID NO: 7606783 - DNA, 22 bp, Homo sapiens
gaggctgaggttgcagtgagct

SEQ ID NO: 7606784 - DNA, 22 bp, Homo sapiens
gaggctgaggttgcagtgagct

SEQ ID NO: 7606785 - DNA, 22 bp, Homo sapiens
gaggctgaggttgcagtgagct

SEQ ID NO: 7606786 - DNA, 22 bp, Homo sapiens
gaggctgaggttgcagtgagct

SEQ ID NO: 7606787 - DNA, 22 bp, Homo sapiens
gaggctgaggttgcagtgagcc

SEQ ID NO: 7606788 - DNA, 22 bp, Homo sapiens
gaggctgaggttgcagtgagct

SEQ ID NO: 7606789 - DNA, 22 bp, Homo sapiens
gaggctgaggttgcagtgagct

SEQ ID NO: 7606790 - DNA, 22 bp, Homo sapiens
gaggctgaggttgcagtgagct

SEQ ID NO: 7606791 - DNA, 22 bp, Homo sapiens
gaggctgaggttgcagtgagcc

SEQ ID NO: 7606792 - DNA, 22 bp, Homo sapiens
gaggctgaggttgcagtgagct

SEQ ID NO: 7606793 - DNA, 22 bp, Homo sapiens
gaggctgaggttgcagtgagcc

SEQ ID NO: 7606794 - DNA, 22 bp, Homo sapiens
gaggctgaggttgcagtgagcc

SEQ ID NO: 7606795 - DNA, 22 bp, Homo sapiens
gaggctgaggttgcagtgagcc

SEQ ID NO: 7606796 - DNA, 22 bp, Homo sapiens
gaggctgaggttgcagtgagcc

SEQ ID NO: 7606797 - DNA, 22 bp, Homo sapiens
gaggctgaggttgcagtgagcc

SEQ ID NO: 7606798 - DNA, 22 bp, Homo sapiens
gaggctgaggttgcagtgagcc

SEQ ID NO: 7606799 - DNA, 22 bp, Homo sapiens
gaggctgagggttagagagtca

SEQ ID NO: 7606800 - DNA, 22 bp, Homo sapiens
gaggctgagggttagagagtca

SEQ ID NO: 7606801 - DNA, 22 bp, Homo sapiens
gaggctgagggttagagagtca

SEQ ID NO: 7606802 - DNA, 22 bp, Homo sapiens
gaggctgagggttagagagtca

SEQ ID NO: 7606803 - DNA, 22 bp, Homo sapiens
gaggctgagggttagagagtca

SEQ ID NO: 7606804 - DNA, 22 bp, Homo sapiens
gaggctgaggcggatggatcac

SEQ ID NO: 7606805 - DNA, 22 bp, Homo sapiens
gaggctgaggcggatggatcac

SEQ ID NO: 7606806 - DNA, 22 bp, Homo sapiens
gaggctgagggttagagagtca

SEQ ID NO: 7606807 - DNA, 22 bp, Homo sapiens
gaggctgaggcggatggatcac

SEQ ID NO: 7606808 - DNA, 22 bp, Homo sapiens
gaggctgaggcggatggatcac

SEQ ID NO: 7606809 - DNA, 22 bp, Homo sapiens
gaggctgaggcaggaggatcac

SEQ ID NO: 7606810 - DNA, 22 bp, Homo sapiens
gaggctgaggcggatggatcac

SEQ ID NO: 7606811 - DNA, 22 bp, Homo sapiens
gaggctgaggcaggaggatcac

SEQ ID NO: 7606812 - DNA, 22 bp, Homo sapiens
gaggctgaggcaggaggatcac

SEQ ID NO: 7606813 - DNA, 22 bp, Homo sapiens
gaggctgaggcaggaggatcac

SEQ ID NO: 7606814 - DNA, 22 bp, Homo sapiens
gaggctgcaggcaatgctgccc

SEQ ID NO: 7606815 - DNA, 22 bp, Homo sapiens
gaggctgcagctatcagacatt

SEQ ID NO: 7606816 - DNA, 22 bp, Homo sapiens
gaggctgcagctatcagacatt

SEQ ID NO: 7606817 - DNA, 22 bp, Homo sapiens
gaggctgcaggcaatgctgccc

SEQ ID NO: 7606818 - DNA, 22 bp, Homo sapiens
gaggctgcattcttcccactgc

SEQ ID NO: 7606819 - DNA, 22 bp, Homo sapiens
gaggctgcaggcaatgctgccc

SEQ ID NO: 7606820 - DNA, 22 bp, Homo sapiens
gaggctgcaggcaatgctgccc

SEQ ID NO: 7606821 - DNA, 22 bp, Homo sapiens
gaggctgcattcttcccactgc

SEQ ID NO: 7606822 - DNA, 22 bp, Homo sapiens
gaggctgcattcttcccactgc

SEQ ID NO: 7606823 - DNA, 22 bp, Homo sapiens
gaggctgccaatgtgtgcatgt

SEQ ID NO: 7606824 - DNA, 22 bp, Homo sapiens
gaggctgccaatgtgtgcatgt

SEQ ID NO: 7606825 - DNA, 22 bp, Homo sapiens
gaggctgccaatgtgtgcatgt

SEQ ID NO: 7606826 - DNA, 22 bp, Homo sapiens
gaggctgcccaactggagtgga

SEQ ID NO: 7606827 - DNA, 22 bp, Homo sapiens
gaggctgcccaactggagtgga

SEQ ID NO: 7606828 - DNA, 22 bp, Homo sapiens
gaggctgcccaactggagtgga

SEQ ID NO: 7606829 - DNA, 22 bp, Homo sapiens
gaggctgcactggctaaaggct

SEQ ID NO: 7606830 - DNA, 22 bp, Homo sapiens
gaggctgcactggctaaaggct

SEQ ID NO: 7606831 - DNA, 22 bp, Homo sapiens
gaggctgcactggctaaaggct

SEQ ID NO: 7606832 - DNA, 22 bp, Homo sapiens
gaggctgcactggctaaaggct

SEQ ID NO: 7606833 - DNA, 22 bp, Homo sapiens
gaggctgcactggctaaaggct

SEQ ID NO: 7606834 - DNA, 22 bp, Homo sapiens
gaggctgattcggggaacagca

SEQ ID NO: 7606835 - DNA, 22 bp, Homo sapiens
gaggctgattcggggaacagca

SEQ ID NO: 7606836 - DNA, 22 bp, Homo sapiens
gaggctgattcggggaacagca

SEQ ID NO: 7606837 - DNA, 22 bp, Homo sapiens
gaggctgatgctgcctcacaga

SEQ ID NO: 7606838 - DNA, 22 bp, Homo sapiens
gaggctgattcggggaacagca

SEQ ID NO: 7606839 - DNA, 22 bp, Homo sapiens
gaggctgagtagctttgtgctc

SEQ ID NO: 7606840 - DNA, 22 bp, Homo sapiens
gaggctgatgctgcctcacaga

SEQ ID NO: 7606841 - DNA, 22 bp, Homo sapiens
gaggctgattcggggaacagca

SEQ ID NO: 7606842 - DNA, 22 bp, Homo sapiens
gaggctgattcggggaacagca

SEQ ID NO: 7606843 - DNA, 22 bp, Homo sapiens
gaggctgagtagctttgtgctc

SEQ ID NO: 7606844 - DNA, 22 bp, Homo sapiens
gaggctgatgctgcctcacaga

SEQ ID NO: 7606845 - DNA, 22 bp, Homo sapiens
gaggctgatgctgcctcacaga

SEQ ID NO: 7606846 - DNA, 22 bp, Homo sapiens
gaggctgagtagctttgtgctc

SEQ ID NO: 7606847 - DNA, 22 bp, Homo sapiens
gagggaggtgatactgaacgta

SEQ ID NO: 7606848 - DNA, 22 bp, Homo sapiens
gagggaggtgatactgaacgta

SEQ ID NO: 7606849 - DNA, 22 bp, Homo sapiens
gagggaggtgatactgaacgta

SEQ ID NO: 7606850 - DNA, 22 bp, Homo sapiens
gagggaggtgatactgaacgta

SEQ ID NO: 7606851 - DNA, 22 bp, Homo sapiens
gagggaggtgatactgaacgta

SEQ ID NO: 7606852 - DNA, 22 bp, Homo sapiens
gagggaggtgatactgaacgta

SEQ ID NO: 7606853 - DNA, 22 bp, Homo sapiens
gagggaggtgatactgaacgta

SEQ ID NO: 7606854 - DNA, 22 bp, Homo sapiens
gagggaggtgatactgaacgta

SEQ ID NO: 7606855 - DNA, 22 bp, Homo sapiens
gagggaggtgatactgaacgta

SEQ ID NO: 7606856 - DNA, 18 bp, Homo sapiens
gagggagtagctgaggtt

SEQ ID NO: 7606857 - DNA, 18 bp, Homo sapiens
gagggagtagctgaggtt

SEQ ID NO: 7606858 - DNA, 18 bp, Homo sapiens
gagggagtagctgaggtt

SEQ ID NO: 7606859 - DNA, 18 bp, Homo sapiens
gagggagtagctgaggtt

SEQ ID NO: 7606860 - DNA, 18 bp, Homo sapiens
gagggagtagctgaggtt

SEQ ID NO: 7606861 - DNA, 18 bp, Homo sapiens
gagggagtagctgaggtt

SEQ ID NO: 7606862 - DNA, 22 bp, Homo sapiens
gagggagtaacgtactacagtg

SEQ ID NO: 7606863 - DNA, 22 bp, Homo sapiens
gagggagtaacgtactacagtg

SEQ ID NO: 7606864 - DNA, 22 bp, Homo sapiens
gagggctgatgttgccacctca

SEQ ID NO: 7606865 - DNA, 22 bp, Homo sapiens
gagggctgatgttgccacctca

SEQ ID NO: 7606866 - DNA, 22 bp, Homo sapiens
gagggctgatgttgccacctca

SEQ ID NO: 7606867 - DNA, 22 bp, Homo sapiens
gagggctgatgttgccacctca

SEQ ID NO: 7606868 - DNA, 22 bp, Homo sapiens
gagggctgatgttgccacctca

SEQ ID NO: 7606869 - DNA, 22 bp, Homo sapiens
gagggctgatgttgccacctca

SEQ ID NO: 7606870 - DNA, 22 bp, Homo sapiens
gagggagtgctttctgatagtt

SEQ ID NO: 7606871 - DNA, 22 bp, Homo sapiens
gagggagtgctttctgatagtt

SEQ ID NO: 7606872 - DNA, 22 bp, Homo sapiens
gagggagtgccagagggccagc

SEQ ID NO: 7606873 - DNA, 22 bp, Homo sapiens
gagggagtgagacacaaaagaa

SEQ ID NO: 7606874 - DNA, 22 bp, Homo sapiens
gagggagtgccagagggccagc

SEQ ID NO: 7606875 - DNA, 22 bp, Homo sapiens
gagggagtgagacacaaaagaa

SEQ ID NO: 7606876 - DNA, 22 bp, Homo sapiens
gagggagtgagacacaaaagaa

SEQ ID NO: 7606877 - DNA, 22 bp, Homo sapiens
gagggagtgccagagggccagc

SEQ ID NO: 7606878 - DNA, 22 bp, Homo sapiens
gagggagtgccagagggccagc

SEQ ID NO: 7606879 - DNA, 18 bp, Homo sapiens
gagggagtagctgaggtt

SEQ ID NO: 7606880 - DNA, 18 bp, Homo sapiens
gagggagtagctgaggtt

SEQ ID NO: 7606881 - DNA, 22 bp, Homo sapiens
gagggagtctgtgcaaagaatt

SEQ ID NO: 7606882 - DNA, 22 bp, Homo sapiens
gagggagtctgtgcaaagaatt

SEQ ID NO: 7606883 - DNA, 22 bp, Homo sapiens
gagggagtctgtgcaaagaatt

SEQ ID NO: 7606884 - DNA, 22 bp, Homo sapiens
gagggagtctgtgcaaagaatt

SEQ ID NO: 7606885 - DNA, 22 bp, Homo sapiens
gagggctgcaatgagacagaga

SEQ ID NO: 7606886 - DNA, 22 bp, Homo sapiens
gagggctgcaatgagacagaga

SEQ ID NO: 7606887 - DNA, 22 bp, Homo sapiens
gagggctgcaatgagacagaga

SEQ ID NO: 7606888 - DNA, 22 bp, Homo sapiens
gagggctgatgttgccacctca

SEQ ID NO: 7606889 - DNA, 22 bp, Homo sapiens
gagggctgatgttgccacctca

SEQ ID NO: 7606890 - DNA, 22 bp, Homo sapiens
gagggctgatgttgccacctca

SEQ ID NO: 7606891 - DNA, 22 bp, Homo sapiens
gagggctgcaatgagacagaga

SEQ ID NO: 7606892 - DNA, 22 bp, Homo sapiens
gagggctgcaatgagacagaga

SEQ ID NO: 7606893 - DNA, 22 bp, Homo sapiens
gagggctgcaatgagacagaga

SEQ ID NO: 7606894 - DNA, 22 bp, Homo sapiens
gagggctgcaatgagacagaga

SEQ ID NO: 7606895 - DNA, 22 bp, Homo sapiens
gagggctgcaatgagacagaga

SEQ ID NO: 7606896 - DNA, 22 bp, Homo sapiens
gagggctgcaatgagacagaga

SEQ ID NO: 7606897 - DNA, 22 bp, Homo sapiens
gagggctgcaatgagacagaga

SEQ ID NO: 7606898 - DNA, 22 bp, Homo sapiens
gagggctgctgccagatatgcc

SEQ ID NO: 7606899 - DNA, 22 bp, Homo sapiens
gagggctgctgccagatatgcc

SEQ ID NO: 7606900 - DNA, 22 bp, Homo sapiens
gagggctgctgccagatatgcc

SEQ ID NO: 7606901 - DNA, 22 bp, Homo sapiens
gagggctgctgccagatatgcc

SEQ ID NO: 7606902 - DNA, 22 bp, Homo sapiens
gagggctgctgccagatatgcc

SEQ ID NO: 7606903 - DNA, 22 bp, Homo sapiens
gagggctgctggaaaaatgcag

SEQ ID NO: 7606904 - DNA, 22 bp, Homo sapiens
gagggctgctgccagatatgcc

SEQ ID NO: 7606905 - DNA, 22 bp, Homo sapiens
gagggctgctgccagatatgcc

SEQ ID NO: 7606906 - DNA, 22 bp, Homo sapiens
gagggctgccacgttgggcgag

SEQ ID NO: 7606907 - DNA, 22 bp, Homo sapiens
gagggctgccacgttgggcgag

SEQ ID NO: 7606908 - DNA, 22 bp, Homo sapiens
gagggctgctgccagatatgcc

SEQ ID NO: 7606909 - DNA, 22 bp, Homo sapiens
gagggctgatgttgccacctca

SEQ ID NO: 7606910 - DNA, 22 bp, Homo sapiens
gagggctgccacgttgggcgag

SEQ ID NO: 7606911 - DNA, 22 bp, Homo sapiens
gagggctgccacgttgggcgag

SEQ ID NO: 7606912 - DNA, 22 bp, Homo sapiens
gagggctgccacgttgggcgag

SEQ ID NO: 7606913 - DNA, 22 bp, Homo sapiens
gagggctgccacgttgggcgag

SEQ ID NO: 7606914 - DNA, 22 bp, Homo sapiens
gagggctgccacgttgggcgag

SEQ ID NO: 7606915 - DNA, 22 bp, Homo sapiens
gagggctgccacgttgggcgag

SEQ ID NO: 7606916 - DNA, 22 bp, Homo sapiens
gagggctgtggggcatgaccag

SEQ ID NO: 7606917 - DNA, 22 bp, Homo sapiens
gagggctgtggggcatgaccag

SEQ ID NO: 7606918 - DNA, 22 bp, Homo sapiens
gagggctgtggggcatgaccag

SEQ ID NO: 7606919 - DNA, 22 bp, Homo sapiens
gagggctgtggggcatgaccag

SEQ ID NO: 7606920 - DNA, 22 bp, Homo sapiens
gagggctgtggggcatgaccag

SEQ ID NO: 7606921 - DNA, 22 bp, Homo sapiens
gagggcttccatggggagcccc

SEQ ID NO: 7606922 - DNA, 22 bp, Homo sapiens
gagggctgtggggcatgaccag

SEQ ID NO: 7606923 - DNA, 22 bp, Homo sapiens
gagggctgtggggcatgaccag

SEQ ID NO: 7606924 - DNA, 22 bp, Homo sapiens
gagggctgtgaaggagcgggtt

SEQ ID NO: 7606925 - DNA, 22 bp, Homo sapiens
gagggctgtgaaggagcgggtt

SEQ ID NO: 7606926 - DNA, 22 bp, Homo sapiens
gagggctgtggggcatgaccag

SEQ ID NO: 7606927 - DNA, 22 bp, Homo sapiens
gagggctgtggggcatgaccag

SEQ ID NO: 7606928 - DNA, 22 bp, Homo sapiens
gagggctgtgaaggagcgggtt

SEQ ID NO: 7606929 - DNA, 22 bp, Homo sapiens
gagggctgtgaaggagcgggtt

SEQ ID NO: 7606930 - DNA, 22 bp, Homo sapiens
gagggctgtgaaggagcgggtt

SEQ ID NO: 7606931 - DNA, 22 bp, Homo sapiens
gagggctgtgaaggagcgggtt

SEQ ID NO: 7606932 - DNA, 22 bp, Homo sapiens
gagggctgctggaaaaatgcag

SEQ ID NO: 7606933 - DNA, 22 bp, Homo sapiens
gagggctgtgaaggagcgggtt

SEQ ID NO: 7606934 - DNA, 22 bp, Homo sapiens
gagggctgtgaaggagcgggtt

SEQ ID NO: 7606935 - DNA, 22 bp, Homo sapiens
gagggctgtgaaggagcgggtt

SEQ ID NO: 7606936 - DNA, 22 bp, Homo sapiens
gagggctgtgaaggagcgggtt

SEQ ID NO: 7606937 - DNA, 22 bp, Homo sapiens
gagggctggggcttaggcttag

SEQ ID NO: 7606938 - DNA, 22 bp, Homo sapiens
gagggctggggcttaggcttag

SEQ ID NO: 7606939 - DNA, 22 bp, Homo sapiens
gagggctggggcttaggcttag

SEQ ID NO: 7606940 - DNA, 22 bp, Homo sapiens
gagggctggggcttaggcttag

SEQ ID NO: 7606941 - DNA, 22 bp, Homo sapiens
gagggctgctggaaaaatgcag

SEQ ID NO: 7606942 - DNA, 22 bp, Homo sapiens
gagggctgctggaaaaatgcag

SEQ ID NO: 7606943 - DNA, 22 bp, Homo sapiens
gagggctgctggaaaaatgcag

SEQ ID NO: 7606944 - DNA, 22 bp, Homo sapiens
gagggctgctggaaaaatgcag

SEQ ID NO: 7606945 - DNA, 22 bp, Homo sapiens
gagggctgctggaaaaatgcag

SEQ ID NO: 7606946 - DNA, 22 bp, Homo sapiens
gagggctgctggaaaaatgcag

SEQ ID NO: 7606947 - DNA, 22 bp, Homo sapiens
gagggctggggcttaggcttag

SEQ ID NO: 7606948 - DNA, 22 bp, Homo sapiens
gagggctggggcttaggcttag

SEQ ID NO: 7606949 - DNA, 22 bp, Homo sapiens
gaggggctctttaatagtaaca

SEQ ID NO: 7606950 - DNA, 22 bp, Homo sapiens
gaggggaaagtgtgaggctgcg

SEQ ID NO: 7606951 - DNA, 22 bp, Homo sapiens
gaggggaaagtgtgaggctgcg

SEQ ID NO: 7606952 - DNA, 22 bp, Homo sapiens
gagggcttgtaagtgggtggag

SEQ ID NO: 7606953 - DNA, 19 bp, Homo sapiens
gagggcttgatggacccga

SEQ ID NO: 7606954 - DNA, 22 bp, Homo sapiens
gaggggaaaacaggaattaaca

SEQ ID NO: 7606955 - DNA, 22 bp, Homo sapiens
gaggggaaaacaggaattaaca

SEQ ID NO: 7606956 - DNA, 22 bp, Homo sapiens
gagggcttgtaagtgggtggag

SEQ ID NO: 7606957 - DNA, 22 bp, Homo sapiens
gagggctttttatgaatggagg

SEQ ID NO: 7606958 - DNA, 22 bp, Homo sapiens
gaggggctgccctggtgtcagg

SEQ ID NO: 7606959 - DNA, 22 bp, Homo sapiens
gaggggctgccctggtgtcagg

SEQ ID NO: 7606960 - DNA, 22 bp, Homo sapiens
gaggggctgccctggtgtcagg

SEQ ID NO: 7606961 - DNA, 22 bp, Homo sapiens
gaggggctgccctggtgtcagg

SEQ ID NO: 7606962 - DNA, 22 bp, Homo sapiens
gagggctgtggggcatgaccag

SEQ ID NO: 7606963 - DNA, 22 bp, Homo sapiens
gaggggctggcacgatggctgc

SEQ ID NO: 7606964 - DNA, 22 bp, Homo sapiens
gaggggctggcacgatggctgc

SEQ ID NO: 7606965 - DNA, 22 bp, Homo sapiens
gaggggctggcacgatggctgc

SEQ ID NO: 7606966 - DNA, 22 bp, Homo sapiens
gaggggctggcacgatggctgc

SEQ ID NO: 7606967 - DNA, 22 bp, Homo sapiens
gaggggctggcacgatggctgc

SEQ ID NO: 7606968 - DNA, 22 bp, Homo sapiens
gaggggctgccctggtgtcagg

SEQ ID NO: 7606969 - DNA, 22 bp, Homo sapiens
gaggggctgccctggtgtcagg

SEQ ID NO: 7606970 - DNA, 22 bp, Homo sapiens
gaggggctggcacgatggctgc

SEQ ID NO: 7606971 - DNA, 22 bp, Homo sapiens
gaggggctggcacgatggctgc

SEQ ID NO: 7606972 - DNA, 22 bp, Homo sapiens
gaggggctggcacgatggctgc

SEQ ID NO: 7606973 - DNA, 22 bp, Homo sapiens
gaggggctggcacgatggctgc

SEQ ID NO: 7606974 - DNA, 22 bp, Homo sapiens
gaggggctggcacgatggctgc

SEQ ID NO: 7606975 - DNA, 22 bp, Homo sapiens
gaggggctggcacgatggctgc

SEQ ID NO: 7606976 - DNA, 22 bp, Homo sapiens
gaggggctggcacgatggctgc

SEQ ID NO: 7606977 - DNA, 22 bp, Homo sapiens
gaggggctggctgtggtcccat

SEQ ID NO: 7606978 - DNA, 22 bp, Homo sapiens
gaggggctgggcagtccctgga

SEQ ID NO: 7606979 - DNA, 22 bp, Homo sapiens
gaggggctgggcagtccctgga

SEQ ID NO: 7606980 - DNA, 22 bp, Homo sapiens
gaggggctgggcagtccctgga

SEQ ID NO: 7606981 - DNA, 22 bp, Homo sapiens
gaggggctgggcagtccctgga

SEQ ID NO: 7606982 - DNA, 22 bp, Homo sapiens
gaggggctggctgtggtcccat

SEQ ID NO: 7606983 - DNA, 22 bp, Homo sapiens
gaggggctggctgtggtcccat

SEQ ID NO: 7606984 - DNA, 22 bp, Homo sapiens
gaggggctggctgtggtcccat

SEQ ID NO: 7606985 - DNA, 22 bp, Homo sapiens
gaggggctggctgtggtcccat

SEQ ID NO: 7606986 - DNA, 22 bp, Homo sapiens
gaggggctggctgtggtcccat

SEQ ID NO: 7606987 - DNA, 20 bp, Homo sapiens
gaggctgaagtgtttttgct

SEQ ID NO: 7606988 - DNA, 22 bp, Homo sapiens
gaggctgaagtgtacatgggtg

SEQ ID NO: 7606989 - DNA, 22 bp, Homo sapiens
gaggctgaagtgtacatgggtg

SEQ ID NO: 7606990 - DNA, 22 bp, Homo sapiens
gaggctgaagtgtacatgggtg

SEQ ID NO: 7606991 - DNA, 22 bp, Homo sapiens
gaggctgaagtgtacatgggtg

SEQ ID NO: 7606992 - DNA, 22 bp, Homo sapiens
gaggctgaagtgtacatgggtg

SEQ ID NO: 7606993 - DNA, 22 bp, Homo sapiens
gaggctgaagtgtacatgggtg

SEQ ID NO: 7606994 - DNA, 22 bp, Homo sapiens
gaggctgaatggccagaagcca

SEQ ID NO: 7606995 - DNA, 22 bp, Homo sapiens
gaggctgaatggccagaagcca

SEQ ID NO: 7606996 - DNA, 22 bp, Homo sapiens
gaggctgaatggccagaagcca

SEQ ID NO: 7606997 - DNA, 20 bp, Homo sapiens
gaggctgaagtgtttttgct

SEQ ID NO: 7606998 - DNA, 22 bp, Homo sapiens
gaggctgaatggccagaagcca

SEQ ID NO: 7606999 - DNA, 22 bp, Homo sapiens
gaggctgaatggccagaagcca

SEQ ID NO: 7607000 - DNA, 20 bp, Homo sapiens
gaggctgaagtgtttttgct

SEQ ID NO: 7607001 - DNA, 22 bp, Homo sapiens
gaggctgaatggccagaagcca

SEQ ID NO: 7607002 - DNA, 22 bp, Homo sapiens
gaggctgacggcaccatcttct

SEQ ID NO: 7607003 - DNA, 22 bp, Homo sapiens
gaggctgaatggccagaagcca

SEQ ID NO: 7607004 - DNA, 22 bp, Homo sapiens
gaggctgaatggccagaagcca

SEQ ID NO: 7607005 - DNA, 22 bp, Homo sapiens
gaggctgacggcaccatcttct

SEQ ID NO: 7607006 - DNA, 22 bp, Homo sapiens
gaggctgacggcaccatcttct

SEQ ID NO: 7607007 - DNA, 22 bp, Homo sapiens
gaggctgagactctgaattttt

SEQ ID NO: 7607008 - DNA, 22 bp, Homo sapiens
gaggctgacggcaccatcttct

SEQ ID NO: 7607009 - DNA, 22 bp, Homo sapiens
gaggctgagactctgaattttt

SEQ ID NO: 7607010 - DNA, 22 bp, Homo sapiens
gaggctgagagtttgttctact

SEQ ID NO: 7607011 - DNA, 22 bp, Homo sapiens
gaggctgagagtttgttctact

SEQ ID NO: 7607012 - DNA, 22 bp, Homo sapiens
gaggctgagagtttgttctact

SEQ ID NO: 7607013 - DNA, 22 bp, Homo sapiens
gaggctgagagtttgttctact

SEQ ID NO: 7607014 - DNA, 22 bp, Homo sapiens
gaggctgagagtttgttctact

SEQ ID NO: 7607015 - DNA, 22 bp, Homo sapiens
gaggctgaggcaggaggatcac

SEQ ID NO: 7607016 - DNA, 22 bp, Homo sapiens
gaggctgagagtttgttctact

SEQ ID NO: 7607017 - DNA, 22 bp, Homo sapiens
gaggctgaggcaggaggatcac

SEQ ID NO: 7607018 - DNA, 22 bp, Homo sapiens
gaggctcagagaggtccacata

SEQ ID NO: 7607019 - DNA, 22 bp, Homo sapiens
gaggctcagagaggtccacata

SEQ ID NO: 7607020 - DNA, 22 bp, Homo sapiens
gaggctcagagaggtccacata

SEQ ID NO: 7607021 - DNA, 22 bp, Homo sapiens
gaggctcagagactttaagttt

SEQ ID NO: 7607022 - DNA, 22 bp, Homo sapiens
gaggctcagagactttaagttt

SEQ ID NO: 7607023 - DNA, 22 bp, Homo sapiens
gaggctcagagaagtcatggta

SEQ ID NO: 7607024 - DNA, 22 bp, Homo sapiens
gaggctcagagaagtcatggta

SEQ ID NO: 7607025 - DNA, 22 bp, Homo sapiens
gaggctcagagaagtcatggta

SEQ ID NO: 7607026 - DNA, 22 bp, Homo sapiens
gaggctcagagggagcatggtc

SEQ ID NO: 7607027 - DNA, 22 bp, Homo sapiens
gaggctcagagggactttcaag

SEQ ID NO: 7607028 - DNA, 22 bp, Homo sapiens
gaggctcagagggactttcaag

SEQ ID NO: 7607029 - DNA, 22 bp, Homo sapiens
gaggctcagagggagcatggtc

SEQ ID NO: 7607030 - DNA, 22 bp, Homo sapiens
gaggctcagagaggtccacata

SEQ ID NO: 7607031 - DNA, 22 bp, Homo sapiens
gaggctcagagaggtccacata

SEQ ID NO: 7607032 - DNA, 22 bp, Homo sapiens
gaggctcagagaggtccacata

SEQ ID NO: 7607033 - DNA, 22 bp, Homo sapiens
gaggctcagagggagcatggtc

SEQ ID NO: 7607034 - DNA, 22 bp, Homo sapiens
gaggctcagagtggttaaataa

SEQ ID NO: 7607035 - DNA, 22 bp, Homo sapiens
gaggctcagggaaacagcgcag

SEQ ID NO: 7607036 - DNA, 22 bp, Homo sapiens
gaggctcagggaaacagcgcag

SEQ ID NO: 7607037 - DNA, 22 bp, Homo sapiens
gaggctcagagggagcatggtc

SEQ ID NO: 7607038 - DNA, 22 bp, Homo sapiens
gaggctcagagtggttaaataa

SEQ ID NO: 7607039 - DNA, 22 bp, Homo sapiens
gaggctcagagggagcatggtc

SEQ ID NO: 7607040 - DNA, 22 bp, Homo sapiens
gaggctcagagggagcatggtc

SEQ ID NO: 7607041 - DNA, 22 bp, Homo sapiens
gaggctcagagggagcatggtc

SEQ ID NO: 7607042 - DNA, 22 bp, Homo sapiens
gaggctgaacaggttctcatga

SEQ ID NO: 7607043 - DNA, 22 bp, Homo sapiens
gaggctgaagtgtacatgggtg

SEQ ID NO: 7607044 - DNA, 22 bp, Homo sapiens
gaggctgaacaggttctcatga

SEQ ID NO: 7607045 - DNA, 22 bp, Homo sapiens
gaggctgaacaggttctcatga

SEQ ID NO: 7607046 - DNA, 22 bp, Homo sapiens
gaggctcagttattttagcctg

SEQ ID NO: 7607047 - DNA, 22 bp, Homo sapiens
gaggctcattgcattgtgcatt

SEQ ID NO: 7607048 - DNA, 22 bp, Homo sapiens
gaggctcattgcattgtgcatt

SEQ ID NO: 7607049 - DNA, 22 bp, Homo sapiens
gaggctcattgcattgtgcatt

SEQ ID NO: 7607050 - DNA, 22 bp, Homo sapiens
gaggctcagttatgtcatcagg

SEQ ID NO: 7607051 - DNA, 22 bp, Homo sapiens
gaggctcagttatgtcatcagg

SEQ ID NO: 7607052 - DNA, 22 bp, Homo sapiens
gaggctcagggaaacagcgcag

SEQ ID NO: 7607053 - DNA, 22 bp, Homo sapiens
gaggctcagggagtatatgaat

SEQ ID NO: 7607054 - DNA, 22 bp, Homo sapiens
gaggctcagggagtatatgaat

SEQ ID NO: 7607055 - DNA, 22 bp, Homo sapiens
gaggctcattgcattgtgcatt

SEQ ID NO: 7607056 - DNA, 22 bp, Homo sapiens
gaggctcagttatgtcatcagg

SEQ ID NO: 7607057 - DNA, 22 bp, Homo sapiens
gaggctcagttattttagcctg

SEQ ID NO: 7607058 - DNA, 22 bp, Homo sapiens
gaggctcagttattttagcctg

SEQ ID NO: 7607059 - DNA, 22 bp, Homo sapiens
gaggctcagttatgtcatcagg

SEQ ID NO: 7607060 - DNA, 22 bp, Homo sapiens
gaggcaggccctgaatgagtca

SEQ ID NO: 7607061 - DNA, 22 bp, Homo sapiens
gaggcaggccctgaatgagtca

SEQ ID NO: 7607062 - DNA, 22 bp, Homo sapiens
gaggcagggtgttgattacaga

SEQ ID NO: 7607063 - DNA, 22 bp, Homo sapiens
gaggcagggtgttgattacaga

SEQ ID NO: 7607064 - DNA, 22 bp, Homo sapiens
gaggcaggccctgaatgagtca

SEQ ID NO: 7607065 - DNA, 22 bp, Homo sapiens
gaggcagggtgttgattacaga

SEQ ID NO: 7607066 - DNA, 22 bp, Homo sapiens
gaggcaggccctgaatgagtca

SEQ ID NO: 7607067 - DNA, 22 bp, Homo sapiens
gaggcaggccctgaatgagtca

SEQ ID NO: 7607068 - DNA, 22 bp, Homo sapiens
gaggcaggccctgaatgagtca

SEQ ID NO: 7607069 - DNA, 22 bp, Homo sapiens
gaggcagggtgttgattacaga

SEQ ID NO: 7607070 - DNA, 22 bp, Homo sapiens
gaggcagggtgttgattacaga

SEQ ID NO: 7607071 - DNA, 22 bp, Homo sapiens
gaggcagggtgttgattacaga

SEQ ID NO: 7607072 - DNA, 22 bp, Homo sapiens
gaggcagggtgttgattacaga

SEQ ID NO: 7607073 - DNA, 22 bp, Homo sapiens
gaggcagtaattgtgggcaata

SEQ ID NO: 7607074 - DNA, 22 bp, Homo sapiens
gaggcagggtgttgattacaga

SEQ ID NO: 7607075 - DNA, 22 bp, Homo sapiens
gaggcagggtgttgattacaga

SEQ ID NO: 7607076 - DNA, 22 bp, Homo sapiens
gaggcagtgtcggtggcaggat

SEQ ID NO: 7607077 - DNA, 22 bp, Homo sapiens
gaggcagtgttgaaaaggagag

SEQ ID NO: 7607078 - DNA, 22 bp, Homo sapiens
gaggcagtgttgaaaaggagag

SEQ ID NO: 7607079 - DNA, 22 bp, Homo sapiens
gaggcagtgttgaaaaggagag

SEQ ID NO: 7607080 - DNA, 22 bp, Homo sapiens
gaggcagtgtcggtggcaggat

SEQ ID NO: 7607081 - DNA, 22 bp, Homo sapiens
gaggcagtgtcggtggcaggat

SEQ ID NO: 7607082 - DNA, 22 bp, Homo sapiens
gaggcagtgtcggtggcaggat

SEQ ID NO: 7607083 - DNA, 22 bp, Homo sapiens
gaggcagtgtcggtggcaggat

SEQ ID NO: 7607084 - DNA, 22 bp, Homo sapiens
gaggcagtgcattgtctagggg

SEQ ID NO: 7607085 - DNA, 22 bp, Homo sapiens
gaggcagtggtctgatgcaagg

SEQ ID NO: 7607086 - DNA, 22 bp, Homo sapiens
gaggcagtgcattgtctagggg

SEQ ID NO: 7607087 - DNA, 19 bp, Homo sapiens
gaggcagtagtcaaagctt

SEQ ID NO: 7607088 - DNA, 19 bp, Homo sapiens
gaggcagtagtcaaagctt

SEQ ID NO: 7607089 - DNA, 22 bp, Homo sapiens
gaggcagtaattgtgggcaata

SEQ ID NO: 7607090 - DNA, 22 bp, Homo sapiens
gaggcagtatagtcattaagta

SEQ ID NO: 7607091 - DNA, 19 bp, Homo sapiens
gaggcagtagtcaaagctt

SEQ ID NO: 7607092 - DNA, 22 bp, Homo sapiens
gaggcataaatcacagtgttca

SEQ ID NO: 7607093 - DNA, 22 bp, Homo sapiens
gaggcagtttgccatgccagga

SEQ ID NO: 7607094 - DNA, 22 bp, Homo sapiens
gaggcagtttgccatgccagga

SEQ ID NO: 7607095 - DNA, 22 bp, Homo sapiens
gaggcagtttgccatgccagga

SEQ ID NO: 7607096 - DNA, 22 bp, Homo sapiens
gaggcagtttgccatgccagga

SEQ ID NO: 7607097 - DNA, 22 bp, Homo sapiens
gaggcagtgtttactgccctgt

SEQ ID NO: 7607098 - DNA, 22 bp, Homo sapiens
gaggcagtgtttactgccctgt

SEQ ID NO: 7607099 - DNA, 22 bp, Homo sapiens
gaggcagttcctgagtgacaag

SEQ ID NO: 7607100 - DNA, 22 bp, Homo sapiens
gaggcagttcctgagtgacaag

SEQ ID NO: 7607101 - DNA, 22 bp, Homo sapiens
gaggcagttcctgagtgacaag

SEQ ID NO: 7607102 - DNA, 22 bp, Homo sapiens
gaggcagttcctgagtgacaag

SEQ ID NO: 7607103 - DNA, 22 bp, Homo sapiens
gaggcataagtagaagagattg

SEQ ID NO: 7607104 - DNA, 22 bp, Homo sapiens
gaggcatctgggcacagaagtg

SEQ ID NO: 7607105 - DNA, 22 bp, Homo sapiens
gaggctcaacccacaggggttg

SEQ ID NO: 7607106 - DNA, 22 bp, Homo sapiens
gaggctcaacccacaggggttg

SEQ ID NO: 7607107 - DNA, 22 bp, Homo sapiens
gaggctcaacccacaggggttg

SEQ ID NO: 7607108 - DNA, 22 bp, Homo sapiens
gaggctcaacccacaggggttg

SEQ ID NO: 7607109 - DNA, 22 bp, Homo sapiens
gaggctcacctagggagcactg

SEQ ID NO: 7607110 - DNA, 22 bp, Homo sapiens
gaggctcacctagggagcactg

SEQ ID NO: 7607111 - DNA, 22 bp, Homo sapiens
gaggctcacgacgggacgaact

SEQ ID NO: 7607112 - DNA, 22 bp, Homo sapiens
gaggctcacgacgggacgaact

SEQ ID NO: 7607113 - DNA, 22 bp, Homo sapiens
gaggctcactaggcatcctggg

SEQ ID NO: 7607114 - DNA, 22 bp, Homo sapiens
gaggctcactaggcatcctggg

SEQ ID NO: 7607115 - DNA, 22 bp, Homo sapiens
gaggctcacctagggagcactg

SEQ ID NO: 7607116 - DNA, 22 bp, Homo sapiens
gaggctcacctagggagcactg

SEQ ID NO: 7607117 - DNA, 22 bp, Homo sapiens
gaggctcacctagggagcactg

SEQ ID NO: 7607118 - DNA, 22 bp, Homo sapiens
gaggctcacgacgggacgaact

SEQ ID NO: 7607119 - DNA, 22 bp, Homo sapiens
gaggctcactttcatcctcttc

SEQ ID NO: 7607120 - DNA, 22 bp, Homo sapiens
gaggctcactaggcatcctggg

SEQ ID NO: 7607121 - DNA, 22 bp, Homo sapiens
gaggctcactttcatcctcttc

SEQ ID NO: 7607122 - DNA, 22 bp, Homo sapiens
gaggctcactgggcaaagactc

SEQ ID NO: 7607123 - DNA, 22 bp, Homo sapiens
gaggctcactgggcaaagactc

SEQ ID NO: 7607124 - DNA, 22 bp, Homo sapiens
gaggctcactgggcaaagactc

SEQ ID NO: 7607125 - DNA, 22 bp, Homo sapiens
gaggctcagagaagtcatggta

SEQ ID NO: 7607126 - DNA, 22 bp, Homo sapiens
gaggctcactttcatcctcttc

SEQ ID NO: 7607127 - DNA, 22 bp, Homo sapiens
gaggctcagagaagtcatggta

SEQ ID NO: 7607128 - DNA, 22 bp, Homo sapiens
gaggctcagagaagtcatggta

SEQ ID NO: 7607129 - DNA, 22 bp, Homo sapiens
gaggctcagagaagtcatggta

SEQ ID NO: 7607130 - DNA, 22 bp, Homo sapiens
gaggcagcttagggtactgact

SEQ ID NO: 7607131 - DNA, 22 bp, Homo sapiens
gaggcagcttagggtactgact

SEQ ID NO: 7607132 - DNA, 22 bp, Homo sapiens
gaggcagctgggtccggtcggg

SEQ ID NO: 7607133 - DNA, 16 bp, Homo sapiens
gaggagcccctctgcc

SEQ ID NO: 7607134 - DNA, 22 bp, Homo sapiens
gaggagccctgttccccaggcc

SEQ ID NO: 7607135 - DNA, 22 bp, Homo sapiens
gaggagcccccactgggctcac

SEQ ID NO: 7607136 - DNA, 22 bp, Homo sapiens
gaggagcccccactgggctcac

SEQ ID NO: 7607137 - DNA, 22 bp, Homo sapiens
gaggagccatagatagtgctgc

SEQ ID NO: 7607138 - DNA, 22 bp, Homo sapiens
gaggagccaggaggtctccctg

SEQ ID NO: 7607139 - DNA, 22 bp, Homo sapiens
gaggagcccagcaccatcactt

SEQ ID NO: 7607140 - DNA, 22 bp, Homo sapiens
gaggagcccccactgggctcac

SEQ ID NO: 7607141 - DNA, 22 bp, Homo sapiens
gaggagcccagcaccatcactt

SEQ ID NO: 7607142 - DNA, 20 bp, Homo sapiens
gaggagccaccttgagctgg

SEQ ID NO: 7607143 - DNA, 22 bp, Homo sapiens
gaggcagcttggggctgtgggt

SEQ ID NO: 7607144 - DNA, 22 bp, Homo sapiens
gaggcagcttggggctgtgggt

SEQ ID NO: 7607145 - DNA, 22 bp, Homo sapiens
gaggcaggaggattgcttgagc

SEQ ID NO: 7607146 - DNA, 22 bp, Homo sapiens
gaggcagcttggggctgtgggt

SEQ ID NO: 7607147 - DNA, 22 bp, Homo sapiens
gaggcaggaggattgcttgagc

SEQ ID NO: 7607148 - DNA, 22 bp, Homo sapiens
gaggcaggaggattgcttgagc

SEQ ID NO: 7607149 - DNA, 22 bp, Homo sapiens
gaggcaggaggattgcttgagc

SEQ ID NO: 7607150 - DNA, 22 bp, Homo sapiens
gaggcaggaggattgcttgagc

SEQ ID NO: 7607151 - DNA, 22 bp, Homo sapiens
gaggcaggaggattgcttgagc

SEQ ID NO: 7607152 - DNA, 22 bp, Homo sapiens
gaggcaggaggattgcttgagc

SEQ ID NO: 7607153 - DNA, 22 bp, Homo sapiens
gaggcagcttggggctgtgggt

SEQ ID NO: 7607154 - DNA, 22 bp, Homo sapiens
gaggcagcttagggtactgact

SEQ ID NO: 7607155 - DNA, 22 bp, Homo sapiens
gaggcagcttggggctgtgggt

SEQ ID NO: 7607156 - DNA, 22 bp, Homo sapiens
gaggcagcttggggctgtgggt

SEQ ID NO: 7607157 - DNA, 22 bp, Homo sapiens
gaggcagcttggggctgtgggt

SEQ ID NO: 7607158 - DNA, 22 bp, Homo sapiens
gaggcagcttagggtactgact

SEQ ID NO: 7607159 - DNA, 22 bp, Homo sapiens
gaggcaggaggattgcttgagc

SEQ ID NO: 7607160 - DNA, 22 bp, Homo sapiens
gaggcaggaggattgcttgagc

SEQ ID NO: 7607161 - DNA, 22 bp, Homo sapiens
gaggcaggcactgttatcagca

SEQ ID NO: 7607162 - DNA, 22 bp, Homo sapiens
gaggcaggaggattgcttgagc

SEQ ID NO: 7607163 - DNA, 22 bp, Homo sapiens
gaggcaggcactgttatcagca

SEQ ID NO: 7607164 - DNA, 22 bp, Homo sapiens
gaggcaggaggattgcttgagc

SEQ ID NO: 7607165 - DNA, 22 bp, Homo sapiens
gaggcaggcactgttatcagca

SEQ ID NO: 7607166 - DNA, 22 bp, Homo sapiens
gaggcaggcactgttatcagca

SEQ ID NO: 7607167 - DNA, 22 bp, Homo sapiens
gaggcaggcactgttatcagca

SEQ ID NO: 7607168 - DNA, 22 bp, Homo sapiens
gaggcaggcactgttatcagca

SEQ ID NO: 7607169 - DNA, 22 bp, Homo sapiens
gaggcaggcactgttatcagca

SEQ ID NO: 7607170 - DNA, 22 bp, Homo sapiens
gaggcaggcactgttatcagca

SEQ ID NO: 7607171 - DNA, 22 bp, Homo sapiens
gaggcaggcactgttatcagca

SEQ ID NO: 7607172 - DNA, 22 bp, Homo sapiens
gaggcaggcactgttatcagca

SEQ ID NO: 7607173 - DNA, 22 bp, Homo sapiens
gaggcaggcagattgcttgagg

SEQ ID NO: 7607174 - DNA, 22 bp, Homo sapiens
gaggcaggcagattgcttgagg

SEQ ID NO: 7607175 - DNA, 22 bp, Homo sapiens
gaggcaggccctgaatgagtca

SEQ ID NO: 7607176 - DNA, 22 bp, Homo sapiens
gaggcaggccctgaatgagtca

SEQ ID NO: 7607177 - DNA, 22 bp, Homo sapiens
gaggcaggccctgaatgagtca

SEQ ID NO: 7607178 - DNA, 22 bp, Homo sapiens
gaggcaggccctgaatgagtca

SEQ ID NO: 7607179 - DNA, 22 bp, Homo sapiens
gaggcaggcagattgcttgagg

SEQ ID NO: 7607180 - DNA, 22 bp, Homo sapiens
gaggcaggcagattgcttgagg

SEQ ID NO: 7607181 - DNA, 22 bp, Homo sapiens
gaggcaggcagattgcttgagg

SEQ ID NO: 7607182 - DNA, 22 bp, Homo sapiens
gaggcaggcagattgcttgagg

SEQ ID NO: 7607183 - DNA, 22 bp, Homo sapiens
gaggcaggcagattgcttgagg

SEQ ID NO: 7607184 - DNA, 22 bp, Homo sapiens
gaggcaggcagattgcttgagg

SEQ ID NO: 7607185 - DNA, 22 bp, Homo sapiens
gaggcaggcagattgcttgagg

SEQ ID NO: 7607186 - DNA, 22 bp, Homo sapiens
gaggcaggcagattgcttgagg

SEQ ID NO: 7607187 - DNA, 22 bp, Homo sapiens
gaggcaggcagattgcttgagg

SEQ ID NO: 7607188 - DNA, 22 bp, Homo sapiens
gaggagcatgggaaggctctgg

SEQ ID NO: 7607189 - DNA, 22 bp, Homo sapiens
gaggagcatgggaaggctctgg

SEQ ID NO: 7607190 - DNA, 22 bp, Homo sapiens
gaggagcatgggaaggctctgg

SEQ ID NO: 7607191 - DNA, 22 bp, Homo sapiens
gaggagccaaggtatgtgtgtt

SEQ ID NO: 7607192 - DNA, 22 bp, Homo sapiens
gaggagccaaggtatgtgtgtt

SEQ ID NO: 7607193 - DNA, 22 bp, Homo sapiens
gaggagccaaggtatgtgtgtt

SEQ ID NO: 7607194 - DNA, 20 bp, Homo sapiens
gaggagccaccttgagctgg

SEQ ID NO: 7607195 - DNA, 22 bp, Homo sapiens
gaggagccaaggtatgtgtgtt

SEQ ID NO: 7607196 - DNA, 22 bp, Homo sapiens
gaggagccaaggtatgtgtgtt

SEQ ID NO: 7607197 - DNA, 20 bp, Homo sapiens
gaggagccaccttgagctgg

SEQ ID NO: 7607198 - DNA, 22 bp, Homo sapiens
gaggagccaggaggtctccctg

SEQ ID NO: 7607199 - DNA, 22 bp, Homo sapiens
gaggagcatgggaaggctctgg

SEQ ID NO: 7607200 - DNA, 22 bp, Homo sapiens
gaggagcatgggaaggctctgg

SEQ ID NO: 7607201 - DNA, 22 bp, Homo sapiens
gaggagcatgggaaggctctgg

SEQ ID NO: 7607202 - DNA, 22 bp, Homo sapiens
gaggagcatgggaaggctctgg

SEQ ID NO: 7607203 - DNA, 22 bp, Homo sapiens
gaggagcatgggaaggctctgg

SEQ ID NO: 7607204 - DNA, 22 bp, Homo sapiens
gaggagcatgggaaggctctgg

SEQ ID NO: 7607205 - DNA, 22 bp, Homo sapiens
gaggagcacatgaggctgaggg

SEQ ID NO: 7607206 - DNA, 22 bp, Homo sapiens
gaggagcacatgaggctgaggg

SEQ ID NO: 7607207 - DNA, 22 bp, Homo sapiens
gaggagcatgggaaggctctgg

SEQ ID NO: 7607208 - DNA, 22 bp, Homo sapiens
gaggagcatgggaaggctctgg

SEQ ID NO: 7607209 - DNA, 22 bp, Homo sapiens
gaggagcacatgaggctgaggg

SEQ ID NO: 7607210 - DNA, 22 bp, Homo sapiens
gaggagcacatgaggctgaggg

SEQ ID NO: 7607211 - DNA, 22 bp, Homo sapiens
gaggagcacatgaggctgaggg

SEQ ID NO: 7607212 - DNA, 22 bp, Homo sapiens
gaggagcacatgaggctgaggg

SEQ ID NO: 7607213 - DNA, 22 bp, Homo sapiens
gaggagcacatgaggctgaggg

SEQ ID NO: 7607214 - DNA, 22 bp, Homo sapiens
gaggagcacatgaggctgaggg

SEQ ID NO: 7607215 - DNA, 22 bp, Homo sapiens
gaggagcacatgaggctgaggg

SEQ ID NO: 7607216 - DNA, 22 bp, Homo sapiens
gaggagcacatgaggctgaggg

SEQ ID NO: 7607217 - DNA, 22 bp, Homo sapiens
gaggagcacatgaggctgaggg

SEQ ID NO: 7607218 - DNA, 22 bp, Homo sapiens
gaggagcacatgaggctgaggg

SEQ ID NO: 7607219 - DNA, 22 bp, Homo sapiens
gaggagcaagaaatagtgccca

SEQ ID NO: 7607220 - DNA, 22 bp, Homo sapiens
gaggagcacatgaggctgaggg

SEQ ID NO: 7607221 - DNA, 22 bp, Homo sapiens
gaggagcacatgaggctgaggg

SEQ ID NO: 7607222 - DNA, 22 bp, Homo sapiens
gaggagcaagaaatagtgccca

SEQ ID NO: 7607223 - DNA, 22 bp, Homo sapiens
gaggagcaagaaatagtgccca

SEQ ID NO: 7607224 - DNA, 22 bp, Homo sapiens
gaggagcaagaaatagtgccca

SEQ ID NO: 7607225 - DNA, 22 bp, Homo sapiens
gaggagcaagaaatagtgccca

SEQ ID NO: 7607226 - DNA, 22 bp, Homo sapiens
gaggagcacatgaggctgaggg

SEQ ID NO: 7607227 - DNA, 22 bp, Homo sapiens
gaggagcacatgaggctgaggg

SEQ ID NO: 7607228 - DNA, 22 bp, Homo sapiens
gaggagaggggctcccaagagc

SEQ ID NO: 7607229 - DNA, 22 bp, Homo sapiens
gaggagaggggctcccaagagc

SEQ ID NO: 7607230 - DNA, 22 bp, Homo sapiens
gaggagagcctgcactttgacc

SEQ ID NO: 7607231 - DNA, 22 bp, Homo sapiens
gaggagaggccatcgttgttat

SEQ ID NO: 7607232 - DNA, 22 bp, Homo sapiens
gaggagaggccatcgttgttat

SEQ ID NO: 7607233 - DNA, 22 bp, Homo sapiens
gaggagagcctgcactttgacc

SEQ ID NO: 7607234 - DNA, 22 bp, Homo sapiens
gaggagagcctgcactttgacc

SEQ ID NO: 7607235 - DNA, 22 bp, Homo sapiens
gaggagagcctgcactttgacc

SEQ ID NO: 7607236 - DNA, 22 bp, Homo sapiens
gaggagagcctgcactttgacc

SEQ ID NO: 7607237 - DNA, 22 bp, Homo sapiens
gaggagagcctgcactttgacc

SEQ ID NO: 7607238 - DNA, 22 bp, Homo sapiens
gaggagagatggtagattgggt

SEQ ID NO: 7607239 - DNA, 22 bp, Homo sapiens
gaggagagatggtagattgggt

SEQ ID NO: 7607240 - DNA, 22 bp, Homo sapiens
gaggagagatggtagattgggt

SEQ ID NO: 7607241 - DNA, 22 bp, Homo sapiens
gaggagagatggtagattgggt

SEQ ID NO: 7607242 - DNA, 22 bp, Homo sapiens
gaggagagatggtagattgggt

SEQ ID NO: 7607243 - DNA, 22 bp, Homo sapiens
gaggagaggccatcgttgttat

SEQ ID NO: 7607244 - DNA, 22 bp, Homo sapiens
gaggagaggctggacgcggtga

SEQ ID NO: 7607245 - DNA, 22 bp, Homo sapiens
gaggagaggctggacgcggtga

SEQ ID NO: 7607246 - DNA, 22 bp, Homo sapiens
gaggagaggctggacgcggtga

SEQ ID NO: 7607247 - DNA, 22 bp, Homo sapiens
gaggagaggctggacgcggtga

SEQ ID NO: 7607248 - DNA, 22 bp, Homo sapiens
gaggagagggctgcgggcccac

SEQ ID NO: 7607249 - DNA, 22 bp, Homo sapiens
gaggagagggctgcgggcccac

SEQ ID NO: 7607250 - DNA, 22 bp, Homo sapiens
gaggagaggggctcccaagagc

SEQ ID NO: 7607251 - DNA, 22 bp, Homo sapiens
gaggagaggggctcccaagagc

SEQ ID NO: 7607252 - DNA, 22 bp, Homo sapiens
gaggagaggggctcccaagagc

SEQ ID NO: 7607253 - DNA, 22 bp, Homo sapiens
gaggagaggggctcccaagagc

SEQ ID NO: 7607254 - DNA, 22 bp, Homo sapiens
gaggagaggggctcccaagagc

SEQ ID NO: 7607255 - DNA, 22 bp, Homo sapiens
gaggagaggggctcccaagagc

SEQ ID NO: 7607256 - DNA, 22 bp, Homo sapiens
gaggagagggctgcgggcccac

SEQ ID NO: 7607257 - DNA, 22 bp, Homo sapiens
gaggagagggctgcgggcccac

SEQ ID NO: 7607258 - DNA, 22 bp, Homo sapiens
gaggagagggctgcgggcccac

SEQ ID NO: 7607259 - DNA, 22 bp, Homo sapiens
gaggagaggctggacgcggtga

SEQ ID NO: 7607260 - DNA, 22 bp, Homo sapiens
gagcagtgagtgaatgttgcct

SEQ ID NO: 7607261 - DNA, 22 bp, Homo sapiens
gagcagtgagtgaatgttgcct

SEQ ID NO: 7607262 - DNA, 22 bp, Homo sapiens
gagcagtgagtgaatgttgcct

SEQ ID NO: 7607263 - DNA, 19 bp, Homo sapiens
gagcagtgaggaccaccag

SEQ ID NO: 7607264 - DNA, 19 bp, Homo sapiens
gagcagtgaggaccaccag

SEQ ID NO: 7607265 - DNA, 22 bp, Homo sapiens
gagcaggcttgcagagaagggg

SEQ ID NO: 7607266 - DNA, 22 bp, Homo sapiens
gagcagggagacaactctggtg

SEQ ID NO: 7607267 - DNA, 22 bp, Homo sapiens
gagcagggagacaactctggtg

SEQ ID NO: 7607268 - DNA, 22 bp, Homo sapiens
gagcaggcttgcagagaagggg

SEQ ID NO: 7607269 - DNA, 22 bp, Homo sapiens
gagcagtgatgggaggacgtca

SEQ ID NO: 7607270 - DNA, 22 bp, Homo sapiens
gagcagtgatgggaggacgtca

SEQ ID NO: 7607271 - DNA, 22 bp, Homo sapiens
gagcagtgatgggaggacgtca

SEQ ID NO: 7607272 - DNA, 22 bp, Homo sapiens
gagcagtgagtgaatgttgcct

SEQ ID NO: 7607273 - DNA, 22 bp, Homo sapiens
gagcagtgggaaggaacagggt

SEQ ID NO: 7607274 - DNA, 22 bp, Homo sapiens
gagcagtgatgggaggacgtca

SEQ ID NO: 7607275 - DNA, 20 bp, Homo sapiens
gagcagtggagtttccaggg

SEQ ID NO: 7607276 - DNA, 22 bp, Homo sapiens
gagagggtgcctggaagccagg

SEQ ID NO: 7607277 - DNA, 22 bp, Homo sapiens
gagagggtgcctggaagccagg

SEQ ID NO: 7607278 - DNA, 22 bp, Homo sapiens
gagagggtgcctggaagccagg

SEQ ID NO: 7607279 - DNA, 22 bp, Homo sapiens
gagagggtgcctggaagccagg

SEQ ID NO: 7607280 - DNA, 22 bp, Homo sapiens
gagagggtgcctggaagccagg

SEQ ID NO: 7607281 - DNA, 22 bp, Homo sapiens
gagagggtgcctggaagccagg

SEQ ID NO: 7607282 - DNA, 22 bp, Homo sapiens
gagaggggtttgccatcctatg

SEQ ID NO: 7607283 - DNA, 22 bp, Homo sapiens
gagaggggtttgccatcctatg

SEQ ID NO: 7607284 - DNA, 22 bp, Homo sapiens
gagaggggtttgccatcctatg

SEQ ID NO: 7607285 - DNA, 22 bp, Homo sapiens
gagaggggtttgccatcctatg

SEQ ID NO: 7607286 - DNA, 22 bp, Homo sapiens
gagaggggtttgccatcctatg

SEQ ID NO: 7607287 - DNA, 22 bp, Homo sapiens
gagaggggtttgccatcctatg

SEQ ID NO: 7607288 - DNA, 22 bp, Homo sapiens
gagcaggctctgcctgtgtgtc

SEQ ID NO: 7607289 - DNA, 22 bp, Homo sapiens
gagaggtaatttgaagtgcaaa

SEQ ID NO: 7607290 - DNA, 22 bp, Homo sapiens
gagcaggcttgcagagaagggg

SEQ ID NO: 7607291 - DNA, 22 bp, Homo sapiens
gagcaggcttgcagagaagggg

SEQ ID NO: 7607292 - DNA, 22 bp, Homo sapiens
gagcaggcttgcagagaagggg

SEQ ID NO: 7607293 - DNA, 22 bp, Homo sapiens
gagcaggcttgcagagaagggg

SEQ ID NO: 7607294 - DNA, 22 bp, Homo sapiens
gagcaggcttgcagagaagggg

SEQ ID NO: 7607295 - DNA, 22 bp, Homo sapiens
gagagggctgcctggtgtgagg

SEQ ID NO: 7607296 - DNA, 22 bp, Homo sapiens
gagagggctggaaacttcctgg

SEQ ID NO: 7607297 - DNA, 22 bp, Homo sapiens
gagagggctggaaacttcctgg

SEQ ID NO: 7607298 - DNA, 22 bp, Homo sapiens
gagagggctggaaacttcctgg

SEQ ID NO: 7607299 - DNA, 22 bp, Homo sapiens
gagagggctgcctggtgtgagg

SEQ ID NO: 7607300 - DNA, 22 bp, Homo sapiens
gagagggctgcctggtgtgagg

SEQ ID NO: 7607301 - DNA, 22 bp, Homo sapiens
gagagggctgcctggtgtgagg

SEQ ID NO: 7607302 - DNA, 22 bp, Homo sapiens
gagagggctgcctggtgtgagg

SEQ ID NO: 7607303 - DNA, 22 bp, Homo sapiens
gagagggctggaaacttcctgg

SEQ ID NO: 7607304 - DNA, 22 bp, Homo sapiens
gagaggggacctgtgtgtctag

SEQ ID NO: 7607305 - DNA, 22 bp, Homo sapiens
gagaggggacctgtgtgtctag

SEQ ID NO: 7607306 - DNA, 22 bp, Homo sapiens
gagaggggacctgtgtgtctag

SEQ ID NO: 7607307 - DNA, 22 bp, Homo sapiens
gagaggggacctgtgtgtctag

SEQ ID NO: 7607308 - DNA, 22 bp, Homo sapiens
gagaggggacctgtgtgtctag

SEQ ID NO: 7607309 - DNA, 22 bp, Homo sapiens
gagaggggacctgtgtgtctag

SEQ ID NO: 7607310 - DNA, 22 bp, Homo sapiens
gagaggggcccaagccacatag

SEQ ID NO: 7607311 - DNA, 22 bp, Homo sapiens
gagaggggacctgtgtgtctag

SEQ ID NO: 7607312 - DNA, 22 bp, Homo sapiens
gagaggggcccaagccacatag

SEQ ID NO: 7607313 - DNA, 22 bp, Homo sapiens
gagaggggcgcgcagctcgcga

SEQ ID NO: 7607314 - DNA, 22 bp, Homo sapiens
gagaggggcgcgcagctcgcga

SEQ ID NO: 7607315 - DNA, 22 bp, Homo sapiens
gagaggggcgcgcagctcgcga

SEQ ID NO: 7607316 - DNA, 22 bp, Homo sapiens
gagaggggcgcgcagctcgcga

SEQ ID NO: 7607317 - DNA, 22 bp, Homo sapiens
gagaggggcgcgcagctcgcga

SEQ ID NO: 7607318 - DNA, 22 bp, Homo sapiens
gagaggggcgcgcagctcgcga

SEQ ID NO: 7607319 - DNA, 22 bp, Homo sapiens
gagaggggtttgccatcctatg

SEQ ID NO: 7607320 - DNA, 22 bp, Homo sapiens
gagaggggcgcgcagctcgcga

SEQ ID NO: 7607321 - DNA, 22 bp, Homo sapiens
gagaggggcgcgcagctcgcga

SEQ ID NO: 7607322 - DNA, 22 bp, Homo sapiens
gagaggggcgcgcagctcgcga

SEQ ID NO: 7607323 - DNA, 22 bp, Homo sapiens
gagaggggcgcgcagctcgcga

SEQ ID NO: 7607324 - DNA, 22 bp, Homo sapiens
gagaggggcgcgcagctcgcga

SEQ ID NO: 7607325 - DNA, 22 bp, Homo sapiens
gagaggggcgcgcagctcgcga

SEQ ID NO: 7607326 - DNA, 22 bp, Homo sapiens
gagaggggcgcgcagctcgcga

SEQ ID NO: 7607327 - DNA, 22 bp, Homo sapiens
gagaggggcccaagccacatag

SEQ ID NO: 7607328 - DNA, 22 bp, Homo sapiens
gagaggggcccaagccacatag

SEQ ID NO: 7607329 - DNA, 22 bp, Homo sapiens
gagaggggcccaagccacatag

SEQ ID NO: 7607330 - DNA, 22 bp, Homo sapiens
gagaggggcgcgcagctcgcga

SEQ ID NO: 7607331 - DNA, 22 bp, Homo sapiens
gagaggggcccaagccacatag

SEQ ID NO: 7607332 - DNA, 22 bp, Homo sapiens
gagaggggcccaagccacatag

SEQ ID NO: 7607333 - DNA, 22 bp, Homo sapiens
gagaggggcccaagccacatag

SEQ ID NO: 7607334 - DNA, 22 bp, Homo sapiens
gagaggggcccaagccacatag

SEQ ID NO: 7607335 - DNA, 22 bp, Homo sapiens
gagaggggcccaagccacatag

SEQ ID NO: 7607336 - DNA, 22 bp, Homo sapiens
gagcagtgtttgtggacctgga

SEQ ID NO: 7607337 - DNA, 22 bp, Homo sapiens
gagcagttatttttagacatga

SEQ ID NO: 7607338 - DNA, 22 bp, Homo sapiens
gagcagttatttttagacatga

SEQ ID NO: 7607339 - DNA, 22 bp, Homo sapiens
gagcagttatttttagacatga

SEQ ID NO: 7607340 - DNA, 22 bp, Homo sapiens
gagcagtgtttgtggacctgga

SEQ ID NO: 7607341 - DNA, 22 bp, Homo sapiens
gagcagtgtttgtggacctgga

SEQ ID NO: 7607342 - DNA, 22 bp, Homo sapiens
gagcagttgggctctaggaagt

SEQ ID NO: 7607343 - DNA, 22 bp, Homo sapiens
gagcagttctccttggtagggg

SEQ ID NO: 7607344 - DNA, 22 bp, Homo sapiens
gagcagttctccttggtagggg

SEQ ID NO: 7607345 - DNA, 22 bp, Homo sapiens
gagcagttctccttggtagggg

SEQ ID NO: 7607346 - DNA, 22 bp, Homo sapiens
gagcataggacacagaggtgtg

SEQ ID NO: 7607347 - DNA, 22 bp, Homo sapiens
gagcagttttatttcatgagac

SEQ ID NO: 7607348 - DNA, 22 bp, Homo sapiens
gagcagttttatttcatgagac

SEQ ID NO: 7607349 - DNA, 22 bp, Homo sapiens
gagcagttttatttcatgagac

SEQ ID NO: 7607350 - DNA, 22 bp, Homo sapiens
gagcagttttatttcatgagac

SEQ ID NO: 7607351 - DNA, 22 bp, Homo sapiens
gagcagttgggctctaggaagt

SEQ ID NO: 7607352 - DNA, 22 bp, Homo sapiens
gagcatccagaggtgttttctc

SEQ ID NO: 7607353 - DNA, 22 bp, Homo sapiens
gagcatccatgactttggcttt

SEQ ID NO: 7607354 - DNA, 22 bp, Homo sapiens
gagcatccacaaagtttggtgt

SEQ ID NO: 7607355 - DNA, 22 bp, Homo sapiens
gagcatcactgtcctctccccg

SEQ ID NO: 7607356 - DNA, 22 bp, Homo sapiens
gagcatctatgtgctgggtact

SEQ ID NO: 7607357 - DNA, 22 bp, Homo sapiens
gagcatcgctgagatcccagac

SEQ ID NO: 7607358 - DNA, 22 bp, Homo sapiens
gagcatcgctgagatcccagac

SEQ ID NO: 7607359 - DNA, 22 bp, Homo sapiens
gagcatctgatgagattggatt

SEQ ID NO: 7607360 - DNA, 22 bp, Homo sapiens
gagcatctctatagtgactgtg

SEQ ID NO: 7607361 - DNA, 21 bp, Homo sapiens
gagcatctccttcctcctgct

SEQ ID NO: 7607362 - DNA, 22 bp, Homo sapiens
gagcatctcctacctactcctt

SEQ ID NO: 7607363 - DNA, 22 bp, Homo sapiens
gagcagtggttgaacagaggca

SEQ ID NO: 7607364 - DNA, 22 bp, Homo sapiens
gagcagtggtggtgtgttagag

SEQ ID NO: 7607365 - DNA, 22 bp, Homo sapiens
gagcagtggttgaacagaggca

SEQ ID NO: 7607366 - DNA, 22 bp, Homo sapiens
gagcagtgtttgtggacctgga

SEQ ID NO: 7607367 - DNA, 22 bp, Homo sapiens
gagcagtgtttgtggacctgga

SEQ ID NO: 7607368 - DNA, 22 bp, Homo sapiens
gagcagtgggaaggaacagggt

SEQ ID NO: 7607369 - DNA, 22 bp, Homo sapiens
gagcagtggtcacagggaggga

SEQ ID NO: 7607370 - DNA, 22 bp, Homo sapiens
gagcagtggtcacagggaggga

SEQ ID NO: 7607371 - DNA, 22 bp, Homo sapiens
gagcagtgggaaggaacagggt

SEQ ID NO: 7607372 - DNA, 22 bp, Homo sapiens
gagcagtggtcacagggaggga

SEQ ID NO: 7607373 - DNA, 22 bp, Homo sapiens
gagcagtggtctgatcttctaa

SEQ ID NO: 7607374 - DNA, 22 bp, Homo sapiens
gagcagtggtcacagggaggga

SEQ ID NO: 7607375 - DNA, 22 bp, Homo sapiens
gagcatggctgcctccctgtgc

SEQ ID NO: 7607376 - DNA, 22 bp, Homo sapiens
gagcatggctgcctccctgtgc

SEQ ID NO: 7607377 - DNA, 21 bp, Homo sapiens
gagcatggcttacatcagcag

SEQ ID NO: 7607378 - DNA, 21 bp, Homo sapiens
gagcatggcttacatcagcag

SEQ ID NO: 7607379 - DNA, 22 bp, Homo sapiens
gagcatggcagctgagggcagg

SEQ ID NO: 7607380 - DNA, 22 bp, Homo sapiens
gagcatggcagctgagggcagg

SEQ ID NO: 7607381 - DNA, 22 bp, Homo sapiens
gagcatggcagctgagggcagg

SEQ ID NO: 7607382 - DNA, 22 bp, Homo sapiens
gagcatggcagctgagggcagg

SEQ ID NO: 7607383 - DNA, 22 bp, Homo sapiens
gagcatggatcatgtgctgggt

SEQ ID NO: 7607384 - DNA, 18 bp, Homo sapiens
gagcatgggcagtgggga

SEQ ID NO: 7607385 - DNA, 18 bp, Homo sapiens
gagcatgggcagtgggga

SEQ ID NO: 7607386 - DNA, 18 bp, Homo sapiens
gagcatgggcagtgggga

SEQ ID NO: 7607387 - DNA, 18 bp, Homo sapiens
gagcatgggcagtgggga

SEQ ID NO: 7607388 - DNA, 18 bp, Homo sapiens
gagcatgggcagtgggga

SEQ ID NO: 7607389 - DNA, 22 bp, Homo sapiens
gagcatggtgcttcagtgaagg

SEQ ID NO: 7607390 - DNA, 18 bp, Homo sapiens
gagcatgggcagtgggga

SEQ ID NO: 7607391 - DNA, 18 bp, Homo sapiens
gagcatgggcagtgggga

SEQ ID NO: 7607392 - DNA, 16 bp, Homo sapiens
gagcatggtggcgggc

SEQ ID NO: 7607393 - DNA, 22 bp, Homo sapiens
gagcatggtgcttcagtgaagg

SEQ ID NO: 7607394 - DNA, 22 bp, Homo sapiens
gagcatgagggaaggcagcaga

SEQ ID NO: 7607395 - DNA, 22 bp, Homo sapiens
gagcatgagggaaggcagcaga

SEQ ID NO: 7607396 - DNA, 22 bp, Homo sapiens
gagcatgagggaaggcagcaga

SEQ ID NO: 7607397 - DNA, 22 bp, Homo sapiens
gagcatgagggaaggcagcaga

SEQ ID NO: 7607398 - DNA, 19 bp, Homo sapiens
gagcatgactggccttgca

SEQ ID NO: 7607399 - DNA, 22 bp, Homo sapiens
gagcatcttgttcccaacttct

SEQ ID NO: 7607400 - DNA, 19 bp, Homo sapiens
gagcatgactggccttgca

SEQ ID NO: 7607401 - DNA, 22 bp, Homo sapiens
gagcatctgtggtccatcagaa

SEQ ID NO: 7607402 - DNA, 22 bp, Homo sapiens
gagcatctgtggtccatcagaa

SEQ ID NO: 7607403 - DNA, 22 bp, Homo sapiens
gagcatctgtggtccatcagaa

SEQ ID NO: 7607404 - DNA, 22 bp, Homo sapiens
gagcatctgtggtccatcagaa

SEQ ID NO: 7607405 - DNA, 20 bp, Homo sapiens
gagcatctgtctgctgtgca

SEQ ID NO: 7607406 - DNA, 22 bp, Homo sapiens
gagcatctggctagaggagtga

SEQ ID NO: 7607407 - DNA, 22 bp, Homo sapiens
gagcatggatagaaggtgggat

SEQ ID NO: 7607408 - DNA, 22 bp, Homo sapiens
gagcatggatagaaggtgggat

SEQ ID NO: 7607409 - DNA, 22 bp, Homo sapiens
gagcatggatagaaggtgggat

SEQ ID NO: 7607410 - DNA, 22 bp, Homo sapiens
gagcatggatagaaggtgggat

SEQ ID NO: 7607411 - DNA, 22 bp, Homo sapiens
gagcatggatcatgtgctgggt

SEQ ID NO: 7607412 - DNA, 22 bp, Homo sapiens
gagcatggatcatgtgctgggt

SEQ ID NO: 7607413 - DNA, 22 bp, Homo sapiens
gagcatggatcatgtgctgggt

SEQ ID NO: 7607414 - DNA, 22 bp, Homo sapiens
gagcatggatagaaggtgggat

SEQ ID NO: 7607415 - DNA, 22 bp, Homo sapiens
gagcatggatagaaggtgggat

SEQ ID NO: 7607416 - DNA, 22 bp, Homo sapiens
gagcccagctgtccttggcaaa

SEQ ID NO: 7607417 - DNA, 22 bp, Homo sapiens
gagcccagctgtccttggcaaa

SEQ ID NO: 7607418 - DNA, 22 bp, Homo sapiens
gagcccagctgtccttggcaaa

SEQ ID NO: 7607419 - DNA, 22 bp, Homo sapiens
gagcccagctgtccttggcaaa

SEQ ID NO: 7607420 - DNA, 22 bp, Homo sapiens
gagcccagctgtccttggcaaa

SEQ ID NO: 7607421 - DNA, 22 bp, Homo sapiens
gagcccagctgtccttggcaaa

SEQ ID NO: 7607422 - DNA, 22 bp, Homo sapiens
gagcccagctgtccttggcaaa

SEQ ID NO: 7607423 - DNA, 22 bp, Homo sapiens
gagcccagctgcggccctcagc

SEQ ID NO: 7607424 - DNA, 22 bp, Homo sapiens
gagcccagctgcggccctcagc

SEQ ID NO: 7607425 - DNA, 22 bp, Homo sapiens
gagcccagcttgcacatggagc

SEQ ID NO: 7607426 - DNA, 22 bp, Homo sapiens
gagcccagcttgcacatggagc

SEQ ID NO: 7607427 - DNA, 22 bp, Homo sapiens
gagcccagctgtccttggcaaa

SEQ ID NO: 7607428 - DNA, 22 bp, Homo sapiens
gagcccagcttgcacatggagc

SEQ ID NO: 7607429 - DNA, 22 bp, Homo sapiens
gagcccagcttgcacatggagc

SEQ ID NO: 7607430 - DNA, 22 bp, Homo sapiens
gagcccagcttgcacatggagc

SEQ ID NO: 7607431 - DNA, 22 bp, Homo sapiens
gagcccaggaagtggaggctga

SEQ ID NO: 7607432 - DNA, 22 bp, Homo sapiens
gagcccagcttgcacatggagc

SEQ ID NO: 7607433 - DNA, 22 bp, Homo sapiens
gagcccaggaagtggaggctga

SEQ ID NO: 7607434 - DNA, 22 bp, Homo sapiens
gagcccaggaagtggaggctga

SEQ ID NO: 7607435 - DNA, 22 bp, Homo sapiens
gagcccaggagtttgatgctgc

SEQ ID NO: 7607436 - DNA, 22 bp, Homo sapiens
gagcccaggagtttgatgctgc

SEQ ID NO: 7607437 - DNA, 22 bp, Homo sapiens
gagcccaggagtttgatgctgc

SEQ ID NO: 7607438 - DNA, 22 bp, Homo sapiens
gagcccaggagtttgatgctgc

SEQ ID NO: 7607439 - DNA, 22 bp, Homo sapiens
gagcccaggagtttgatgctgc

SEQ ID NO: 7607440 - DNA, 22 bp, Homo sapiens
gagcccaggaagtggaggctga

SEQ ID NO: 7607441 - DNA, 22 bp, Homo sapiens
gagcccaggaagtggaggctga

SEQ ID NO: 7607442 - DNA, 22 bp, Homo sapiens
gagcccaggaagtggaggctga

SEQ ID NO: 7607443 - DNA, 22 bp, Homo sapiens
gagcccaggaagtggaggctga

SEQ ID NO: 7607444 - DNA, 22 bp, Homo sapiens
gagcccaggaagtggaggctga

SEQ ID NO: 7607445 - DNA, 22 bp, Homo sapiens
gagcccaggaagtggaggctga

SEQ ID NO: 7607446 - DNA, 22 bp, Homo sapiens
gagcccaggaagtggaggctga

SEQ ID NO: 7607447 - DNA, 22 bp, Homo sapiens
gagcccaggaagtggaggctga

SEQ ID NO: 7607448 - DNA, 22 bp, Homo sapiens
gagcccagctctacctcagact

SEQ ID NO: 7607449 - DNA, 22 bp, Homo sapiens
gagcccagctctacctcagact

SEQ ID NO: 7607450 - DNA, 22 bp, Homo sapiens
gagcccagctctacctcagact

SEQ ID NO: 7607451 - DNA, 22 bp, Homo sapiens
gagcccagctctacctcagact

SEQ ID NO: 7607452 - DNA, 22 bp, Homo sapiens
gagcccagctctacctcagact

SEQ ID NO: 7607453 - DNA, 22 bp, Homo sapiens
gagcccagctaaatttatataa

SEQ ID NO: 7607454 - DNA, 22 bp, Homo sapiens
gagcccagcccagagccatatg

SEQ ID NO: 7607455 - DNA, 22 bp, Homo sapiens
gagcccagcccagagccatatg

SEQ ID NO: 7607456 - DNA, 22 bp, Homo sapiens
gagcccagcccagagccatatg

SEQ ID NO: 7607457 - DNA, 22 bp, Homo sapiens
gagcccagctgcggccctcagc

SEQ ID NO: 7607458 - DNA, 22 bp, Homo sapiens
gagcccagctgcggccctcagc

SEQ ID NO: 7607459 - DNA, 22 bp, Homo sapiens
gagcccagctgcggccctcagc

SEQ ID NO: 7607460 - DNA, 22 bp, Homo sapiens
gagcccagctctacctcagact

SEQ ID NO: 7607461 - DNA, 22 bp, Homo sapiens
gagcccagctgcggccctcagc

SEQ ID NO: 7607462 - DNA, 22 bp, Homo sapiens
gagcccagctgcggccctcagc

SEQ ID NO: 7607463 - DNA, 22 bp, Homo sapiens
gagcccagctgcggccctcagc

SEQ ID NO: 7607464 - DNA, 22 bp, Homo sapiens
gagcccagctctacctcagact

SEQ ID NO: 7607465 - DNA, 22 bp, Homo sapiens
gagcccagctctacctcagact

SEQ ID NO: 7607466 - DNA, 22 bp, Homo sapiens
gagccaggtttgaatctcagtc

SEQ ID NO: 7607467 - DNA, 22 bp, Homo sapiens
gagccaggtttgaatctcagtc

SEQ ID NO: 7607468 - DNA, 22 bp, Homo sapiens
gagccaggtttgaatctcagtc

SEQ ID NO: 7607469 - DNA, 22 bp, Homo sapiens
gagcatttttgtctgcatttta

SEQ ID NO: 7607470 - DNA, 22 bp, Homo sapiens
gagccaggtttgaatctcagtc

SEQ ID NO: 7607471 - DNA, 22 bp, Homo sapiens
gagcatttggttatagtaattt

SEQ ID NO: 7607472 - DNA, 22 bp, Homo sapiens
gagcatttggttatagtaattt

SEQ ID NO: 7607473 - DNA, 22 bp, Homo sapiens
gagcatttttgtctgcatttta

SEQ ID NO: 7607474 - DNA, 22 bp, Homo sapiens
gagcatggttccataggttggt

SEQ ID NO: 7607475 - DNA, 22 bp, Homo sapiens
gagcatggttccataggttggt

SEQ ID NO: 7607476 - DNA, 22 bp, Homo sapiens
gagcccagcccagagccatatg

SEQ ID NO: 7607477 - DNA, 22 bp, Homo sapiens
gagcccagattggaatttccca

SEQ ID NO: 7607478 - DNA, 22 bp, Homo sapiens
gagccagtgatcagacagggag

SEQ ID NO: 7607479 - DNA, 22 bp, Homo sapiens
gagcccagattggaatttccca

SEQ ID NO: 7607480 - DNA, 20 bp, Homo sapiens
gagcccaagtagggagaaat

SEQ ID NO: 7607481 - DNA, 22 bp, Homo sapiens
gagccatacaacctataaagtg

SEQ ID NO: 7607482 - DNA, 22 bp, Homo sapiens
gagccatacaacctataaagtg

SEQ ID NO: 7607483 - DNA, 22 bp, Homo sapiens
gagccattgtccaagcctgttt

SEQ ID NO: 7607484 - DNA, 22 bp, Homo sapiens
gagccagtgatcagacagggag

SEQ ID NO: 7607485 - DNA, 22 bp, Homo sapiens
gagccagtgatcagacagggag

SEQ ID NO: 7607486 - DNA, 22 bp, Homo sapiens
gagcccaggttctgcttccagc

SEQ ID NO: 7607487 - DNA, 22 bp, Homo sapiens
gagcccaggttctgcttccagc

SEQ ID NO: 7607488 - DNA, 22 bp, Homo sapiens
gagcccaggttctgcttccagc

SEQ ID NO: 7607489 - DNA, 22 bp, Homo sapiens
gagcccaggttctgcttccagc

SEQ ID NO: 7607490 - DNA, 22 bp, Homo sapiens
gagcccaggttctgcttccagc

SEQ ID NO: 7607491 - DNA, 22 bp, Homo sapiens
gagcccaggttctgcttccagc

SEQ ID NO: 7607492 - DNA, 22 bp, Homo sapiens
gagcccaggttctgcttccagc

SEQ ID NO: 7607493 - DNA, 22 bp, Homo sapiens
gagcccagtaggcaaagctgca

SEQ ID NO: 7607494 - DNA, 22 bp, Homo sapiens
gagcccagtaggcaaagctgca

SEQ ID NO: 7607495 - DNA, 22 bp, Homo sapiens
gagcccagtctgctcctgcgcc

SEQ ID NO: 7607496 - DNA, 22 bp, Homo sapiens
gagcccagtctgctcctgcgcc

SEQ ID NO: 7607497 - DNA, 22 bp, Homo sapiens
gagcccagtctgctcctgcgcc

SEQ ID NO: 7607498 - DNA, 22 bp, Homo sapiens
gagcccagtaggcaaagctgca

SEQ ID NO: 7607499 - DNA, 22 bp, Homo sapiens
gagcccagtaggcaaagctgca

SEQ ID NO: 7607500 - DNA, 22 bp, Homo sapiens
gagcccagtaggcaaagctgca

SEQ ID NO: 7607501 - DNA, 22 bp, Homo sapiens
gagcccagtaggcaaagctgca

SEQ ID NO: 7607502 - DNA, 22 bp, Homo sapiens
gagcccagtaggcaaagctgca

SEQ ID NO: 7607503 - DNA, 22 bp, Homo sapiens
gagccctgaacaacagcaggaa

SEQ ID NO: 7607504 - DNA, 22 bp, Homo sapiens
gagccctgaacaacagcaggaa

SEQ ID NO: 7607505 - DNA, 22 bp, Homo sapiens
gagccctgaacaacagcaggaa

SEQ ID NO: 7607506 - DNA, 22 bp, Homo sapiens
gagccctgaacaacagcaggaa

SEQ ID NO: 7607507 - DNA, 22 bp, Homo sapiens
gagccctgaacaacagcaggaa

SEQ ID NO: 7607508 - DNA, 22 bp, Homo sapiens
gagccctgaacaacagcaggaa

SEQ ID NO: 7607509 - DNA, 22 bp, Homo sapiens
gagccctgaacaacagcaggaa

SEQ ID NO: 7607510 - DNA, 22 bp, Homo sapiens
gagcccagtaggcaaagctgca

SEQ ID NO: 7607511 - DNA, 22 bp, Homo sapiens
gagccctgaacaacagcaggaa

SEQ ID NO: 7607512 - DNA, 22 bp, Homo sapiens
gagccctgaacaacagcaggaa

SEQ ID NO: 7607513 - DNA, 22 bp, Homo sapiens
gagccctgaacaacagcaggaa

SEQ ID NO: 7607514 - DNA, 22 bp, Homo sapiens
gagccctgagagttgtgaggcc

SEQ ID NO: 7607515 - DNA, 22 bp, Homo sapiens
gagccctgagagttgtgaggcc

SEQ ID NO: 7607516 - DNA, 22 bp, Homo sapiens
gagccctgagagttgtgaggcc

SEQ ID NO: 7607517 - DNA, 22 bp, Homo sapiens
gagccctgacactgagggagtt

SEQ ID NO: 7607518 - DNA, 22 bp, Homo sapiens
gagccctgacactgagggagtt

SEQ ID NO: 7607519 - DNA, 22 bp, Homo sapiens
gagccctgacactgagggagtt

SEQ ID NO: 7607520 - DNA, 22 bp, Homo sapiens
gagccctgacactgagggagtt

SEQ ID NO: 7607521 - DNA, 22 bp, Homo sapiens
gagccctgacactgagggagtt

SEQ ID NO: 7607522 - DNA, 22 bp, Homo sapiens
gagccctgacactgagggagtt

SEQ ID NO: 7607523 - DNA, 22 bp, Homo sapiens
gagccctgacactgagggagtt

SEQ ID NO: 7607524 - DNA, 22 bp, Homo sapiens
gagccctgacactgagggagtt

SEQ ID NO: 7607525 - DNA, 21 bp, Homo sapiens
gagcccaggcatctcattaat

SEQ ID NO: 7607526 - DNA, 21 bp, Homo sapiens
gagcccaggcatctcattaat

SEQ ID NO: 7607527 - DNA, 22 bp, Homo sapiens
gagcccaggcagaggttgcagt

SEQ ID NO: 7607528 - DNA, 22 bp, Homo sapiens
gagcccaggcagaggttgcagt

SEQ ID NO: 7607529 - DNA, 22 bp, Homo sapiens
gagcccaggcagaggttgcagt

SEQ ID NO: 7607530 - DNA, 21 bp, Homo sapiens
gagcccaggcatctcattaat

SEQ ID NO: 7607531 - DNA, 22 bp, Homo sapiens
gagcccaggctggggttcagag

SEQ ID NO: 7607532 - DNA, 22 bp, Homo sapiens
gagcccaggctggggttcagag

SEQ ID NO: 7607533 - DNA, 22 bp, Homo sapiens
gagcccaggctggggttcagag

SEQ ID NO: 7607534 - DNA, 22 bp, Homo sapiens
gagcccaggctggggttcagag

SEQ ID NO: 7607535 - DNA, 22 bp, Homo sapiens
gagcccaggctggggttcagag

SEQ ID NO: 7607536 - DNA, 22 bp, Homo sapiens
gagcccaggcagaggttgcagt

SEQ ID NO: 7607537 - DNA, 22 bp, Homo sapiens
gagcccaggcagaggttgcagt

SEQ ID NO: 7607538 - DNA, 22 bp, Homo sapiens
gagcccaggcagaggttgcagt

SEQ ID NO: 7607539 - DNA, 22 bp, Homo sapiens
gagcccaggcagaggttgcagt

SEQ ID NO: 7607540 - DNA, 22 bp, Homo sapiens
gagcccaggcagaggttgcagt

SEQ ID NO: 7607541 - DNA, 22 bp, Homo sapiens
gagcccaggatggtgtatggct

SEQ ID NO: 7607542 - DNA, 22 bp, Homo sapiens
gagcccaggatggtgtatggct

SEQ ID NO: 7607543 - DNA, 22 bp, Homo sapiens
gagcccaggatggtgtatggct

SEQ ID NO: 7607544 - DNA, 22 bp, Homo sapiens
gagcccaggatggtgtatggct

SEQ ID NO: 7607545 - DNA, 22 bp, Homo sapiens
gagcccaggatggtgtatggct

SEQ ID NO: 7607546 - DNA, 22 bp, Homo sapiens
gagcccaggatggtgtatggct

SEQ ID NO: 7607547 - DNA, 22 bp, Homo sapiens
gagcccagggtgaaatagcagc

SEQ ID NO: 7607548 - DNA, 22 bp, Homo sapiens
gagcccagggtgaaatagcagc

SEQ ID NO: 7607549 - DNA, 22 bp, Homo sapiens
gagcccagggtgaaatagcagc

SEQ ID NO: 7607550 - DNA, 22 bp, Homo sapiens
gagcccagggcaggcaaggcag

SEQ ID NO: 7607551 - DNA, 22 bp, Homo sapiens
gagcccagggcaggcaaggcag

SEQ ID NO: 7607552 - DNA, 22 bp, Homo sapiens
gagcccagggtgaaatagcagc

SEQ ID NO: 7607553 - DNA, 22 bp, Homo sapiens
gagcccagggtgaaatagcagc

SEQ ID NO: 7607554 - DNA, 22 bp, Homo sapiens
gagcccagggtgaaatagcagc

SEQ ID NO: 7607555 - DNA, 22 bp, Homo sapiens
gagcccagggtgaaatagcagc

SEQ ID NO: 7607556 - DNA, 22 bp, Homo sapiens
gagcccagggcaggcaaggcag

SEQ ID NO: 7607557 - DNA, 22 bp, Homo sapiens
gagcccagggcaggcaaggcag

SEQ ID NO: 7607558 - DNA, 22 bp, Homo sapiens
gagcccagggcaggcaaggcag

SEQ ID NO: 7607559 - DNA, 22 bp, Homo sapiens
gagcccaggctggggttcagag

SEQ ID NO: 7607560 - DNA, 22 bp, Homo sapiens
gagcccaggctggggttcagag

SEQ ID NO: 7607561 - DNA, 22 bp, Homo sapiens
gagcccaggctggggttcagag

SEQ ID NO: 7607562 - DNA, 22 bp, Homo sapiens
gagcccaggctggggttcagag

SEQ ID NO: 7607563 - DNA, 22 bp, Homo sapiens
gagcccagggcaggcaaggcag

SEQ ID NO: 7607564 - DNA, 22 bp, Homo sapiens
gagcccagggcaggcaaggcag

SEQ ID NO: 7607565 - DNA, 22 bp, Homo sapiens
gagcccagggcaggcaaggcag

SEQ ID NO: 7607566 - DNA, 22 bp, Homo sapiens
gagcccagggcaggcaaggcag

SEQ ID NO: 7607567 - DNA, 18 bp, Homo sapiens
gagccctgagtctgcaca

SEQ ID NO: 7607568 - DNA, 18 bp, Homo sapiens
gagccctgagtctgcaca

SEQ ID NO: 7607569 - DNA, 18 bp, Homo sapiens
gagccctgagtctgcaca

SEQ ID NO: 7607570 - DNA, 18 bp, Homo sapiens
gagccctgagtctgcaca

SEQ ID NO: 7607571 - DNA, 18 bp, Homo sapiens
gagccctgagtctgcaca

SEQ ID NO: 7607572 - DNA, 18 bp, Homo sapiens
gagccctgagtctgcaca

SEQ ID NO: 7607573 - DNA, 18 bp, Homo sapiens
gagccctgagtctgcaca

SEQ ID NO: 7607574 - DNA, 18 bp, Homo sapiens
gagccctgagtctgcaca

SEQ ID NO: 7607575 - DNA, 22 bp, Homo sapiens
gagccctgagagttgtgaggcc

SEQ ID NO: 7607576 - DNA, 22 bp, Homo sapiens
gagccctgcccacttgtctgag

SEQ ID NO: 7607577 - DNA, 22 bp, Homo sapiens
gagccctgcccacttgtctgag

SEQ ID NO: 7607578 - DNA, 22 bp, Homo sapiens
gagccctgcccacttgtctgag

SEQ ID NO: 7607579 - DNA, 22 bp, Homo sapiens
gagccctgatttgcagcatttg

SEQ ID NO: 7607580 - DNA, 22 bp, Homo sapiens
gagccctgatttgcagcatttg

SEQ ID NO: 7607581 - DNA, 22 bp, Homo sapiens
gagccctgatttgcagcatttg

SEQ ID NO: 7607582 - DNA, 22 bp, Homo sapiens
gagccctgcggagccccgaggc

SEQ ID NO: 7607583 - DNA, 22 bp, Homo sapiens
gagccctgcggagccccgaggc

SEQ ID NO: 7607584 - DNA, 22 bp, Homo sapiens
gagccctgcggagccccgaggc

SEQ ID NO: 7607585 - DNA, 22 bp, Homo sapiens
gagccctgcccacttgtctgag

SEQ ID NO: 7607586 - DNA, 22 bp, Homo sapiens
gagccctgcccacttgtctgag

SEQ ID NO: 7607587 - DNA, 22 bp, Homo sapiens
gagccctgctgggccttgtctc

SEQ ID NO: 7607588 - DNA, 22 bp, Homo sapiens
gagccctgctgggccttgtctc

SEQ ID NO: 7607589 - DNA, 22 bp, Homo sapiens
gagccctgctgggccttgtctc

SEQ ID NO: 7607590 - DNA, 22 bp, Homo sapiens
gagccctgctgggccttgtctc

SEQ ID NO: 7607591 - DNA, 22 bp, Homo sapiens
gagccctgcgtgtctgggggca

SEQ ID NO: 7607592 - DNA, 22 bp, Homo sapiens
gagccctgcgtgtctgggggca

SEQ ID NO: 7607593 - DNA, 22 bp, Homo sapiens
gagccctgcgtgtctgggggca

SEQ ID NO: 7607594 - DNA, 22 bp, Homo sapiens
gagccctgcgtgtctgggggca

SEQ ID NO: 7607595 - DNA, 22 bp, Homo sapiens
gagccctgcgtgtctgggggca

SEQ ID NO: 7607596 - DNA, 22 bp, Homo sapiens
gagccctgcggagccccgaggc

SEQ ID NO: 7607597 - DNA, 22 bp, Homo sapiens
gagccctgcggagccccgaggc

SEQ ID NO: 7607598 - DNA, 22 bp, Homo sapiens
gagccctgcgtgtctgggggca

SEQ ID NO: 7607599 - DNA, 22 bp, Homo sapiens
gagccctgcgtgtctgggggca

SEQ ID NO: 7607600 - DNA, 22 bp, Homo sapiens
gagccctgcttccaagggggca

SEQ ID NO: 7607601 - DNA, 22 bp, Homo sapiens
gagccctgctgggccttgtctc

SEQ ID NO: 7607602 - DNA, 22 bp, Homo sapiens
gagccctgcttccaagggggca

SEQ ID NO: 7607603 - DNA, 22 bp, Homo sapiens
gagccctgcttccaagggggca

SEQ ID NO: 7607604 - DNA, 22 bp, Homo sapiens
gagccctgcttccaagggggca

SEQ ID NO: 7607605 - DNA, 22 bp, Homo sapiens
gagccctggcagtctgggatgg

SEQ ID NO: 7607606 - DNA, 22 bp, Homo sapiens
gagccctggcagtctgggatgg

SEQ ID NO: 7607607 - DNA, 22 bp, Homo sapiens
gagccctggcagtctgggatgg

SEQ ID NO: 7607608 - DNA, 22 bp, Homo sapiens
gagccctgtagcaagtcatgtc

SEQ ID NO: 7607609 - DNA, 22 bp, Homo sapiens
gagccctgtagcaagtcatgtc

SEQ ID NO: 7607610 - DNA, 22 bp, Homo sapiens
gagccctgtagcaagtcatgtc

SEQ ID NO: 7607611 - DNA, 22 bp, Homo sapiens
gagccctgtagcaagtcatgtc

SEQ ID NO: 7607612 - DNA, 22 bp, Homo sapiens
gagccctgtagcaagtcatgtc

SEQ ID NO: 7607613 - DNA, 22 bp, Homo sapiens
gagccctgtagcaagtcatgtc

SEQ ID NO: 7607614 - DNA, 22 bp, Homo sapiens
gagccctgtagcaagtcatgtc

SEQ ID NO: 7607615 - DNA, 22 bp, Homo sapiens
gagccctgtagcaagtcatgtc

SEQ ID NO: 7607616 - DNA, 22 bp, Homo sapiens
gagccctgtagcaagtcatgtc

SEQ ID NO: 7607617 - DNA, 22 bp, Homo sapiens
gagccctgtagcaagtcatgtc

SEQ ID NO: 7607618 - DNA, 18 bp, Homo sapiens
gagccctgggagatctct

SEQ ID NO: 7607619 - DNA, 22 bp, Homo sapiens
gagccctggcagtctgggatgg

SEQ ID NO: 7607620 - DNA, 22 bp, Homo sapiens
gagccctggcagtctgggatgg

SEQ ID NO: 7607621 - DNA, 22 bp, Homo sapiens
gagccctggcagtctgggatgg

SEQ ID NO: 7607622 - DNA, 22 bp, Homo sapiens
gagccctgtagcaagtcatgtc

SEQ ID NO: 7607623 - DNA, 22 bp, Homo sapiens
gagccctgtagcaagtcatgtc

SEQ ID NO: 7607624 - DNA, 18 bp, Homo sapiens
gagccctgggagatctct

SEQ ID NO: 7607625 - DNA, 18 bp, Homo sapiens
gagccctgggagatctct

SEQ ID NO: 7607626 - DNA, 18 bp, Homo sapiens
gagccctgggagatctct

SEQ ID NO: 7607627 - DNA, 18 bp, Homo sapiens
gagccctgggagatctct

SEQ ID NO: 7607628 - DNA, 22 bp, Homo sapiens
gagccctgttcaggcctcctca

SEQ ID NO: 7607629 - DNA, 22 bp, Homo sapiens
gagccctgttcaggcctcctca

SEQ ID NO: 7607630 - DNA, 22 bp, Homo sapiens
gagccctgttcaggcctcctca

SEQ ID NO: 7607631 - DNA, 22 bp, Homo sapiens
gagccctgttcaggcctcctca

SEQ ID NO: 7607632 - DNA, 22 bp, Homo sapiens
gagccctgttcaggcctcctca

SEQ ID NO: 7607633 - DNA, 22 bp, Homo sapiens
gagctgagatcatgtacactag

SEQ ID NO: 7607634 - DNA, 22 bp, Homo sapiens
gagctgagatcgtgccattgca

SEQ ID NO: 7607635 - DNA, 22 bp, Homo sapiens
gagctgagatcgtgccattgca

SEQ ID NO: 7607636 - DNA, 22 bp, Homo sapiens
gagctgagatcatgtacactag

SEQ ID NO: 7607637 - DNA, 22 bp, Homo sapiens
gagccctgtaggaatctctcaa

SEQ ID NO: 7607638 - DNA, 22 bp, Homo sapiens
gagccctgtaggaatctctcaa

SEQ ID NO: 7607639 - DNA, 22 bp, Homo sapiens
gagccctgtaggaatctctcaa

SEQ ID NO: 7607640 - DNA, 22 bp, Homo sapiens
gagccctgtaggaatctctcaa

SEQ ID NO: 7607641 - DNA, 22 bp, Homo sapiens
gagccctgtgattctgttgtgt

SEQ ID NO: 7607642 - DNA, 22 bp, Homo sapiens
gagccctgtgattctgttgtgt

SEQ ID NO: 7607643 - DNA, 22 bp, Homo sapiens
gagccctgtgattctgttgtgt

SEQ ID NO: 7607644 - DNA, 22 bp, Homo sapiens
gagccctgtgattctgttgtgt

SEQ ID NO: 7607645 - DNA, 22 bp, Homo sapiens
gagccctgtgaggaaagagggt

SEQ ID NO: 7607646 - DNA, 22 bp, Homo sapiens
gagccctgtgaggaaagagggt

SEQ ID NO: 7607647 - DNA, 22 bp, Homo sapiens
gagctgagcttaactccttgaa

SEQ ID NO: 7607648 - DNA, 22 bp, Homo sapiens
gagctgaggatacatcagtgaa

SEQ ID NO: 7607649 - DNA, 22 bp, Homo sapiens
gagctgaggatacatcagtgaa

SEQ ID NO: 7607650 - DNA, 22 bp, Homo sapiens
gagctgagcttaactccttgaa

SEQ ID NO: 7607651 - DNA, 22 bp, Homo sapiens
gagctgagcttaactccttgaa

SEQ ID NO: 7607652 - DNA, 22 bp, Homo sapiens
gagctgagcttaactccttgaa

SEQ ID NO: 7607653 - DNA, 22 bp, Homo sapiens
gagctgagcctgggtggaccgc

SEQ ID NO: 7607654 - DNA, 22 bp, Homo sapiens
gagctgagcagggagcctcact

SEQ ID NO: 7607655 - DNA, 22 bp, Homo sapiens
gagctgagcctgggtggaccgc

SEQ ID NO: 7607656 - DNA, 22 bp, Homo sapiens
gagctgagatttgaagcaagtt

SEQ ID NO: 7607657 - DNA, 22 bp, Homo sapiens
gagctgagcagggagcctcact

SEQ ID NO: 7607658 - DNA, 22 bp, Homo sapiens
gagctgagatttgaagcaagtt

SEQ ID NO: 7607659 - DNA, 22 bp, Homo sapiens
gagctgaggccagagtcttctg

SEQ ID NO: 7607660 - DNA, 22 bp, Homo sapiens
gagctgaggccagagtcttctg

SEQ ID NO: 7607661 - DNA, 22 bp, Homo sapiens
gagctgaggatacatcagtgaa

SEQ ID NO: 7607662 - DNA, 22 bp, Homo sapiens
gagctgaggctcaggctggcgt

SEQ ID NO: 7607663 - DNA, 22 bp, Homo sapiens
gagctgaggctcaggctggcgt

SEQ ID NO: 7607664 - DNA, 22 bp, Homo sapiens
gagctgaggccagagtcttctg

SEQ ID NO: 7607665 - DNA, 22 bp, Homo sapiens
gagctgaggctcaggctggcgt

SEQ ID NO: 7607666 - DNA, 22 bp, Homo sapiens
gagctgaggctcaggctggcgt

SEQ ID NO: 7607667 - DNA, 22 bp, Homo sapiens
gagctgaggctcaggctggcgt

SEQ ID NO: 7607668 - DNA, 22 bp, Homo sapiens
gagctgaggctcaggctggcgt

SEQ ID NO: 7607669 - DNA, 22 bp, Homo sapiens
gagctgaggctgaggcctcact

SEQ ID NO: 7607670 - DNA, 22 bp, Homo sapiens
gagctgaggctgaggcctcact

SEQ ID NO: 7607671 - DNA, 22 bp, Homo sapiens
gagctgagggtctaggagggtt

SEQ ID NO: 7607672 - DNA, 22 bp, Homo sapiens
gagctgagggtctaggagggtt

SEQ ID NO: 7607673 - DNA, 22 bp, Homo sapiens
gagctgagggtctaggagggtt

SEQ ID NO: 7607674 - DNA, 22 bp, Homo sapiens
gagctgagggtctaggagggtt

SEQ ID NO: 7607675 - DNA, 22 bp, Homo sapiens
gagctgagggtctaggagggtt

SEQ ID NO: 7607676 - DNA, 22 bp, Homo sapiens
gagctgagtagaggctgctccc

SEQ ID NO: 7607677 - DNA, 22 bp, Homo sapiens
gagctgagtagaggctgctccc

SEQ ID NO: 7607678 - DNA, 22 bp, Homo sapiens
gagctgagtatcccactgaagt

SEQ ID NO: 7607679 - DNA, 22 bp, Homo sapiens
gagctgagtatcccactgaagt

SEQ ID NO: 7607680 - DNA, 22 bp, Homo sapiens
gagctgagtatcccactgaagt

SEQ ID NO: 7607681 - DNA, 22 bp, Homo sapiens
gagctgagtatcccactgaagt

SEQ ID NO: 7607682 - DNA, 22 bp, Homo sapiens
gagctgagtatgaaggatgtga

SEQ ID NO: 7607683 - DNA, 22 bp, Homo sapiens
gagctgagtatgaaggatgtga

SEQ ID NO: 7607684 - DNA, 22 bp, Homo sapiens
gagctgagtatcccactgaagt

SEQ ID NO: 7607685 - DNA, 22 bp, Homo sapiens
gagctgaggtgatgtggtcgtt

SEQ ID NO: 7607686 - DNA, 22 bp, Homo sapiens
gagctgaggtgatgtggtcgtt

SEQ ID NO: 7607687 - DNA, 22 bp, Homo sapiens
gagctgagtagaggctgctccc

SEQ ID NO: 7607688 - DNA, 22 bp, Homo sapiens
gagctgagggtctaggagggtt

SEQ ID NO: 7607689 - DNA, 22 bp, Homo sapiens
gagctgagggtctaggagggtt

SEQ ID NO: 7607690 - DNA, 22 bp, Homo sapiens
gagctgagggtctaggagggtt

SEQ ID NO: 7607691 - DNA, 22 bp, Homo sapiens
gagctgagtctgcagtcgccat

SEQ ID NO: 7607692 - DNA, 22 bp, Homo sapiens
gagctgagtctgcagtcgccat

SEQ ID NO: 7607693 - DNA, 22 bp, Homo sapiens
gagctgagtctgcagtcgccat

SEQ ID NO: 7607694 - DNA, 22 bp, Homo sapiens
gagctgccggcccacagtacta

SEQ ID NO: 7607695 - DNA, 22 bp, Homo sapiens
gagctgcctacattgccaagag

SEQ ID NO: 7607696 - DNA, 23 bp, Homo sapiens
gagctgagtgtagggagactagg

SEQ ID NO: 7607697 - DNA, 22 bp, Homo sapiens
gagctgcctgaacaagcagcag

SEQ ID NO: 7607698 - DNA, 22 bp, Homo sapiens
gagctgcctgaacaagcagcag

SEQ ID NO: 7607699 - DNA, 22 bp, Homo sapiens
gagctgcctgaacaagcagcag

SEQ ID NO: 7607700 - DNA, 22 bp, Homo sapiens
gagctgcctgaacaagcagcag

SEQ ID NO: 7607701 - DNA, 22 bp, Homo sapiens
gagctgcctgaacaagcagcag

SEQ ID NO: 7607702 - DNA, 22 bp, Homo sapiens
gagctgcctacattgccaagag

SEQ ID NO: 7607703 - DNA, 22 bp, Homo sapiens
gagctgcctgaacaagcagcag

SEQ ID NO: 7607704 - DNA, 22 bp, Homo sapiens
gagctgcctacattgccaagag

SEQ ID NO: 7607705 - DNA, 22 bp, Homo sapiens
gaggaagaagcaaaccagctaa

SEQ ID NO: 7607706 - DNA, 22 bp, Homo sapiens
gaggaagaagcaaaccagctaa

SEQ ID NO: 7607707 - DNA, 22 bp, Homo sapiens
gaggaagaagcaaaccagctaa

SEQ ID NO: 7607708 - DNA, 22 bp, Homo sapiens
gaggaagaagggattagaactc

SEQ ID NO: 7607709 - DNA, 22 bp, Homo sapiens
gaggaagaagggattagaactc

SEQ ID NO: 7607710 - DNA, 22 bp, Homo sapiens
gaggaagaagggattagaactc

SEQ ID NO: 7607711 - DNA, 22 bp, Homo sapiens
gaggaagaagggattagaactc

SEQ ID NO: 7607712 - DNA, 22 bp, Homo sapiens
gaggaagaagggattagaactc

SEQ ID NO: 7607713 - DNA, 22 bp, Homo sapiens
gaggaagaaagcataggtgggg

SEQ ID NO: 7607714 - DNA, 22 bp, Homo sapiens
gaggaagaaagcataggtgggg

SEQ ID NO: 7607715 - DNA, 22 bp, Homo sapiens
gaggaagaaagcataggtgggg

SEQ ID NO: 7607716 - DNA, 22 bp, Homo sapiens
gaggaagaaagcataggtgggg

SEQ ID NO: 7607717 - DNA, 22 bp, Homo sapiens
gaggaagaagcaaaccagctaa

SEQ ID NO: 7607718 - DNA, 22 bp, Homo sapiens
gaggaagaagcaaaccagctaa

SEQ ID NO: 7607719 - DNA, 22 bp, Homo sapiens
gaggaagaagcaaaccagctaa

SEQ ID NO: 7607720 - DNA, 22 bp, Homo sapiens
gaggaagaagcaaaccagctaa

SEQ ID NO: 7607721 - DNA, 22 bp, Homo sapiens
gaggaagaagcaaaccagctaa

SEQ ID NO: 7607722 - DNA, 22 bp, Homo sapiens
gaggaagaagcaaaccagctaa

SEQ ID NO: 7607723 - DNA, 22 bp, Homo sapiens
gaggaagaagcaaaccagctaa

SEQ ID NO: 7607724 - DNA, 22 bp, Homo sapiens
gaggagagagggactgtctgca

SEQ ID NO: 7607725 - DNA, 22 bp, Homo sapiens
gaggagagagggactgtctgca

SEQ ID NO: 7607726 - DNA, 22 bp, Homo sapiens
gaggagagagggactgtctgca

SEQ ID NO: 7607727 - DNA, 22 bp, Homo sapiens
gaggagagagggactgtctgca

SEQ ID NO: 7607728 - DNA, 22 bp, Homo sapiens
gaggagagagggactgtctgca

SEQ ID NO: 7607729 - DNA, 22 bp, Homo sapiens
gaggagagatggtagattgggt

SEQ ID NO: 7607730 - DNA, 22 bp, Homo sapiens
gaggagagatggtagattgggt

SEQ ID NO: 7607731 - DNA, 22 bp, Homo sapiens
gaggaagaatcagggtggtgag

SEQ ID NO: 7607732 - DNA, 22 bp, Homo sapiens
gaggaagaatcagggtggtgag

SEQ ID NO: 7607733 - DNA, 22 bp, Homo sapiens
gaggaagaattggttattggag

SEQ ID NO: 7607734 - DNA, 22 bp, Homo sapiens
gaggaagaattggttattggag

SEQ ID NO: 7607735 - DNA, 22 bp, Homo sapiens
gaggaagaattggttattggag

SEQ ID NO: 7607736 - DNA, 22 bp, Homo sapiens
gaggaagaatcagggtggtgag

SEQ ID NO: 7607737 - DNA, 22 bp, Homo sapiens
gaggaagaatcagggtggtgag

SEQ ID NO: 7607738 - DNA, 22 bp, Homo sapiens
gaggaagaatcagggtggtgag

SEQ ID NO: 7607739 - DNA, 22 bp, Homo sapiens
gaggaagaatcagggtggtgag

SEQ ID NO: 7607740 - DNA, 22 bp, Homo sapiens
gaggaagaatcagggtggtgag

SEQ ID NO: 7607741 - DNA, 22 bp, Homo sapiens
gaggaagaatcagggtggtgag

SEQ ID NO: 7607742 - DNA, 22 bp, Homo sapiens
gaggaagaatcagggtggtgag

SEQ ID NO: 7607743 - DNA, 21 bp, Homo sapiens
gaggaaatgctctggtgttca

SEQ ID NO: 7607744 - DNA, 21 bp, Homo sapiens
gaggaaatgctctggtgttca

SEQ ID NO: 7607745 - DNA, 21 bp, Homo sapiens
gaggaaatgctctggtgttca

SEQ ID NO: 7607746 - DNA, 21 bp, Homo sapiens
gaggaaatgctctggtgttca

SEQ ID NO: 7607747 - DNA, 21 bp, Homo sapiens
gaggaaatgctctggtgttca

SEQ ID NO: 7607748 - DNA, 22 bp, Homo sapiens
gaggaaatggttgttcaggtgg

SEQ ID NO: 7607749 - DNA, 22 bp, Homo sapiens
gaggaaatggttgttcaggtgg

SEQ ID NO: 7607750 - DNA, 22 bp, Homo sapiens
gaggaaatcttaggccccaacc

SEQ ID NO: 7607751 - DNA, 22 bp, Homo sapiens
gaggaaatggttgttcaggtgg

SEQ ID NO: 7607752 - DNA, 22 bp, Homo sapiens
gaggaacagagacgggatcgct

SEQ ID NO: 7607753 - DNA, 22 bp, Homo sapiens
gaggaacaagctgctttatctt

SEQ ID NO: 7607754 - DNA, 22 bp, Homo sapiens
gaggaacagagacgggatcgct

SEQ ID NO: 7607755 - DNA, 22 bp, Homo sapiens
gaggaacagagacgggatcgct

SEQ ID NO: 7607756 - DNA, 22 bp, Homo sapiens
gaggaacagagggcaaggccag

SEQ ID NO: 7607757 - DNA, 22 bp, Homo sapiens
gaggaaccaaatcagcttgcac

SEQ ID NO: 7607758 - DNA, 18 bp, Homo sapiens
gaggaacattcacctcct

SEQ ID NO: 7607759 - DNA, 18 bp, Homo sapiens
gaggaacattcacctcct

SEQ ID NO: 7607760 - DNA, 22 bp, Homo sapiens
gaggaacagcagccacatgtcc

SEQ ID NO: 7607761 - DNA, 22 bp, Homo sapiens
gaggaacatgaggtgacctggg

SEQ ID NO: 7607762 - DNA, 22 bp, Homo sapiens
gaggaacagcagccacatgtcc

SEQ ID NO: 7607763 - DNA, 22 bp, Homo sapiens
gaggaacagcagccacatgtcc

SEQ ID NO: 7607764 - DNA, 22 bp, Homo sapiens
gaggaacagcagccacatgtcc

SEQ ID NO: 7607765 - DNA, 22 bp, Homo sapiens
gaggaacagcagccacatgtcc

SEQ ID NO: 7607766 - DNA, 22 bp, Homo sapiens
gaggaacagagggcaaggccag

SEQ ID NO: 7607767 - DNA, 22 bp, Homo sapiens
gaggaacagcagccacatgtcc

SEQ ID NO: 7607768 - DNA, 22 bp, Homo sapiens
gaggaacctcctgaaaagtata

SEQ ID NO: 7607769 - DNA, 22 bp, Homo sapiens
gaggaactgagtaccatgattc

SEQ ID NO: 7607770 - DNA, 22 bp, Homo sapiens
gaggaactggagctttcatttt

SEQ ID NO: 7607771 - DNA, 22 bp, Homo sapiens
gaggaactggagctttcatttt

SEQ ID NO: 7607772 - DNA, 20 bp, Homo sapiens
gaggaaccactgggaggaga

SEQ ID NO: 7607773 - DNA, 20 bp, Homo sapiens
gaggaaccactgggaggaga

SEQ ID NO: 7607774 - DNA, 22 bp, Homo sapiens
gaggaagaaagcataggtgggg

SEQ ID NO: 7607775 - DNA, 22 bp, Homo sapiens
gaggaagaaagcataggtgggg

SEQ ID NO: 7607776 - DNA, 22 bp, Homo sapiens
gaggaagaaagcataggtgggg

SEQ ID NO: 7607777 - DNA, 22 bp, Homo sapiens
gaggaagaaagcataggtgggg

SEQ ID NO: 7607778 - DNA, 22 bp, Homo sapiens
gaggaagaaagcataggtgggg

SEQ ID NO: 7607779 - DNA, 22 bp, Homo sapiens
gaggaagaaagcataggtgggg

SEQ ID NO: 7607780 - DNA, 22 bp, Homo sapiens
gaggaagaaagcataggtgggg

SEQ ID NO: 7607781 - DNA, 22 bp, Homo sapiens
gaggaacttgggttttggattg

SEQ ID NO: 7607782 - DNA, 22 bp, Homo sapiens
gaggaacttatgatattctact

SEQ ID NO: 7607783 - DNA, 22 bp, Homo sapiens
gaggaacttatgatattctact

SEQ ID NO: 7607784 - DNA, 22 bp, Homo sapiens
gaggaacttatgatattctact

SEQ ID NO: 7607785 - DNA, 19 bp, Homo sapiens
gaggaactggcttggttcc

SEQ ID NO: 7607786 - DNA, 22 bp, Homo sapiens
gaggaaaatggagtgtaattaa

SEQ ID NO: 7607787 - DNA, 22 bp, Homo sapiens
gaggaaaatggagtgtaattaa

SEQ ID NO: 7607788 - DNA, 22 bp, Homo sapiens
gaggaaaatgcaacaggaatgc

SEQ ID NO: 7607789 - DNA, 22 bp, Homo sapiens
gaggaaaatgcaacaggaatgc

SEQ ID NO: 7607790 - DNA, 22 bp, Homo sapiens
gaggaaaatgggacaggctgta

SEQ ID NO: 7607791 - DNA, 22 bp, Homo sapiens
gaggaaaatgggacaggctgta

SEQ ID NO: 7607792 - DNA, 22 bp, Homo sapiens
gaggaaaatgggacaggctgta

SEQ ID NO: 7607793 - DNA, 22 bp, Homo sapiens
gaggaaaatgggacaggctgta

SEQ ID NO: 7607794 - DNA, 22 bp, Homo sapiens
gagctgcttctgtgtgccgggt

SEQ ID NO: 7607795 - DNA, 22 bp, Homo sapiens
gagctgcttctgtgtgccgggt

SEQ ID NO: 7607796 - DNA, 22 bp, Homo sapiens
gagctgctgtgaggggagcttc

SEQ ID NO: 7607797 - DNA, 22 bp, Homo sapiens
gagctgctgtgaggggagcttc

SEQ ID NO: 7607798 - DNA, 22 bp, Homo sapiens
gagctgctggttgctggtgcct

SEQ ID NO: 7607799 - DNA, 22 bp, Homo sapiens
gagctgctggttgctggtgcct

SEQ ID NO: 7607800 - DNA, 22 bp, Homo sapiens
gagctgctggttgctggtgcct

SEQ ID NO: 7607801 - DNA, 19 bp, Homo sapiens
gagctgccttttgaagacc

SEQ ID NO: 7607802 - DNA, 22 bp, Homo sapiens
gagctgctgaagggaaaatgaa

SEQ ID NO: 7607803 - DNA, 19 bp, Homo sapiens
gagctgccttttgaagacc

SEQ ID NO: 7607804 - DNA, 19 bp, Homo sapiens
gagctgccttttgaagacc

SEQ ID NO: 7607805 - DNA, 19 bp, Homo sapiens
gagctgccttttgaagacc

SEQ ID NO: 7607806 - DNA, 22 bp, Homo sapiens
gagctgctggctcctcaggtta

SEQ ID NO: 7607807 - DNA, 22 bp, Homo sapiens
gagctgctggcctcctgcggga

SEQ ID NO: 7607808 - DNA, 22 bp, Homo sapiens
gagctgctggcctcctgcggga

SEQ ID NO: 7607809 - DNA, 22 bp, Homo sapiens
gagctgctggatatgtggcctg

SEQ ID NO: 7607810 - DNA, 22 bp, Homo sapiens
gagctgctggaagtggagccct

SEQ ID NO: 7607811 - DNA, 22 bp, Homo sapiens
gagctgctggaagtggagccct

SEQ ID NO: 7607812 - DNA, 22 bp, Homo sapiens
gagctgcctgttgcatagcaac

SEQ ID NO: 7607813 - DNA, 22 bp, Homo sapiens
gagctgcctgttgcatagcaac

SEQ ID NO: 7607814 - DNA, 22 bp, Homo sapiens
gagctgcctgttgcatagcaac

SEQ ID NO: 7607815 - DNA, 22 bp, Homo sapiens
gagctgcctgtgtgccatgatg

SEQ ID NO: 7607816 - DNA, 22 bp, Homo sapiens
gagctgcctgttgcatagcaac

SEQ ID NO: 7607817 - DNA, 22 bp, Homo sapiens
gagctgcctgttgcatagcaac

SEQ ID NO: 7607818 - DNA, 22 bp, Homo sapiens
gagctgcctgttgcatagcaac

SEQ ID NO: 7607819 - DNA, 22 bp, Homo sapiens
gagctgcctgtgtgccatgatg

SEQ ID NO: 7607820 - DNA, 22 bp, Homo sapiens
gagctgcctgtgtgccatgatg

SEQ ID NO: 7607821 - DNA, 22 bp, Homo sapiens
gagctgcctgtgtgccatgatg

SEQ ID NO: 7607822 - DNA, 22 bp, Homo sapiens
gagctgcctgtgtgccatgatg

SEQ ID NO: 7607823 - DNA, 23 bp, Homo sapiens
gaggaaagaatatagatgcaatc

SEQ ID NO: 7607824 - DNA, 23 bp, Homo sapiens
gaggaaagaatatagatgcaatc

SEQ ID NO: 7607825 - DNA, 23 bp, Homo sapiens
gaggaaagaatatagatgcaatc

SEQ ID NO: 7607826 - DNA, 22 bp, Homo sapiens
gaggaaagaaccccagtcaata

SEQ ID NO: 7607827 - DNA, 23 bp, Homo sapiens
gaggaaagaatatagatgcaatc

SEQ ID NO: 7607828 - DNA, 23 bp, Homo sapiens
gaggaaagaatatagatgcaatc

SEQ ID NO: 7607829 - DNA, 23 bp, Homo sapiens
gaggaaagaatatagatgcaatc

SEQ ID NO: 7607830 - DNA, 22 bp, Homo sapiens
gaggaaagagtcaaatctgaag

SEQ ID NO: 7607831 - DNA, 22 bp, Homo sapiens
gaggaaagagtcaaatctgaag

SEQ ID NO: 7607832 - DNA, 23 bp, Homo sapiens
gaggaaagaatatagatgcaatc

SEQ ID NO: 7607833 - DNA, 23 bp, Homo sapiens
gaggaaagaatatagatgcaatc

SEQ ID NO: 7607834 - DNA, 23 bp, Homo sapiens
gaggaaagaatatagatgcaatc

SEQ ID NO: 7607835 - DNA, 22 bp, Homo sapiens
gaggaaatcttaggccccaacc

SEQ ID NO: 7607836 - DNA, 22 bp, Homo sapiens
gaggaaatcttaggccccaacc

SEQ ID NO: 7607837 - DNA, 22 bp, Homo sapiens
gaggaaatcattccagaaaagg

SEQ ID NO: 7607838 - DNA, 22 bp, Homo sapiens
gaggaaatcattccagaaaagg

SEQ ID NO: 7607839 - DNA, 22 bp, Homo sapiens
gaggaaatcattccagaaaagg

SEQ ID NO: 7607840 - DNA, 22 bp, Homo sapiens
gaggaaatcattccagaaaagg

SEQ ID NO: 7607841 - DNA, 22 bp, Homo sapiens
gaggaaagctggtttaaagtat

SEQ ID NO: 7607842 - DNA, 22 bp, Homo sapiens
gaggaaagctggtttaaagtat

SEQ ID NO: 7607843 - DNA, 22 bp, Homo sapiens
gaggaaagctggtttaaagtat

SEQ ID NO: 7607844 - DNA, 22 bp, Homo sapiens
gaggaaagctggtttaaagtat

SEQ ID NO: 7607845 - DNA, 22 bp, Homo sapiens
gaggaaagagtcaaatctgaag

SEQ ID NO: 7607846 - DNA, 18 bp, Homo sapiens
gaggaaacaaggcagagg

SEQ ID NO: 7607847 - DNA, 18 bp, Homo sapiens
gaggaaacaaggcagagg

SEQ ID NO: 7607848 - DNA, 22 bp, Homo sapiens
gaggaaacattgtagaagcagt

SEQ ID NO: 7607849 - DNA, 22 bp, Homo sapiens
gaggaaacattgtagaagcagt

SEQ ID NO: 7607850 - DNA, 18 bp, Homo sapiens
gaggaaacaggctctgtg

SEQ ID NO: 7607851 - DNA, 18 bp, Homo sapiens
gaggaaacaggctctgtg

SEQ ID NO: 7607852 - DNA, 22 bp, Homo sapiens
gaggaaagaaccccagtcaata

SEQ ID NO: 7607853 - DNA, 22 bp, Homo sapiens
gaggaaagaaccccagtcaata

SEQ ID NO: 7607854 - DNA, 22 bp, Homo sapiens
gaggaaagaaccccagtcaata

SEQ ID NO: 7607855 - DNA, 22 bp, Homo sapiens
gaggaaagaaccccagtcaata

SEQ ID NO: 7607856 - DNA, 22 bp, Homo sapiens
gaggaaagaaccccagtcaata

SEQ ID NO: 7607857 - DNA, 22 bp, Homo sapiens
gaggaaagaaccccagtcaata

SEQ ID NO: 7607858 - DNA, 22 bp, Homo sapiens
gaggaaagaaccccagtcaata

SEQ ID NO: 7607859 - DNA, 23 bp, Homo sapiens
gaggaaagaatatagatgcaatc

SEQ ID NO: 7607860 - DNA, 22 bp, Homo sapiens
gaggaaagaaccccagtcaata

SEQ ID NO: 7607861 - DNA, 22 bp, Homo sapiens
gaggaaagaaccccagtcaata

SEQ ID NO: 7607862 - DNA, 22 bp, Homo sapiens
gaaggcaggcttctgattaggt

SEQ ID NO: 7607863 - DNA, 22 bp, Homo sapiens
gaaggcaggcttctgattaggt

SEQ ID NO: 7607864 - DNA, 22 bp, Homo sapiens
gaaggcagggaatgtggtgcta

SEQ ID NO: 7607865 - DNA, 22 bp, Homo sapiens
gaaggcaggcttctgattaggt

SEQ ID NO: 7607866 - DNA, 22 bp, Homo sapiens
gaaggcagggaatgtggtgcta

SEQ ID NO: 7607867 - DNA, 22 bp, Homo sapiens
gaaggcagggaatgtggtgcta

SEQ ID NO: 7607868 - DNA, 22 bp, Homo sapiens
gaaggcagggaatgtggtgcta

SEQ ID NO: 7607869 - DNA, 22 bp, Homo sapiens
gaaggcaggcttctgattaggt

SEQ ID NO: 7607870 - DNA, 22 bp, Homo sapiens
gaaggcagggaatgtggtgcta

SEQ ID NO: 7607871 - DNA, 22 bp, Homo sapiens
gaaggcagggaatgtggtgcta

SEQ ID NO: 7607872 - DNA, 22 bp, Homo sapiens
gaaggcagggaatgtggtgcta

SEQ ID NO: 7607873 - DNA, 22 bp, Homo sapiens
gaaggcaggtttttcaaaactg

SEQ ID NO: 7607874 - DNA, 22 bp, Homo sapiens
gaaggcaggtttttcaaaactg

SEQ ID NO: 7607875 - DNA, 22 bp, Homo sapiens
gaaggcacccggcgtgcggcgg

SEQ ID NO: 7607876 - DNA, 22 bp, Homo sapiens
gaaggcacagatggcagtccac

SEQ ID NO: 7607877 - DNA, 22 bp, Homo sapiens
gaaggcacagatggcagtccac

SEQ ID NO: 7607878 - DNA, 22 bp, Homo sapiens
gaaggcaccctccatcactcac

SEQ ID NO: 7607879 - DNA, 22 bp, Homo sapiens
gaaggcactgaactccttctgg

SEQ ID NO: 7607880 - DNA, 22 bp, Homo sapiens
gaaggcaagctttggatatgag

SEQ ID NO: 7607881 - DNA, 22 bp, Homo sapiens
gaaggcacagatggcagtccac

SEQ ID NO: 7607882 - DNA, 20 bp, Homo sapiens
gaaggcaatggtttggcaca

SEQ ID NO: 7607883 - DNA, 20 bp, Homo sapiens
gaaggcaatggtttggcaca

SEQ ID NO: 7607884 - DNA, 22 bp, Homo sapiens
gaaggcaagtgagccaagagaa

SEQ ID NO: 7607885 - DNA, 22 bp, Homo sapiens
gaaggcaagtgagccaagagaa

SEQ ID NO: 7607886 - DNA, 22 bp, Homo sapiens
gaaggcaagtgagccaagagaa

SEQ ID NO: 7607887 - DNA, 22 bp, Homo sapiens
gaaggagctaaagggagccctg

SEQ ID NO: 7607888 - DNA, 22 bp, Homo sapiens
gaaggagccgagctcttcccca

SEQ ID NO: 7607889 - DNA, 22 bp, Homo sapiens
gaaggagctaccaagactgaat

SEQ ID NO: 7607890 - DNA, 22 bp, Homo sapiens
gaaggagctaccaagactgaat

SEQ ID NO: 7607891 - DNA, 22 bp, Homo sapiens
gaaggagctaccaagactgaat

SEQ ID NO: 7607892 - DNA, 22 bp, Homo sapiens
gaaggagctaccaagactgaat

SEQ ID NO: 7607893 - DNA, 22 bp, Homo sapiens
gaagccactatagatattctaa

SEQ ID NO: 7607894 - DNA, 22 bp, Homo sapiens
gaagccactatagatattctaa

SEQ ID NO: 7607895 - DNA, 20 bp, Homo sapiens
gaagccagaggggaaaggag

SEQ ID NO: 7607896 - DNA, 20 bp, Homo sapiens
gaagccagaggggaaaggag

SEQ ID NO: 7607897 - DNA, 20 bp, Homo sapiens
gaagccagaggggaaaggag

SEQ ID NO: 7607898 - DNA, 20 bp, Homo sapiens
gaagccagaggggaaaggag

SEQ ID NO: 7607899 - DNA, 22 bp, Homo sapiens
gaaggagagggtcaaggataat

SEQ ID NO: 7607900 - DNA, 22 bp, Homo sapiens
gaaggagagggtcaaggataat

SEQ ID NO: 7607901 - DNA, 22 bp, Homo sapiens
gaaggagagggtcaaggataat

SEQ ID NO: 7607902 - DNA, 16 bp, Homo sapiens
gaaggagattcagaaa

SEQ ID NO: 7607903 - DNA, 22 bp, Homo sapiens
gaagccaccctccttccagccc

SEQ ID NO: 7607904 - DNA, 22 bp, Homo sapiens
gaagccaccctccttccagccc

SEQ ID NO: 7607905 - DNA, 22 bp, Homo sapiens
gaagccactatagatattctaa

SEQ ID NO: 7607906 - DNA, 22 bp, Homo sapiens
gaagccactatagatattctaa

SEQ ID NO: 7607907 - DNA, 22 bp, Homo sapiens
gaagccacgttaaattggctgt

SEQ ID NO: 7607908 - DNA, 22 bp, Homo sapiens
gaagccacgttaaattggctgt

SEQ ID NO: 7607909 - DNA, 22 bp, Homo sapiens
gaagccacgttaaattggctgt

SEQ ID NO: 7607910 - DNA, 22 bp, Homo sapiens
gaagccacgttaaattggctgt

SEQ ID NO: 7607911 - DNA, 22 bp, Homo sapiens
gaagccacagagattgtggggg

SEQ ID NO: 7607912 - DNA, 22 bp, Homo sapiens
gaagccacagagattgtggggg

SEQ ID NO: 7607913 - DNA, 22 bp, Homo sapiens
gaagccacagggaaggagaaca

SEQ ID NO: 7607914 - DNA, 23 bp, Homo sapiens
gaagccacacaaaggtcgccaag

SEQ ID NO: 7607915 - DNA, 22 bp, Homo sapiens
gaagccacaactttttcttagc

SEQ ID NO: 7607916 - DNA, 22 bp, Homo sapiens
gaaggcagtaaatggctgtttt

SEQ ID NO: 7607917 - DNA, 22 bp, Homo sapiens
gaaggcagtaaatggctgtttt

SEQ ID NO: 7607918 - DNA, 22 bp, Homo sapiens
gaaggcagtaaatggctgtttt

SEQ ID NO: 7607919 - DNA, 22 bp, Homo sapiens
gaaggcagtaaatggctgtttt

SEQ ID NO: 7607920 - DNA, 22 bp, Homo sapiens
gaaggcaggtttttcaaaactg

SEQ ID NO: 7607921 - DNA, 22 bp, Homo sapiens
gaaggcagtaaatggctgtttt

SEQ ID NO: 7607922 - DNA, 22 bp, Homo sapiens
gaaggcagtaaatggctgtttt

SEQ ID NO: 7607923 - DNA, 22 bp, Homo sapiens
gaaggcaggtttttcaaaactg

SEQ ID NO: 7607924 - DNA, 22 bp, Homo sapiens
gaaggcatcagcaggcaccgat

SEQ ID NO: 7607925 - DNA, 18 bp, Homo sapiens
gaaggcattcagtggctt

SEQ ID NO: 7607926 - DNA, 18 bp, Homo sapiens
gaaggcattcagtggctt

SEQ ID NO: 7607927 - DNA, 22 bp, Homo sapiens
gaaggcattctattctacatat

SEQ ID NO: 7607928 - DNA, 22 bp, Homo sapiens
gaaggcatcagcaggcaccgat

SEQ ID NO: 7607929 - DNA, 22 bp, Homo sapiens
gaaggcatctatgtgacctgga

SEQ ID NO: 7607930 - DNA, 22 bp, Homo sapiens
gaaggcatctatgtgacctgga

SEQ ID NO: 7607931 - DNA, 22 bp, Homo sapiens
gaaggcatctctggacttattt

SEQ ID NO: 7607932 - DNA, 22 bp, Homo sapiens
gaaggcatcaccaacattgaaa

SEQ ID NO: 7607933 - DNA, 22 bp, Homo sapiens
gaaggcatcaccaacattgaaa

SEQ ID NO: 7607934 - DNA, 22 bp, Homo sapiens
gaaggcatcacagaggctgtgg

SEQ ID NO: 7607935 - DNA, 22 bp, Homo sapiens
gaaggcatcacagaggctgtgg

SEQ ID NO: 7607936 - DNA, 22 bp, Homo sapiens
gaaggcatcacagaggctgtgg

SEQ ID NO: 7607937 - DNA, 22 bp, Homo sapiens
gaaggcatcacagaggctgtga

SEQ ID NO: 7607938 - DNA, 22 bp, Homo sapiens
gaaggcataaaaccaattttgt

SEQ ID NO: 7607939 - DNA, 22 bp, Homo sapiens
gaaggcatcacagaggctgtga

SEQ ID NO: 7607940 - DNA, 22 bp, Homo sapiens
gaaggcatcacagaggctgtga

SEQ ID NO: 7607941 - DNA, 22 bp, Homo sapiens
gaaggccagttttgagataggt

SEQ ID NO: 7607942 - DNA, 22 bp, Homo sapiens
gaaggccactttgtgttgagaa

SEQ ID NO: 7607943 - DNA, 22 bp, Homo sapiens
gaaggccagttttgagataggt

SEQ ID NO: 7607944 - DNA, 22 bp, Homo sapiens
gaaggccactttgtgttgagaa

SEQ ID NO: 7607945 - DNA, 22 bp, Homo sapiens
gaaggccacggaatggagctgg

SEQ ID NO: 7607946 - DNA, 22 bp, Homo sapiens
gaaggccacggaatggagctgg

SEQ ID NO: 7607947 - DNA, 22 bp, Homo sapiens
gaaggccacaagagaagttaag

SEQ ID NO: 7607948 - DNA, 22 bp, Homo sapiens
gaaggccacaagagaagttaag

SEQ ID NO: 7607949 - DNA, 22 bp, Homo sapiens
gaaggccacggaatggagctgg

SEQ ID NO: 7607950 - DNA, 22 bp, Homo sapiens
gaaggccacaaaaaatgtcata

SEQ ID NO: 7607951 - DNA, 22 bp, Homo sapiens
gaaggccacaaaaaatgtcata

SEQ ID NO: 7607952 - DNA, 22 bp, Homo sapiens
gaaggccaagaggctccaagat

SEQ ID NO: 7607953 - DNA, 22 bp, Homo sapiens
gaaggccaagaggctccaagat

SEQ ID NO: 7607954 - DNA, 22 bp, Homo sapiens
gaaggccaagaggctccaagat

SEQ ID NO: 7607955 - DNA, 22 bp, Homo sapiens
gaaggcattctattctacatat

SEQ ID NO: 7607956 - DNA, 22 bp, Homo sapiens
gaaggcatttaggaactgcaat

SEQ ID NO: 7607957 - DNA, 22 bp, Homo sapiens
gaaggcatttaggaactgcaat

SEQ ID NO: 7607958 - DNA, 22 bp, Homo sapiens
gaaggcatttaggaactgcaat

SEQ ID NO: 7607959 - DNA, 22 bp, Homo sapiens
gaaggcatttcagagatctctg

SEQ ID NO: 7607960 - DNA, 22 bp, Homo sapiens
gaaggcattttatgccttatag

SEQ ID NO: 7607961 - DNA, 22 bp, Homo sapiens
gaaggcatttcagagatctctg

SEQ ID NO: 7607962 - DNA, 22 bp, Homo sapiens
gaaggccaagaggctccaagat

SEQ ID NO: 7607963 - DNA, 22 bp, Homo sapiens
gaaggccaagaggctccaagat

SEQ ID NO: 7607964 - DNA, 22 bp, Homo sapiens
gaagggaatttggagggtttca

SEQ ID NO: 7607965 - DNA, 22 bp, Homo sapiens
gaagggaatttggagggtttca

SEQ ID NO: 7607966 - DNA, 22 bp, Homo sapiens
gaagggaaggaaagaaccagca

SEQ ID NO: 7607967 - DNA, 22 bp, Homo sapiens
gaagggaatttggagggtttca

SEQ ID NO: 7607968 - DNA, 22 bp, Homo sapiens
gaagggaatttggagggtttca

SEQ ID NO: 7607969 - DNA, 22 bp, Homo sapiens
gaagggaatttggagggtttca

SEQ ID NO: 7607970 - DNA, 22 bp, Homo sapiens
gaagggagaaggttgggtgacg

SEQ ID NO: 7607971 - DNA, 22 bp, Homo sapiens
gaagggagaaggttgggtgacg

SEQ ID NO: 7607972 - DNA, 22 bp, Homo sapiens
gaagggagaaggttgggtgacg

SEQ ID NO: 7607973 - DNA, 22 bp, Homo sapiens
gaagggagaaggttgggtgacg

SEQ ID NO: 7607974 - DNA, 18 bp, Homo sapiens
gaagggagctggaatgca

SEQ ID NO: 7607975 - DNA, 18 bp, Homo sapiens
gaagggagctggaatgca

SEQ ID NO: 7607976 - DNA, 18 bp, Homo sapiens
gaagggagctggaatgca

SEQ ID NO: 7607977 - DNA, 18 bp, Homo sapiens
gaagggagctggaatgca

SEQ ID NO: 7607978 - DNA, 18 bp, Homo sapiens
gaagggagctggaatgca

SEQ ID NO: 7607979 - DNA, 18 bp, Homo sapiens
gaagggagctggaatgca

SEQ ID NO: 7607980 - DNA, 22 bp, Homo sapiens
gaagggagaaggttgggtgacg

SEQ ID NO: 7607981 - DNA, 22 bp, Homo sapiens
gaagggagaaggttgggtgacg

SEQ ID NO: 7607982 - DNA, 22 bp, Homo sapiens
gaagggagaaggttgggtgacg

SEQ ID NO: 7607983 - DNA, 22 bp, Homo sapiens
gaagggagaaggttgggtgacg

SEQ ID NO: 7607984 - DNA, 22 bp, Homo sapiens
gaaggcccagcttgaatgctgc

SEQ ID NO: 7607985 - DNA, 22 bp, Homo sapiens
gaaggcccagcttgaatgctgc

SEQ ID NO: 7607986 - DNA, 22 bp, Homo sapiens
gaaggcccagcttgaatgctgc

SEQ ID NO: 7607987 - DNA, 22 bp, Homo sapiens
gaaggccatttttaggtagaat

SEQ ID NO: 7607988 - DNA, 22 bp, Homo sapiens
gaaggccatttttaggtagaat

SEQ ID NO: 7607989 - DNA, 22 bp, Homo sapiens
gaaggccatttttaggtagaat

SEQ ID NO: 7607990 - DNA, 22 bp, Homo sapiens
gaaggccatttttaggtagaat

SEQ ID NO: 7607991 - DNA, 22 bp, Homo sapiens
gaaggccagttttgagataggt

SEQ ID NO: 7607992 - DNA, 22 bp, Homo sapiens
gaaggccattagagcctgtgcc

SEQ ID NO: 7607993 - DNA, 22 bp, Homo sapiens
gaaggccagttttgagataggt

SEQ ID NO: 7607994 - DNA, 22 bp, Homo sapiens
gaaggccattagagcctgtgcc

SEQ ID NO: 7607995 - DNA, 22 bp, Homo sapiens
gaaggccattagagcctgtgcc

SEQ ID NO: 7607996 - DNA, 22 bp, Homo sapiens
gaaggccattagagcctgtgcc

SEQ ID NO: 7607997 - DNA, 22 bp, Homo sapiens
gaaggccattagagcctgtgcc

SEQ ID NO: 7607998 - DNA, 22 bp, Homo sapiens
gaaggccattgcgtcctgggat

SEQ ID NO: 7607999 - DNA, 22 bp, Homo sapiens
gaagcagctggtgagatggagc

SEQ ID NO: 7608000 - DNA, 22 bp, Homo sapiens
gaagcagctggtgagatggagc

SEQ ID NO: 7608001 - DNA, 22 bp, Homo sapiens
gaagcagctggtgagatggagc

SEQ ID NO: 7608002 - DNA, 20 bp, Homo sapiens
gaagcagcttcatgtagaca

SEQ ID NO: 7608003 - DNA, 20 bp, Homo sapiens
gaagcagcttcatgtagaca

SEQ ID NO: 7608004 - DNA, 20 bp, Homo sapiens
gaagcagcttcatgtagaca

SEQ ID NO: 7608005 - DNA, 22 bp, Homo sapiens
gaagcagctttctggtgaggag

SEQ ID NO: 7608006 - DNA, 22 bp, Homo sapiens
gaagcagctttctggtgaggag

SEQ ID NO: 7608007 - DNA, 22 bp, Homo sapiens
gaagcagctttctggtgaggag

SEQ ID NO: 7608008 - DNA, 22 bp, Homo sapiens
gaagcagctttctggtgaggag

SEQ ID NO: 7608009 - DNA, 22 bp, Homo sapiens
gaagcagctttctggtgaggag

SEQ ID NO: 7608010 - DNA, 20 bp, Homo sapiens
gaagcagcttcatgtagaca

SEQ ID NO: 7608011 - DNA, 22 bp, Homo sapiens
gaagcagctttctggtgaggag

SEQ ID NO: 7608012 - DNA, 22 bp, Homo sapiens
gaagcagtagcaactgtgtctt

SEQ ID NO: 7608013 - DNA, 22 bp, Homo sapiens
gaagcagtagcaactgtgtctt

SEQ ID NO: 7608014 - DNA, 22 bp, Homo sapiens
gaagcagtagcaactgtgtctt

SEQ ID NO: 7608015 - DNA, 22 bp, Homo sapiens
gaagcagtagcaactgtgtctt

SEQ ID NO: 7608016 - DNA, 22 bp, Homo sapiens
gaagcagtgtgaacccatgtaa

SEQ ID NO: 7608017 - DNA, 22 bp, Homo sapiens
gaagcagtgtgaacccatgtaa

SEQ ID NO: 7608018 - DNA, 22 bp, Homo sapiens
gaagcagtatcctgacagcacc

SEQ ID NO: 7608019 - DNA, 22 bp, Homo sapiens
gaagcagtatcctgacagcacc

SEQ ID NO: 7608020 - DNA, 22 bp, Homo sapiens
gaagcagtatcctgacagcacc

SEQ ID NO: 7608021 - DNA, 22 bp, Homo sapiens
gaagcagtatcctgacagcacc

SEQ ID NO: 7608022 - DNA, 22 bp, Homo sapiens
gaagcagtcagcagcacctttg

SEQ ID NO: 7608023 - DNA, 22 bp, Homo sapiens
gaagcatgctaaggattctcag

SEQ ID NO: 7608024 - DNA, 22 bp, Homo sapiens
gaagccaacattccaagtagaa

SEQ ID NO: 7608025 - DNA, 22 bp, Homo sapiens
gaagccaagggctgcttttcct

SEQ ID NO: 7608026 - DNA, 22 bp, Homo sapiens
gaagccaagtcctcgagtttca

SEQ ID NO: 7608027 - DNA, 22 bp, Homo sapiens
gaagccaagtgcaaatgcctta

SEQ ID NO: 7608028 - DNA, 22 bp, Homo sapiens
gaagcatgctaaggattctcag

SEQ ID NO: 7608029 - DNA, 22 bp, Homo sapiens
gaagcatcagcaatggctggaa

SEQ ID NO: 7608030 - DNA, 18 bp, Homo sapiens
gaagcatatttgttcttc

SEQ ID NO: 7608031 - DNA, 18 bp, Homo sapiens
gaagcatatttgttcttc

SEQ ID NO: 7608032 - DNA, 22 bp, Homo sapiens
gaagcatataggtactgaacta

SEQ ID NO: 7608033 - DNA, 22 bp, Homo sapiens
gaagcagtgtgaacccatgtaa

SEQ ID NO: 7608034 - DNA, 22 bp, Homo sapiens
gaagcagtgtgaacccatgtaa

SEQ ID NO: 7608035 - DNA, 22 bp, Homo sapiens
gaagcagttcgaaagcagttgg

SEQ ID NO: 7608036 - DNA, 22 bp, Homo sapiens
gaagcagttcgaaagcagttgg

SEQ ID NO: 7608037 - DNA, 22 bp, Homo sapiens
gaagcagtttctgtaatgaaat

SEQ ID NO: 7608038 - DNA, 22 bp, Homo sapiens
gaagcaagtgcaaggaagaggc

SEQ ID NO: 7608039 - DNA, 22 bp, Homo sapiens
gaagcaagtgcaaggaagaggc

SEQ ID NO: 7608040 - DNA, 22 bp, Homo sapiens
gaagcaagtgcaaggaagaggc

SEQ ID NO: 7608041 - DNA, 22 bp, Homo sapiens
gaagcaagtgcaaggaagaggc

SEQ ID NO: 7608042 - DNA, 22 bp, Homo sapiens
gaagcaagtgcaaggaagaggc

SEQ ID NO: 7608043 - DNA, 22 bp, Homo sapiens
gaagcaagtgcaaggaagaggc

SEQ ID NO: 7608044 - DNA, 22 bp, Homo sapiens
gaagcagcagctggggacagtt

SEQ ID NO: 7608045 - DNA, 22 bp, Homo sapiens
gaagcaagtggcctgattcaga

SEQ ID NO: 7608046 - DNA, 22 bp, Homo sapiens
gaagcaatctggctcccagcca

SEQ ID NO: 7608047 - DNA, 22 bp, Homo sapiens
gaagcaagtggcctgattcaga

SEQ ID NO: 7608048 - DNA, 22 bp, Homo sapiens
gaagcaagtggcctgattcaga

SEQ ID NO: 7608049 - DNA, 22 bp, Homo sapiens
gaagcaagtggcctgattcaga

SEQ ID NO: 7608050 - DNA, 22 bp, Homo sapiens
gaagcaagtggcctgattcaga

SEQ ID NO: 7608051 - DNA, 22 bp, Homo sapiens
gaagcaagtggcctgattcaga

SEQ ID NO: 7608052 - DNA, 22 bp, Homo sapiens
gaagcaaagagctagtgccgct

SEQ ID NO: 7608053 - DNA, 22 bp, Homo sapiens
gaagcaaagagctagtgccgct

SEQ ID NO: 7608054 - DNA, 22 bp, Homo sapiens
gaagcaaagagctagtgccgct

SEQ ID NO: 7608055 - DNA, 22 bp, Homo sapiens
gaagcaaagagctagtgccgct

SEQ ID NO: 7608056 - DNA, 22 bp, Homo sapiens
gaagcaaaatgtctgcacatat

SEQ ID NO: 7608057 - DNA, 22 bp, Homo sapiens
gaagcaaaatgtctgcacatat

SEQ ID NO: 7608058 - DNA, 22 bp, Homo sapiens
gaaaggcaggcagggtgtccat

SEQ ID NO: 7608059 - DNA, 22 bp, Homo sapiens
gaaaggatttggtgccaagcgt

SEQ ID NO: 7608060 - DNA, 22 bp, Homo sapiens
gaaaggcaggcagggtgtccat

SEQ ID NO: 7608061 - DNA, 22 bp, Homo sapiens
gaaaggcaggcagggtgtccat

SEQ ID NO: 7608062 - DNA, 22 bp, Homo sapiens
gaaaggcaggcagggtgtccat

SEQ ID NO: 7608063 - DNA, 22 bp, Homo sapiens
gaagcagcagctggggacagtt

SEQ ID NO: 7608064 - DNA, 22 bp, Homo sapiens
gaagcagcagctggggacagtt

SEQ ID NO: 7608065 - DNA, 22 bp, Homo sapiens
gaagcagccacggggagacaga

SEQ ID NO: 7608066 - DNA, 22 bp, Homo sapiens
gaagcagccacggggagacaga

SEQ ID NO: 7608067 - DNA, 22 bp, Homo sapiens
gaagcagcgaagtggaagggac

SEQ ID NO: 7608068 - DNA, 22 bp, Homo sapiens
gaagcagcgaagtggaagggac

SEQ ID NO: 7608069 - DNA, 22 bp, Homo sapiens
gaagcagcgaagtggaagggac

SEQ ID NO: 7608070 - DNA, 22 bp, Homo sapiens
gaagcagctagcccactagtca

SEQ ID NO: 7608071 - DNA, 22 bp, Homo sapiens
gaagcagctcagattgactgaa

SEQ ID NO: 7608072 - DNA, 22 bp, Homo sapiens
gaagcagctcagattgactgaa

SEQ ID NO: 7608073 - DNA, 22 bp, Homo sapiens
gaagcagctcagattgactgaa

SEQ ID NO: 7608074 - DNA, 22 bp, Homo sapiens
gaagcagctgccagagatgtct

SEQ ID NO: 7608075 - DNA, 22 bp, Homo sapiens
gaagcagctggtgagatggagc

SEQ ID NO: 7608076 - DNA, 22 bp, Homo sapiens
gaagcagctggtgagatggagc

SEQ ID NO: 7608077 - DNA, 22 bp, Homo sapiens
gaagcagctaggatcttcattt

SEQ ID NO: 7608078 - DNA, 22 bp, Homo sapiens
gaagcagctaggatcttcattt

SEQ ID NO: 7608079 - DNA, 22 bp, Homo sapiens
gaagcagctaggatcttcattt

SEQ ID NO: 7608080 - DNA, 22 bp, Homo sapiens
gaagcagctaggatcttcattt

SEQ ID NO: 7608081 - DNA, 22 bp, Homo sapiens
gaagcagctagcccactagtca

SEQ ID NO: 7608082 - DNA, 22 bp, Homo sapiens
gaagcagctaggatcttcattt

SEQ ID NO: 7608083 - DNA, 22 bp, Homo sapiens
gaaaggaaatattctaagcact

SEQ ID NO: 7608084 - DNA, 22 bp, Homo sapiens
gaaaggaaatattctaagcact

SEQ ID NO: 7608085 - DNA, 22 bp, Homo sapiens
gaaaggaaatattctaagcact

SEQ ID NO: 7608086 - DNA, 22 bp, Homo sapiens
gaaaggaaatattctaagcact

SEQ ID NO: 7608087 - DNA, 22 bp, Homo sapiens
gaaagcttccattttgtacatt

SEQ ID NO: 7608088 - DNA, 22 bp, Homo sapiens
gaaaggaaatattctaagcact

SEQ ID NO: 7608089 - DNA, 22 bp, Homo sapiens
gaaaggaaatattctaagcact

SEQ ID NO: 7608090 - DNA, 22 bp, Homo sapiens
gaaaggaaatattctaagcact

SEQ ID NO: 7608091 - DNA, 22 bp, Homo sapiens
gaaaggaaatattctaagcact

SEQ ID NO: 7608092 - DNA, 22 bp, Homo sapiens
gaaagcttccattttgtacatt

SEQ ID NO: 7608093 - DNA, 22 bp, Homo sapiens
gaaagcttccattttgtacatt

SEQ ID NO: 7608094 - DNA, 22 bp, Homo sapiens
gaaagcttccattttgtacatt

SEQ ID NO: 7608095 - DNA, 22 bp, Homo sapiens
gaaagctctgcttcagcctgca

SEQ ID NO: 7608096 - DNA, 22 bp, Homo sapiens
gaaagctgaaccaggaaccatg

SEQ ID NO: 7608097 - DNA, 22 bp, Homo sapiens
gaaagctgaaccaggaaccatg

SEQ ID NO: 7608098 - DNA, 22 bp, Homo sapiens
gaaagctgaaccaggaaccatg

SEQ ID NO: 7608099 - DNA, 22 bp, Homo sapiens
gaaagctgggaaataaatatta

SEQ ID NO: 7608100 - DNA, 22 bp, Homo sapiens
gaaagctgggaaataaatatta

SEQ ID NO: 7608101 - DNA, 22 bp, Homo sapiens
gaaagctgggaaataaatatta

SEQ ID NO: 7608102 - DNA, 22 bp, Homo sapiens
gaaagctgtgaaatagtgctct

SEQ ID NO: 7608103 - DNA, 22 bp, Homo sapiens
gaaagctgtgaaatagtgctct

SEQ ID NO: 7608104 - DNA, 22 bp, Homo sapiens
gaaagctgtgaaatagtgctct

SEQ ID NO: 7608105 - DNA, 22 bp, Homo sapiens
gaaagctgtgaaatagtgctct

SEQ ID NO: 7608106 - DNA, 22 bp, Homo sapiens
gaaaggaagaaaggtcatttta

SEQ ID NO: 7608107 - DNA, 18 bp, Homo sapiens
gaaaggagagacagtagg

SEQ ID NO: 7608108 - DNA, 18 bp, Homo sapiens
gaaaggagagacagtagg

SEQ ID NO: 7608109 - DNA, 18 bp, Homo sapiens
gaaaggagagacagtagg

SEQ ID NO: 7608110 - DNA, 22 bp, Homo sapiens
gaaaggaagaaaggtcatttta

SEQ ID NO: 7608111 - DNA, 22 bp, Homo sapiens
gaaaggaagaaaggtcatttta

SEQ ID NO: 7608112 - DNA, 22 bp, Homo sapiens
gaaaggaagaaaggtcatttta

SEQ ID NO: 7608113 - DNA, 22 bp, Homo sapiens
gaaaggaagaaaggtcatttta

SEQ ID NO: 7608114 - DNA, 22 bp, Homo sapiens
gaaaggaagaaaggtcatttta

SEQ ID NO: 7608115 - DNA, 18 bp, Homo sapiens
gaaaggagagacagtagg

SEQ ID NO: 7608116 - DNA, 22 bp, Homo sapiens
gaaaggaaattgagggacgcat

SEQ ID NO: 7608117 - DNA, 22 bp, Homo sapiens
gaaaggaaattgagggacgcat

SEQ ID NO: 7608118 - DNA, 22 bp, Homo sapiens
gaaaggaaattgagggacgcat

SEQ ID NO: 7608119 - DNA, 22 bp, Homo sapiens
gaaaggaaattgagggacgcat

SEQ ID NO: 7608120 - DNA, 22 bp, Homo sapiens
gaaaggaaattgagggacgcat

SEQ ID NO: 7608121 - DNA, 22 bp, Homo sapiens
gaaaggaacttgtgagtgggag

SEQ ID NO: 7608122 - DNA, 22 bp, Homo sapiens
gaaaggaacttgtgagtgggag

SEQ ID NO: 7608123 - DNA, 22 bp, Homo sapiens
gaaaggaacttgtgagtgggag

SEQ ID NO: 7608124 - DNA, 22 bp, Homo sapiens
gaaaggaacttgtgagtgggag

SEQ ID NO: 7608125 - DNA, 22 bp, Homo sapiens
gaaaggagggctcacaaaagtg

SEQ ID NO: 7608126 - DNA, 22 bp, Homo sapiens
gaaaggagggaaacagagcggt

SEQ ID NO: 7608127 - DNA, 22 bp, Homo sapiens
gaaaggagggctcacaaaagtg

SEQ ID NO: 7608128 - DNA, 22 bp, Homo sapiens
gaaaggagggctcacaaaagtg

SEQ ID NO: 7608129 - DNA, 22 bp, Homo sapiens
gaaaggagtcagtcttactgaa

SEQ ID NO: 7608130 - DNA, 22 bp, Homo sapiens
gaaaggagggctcacaaaagtg

SEQ ID NO: 7608131 - DNA, 22 bp, Homo sapiens
gaaaggagtcagtcttactgaa

SEQ ID NO: 7608132 - DNA, 20 bp, Homo sapiens
gaaaggagtgtccctgtgag

SEQ ID NO: 7608133 - DNA, 17 bp, Homo sapiens
gaaaggaggcaacactg

SEQ ID NO: 7608134 - DNA, 17 bp, Homo sapiens
gaaaggaggcaacactg

SEQ ID NO: 7608135 - DNA, 22 bp, Homo sapiens
gaaaggagagggttaaggagct

SEQ ID NO: 7608136 - DNA, 22 bp, Homo sapiens
gaaaggagagggttaaggagct

SEQ ID NO: 7608137 - DNA, 22 bp, Homo sapiens
gaaaggagagggttaaggagct

SEQ ID NO: 7608138 - DNA, 17 bp, Homo sapiens
gaaaggaggcaacactg

SEQ ID NO: 7608139 - DNA, 17 bp, Homo sapiens
gaaaggaggcaacactg

SEQ ID NO: 7608140 - DNA, 22 bp, Homo sapiens
gaaaggagggaaacagagcggt

SEQ ID NO: 7608141 - DNA, 22 bp, Homo sapiens
gaaaggagggaaacagagcggt

SEQ ID NO: 7608142 - DNA, 22 bp, Homo sapiens
gaaaggagggaaacagagcggt

SEQ ID NO: 7608143 - DNA, 18 bp, Homo sapiens
gaaaggagagacagtagg

SEQ ID NO: 7608144 - DNA, 18 bp, Homo sapiens
gaaaggagagacagtagg

SEQ ID NO: 7608145 - DNA, 22 bp, Homo sapiens
gaaaggagagggttaaggagct

SEQ ID NO: 7608146 - DNA, 22 bp, Homo sapiens
gaaaggagagggttaaggagct

SEQ ID NO: 7608147 - DNA, 22 bp, Homo sapiens
gaaaggagagggttaaggagct

SEQ ID NO: 7608148 - DNA, 22 bp, Homo sapiens
gaaaggagagggttaaggagct

SEQ ID NO: 7608149 - DNA, 22 bp, Homo sapiens
gaaaggagagggttaaggagct

SEQ ID NO: 7608150 - DNA, 22 bp, Homo sapiens
gaatgaataggtgtccagatgg

SEQ ID NO: 7608151 - DNA, 22 bp, Homo sapiens
gaatgaatctgtaagtgacaag

SEQ ID NO: 7608152 - DNA, 22 bp, Homo sapiens
gaatgaatctgtaagtgacaag

SEQ ID NO: 7608153 - DNA, 22 bp, Homo sapiens
gaatgaatctgtaagtgacaag

SEQ ID NO: 7608154 - DNA, 22 bp, Homo sapiens
gaatgaattcagcacatggaat

SEQ ID NO: 7608155 - DNA, 22 bp, Homo sapiens
gaatgaattcagcacatggaat

SEQ ID NO: 7608156 - DNA, 22 bp, Homo sapiens
gaatgaacaaggatgttcatcc

SEQ ID NO: 7608157 - DNA, 22 bp, Homo sapiens
gaatgaacaaggatgttcatcc

SEQ ID NO: 7608158 - DNA, 22 bp, Homo sapiens
gaatgaacaaggatgttcatcc

SEQ ID NO: 7608159 - DNA, 22 bp, Homo sapiens
gaatgaacaaatgtggtggaga

SEQ ID NO: 7608160 - DNA, 22 bp, Homo sapiens
gaatgaaagatttgcattctat

SEQ ID NO: 7608161 - DNA, 22 bp, Homo sapiens
gaatgaaagatttgcattctat

SEQ ID NO: 7608162 - DNA, 22 bp, Homo sapiens
gaatgaaagatttgcattctat

SEQ ID NO: 7608163 - DNA, 22 bp, Homo sapiens
gaatgaaagatttgcattctat

SEQ ID NO: 7608164 - DNA, 22 bp, Homo sapiens
gaatcttttttcttgccaggca

SEQ ID NO: 7608165 - DNA, 21 bp, Homo sapiens
gaatctttgatttacatggga

SEQ ID NO: 7608166 - DNA, 22 bp, Homo sapiens
gaatcttttgtctcgtgaataa

SEQ ID NO: 7608167 - DNA, 22 bp, Homo sapiens
gaatgaaaaccttggctcaaat

SEQ ID NO: 7608168 - DNA, 22 bp, Homo sapiens
gaatgaaaaccttggctcaaat

SEQ ID NO: 7608169 - DNA, 22 bp, Homo sapiens
gaatgacattgaaaagacattg

SEQ ID NO: 7608170 - DNA, 22 bp, Homo sapiens
gaatgacattgaaaagacattg

SEQ ID NO: 7608171 - DNA, 22 bp, Homo sapiens
gaatgacattgaaaagacattg

SEQ ID NO: 7608172 - DNA, 22 bp, Homo sapiens
gaatgacattgagccataacat

SEQ ID NO: 7608173 - DNA, 22 bp, Homo sapiens
gaatgacccactatcaagagac

SEQ ID NO: 7608174 - DNA, 22 bp, Homo sapiens
gaatgagggagatgttggtgca

SEQ ID NO: 7608175 - DNA, 22 bp, Homo sapiens
gaatgagactatgcgagtgtga

SEQ ID NO: 7608176 - DNA, 22 bp, Homo sapiens
gaatgagactatgcgagtgtga

SEQ ID NO: 7608177 - DNA, 22 bp, Homo sapiens
gaatgagtagagtataaacaaa

SEQ ID NO: 7608178 - DNA, 22 bp, Homo sapiens
gaatgagttaatatttgcttgg

SEQ ID NO: 7608179 - DNA, 22 bp, Homo sapiens
gaatgatatattagcagatttt

SEQ ID NO: 7608180 - DNA, 22 bp, Homo sapiens
gaatgatatattagcagatttt

SEQ ID NO: 7608181 - DNA, 22 bp, Homo sapiens
gaatgatatattagcagatttt

SEQ ID NO: 7608182 - DNA, 22 bp, Homo sapiens
gaatgatagagctgccttcgga

SEQ ID NO: 7608183 - DNA, 22 bp, Homo sapiens
gaatgataaatggaagcagcat

SEQ ID NO: 7608184 - DNA, 22 bp, Homo sapiens
gaatgataaatggaagcagcat

SEQ ID NO: 7608185 - DNA, 22 bp, Homo sapiens
gaatgatagagctgccttcgga

SEQ ID NO: 7608186 - DNA, 22 bp, Homo sapiens
gacactgtgctagctgggctta

SEQ ID NO: 7608187 - DNA, 22 bp, Homo sapiens
gacactgtgctagctgggctta

SEQ ID NO: 7608188 - DNA, 22 bp, Homo sapiens
gacactgtcccacagaattcga

SEQ ID NO: 7608189 - DNA, 22 bp, Homo sapiens
gacactggcttgtcccgccatc

SEQ ID NO: 7608190 - DNA, 22 bp, Homo sapiens
gacactgtcccacagaattcga

SEQ ID NO: 7608191 - DNA, 22 bp, Homo sapiens
gacactggcttgtcccgccatc

SEQ ID NO: 7608192 - DNA, 22 bp, Homo sapiens
gacactggatttctagaaatgt

SEQ ID NO: 7608193 - DNA, 22 bp, Homo sapiens
gacactggaaatattgaattgg

SEQ ID NO: 7608194 - DNA, 19 bp, Homo sapiens
gacacagttggttcctttg

SEQ ID NO: 7608195 - DNA, 22 bp, Homo sapiens
gacacagttctgttctagtagg

SEQ ID NO: 7608196 - DNA, 22 bp, Homo sapiens
gacacagttctgttctagtagg

SEQ ID NO: 7608197 - DNA, 21 bp, Homo sapiens
gacactgcttactctgaccta

SEQ ID NO: 7608198 - DNA, 22 bp, Homo sapiens
gacactgttatggtgaggtaag

SEQ ID NO: 7608199 - DNA, 22 bp, Homo sapiens
gacactgttatggtgaggtaag

SEQ ID NO: 7608200 - DNA, 22 bp, Homo sapiens
gacactgtgctagctgggctta

SEQ ID NO: 7608201 - DNA, 22 bp, Homo sapiens
gacactttaggccaccatgcaa

SEQ ID NO: 7608202 - DNA, 22 bp, Homo sapiens
gacactttaggatttaaaagtc

SEQ ID NO: 7608203 - DNA, 22 bp, Homo sapiens
gacacttgacatccagcagcaa

SEQ ID NO: 7608204 - DNA, 22 bp, Homo sapiens
gacacttgacatccagcagcaa

SEQ ID NO: 7608205 - DNA, 22 bp, Homo sapiens
gaatgatttggttgtttagatt

SEQ ID NO: 7608206 - DNA, 21 bp, Homo sapiens
gacacagtaatcttggggctt

SEQ ID NO: 7608207 - DNA, 21 bp, Homo sapiens
gacacagtaatcttggggctt

SEQ ID NO: 7608208 - DNA, 22 bp, Homo sapiens
gacacagtaatgtgtttcatct

SEQ ID NO: 7608209 - DNA, 22 bp, Homo sapiens
gaatgatttggttgtttagatt

SEQ ID NO: 7608210 - DNA, 22 bp, Homo sapiens
gacacagtaatgtgtttcatct

SEQ ID NO: 7608211 - DNA, 22 bp, Homo sapiens
gaatgatattatttcgtgctgg

SEQ ID NO: 7608212 - DNA, 22 bp, Homo sapiens
gaatgatattatttcgtgctgg

SEQ ID NO: 7608213 - DNA, 22 bp, Homo sapiens
gaatgatatattagcagatttt

SEQ ID NO: 7608214 - DNA, 22 bp, Homo sapiens
gacacagttacttattttgcct

SEQ ID NO: 7608215 - DNA, 22 bp, Homo sapiens
gacacagttccctatgaggtaa

SEQ ID NO: 7608216 - DNA, 22 bp, Homo sapiens
gacacagtggttctgtgagtaa

SEQ ID NO: 7608217 - DNA, 19 bp, Homo sapiens
gacacagttggttcctttg

SEQ ID NO: 7608218 - DNA, 22 bp, Homo sapiens
gacacagttctgttctagtagg

SEQ ID NO: 7608219 - DNA, 22 bp, Homo sapiens
gacacagttacttattttgcct

SEQ ID NO: 7608220 - DNA, 22 bp, Homo sapiens
gacacagtggttctgtgagtaa

SEQ ID NO: 7608221 - DNA, 22 bp, Homo sapiens
gacacagtagccagtgcagtga

SEQ ID NO: 7608222 - DNA, 22 bp, Homo sapiens
gacacagtagccagtgcagtga

SEQ ID NO: 7608223 - DNA, 22 bp, Homo sapiens
gacacagtcaagagtggaggaa

SEQ ID NO: 7608224 - DNA, 22 bp, Homo sapiens
gacacagtcaagagtggaggaa

SEQ ID NO: 7608225 - DNA, 22 bp, Homo sapiens
gacagacactgtgtcctcactt

SEQ ID NO: 7608226 - DNA, 22 bp, Homo sapiens
gacagacactgtgtcctcactt

SEQ ID NO: 7608227 - DNA, 22 bp, Homo sapiens
gacagacactgtgtcctcactt

SEQ ID NO: 7608228 - DNA, 22 bp, Homo sapiens
gacagacagagaatgggcttga

SEQ ID NO: 7608229 - DNA, 22 bp, Homo sapiens
gacagacactgtgtcctcactt

SEQ ID NO: 7608230 - DNA, 22 bp, Homo sapiens
gacagacactgtgtcctcactt

SEQ ID NO: 7608231 - DNA, 22 bp, Homo sapiens
gacagacactattggtatgcct

SEQ ID NO: 7608232 - DNA, 22 bp, Homo sapiens
gacagacactattggtatgcct

SEQ ID NO: 7608233 - DNA, 22 bp, Homo sapiens
gacagacactattggtatgcct

SEQ ID NO: 7608234 - DNA, 22 bp, Homo sapiens
gacagacaggaggcattcaggg

SEQ ID NO: 7608235 - DNA, 22 bp, Homo sapiens
gacagacaggaggcattcaggg

SEQ ID NO: 7608236 - DNA, 22 bp, Homo sapiens
gacagacaggagctcacaggca

SEQ ID NO: 7608237 - DNA, 22 bp, Homo sapiens
gacagacaggagctcacaggca

SEQ ID NO: 7608238 - DNA, 22 bp, Homo sapiens
gacagacaggaggccacctgct

SEQ ID NO: 7608239 - DNA, 22 bp, Homo sapiens
gacagacaggaggccacctgct

SEQ ID NO: 7608240 - DNA, 22 bp, Homo sapiens
gacagacaggaggccacctgct

SEQ ID NO: 7608241 - DNA, 22 bp, Homo sapiens
gacagacaggaggccacctgct

SEQ ID NO: 7608242 - DNA, 22 bp, Homo sapiens
gacagacaggggttctcctgga

SEQ ID NO: 7608243 - DNA, 22 bp, Homo sapiens
gacagacaggggttctcctgga

SEQ ID NO: 7608244 - DNA, 22 bp, Homo sapiens
gacagacaggaggccacctgct

SEQ ID NO: 7608245 - DNA, 22 bp, Homo sapiens
gacagacaggggttctcctgga

SEQ ID NO: 7608246 - DNA, 22 bp, Homo sapiens
gacagacaggggttctcctgga

SEQ ID NO: 7608247 - DNA, 22 bp, Homo sapiens
gacagacaggggttctcctgga

SEQ ID NO: 7608248 - DNA, 22 bp, Homo sapiens
gacagacaggggttctcctgga

SEQ ID NO: 7608249 - DNA, 22 bp, Homo sapiens
gacagacaggtgtggtaggcac

SEQ ID NO: 7608250 - DNA, 22 bp, Homo sapiens
gacagacaggtgtggtaggcac

SEQ ID NO: 7608251 - DNA, 22 bp, Homo sapiens
gacagacaggtgtggtaggcac

SEQ ID NO: 7608252 - DNA, 22 bp, Homo sapiens
gacagacaggtgtggtaggcac

SEQ ID NO: 7608253 - DNA, 22 bp, Homo sapiens
gacagacactattggtatgcct

SEQ ID NO: 7608254 - DNA, 22 bp, Homo sapiens
gacagacactattggtatgcct

SEQ ID NO: 7608255 - DNA, 22 bp, Homo sapiens
gacagacacagggccatgattg

SEQ ID NO: 7608256 - DNA, 22 bp, Homo sapiens
gacagacacctggggggttgct

SEQ ID NO: 7608257 - DNA, 22 bp, Homo sapiens
gacagacacagggccatgattg

SEQ ID NO: 7608258 - DNA, 22 bp, Homo sapiens
gacagacacagggccatgattg

SEQ ID NO: 7608259 - DNA, 22 bp, Homo sapiens
gacagaattttccatcatgtgg

SEQ ID NO: 7608260 - DNA, 22 bp, Homo sapiens
gacagaattttccatcatgtgg

SEQ ID NO: 7608261 - DNA, 22 bp, Homo sapiens
gacagacacaattgatccatga

SEQ ID NO: 7608262 - DNA, 22 bp, Homo sapiens
gacagacacaattgatccatga

SEQ ID NO: 7608263 - DNA, 22 bp, Homo sapiens
gacactttctcaggtaaagcat

SEQ ID NO: 7608264 - DNA, 22 bp, Homo sapiens
gacactttattaagctgttgtt

SEQ ID NO: 7608265 - DNA, 22 bp, Homo sapiens
gacactttattaagctgttgtt

SEQ ID NO: 7608266 - DNA, 22 bp, Homo sapiens
gacactttgggactcagcccta

SEQ ID NO: 7608267 - DNA, 22 bp, Homo sapiens
gacactttggtgctttgtggtt

SEQ ID NO: 7608268 - DNA, 22 bp, Homo sapiens
gacagaactcaaacatgagaag

SEQ ID NO: 7608269 - DNA, 22 bp, Homo sapiens
gacagaattttccatcatgtgg

SEQ ID NO: 7608270 - DNA, 22 bp, Homo sapiens
gacagaatcatctcctgggact

SEQ ID NO: 7608271 - DNA, 22 bp, Homo sapiens
gacagaaggcatctagggcacg

SEQ ID NO: 7608272 - DNA, 22 bp, Homo sapiens
gacagaagaggaacttggacag

SEQ ID NO: 7608273 - DNA, 22 bp, Homo sapiens
gacagaaggcatctagggcacg

SEQ ID NO: 7608274 - DNA, 22 bp, Homo sapiens
gacagaaggcatctagggcacg

SEQ ID NO: 7608275 - DNA, 22 bp, Homo sapiens
gaaggtttactgaagatttaaa

SEQ ID NO: 7608276 - DNA, 22 bp, Homo sapiens
gaaggtggcgagcggattgctg

SEQ ID NO: 7608277 - DNA, 22 bp, Homo sapiens
gaaggtttactgaagatttaaa

SEQ ID NO: 7608278 - DNA, 17 bp, Homo sapiens
gaaggtttctcttaggt

SEQ ID NO: 7608279 - DNA, 22 bp, Homo sapiens
gaaggtttgaaataggtataga

SEQ ID NO: 7608280 - DNA, 22 bp, Homo sapiens
gaatatttgtaattactgttga

SEQ ID NO: 7608281 - DNA, 22 bp, Homo sapiens
gaatatttgtaattactgttga

SEQ ID NO: 7608282 - DNA, 22 bp, Homo sapiens
gaaggtttgatccttatttata

SEQ ID NO: 7608283 - DNA, 22 bp, Homo sapiens
gaatatttgtaattactgttga

SEQ ID NO: 7608284 - DNA, 22 bp, Homo sapiens
gaatatttgtaattactgttga

SEQ ID NO: 7608285 - DNA, 22 bp, Homo sapiens
gaatatttgtaattactgttga

SEQ ID NO: 7608286 - DNA, 22 bp, Homo sapiens
gaatatttgtaattactgttga

SEQ ID NO: 7608287 - DNA, 22 bp, Homo sapiens
gaatatttgtaattactgttga

SEQ ID NO: 7608288 - DNA, 22 bp, Homo sapiens
gaatcatttatttttgacagca

SEQ ID NO: 7608289 - DNA, 22 bp, Homo sapiens
gaatcatttcttctgaaaggta

SEQ ID NO: 7608290 - DNA, 22 bp, Homo sapiens
gaatcatttagctctgcatgga

SEQ ID NO: 7608291 - DNA, 22 bp, Homo sapiens
gaatcatttatttttgacagca

SEQ ID NO: 7608292 - DNA, 22 bp, Homo sapiens
gaatccaggacggtcgtgggtt

SEQ ID NO: 7608293 - DNA, 22 bp, Homo sapiens
gaatccaggacggtcgtgggtt

SEQ ID NO: 7608294 - DNA, 22 bp, Homo sapiens
gaatcatttagctctgcatgga

SEQ ID NO: 7608295 - DNA, 22 bp, Homo sapiens
gaatcatttcttctgaaaggta

SEQ ID NO: 7608296 - DNA, 22 bp, Homo sapiens
gaatccagatttttctcttatt

SEQ ID NO: 7608297 - DNA, 22 bp, Homo sapiens
gaatcatttatttttgacagca

SEQ ID NO: 7608298 - DNA, 22 bp, Homo sapiens
gaatccagggtgtttgctgagg

SEQ ID NO: 7608299 - DNA, 22 bp, Homo sapiens
gaatccagggttgtttgagcta

SEQ ID NO: 7608300 - DNA, 22 bp, Homo sapiens
gaatccagggttgtttgagcta

SEQ ID NO: 7608301 - DNA, 22 bp, Homo sapiens
gaatattttcagtacagatggt

SEQ ID NO: 7608302 - DNA, 22 bp, Homo sapiens
gaatatttgtaattactgttga

SEQ ID NO: 7608303 - DNA, 22 bp, Homo sapiens
gaatcattcattgctcaattaa

SEQ ID NO: 7608304 - DNA, 22 bp, Homo sapiens
gaatcattcattgctcaattaa

SEQ ID NO: 7608305 - DNA, 22 bp, Homo sapiens
gaatattttcagtacagatggt

SEQ ID NO: 7608306 - DNA, 22 bp, Homo sapiens
gaatattttcagtacagatggt

SEQ ID NO: 7608307 - DNA, 22 bp, Homo sapiens
gaatcattggaaccacatccaa

SEQ ID NO: 7608308 - DNA, 22 bp, Homo sapiens
gaatcattggaaccacatccaa

SEQ ID NO: 7608309 - DNA, 22 bp, Homo sapiens
gaatctgcattttaacaagatc

SEQ ID NO: 7608310 - DNA, 22 bp, Homo sapiens
gaatcccaatctgttattgaca

SEQ ID NO: 7608311 - DNA, 22 bp, Homo sapiens
gaatctgtcacttggccactct

SEQ ID NO: 7608312 - DNA, 22 bp, Homo sapiens
gaatcttaaatcggaatcttaa

SEQ ID NO: 7608313 - DNA, 22 bp, Homo sapiens
gaatctgtgtgaaattcacaca

SEQ ID NO: 7608314 - DNA, 22 bp, Homo sapiens
gaatctgtgtgaaattcacaca

SEQ ID NO: 7608315 - DNA, 22 bp, Homo sapiens
gaatcttagaaaggttaaggaa

SEQ ID NO: 7608316 - DNA, 22 bp, Homo sapiens
gaatcttatgtggtgttttcta

SEQ ID NO: 7608317 - DNA, 20 bp, Homo sapiens
gaatctttccccatgcaatg

SEQ ID NO: 7608318 - DNA, 22 bp, Homo sapiens
gaatccatcatgcagaacaatg

SEQ ID NO: 7608319 - DNA, 22 bp, Homo sapiens
gaatcccaatctgttattgaca

SEQ ID NO: 7608320 - DNA, 22 bp, Homo sapiens
gaatcccttgcaagttgttgta

SEQ ID NO: 7608321 - DNA, 22 bp, Homo sapiens
gaatcccttgcaagttgttgta

SEQ ID NO: 7608322 - DNA, 22 bp, Homo sapiens
gaatcccttgcattatcccttt

SEQ ID NO: 7608323 - DNA, 22 bp, Homo sapiens
gaatccatcatgcagaacaatg

SEQ ID NO: 7608324 - DNA, 22 bp, Homo sapiens
gaatccttggggaatggggccc

SEQ ID NO: 7608325 - DNA, 22 bp, Homo sapiens
gaatctcaggggagttactgga

SEQ ID NO: 7608326 - DNA, 22 bp, Homo sapiens
gaatctcaggaagatctctgca

SEQ ID NO: 7608327 - DNA, 22 bp, Homo sapiens
gaatctcaggaagatctctgca

SEQ ID NO: 7608328 - DNA, 22 bp, Homo sapiens
gaatctatgcctcatatagacc

SEQ ID NO: 7608329 - DNA, 22 bp, Homo sapiens
gaatctatgcctcatatagacc

SEQ ID NO: 7608330 - DNA, 22 bp, Homo sapiens
gaaggtgcagtggctggaggct

SEQ ID NO: 7608331 - DNA, 22 bp, Homo sapiens
gaaggtgcagtggctggaggct

SEQ ID NO: 7608332 - DNA, 22 bp, Homo sapiens
gaaggtggcgagcggattgctg

SEQ ID NO: 7608333 - DNA, 22 bp, Homo sapiens
gaaggtggcgagcggattgctg

SEQ ID NO: 7608334 - DNA, 22 bp, Homo sapiens
gaaggtgcaggcaaggttggtt

SEQ ID NO: 7608335 - DNA, 22 bp, Homo sapiens
gaaggtgcaggcaaggttggtt

SEQ ID NO: 7608336 - DNA, 22 bp, Homo sapiens
gaaggtccagcgtggccaagtc

SEQ ID NO: 7608337 - DNA, 22 bp, Homo sapiens
gaaggtggcgagcggattgctg

SEQ ID NO: 7608338 - DNA, 22 bp, Homo sapiens
gaagggtgtgtgtgagggacac

SEQ ID NO: 7608339 - DNA, 22 bp, Homo sapiens
gaaggtagctgctgagatgaca

SEQ ID NO: 7608340 - DNA, 22 bp, Homo sapiens
gaaggtagctgctgagatgaca

SEQ ID NO: 7608341 - DNA, 22 bp, Homo sapiens
gaagggtgtgtgtgagggacac

SEQ ID NO: 7608342 - DNA, 22 bp, Homo sapiens
gaagggtgtgtgtgagggacac

SEQ ID NO: 7608343 - DNA, 22 bp, Homo sapiens
gaagggtgtgtgtgagggacac

SEQ ID NO: 7608344 - DNA, 22 bp, Homo sapiens
gaagggtgtgtgtgagggacac

SEQ ID NO: 7608345 - DNA, 22 bp, Homo sapiens
gaagggtgcatggagggaagtc

SEQ ID NO: 7608346 - DNA, 22 bp, Homo sapiens
gaagggtgcatggagggaagtc

SEQ ID NO: 7608347 - DNA, 22 bp, Homo sapiens
gaagggtgcatggagggaagtc

SEQ ID NO: 7608348 - DNA, 22 bp, Homo sapiens
gaagggtgtgatttgcctgaga

SEQ ID NO: 7608349 - DNA, 22 bp, Homo sapiens
gaagggtgtgatttgcctgaga

SEQ ID NO: 7608350 - DNA, 22 bp, Homo sapiens
gaagggtgtgtgtgagggacac

SEQ ID NO: 7608351 - DNA, 22 bp, Homo sapiens
gaagggtgtgatttgcctgaga

SEQ ID NO: 7608352 - DNA, 22 bp, Homo sapiens
gaagggggttgcagtctagggt

SEQ ID NO: 7608353 - DNA, 22 bp, Homo sapiens
gaagggggttgcagtctagggt

SEQ ID NO: 7608354 - DNA, 22 bp, Homo sapiens
gaagggggttgcagtctagggt

SEQ ID NO: 7608355 - DNA, 22 bp, Homo sapiens
gaagggggttgcagtctagggt

SEQ ID NO: 7608356 - DNA, 22 bp, Homo sapiens
gaagggggagctcttcctaatt

SEQ ID NO: 7608357 - DNA, 22 bp, Homo sapiens
gaagggggagctcttcctaatt

SEQ ID NO: 7608358 - DNA, 22 bp, Homo sapiens
gaagggggaaaatgacaacaga

SEQ ID NO: 7608359 - DNA, 22 bp, Homo sapiens
gaagggtgcatggagggaagtc

SEQ ID NO: 7608360 - DNA, 22 bp, Homo sapiens
gaagggtgcatggagggaagtc

SEQ ID NO: 7608361 - DNA, 22 bp, Homo sapiens
gaagggtgcatggagggaagtc

SEQ ID NO: 7608362 - DNA, 22 bp, Homo sapiens
gaagggtgcatggagggaagtc

SEQ ID NO: 7608363 - DNA, 22 bp, Homo sapiens
gaagggtgcatggagggaagtc

SEQ ID NO: 7608364 - DNA, 22 bp, Homo sapiens
gaagggtgcatggagggaagtc

SEQ ID NO: 7608365 - DNA, 22 bp, Homo sapiens
gaagggggaaaatgacaacaga

SEQ ID NO: 7608366 - DNA, 22 bp, Homo sapiens
gaaggggagtggctagtgtgtg

SEQ ID NO: 7608367 - DNA, 22 bp, Homo sapiens
gaaggggagtggctagtgtgtg

SEQ ID NO: 7608368 - DNA, 22 bp, Homo sapiens
gaaggggagtggctagtgtgtg

SEQ ID NO: 7608369 - DNA, 22 bp, Homo sapiens
gaaggggactggcagctgcaga

SEQ ID NO: 7608370 - DNA, 22 bp, Homo sapiens
gaaggggactggcagctgcaga

SEQ ID NO: 7608371 - DNA, 22 bp, Homo sapiens
gaaggggactggcagctgcaga

SEQ ID NO: 7608372 - DNA, 22 bp, Homo sapiens
gaaggggactggcagctgcaga

SEQ ID NO: 7608373 - DNA, 19 bp, Homo sapiens
gaaggggaaggtgggtacc

SEQ ID NO: 7608374 - DNA, 22 bp, Homo sapiens
gaaggggactggcagctgcaga

SEQ ID NO: 7608375 - DNA, 22 bp, Homo sapiens
gaaggggactggcagctgcaga

SEQ ID NO: 7608376 - DNA, 19 bp, Homo sapiens
gaaggggaaggtgggtacc

SEQ ID NO: 7608377 - DNA, 22 bp, Homo sapiens
gaaggggaaagttgagcaaata

SEQ ID NO: 7608378 - DNA, 22 bp, Homo sapiens
gaaggggaaagttgagcaaata

SEQ ID NO: 7608379 - DNA, 18 bp, Homo sapiens
gaagggctttgaagtaga

SEQ ID NO: 7608380 - DNA, 22 bp, Homo sapiens
gaaggggaaagttgagcaaata

SEQ ID NO: 7608381 - DNA, 22 bp, Homo sapiens
gaaggggaaagttgagcaaata

SEQ ID NO: 7608382 - DNA, 18 bp, Homo sapiens
gaagggagctggaatgca

SEQ ID NO: 7608383 - DNA, 20 bp, Homo sapiens
gaagggatcactgcatactt

SEQ ID NO: 7608384 - DNA, 18 bp, Homo sapiens
gaagggagctggaatgca

SEQ ID NO: 7608385 - DNA, 18 bp, Homo sapiens
gaagggagctggaatgca

SEQ ID NO: 7608386 - DNA, 18 bp, Homo sapiens
gaagggagctggaatgca

SEQ ID NO: 7608387 - DNA, 22 bp, Homo sapiens
gaagggctgcaggtctgggccc

SEQ ID NO: 7608388 - DNA, 22 bp, Homo sapiens
gaagggctgcaggtctgggccc

SEQ ID NO: 7608389 - DNA, 22 bp, Homo sapiens
gaagggctgcaggtctgggccc

SEQ ID NO: 7608390 - DNA, 22 bp, Homo sapiens
gaagggctgcaggtctgggccc

SEQ ID NO: 7608391 - DNA, 22 bp, Homo sapiens
gaagggctcatcaggtggccgc

SEQ ID NO: 7608392 - DNA, 22 bp, Homo sapiens
gaagggctcatcaggtggccgc

SEQ ID NO: 7608393 - DNA, 22 bp, Homo sapiens
gaagggctcatcaggtggccgc

SEQ ID NO: 7608394 - DNA, 22 bp, Homo sapiens
gaagggctttctgggagaagag

SEQ ID NO: 7608395 - DNA, 22 bp, Homo sapiens
gaagggctttctgggagaagag

SEQ ID NO: 7608396 - DNA, 22 bp, Homo sapiens
gaagggctttctgggagaagag

SEQ ID NO: 7608397 - DNA, 22 bp, Homo sapiens
gaagggctttctgggagaagag

SEQ ID NO: 7608398 - DNA, 22 bp, Homo sapiens
gaagggctttctgggagaagag

SEQ ID NO: 7608399 - DNA, 22 bp, Homo sapiens
gaagggctgcaggtctgggccc

SEQ ID NO: 7608400 - DNA, 22 bp, Homo sapiens
gaagggctgcaggtctgggccc

SEQ ID NO: 7608401 - DNA, 22 bp, Homo sapiens
gaagggcttggctgggaggcca

SEQ ID NO: 7608402 - DNA, 22 bp, Homo sapiens
gacagcaagagacagagcatcc

SEQ ID NO: 7608403 - DNA, 22 bp, Homo sapiens
gacagcaagagacagagcatcc

SEQ ID NO: 7608404 - DNA, 22 bp, Homo sapiens
gacagcaagagacagagcatcc

SEQ ID NO: 7608405 - DNA, 21 bp, Homo sapiens
gacagcaactgtagtcctctt

SEQ ID NO: 7608406 - DNA, 21 bp, Homo sapiens
gacagcaactgtagtcctctt

SEQ ID NO: 7608407 - DNA, 22 bp, Homo sapiens
gacagcaagagacagagcatcc

SEQ ID NO: 7608408 - DNA, 22 bp, Homo sapiens
gacagcaagagacagagcatcc

SEQ ID NO: 7608409 - DNA, 22 bp, Homo sapiens
gacagcaagagacagagcatcc

SEQ ID NO: 7608410 - DNA, 22 bp, Homo sapiens
gacagcaagagacagagcatcc

SEQ ID NO: 7608411 - DNA, 22 bp, Homo sapiens
gacagaggagaagatgctgtgg

SEQ ID NO: 7608412 - DNA, 22 bp, Homo sapiens
gacagaggagaagatgctgtgg

SEQ ID NO: 7608413 - DNA, 22 bp, Homo sapiens
gacagaggagaagatgctgtgg

SEQ ID NO: 7608414 - DNA, 22 bp, Homo sapiens
gacagaggagaagatgctgtgg

SEQ ID NO: 7608415 - DNA, 22 bp, Homo sapiens
gacagaggcaagaccagaagcc

SEQ ID NO: 7608416 - DNA, 22 bp, Homo sapiens
gacagaggcaagaccagaagcc

SEQ ID NO: 7608417 - DNA, 22 bp, Homo sapiens
gacagaggcaagaccagaagcc

SEQ ID NO: 7608418 - DNA, 22 bp, Homo sapiens
gacagaggcaagaccagaagcc

SEQ ID NO: 7608419 - DNA, 22 bp, Homo sapiens
gacagcagacaaaccatgtttt

SEQ ID NO: 7608420 - DNA, 22 bp, Homo sapiens
gacagcagaatccattcccagt

SEQ ID NO: 7608421 - DNA, 22 bp, Homo sapiens
gacagcagacaaaccatgtttt

SEQ ID NO: 7608422 - DNA, 22 bp, Homo sapiens
gacagcagacaaaccatgtttt

SEQ ID NO: 7608423 - DNA, 22 bp, Homo sapiens
gacagcaatgacggggcagctg

SEQ ID NO: 7608424 - DNA, 22 bp, Homo sapiens
gacagcaatgacggggcagctg

SEQ ID NO: 7608425 - DNA, 22 bp, Homo sapiens
gacagcagaatccattcccagt

SEQ ID NO: 7608426 - DNA, 22 bp, Homo sapiens
gacagcagaatccattcccagt

SEQ ID NO: 7608427 - DNA, 22 bp, Homo sapiens
gacagcaatgacggggcagctg

SEQ ID NO: 7608428 - DNA, 22 bp, Homo sapiens
gacagcagaaaacttttgtgct

SEQ ID NO: 7608429 - DNA, 22 bp, Homo sapiens
gacagcagagcagactaatgga

SEQ ID NO: 7608430 - DNA, 22 bp, Homo sapiens
gacagcagacagcctggcccct

SEQ ID NO: 7608431 - DNA, 22 bp, Homo sapiens
gacagcagacagcctggcccct

SEQ ID NO: 7608432 - DNA, 22 bp, Homo sapiens
gacagcagacagcctggcccct

SEQ ID NO: 7608433 - DNA, 22 bp, Homo sapiens
gacagcagacagcctggcccct

SEQ ID NO: 7608434 - DNA, 22 bp, Homo sapiens
gacagcagacagaactacctgc

SEQ ID NO: 7608435 - DNA, 22 bp, Homo sapiens
gacagcagacagaactacctgc

SEQ ID NO: 7608436 - DNA, 22 bp, Homo sapiens
gacagcagacagaactacctgc

SEQ ID NO: 7608437 - DNA, 22 bp, Homo sapiens
gacagcagacagaactacctgc

SEQ ID NO: 7608438 - DNA, 22 bp, Homo sapiens
gacagagaggctgagcagtaca

SEQ ID NO: 7608439 - DNA, 22 bp, Homo sapiens
gacagagaggctgagcagtaca

SEQ ID NO: 7608440 - DNA, 22 bp, Homo sapiens
gacagagaggctgagcagtaca

SEQ ID NO: 7608441 - DNA, 22 bp, Homo sapiens
gacagagaggctgagcagtaca

SEQ ID NO: 7608442 - DNA, 22 bp, Homo sapiens
gacagagaggctgagcagtaca

SEQ ID NO: 7608443 - DNA, 22 bp, Homo sapiens
gacagagaggctgagcagtaca

SEQ ID NO: 7608444 - DNA, 22 bp, Homo sapiens
gacagagaggctgagcagtaca

SEQ ID NO: 7608445 - DNA, 22 bp, Homo sapiens
gacagactgcgtagtccccaaa

SEQ ID NO: 7608446 - DNA, 22 bp, Homo sapiens
gacagactgcgtagtccccaaa

SEQ ID NO: 7608447 - DNA, 22 bp, Homo sapiens
gacagacttcatatccttcctc

SEQ ID NO: 7608448 - DNA, 22 bp, Homo sapiens
gacagacatgggacttcatact

SEQ ID NO: 7608449 - DNA, 22 bp, Homo sapiens
gacagactaaatggctgtagga

SEQ ID NO: 7608450 - DNA, 22 bp, Homo sapiens
gacagactaaatggctgtagga

SEQ ID NO: 7608451 - DNA, 22 bp, Homo sapiens
gacagacaggtgtggtaggcac

SEQ ID NO: 7608452 - DNA, 22 bp, Homo sapiens
gacagacatttcctgatccaat

SEQ ID NO: 7608453 - DNA, 22 bp, Homo sapiens
gacagagattgaatcaggaaat

SEQ ID NO: 7608454 - DNA, 22 bp, Homo sapiens
gacagagattgaatcaggaaat

SEQ ID NO: 7608455 - DNA, 22 bp, Homo sapiens
gacagagcagcacccagcccct

SEQ ID NO: 7608456 - DNA, 22 bp, Homo sapiens
gacagagcagcacccagcccct

SEQ ID NO: 7608457 - DNA, 22 bp, Homo sapiens
gacagagccagttggaggtagg

SEQ ID NO: 7608458 - DNA, 22 bp, Homo sapiens
gacagagctgctctagattctg

SEQ ID NO: 7608459 - DNA, 22 bp, Homo sapiens
gacagaggagaagatgctgtgg

SEQ ID NO: 7608460 - DNA, 22 bp, Homo sapiens
gacagaggagaagatgctgtgg

SEQ ID NO: 7608461 - DNA, 22 bp, Homo sapiens
gacagaggagaagatgctgtgg

SEQ ID NO: 7608462 - DNA, 22 bp, Homo sapiens
gacagagaggctgagcagtaca

SEQ ID NO: 7608463 - DNA, 22 bp, Homo sapiens
gacagagaggctgagcagtaca

SEQ ID NO: 7608464 - DNA, 22 bp, Homo sapiens
gacagagattgaatcaggaaat

SEQ ID NO: 7608465 - DNA, 22 bp, Homo sapiens
gacagagattgaatcaggaaat

SEQ ID NO: 7608466 - DNA, 22 bp, Homo sapiens
gacagagattgaatcaggaaat

SEQ ID NO: 7608467 - DNA, 22 bp, Homo sapiens
gacagagattgaatcaggaaat

SEQ ID NO: 7608468 - DNA, 22 bp, Homo sapiens
gacagagattgaatcaggaaat

SEQ ID NO: 7608469 - DNA, 22 bp, Homo sapiens
gacagcagcatgtttacaggcc

SEQ ID NO: 7608470 - DNA, 22 bp, Homo sapiens
gacagcagcatgtttacaggcc

SEQ ID NO: 7608471 - DNA, 22 bp, Homo sapiens
gacagcagcataatacatgaac

SEQ ID NO: 7608472 - DNA, 22 bp, Homo sapiens
gacagcagcataatacatgaac

SEQ ID NO: 7608473 - DNA, 22 bp, Homo sapiens
gacagcagatgaagcctgcaga

SEQ ID NO: 7608474 - DNA, 22 bp, Homo sapiens
gacagcagatgaagcctgcaga

SEQ ID NO: 7608475 - DNA, 22 bp, Homo sapiens
gacagcagatgaagcctgcaga

SEQ ID NO: 7608476 - DNA, 22 bp, Homo sapiens
gacagcagatgaagcctgcaga

SEQ ID NO: 7608477 - DNA, 22 bp, Homo sapiens
gacagcagatgaagcctgcaga

SEQ ID NO: 7608478 - DNA, 22 bp, Homo sapiens
gacagcagatgaagcctgcaga

SEQ ID NO: 7608479 - DNA, 22 bp, Homo sapiens
gacagcagatgaagcctgcaga

SEQ ID NO: 7608480 - DNA, 22 bp, Homo sapiens
gacagcagatgaagcctgcaga

SEQ ID NO: 7608481 - DNA, 22 bp, Homo sapiens
gacagcagatgaagcctgcaga

SEQ ID NO: 7608482 - DNA, 22 bp, Homo sapiens
gacagcagatgaagcctgcaga

SEQ ID NO: 7608483 - DNA, 22 bp, Homo sapiens
gacagcagataagacctcatca

SEQ ID NO: 7608484 - DNA, 22 bp, Homo sapiens
gacagcagatactttcattgaa

SEQ ID NO: 7608485 - DNA, 22 bp, Homo sapiens
gacagcagatactttcattgaa

SEQ ID NO: 7608486 - DNA, 22 bp, Homo sapiens
gacagcagataagacctcatca

SEQ ID NO: 7608487 - DNA, 22 bp, Homo sapiens
gacagcagataagacctcatca

SEQ ID NO: 7608488 - DNA, 22 bp, Homo sapiens
gacattcattaagcctttctgt

SEQ ID NO: 7608489 - DNA, 20 bp, Homo sapiens
gacattcatagttattacca

SEQ ID NO: 7608490 - DNA, 22 bp, Homo sapiens
gacattcaggtgttcaatgcca

SEQ ID NO: 7608491 - DNA, 20 bp, Homo sapiens
gacattcatagttattacca

SEQ ID NO: 7608492 - DNA, 22 bp, Homo sapiens
gacattcattaagcctttctgt

SEQ ID NO: 7608493 - DNA, 22 bp, Homo sapiens
gacattcaggtgttcaatgcca

SEQ ID NO: 7608494 - DNA, 22 bp, Homo sapiens
gacattcagccaattactttct

SEQ ID NO: 7608495 - DNA, 22 bp, Homo sapiens
gacattctaaaaaatatggaag

SEQ ID NO: 7608496 - DNA, 22 bp, Homo sapiens
gacattctaaaaaatatggaag

SEQ ID NO: 7608497 - DNA, 19 bp, Homo sapiens
gacattcctgacactggct

SEQ ID NO: 7608498 - DNA, 22 bp, Homo sapiens
gacattcattgatgtcttcctc

SEQ ID NO: 7608499 - DNA, 22 bp, Homo sapiens
gacattcattgatgtcttcctc

SEQ ID NO: 7608500 - DNA, 22 bp, Homo sapiens
gacattcattgatgtcttcctc

SEQ ID NO: 7608501 - DNA, 22 bp, Homo sapiens
gacattcacaggtaaacattcc

SEQ ID NO: 7608502 - DNA, 22 bp, Homo sapiens
gacattcacaggtaaacattcc

SEQ ID NO: 7608503 - DNA, 22 bp, Homo sapiens
gacattcagactcacatggagg

SEQ ID NO: 7608504 - DNA, 22 bp, Homo sapiens
gacattcagactcacatggagg

SEQ ID NO: 7608505 - DNA, 22 bp, Homo sapiens
gacattcagccaattactttct

SEQ ID NO: 7608506 - DNA, 22 bp, Homo sapiens
gacattcacagtttccgatggt

SEQ ID NO: 7608507 - DNA, 22 bp, Homo sapiens
gacattcagactcacatggagg

SEQ ID NO: 7608508 - DNA, 22 bp, Homo sapiens
gacattcacaggtaaacattcc

SEQ ID NO: 7608509 - DNA, 22 bp, Homo sapiens
gacattcacagtttccgatggt

SEQ ID NO: 7608510 - DNA, 22 bp, Homo sapiens
gacattcaagtttgcagttagg

SEQ ID NO: 7608511 - DNA, 22 bp, Homo sapiens
gacattcaagtttgcagttagg

SEQ ID NO: 7608512 - DNA, 22 bp, Homo sapiens
gacagcagcatgtttacaggcc

SEQ ID NO: 7608513 - DNA, 22 bp, Homo sapiens
gacatttactgaatactgatta

SEQ ID NO: 7608514 - DNA, 22 bp, Homo sapiens
gacatttactgaatactgatta

SEQ ID NO: 7608515 - DNA, 22 bp, Homo sapiens
gacatttactgaatactgatta

SEQ ID NO: 7608516 - DNA, 22 bp, Homo sapiens
gacatttagaagttagattcaa

SEQ ID NO: 7608517 - DNA, 22 bp, Homo sapiens
gacatttagaagtctaatggcc

SEQ ID NO: 7608518 - DNA, 22 bp, Homo sapiens
gacatttagaagtctaatggcc

SEQ ID NO: 7608519 - DNA, 22 bp, Homo sapiens
gacatttaaggcagtcacttaa

SEQ ID NO: 7608520 - DNA, 22 bp, Homo sapiens
gacatttaaggcagtcacttaa

SEQ ID NO: 7608521 - DNA, 22 bp, Homo sapiens
gacatttaaggcagtcacttaa

SEQ ID NO: 7608522 - DNA, 22 bp, Homo sapiens
gacatttaatagtattgtggga

SEQ ID NO: 7608523 - DNA, 22 bp, Homo sapiens
gacatttactgaatactgatta

SEQ ID NO: 7608524 - DNA, 22 bp, Homo sapiens
gacatttactgaatactgatta

SEQ ID NO: 7608525 - DNA, 22 bp, Homo sapiens
gacatttaaggcagtcacttaa

SEQ ID NO: 7608526 - DNA, 22 bp, Homo sapiens
gacatttaaattgcaggcagcc

SEQ ID NO: 7608527 - DNA, 22 bp, Homo sapiens
gacattgctcggaaattagtgt

SEQ ID NO: 7608528 - DNA, 23 bp, Homo sapiens
gacattggctgtctgatgcaggg

SEQ ID NO: 7608529 - DNA, 20 bp, Homo sapiens
gacattgtaattaatgatga

SEQ ID NO: 7608530 - DNA, 22 bp, Homo sapiens
gacattgtggttattaaatgtt

SEQ ID NO: 7608531 - DNA, 22 bp, Homo sapiens
gacattctgtgactctgaacag

SEQ ID NO: 7608532 - DNA, 22 bp, Homo sapiens
gacattctgtgactctgaacag

SEQ ID NO: 7608533 - DNA, 22 bp, Homo sapiens
gacattctgtcaatgttgactc

SEQ ID NO: 7608534 - DNA, 22 bp, Homo sapiens
gacattgaagtatttttgtcga

SEQ ID NO: 7608535 - DNA, 22 bp, Homo sapiens
gaccagagaaaggcactggaag

SEQ ID NO: 7608536 - DNA, 22 bp, Homo sapiens
gaccagagaaaggcactggaag

SEQ ID NO: 7608537 - DNA, 22 bp, Homo sapiens
gaccagagaaaggcactggaag

SEQ ID NO: 7608538 - DNA, 22 bp, Homo sapiens
gaccagagaaaggcactggaag

SEQ ID NO: 7608539 - DNA, 22 bp, Homo sapiens
gaccagaaatgattctccagct

SEQ ID NO: 7608540 - DNA, 22 bp, Homo sapiens
gaccagaaagtcatgagtcagt

SEQ ID NO: 7608541 - DNA, 22 bp, Homo sapiens
gaccagaatctggactctgatt

SEQ ID NO: 7608542 - DNA, 22 bp, Homo sapiens
gaccagaatctggactctgatt

SEQ ID NO: 7608543 - DNA, 22 bp, Homo sapiens
gaccagaaggaaatgtgagcag

SEQ ID NO: 7608544 - DNA, 22 bp, Homo sapiens
gaccacaggtatgggcttggca

SEQ ID NO: 7608545 - DNA, 21 bp, Homo sapiens
gaccacagggaaggtcttgca

SEQ ID NO: 7608546 - DNA, 21 bp, Homo sapiens
gaccacagggaaggtcttgca

SEQ ID NO: 7608547 - DNA, 21 bp, Homo sapiens
gaccacagggaaggtcttgca

SEQ ID NO: 7608548 - DNA, 22 bp, Homo sapiens
gaccacagtccagtcatcatgg

SEQ ID NO: 7608549 - DNA, 22 bp, Homo sapiens
gaccacagtccagtcatcatgg

SEQ ID NO: 7608550 - DNA, 22 bp, Homo sapiens
gaccacaggtatgggcttggca

SEQ ID NO: 7608551 - DNA, 22 bp, Homo sapiens
gaccacaggtatgggcttggca

SEQ ID NO: 7608552 - DNA, 22 bp, Homo sapiens
gaccacagtccagtcatcatgg

SEQ ID NO: 7608553 - DNA, 22 bp, Homo sapiens
gaccaccagaggtccgtgggta

SEQ ID NO: 7608554 - DNA, 22 bp, Homo sapiens
gaccactggggtgagggccatc

SEQ ID NO: 7608555 - DNA, 22 bp, Homo sapiens
gaccactggcgctgcgagaccc

SEQ ID NO: 7608556 - DNA, 22 bp, Homo sapiens
gacatttagaagttagattcaa

SEQ ID NO: 7608557 - DNA, 22 bp, Homo sapiens
gacatttagaagttagattcaa

SEQ ID NO: 7608558 - DNA, 22 bp, Homo sapiens
gacatttagctgttttgcattt

SEQ ID NO: 7608559 - DNA, 22 bp, Homo sapiens
gacatttagctgttttgcattt

SEQ ID NO: 7608560 - DNA, 22 bp, Homo sapiens
gacatttagctgttttgcattt

SEQ ID NO: 7608561 - DNA, 22 bp, Homo sapiens
gacatttagctgttttgcattt

SEQ ID NO: 7608562 - DNA, 22 bp, Homo sapiens
gacatttagctgttttgcattt

SEQ ID NO: 7608563 - DNA, 22 bp, Homo sapiens
gacatttaggtagcttccagtt

SEQ ID NO: 7608564 - DNA, 22 bp, Homo sapiens
gacatttatgaaggagatatgc

SEQ ID NO: 7608565 - DNA, 21 bp, Homo sapiens
gaccacagggaaggtcttgca

SEQ ID NO: 7608566 - DNA, 22 bp, Homo sapiens
gaccacagctacaagggcaagg

SEQ ID NO: 7608567 - DNA, 22 bp, Homo sapiens
gaccacagctacaagggcaagg

SEQ ID NO: 7608568 - DNA, 22 bp, Homo sapiens
gaccacagctacaagggcaagg

SEQ ID NO: 7608569 - DNA, 22 bp, Homo sapiens
gaccacagcagtgcaagaggag

SEQ ID NO: 7608570 - DNA, 22 bp, Homo sapiens
gaccacagctacaagggcaagg

SEQ ID NO: 7608571 - DNA, 22 bp, Homo sapiens
gaccacagctacaagggcaagg

SEQ ID NO: 7608572 - DNA, 22 bp, Homo sapiens
gaccacagcagtgcaagaggag

SEQ ID NO: 7608573 - DNA, 22 bp, Homo sapiens
gaccaggagatttgagctaggc

SEQ ID NO: 7608574 - DNA, 22 bp, Homo sapiens
gaccaggctagttcagagcttc

SEQ ID NO: 7608575 - DNA, 22 bp, Homo sapiens
gaccaggctagttcagagcttc

SEQ ID NO: 7608576 - DNA, 22 bp, Homo sapiens
gaccaggcccaggtgcaaggga

SEQ ID NO: 7608577 - DNA, 22 bp, Homo sapiens
gaccaggaagggtttctgggat

SEQ ID NO: 7608578 - DNA, 22 bp, Homo sapiens
gaccaggacacagtggcaaggt

SEQ ID NO: 7608579 - DNA, 22 bp, Homo sapiens
gaccaggacacagtggcaaggt

SEQ ID NO: 7608580 - DNA, 22 bp, Homo sapiens
gaccaggacacagtggcaaggt

SEQ ID NO: 7608581 - DNA, 17 bp, Homo sapiens
gaccaggagaaaccagg

SEQ ID NO: 7608582 - DNA, 22 bp, Homo sapiens
gaccaggagatttgagctaggc

SEQ ID NO: 7608583 - DNA, 22 bp, Homo sapiens
gaccaggagatttgagctaggc

SEQ ID NO: 7608584 - DNA, 22 bp, Homo sapiens
gaccaggaaagagtgtgactaa

SEQ ID NO: 7608585 - DNA, 22 bp, Homo sapiens
gaccaggaaagagtgtgactaa

SEQ ID NO: 7608586 - DNA, 22 bp, Homo sapiens
gaccaggaaagagtgtgactaa

SEQ ID NO: 7608587 - DNA, 22 bp, Homo sapiens
gaccagctggtgaaaaccaatt

SEQ ID NO: 7608588 - DNA, 22 bp, Homo sapiens
gaccagctggtcctgtcctggg

SEQ ID NO: 7608589 - DNA, 22 bp, Homo sapiens
gaccagctggtcctgtcctggg

SEQ ID NO: 7608590 - DNA, 22 bp, Homo sapiens
gaccagctgataaggcatataa

SEQ ID NO: 7608591 - DNA, 22 bp, Homo sapiens
gaccagctctctgaagaaagag

SEQ ID NO: 7608592 - DNA, 22 bp, Homo sapiens
gaccagctctctgaagaaagag

SEQ ID NO: 7608593 - DNA, 22 bp, Homo sapiens
gaccagctacttgtacagttca

SEQ ID NO: 7608594 - DNA, 22 bp, Homo sapiens
gaccagatgcaacaacttatcc

SEQ ID NO: 7608595 - DNA, 22 bp, Homo sapiens
gactccagggattggaagatgt

SEQ ID NO: 7608596 - DNA, 22 bp, Homo sapiens
gactccagggattggaagatgt

SEQ ID NO: 7608597 - DNA, 22 bp, Homo sapiens
gactccaggtgcaggaggagcc

SEQ ID NO: 7608598 - DNA, 22 bp, Homo sapiens
gactccaggtgcaggaggagcc

SEQ ID NO: 7608599 - DNA, 22 bp, Homo sapiens
gactccaggtgtccaggcctcc

SEQ ID NO: 7608600 - DNA, 22 bp, Homo sapiens
gactccaggtgtccaggcctcc

SEQ ID NO: 7608601 - DNA, 22 bp, Homo sapiens
gactccaggtgtccaggcctcc

SEQ ID NO: 7608602 - DNA, 22 bp, Homo sapiens
gactccaggtgtccaggcctcc

SEQ ID NO: 7608603 - DNA, 22 bp, Homo sapiens
gactccagggattggaagatgt

SEQ ID NO: 7608604 - DNA, 22 bp, Homo sapiens
gaccaggctgttccagtctaac

SEQ ID NO: 7608605 - DNA, 22 bp, Homo sapiens
gaccaggctgttccagtctaac

SEQ ID NO: 7608606 - DNA, 22 bp, Homo sapiens
gaccaggctagttcagagcttc

SEQ ID NO: 7608607 - DNA, 22 bp, Homo sapiens
gactccagcatatacttttagt

SEQ ID NO: 7608608 - DNA, 22 bp, Homo sapiens
gactccagcatatacttttagt

SEQ ID NO: 7608609 - DNA, 22 bp, Homo sapiens
gactccatccaatctgtgttct

SEQ ID NO: 7608610 - DNA, 22 bp, Homo sapiens
gactcccaagcttggaggaagg

SEQ ID NO: 7608611 - DNA, 22 bp, Homo sapiens
gactcccaagcttggaggaagg

SEQ ID NO: 7608612 - DNA, 22 bp, Homo sapiens
gactccagtgattgtcctgtct

SEQ ID NO: 7608613 - DNA, 22 bp, Homo sapiens
gactccagtgattgtcctgtct

SEQ ID NO: 7608614 - DNA, 22 bp, Homo sapiens
gactccaggtgtccaggcctcc

SEQ ID NO: 7608615 - DNA, 22 bp, Homo sapiens
gactcccctgggccccatccag

SEQ ID NO: 7608616 - DNA, 22 bp, Homo sapiens
gactccagtgattgtcctgtct

SEQ ID NO: 7608617 - DNA, 22 bp, Homo sapiens
gactccccacgttaaggaatgt

SEQ ID NO: 7608618 - DNA, 22 bp, Homo sapiens
gactcctcagtcaccctcagct

SEQ ID NO: 7608619 - DNA, 22 bp, Homo sapiens
gactcctcagtcaccctcagct

SEQ ID NO: 7608620 - DNA, 22 bp, Homo sapiens
gactcccctgggccccatccag

SEQ ID NO: 7608621 - DNA, 22 bp, Homo sapiens
gactctcaagcacaagtccacc

SEQ ID NO: 7608622 - DNA, 22 bp, Homo sapiens
gactctagattcatggtggagt

SEQ ID NO: 7608623 - DNA, 22 bp, Homo sapiens
gactctgctgactagttgacta

SEQ ID NO: 7608624 - DNA, 21 bp, Homo sapiens
gactctgcaccaaattaagcc

SEQ ID NO: 7608625 - DNA, 22 bp, Homo sapiens
gactctgctacaggccgaggtt

SEQ ID NO: 7608626 - DNA, 22 bp, Homo sapiens
gactctgctacaggccgaggtt

SEQ ID NO: 7608627 - DNA, 22 bp, Homo sapiens
gactctgctaggaaaatctcag

SEQ ID NO: 7608628 - DNA, 22 bp, Homo sapiens
gactcgctcccttttgtcttat

SEQ ID NO: 7608629 - DNA, 22 bp, Homo sapiens
gactcctgggcctctgagaggc

SEQ ID NO: 7608630 - DNA, 22 bp, Homo sapiens
gactcgctcccttttgtcttat

SEQ ID NO: 7608631 - DNA, 22 bp, Homo sapiens
gactcctgggcctctgagaggc

SEQ ID NO: 7608632 - DNA, 22 bp, Homo sapiens
gactcctcccgctcccatgccg

SEQ ID NO: 7608633 - DNA, 22 bp, Homo sapiens
gactcctctctaacccactgga

SEQ ID NO: 7608634 - DNA, 22 bp, Homo sapiens
gactcctcagtcaccctcagct

SEQ ID NO: 7608635 - DNA, 22 bp, Homo sapiens
gactctggtgtcagaagtgccc

SEQ ID NO: 7608636 - DNA, 21 bp, Homo sapiens
gactctggggtcagctcaacc

SEQ ID NO: 7608637 - DNA, 21 bp, Homo sapiens
gactctggggtcagctcaacc

SEQ ID NO: 7608638 - DNA, 21 bp, Homo sapiens
gactctggggtcagctcaacc

SEQ ID NO: 7608639 - DNA, 22 bp, Homo sapiens
gactctggtgacttgacctgta

SEQ ID NO: 7608640 - DNA, 22 bp, Homo sapiens
gactctgggctgagccagggcc

SEQ ID NO: 7608641 - DNA, 22 bp, Homo sapiens
gactctgggagtttatgtgatt

SEQ ID NO: 7608642 - DNA, 22 bp, Homo sapiens
gactctgggcctttggtgactc

SEQ ID NO: 7608643 - DNA, 22 bp, Homo sapiens
gactctggcagcactagggggc

SEQ ID NO: 7608644 - DNA, 22 bp, Homo sapiens
gactctggcctcatccctgagg

SEQ ID NO: 7608645 - DNA, 22 bp, Homo sapiens
gactctgggaggtggactgagg

SEQ ID NO: 7608646 - DNA, 22 bp, Homo sapiens
gactgaggcctttattgagaca

SEQ ID NO: 7608647 - DNA, 22 bp, Homo sapiens
gactgaggaggtaaggtttgaa

SEQ ID NO: 7608648 - DNA, 22 bp, Homo sapiens
gactgagaatcatagaaggcaa

SEQ ID NO: 7608649 - DNA, 22 bp, Homo sapiens
gactgagaatcatagaaggcaa

SEQ ID NO: 7608650 - DNA, 22 bp, Homo sapiens
gactgagaatcatagaaggcaa

SEQ ID NO: 7608651 - DNA, 22 bp, Homo sapiens
gactgagaatcatagaaggcaa

SEQ ID NO: 7608652 - DNA, 22 bp, Homo sapiens
gactgaaagcttggaatgttcc

SEQ ID NO: 7608653 - DNA, 22 bp, Homo sapiens
gactctttccctgtgacagagt

SEQ ID NO: 7608654 - DNA, 22 bp, Homo sapiens
gactctttcaaacagaaagcca

SEQ ID NO: 7608655 - DNA, 22 bp, Homo sapiens
gactctggttgcgggttctgct

SEQ ID NO: 7608656 - DNA, 22 bp, Homo sapiens
gactctgtgggaggaggctcag

SEQ ID NO: 7608657 - DNA, 22 bp, Homo sapiens
gactgaaattataccaagtggt

SEQ ID NO: 7608658 - DNA, 22 bp, Homo sapiens
gactgaaattataccaagtggt

SEQ ID NO: 7608659 - DNA, 22 bp, Homo sapiens
gactgaaggtctcagcatgtga

SEQ ID NO: 7608660 - DNA, 22 bp, Homo sapiens
gactgaaggtctcagcatgtga

SEQ ID NO: 7608661 - DNA, 22 bp, Homo sapiens
gactgaaggtctcagcatgtga

SEQ ID NO: 7608662 - DNA, 22 bp, Homo sapiens
gactgagaaacagtacattacc

SEQ ID NO: 7608663 - DNA, 22 bp, Homo sapiens
gactgaggtattaagatggctt

SEQ ID NO: 7608664 - DNA, 22 bp, Homo sapiens
gactgaggtattaagatggctt

SEQ ID NO: 7608665 - DNA, 17 bp, Homo sapiens
gactgaggtaaggtgag

SEQ ID NO: 7608666 - DNA, 17 bp, Homo sapiens
gactgaggtaaggtgag

SEQ ID NO: 7608667 - DNA, 22 bp, Homo sapiens
gactgagggatagaggtgcttc

SEQ ID NO: 7608668 - DNA, 22 bp, Homo sapiens
gactgagggatagaggtgcttc

SEQ ID NO: 7608669 - DNA, 22 bp, Homo sapiens
gactgagggacagggcagtgga

SEQ ID NO: 7608670 - DNA, 22 bp, Homo sapiens
gactgagggatagaggtgcttc

SEQ ID NO: 7608671 - DNA, 22 bp, Homo sapiens
gactgaggctcccctaggctca

SEQ ID NO: 7608672 - DNA, 22 bp, Homo sapiens
gactgaggctcccctaggctca

SEQ ID NO: 7608673 - DNA, 22 bp, Homo sapiens
gactgagggacagggcagtgga

SEQ ID NO: 7608674 - DNA, 22 bp, Homo sapiens
gactgagggacagggcagtgga

SEQ ID NO: 7608675 - DNA, 22 bp, Homo sapiens
gagactgggggcttggcctttt

SEQ ID NO: 7608676 - DNA, 20 bp, Homo sapiens
gagactggatctggagagac

SEQ ID NO: 7608677 - DNA, 20 bp, Homo sapiens
gagactggatctggagagac

SEQ ID NO: 7608678 - DNA, 20 bp, Homo sapiens
gagactggatctggagagac

SEQ ID NO: 7608679 - DNA, 22 bp, Homo sapiens
gagactcttgctttaatagccc

SEQ ID NO: 7608680 - DNA, 21 bp, Homo sapiens
gagactctcatgttatttgga

SEQ ID NO: 7608681 - DNA, 22 bp, Homo sapiens
gagactgatggggctcccagaa

SEQ ID NO: 7608682 - DNA, 22 bp, Homo sapiens
gagactgaggtcaccaggctgt

SEQ ID NO: 7608683 - DNA, 22 bp, Homo sapiens
gagacggggtttgagacgggtt

SEQ ID NO: 7608684 - DNA, 22 bp, Homo sapiens
gagacgtggcctttgcctgagc

SEQ ID NO: 7608685 - DNA, 22 bp, Homo sapiens
gagacgtggcctttgcctgagc

SEQ ID NO: 7608686 - DNA, 22 bp, Homo sapiens
gagacgtggcctttgcctgagc

SEQ ID NO: 7608687 - DNA, 22 bp, Homo sapiens
gagacgtggcctttgcctgagc

SEQ ID NO: 7608688 - DNA, 22 bp, Homo sapiens
gagacgtggcctttgcctgagc

SEQ ID NO: 7608689 - DNA, 21 bp, Homo sapiens
gagactctcatgttatttgga

SEQ ID NO: 7608690 - DNA, 22 bp, Homo sapiens
gagacccaggggtctgctgccc

SEQ ID NO: 7608691 - DNA, 22 bp, Homo sapiens
gagacccaggggtctgctgccc

SEQ ID NO: 7608692 - DNA, 17 bp, Homo sapiens
gagacccccactacacc

SEQ ID NO: 7608693 - DNA, 22 bp, Homo sapiens
gagacctctgatgtccctgggg

SEQ ID NO: 7608694 - DNA, 22 bp, Homo sapiens
gagaccctcttcctccctacag

SEQ ID NO: 7608695 - DNA, 22 bp, Homo sapiens
gagacctcttggtatcgctagg

SEQ ID NO: 7608696 - DNA, 22 bp, Homo sapiens
gagacctcttggtatcgctagg

SEQ ID NO: 7608697 - DNA, 22 bp, Homo sapiens
gagacggggccctggccaggcg

SEQ ID NO: 7608698 - DNA, 22 bp, Homo sapiens
gagacggggccctggccaggcg

SEQ ID NO: 7608699 - DNA, 22 bp, Homo sapiens
gagaccttaagagatgtcagct

SEQ ID NO: 7608700 - DNA, 22 bp, Homo sapiens
gagacctgcagctgtagtctgc

SEQ ID NO: 7608701 - DNA, 22 bp, Homo sapiens
gagagaaaacaagttctccatt

SEQ ID NO: 7608702 - DNA, 22 bp, Homo sapiens
gagagaaaaatgagcttcattg

SEQ ID NO: 7608703 - DNA, 22 bp, Homo sapiens
gagagaaaacaagttctccatt

SEQ ID NO: 7608704 - DNA, 22 bp, Homo sapiens
gagagaaaacaagttctccatt

SEQ ID NO: 7608705 - DNA, 22 bp, Homo sapiens
gagagaaaaatgagcttcattg

SEQ ID NO: 7608706 - DNA, 22 bp, Homo sapiens
gagagaaaaatgagcttcattg

SEQ ID NO: 7608707 - DNA, 22 bp, Homo sapiens
gagagaaaaatgagcttcattg

SEQ ID NO: 7608708 - DNA, 22 bp, Homo sapiens
gagactttctgatctcactcat

SEQ ID NO: 7608709 - DNA, 22 bp, Homo sapiens
gagagaaaaatgagcttcattg

SEQ ID NO: 7608710 - DNA, 22 bp, Homo sapiens
gagagaaaaatgagcttcattg

SEQ ID NO: 7608711 - DNA, 22 bp, Homo sapiens
gagagaaaaatgagcttcattg

SEQ ID NO: 7608712 - DNA, 22 bp, Homo sapiens
gagacttaggcaagtcacttag

SEQ ID NO: 7608713 - DNA, 22 bp, Homo sapiens
gagactgtcacttgggacctgt

SEQ ID NO: 7608714 - DNA, 22 bp, Homo sapiens
gagactggtgtttgctgggctg

SEQ ID NO: 7608715 - DNA, 22 bp, Homo sapiens
gagactggtgtttgctgggctg

SEQ ID NO: 7608716 - DNA, 22 bp, Homo sapiens
gagactggtgtttgctgggctg

SEQ ID NO: 7608717 - DNA, 22 bp, Homo sapiens
gagactggtgtttgctgggctg

SEQ ID NO: 7608718 - DNA, 22 bp, Homo sapiens
gagactggtgtttgctgggctg

SEQ ID NO: 7608719 - DNA, 22 bp, Homo sapiens
gagactggtgtttgctgggctg

SEQ ID NO: 7608720 - DNA, 22 bp, Homo sapiens
gagagaaaacaagttctccatt

SEQ ID NO: 7608721 - DNA, 22 bp, Homo sapiens
gagagaaaacaagttctccatt

SEQ ID NO: 7608722 - DNA, 22 bp, Homo sapiens
gagagaaaagggggaattgatt

SEQ ID NO: 7608723 - DNA, 22 bp, Homo sapiens
gagagaaaagggggaattgatt

SEQ ID NO: 7608724 - DNA, 22 bp, Homo sapiens
gagagaaaagggggaattgatt

SEQ ID NO: 7608725 - DNA, 22 bp, Homo sapiens
gagagaaaagggggaattgatt

SEQ ID NO: 7608726 - DNA, 22 bp, Homo sapiens
gagagaaaagggggaattgatt

SEQ ID NO: 7608727 - DNA, 22 bp, Homo sapiens
gagagaaaagggggaattgatt

SEQ ID NO: 7608728 - DNA, 22 bp, Homo sapiens
gagagaaaagggggaattgatt

SEQ ID NO: 7608729 - DNA, 22 bp, Homo sapiens
gagagaaaagggggaattgatt

SEQ ID NO: 7608730 - DNA, 22 bp, Homo sapiens
gagagaaaagggggaattgatt

SEQ ID NO: 7608731 - DNA, 22 bp, Homo sapiens
gagagaaagcccctgcatccct

SEQ ID NO: 7608732 - DNA, 22 bp, Homo sapiens
gagagaaagcccctgcatccct

SEQ ID NO: 7608733 - DNA, 22 bp, Homo sapiens
gagagaaagcccctgcatccct

SEQ ID NO: 7608734 - DNA, 22 bp, Homo sapiens
gagagaaagcccctgcatccct

SEQ ID NO: 7608735 - DNA, 22 bp, Homo sapiens
gagagaaagcccctgcatccct

SEQ ID NO: 7608736 - DNA, 22 bp, Homo sapiens
gagagaaagcccctgcatccct

SEQ ID NO: 7608737 - DNA, 22 bp, Homo sapiens
gagagaaagcccctgcatccct

SEQ ID NO: 7608738 - DNA, 22 bp, Homo sapiens
gagagaaaggataacagctcaa

SEQ ID NO: 7608739 - DNA, 22 bp, Homo sapiens
gagagaaaggataacagctcaa

SEQ ID NO: 7608740 - DNA, 22 bp, Homo sapiens
gagagaaagcccctgcatccct

SEQ ID NO: 7608741 - DNA, 22 bp, Homo sapiens
gagagaaagcccctgcatccct

SEQ ID NO: 7608742 - DNA, 22 bp, Homo sapiens
gagagaaagcccctgcatccct

SEQ ID NO: 7608743 - DNA, 22 bp, Homo sapiens
gagagaaaggataacagctcaa

SEQ ID NO: 7608744 - DNA, 22 bp, Homo sapiens
gagagaaaggataacagctcaa

SEQ ID NO: 7608745 - DNA, 22 bp, Homo sapiens
gagagaaaggcttgcaggctgt

SEQ ID NO: 7608746 - DNA, 22 bp, Homo sapiens
gagagaaaggcttgcaggctgt

SEQ ID NO: 7608747 - DNA, 22 bp, Homo sapiens
gagagaaaggataacagctcaa

SEQ ID NO: 7608748 - DNA, 22 bp, Homo sapiens
gagagaaaggataacagctcaa

SEQ ID NO: 7608749 - DNA, 22 bp, Homo sapiens
gagagaaaggataacagctcaa

SEQ ID NO: 7608750 - DNA, 22 bp, Homo sapiens
gagagaaaggataacagctcaa

SEQ ID NO: 7608751 - DNA, 18 bp, Homo sapiens
gagagggatccctcagga

SEQ ID NO: 7608752 - DNA, 18 bp, Homo sapiens
gagagggatccctcagga

SEQ ID NO: 7608753 - DNA, 18 bp, Homo sapiens
gagagggatccctcagga

SEQ ID NO: 7608754 - DNA, 18 bp, Homo sapiens
gagagggatccctcagga

SEQ ID NO: 7608755 - DNA, 22 bp, Homo sapiens
gagagaagaaagccatggtcct

SEQ ID NO: 7608756 - DNA, 22 bp, Homo sapiens
gagagaagaaagccatggtcct

SEQ ID NO: 7608757 - DNA, 22 bp, Homo sapiens
gagagaagaaagccatggtcct

SEQ ID NO: 7608758 - DNA, 22 bp, Homo sapiens
gagagaaccctaaatgagatat

SEQ ID NO: 7608759 - DNA, 22 bp, Homo sapiens
gagagaagaaagccatggtcct

SEQ ID NO: 7608760 - DNA, 22 bp, Homo sapiens
gagagaagaaagccatggtcct

SEQ ID NO: 7608761 - DNA, 22 bp, Homo sapiens
gagagaaccctaaatgagatat

SEQ ID NO: 7608762 - DNA, 22 bp, Homo sapiens
gagagaacacaaagggccagct

SEQ ID NO: 7608763 - DNA, 22 bp, Homo sapiens
gagagaacacaaagggccagct

SEQ ID NO: 7608764 - DNA, 18 bp, Homo sapiens
gagagggatccctcagga

SEQ ID NO: 7608765 - DNA, 18 bp, Homo sapiens
gagagggatccctcagga

SEQ ID NO: 7608766 - DNA, 18 bp, Homo sapiens
gagagggatccctcagga

SEQ ID NO: 7608767 - DNA, 18 bp, Homo sapiens
gagagggatccctcagga

SEQ ID NO: 7608768 - DNA, 18 bp, Homo sapiens
gagagggatccctcagga

SEQ ID NO: 7608769 - DNA, 22 bp, Homo sapiens
gagagggcaaacttgtagctaa

SEQ ID NO: 7608770 - DNA, 22 bp, Homo sapiens
gagagggcaaacttgtagctaa

SEQ ID NO: 7608771 - DNA, 22 bp, Homo sapiens
gagagggcaaacttgtagctaa

SEQ ID NO: 7608772 - DNA, 22 bp, Homo sapiens
gagagaaattagttggtttgct

SEQ ID NO: 7608773 - DNA, 22 bp, Homo sapiens
gagagaaattagttggtttgct

SEQ ID NO: 7608774 - DNA, 22 bp, Homo sapiens
gagagaaattagttggtttgct

SEQ ID NO: 7608775 - DNA, 22 bp, Homo sapiens
gagagaaatgtgcagtttgggc

SEQ ID NO: 7608776 - DNA, 22 bp, Homo sapiens
gagagaaatgtgcagtttgggc

SEQ ID NO: 7608777 - DNA, 22 bp, Homo sapiens
gagagaaattagttggtttgct

SEQ ID NO: 7608778 - DNA, 22 bp, Homo sapiens
gagagaaattagttggtttgct

SEQ ID NO: 7608779 - DNA, 22 bp, Homo sapiens
gagagaaattagttggtttgct

SEQ ID NO: 7608780 - DNA, 22 bp, Homo sapiens
gagagaaattagttggtttgct

SEQ ID NO: 7608781 - DNA, 22 bp, Homo sapiens
gagagaaatgtgcagtttgggc

SEQ ID NO: 7608782 - DNA, 22 bp, Homo sapiens
gagagaaatgtgcagtttgggc

SEQ ID NO: 7608783 - DNA, 22 bp, Homo sapiens
gagagaaatgtgcagtttgggc

SEQ ID NO: 7608784 - DNA, 22 bp, Homo sapiens
gagagaaatgtgcagtttgggc

SEQ ID NO: 7608785 - DNA, 22 bp, Homo sapiens
gagagaaaggcttgcaggctgt

SEQ ID NO: 7608786 - DNA, 22 bp, Homo sapiens
gagagaaaggcttgcaggctgt

SEQ ID NO: 7608787 - DNA, 22 bp, Homo sapiens
gagagaaaggcttgcaggctgt

SEQ ID NO: 7608788 - DNA, 22 bp, Homo sapiens
gagagaaatgtgcagtttgggc

SEQ ID NO: 7608789 - DNA, 22 bp, Homo sapiens
gagagaaatgtgcagtttgggc

SEQ ID NO: 7608790 - DNA, 22 bp, Homo sapiens
gagagaaatgtgcagtttgggc

SEQ ID NO: 7608791 - DNA, 22 bp, Homo sapiens
gagagaaatgtgcagtttgggc

SEQ ID NO: 7608792 - DNA, 22 bp, Homo sapiens
gagagaaaggcttgcaggctgt

SEQ ID NO: 7608793 - DNA, 22 bp, Homo sapiens
gagagaaaggcttgcaggctgt

SEQ ID NO: 7608794 - DNA, 22 bp, Homo sapiens
gagagaaaggcttgcaggctgt

SEQ ID NO: 7608795 - DNA, 22 bp, Homo sapiens
gagagaaaggcttgcaggctgt

SEQ ID NO: 7608796 - DNA, 22 bp, Homo sapiens
gagagaaaggcttgcaggctgt

SEQ ID NO: 7608797 - DNA, 22 bp, Homo sapiens
gagagaaaggcttgcaggctgt

SEQ ID NO: 7608798 - DNA, 22 bp, Homo sapiens
gagagaaaggcttgcaggctgt

SEQ ID NO: 7608799 - DNA, 22 bp, Homo sapiens
gagagggctgcctggtgtgagg

SEQ ID NO: 7608800 - DNA, 22 bp, Homo sapiens
gagagggctgcctggtgtgagg

SEQ ID NO: 7608801 - DNA, 22 bp, Homo sapiens
gagagggctgcctggtgtgagg

SEQ ID NO: 7608802 - DNA, 22 bp, Homo sapiens
gagagggctctgtgtgggtact

SEQ ID NO: 7608803 - DNA, 22 bp, Homo sapiens
gagagggctctgtgtgggtact

SEQ ID NO: 7608804 - DNA, 22 bp, Homo sapiens
gagagggctctgtgtgggtact

SEQ ID NO: 7608805 - DNA, 22 bp, Homo sapiens
gagagggctctgtgtgggtact

SEQ ID NO: 7608806 - DNA, 22 bp, Homo sapiens
gagagggctctgtgtgggtact

SEQ ID NO: 7608807 - DNA, 22 bp, Homo sapiens
gagagggctctgtgtgggtact

SEQ ID NO: 7608808 - DNA, 22 bp, Homo sapiens
gagagggccgggggccagctcc

SEQ ID NO: 7608809 - DNA, 22 bp, Homo sapiens
gagagggccgggggccagctcc

SEQ ID NO: 7608810 - DNA, 22 bp, Homo sapiens
gagagggctctgtgtgggtact

SEQ ID NO: 7608811 - DNA, 22 bp, Homo sapiens
gagagggccgggggccagctcc

SEQ ID NO: 7608812 - DNA, 22 bp, Homo sapiens
gagagggccgggggccagctcc

SEQ ID NO: 7608813 - DNA, 22 bp, Homo sapiens
gagagggccgggggccagctcc

SEQ ID NO: 7608814 - DNA, 22 bp, Homo sapiens
gagagggccgggggccagctcc

SEQ ID NO: 7608815 - DNA, 22 bp, Homo sapiens
gagagggccgggggccagctcc

SEQ ID NO: 7608816 - DNA, 22 bp, Homo sapiens
gagagggccagggtgagaacta

SEQ ID NO: 7608817 - DNA, 22 bp, Homo sapiens
gagagggccagggtgagaacta

SEQ ID NO: 7608818 - DNA, 22 bp, Homo sapiens
gagagggccgggggccagctcc

SEQ ID NO: 7608819 - DNA, 22 bp, Homo sapiens
gagagggccgggggccagctcc

SEQ ID NO: 7608820 - DNA, 22 bp, Homo sapiens
gagagggcaaggtagatgctac

SEQ ID NO: 7608821 - DNA, 21 bp, Homo sapiens
gagagggcattataggaagtg

SEQ ID NO: 7608822 - DNA, 21 bp, Homo sapiens
gagagggcattataggaagtg

SEQ ID NO: 7608823 - DNA, 21 bp, Homo sapiens
gagagggcattataggaagtg

SEQ ID NO: 7608824 - DNA, 21 bp, Homo sapiens
gagagggcattataggaagtg

SEQ ID NO: 7608825 - DNA, 22 bp, Homo sapiens
gagagggcaaggtagatgctac

SEQ ID NO: 7608826 - DNA, 21 bp, Homo sapiens
gagagggcattataggaagtg

SEQ ID NO: 7608827 - DNA, 22 bp, Homo sapiens
gagagggcaaggtagatgctac

SEQ ID NO: 7608828 - DNA, 22 bp, Homo sapiens
gagagggcaaggtagatgctac

SEQ ID NO: 7608829 - DNA, 22 bp, Homo sapiens
gagagggcaaggtagatgctac

SEQ ID NO: 7608830 - DNA, 22 bp, Homo sapiens
gagagggcaaggtagatgctac

SEQ ID NO: 7608831 - DNA, 22 bp, Homo sapiens
gagagggcaaggtagatgctac

SEQ ID NO: 7608832 - DNA, 22 bp, Homo sapiens
gagagggccagggtgagaacta

SEQ ID NO: 7608833 - DNA, 22 bp, Homo sapiens
gagagggccagggtgagaacta

SEQ ID NO: 7608834 - DNA, 22 bp, Homo sapiens
gagagggccagggtgagaacta

SEQ ID NO: 7608835 - DNA, 22 bp, Homo sapiens
gagagggccagggtgagaacta

SEQ ID NO: 7608836 - DNA, 22 bp, Homo sapiens
gagagggccagggtgagaacta

SEQ ID NO: 7608837 - DNA, 21 bp, Homo sapiens
gagagggcattataggaagtg

SEQ ID NO: 7608838 - DNA, 21 bp, Homo sapiens
gagagggcattataggaagtg

SEQ ID NO: 7608839 - DNA, 21 bp, Homo sapiens
gagagggcattataggaagtg

SEQ ID NO: 7608840 - DNA, 21 bp, Homo sapiens
gagagggcattataggaagtg

SEQ ID NO: 7608841 - DNA, 21 bp, Homo sapiens
gagagggcattataggaagtg

SEQ ID NO: 7608842 - DNA, 21 bp, Homo sapiens
gagagggcattataggaagtg

SEQ ID NO: 7608843 - DNA, 22 bp, Homo sapiens
gagaaaggcattcctatgcaaa

SEQ ID NO: 7608844 - DNA, 22 bp, Homo sapiens
gagaaaggcattcctatgcaaa

SEQ ID NO: 7608845 - DNA, 22 bp, Homo sapiens
gagacagatgctgctggagcat

SEQ ID NO: 7608846 - DNA, 22 bp, Homo sapiens
gagacagatgctgctggagcat

SEQ ID NO: 7608847 - DNA, 22 bp, Homo sapiens
gagacagatgctgctggagcat

SEQ ID NO: 7608848 - DNA, 22 bp, Homo sapiens
gagacagatgctgctggagcat

SEQ ID NO: 7608849 - DNA, 22 bp, Homo sapiens
gagacagatgctgctggagcat

SEQ ID NO: 7608850 - DNA, 22 bp, Homo sapiens
gagacagatgctgctggagcat

SEQ ID NO: 7608851 - DNA, 22 bp, Homo sapiens
gagacagatgctgctggagcat

SEQ ID NO: 7608852 - DNA, 22 bp, Homo sapiens
gagacagatgctgctggagcat

SEQ ID NO: 7608853 - DNA, 22 bp, Homo sapiens
gagaaaggcattcctatgcaaa

SEQ ID NO: 7608854 - DNA, 22 bp, Homo sapiens
gagaaaggcattcctatgcaaa

SEQ ID NO: 7608855 - DNA, 22 bp, Homo sapiens
gagaaaggcattcctatgcaaa

SEQ ID NO: 7608856 - DNA, 22 bp, Homo sapiens
gagaaaggcattcctatgcaaa

SEQ ID NO: 7608857 - DNA, 22 bp, Homo sapiens
gagaaaggcattcctatgcaaa

SEQ ID NO: 7608858 - DNA, 22 bp, Homo sapiens
gagaaaggcatccttggcttca

SEQ ID NO: 7608859 - DNA, 22 bp, Homo sapiens
gagaaaggcatccttggcttca

SEQ ID NO: 7608860 - DNA, 22 bp, Homo sapiens
gagaaagcttctttcccacagg

SEQ ID NO: 7608861 - DNA, 22 bp, Homo sapiens
gagacattcttaggaacaatgt

SEQ ID NO: 7608862 - DNA, 22 bp, Homo sapiens
gagacattcttaggaacaatgt

SEQ ID NO: 7608863 - DNA, 19 bp, Homo sapiens
gagacatgtagatagaaga

SEQ ID NO: 7608864 - DNA, 22 bp, Homo sapiens
gagacagatgctgctggagcat

SEQ ID NO: 7608865 - DNA, 20 bp, Homo sapiens
gagacagcaaaagcctctcc

SEQ ID NO: 7608866 - DNA, 20 bp, Homo sapiens
gagacagcaaaagcctctcc

SEQ ID NO: 7608867 - DNA, 20 bp, Homo sapiens
gagacagcaaaagcctctcc

SEQ ID NO: 7608868 - DNA, 22 bp, Homo sapiens
gagacagatgctgctggagcat

SEQ ID NO: 7608869 - DNA, 22 bp, Homo sapiens
gagacagatgctgctggagcat

SEQ ID NO: 7608870 - DNA, 23 bp, Homo sapiens
gagaccagggccagctgtgtcat

SEQ ID NO: 7608871 - DNA, 22 bp, Homo sapiens
gagaccaggaagtacagcagcc

SEQ ID NO: 7608872 - DNA, 22 bp, Homo sapiens
gagaccaaggattgaatgctgg

SEQ ID NO: 7608873 - DNA, 22 bp, Homo sapiens
gagaccaggaagtacagcagcc

SEQ ID NO: 7608874 - DNA, 22 bp, Homo sapiens
gagaccaggaagtacagcagcc

SEQ ID NO: 7608875 - DNA, 19 bp, Homo sapiens
gagaaagcaggcacagcac

SEQ ID NO: 7608876 - DNA, 22 bp, Homo sapiens
gagaaagattgtccttcagggg

SEQ ID NO: 7608877 - DNA, 22 bp, Homo sapiens
gagaaagattgtccttcagggg

SEQ ID NO: 7608878 - DNA, 19 bp, Homo sapiens
gagaaagcaggcacagcac

SEQ ID NO: 7608879 - DNA, 19 bp, Homo sapiens
gagaaagcaggcacagcac

SEQ ID NO: 7608880 - DNA, 19 bp, Homo sapiens
gagaaagcaggcacagcac

SEQ ID NO: 7608881 - DNA, 18 bp, Homo sapiens
gagaaagcagggaatgtt

SEQ ID NO: 7608882 - DNA, 18 bp, Homo sapiens
gagaaagcagggaatgtt

SEQ ID NO: 7608883 - DNA, 22 bp, Homo sapiens
gagaaagcttcagaaatggcct

SEQ ID NO: 7608884 - DNA, 22 bp, Homo sapiens
gagaaagcttcagaaatggcct

SEQ ID NO: 7608885 - DNA, 22 bp, Homo sapiens
gagaaagctaaataagttgatt

SEQ ID NO: 7608886 - DNA, 22 bp, Homo sapiens
gagaaagctaaataagttgatt

SEQ ID NO: 7608887 - DNA, 23 bp, Homo sapiens
gagaaagccggctatgatcctgg

SEQ ID NO: 7608888 - DNA, 22 bp, Homo sapiens
gagaaagctaataggaatccta

SEQ ID NO: 7608889 - DNA, 22 bp, Homo sapiens
gagaaagatgtaggctgggagg

SEQ ID NO: 7608890 - DNA, 22 bp, Homo sapiens
gagaaagatgtaggctgggagg

SEQ ID NO: 7608891 - DNA, 22 bp, Homo sapiens
gagaaagatgtaggctgggagg

SEQ ID NO: 7608892 - DNA, 22 bp, Homo sapiens
gagaaagatgtaggctgggagg

SEQ ID NO: 7608893 - DNA, 22 bp, Homo sapiens
gagaaagatgtaggctgggagg

SEQ ID NO: 7608894 - DNA, 22 bp, Homo sapiens
gagaaagatgtaggctgggagg

SEQ ID NO: 7608895 - DNA, 22 bp, Homo sapiens
gagaaagattgtccttcagggg

SEQ ID NO: 7608896 - DNA, 22 bp, Homo sapiens
gagaaagattgtccttcagggg

SEQ ID NO: 7608897 - DNA, 22 bp, Homo sapiens
gagaaagattgtccttcagggg

SEQ ID NO: 7608898 - DNA, 22 bp, Homo sapiens
gagaaagattgtccttcagggg

SEQ ID NO: 7608899 - DNA, 22 bp, Homo sapiens
gagaaagatgtaggctgggagg

SEQ ID NO: 7608900 - DNA, 22 bp, Homo sapiens
gagaaagatgtaggctgggagg

SEQ ID NO: 7608901 - DNA, 22 bp, Homo sapiens
gagaaagatgtaggctgggagg

SEQ ID NO: 7608902 - DNA, 22 bp, Homo sapiens
gagaaagatgtaggctgggagg

SEQ ID NO: 7608903 - DNA, 22 bp, Homo sapiens
gagaaagatgtaggctgggagg

SEQ ID NO: 7608904 - DNA, 22 bp, Homo sapiens
gagaaagatgtaggctgggagg

SEQ ID NO: 7608905 - DNA, 22 bp, Homo sapiens
gagaaagatggaatcttacagg

SEQ ID NO: 7608906 - DNA, 22 bp, Homo sapiens
gagaaagatggaatcttacagg

SEQ ID NO: 7608907 - DNA, 22 bp, Homo sapiens
gagaaagatggaatcttacagg

SEQ ID NO: 7608908 - DNA, 22 bp, Homo sapiens
gagaaagatggaatcttacagg

SEQ ID NO: 7608909 - DNA, 22 bp, Homo sapiens
gagaaagatggaatcttacagg

SEQ ID NO: 7608910 - DNA, 22 bp, Homo sapiens
gactgcagtgaaggcacatggg

SEQ ID NO: 7608911 - DNA, 22 bp, Homo sapiens
gactgcatgatgttccagagga

SEQ ID NO: 7608912 - DNA, 22 bp, Homo sapiens
gactgaggtgacctaggactac

SEQ ID NO: 7608913 - DNA, 22 bp, Homo sapiens
gactgcagtgaaggcacatggg

SEQ ID NO: 7608914 - DNA, 22 bp, Homo sapiens
gactgcagtaagcctcatgact

SEQ ID NO: 7608915 - DNA, 22 bp, Homo sapiens
gactgcagtaagcctcatgact

SEQ ID NO: 7608916 - DNA, 22 bp, Homo sapiens
gactgcaagtctgggaaaggag

SEQ ID NO: 7608917 - DNA, 22 bp, Homo sapiens
gactgaggtgacctaggactac

SEQ ID NO: 7608918 - DNA, 22 bp, Homo sapiens
gactgaggtgacctaggactac

SEQ ID NO: 7608919 - DNA, 22 bp, Homo sapiens
gactgaggtgacctaggactac

SEQ ID NO: 7608920 - DNA, 22 bp, Homo sapiens
gactgaggtgacctaggactac

SEQ ID NO: 7608921 - DNA, 22 bp, Homo sapiens
gactgaggtgcccagaggtgac

SEQ ID NO: 7608922 - DNA, 22 bp, Homo sapiens
gactgaggtgcccagaggtgac

SEQ ID NO: 7608923 - DNA, 22 bp, Homo sapiens
gactgaggtgcccagaggtgac

SEQ ID NO: 7608924 - DNA, 22 bp, Homo sapiens
gactgaggtgcccagaggtgac

SEQ ID NO: 7608925 - DNA, 22 bp, Homo sapiens
gactgcaaccttagactagaaa

SEQ ID NO: 7608926 - DNA, 21 bp, Homo sapiens
gactgcaagcgaggctgtgaa

SEQ ID NO: 7608927 - DNA, 21 bp, Homo sapiens
gactgcaagcgaggctgtgaa

SEQ ID NO: 7608928 - DNA, 22 bp, Homo sapiens
gagaaacactgttagtttatta

SEQ ID NO: 7608929 - DNA, 22 bp, Homo sapiens
gagaaacactgttagtttatta

SEQ ID NO: 7608930 - DNA, 22 bp, Homo sapiens
gagaaacactgttagtttatta

SEQ ID NO: 7608931 - DNA, 22 bp, Homo sapiens
gagaaacactgttagtttatta

SEQ ID NO: 7608932 - DNA, 22 bp, Homo sapiens
gactgcctttttgagcaaaatg

SEQ ID NO: 7608933 - DNA, 22 bp, Homo sapiens
gagaaacactgttagtttatta

SEQ ID NO: 7608934 - DNA, 22 bp, Homo sapiens
gagaaacactgttagtttatta

SEQ ID NO: 7608935 - DNA, 22 bp, Homo sapiens
gagaaacactgttagtttatta

SEQ ID NO: 7608936 - DNA, 22 bp, Homo sapiens
gagaaacaggaattgagtcgct

SEQ ID NO: 7608937 - DNA, 22 bp, Homo sapiens
gagaaacaggaattgagtcgct

SEQ ID NO: 7608938 - DNA, 23 bp, Homo sapiens
gagaaacctcggtaagcaggagg

SEQ ID NO: 7608939 - DNA, 23 bp, Homo sapiens
gagaaacctcggtaagcaggagg

SEQ ID NO: 7608940 - DNA, 19 bp, Homo sapiens
gagaaaccccgtctttagg

SEQ ID NO: 7608941 - DNA, 22 bp, Homo sapiens
gagaaaccgattctgcatgtca

SEQ ID NO: 7608942 - DNA, 22 bp, Homo sapiens
gagaaacaggaattgagtcgct

SEQ ID NO: 7608943 - DNA, 22 bp, Homo sapiens
gagaaacaggaattgagtcgct

SEQ ID NO: 7608944 - DNA, 22 bp, Homo sapiens
gagaaacaggaattgagtcgct

SEQ ID NO: 7608945 - DNA, 22 bp, Homo sapiens
gagaaacaggaattgagtcgct

SEQ ID NO: 7608946 - DNA, 22 bp, Homo sapiens
gagaaacaggaattgagtcgct

SEQ ID NO: 7608947 - DNA, 22 bp, Homo sapiens
gagaaagatggaatcttacagg

SEQ ID NO: 7608948 - DNA, 22 bp, Homo sapiens
gagaaagatggaatcttacagg

SEQ ID NO: 7608949 - DNA, 22 bp, Homo sapiens
gagaaagatggaatcttacagg

SEQ ID NO: 7608950 - DNA, 22 bp, Homo sapiens
gagaaagatggaatcttacagg

SEQ ID NO: 7608951 - DNA, 22 bp, Homo sapiens
gagaaagatgaagagtggcgtt

SEQ ID NO: 7608952 - DNA, 22 bp, Homo sapiens
gagaaagatgaagagtggcgtt

SEQ ID NO: 7608953 - DNA, 22 bp, Homo sapiens
gagaaagatgaagagtggcgtt

SEQ ID NO: 7608954 - DNA, 22 bp, Homo sapiens
gagaaagatgaagagtggcgtt

SEQ ID NO: 7608955 - DNA, 22 bp, Homo sapiens
gagaaagatgaagagtggcgtt

SEQ ID NO: 7608956 - DNA, 22 bp, Homo sapiens
gagaaagatgaagagtggcgtt

SEQ ID NO: 7608957 - DNA, 22 bp, Homo sapiens
gagaaagatgaagagtggcgtt

SEQ ID NO: 7608958 - DNA, 22 bp, Homo sapiens
gagaaagacgtaggctgggagg

SEQ ID NO: 7608959 - DNA, 22 bp, Homo sapiens
gagaaagacgtaggctgggagg

SEQ ID NO: 7608960 - DNA, 22 bp, Homo sapiens
gagaaagacgtaggctgggagg

SEQ ID NO: 7608961 - DNA, 22 bp, Homo sapiens
gagaaagacgtaggctgggagg

SEQ ID NO: 7608962 - DNA, 22 bp, Homo sapiens
gagaaagacgtaggctgggagg

SEQ ID NO: 7608963 - DNA, 22 bp, Homo sapiens
gagaaagacgtaggctgggagg

SEQ ID NO: 7608964 - DNA, 22 bp, Homo sapiens
gagaaagacgtaggctgggagg

SEQ ID NO: 7608965 - DNA, 22 bp, Homo sapiens
gagaaagacgtaggctgggagg

SEQ ID NO: 7608966 - DNA, 22 bp, Homo sapiens
gagaaagacgtaggctgggagg

SEQ ID NO: 7608967 - DNA, 22 bp, Homo sapiens
gagaaagacgtaggctgggagg

SEQ ID NO: 7608968 - DNA, 22 bp, Homo sapiens
gagaaagacgtaggctgggagg

SEQ ID NO: 7608969 - DNA, 22 bp, Homo sapiens
gagaaagacgtaggctgggagg

SEQ ID NO: 7608970 - DNA, 22 bp, Homo sapiens
gagaaacctgtaaggaaggaag

SEQ ID NO: 7608971 - DNA, 18 bp, Homo sapiens
gagaaacctgtgaatgct

SEQ ID NO: 7608972 - DNA, 22 bp, Homo sapiens
gagaaactaacatctgaaggtg

SEQ ID NO: 7608973 - DNA, 22 bp, Homo sapiens
gagaaactaacatctgaaggtg

SEQ ID NO: 7608974 - DNA, 22 bp, Homo sapiens
gagaaagaaagggaagtttgtt

SEQ ID NO: 7608975 - DNA, 22 bp, Homo sapiens
gagaaagaaagggaagtttgtt

SEQ ID NO: 7608976 - DNA, 22 bp, Homo sapiens
gagaaagaaagggaagtttgtt

SEQ ID NO: 7608977 - DNA, 22 bp, Homo sapiens
gagaaacttggagttattctgg

SEQ ID NO: 7608978 - DNA, 22 bp, Homo sapiens
gagaaagaaagggaagtttgtt

SEQ ID NO: 7608979 - DNA, 22 bp, Homo sapiens
gagaaacttggagttattctgg

SEQ ID NO: 7608980 - DNA, 22 bp, Homo sapiens
gagaaacttggagttattctgg

SEQ ID NO: 7608981 - DNA, 22 bp, Homo sapiens
gagaaacttggagttattctgg

SEQ ID NO: 7608982 - DNA, 22 bp, Homo sapiens
cccttggggtggaggttgcagt

SEQ ID NO: 7608983 - DNA, 22 bp, Homo sapiens
cccttggggtggaggttgcagt

SEQ ID NO: 7608984 - DNA, 22 bp, Homo sapiens
cccttggggtggaggttgcagt

SEQ ID NO: 7608985 - DNA, 22 bp, Homo sapiens
cccttgggtgccagccacaagt

SEQ ID NO: 7608986 - DNA, 22 bp, Homo sapiens
cccttggggctctttgccaggc

SEQ ID NO: 7608987 - DNA, 22 bp, Homo sapiens
cccttgggcttccacccagccc

SEQ ID NO: 7608988 - DNA, 22 bp, Homo sapiens
cccttggctttagtttctaaag

SEQ ID NO: 7608989 - DNA, 22 bp, Homo sapiens
cccttgggccccagctcagggc

SEQ ID NO: 7608990 - DNA, 22 bp, Homo sapiens
cccttgggccccagctcagggc

SEQ ID NO: 7608991 - DNA, 22 bp, Homo sapiens
cccttgggccccagctcagggc

SEQ ID NO: 7608992 - DNA, 22 bp, Homo sapiens
cccttgggcttcagccctaccg

SEQ ID NO: 7608993 - DNA, 22 bp, Homo sapiens
cccttgggccccagctcagggc

SEQ ID NO: 7608994 - DNA, 22 bp, Homo sapiens
cccttggctttagtttctaaag

SEQ ID NO: 7608995 - DNA, 22 bp, Homo sapiens
cccttggcaaagctccccagtc

SEQ ID NO: 7608996 - DNA, 22 bp, Homo sapiens
cccttggccactgcgccagtga

SEQ ID NO: 7608997 - DNA, 22 bp, Homo sapiens
cccttggccactgcgccagtga

SEQ ID NO: 7608998 - DNA, 22 bp, Homo sapiens
cccttggcaaagctccccagtc

SEQ ID NO: 7608999 - DNA, 22 bp, Homo sapiens
cccttggaaggtagctggcagt

SEQ ID NO: 7609000 - DNA, 22 bp, Homo sapiens
cccttggaaggtagctggcagt

SEQ ID NO: 7609001 - DNA, 22 bp, Homo sapiens
cccttggaaggtagctggcagt

SEQ ID NO: 7609002 - DNA, 22 bp, Homo sapiens
cccttggaggaagctctaggct

SEQ ID NO: 7609003 - DNA, 22 bp, Homo sapiens
cccttggaggaagctctaggct

SEQ ID NO: 7609004 - DNA, 22 bp, Homo sapiens
ccctttaaggtctgattttcag

SEQ ID NO: 7609005 - DNA, 22 bp, Homo sapiens
ccctttaagtagaatatattat

SEQ ID NO: 7609006 - DNA, 22 bp, Homo sapiens
ccctttaagtagaatatattat

SEQ ID NO: 7609007 - DNA, 23 bp, Homo sapiens
ccctttaagatttgaatagtcag

SEQ ID NO: 7609008 - DNA, 20 bp, Homo sapiens
ccctttaagctttagtatgc

SEQ ID NO: 7609009 - DNA, 22 bp, Homo sapiens
ccctttaaagttttaccagcag

SEQ ID NO: 7609010 - DNA, 22 bp, Homo sapiens
ccctttagcccctgcagagact

SEQ ID NO: 7609011 - DNA, 22 bp, Homo sapiens
ccctttaagtcctggaacaaag

SEQ ID NO: 7609012 - DNA, 22 bp, Homo sapiens
ccctttaagtcctggaacaaag

SEQ ID NO: 7609013 - DNA, 22 bp, Homo sapiens
ccctttaattccaacacaggaa

SEQ ID NO: 7609014 - DNA, 22 bp, Homo sapiens
ccctttagcccctgcagagact

SEQ ID NO: 7609015 - DNA, 22 bp, Homo sapiens
ccctttagcccctgcagagact

SEQ ID NO: 7609016 - DNA, 22 bp, Homo sapiens
ccctttagcccctgcagagact

SEQ ID NO: 7609017 - DNA, 22 bp, Homo sapiens
tggcaggtagtcagaggcgaca

SEQ ID NO: 7609018 - DNA, 22 bp, Homo sapiens
cccttgagctgtggctgggtga

SEQ ID NO: 7609019 - DNA, 22 bp, Homo sapiens
cccttgagctgtggctgggtga

SEQ ID NO: 7609020 - DNA, 22 bp, Homo sapiens
cccttgagcctggaggagctct

SEQ ID NO: 7609021 - DNA, 22 bp, Homo sapiens
cccttgagcctggaggagctct

SEQ ID NO: 7609022 - DNA, 22 bp, Homo sapiens
cccttgagcctggaggagctct

SEQ ID NO: 7609023 - DNA, 22 bp, Homo sapiens
tggcagggagccaccggtcatg

SEQ ID NO: 7609024 - DNA, 22 bp, Homo sapiens
tggcagggagccaccggtcatg

SEQ ID NO: 7609025 - DNA, 19 bp, Homo sapiens
tggcagggagagtttgaag

SEQ ID NO: 7609026 - DNA, 22 bp, Homo sapiens
cccttgaagactagaatgagga

SEQ ID NO: 7609027 - DNA, 22 bp, Homo sapiens
tggcagggagccaccggtcatg

SEQ ID NO: 7609028 - DNA, 22 bp, Homo sapiens
cccttgctgccacagctgccca

SEQ ID NO: 7609029 - DNA, 22 bp, Homo sapiens
cccttgctgccacagctgccca

SEQ ID NO: 7609030 - DNA, 22 bp, Homo sapiens
tggcagggaatacagatgttta

SEQ ID NO: 7609031 - DNA, 22 bp, Homo sapiens
tggcagggaatacagatgttta

SEQ ID NO: 7609032 - DNA, 22 bp, Homo sapiens
tggcagggaatacagatgttta

SEQ ID NO: 7609033 - DNA, 22 bp, Homo sapiens
tggcagggaatacagatgttta

SEQ ID NO: 7609034 - DNA, 19 bp, Homo sapiens
tggcagggagagtttgaag

SEQ ID NO: 7609035 - DNA, 19 bp, Homo sapiens
tggcagggagagtttgaag

SEQ ID NO: 7609036 - DNA, 19 bp, Homo sapiens
tggcagggagagtttgaag

SEQ ID NO: 7609037 - DNA, 19 bp, Homo sapiens
tggcagggagagtttgaag

SEQ ID NO: 7609038 - DNA, 19 bp, Homo sapiens
tggcagggagagtttgaag

SEQ ID NO: 7609039 - DNA, 22 bp, Homo sapiens
tggcagggagccaccggtcatg

SEQ ID NO: 7609040 - DNA, 19 bp, Homo sapiens
tggcagggagagtttgaag

SEQ ID NO: 7609041 - DNA, 22 bp, Homo sapiens
ccctgggacccgctgcagaggc

SEQ ID NO: 7609042 - DNA, 22 bp, Homo sapiens
ccctgggacccgctgcagaggc

SEQ ID NO: 7609043 - DNA, 22 bp, Homo sapiens
ccctgggacccgctgcagaggc

SEQ ID NO: 7609044 - DNA, 22 bp, Homo sapiens
ccctgggaagtattccagctat

SEQ ID NO: 7609045 - DNA, 22 bp, Homo sapiens
ccctgggaagtattccagctat

SEQ ID NO: 7609046 - DNA, 22 bp, Homo sapiens
ccctgggaagtattccagctat

SEQ ID NO: 7609047 - DNA, 22 bp, Homo sapiens
ccctggcttggcactctccact

SEQ ID NO: 7609048 - DNA, 22 bp, Homo sapiens
ccctggcttggcactctccact

SEQ ID NO: 7609049 - DNA, 22 bp, Homo sapiens
ccctggcttggcactctccact

SEQ ID NO: 7609050 - DNA, 22 bp, Homo sapiens
ccctggcttggcactctccact

SEQ ID NO: 7609051 - DNA, 22 bp, Homo sapiens
ccctggcttggcactctccact

SEQ ID NO: 7609052 - DNA, 22 bp, Homo sapiens
ccctggcttggcactctccact

SEQ ID NO: 7609053 - DNA, 22 bp, Homo sapiens
ccctggcttggcactctccact

SEQ ID NO: 7609054 - DNA, 22 bp, Homo sapiens
ccctggcttggcactctccact

SEQ ID NO: 7609055 - DNA, 22 bp, Homo sapiens
ccctggcttggcactctccact

SEQ ID NO: 7609056 - DNA, 22 bp, Homo sapiens
ccctggcttggcactctccact

SEQ ID NO: 7609057 - DNA, 22 bp, Homo sapiens
ccctggcttaaaaacctcatat

SEQ ID NO: 7609058 - DNA, 22 bp, Homo sapiens
ccctggctggctctgcccggac

SEQ ID NO: 7609059 - DNA, 22 bp, Homo sapiens
ccctggcttaaaaacctcatat

SEQ ID NO: 7609060 - DNA, 22 bp, Homo sapiens
ccctggcttaaaaacctcatat

SEQ ID NO: 7609061 - DNA, 22 bp, Homo sapiens
ccctggcttaaaaacctcatat

SEQ ID NO: 7609062 - DNA, 22 bp, Homo sapiens
ccctggctggaaattaagtagt

SEQ ID NO: 7609063 - DNA, 22 bp, Homo sapiens
ccctggctgcttgtagtctggc

SEQ ID NO: 7609064 - DNA, 22 bp, Homo sapiens
ccctggctgcttgtagtctggc

SEQ ID NO: 7609065 - DNA, 22 bp, Homo sapiens
ccctggctggaaattaagtagt

SEQ ID NO: 7609066 - DNA, 22 bp, Homo sapiens
ccctggctggctctgcccggac

SEQ ID NO: 7609067 - DNA, 22 bp, Homo sapiens
ccctggctggctctgcccggac

SEQ ID NO: 7609068 - DNA, 22 bp, Homo sapiens
ccctggctggaaattaagtagt

SEQ ID NO: 7609069 - DNA, 22 bp, Homo sapiens
ccctggctgcttgtagtctggc

SEQ ID NO: 7609070 - DNA, 22 bp, Homo sapiens
ccctgggacccgctgcagaggc

SEQ ID NO: 7609071 - DNA, 22 bp, Homo sapiens
ccctgggagaagttgagggctg

SEQ ID NO: 7609072 - DNA, 22 bp, Homo sapiens
ccctgggagaagttgagggctg

SEQ ID NO: 7609073 - DNA, 22 bp, Homo sapiens
ccctgggagaagttgagggctg

SEQ ID NO: 7609074 - DNA, 22 bp, Homo sapiens
ccctgggacccgctgcagaggc

SEQ ID NO: 7609075 - DNA, 22 bp, Homo sapiens
ccctgggacccgctgcagaggc

SEQ ID NO: 7609076 - DNA, 22 bp, Homo sapiens
ccctgggacccgctgcagaggc

SEQ ID NO: 7609077 - DNA, 22 bp, Homo sapiens
ccctgggaggcttccaggcaga

SEQ ID NO: 7609078 - DNA, 22 bp, Homo sapiens
ccctgggaggcttccaggcaga

SEQ ID NO: 7609079 - DNA, 22 bp, Homo sapiens
ccctgggagctgcctggctgac

SEQ ID NO: 7609080 - DNA, 22 bp, Homo sapiens
ccctgggagctgcctggctgac

SEQ ID NO: 7609081 - DNA, 22 bp, Homo sapiens
ccctgggagaagttgagggctg

SEQ ID NO: 7609082 - DNA, 22 bp, Homo sapiens
ccctgggagaagttgagggctg

SEQ ID NO: 7609083 - DNA, 22 bp, Homo sapiens
tggcaggaaaaacattggagat

SEQ ID NO: 7609084 - DNA, 22 bp, Homo sapiens
tggcaggaaaaacattggagat

SEQ ID NO: 7609085 - DNA, 22 bp, Homo sapiens
ccctgggagtccactgatgtca

SEQ ID NO: 7609086 - DNA, 22 bp, Homo sapiens
tggcaggaaaaacattggagat

SEQ ID NO: 7609087 - DNA, 22 bp, Homo sapiens
ccctgggagtccactgatgtca

SEQ ID NO: 7609088 - DNA, 22 bp, Homo sapiens
tggcaggaaaaacattggagat

SEQ ID NO: 7609089 - DNA, 22 bp, Homo sapiens
tggcaggaaaaacattggagat

SEQ ID NO: 7609090 - DNA, 22 bp, Homo sapiens
tggcaggaaaaacattggagat

SEQ ID NO: 7609091 - DNA, 22 bp, Homo sapiens
tggcaggaaaaacattggagat

SEQ ID NO: 7609092 - DNA, 22 bp, Homo sapiens
ccctgggaggcttccaggcaga

SEQ ID NO: 7609093 - DNA, 22 bp, Homo sapiens
ccctgggaggcttccaggcaga

SEQ ID NO: 7609094 - DNA, 22 bp, Homo sapiens
ccctgggaggcttccaggcaga

SEQ ID NO: 7609095 - DNA, 22 bp, Homo sapiens
tggcaggaaaaagggccagagg

SEQ ID NO: 7609096 - DNA, 19 bp, Homo sapiens
tggcaggcccaggatggac

SEQ ID NO: 7609097 - DNA, 22 bp, Homo sapiens
tggcaggaaaaacattggagat

SEQ ID NO: 7609098 - DNA, 22 bp, Homo sapiens
tggcaggaaaaacattggagat

SEQ ID NO: 7609099 - DNA, 19 bp, Homo sapiens
tggcaggcccaggatggac

SEQ ID NO: 7609100 - DNA, 19 bp, Homo sapiens
tggcaggcccaggatggac

SEQ ID NO: 7609101 - DNA, 19 bp, Homo sapiens
tggcaggcccaggatggac

SEQ ID NO: 7609102 - DNA, 19 bp, Homo sapiens
tggcaggcccaggatggac

SEQ ID NO: 7609103 - DNA, 22 bp, Homo sapiens
tggcaggcggaggttgcagtga

SEQ ID NO: 7609104 - DNA, 22 bp, Homo sapiens
tggcaggcggaggttgcagtga

SEQ ID NO: 7609105 - DNA, 22 bp, Homo sapiens
tggcaggcgggagccatagagg

SEQ ID NO: 7609106 - DNA, 22 bp, Homo sapiens
tggcaggcggaggttgcagtga

SEQ ID NO: 7609107 - DNA, 22 bp, Homo sapiens
tggcaggctgagttggcctggt

SEQ ID NO: 7609108 - DNA, 22 bp, Homo sapiens
tggcaggctctgagtagcacct

SEQ ID NO: 7609109 - DNA, 22 bp, Homo sapiens
tggcaggctctgagtagcacct

SEQ ID NO: 7609110 - DNA, 22 bp, Homo sapiens
tggcaggctctgagtagcacct

SEQ ID NO: 7609111 - DNA, 22 bp, Homo sapiens
tggcaggcgggagccatagagg

SEQ ID NO: 7609112 - DNA, 22 bp, Homo sapiens
tggcaggcgggagccatagagg

SEQ ID NO: 7609113 - DNA, 22 bp, Homo sapiens
tggcaggcgggagccatagagg

SEQ ID NO: 7609114 - DNA, 22 bp, Homo sapiens
tggcaggctgagttggcctggt

SEQ ID NO: 7609115 - DNA, 22 bp, Homo sapiens
tggcaggctgagttggcctggt

SEQ ID NO: 7609116 - DNA, 22 bp, Homo sapiens
tggcaggctctgagtagcacct

SEQ ID NO: 7609117 - DNA, 22 bp, Homo sapiens
tggcaggctgagttggcctggt

SEQ ID NO: 7609118 - DNA, 22 bp, Homo sapiens
tggcaggctgagttggcctggt

SEQ ID NO: 7609119 - DNA, 22 bp, Homo sapiens
tggcaggctgagttggcctggt

SEQ ID NO: 7609120 - DNA, 22 bp, Homo sapiens
tggcaggctgagttggcctggt

SEQ ID NO: 7609121 - DNA, 22 bp, Homo sapiens
tggcaggctgagttggcctggt

SEQ ID NO: 7609122 - DNA, 22 bp, Homo sapiens
tggcagggaatacagatgttta

SEQ ID NO: 7609123 - DNA, 22 bp, Homo sapiens
tggcagggaatacagatgttta

SEQ ID NO: 7609124 - DNA, 22 bp, Homo sapiens
tggcacagtgctggatggtgct

SEQ ID NO: 7609125 - DNA, 22 bp, Homo sapiens
tggcacagtgctggatggtgct

SEQ ID NO: 7609126 - DNA, 22 bp, Homo sapiens
tggcacagtgctggatggtgct

SEQ ID NO: 7609127 - DNA, 22 bp, Homo sapiens
ccctggatttacatcattctga

SEQ ID NO: 7609128 - DNA, 22 bp, Homo sapiens
tggcacagtgctggatggtgct

SEQ ID NO: 7609129 - DNA, 22 bp, Homo sapiens
tggcacagtgctggatggtgct

SEQ ID NO: 7609130 - DNA, 22 bp, Homo sapiens
tggcacagtgctggatggtgct

SEQ ID NO: 7609131 - DNA, 22 bp, Homo sapiens
ccctggagtgtgacgaggcatt

SEQ ID NO: 7609132 - DNA, 22 bp, Homo sapiens
ccctggagtgtgacgaggcatt

SEQ ID NO: 7609133 - DNA, 22 bp, Homo sapiens
ccctggagtgtgacgaggcatt

SEQ ID NO: 7609134 - DNA, 22 bp, Homo sapiens
ccctggagtgtgacgaggcatt

SEQ ID NO: 7609135 - DNA, 22 bp, Homo sapiens
ccctggagtgtgacgaggcatt

SEQ ID NO: 7609136 - DNA, 22 bp, Homo sapiens
ccctggatttacatcattctga

SEQ ID NO: 7609137 - DNA, 22 bp, Homo sapiens
tggcagaagttcactagtagct

SEQ ID NO: 7609138 - DNA, 22 bp, Homo sapiens
tggcagaagttcactagtagct

SEQ ID NO: 7609139 - DNA, 22 bp, Homo sapiens
tggcagaatgaagactggggcc

SEQ ID NO: 7609140 - DNA, 22 bp, Homo sapiens
tggcagaatgaagactggggcc

SEQ ID NO: 7609141 - DNA, 22 bp, Homo sapiens
tggcagaagtacacaagcatgc

SEQ ID NO: 7609142 - DNA, 22 bp, Homo sapiens
tggcagaagttcactagtagct

SEQ ID NO: 7609143 - DNA, 22 bp, Homo sapiens
tggcagaagttcactagtagct

SEQ ID NO: 7609144 - DNA, 22 bp, Homo sapiens
tggcagaaagaaccatgtgcaa

SEQ ID NO: 7609145 - DNA, 22 bp, Homo sapiens
tggcagaagtacacaagcatgc

SEQ ID NO: 7609146 - DNA, 22 bp, Homo sapiens
tggcagaagtacacaagcatgc

SEQ ID NO: 7609147 - DNA, 22 bp, Homo sapiens
tggcagaagtacacaagcatgc

SEQ ID NO: 7609148 - DNA, 22 bp, Homo sapiens
tggcacttgtcacctgctttca

SEQ ID NO: 7609149 - DNA, 22 bp, Homo sapiens
tggcacttgtcacctgctttca

SEQ ID NO: 7609150 - DNA, 22 bp, Homo sapiens
tggcactttacacccatttggc

SEQ ID NO: 7609151 - DNA, 22 bp, Homo sapiens
tggcactttacttcctcaggag

SEQ ID NO: 7609152 - DNA, 22 bp, Homo sapiens
tggcactttgagcaaaggtgca

SEQ ID NO: 7609153 - DNA, 22 bp, Homo sapiens
tggcacttttcccagttttggt

SEQ ID NO: 7609154 - DNA, 22 bp, Homo sapiens
tggcagaaagaaccatgtgcaa

SEQ ID NO: 7609155 - DNA, 22 bp, Homo sapiens
ccctggctgctaccaggtagct

SEQ ID NO: 7609156 - DNA, 22 bp, Homo sapiens
ccctggctgctaccaggtagct

SEQ ID NO: 7609157 - DNA, 22 bp, Homo sapiens
ccctggctgctaccaggtagct

SEQ ID NO: 7609158 - DNA, 22 bp, Homo sapiens
ccctggctgctaccaggtagct

SEQ ID NO: 7609159 - DNA, 22 bp, Homo sapiens
ccctggctgctaccaggtagct

SEQ ID NO: 7609160 - DNA, 22 bp, Homo sapiens
ccctggctgctaccaggtagct

SEQ ID NO: 7609161 - DNA, 22 bp, Homo sapiens
ccctggctgcgtgatggatgaa

SEQ ID NO: 7609162 - DNA, 22 bp, Homo sapiens
ccctggctgcttgtagtctggc

SEQ ID NO: 7609163 - DNA, 22 bp, Homo sapiens
ccctggctgcttgtagtctggc

SEQ ID NO: 7609164 - DNA, 22 bp, Homo sapiens
ccctggctgcttgtagtctggc

SEQ ID NO: 7609165 - DNA, 22 bp, Homo sapiens
ccctggctgctaccaggtagct

SEQ ID NO: 7609166 - DNA, 22 bp, Homo sapiens
ccctggctgctaccaggtagct

SEQ ID NO: 7609167 - DNA, 22 bp, Homo sapiens
tggcagagaacacacatgattc

SEQ ID NO: 7609168 - DNA, 22 bp, Homo sapiens
tggcagagaacacacatgattc

SEQ ID NO: 7609169 - DNA, 22 bp, Homo sapiens
tggcagagaacacacatgattc

SEQ ID NO: 7609170 - DNA, 22 bp, Homo sapiens
tggcagagaacacacatgattc

SEQ ID NO: 7609171 - DNA, 22 bp, Homo sapiens
tggcagagaacacacatgattc

SEQ ID NO: 7609172 - DNA, 22 bp, Homo sapiens
tggcagagaacacacatgattc

SEQ ID NO: 7609173 - DNA, 22 bp, Homo sapiens
ccctggctgcgtgatggatgaa

SEQ ID NO: 7609174 - DNA, 22 bp, Homo sapiens
ccctggctgcgtgatggatgaa

SEQ ID NO: 7609175 - DNA, 22 bp, Homo sapiens
ccctggctgcgtgatggatgaa

SEQ ID NO: 7609176 - DNA, 22 bp, Homo sapiens
tggcagaatttctagcagattc

SEQ ID NO: 7609177 - DNA, 22 bp, Homo sapiens
tggcagaatttctagcagattc

SEQ ID NO: 7609178 - DNA, 22 bp, Homo sapiens
tggcagaagttcactagtagct

SEQ ID NO: 7609179 - DNA, 22 bp, Homo sapiens
tggcagaatttctagcagattc

SEQ ID NO: 7609180 - DNA, 22 bp, Homo sapiens
tggcagaatttctagcagattc

SEQ ID NO: 7609181 - DNA, 22 bp, Homo sapiens
tggcagaattttaaagacagat

SEQ ID NO: 7609182 - DNA, 22 bp, Homo sapiens
tggcagaattttaaagacagat

SEQ ID NO: 7609183 - DNA, 22 bp, Homo sapiens
tggcagaattttaaagacagat

SEQ ID NO: 7609184 - DNA, 22 bp, Homo sapiens
tggcagaattttaaagacagat

SEQ ID NO: 7609185 - DNA, 22 bp, Homo sapiens
tggcagaattttaaagacagat

SEQ ID NO: 7609186 - DNA, 21 bp, Homo sapiens
tggcagacaggaggagctcac

SEQ ID NO: 7609187 - DNA, 22 bp, Homo sapiens
tggcagaccatcttattaacaa

SEQ ID NO: 7609188 - DNA, 19 bp, Homo sapiens
tggcagacacaccttcttc

SEQ ID NO: 7609189 - DNA, 22 bp, Homo sapiens
tggcagactttagggtctacat

SEQ ID NO: 7609190 - DNA, 21 bp, Homo sapiens
tggcagactagagtatagatg

SEQ ID NO: 7609191 - DNA, 22 bp, Homo sapiens
tggcagacctgaaggttcggcg

SEQ ID NO: 7609192 - DNA, 22 bp, Homo sapiens
tggcagagaacacacatgattc

SEQ ID NO: 7609193 - DNA, 22 bp, Homo sapiens
tggcagactttagggtctacat

SEQ ID NO: 7609194 - DNA, 22 bp, Homo sapiens
tggcagagaacacacatgattc

SEQ ID NO: 7609195 - DNA, 22 bp, Homo sapiens
ccctggaggtcagaggcctggg

SEQ ID NO: 7609196 - DNA, 22 bp, Homo sapiens
ccctggagggcagacagatgcc

SEQ ID NO: 7609197 - DNA, 22 bp, Homo sapiens
ccctggagggcagacagatgcc

SEQ ID NO: 7609198 - DNA, 22 bp, Homo sapiens
ccctggagggcagacagatgcc

SEQ ID NO: 7609199 - DNA, 22 bp, Homo sapiens
ccctggagggcagacagatgcc

SEQ ID NO: 7609200 - DNA, 22 bp, Homo sapiens
ccctggagggcagacagatgcc

SEQ ID NO: 7609201 - DNA, 22 bp, Homo sapiens
ccctggagggcagacagatgcc

SEQ ID NO: 7609202 - DNA, 22 bp, Homo sapiens
ccctggaggtggaggttgcagg

SEQ ID NO: 7609203 - DNA, 22 bp, Homo sapiens
ccctggaggtcagaggcctggg

SEQ ID NO: 7609204 - DNA, 22 bp, Homo sapiens
ccctggaggtcagaggcctggg

SEQ ID NO: 7609205 - DNA, 22 bp, Homo sapiens
ccctggaggtcagaggcctggg

SEQ ID NO: 7609206 - DNA, 22 bp, Homo sapiens
ccctggaggtcagaggcctggg

SEQ ID NO: 7609207 - DNA, 22 bp, Homo sapiens
ccctggaggtcagaggcctggg

SEQ ID NO: 7609208 - DNA, 22 bp, Homo sapiens
ccctggaggtcagaggcctggg

SEQ ID NO: 7609209 - DNA, 22 bp, Homo sapiens
ccctggaggtggaggttgcagg

SEQ ID NO: 7609210 - DNA, 22 bp, Homo sapiens
ccctggaggtggaggttgcagg

SEQ ID NO: 7609211 - DNA, 22 bp, Homo sapiens
ccctggaggtggaggttgcagg

SEQ ID NO: 7609212 - DNA, 22 bp, Homo sapiens
ccctggaggtggaggttgcagg

SEQ ID NO: 7609213 - DNA, 22 bp, Homo sapiens
ccctggaggttgaggctgcagt

SEQ ID NO: 7609214 - DNA, 22 bp, Homo sapiens
ccctggaggtggaggttgcagg

SEQ ID NO: 7609215 - DNA, 22 bp, Homo sapiens
ccctggaggtggaggttgcagg

SEQ ID NO: 7609216 - DNA, 22 bp, Homo sapiens
ccctggaggttgaggctgcagt

SEQ ID NO: 7609217 - DNA, 22 bp, Homo sapiens
ccctggaggttgaggctgcagt

SEQ ID NO: 7609218 - DNA, 22 bp, Homo sapiens
ccctggaggttgaggctgcagt

SEQ ID NO: 7609219 - DNA, 22 bp, Homo sapiens
ccctggaggttgaggctgcagt

SEQ ID NO: 7609220 - DNA, 22 bp, Homo sapiens
ccctggaggttgaggctgcagt

SEQ ID NO: 7609221 - DNA, 22 bp, Homo sapiens
ccctggaggttgaggctgcagt

SEQ ID NO: 7609222 - DNA, 22 bp, Homo sapiens
ccctggaggttgaggctgcagt

SEQ ID NO: 7609223 - DNA, 22 bp, Homo sapiens
ccctggaggttgaggctgcagt

SEQ ID NO: 7609224 - DNA, 22 bp, Homo sapiens
ccctggagtccggagctcacct

SEQ ID NO: 7609225 - DNA, 22 bp, Homo sapiens
ccctggagtcaggttggcctgg

SEQ ID NO: 7609226 - DNA, 22 bp, Homo sapiens
ccctggagtcaggttggcctgg

SEQ ID NO: 7609227 - DNA, 22 bp, Homo sapiens
ccctggagtcaggttggcctgg

SEQ ID NO: 7609228 - DNA, 22 bp, Homo sapiens
ccctggagtcaggttggcctgg

SEQ ID NO: 7609229 - DNA, 22 bp, Homo sapiens
ccctggagtagcactgggtcgc

SEQ ID NO: 7609230 - DNA, 22 bp, Homo sapiens
ccctggagtagcactgggtcgc

SEQ ID NO: 7609231 - DNA, 23 bp, Homo sapiens
ccctggagtaaattcttggaagg

SEQ ID NO: 7609232 - DNA, 23 bp, Homo sapiens
ccctggagtaaattcttggaagg

SEQ ID NO: 7609233 - DNA, 22 bp, Homo sapiens
ccctggaggttgaggctgcagt

SEQ ID NO: 7609234 - DNA, 22 bp, Homo sapiens
ccctggagtccggagctcacct

SEQ ID NO: 7609235 - DNA, 22 bp, Homo sapiens
ccctggagtcctggcagttgat

SEQ ID NO: 7609236 - DNA, 22 bp, Homo sapiens
ccctggagtcctggcagttgat

SEQ ID NO: 7609237 - DNA, 22 bp, Homo sapiens
ccctggagtccggagctcacct

SEQ ID NO: 7609238 - DNA, 22 bp, Homo sapiens
ccctggagtccggagctcacct

SEQ ID NO: 7609239 - DNA, 22 bp, Homo sapiens
ccctggagtccggagctcacct

SEQ ID NO: 7609240 - DNA, 22 bp, Homo sapiens
ccctggagtccggagctcacct

SEQ ID NO: 7609241 - DNA, 22 bp, Homo sapiens
ccctggagtgtgacgaggcatt

SEQ ID NO: 7609242 - DNA, 22 bp, Homo sapiens
ccctggagtgtgacgaggcatt

SEQ ID NO: 7609243 - DNA, 22 bp, Homo sapiens
ccctggagtgccggaatcaaga

SEQ ID NO: 7609244 - DNA, 22 bp, Homo sapiens
ccctggagtcctggcagttgat

SEQ ID NO: 7609245 - DNA, 22 bp, Homo sapiens
ccctggagtcctggcagttgat

SEQ ID NO: 7609246 - DNA, 22 bp, Homo sapiens
tggaggacaggactggacagcc

SEQ ID NO: 7609247 - DNA, 22 bp, Homo sapiens
tggaggacaggactggacagcc

SEQ ID NO: 7609248 - DNA, 22 bp, Homo sapiens
tggaggacaggactggacagcc

SEQ ID NO: 7609249 - DNA, 22 bp, Homo sapiens
tggaggacgtgtccaccatgaa

SEQ ID NO: 7609250 - DNA, 22 bp, Homo sapiens
tggaggacaggactggacagcc

SEQ ID NO: 7609251 - DNA, 22 bp, Homo sapiens
tggaggaatcagggcttaggct

SEQ ID NO: 7609252 - DNA, 22 bp, Homo sapiens
tggaggacaggactggacagcc

SEQ ID NO: 7609253 - DNA, 22 bp, Homo sapiens
tggaggacaggactggacagcc

SEQ ID NO: 7609254 - DNA, 22 bp, Homo sapiens
tggaggacaggactggacagcc

SEQ ID NO: 7609255 - DNA, 22 bp, Homo sapiens
tggaggaatcagggcttaggct

SEQ ID NO: 7609256 - DNA, 22 bp, Homo sapiens
tggaggaatcagggcttaggct

SEQ ID NO: 7609257 - DNA, 21 bp, Homo sapiens
tggaggaataaagcacagaag

SEQ ID NO: 7609258 - DNA, 22 bp, Homo sapiens
tggaggaataacagcaacctta

SEQ ID NO: 7609259 - DNA, 22 bp, Homo sapiens
tggaggaataacagcaacctta

SEQ ID NO: 7609260 - DNA, 21 bp, Homo sapiens
tggaggaataaagcacagaag

SEQ ID NO: 7609261 - DNA, 21 bp, Homo sapiens
tggaggaataaagcacagaag

SEQ ID NO: 7609262 - DNA, 22 bp, Homo sapiens
tggaggaagttgctggaagtca

SEQ ID NO: 7609263 - DNA, 21 bp, Homo sapiens
tggaggaataaagcacagaag

SEQ ID NO: 7609264 - DNA, 21 bp, Homo sapiens
tggaggaataaagcacagaag

SEQ ID NO: 7609265 - DNA, 18 bp, Homo sapiens
tggaggaatcacaatggc

SEQ ID NO: 7609266 - DNA, 18 bp, Homo sapiens
tggaggaatcacaatggc

SEQ ID NO: 7609267 - DNA, 23 bp, Homo sapiens
tggaggaaacacatcagaagacc

SEQ ID NO: 7609268 - DNA, 23 bp, Homo sapiens
tggaggaaacacatcagaagacc

SEQ ID NO: 7609269 - DNA, 23 bp, Homo sapiens
tggaggaaacacatcagaagacc

SEQ ID NO: 7609270 - DNA, 22 bp, Homo sapiens
tggaggaagtggacagttgtgt

SEQ ID NO: 7609271 - DNA, 19 bp, Homo sapiens
tggaggaagtatatttcat

SEQ ID NO: 7609272 - DNA, 19 bp, Homo sapiens
tggaggaagtatatttcat

SEQ ID NO: 7609273 - DNA, 22 bp, Homo sapiens
tggaggaagtggacagttgtgt

SEQ ID NO: 7609274 - DNA, 22 bp, Homo sapiens
tggaggaagttgctggaagtca

SEQ ID NO: 7609275 - DNA, 22 bp, Homo sapiens
tggaggaagttgctggaagtca

SEQ ID NO: 7609276 - DNA, 22 bp, Homo sapiens
tggaggaagttgctggaagtca

SEQ ID NO: 7609277 - DNA, 22 bp, Homo sapiens
tggaggaagttgctggaagtca

SEQ ID NO: 7609278 - DNA, 22 bp, Homo sapiens
tggaggaagtggctggccagaa

SEQ ID NO: 7609279 - DNA, 22 bp, Homo sapiens
tggaggaagtggctggccagaa

SEQ ID NO: 7609280 - DNA, 22 bp, Homo sapiens
tggaggaagtggctggccagaa

SEQ ID NO: 7609281 - DNA, 22 bp, Homo sapiens
tggaggaagtggctggccagaa

SEQ ID NO: 7609282 - DNA, 22 bp, Homo sapiens
tggaggaagtggctggccagaa

SEQ ID NO: 7609283 - DNA, 22 bp, Homo sapiens
tggaggaagtggctggccagaa

SEQ ID NO: 7609284 - DNA, 22 bp, Homo sapiens
tggaggaaaattactggggtct

SEQ ID NO: 7609285 - DNA, 23 bp, Homo sapiens
tggaggaaacacatcagaagacc

SEQ ID NO: 7609286 - DNA, 23 bp, Homo sapiens
tggaggaaacacatcagaagacc

SEQ ID NO: 7609287 - DNA, 23 bp, Homo sapiens
tggaggaaacacatcagaagacc

SEQ ID NO: 7609288 - DNA, 22 bp, Homo sapiens
tggagctgaggggaatgctgag

SEQ ID NO: 7609289 - DNA, 22 bp, Homo sapiens
tggaggaaaattactggggtct

SEQ ID NO: 7609290 - DNA, 22 bp, Homo sapiens
tggagctgaggggaatgctgag

SEQ ID NO: 7609291 - DNA, 22 bp, Homo sapiens
tggagctgaggggaatgctgag

SEQ ID NO: 7609292 - DNA, 22 bp, Homo sapiens
tggagatgtaaagcaaggctta

SEQ ID NO: 7609293 - DNA, 22 bp, Homo sapiens
tggagatgtaaagcaaggctta

SEQ ID NO: 7609294 - DNA, 22 bp, Homo sapiens
tggagatgggttaatggagaga

SEQ ID NO: 7609295 - DNA, 22 bp, Homo sapiens
tggagatgtaaagcaaggctta

SEQ ID NO: 7609296 - DNA, 22 bp, Homo sapiens
tggagcaaacccatggctgtgc

SEQ ID NO: 7609297 - DNA, 22 bp, Homo sapiens
tggagatggcctcaggccctca

SEQ ID NO: 7609298 - DNA, 22 bp, Homo sapiens
tggagatggcctcaggccctca

SEQ ID NO: 7609299 - DNA, 22 bp, Homo sapiens
tggagatggcctcaggccctca

SEQ ID NO: 7609300 - DNA, 22 bp, Homo sapiens
tggagatgcctggagattaggg

SEQ ID NO: 7609301 - DNA, 22 bp, Homo sapiens
tggagatgggttaatggagaga

SEQ ID NO: 7609302 - DNA, 22 bp, Homo sapiens
tggagatgggttaatggagaga

SEQ ID NO: 7609303 - DNA, 22 bp, Homo sapiens
tggagatgggaaaaaggaggta

SEQ ID NO: 7609304 - DNA, 23 bp, Homo sapiens
tggagatgccccactccctgtct

SEQ ID NO: 7609305 - DNA, 23 bp, Homo sapiens
tggagatgccccactccctgtct

SEQ ID NO: 7609306 - DNA, 22 bp, Homo sapiens
tggagatgcacgagcaggtgga

SEQ ID NO: 7609307 - DNA, 23 bp, Homo sapiens
tggagatgccccactccctgtct

SEQ ID NO: 7609308 - DNA, 23 bp, Homo sapiens
tggagatgccccactccctgtct

SEQ ID NO: 7609309 - DNA, 22 bp, Homo sapiens
tggagatgcacgagcaggtgga

SEQ ID NO: 7609310 - DNA, 22 bp, Homo sapiens
tggagatgcacgagcaggtgga

SEQ ID NO: 7609311 - DNA, 22 bp, Homo sapiens
tggagatgcacgagcaggtgga

SEQ ID NO: 7609312 - DNA, 22 bp, Homo sapiens
tggagatgcacgagcaggtgga

SEQ ID NO: 7609313 - DNA, 22 bp, Homo sapiens
ccctggaggaccccaatgtggc

SEQ ID NO: 7609314 - DNA, 22 bp, Homo sapiens
ccctggaggaccccaatgtggc

SEQ ID NO: 7609315 - DNA, 22 bp, Homo sapiens
tggaggccaaggcaggcggatc

SEQ ID NO: 7609316 - DNA, 22 bp, Homo sapiens
tggaggccacatgaacgctgcg

SEQ ID NO: 7609317 - DNA, 22 bp, Homo sapiens
tggaggccacatgaacgctgcg

SEQ ID NO: 7609318 - DNA, 22 bp, Homo sapiens
tggaggccaaggcaggcggatc

SEQ ID NO: 7609319 - DNA, 22 bp, Homo sapiens
tggaggccaaggcaggcggatc

SEQ ID NO: 7609320 - DNA, 22 bp, Homo sapiens
tggaggccaactttcctcatct

SEQ ID NO: 7609321 - DNA, 22 bp, Homo sapiens
ccctggagggatttctcaatca

SEQ ID NO: 7609322 - DNA, 22 bp, Homo sapiens
ccctggagggatttctcaatca

SEQ ID NO: 7609323 - DNA, 22 bp, Homo sapiens
ccctggagggatttctcaatca

SEQ ID NO: 7609324 - DNA, 22 bp, Homo sapiens
ccctggagggacagctgctcta

SEQ ID NO: 7609325 - DNA, 22 bp, Homo sapiens
ccctggagggacagctgctcta

SEQ ID NO: 7609326 - DNA, 22 bp, Homo sapiens
tggaggcattgtgactgctgaa

SEQ ID NO: 7609327 - DNA, 22 bp, Homo sapiens
tggaggcattgtgactgctgaa

SEQ ID NO: 7609328 - DNA, 22 bp, Homo sapiens
tggaggcattgtgactgctgaa

SEQ ID NO: 7609329 - DNA, 22 bp, Homo sapiens
tggaggcattgtgactgctgaa

SEQ ID NO: 7609330 - DNA, 22 bp, Homo sapiens
tggaggcattgtgactgctgaa

SEQ ID NO: 7609331 - DNA, 22 bp, Homo sapiens
tggaggcattgtgactgctgaa

SEQ ID NO: 7609332 - DNA, 22 bp, Homo sapiens
tggaggcattgtgactgctgaa

SEQ ID NO: 7609333 - DNA, 22 bp, Homo sapiens
tggaggcatgacagtgtctgga

SEQ ID NO: 7609334 - DNA, 22 bp, Homo sapiens
tggaggcatgacagtgtctgga

SEQ ID NO: 7609335 - DNA, 22 bp, Homo sapiens
tggaggcatgacagtgtctgga

SEQ ID NO: 7609336 - DNA, 22 bp, Homo sapiens
tggaggcatgacagtgtctgga

SEQ ID NO: 7609337 - DNA, 22 bp, Homo sapiens
tggaggcatttctttttggtcg

SEQ ID NO: 7609338 - DNA, 22 bp, Homo sapiens
tggaggcatttctttttggtcg

SEQ ID NO: 7609339 - DNA, 22 bp, Homo sapiens
tggaggcatttgatgttcataa

SEQ ID NO: 7609340 - DNA, 22 bp, Homo sapiens
tggaggcatttgatgttcataa

SEQ ID NO: 7609341 - DNA, 22 bp, Homo sapiens
tggaggcatttgatgttcataa

SEQ ID NO: 7609342 - DNA, 22 bp, Homo sapiens
tggaggcattttaggttgtcac

SEQ ID NO: 7609343 - DNA, 22 bp, Homo sapiens
tggaggcattttaggttgtcac

SEQ ID NO: 7609344 - DNA, 22 bp, Homo sapiens
tggaggcattttaggttgtcac

SEQ ID NO: 7609345 - DNA, 22 bp, Homo sapiens
tggaggcattttaggttgtcac

SEQ ID NO: 7609346 - DNA, 22 bp, Homo sapiens
tggaggcatttgatgttcataa

SEQ ID NO: 7609347 - DNA, 22 bp, Homo sapiens
tggaggcagtttaagtctgaga

SEQ ID NO: 7609348 - DNA, 22 bp, Homo sapiens
tggaggcagtttaagtctgaga

SEQ ID NO: 7609349 - DNA, 22 bp, Homo sapiens
tggaggcagtttaagtctgaga

SEQ ID NO: 7609350 - DNA, 22 bp, Homo sapiens
tggaggcagtttaagtctgaga

SEQ ID NO: 7609351 - DNA, 22 bp, Homo sapiens
tggaggcagtttaagtctgaga

SEQ ID NO: 7609352 - DNA, 22 bp, Homo sapiens
tggaggcagtttaagtctgaga

SEQ ID NO: 7609353 - DNA, 22 bp, Homo sapiens
tggaggcataggcctgggccct

SEQ ID NO: 7609354 - DNA, 22 bp, Homo sapiens
tggaggcataggcctgggccct

SEQ ID NO: 7609355 - DNA, 22 bp, Homo sapiens
tggaggagaactccctggctac

SEQ ID NO: 7609356 - DNA, 22 bp, Homo sapiens
tggaggagaactccctggctac

SEQ ID NO: 7609357 - DNA, 22 bp, Homo sapiens
tggaggagaactccctggctac

SEQ ID NO: 7609358 - DNA, 22 bp, Homo sapiens
tggaggcagtcacctgaagtca

SEQ ID NO: 7609359 - DNA, 22 bp, Homo sapiens
tggaggagaactccctggctac

SEQ ID NO: 7609360 - DNA, 22 bp, Homo sapiens
tggaggacgtgtccaccatgaa

SEQ ID NO: 7609361 - DNA, 22 bp, Homo sapiens
tggaggacgtgtccaccatgaa

SEQ ID NO: 7609362 - DNA, 22 bp, Homo sapiens
tggaggagaactccctggctac

SEQ ID NO: 7609363 - DNA, 22 bp, Homo sapiens
tggaggagaactccctggctac

SEQ ID NO: 7609364 - DNA, 22 bp, Homo sapiens
tggaggcatgacagtgtctgga

SEQ ID NO: 7609365 - DNA, 22 bp, Homo sapiens
tggaggcatgacagtgtctgga

SEQ ID NO: 7609366 - DNA, 16 bp, Homo sapiens
tggaggcatctggccc

SEQ ID NO: 7609367 - DNA, 22 bp, Homo sapiens
tggaggcatcagagtgcttggc

SEQ ID NO: 7609368 - DNA, 16 bp, Homo sapiens
tggaggcatctggccc

SEQ ID NO: 7609369 - DNA, 22 bp, Homo sapiens
tggaggcatcagagtgcttggc

SEQ ID NO: 7609370 - DNA, 22 bp, Homo sapiens
tggaggcatcagagtgcttggc

SEQ ID NO: 7609371 - DNA, 22 bp, Homo sapiens
tggaggcatcagagtgcttggc

SEQ ID NO: 7609372 - DNA, 22 bp, Homo sapiens
tggaggcataggcctgggccct

SEQ ID NO: 7609373 - DNA, 22 bp, Homo sapiens
tggaggcatcagagtgcttggc

SEQ ID NO: 7609374 - DNA, 22 bp, Homo sapiens
tggaggcatcagagtgcttggc

SEQ ID NO: 7609375 - DNA, 22 bp, Homo sapiens
tggaggcatcagagtgcttggc

SEQ ID NO: 7609376 - DNA, 22 bp, Homo sapiens
tggaggcatcagagtgcttggc

SEQ ID NO: 7609377 - DNA, 22 bp, Homo sapiens
tggaggcataggcctgggccct

SEQ ID NO: 7609378 - DNA, 22 bp, Homo sapiens
tggaggcataggcctgggccct

SEQ ID NO: 7609379 - DNA, 22 bp, Homo sapiens
tggaggcataggcctgggccct

SEQ ID NO: 7609380 - DNA, 22 bp, Homo sapiens
tggaggcataggcctgggccct

SEQ ID NO: 7609381 - DNA, 18 bp, Homo sapiens
tggagacatagacaatgt

SEQ ID NO: 7609382 - DNA, 18 bp, Homo sapiens
tggagacatagacaatgt

SEQ ID NO: 7609383 - DNA, 18 bp, Homo sapiens
tggagacatagacaatgt

SEQ ID NO: 7609384 - DNA, 18 bp, Homo sapiens
tggagacatagacaatgt

SEQ ID NO: 7609385 - DNA, 22 bp, Homo sapiens
tggagacatgggcgaatctaag

SEQ ID NO: 7609386 - DNA, 22 bp, Homo sapiens
tggagacatgggcgaatctaag

SEQ ID NO: 7609387 - DNA, 22 bp, Homo sapiens
tggagacagagatagccaattg

SEQ ID NO: 7609388 - DNA, 22 bp, Homo sapiens
tggagacagagatagccaattg

SEQ ID NO: 7609389 - DNA, 22 bp, Homo sapiens
tggagacacaggaccagactgc

SEQ ID NO: 7609390 - DNA, 22 bp, Homo sapiens
tggagacacaggaccagactgc

SEQ ID NO: 7609391 - DNA, 22 bp, Homo sapiens
tggagacacaggaccagactgc

SEQ ID NO: 7609392 - DNA, 22 bp, Homo sapiens
tggagacacaggaccagactgc

SEQ ID NO: 7609393 - DNA, 22 bp, Homo sapiens
tggagacagagatagccaattg

SEQ ID NO: 7609394 - DNA, 22 bp, Homo sapiens
tggagacagagatagccaattg

SEQ ID NO: 7609395 - DNA, 23 bp, Homo sapiens
tggagaatttagagtctctagga

SEQ ID NO: 7609396 - DNA, 20 bp, Homo sapiens
tggagacaattgcccttttt

SEQ ID NO: 7609397 - DNA, 20 bp, Homo sapiens
tggagacaattgcccttttt

SEQ ID NO: 7609398 - DNA, 22 bp, Homo sapiens
tggagaattctatgttgagggg

SEQ ID NO: 7609399 - DNA, 22 bp, Homo sapiens
tggagaattctatgttgagggg

SEQ ID NO: 7609400 - DNA, 22 bp, Homo sapiens
tggagaattctatgttgagggg

SEQ ID NO: 7609401 - DNA, 22 bp, Homo sapiens
tggagaattctatgttgagggg

SEQ ID NO: 7609402 - DNA, 22 bp, Homo sapiens
tggagaattctatgttgagggg

SEQ ID NO: 7609403 - DNA, 22 bp, Homo sapiens
tggagaattctatgttgagggg

SEQ ID NO: 7609404 - DNA, 22 bp, Homo sapiens
tggacatgtcttctccaagaaa

SEQ ID NO: 7609405 - DNA, 21 bp, Homo sapiens
tggacattatggagagagtag

SEQ ID NO: 7609406 - DNA, 22 bp, Homo sapiens
tggacatgtaaaggctcaaggt

SEQ ID NO: 7609407 - DNA, 22 bp, Homo sapiens
tggacatgtccggccagacaat

SEQ ID NO: 7609408 - DNA, 22 bp, Homo sapiens
tggaaagaattcctatggttca

SEQ ID NO: 7609409 - DNA, 22 bp, Homo sapiens
tggaaagaattcctatggttca

SEQ ID NO: 7609410 - DNA, 22 bp, Homo sapiens
tggaaagaaagtaaaggcgtat

SEQ ID NO: 7609411 - DNA, 22 bp, Homo sapiens
tggaaagaaagtaaaggcgtat

SEQ ID NO: 7609412 - DNA, 22 bp, Homo sapiens
tggaaagaaagtaaaggcgtat

SEQ ID NO: 7609413 - DNA, 22 bp, Homo sapiens
tggagaattctatgttgagggg

SEQ ID NO: 7609414 - DNA, 22 bp, Homo sapiens
tggagaattctatgttgagggg

SEQ ID NO: 7609415 - DNA, 22 bp, Homo sapiens
tggagaattaggccaaatctcc

SEQ ID NO: 7609416 - DNA, 22 bp, Homo sapiens
tggagaatggaatgttgtgcag

SEQ ID NO: 7609417 - DNA, 22 bp, Homo sapiens
tggagaatgatattccatcatt

SEQ ID NO: 7609418 - DNA, 21 bp, Homo sapiens
tggacattatggagagagtag

SEQ ID NO: 7609419 - DNA, 22 bp, Homo sapiens
tggagaatctggaaactgttga

SEQ ID NO: 7609420 - DNA, 22 bp, Homo sapiens
tggagacatttctcattaaaaa

SEQ ID NO: 7609421 - DNA, 22 bp, Homo sapiens
tggagacatttctcattaaaaa

SEQ ID NO: 7609422 - DNA, 22 bp, Homo sapiens
tggagactcagaaggggaagca

SEQ ID NO: 7609423 - DNA, 22 bp, Homo sapiens
tggagactctgcatctgtgaca

SEQ ID NO: 7609424 - DNA, 22 bp, Homo sapiens
tggagactcagaaggggaagca

SEQ ID NO: 7609425 - DNA, 21 bp, Homo sapiens
tggagactctggttctttgtg

SEQ ID NO: 7609426 - DNA, 22 bp, Homo sapiens
tggagactgactgcctgtattt

SEQ ID NO: 7609427 - DNA, 22 bp, Homo sapiens
tggagactgtgctaagggagtt

SEQ ID NO: 7609428 - DNA, 22 bp, Homo sapiens
tggagactgataaaggctattg

SEQ ID NO: 7609429 - DNA, 19 bp, Homo sapiens
tggagactgagagtgagca

SEQ ID NO: 7609430 - DNA, 22 bp, Homo sapiens
tggagagtttagcctactggaa

SEQ ID NO: 7609431 - DNA, 22 bp, Homo sapiens
tggagatgaacatggtgatgtt

SEQ ID NO: 7609432 - DNA, 22 bp, Homo sapiens
tggagatgaacatggtgatgtt

SEQ ID NO: 7609433 - DNA, 22 bp, Homo sapiens
tggagagaaaaaagacagttct

SEQ ID NO: 7609434 - DNA, 22 bp, Homo sapiens
tggagagaaaaaagacagttct

SEQ ID NO: 7609435 - DNA, 22 bp, Homo sapiens
tggagagaaaaaagacagttct

SEQ ID NO: 7609436 - DNA, 22 bp, Homo sapiens
tggagagaaaaaagacagttct

SEQ ID NO: 7609437 - DNA, 22 bp, Homo sapiens
tggagagtttagcctactggaa

SEQ ID NO: 7609438 - DNA, 22 bp, Homo sapiens
tggagagtttagcctactggaa

SEQ ID NO: 7609439 - DNA, 22 bp, Homo sapiens
tggagatgaacatggtgatgtt

SEQ ID NO: 7609440 - DNA, 22 bp, Homo sapiens
tggagatccttcattttggtgt

SEQ ID NO: 7609441 - DNA, 22 bp, Homo sapiens
tggagatgaacatggtgatgtt

SEQ ID NO: 7609442 - DNA, 22 bp, Homo sapiens
tggagatgaggacatggacgtc

SEQ ID NO: 7609443 - DNA, 22 bp, Homo sapiens
tggagatgaggacatggacgtc

SEQ ID NO: 7609444 - DNA, 22 bp, Homo sapiens
tggagatgaatatgtgtacctg

SEQ ID NO: 7609445 - DNA, 22 bp, Homo sapiens
tggagatgaatatgtgtacctg

SEQ ID NO: 7609446 - DNA, 22 bp, Homo sapiens
tggagatgaatatgtgtacctg

SEQ ID NO: 7609447 - DNA, 22 bp, Homo sapiens
ccctcctcaactctggcttcca

SEQ ID NO: 7609448 - DNA, 22 bp, Homo sapiens
ccctcctcaactctggcttcca

SEQ ID NO: 7609449 - DNA, 23 bp, Homo sapiens
tggaaacattctgaatgtccatc

SEQ ID NO: 7609450 - DNA, 23 bp, Homo sapiens
tggaaacattctgaatgtccatc

SEQ ID NO: 7609451 - DNA, 23 bp, Homo sapiens
tggaaacattctgaatgtccatc

SEQ ID NO: 7609452 - DNA, 22 bp, Homo sapiens
ccctcctcaactctggcttcca

SEQ ID NO: 7609453 - DNA, 22 bp, Homo sapiens
ccctcctcaactctggcttcca

SEQ ID NO: 7609454 - DNA, 22 bp, Homo sapiens
ccctcctcaactctggcttcca

SEQ ID NO: 7609455 - DNA, 22 bp, Homo sapiens
ccctcctcaactctggcttcca

SEQ ID NO: 7609456 - DNA, 22 bp, Homo sapiens
ccctccctttgtctttatgaac

SEQ ID NO: 7609457 - DNA, 22 bp, Homo sapiens
ccctccctttgtctttatgaac

SEQ ID NO: 7609458 - DNA, 22 bp, Homo sapiens
ccctccctttgtctttatgaac

SEQ ID NO: 7609459 - DNA, 22 bp, Homo sapiens
ccctccctttgcagcagtgcat

SEQ ID NO: 7609460 - DNA, 22 bp, Homo sapiens
ccctccctttgcagcagtgcat

SEQ ID NO: 7609461 - DNA, 22 bp, Homo sapiens
ccctccctttgcagcagtgcat

SEQ ID NO: 7609462 - DNA, 22 bp, Homo sapiens
ccctccctgaagaagttactct

SEQ ID NO: 7609463 - DNA, 22 bp, Homo sapiens
ccctccctgtgtgcctcatttg

SEQ ID NO: 7609464 - DNA, 22 bp, Homo sapiens
ccctccctgtgtgcctcatttg

SEQ ID NO: 7609465 - DNA, 22 bp, Homo sapiens
ccctccctgtgtgcctcatttg

SEQ ID NO: 7609466 - DNA, 22 bp, Homo sapiens
ccctccctgtgtgcctcatttg

SEQ ID NO: 7609467 - DNA, 22 bp, Homo sapiens
ccctccctgaagaagttactct

SEQ ID NO: 7609468 - DNA, 22 bp, Homo sapiens
ccctccctgaagaagttactct

SEQ ID NO: 7609469 - DNA, 22 bp, Homo sapiens
ccctccctgaagaagttactct

SEQ ID NO: 7609470 - DNA, 22 bp, Homo sapiens
ccctccctgaagaagttactct

SEQ ID NO: 7609471 - DNA, 22 bp, Homo sapiens
ccctccctgaagaagttactct

SEQ ID NO: 7609472 - DNA, 22 bp, Homo sapiens
ccctccctgaagaagttactct

SEQ ID NO: 7609473 - DNA, 22 bp, Homo sapiens
ccctcccttccaagttgaggac

SEQ ID NO: 7609474 - DNA, 22 bp, Homo sapiens
ccctcccttccaagttgaggac

SEQ ID NO: 7609475 - DNA, 22 bp, Homo sapiens
ccctccctgtgtgcctcatttg

SEQ ID NO: 7609476 - DNA, 22 bp, Homo sapiens
ccctccctgtgtgcctcatttg

SEQ ID NO: 7609477 - DNA, 22 bp, Homo sapiens
ccctccctgtgtgcctcatttg

SEQ ID NO: 7609478 - DNA, 22 bp, Homo sapiens
ccctccctttgcagcagtgcat

SEQ ID NO: 7609479 - DNA, 22 bp, Homo sapiens
ccctccctttgcagcagtgcat

SEQ ID NO: 7609480 - DNA, 22 bp, Homo sapiens
ccctccctttgcagcagtgcat

SEQ ID NO: 7609481 - DNA, 22 bp, Homo sapiens
ccctcccttccaagttgaggac

SEQ ID NO: 7609482 - DNA, 23 bp, Homo sapiens
tggaaacattctgaatgtccatc

SEQ ID NO: 7609483 - DNA, 22 bp, Homo sapiens
tggaaactaacaacagagcaga

SEQ ID NO: 7609484 - DNA, 22 bp, Homo sapiens
tggaaactaacaacagagcaga

SEQ ID NO: 7609485 - DNA, 22 bp, Homo sapiens
tggaaactaagactagagagac

SEQ ID NO: 7609486 - DNA, 22 bp, Homo sapiens
tggaaactagagtgtgggaagc

SEQ ID NO: 7609487 - DNA, 22 bp, Homo sapiens
tggaaactagccttttaggttg

SEQ ID NO: 7609488 - DNA, 22 bp, Homo sapiens
tggaaactagagagtttgtatt

SEQ ID NO: 7609489 - DNA, 22 bp, Homo sapiens
tggaaactataaaagcaccttc

SEQ ID NO: 7609490 - DNA, 22 bp, Homo sapiens
tggaaactaggatggaagaaat

SEQ ID NO: 7609491 - DNA, 22 bp, Homo sapiens
tggaaactaggatggaagaaat

SEQ ID NO: 7609492 - DNA, 22 bp, Homo sapiens
tggaaactaggatggaagaaat

SEQ ID NO: 7609493 - DNA, 22 bp, Homo sapiens
tggaaactatagtcacaataga

SEQ ID NO: 7609494 - DNA, 22 bp, Homo sapiens
tggaaactatcctcacaactag

SEQ ID NO: 7609495 - DNA, 22 bp, Homo sapiens
tggaaactatcctcacaactag

SEQ ID NO: 7609496 - DNA, 22 bp, Homo sapiens
tggaaactcagggccagaagga

SEQ ID NO: 7609497 - DNA, 19 bp, Homo sapiens
tggaaactcctgatattag

SEQ ID NO: 7609498 - DNA, 22 bp, Homo sapiens
tggaaactctacctctctaaga

SEQ ID NO: 7609499 - DNA, 22 bp, Homo sapiens
tggaaactctacctctctaaga

SEQ ID NO: 7609500 - DNA, 22 bp, Homo sapiens
tggaaactgtggtatttcttta

SEQ ID NO: 7609501 - DNA, 22 bp, Homo sapiens
tggaaactgcagttcccgggga

SEQ ID NO: 7609502 - DNA, 22 bp, Homo sapiens
tggaaactgggagttaaatgta

SEQ ID NO: 7609503 - DNA, 22 bp, Homo sapiens
tggaaactgggagttaaatgta

SEQ ID NO: 7609504 - DNA, 22 bp, Homo sapiens
tggaaagaaaaacaggccatga

SEQ ID NO: 7609505 - DNA, 22 bp, Homo sapiens
tggaaagaaaaacaggccatga

SEQ ID NO: 7609506 - DNA, 22 bp, Homo sapiens
tggaaagaaaaacaggccatga

SEQ ID NO: 7609507 - DNA, 21 bp, Homo sapiens
tggaaacttctagcttacgta

SEQ ID NO: 7609508 - DNA, 22 bp, Homo sapiens
tggaaacttggaacgtcttcag

SEQ ID NO: 7609509 - DNA, 22 bp, Homo sapiens
tggaaagaaaaacaggccatga

SEQ ID NO: 7609510 - DNA, 23 bp, Homo sapiens
tggaaacttaagggggagatgtc

SEQ ID NO: 7609511 - DNA, 23 bp, Homo sapiens
tggaaacttaagggggagatgtc

SEQ ID NO: 7609512 - DNA, 22 bp, Homo sapiens
tggaaacttaccgtttggggaa

SEQ ID NO: 7609513 - DNA, 22 bp, Homo sapiens
tggaaacttatctgacacgaac

SEQ ID NO: 7609514 - DNA, 22 bp, Homo sapiens
tgcttgcttctcacatgcacct

SEQ ID NO: 7609515 - DNA, 22 bp, Homo sapiens
tgcttgctgtaaagcttggtca

SEQ ID NO: 7609516 - DNA, 22 bp, Homo sapiens
tgcttgctgggccaatggcaat

SEQ ID NO: 7609517 - DNA, 22 bp, Homo sapiens
tgcttgctgggccaatggcaat

SEQ ID NO: 7609518 - DNA, 22 bp, Homo sapiens
tgcttccttgatcattcccaaa

SEQ ID NO: 7609519 - DNA, 22 bp, Homo sapiens
tgcttgctggaggcagacagaa

SEQ ID NO: 7609520 - DNA, 22 bp, Homo sapiens
tgcttggcctacttgtcctttg

SEQ ID NO: 7609521 - DNA, 22 bp, Homo sapiens
tgcttggagaatcagtcccagc

SEQ ID NO: 7609522 - DNA, 22 bp, Homo sapiens
tgcttggctagcttggcagctc

SEQ ID NO: 7609523 - DNA, 22 bp, Homo sapiens
tgcttggctagcttggcagctc

SEQ ID NO: 7609524 - DNA, 22 bp, Homo sapiens
tgcttggctagcttggcagctc

SEQ ID NO: 7609525 - DNA, 22 bp, Homo sapiens
tgcttgtattcatatcacagct

SEQ ID NO: 7609526 - DNA, 22 bp, Homo sapiens
tgcttgtattcatatcacagct

SEQ ID NO: 7609527 - DNA, 22 bp, Homo sapiens
tgcttgtcacatacaggagcat

SEQ ID NO: 7609528 - DNA, 22 bp, Homo sapiens
tgcttgtcaccctgcctgagtg

SEQ ID NO: 7609529 - DNA, 22 bp, Homo sapiens
tgcttgtcacatacaggagcat

SEQ ID NO: 7609530 - DNA, 22 bp, Homo sapiens
tgcttgtcaccctgcctgagtg

SEQ ID NO: 7609531 - DNA, 21 bp, Homo sapiens
tgcttgggggcttcaggagct

SEQ ID NO: 7609532 - DNA, 21 bp, Homo sapiens
tgcttgggggcttcaggagct

SEQ ID NO: 7609533 - DNA, 21 bp, Homo sapiens
tgcttgggggcttcaggagct

SEQ ID NO: 7609534 - DNA, 22 bp, Homo sapiens
tgcttgtagcaatacacaagtt

SEQ ID NO: 7609535 - DNA, 22 bp, Homo sapiens
tgcttgtagcaatacacaagtt

SEQ ID NO: 7609536 - DNA, 20 bp, Homo sapiens
tgcttgtaatacctgcttca

SEQ ID NO: 7609537 - DNA, 22 bp, Homo sapiens
tgcttgggaatgtggagtcaga

SEQ ID NO: 7609538 - DNA, 22 bp, Homo sapiens
tgcttgggcggccagcatggcg

SEQ ID NO: 7609539 - DNA, 22 bp, Homo sapiens
tgcttgggcggccagcatggcg

SEQ ID NO: 7609540 - DNA, 22 bp, Homo sapiens
tgcttgggcggccagcatggcg

SEQ ID NO: 7609541 - DNA, 22 bp, Homo sapiens
tgcttgggcggccagcatggcg

SEQ ID NO: 7609542 - DNA, 22 bp, Homo sapiens
tgcttgggaatgtggagtcaga

SEQ ID NO: 7609543 - DNA, 22 bp, Homo sapiens
tgcttgggcggccagcatggcg

SEQ ID NO: 7609544 - DNA, 22 bp, Homo sapiens
tgcttgggaatgtggagtcaga

SEQ ID NO: 7609545 - DNA, 22 bp, Homo sapiens
ccctccctctgctgggtgtaga

SEQ ID NO: 7609546 - DNA, 22 bp, Homo sapiens
ccctccctctgctgggtgtaga

SEQ ID NO: 7609547 - DNA, 22 bp, Homo sapiens
ccctccctatgtagatgatgtt

SEQ ID NO: 7609548 - DNA, 22 bp, Homo sapiens
ccctccctatgtagatgatgtt

SEQ ID NO: 7609549 - DNA, 22 bp, Homo sapiens
ccctccctctgctgggtgtaga

SEQ ID NO: 7609550 - DNA, 22 bp, Homo sapiens
ccctccctctgctgggtgtaga

SEQ ID NO: 7609551 - DNA, 22 bp, Homo sapiens
ccctccctatgtagatgatgtt

SEQ ID NO: 7609552 - DNA, 22 bp, Homo sapiens
ccctccctatgtagatgatgtt

SEQ ID NO: 7609553 - DNA, 22 bp, Homo sapiens
ccctccctatgtagatgatgtt

SEQ ID NO: 7609554 - DNA, 22 bp, Homo sapiens
ccctcccggcgtgctgggctcg

SEQ ID NO: 7609555 - DNA, 22 bp, Homo sapiens
ccctcccggcgtgctgggctcg

SEQ ID NO: 7609556 - DNA, 22 bp, Homo sapiens
ccctccccacaaagcttcacac

SEQ ID NO: 7609557 - DNA, 22 bp, Homo sapiens
ccctccccacaaagcttcacac

SEQ ID NO: 7609558 - DNA, 22 bp, Homo sapiens
ccctccccacaaagcttcacac

SEQ ID NO: 7609559 - DNA, 22 bp, Homo sapiens
ccctccccagggtcatattgaa

SEQ ID NO: 7609560 - DNA, 22 bp, Homo sapiens
ccctccccagggtcatattgaa

SEQ ID NO: 7609561 - DNA, 22 bp, Homo sapiens
ccctccccagggtcatattgaa

SEQ ID NO: 7609562 - DNA, 22 bp, Homo sapiens
ccctccccacaaagcttcacac

SEQ ID NO: 7609563 - DNA, 22 bp, Homo sapiens
ccctccccagggtcatattgaa

SEQ ID NO: 7609564 - DNA, 22 bp, Homo sapiens
ccctccccagggtcatattgaa

SEQ ID NO: 7609565 - DNA, 22 bp, Homo sapiens
ccctccccagggtcatattgaa

SEQ ID NO: 7609566 - DNA, 22 bp, Homo sapiens
ccctccccagggtcatattgaa

SEQ ID NO: 7609567 - DNA, 22 bp, Homo sapiens
ccctccatgacgtcttcagccg

SEQ ID NO: 7609568 - DNA, 22 bp, Homo sapiens
ccctccccacaaagcttcacac

SEQ ID NO: 7609569 - DNA, 22 bp, Homo sapiens
ccctccatgacgtcttcagccg

SEQ ID NO: 7609570 - DNA, 22 bp, Homo sapiens
ccctccccacaaagcttcacac

SEQ ID NO: 7609571 - DNA, 22 bp, Homo sapiens
ccctccccacaaagcttcacac

SEQ ID NO: 7609572 - DNA, 22 bp, Homo sapiens
ccctccagtgtcccagtgggga

SEQ ID NO: 7609573 - DNA, 22 bp, Homo sapiens
ccctccagtgtcccagtgggga

SEQ ID NO: 7609574 - DNA, 22 bp, Homo sapiens
ccctccagtgtcccagtgggga

SEQ ID NO: 7609575 - DNA, 22 bp, Homo sapiens
tgcttgtcaggataagctctgg

SEQ ID NO: 7609576 - DNA, 22 bp, Homo sapiens
tgcttgtcaggataagctctgg

SEQ ID NO: 7609577 - DNA, 22 bp, Homo sapiens
tgcttgtcagtgtgctagaaac

SEQ ID NO: 7609578 - DNA, 21 bp, Homo sapiens
tgcttgtcatgaatgggccag

SEQ ID NO: 7609579 - DNA, 21 bp, Homo sapiens
tgcttgtcatgaatgggccag

SEQ ID NO: 7609580 - DNA, 23 bp, Homo sapiens
tgcttgtcatgacatcaccaagc

SEQ ID NO: 7609581 - DNA, 20 bp, Homo sapiens
tgcttgtcatgcactcaggc

SEQ ID NO: 7609582 - DNA, 22 bp, Homo sapiens
tgcttgtccgaggtgagtactt

SEQ ID NO: 7609583 - DNA, 22 bp, Homo sapiens
ccctccagtgtcccagtgggga

SEQ ID NO: 7609584 - DNA, 22 bp, Homo sapiens
tgcttgtccctctttatgatgg

SEQ ID NO: 7609585 - DNA, 20 bp, Homo sapiens
tgcttgtcatgcactcaggc

SEQ ID NO: 7609586 - DNA, 22 bp, Homo sapiens
tgcttccttgagctctccaatc

SEQ ID NO: 7609587 - DNA, 22 bp, Homo sapiens
tgcttccttgatcattcccaaa

SEQ ID NO: 7609588 - DNA, 22 bp, Homo sapiens
tgcttccttgagctctccaatc

SEQ ID NO: 7609589 - DNA, 22 bp, Homo sapiens
tgcttccttcccgttcttctcc

SEQ ID NO: 7609590 - DNA, 20 bp, Homo sapiens
tgcttcctggccactgcggg

SEQ ID NO: 7609591 - DNA, 22 bp, Homo sapiens
tgcttccttcccgttcttctcc

SEQ ID NO: 7609592 - DNA, 20 bp, Homo sapiens
tgcttcctggccactgcggg

SEQ ID NO: 7609593 - DNA, 22 bp, Homo sapiens
tgcttcctgctaaggctgcctg

SEQ ID NO: 7609594 - DNA, 22 bp, Homo sapiens
tgcttcctgctaaggctgcctg

SEQ ID NO: 7609595 - DNA, 22 bp, Homo sapiens
tgcttcctgaggccgtcttctc

SEQ ID NO: 7609596 - DNA, 22 bp, Homo sapiens
tgcttcctgaggccgtcttctc

SEQ ID NO: 7609597 - DNA, 19 bp, Homo sapiens
tgcttcctcaccatctccc

SEQ ID NO: 7609598 - DNA, 19 bp, Homo sapiens
tgcttcctcaccatctccc

SEQ ID NO: 7609599 - DNA, 19 bp, Homo sapiens
tgcttcctcaccatctccc

SEQ ID NO: 7609600 - DNA, 21 bp, Homo sapiens
tgcttccctgggccacactga

SEQ ID NO: 7609601 - DNA, 21 bp, Homo sapiens
tgcttccctgggccacactga

SEQ ID NO: 7609602 - DNA, 21 bp, Homo sapiens
tgcttccctgggccacactga

SEQ ID NO: 7609603 - DNA, 22 bp, Homo sapiens
tgcttccgctaaaaattaatcc

SEQ ID NO: 7609604 - DNA, 22 bp, Homo sapiens
tgcttcctatccacacaatgcc

SEQ ID NO: 7609605 - DNA, 21 bp, Homo sapiens
tgcttccctgggccacactga

SEQ ID NO: 7609606 - DNA, 22 bp, Homo sapiens
tgctgtttcattttcctcatcc

SEQ ID NO: 7609607 - DNA, 22 bp, Homo sapiens
tgctgttgacggactggctgct

SEQ ID NO: 7609608 - DNA, 22 bp, Homo sapiens
tgctgttgacggactggctgct

SEQ ID NO: 7609609 - DNA, 22 bp, Homo sapiens
tgctgtttcacctcccagcgat

SEQ ID NO: 7609610 - DNA, 22 bp, Homo sapiens
ccccaggagcttgttttagaga

SEQ ID NO: 7609611 - DNA, 22 bp, Homo sapiens
ccccaggcagggcctaacagag

SEQ ID NO: 7609612 - DNA, 22 bp, Homo sapiens
ccccaggcagggcctaacagag

SEQ ID NO: 7609613 - DNA, 22 bp, Homo sapiens
ccccaggagcttgttttagaga

SEQ ID NO: 7609614 - DNA, 22 bp, Homo sapiens
ccccaggagcttgttttagaga

SEQ ID NO: 7609615 - DNA, 21 bp, Homo sapiens
tgcttccctgggccacactga

SEQ ID NO: 7609616 - DNA, 22 bp, Homo sapiens
tgcttccctgctctgcacacct

SEQ ID NO: 7609617 - DNA, 22 bp, Homo sapiens
tgcttaaaaacagtatggtagt

SEQ ID NO: 7609618 - DNA, 22 bp, Homo sapiens
tgcttccctgctctgcacacct

SEQ ID NO: 7609619 - DNA, 22 bp, Homo sapiens
tgctgtttgagcttattttcag

SEQ ID NO: 7609620 - DNA, 22 bp, Homo sapiens
tgctgtttgagcttattttcag

SEQ ID NO: 7609621 - DNA, 22 bp, Homo sapiens
tgctgtttcattttcctcatcc

SEQ ID NO: 7609622 - DNA, 22 bp, Homo sapiens
tgctgtttgagcttattttcag

SEQ ID NO: 7609623 - DNA, 22 bp, Homo sapiens
ccccaggagaaatcttaaacta

SEQ ID NO: 7609624 - DNA, 22 bp, Homo sapiens
ccccaggagaaatcttaaacta

SEQ ID NO: 7609625 - DNA, 22 bp, Homo sapiens
ccccaggagatttgggagcaca

SEQ ID NO: 7609626 - DNA, 22 bp, Homo sapiens
ccccaggagatttgggagcaca

SEQ ID NO: 7609627 - DNA, 22 bp, Homo sapiens
ccccaggagatttgggagcaca

SEQ ID NO: 7609628 - DNA, 22 bp, Homo sapiens
ccccaggagaaatcttaaacta

SEQ ID NO: 7609629 - DNA, 22 bp, Homo sapiens
ccccaggagaaatcttaaacta

SEQ ID NO: 7609630 - DNA, 22 bp, Homo sapiens
ccccaggagaaatcttaaacta

SEQ ID NO: 7609631 - DNA, 22 bp, Homo sapiens
ccccaggagatttgggagcaca

SEQ ID NO: 7609632 - DNA, 22 bp, Homo sapiens
ccccaggagatttgggagcaca

SEQ ID NO: 7609633 - DNA, 22 bp, Homo sapiens
ccccaggagatttgggagcaca

SEQ ID NO: 7609634 - DNA, 22 bp, Homo sapiens
ccccaggagatttgggagcaca

SEQ ID NO: 7609635 - DNA, 22 bp, Homo sapiens
ccccaggagatttgggagcaca

SEQ ID NO: 7609636 - DNA, 22 bp, Homo sapiens
ccccaggacgtggccctcatag

SEQ ID NO: 7609637 - DNA, 22 bp, Homo sapiens
ccccaggacgtggccctcatag

SEQ ID NO: 7609638 - DNA, 16 bp, Homo sapiens
ccccaggacttggcac

SEQ ID NO: 7609639 - DNA, 22 bp, Homo sapiens
ccccaggacgtggccctcatag

SEQ ID NO: 7609640 - DNA, 16 bp, Homo sapiens
ccccaggacttggcac

SEQ ID NO: 7609641 - DNA, 16 bp, Homo sapiens
ccccaggacttggcac

SEQ ID NO: 7609642 - DNA, 22 bp, Homo sapiens
ccccaggaagcctcagatttgc

SEQ ID NO: 7609643 - DNA, 22 bp, Homo sapiens
ccccaggacacatggaccaagt

SEQ ID NO: 7609644 - DNA, 22 bp, Homo sapiens
ccccaggacgtggccctcatag

SEQ ID NO: 7609645 - DNA, 22 bp, Homo sapiens
ccccaggacacatggaccaagt

SEQ ID NO: 7609646 - DNA, 22 bp, Homo sapiens
ccccaggacacatggaccaagt

SEQ ID NO: 7609647 - DNA, 22 bp, Homo sapiens
tgctgcctttgggacctggcct

SEQ ID NO: 7609648 - DNA, 22 bp, Homo sapiens
tgctgcctttgggacctggcct

SEQ ID NO: 7609649 - DNA, 22 bp, Homo sapiens
tgctgcctttgtggggtcactg

SEQ ID NO: 7609650 - DNA, 22 bp, Homo sapiens
tgctgcctttgtggggtcactg

SEQ ID NO: 7609651 - DNA, 22 bp, Homo sapiens
tgctgcctttgtggggtcactg

SEQ ID NO: 7609652 - DNA, 22 bp, Homo sapiens
tgctgcctttgggacctggcct

SEQ ID NO: 7609653 - DNA, 22 bp, Homo sapiens
tgctgcgaggggaaataattta

SEQ ID NO: 7609654 - DNA, 22 bp, Homo sapiens
tgctgcgggacccactgtgggc

SEQ ID NO: 7609655 - DNA, 17 bp, Homo sapiens
tgctgctaattaaaata

SEQ ID NO: 7609656 - DNA, 19 bp, Homo sapiens
tgctgctacttctctctgt

SEQ ID NO: 7609657 - DNA, 19 bp, Homo sapiens
tgctgctacttctctctgt

SEQ ID NO: 7609658 - DNA, 22 bp, Homo sapiens
tgctgctcaagctgcagcaaaa

SEQ ID NO: 7609659 - DNA, 22 bp, Homo sapiens
tgctgctcaagctgcagcaaaa

SEQ ID NO: 7609660 - DNA, 22 bp, Homo sapiens
tgctgctcaagctgcagcaaaa

SEQ ID NO: 7609661 - DNA, 22 bp, Homo sapiens
tgctgctcaagctgcagcaaaa

SEQ ID NO: 7609662 - DNA, 22 bp, Homo sapiens
tgctgctcagaacccctgggct

SEQ ID NO: 7609663 - DNA, 22 bp, Homo sapiens
tgctgctcaatgagatgccatc

SEQ ID NO: 7609664 - DNA, 22 bp, Homo sapiens
tgctgctcacacacagtgaatg

SEQ ID NO: 7609665 - DNA, 22 bp, Homo sapiens
tgctgctcacacacagtgaatg

SEQ ID NO: 7609666 - DNA, 22 bp, Homo sapiens
tgctgctcacacacagtgaatg

SEQ ID NO: 7609667 - DNA, 22 bp, Homo sapiens
tgctgctcaatgagatgccatc

SEQ ID NO: 7609668 - DNA, 22 bp, Homo sapiens
tgctgctcaatgagatgccatc

SEQ ID NO: 7609669 - DNA, 22 bp, Homo sapiens
tgctgctccatctgaccattcc

SEQ ID NO: 7609670 - DNA, 22 bp, Homo sapiens
cccagtggcttttgcccaggtt

SEQ ID NO: 7609671 - DNA, 22 bp, Homo sapiens
cccagtggcttttgcccaggtt

SEQ ID NO: 7609672 - DNA, 22 bp, Homo sapiens
tgctgctccccagcacacagca

SEQ ID NO: 7609673 - DNA, 22 bp, Homo sapiens
tgctgctccccagcacacagca

SEQ ID NO: 7609674 - DNA, 22 bp, Homo sapiens
tgctgctcagaacccctgggct

SEQ ID NO: 7609675 - DNA, 22 bp, Homo sapiens
tgctgctccatctgaccattcc

SEQ ID NO: 7609676 - DNA, 22 bp, Homo sapiens
cccagtggtttgcagaaccaag

SEQ ID NO: 7609677 - DNA, 22 bp, Homo sapiens
cccagtggtgctggcatctgtg

SEQ ID NO: 7609678 - DNA, 22 bp, Homo sapiens
cccagtggtgctggcatctgtg

SEQ ID NO: 7609679 - DNA, 22 bp, Homo sapiens
cccagtggtgctggcatctgtg

SEQ ID NO: 7609680 - DNA, 22 bp, Homo sapiens
cccagtggtgctggcatctgtg

SEQ ID NO: 7609681 - DNA, 22 bp, Homo sapiens
cccagtggtgctggcatctgtg

SEQ ID NO: 7609682 - DNA, 22 bp, Homo sapiens
cccagtggtgctggcatctgtg

SEQ ID NO: 7609683 - DNA, 22 bp, Homo sapiens
cccagtgggtcactgcatctca

SEQ ID NO: 7609684 - DNA, 22 bp, Homo sapiens
cccagtggtgctggcatctgtg

SEQ ID NO: 7609685 - DNA, 22 bp, Homo sapiens
cccagtgggtcactgcatctca

SEQ ID NO: 7609686 - DNA, 22 bp, Homo sapiens
cccagtggggagcttctgcctt

SEQ ID NO: 7609687 - DNA, 22 bp, Homo sapiens
cccagtggggagcttctgcctt

SEQ ID NO: 7609688 - DNA, 22 bp, Homo sapiens
cccagtgggtcactgcatctca

SEQ ID NO: 7609689 - DNA, 22 bp, Homo sapiens
cccagttgttgccggctctgga

SEQ ID NO: 7609690 - DNA, 22 bp, Homo sapiens
cccagttgttgccggctctgga

SEQ ID NO: 7609691 - DNA, 22 bp, Homo sapiens
cccagttgttgccggctctgga

SEQ ID NO: 7609692 - DNA, 22 bp, Homo sapiens
cccagttgttgccggctctgga

SEQ ID NO: 7609693 - DNA, 22 bp, Homo sapiens
cccagttgttgccggctctgga

SEQ ID NO: 7609694 - DNA, 22 bp, Homo sapiens
cccagttgttgccggctctgga

SEQ ID NO: 7609695 - DNA, 22 bp, Homo sapiens
cccagttgttgccggctctgga

SEQ ID NO: 7609696 - DNA, 22 bp, Homo sapiens
cccagttagttgcttccacatc

SEQ ID NO: 7609697 - DNA, 22 bp, Homo sapiens
cccagtgtttaggtcccatctc

SEQ ID NO: 7609698 - DNA, 22 bp, Homo sapiens
cccagtgtttaggtcccatctc

SEQ ID NO: 7609699 - DNA, 22 bp, Homo sapiens
cccagtgttacgtgacagcctg

SEQ ID NO: 7609700 - DNA, 22 bp, Homo sapiens
cccagtgttacgtgacagcctg

SEQ ID NO: 7609701 - DNA, 22 bp, Homo sapiens
cccagtgttacgtgacagcctg

SEQ ID NO: 7609702 - DNA, 22 bp, Homo sapiens
cccagtgtggttgtgaattctg

SEQ ID NO: 7609703 - DNA, 22 bp, Homo sapiens
cccagtgtggttgtgaattctg

SEQ ID NO: 7609704 - DNA, 22 bp, Homo sapiens
cccagtgttccttgaggggctg

SEQ ID NO: 7609705 - DNA, 22 bp, Homo sapiens
cccagtgttccttgaggggctg

SEQ ID NO: 7609706 - DNA, 22 bp, Homo sapiens
cccagtgttccttgaggggctg

SEQ ID NO: 7609707 - DNA, 22 bp, Homo sapiens
tgctgggcactgtctaggtact

SEQ ID NO: 7609708 - DNA, 22 bp, Homo sapiens
tgctgggcactgtctaggtact

SEQ ID NO: 7609709 - DNA, 22 bp, Homo sapiens
tgctgggcaccagtgcctgcag

SEQ ID NO: 7609710 - DNA, 22 bp, Homo sapiens
tgctgggcaccagtgcctgcag

SEQ ID NO: 7609711 - DNA, 22 bp, Homo sapiens
tgctggggctctgaccactcca

SEQ ID NO: 7609712 - DNA, 22 bp, Homo sapiens
tgctggggctctgaccactcca

SEQ ID NO: 7609713 - DNA, 22 bp, Homo sapiens
tgctgggcactgtctaggtact

SEQ ID NO: 7609714 - DNA, 22 bp, Homo sapiens
tgctgggcaccagtgcctgcag

SEQ ID NO: 7609715 - DNA, 22 bp, Homo sapiens
tgctgggcaccagtgcctgcag

SEQ ID NO: 7609716 - DNA, 22 bp, Homo sapiens
tgctgggcaccagtgcctgcag

SEQ ID NO: 7609717 - DNA, 22 bp, Homo sapiens
cccagtgtgatgaggttgctaa

SEQ ID NO: 7609718 - DNA, 22 bp, Homo sapiens
tgctgggcaccagtgcctgcag

SEQ ID NO: 7609719 - DNA, 22 bp, Homo sapiens
tgctgggcaccagtgcctgcag

SEQ ID NO: 7609720 - DNA, 22 bp, Homo sapiens
cccagtgtggttctttggagaa

SEQ ID NO: 7609721 - DNA, 22 bp, Homo sapiens
cccagtgtggttctttggagaa

SEQ ID NO: 7609722 - DNA, 22 bp, Homo sapiens
cccagtgtggttctttggagaa

SEQ ID NO: 7609723 - DNA, 22 bp, Homo sapiens
cccagtgtgatgaggttgctaa

SEQ ID NO: 7609724 - DNA, 22 bp, Homo sapiens
cccagtgtgcccctcctgcagc

SEQ ID NO: 7609725 - DNA, 22 bp, Homo sapiens
cccagtgtgcccctcctgcagc

SEQ ID NO: 7609726 - DNA, 22 bp, Homo sapiens
cccagtgtctgggcctgcaggg

SEQ ID NO: 7609727 - DNA, 22 bp, Homo sapiens
cccagtgtctgggcctgcaggg

SEQ ID NO: 7609728 - DNA, 22 bp, Homo sapiens
cccagtgtctgggcctgcaggg

SEQ ID NO: 7609729 - DNA, 22 bp, Homo sapiens
cccagtgtctgggcctgcaggg

SEQ ID NO: 7609730 - DNA, 22 bp, Homo sapiens
cccagtgtcaccaacaggacac

SEQ ID NO: 7609731 - DNA, 22 bp, Homo sapiens
cccagtgtcaccaacaggacac

SEQ ID NO: 7609732 - DNA, 20 bp, Homo sapiens
cccagtgtccagccttgcca

SEQ ID NO: 7609733 - DNA, 20 bp, Homo sapiens
cccagtgtccagccttgcca

SEQ ID NO: 7609734 - DNA, 22 bp, Homo sapiens
cccagtgtcattctaagggagg

SEQ ID NO: 7609735 - DNA, 22 bp, Homo sapiens
cccagtgtcattctaagggagg

SEQ ID NO: 7609736 - DNA, 22 bp, Homo sapiens
cccagtgtctccaacatcagat

SEQ ID NO: 7609737 - DNA, 22 bp, Homo sapiens
cccagtgtctccaacatcagat

SEQ ID NO: 7609738 - DNA, 22 bp, Homo sapiens
cccagtgtctccaacatcagat

SEQ ID NO: 7609739 - DNA, 22 bp, Homo sapiens
cccagtgtctcttgtgcctttc

SEQ ID NO: 7609740 - DNA, 22 bp, Homo sapiens
cccagtgtctcttgtgcctttc

SEQ ID NO: 7609741 - DNA, 22 bp, Homo sapiens
cccagtgtctcttgtgcctttc

SEQ ID NO: 7609742 - DNA, 22 bp, Homo sapiens
tgctgggggttcagatgagtaa

SEQ ID NO: 7609743 - DNA, 18 bp, Homo sapiens
tgctggggtagaatccac

SEQ ID NO: 7609744 - DNA, 18 bp, Homo sapiens
tgctggggtagaatccac

SEQ ID NO: 7609745 - DNA, 18 bp, Homo sapiens
tgctggggtagaatccac

SEQ ID NO: 7609746 - DNA, 18 bp, Homo sapiens
tgctggggtagaatccac

SEQ ID NO: 7609747 - DNA, 22 bp, Homo sapiens
tgctgggggttcagatgagtaa

SEQ ID NO: 7609748 - DNA, 22 bp, Homo sapiens
tgctgggggttcagatgagtaa

SEQ ID NO: 7609749 - DNA, 22 bp, Homo sapiens
tgctgggggttcagatgagtaa

SEQ ID NO: 7609750 - DNA, 23 bp, Homo sapiens
tgctggggtagtttgtggcacag

SEQ ID NO: 7609751 - DNA, 18 bp, Homo sapiens
tgctggggtagaatccac

SEQ ID NO: 7609752 - DNA, 18 bp, Homo sapiens
tgctggggtagaatccac

SEQ ID NO: 7609753 - DNA, 18 bp, Homo sapiens
tgctggggtagaatccac

SEQ ID NO: 7609754 - DNA, 23 bp, Homo sapiens
tgctggggtagtttgtggcacag

SEQ ID NO: 7609755 - DNA, 23 bp, Homo sapiens
tgctggggtagtttgtggcacag

SEQ ID NO: 7609756 - DNA, 23 bp, Homo sapiens
tgctggggtagtttgtggcacag

SEQ ID NO: 7609757 - DNA, 23 bp, Homo sapiens
tgctggggtagtttgtggcacag

SEQ ID NO: 7609758 - DNA, 22 bp, Homo sapiens
ccccagctgcatacttgccaag

SEQ ID NO: 7609759 - DNA, 22 bp, Homo sapiens
ccccagctgcatacttgccaag

SEQ ID NO: 7609760 - DNA, 22 bp, Homo sapiens
ccccagctgcatacttgccaag

SEQ ID NO: 7609761 - DNA, 22 bp, Homo sapiens
ccccagctgcatacttgccaag

SEQ ID NO: 7609762 - DNA, 22 bp, Homo sapiens
ccccagctcagtgcagggacat

SEQ ID NO: 7609763 - DNA, 22 bp, Homo sapiens
ccccagctgagatttgaggaga

SEQ ID NO: 7609764 - DNA, 22 bp, Homo sapiens
ccccagctgagatttgaggaga

SEQ ID NO: 7609765 - DNA, 22 bp, Homo sapiens
ccccagctcagtgcagggacat

SEQ ID NO: 7609766 - DNA, 22 bp, Homo sapiens
ccccagctgcatacttgccaag

SEQ ID NO: 7609767 - DNA, 22 bp, Homo sapiens
ccccagctgcatacttgccaag

SEQ ID NO: 7609768 - DNA, 22 bp, Homo sapiens
ccccaggaagcctcagatttgc

SEQ ID NO: 7609769 - DNA, 22 bp, Homo sapiens
ccccaggacacatggaccaagt

SEQ ID NO: 7609770 - DNA, 22 bp, Homo sapiens
ccccagctgcatacttgccaag

SEQ ID NO: 7609771 - DNA, 22 bp, Homo sapiens
ccccaggaagcctcagatttgc

SEQ ID NO: 7609772 - DNA, 22 bp, Homo sapiens
tgctgggggtagctctgcgtag

SEQ ID NO: 7609773 - DNA, 22 bp, Homo sapiens
tgctgggggctttctggatacc

SEQ ID NO: 7609774 - DNA, 22 bp, Homo sapiens
tgctgggggtagctctgcgtag

SEQ ID NO: 7609775 - DNA, 22 bp, Homo sapiens
tgctgggggtagctctgcgtag

SEQ ID NO: 7609776 - DNA, 22 bp, Homo sapiens
tgctgggggctttctggatacc

SEQ ID NO: 7609777 - DNA, 22 bp, Homo sapiens
tgctgggggctttctggatacc

SEQ ID NO: 7609778 - DNA, 22 bp, Homo sapiens
tgctgggggctttctggatacc

SEQ ID NO: 7609779 - DNA, 22 bp, Homo sapiens
tgctggggctctgaccactcca

SEQ ID NO: 7609780 - DNA, 22 bp, Homo sapiens
tgctgggggctttctggatacc

SEQ ID NO: 7609781 - DNA, 22 bp, Homo sapiens
tgctgggggctttctggatacc

SEQ ID NO: 7609782 - DNA, 22 bp, Homo sapiens
tgctgggggctttctggatacc

SEQ ID NO: 7609783 - DNA, 22 bp, Homo sapiens
tgctgggggctttctggatacc

SEQ ID NO: 7609784 - DNA, 22 bp, Homo sapiens
tgctgggggctttctggatacc

SEQ ID NO: 7609785 - DNA, 22 bp, Homo sapiens
tgctgggggtagctctgcgtag

SEQ ID NO: 7609786 - DNA, 22 bp, Homo sapiens
tgctgggggtgtctcaccaggc

SEQ ID NO: 7609787 - DNA, 22 bp, Homo sapiens
tgctgggggtagctctgcgtag

SEQ ID NO: 7609788 - DNA, 22 bp, Homo sapiens
tgctgggggtagctctgcgtag

SEQ ID NO: 7609789 - DNA, 22 bp, Homo sapiens
tgctgggggtgtctcaccaggc

SEQ ID NO: 7609790 - DNA, 22 bp, Homo sapiens
tgctgggggtgtctcaccaggc

SEQ ID NO: 7609791 - DNA, 22 bp, Homo sapiens
tgctgggggtgtctcaccaggc

SEQ ID NO: 7609792 - DNA, 22 bp, Homo sapiens
tgctgggggttcagatgagtaa

SEQ ID NO: 7609793 - DNA, 22 bp, Homo sapiens
tgctgggggttcagatgagtaa

SEQ ID NO: 7609794 - DNA, 22 bp, Homo sapiens
tgctgggggttcagatgagtaa

SEQ ID NO: 7609795 - DNA, 22 bp, Homo sapiens
tgctgggggttcagatgagtaa

SEQ ID NO: 7609796 - DNA, 22 bp, Homo sapiens
tgctgggggttcagatgagtaa

SEQ ID NO: 7609797 - DNA, 22 bp, Homo sapiens
tgctgggggtgtctcaccaggc

SEQ ID NO: 7609798 - DNA, 22 bp, Homo sapiens
tgctgggggtgtctcaccaggc

SEQ ID NO: 7609799 - DNA, 22 bp, Homo sapiens
tgctgggggtgtctcaccaggc

SEQ ID NO: 7609800 - DNA, 22 bp, Homo sapiens
tgctcagggagcttcctggtgg

SEQ ID NO: 7609801 - DNA, 22 bp, Homo sapiens
tgctcagggagcttcctggtgg

SEQ ID NO: 7609802 - DNA, 22 bp, Homo sapiens
tgctcagggagcttcctggtgg

SEQ ID NO: 7609803 - DNA, 22 bp, Homo sapiens
tgctcagggacaatggagaggg

SEQ ID NO: 7609804 - DNA, 22 bp, Homo sapiens
tgctcagggacaatggagaggg

SEQ ID NO: 7609805 - DNA, 22 bp, Homo sapiens
tgctcagggacaatggagaggg

SEQ ID NO: 7609806 - DNA, 22 bp, Homo sapiens
tgctcagggacaatggagaggg

SEQ ID NO: 7609807 - DNA, 22 bp, Homo sapiens
tgctcaggccctgggccatcct

SEQ ID NO: 7609808 - DNA, 22 bp, Homo sapiens
tgctcaggccctgggccatcct

SEQ ID NO: 7609809 - DNA, 22 bp, Homo sapiens
tgctcaggccctgggccatcct

SEQ ID NO: 7609810 - DNA, 22 bp, Homo sapiens
tgctcaggccctgggccatcct

SEQ ID NO: 7609811 - DNA, 19 bp, Homo sapiens
tgctcaggccaaggagccc

SEQ ID NO: 7609812 - DNA, 22 bp, Homo sapiens
tgctcaggagcttagagcacag

SEQ ID NO: 7609813 - DNA, 22 bp, Homo sapiens
tgctcaggacagtggaacctaa

SEQ ID NO: 7609814 - DNA, 22 bp, Homo sapiens
tgctcaggacagtggaacctaa

SEQ ID NO: 7609815 - DNA, 22 bp, Homo sapiens
tgctcaggaaataatgtctgtg

SEQ ID NO: 7609816 - DNA, 22 bp, Homo sapiens
tgctagtgtgtgagatgttcaa

SEQ ID NO: 7609817 - DNA, 22 bp, Homo sapiens
tgctcaggaaataatgtctgtg

SEQ ID NO: 7609818 - DNA, 22 bp, Homo sapiens
tgctcaggaaataatgtctgtg

SEQ ID NO: 7609819 - DNA, 22 bp, Homo sapiens
tgctcaggaaataatgtctgtg

SEQ ID NO: 7609820 - DNA, 20 bp, Homo sapiens
tgctcaggatggagaggtgt

SEQ ID NO: 7609821 - DNA, 19 bp, Homo sapiens
tgctcaggccaaggagccc

SEQ ID NO: 7609822 - DNA, 22 bp, Homo sapiens
tgctcaggaggaggctgtgagg

SEQ ID NO: 7609823 - DNA, 22 bp, Homo sapiens
tgctcaggagcttagagcacag

SEQ ID NO: 7609824 - DNA, 22 bp, Homo sapiens
tgctcaggagcttagagcacag

SEQ ID NO: 7609825 - DNA, 22 bp, Homo sapiens
tgctcaggaggaggctgtgagg

SEQ ID NO: 7609826 - DNA, 22 bp, Homo sapiens
tgctcaggaggaggctgtgagg

SEQ ID NO: 7609827 - DNA, 22 bp, Homo sapiens
tgctcaggaggaggctgtgagg

SEQ ID NO: 7609828 - DNA, 22 bp, Homo sapiens
tgctagggatgtagcagtgaag

SEQ ID NO: 7609829 - DNA, 22 bp, Homo sapiens
tgctagggatatagtggcgagt

SEQ ID NO: 7609830 - DNA, 22 bp, Homo sapiens
tgctagtgtgtgagatgttcaa

SEQ ID NO: 7609831 - DNA, 22 bp, Homo sapiens
tgctaggagaggcagcacagcg

SEQ ID NO: 7609832 - DNA, 22 bp, Homo sapiens
tgctagctcacccttgcctccc

SEQ ID NO: 7609833 - DNA, 22 bp, Homo sapiens
tgctagccaagcccatcccttt

SEQ ID NO: 7609834 - DNA, 22 bp, Homo sapiens
tgctagggatacagtggtgaat

SEQ ID NO: 7609835 - DNA, 22 bp, Homo sapiens
tgctagggatatagtggcgagt

SEQ ID NO: 7609836 - DNA, 22 bp, Homo sapiens
tgctagggatatagtggcgagt

SEQ ID NO: 7609837 - DNA, 22 bp, Homo sapiens
tgctaggcagtgcttccctgac

SEQ ID NO: 7609838 - DNA, 22 bp, Homo sapiens
tgctaggcattgtctgggagta

SEQ ID NO: 7609839 - DNA, 22 bp, Homo sapiens
tgctaggcattgtctgggagta

SEQ ID NO: 7609840 - DNA, 21 bp, Homo sapiens
tgctaggccatattggttgct

SEQ ID NO: 7609841 - DNA, 22 bp, Homo sapiens
tgctagatgagttttgagaagt

SEQ ID NO: 7609842 - DNA, 22 bp, Homo sapiens
tgctagcactgtgcagtctacg

SEQ ID NO: 7609843 - DNA, 22 bp, Homo sapiens
tgctagccaagcccatcccttt

SEQ ID NO: 7609844 - DNA, 22 bp, Homo sapiens
tgctagccaagcccatcccttt

SEQ ID NO: 7609845 - DNA, 22 bp, Homo sapiens
tgctagaatttgcagaagcata

SEQ ID NO: 7609846 - DNA, 22 bp, Homo sapiens
tgctagaatttgcagaagcata

SEQ ID NO: 7609847 - DNA, 22 bp, Homo sapiens
tgctagaatacctacctggagg

SEQ ID NO: 7609848 - DNA, 22 bp, Homo sapiens
tgctagaagatagctagaagat

SEQ ID NO: 7609849 - DNA, 22 bp, Homo sapiens
tgctagaatttgcagaagcata

SEQ ID NO: 7609850 - DNA, 22 bp, Homo sapiens
tgctactacttgtcaacggtca

SEQ ID NO: 7609851 - DNA, 22 bp, Homo sapiens
tgctacctgccgcttccaaggg

SEQ ID NO: 7609852 - DNA, 18 bp, Homo sapiens
tgctacccagttcagggt

SEQ ID NO: 7609853 - DNA, 22 bp, Homo sapiens
tgctacttttgaaatcttcctt

SEQ ID NO: 7609854 - DNA, 22 bp, Homo sapiens
tgctactgaataggtgtccaat

SEQ ID NO: 7609855 - DNA, 19 bp, Homo sapiens
tgctagaaattctgtgact

SEQ ID NO: 7609856 - DNA, 22 bp, Homo sapiens
tgctagaaatctgaaactagca

SEQ ID NO: 7609857 - DNA, 22 bp, Homo sapiens
tgctagaaatctgaaactagca

SEQ ID NO: 7609858 - DNA, 22 bp, Homo sapiens
tgctagaagatagctagaagat

SEQ ID NO: 7609859 - DNA, 22 bp, Homo sapiens
tgccttctcttccctgggagct

SEQ ID NO: 7609860 - DNA, 22 bp, Homo sapiens
tgccttctcttccctgggagct

SEQ ID NO: 7609861 - DNA, 22 bp, Homo sapiens
tgccttctcccttggaccctga

SEQ ID NO: 7609862 - DNA, 22 bp, Homo sapiens
tgccttcgtacatgcaacatgc

SEQ ID NO: 7609863 - DNA, 22 bp, Homo sapiens
tgccttctcccttggaccctga

SEQ ID NO: 7609864 - DNA, 22 bp, Homo sapiens
tgcaggtgctgtgtcaagagag

SEQ ID NO: 7609865 - DNA, 22 bp, Homo sapiens
tgcaggtgctgtgtcaagagag

SEQ ID NO: 7609866 - DNA, 22 bp, Homo sapiens
tgcaggtgctgtgtcaagagag

SEQ ID NO: 7609867 - DNA, 22 bp, Homo sapiens
tgctaatatctagaagtttgtt

SEQ ID NO: 7609868 - DNA, 22 bp, Homo sapiens
tgctaatgtcctgaccgttctg

SEQ ID NO: 7609869 - DNA, 21 bp, Homo sapiens
tgctaagtgtcacatgtctgc

SEQ ID NO: 7609870 - DNA, 22 bp, Homo sapiens
tgctaagttctgcaaaagataa

SEQ ID NO: 7609871 - DNA, 22 bp, Homo sapiens
tgctaataaactccaggctgag

SEQ ID NO: 7609872 - DNA, 22 bp, Homo sapiens
tgctaagctcacatggctctag

SEQ ID NO: 7609873 - DNA, 22 bp, Homo sapiens
tgccttcttctccctggctcag

SEQ ID NO: 7609874 - DNA, 22 bp, Homo sapiens
tgccttcttctccctggctcag

SEQ ID NO: 7609875 - DNA, 22 bp, Homo sapiens
tgctaagctgaggaagatgaga

SEQ ID NO: 7609876 - DNA, 22 bp, Homo sapiens
tgctaagctgaggaagatgaga

SEQ ID NO: 7609877 - DNA, 22 bp, Homo sapiens
tgctacagagcgggggctcagt

SEQ ID NO: 7609878 - DNA, 22 bp, Homo sapiens
tgctacagagccaggaagagtg

SEQ ID NO: 7609879 - DNA, 22 bp, Homo sapiens
tgctacagctgttcagtgccct

SEQ ID NO: 7609880 - DNA, 22 bp, Homo sapiens
tgctacagagccaggaagagtg

SEQ ID NO: 7609881 - DNA, 22 bp, Homo sapiens
tgctacagagccaggaagagtg

SEQ ID NO: 7609882 - DNA, 22 bp, Homo sapiens
tgctacagagccaggaagagtg

SEQ ID NO: 7609883 - DNA, 22 bp, Homo sapiens
tgctacacttaaatcagtcacc

SEQ ID NO: 7609884 - DNA, 22 bp, Homo sapiens
tgctacacttaaatcagtcacc

SEQ ID NO: 7609885 - DNA, 22 bp, Homo sapiens
tgctacactcaatcagtgctat

SEQ ID NO: 7609886 - DNA, 22 bp, Homo sapiens
tgctacactcaatcagtgctat

SEQ ID NO: 7609887 - DNA, 22 bp, Homo sapiens
tgctacaaattcgtaatcaatt

SEQ ID NO: 7609888 - DNA, 22 bp, Homo sapiens
tgctacactcaatcagtgctat

SEQ ID NO: 7609889 - DNA, 22 bp, Homo sapiens
tgctaattcaaagggtagttag

SEQ ID NO: 7609890 - DNA, 22 bp, Homo sapiens
tgctaattcaaagggtagttag

SEQ ID NO: 7609891 - DNA, 23 bp, Homo sapiens
tgctaattggacttgattctgca

SEQ ID NO: 7609892 - DNA, 22 bp, Homo sapiens
tgctacaggcgatcctcaacta

SEQ ID NO: 7609893 - DNA, 22 bp, Homo sapiens
tgctacataccacgatgcagta

SEQ ID NO: 7609894 - DNA, 22 bp, Homo sapiens
tgctacataggatagctcaaat

SEQ ID NO: 7609895 - DNA, 22 bp, Homo sapiens
tgctacataggatagctcaaat

SEQ ID NO: 7609896 - DNA, 22 bp, Homo sapiens
tgctacataccacgatgcagta

SEQ ID NO: 7609897 - DNA, 22 bp, Homo sapiens
tgctacagagcgggggctcagt

SEQ ID NO: 7609898 - DNA, 22 bp, Homo sapiens
tgctacattatatggcaaagga

SEQ ID NO: 7609899 - DNA, 22 bp, Homo sapiens
tgctacatgcactgtgatctag

SEQ ID NO: 7609900 - DNA, 21 bp, Homo sapiens
tgctacattgctggttatgtt

SEQ ID NO: 7609901 - DNA, 19 bp, Homo sapiens
tgctacccagtttcagggg

SEQ ID NO: 7609902 - DNA, 19 bp, Homo sapiens
tgctaccgtgggatgctta

SEQ ID NO: 7609903 - DNA, 22 bp, Homo sapiens
tgcaggtgctacaagaactcac

SEQ ID NO: 7609904 - DNA, 22 bp, Homo sapiens
tgcaggtgctacaagaactcac

SEQ ID NO: 7609905 - DNA, 22 bp, Homo sapiens
tgcaggtgctccgggggtgccc

SEQ ID NO: 7609906 - DNA, 22 bp, Homo sapiens
tgcaggtgctccgggggtgccc

SEQ ID NO: 7609907 - DNA, 22 bp, Homo sapiens
tgcaggtgctccgggggtgccc

SEQ ID NO: 7609908 - DNA, 22 bp, Homo sapiens
tgcaggtgctccgggggtgccc

SEQ ID NO: 7609909 - DNA, 22 bp, Homo sapiens
tgcaggtgctccgggggtgccc

SEQ ID NO: 7609910 - DNA, 22 bp, Homo sapiens
tgcaggtgctgatacctactcc

SEQ ID NO: 7609911 - DNA, 22 bp, Homo sapiens
tgcaggtgcctcttgagcttgt

SEQ ID NO: 7609912 - DNA, 22 bp, Homo sapiens
tgcaggtgcctcttgagcttgt

SEQ ID NO: 7609913 - DNA, 22 bp, Homo sapiens
tgcaggtgcgttttcaagcctc

SEQ ID NO: 7609914 - DNA, 22 bp, Homo sapiens
tgcaggtgcgttttcaagcctc

SEQ ID NO: 7609915 - DNA, 22 bp, Homo sapiens
tgcaggtgctccgggggtgccc

SEQ ID NO: 7609916 - DNA, 22 bp, Homo sapiens
tgcaggtgctacaagaactcac

SEQ ID NO: 7609917 - DNA, 22 bp, Homo sapiens
tgcaggtgccatcgctgctcat

SEQ ID NO: 7609918 - DNA, 22 bp, Homo sapiens
tgcaggtgccatcgctgctcat

SEQ ID NO: 7609919 - DNA, 22 bp, Homo sapiens
tgcaggtgccatcgctgctcat

SEQ ID NO: 7609920 - DNA, 22 bp, Homo sapiens
tgcaggtgcctcttgagcttgt

SEQ ID NO: 7609921 - DNA, 22 bp, Homo sapiens
tgcaggtgccatcgctgctcat

SEQ ID NO: 7609922 - DNA, 22 bp, Homo sapiens
tgcaggtgccatcgctgctcat

SEQ ID NO: 7609923 - DNA, 22 bp, Homo sapiens
tgcagggctaagtcagagcctg

SEQ ID NO: 7609924 - DNA, 22 bp, Homo sapiens
tgcagggctaagtcagagcctg

SEQ ID NO: 7609925 - DNA, 22 bp, Homo sapiens
tgcagggctaagtcagagcctg

SEQ ID NO: 7609926 - DNA, 22 bp, Homo sapiens
tgcagggctaagtcagagcctg

SEQ ID NO: 7609927 - DNA, 22 bp, Homo sapiens
tgctcaggtcgttctgcccctt

SEQ ID NO: 7609928 - DNA, 22 bp, Homo sapiens
tgctcagggagcttcctggtgg

SEQ ID NO: 7609929 - DNA, 22 bp, Homo sapiens
tgctcaggtgccttggctgctg

SEQ ID NO: 7609930 - DNA, 22 bp, Homo sapiens
tgctcaggtcgttctgcccctt

SEQ ID NO: 7609931 - DNA, 21 bp, Homo sapiens
tgctcagtaaatgctgagtga

SEQ ID NO: 7609932 - DNA, 22 bp, Homo sapiens
tgctcaggtgccttggctgctg

SEQ ID NO: 7609933 - DNA, 22 bp, Homo sapiens
tgctcaggtgccttggctgctg

SEQ ID NO: 7609934 - DNA, 22 bp, Homo sapiens
tgctcaggtgccttggctgctg

SEQ ID NO: 7609935 - DNA, 22 bp, Homo sapiens
tgctcaggtgccttggctgctg

SEQ ID NO: 7609936 - DNA, 22 bp, Homo sapiens
cccagtccagaccatgacctca

SEQ ID NO: 7609937 - DNA, 22 bp, Homo sapiens
cccaggtctgtgccagctctga

SEQ ID NO: 7609938 - DNA, 22 bp, Homo sapiens
cccaggtctgtgccagctctga

SEQ ID NO: 7609939 - DNA, 22 bp, Homo sapiens
cccaggtctgtgccagctctga

SEQ ID NO: 7609940 - DNA, 22 bp, Homo sapiens
cccaggtctgtgccagctctga

SEQ ID NO: 7609941 - DNA, 22 bp, Homo sapiens
cccaggtctgtgccagctctga

SEQ ID NO: 7609942 - DNA, 22 bp, Homo sapiens
cccaggtctgccagcctgtggg

SEQ ID NO: 7609943 - DNA, 22 bp, Homo sapiens
cccaggtctcctgcttcccagg

SEQ ID NO: 7609944 - DNA, 22 bp, Homo sapiens
cccaggtctcctgcttcccagg

SEQ ID NO: 7609945 - DNA, 22 bp, Homo sapiens
cccaggtctccttctttagctg

SEQ ID NO: 7609946 - DNA, 22 bp, Homo sapiens
cccaggtctgccagcctgtggg

SEQ ID NO: 7609947 - DNA, 22 bp, Homo sapiens
cccaggtctgccagcctgtggg

SEQ ID NO: 7609948 - DNA, 22 bp, Homo sapiens
cccaggtctgccagcctgtggg

SEQ ID NO: 7609949 - DNA, 19 bp, Homo sapiens
cccagtccttgtcctgggc

SEQ ID NO: 7609950 - DNA, 19 bp, Homo sapiens
cccagtccttgtcctgggc

SEQ ID NO: 7609951 - DNA, 19 bp, Homo sapiens
cccagtccttgtcctgggc

SEQ ID NO: 7609952 - DNA, 19 bp, Homo sapiens
cccagtccttgtcctgggc

SEQ ID NO: 7609953 - DNA, 19 bp, Homo sapiens
cccagtccttgtcctgggc

SEQ ID NO: 7609954 - DNA, 19 bp, Homo sapiens
cccagtccttgtcctgggc

SEQ ID NO: 7609955 - DNA, 19 bp, Homo sapiens
cccagtccttgtcctgggc

SEQ ID NO: 7609956 - DNA, 19 bp, Homo sapiens
cccagtccttgtcctgggc

SEQ ID NO: 7609957 - DNA, 22 bp, Homo sapiens
cccagtccagaccatgacctca

SEQ ID NO: 7609958 - DNA, 22 bp, Homo sapiens
cccagtccagaccatgacctca

SEQ ID NO: 7609959 - DNA, 22 bp, Homo sapiens
cccagtcctaaagcagacgcca

SEQ ID NO: 7609960 - DNA, 22 bp, Homo sapiens
cccagtcctaaagcagacgcca

SEQ ID NO: 7609961 - DNA, 22 bp, Homo sapiens
cccagtcctaaagcagacgcca

SEQ ID NO: 7609962 - DNA, 19 bp, Homo sapiens
cccagtctaggtcctagga

SEQ ID NO: 7609963 - DNA, 19 bp, Homo sapiens
cccagtctaggtcctagga

SEQ ID NO: 7609964 - DNA, 19 bp, Homo sapiens
cccagtctaggtcctagga

SEQ ID NO: 7609965 - DNA, 19 bp, Homo sapiens
cccagtctaggtcctagga

SEQ ID NO: 7609966 - DNA, 20 bp, Homo sapiens
cccagtgaagcatggaagag

SEQ ID NO: 7609967 - DNA, 22 bp, Homo sapiens
cccagtgccaggcacaggcagc

SEQ ID NO: 7609968 - DNA, 22 bp, Homo sapiens
cccagtgccaggcacaggcagc

SEQ ID NO: 7609969 - DNA, 22 bp, Homo sapiens
cccagtgccaggcacaggcagc

SEQ ID NO: 7609970 - DNA, 22 bp, Homo sapiens
cccagtgccaggcacaggcagc

SEQ ID NO: 7609971 - DNA, 22 bp, Homo sapiens
cccagtggaaggagtagaagac

SEQ ID NO: 7609972 - DNA, 22 bp, Homo sapiens
cccagtggaaggagtagaagac

SEQ ID NO: 7609973 - DNA, 22 bp, Homo sapiens
cccagtggaaggagtagaagac

SEQ ID NO: 7609974 - DNA, 22 bp, Homo sapiens
cccagtggagataggagtgtgg

SEQ ID NO: 7609975 - DNA, 18 bp, Homo sapiens
cccagtgctcactgcctc

SEQ ID NO: 7609976 - DNA, 22 bp, Homo sapiens
cccagtgctatgcctattacat

SEQ ID NO: 7609977 - DNA, 18 bp, Homo sapiens
cccagtgctcactgcctc

SEQ ID NO: 7609978 - DNA, 18 bp, Homo sapiens
cccagtgctcactgcctc

SEQ ID NO: 7609979 - DNA, 18 bp, Homo sapiens
cccagtgctcactgcctc

SEQ ID NO: 7609980 - DNA, 22 bp, Homo sapiens
cccagtggagataggagtgtgg

SEQ ID NO: 7609981 - DNA, 22 bp, Homo sapiens
cccagtggcaaagcagcttaga

SEQ ID NO: 7609982 - DNA, 22 bp, Homo sapiens
cccagtggcccagcatgtggtg

SEQ ID NO: 7609983 - DNA, 22 bp, Homo sapiens
cccagtggagataggagtgtgg

SEQ ID NO: 7609984 - DNA, 22 bp, Homo sapiens
cccagtggcaaagcagcttaga

SEQ ID NO: 7609985 - DNA, 22 bp, Homo sapiens
cccagtggcccagcatgtggtg

SEQ ID NO: 7609986 - DNA, 22 bp, Homo sapiens
cccagtggcccagcatgtggtg

SEQ ID NO: 7609987 - DNA, 22 bp, Homo sapiens
tgctctgcacatccctcacaaa

SEQ ID NO: 7609988 - DNA, 22 bp, Homo sapiens
tgctctgcacatccctcacaaa

SEQ ID NO: 7609989 - DNA, 22 bp, Homo sapiens
tgctctgattggagtctgttgc

SEQ ID NO: 7609990 - DNA, 22 bp, Homo sapiens
tgctctgcaagcaggagcaaga

SEQ ID NO: 7609991 - DNA, 22 bp, Homo sapiens
tgctctgaggcacatgccatcg

SEQ ID NO: 7609992 - DNA, 22 bp, Homo sapiens
tgctctgaggcacatgccatcg

SEQ ID NO: 7609993 - DNA, 22 bp, Homo sapiens
tgctctgaggcacatgccatcg

SEQ ID NO: 7609994 - DNA, 22 bp, Homo sapiens
tgctctgatggggtggacatag

SEQ ID NO: 7609995 - DNA, 22 bp, Homo sapiens
tgctctgatggggtggacatag

SEQ ID NO: 7609996 - DNA, 22 bp, Homo sapiens
tgctctgatggggtggacatag

SEQ ID NO: 7609997 - DNA, 22 bp, Homo sapiens
tgctctgaactgaacttagggt

SEQ ID NO: 7609998 - DNA, 22 bp, Homo sapiens
cccagtggctgtccccatgggc

SEQ ID NO: 7609999 - DNA, 22 bp, Homo sapiens
tgctctgaaggggaagggatgg

SEQ ID NO: 7610000 - DNA, 22 bp, Homo sapiens
tgctctgaaggggaagggatgg

SEQ ID NO: 7610001 - DNA, 22 bp, Homo sapiens
tgctctgaaggaagagccccat

SEQ ID NO: 7610002 - DNA, 22 bp, Homo sapiens
tgctctgaaggaagagccccat

SEQ ID NO: 7610003 - DNA, 22 bp, Homo sapiens
tgctctgaaggggaagggatgg

SEQ ID NO: 7610004 - DNA, 21 bp, Homo sapiens
tgctgcctgtgggtgtttacc

SEQ ID NO: 7610005 - DNA, 22 bp, Homo sapiens
tgctgcctgttgtggggccacg

SEQ ID NO: 7610006 - DNA, 20 bp, Homo sapiens
tgctgcctgtttttgtgaat

SEQ ID NO: 7610007 - DNA, 22 bp, Homo sapiens
tgctgcctgttgtggggccacg

SEQ ID NO: 7610008 - DNA, 22 bp, Homo sapiens
tgctgcctgttgtggggccacg

SEQ ID NO: 7610009 - DNA, 22 bp, Homo sapiens
tgctgcctgtgccaggagggtc

SEQ ID NO: 7610010 - DNA, 22 bp, Homo sapiens
tgctgcctgtgccaggagggtc

SEQ ID NO: 7610011 - DNA, 22 bp, Homo sapiens
tgctgcctgtgccaggagggtc

SEQ ID NO: 7610012 - DNA, 22 bp, Homo sapiens
tgctgcctggtttcttcttgct

SEQ ID NO: 7610013 - DNA, 22 bp, Homo sapiens
tgctgcctgtgccaggagggtc

SEQ ID NO: 7610014 - DNA, 22 bp, Homo sapiens
tgctgcctgtgccaggagggtc

SEQ ID NO: 7610015 - DNA, 22 bp, Homo sapiens
tgctgcctgctacgagggaaga

SEQ ID NO: 7610016 - DNA, 22 bp, Homo sapiens
tgctgcctgctacgagggaaga

SEQ ID NO: 7610017 - DNA, 22 bp, Homo sapiens
tgctgcctggagccttttgttt

SEQ ID NO: 7610018 - DNA, 22 bp, Homo sapiens
tgctgcctgatgctttctggac

SEQ ID NO: 7610019 - DNA, 22 bp, Homo sapiens
tgctgcctgatgctttctggac

SEQ ID NO: 7610020 - DNA, 22 bp, Homo sapiens
tgctgcctgatgctttctggac

SEQ ID NO: 7610021 - DNA, 22 bp, Homo sapiens
tgctgcaggcagcccctctact

SEQ ID NO: 7610022 - DNA, 22 bp, Homo sapiens
tgctgcaggcagcccctctact

SEQ ID NO: 7610023 - DNA, 22 bp, Homo sapiens
tgctgcaggcaatagaaaacct

SEQ ID NO: 7610024 - DNA, 22 bp, Homo sapiens
tgctgcctttctgaatggtgga

SEQ ID NO: 7610025 - DNA, 22 bp, Homo sapiens
tgctgcctttcaatgttgtcat

SEQ ID NO: 7610026 - DNA, 22 bp, Homo sapiens
tgctgcctttcaatgttgtcat

SEQ ID NO: 7610027 - DNA, 22 bp, Homo sapiens
tgctgcctttgcttagcgaata

SEQ ID NO: 7610028 - DNA, 22 bp, Homo sapiens
tgctgcctttctgaatggtgga

SEQ ID NO: 7610029 - DNA, 22 bp, Homo sapiens
tgctgccttgtgctgcctttca

SEQ ID NO: 7610030 - DNA, 22 bp, Homo sapiens
tgctgccttgacctcctgggct

SEQ ID NO: 7610031 - DNA, 22 bp, Homo sapiens
tgctgccttgacctcctgggct

SEQ ID NO: 7610032 - DNA, 22 bp, Homo sapiens
tgctgcctttactgggatttaa

SEQ ID NO: 7610033 - DNA, 22 bp, Homo sapiens
tgctgccttctaggcgtgccct

SEQ ID NO: 7610034 - DNA, 22 bp, Homo sapiens
tgctgccttctaggcgtgccct

SEQ ID NO: 7610035 - DNA, 22 bp, Homo sapiens
tgctgccttagaaatggctata

SEQ ID NO: 7610036 - DNA, 22 bp, Homo sapiens
tgctgccttagcagccaggcaa

SEQ ID NO: 7610037 - DNA, 22 bp, Homo sapiens
tgctgccttagaaatggctata

SEQ ID NO: 7610038 - DNA, 22 bp, Homo sapiens
tgctgccttagcagccaggcaa

SEQ ID NO: 7610039 - DNA, 22 bp, Homo sapiens
tgctgccttagcagccaggcaa

SEQ ID NO: 7610040 - DNA, 22 bp, Homo sapiens
tgctctgcacatccctcacaaa

SEQ ID NO: 7610041 - DNA, 22 bp, Homo sapiens
tgctctgcacatccctcacaaa

SEQ ID NO: 7610042 - DNA, 22 bp, Homo sapiens
tgctctgcacatccctcacaaa

SEQ ID NO: 7610043 - DNA, 22 bp, Homo sapiens
tgctctgcaagcaggagcaaga

SEQ ID NO: 7610044 - DNA, 22 bp, Homo sapiens
tgctctgcacatccctcacaaa

SEQ ID NO: 7610045 - DNA, 22 bp, Homo sapiens
tgctctggaaataaatgattta

SEQ ID NO: 7610046 - DNA, 22 bp, Homo sapiens
tgctctggaaataaatgattta

SEQ ID NO: 7610047 - DNA, 22 bp, Homo sapiens
tgctctggaaataaatgattta

SEQ ID NO: 7610048 - DNA, 20 bp, Homo sapiens
tgctctggaaatggtctgag

SEQ ID NO: 7610049 - DNA, 20 bp, Homo sapiens
tgctctggaaatggtctgag

SEQ ID NO: 7610050 - DNA, 20 bp, Homo sapiens
tgctctggaaatggtctgag

SEQ ID NO: 7610051 - DNA, 20 bp, Homo sapiens
tgctctggaaatggtctgag

SEQ ID NO: 7610052 - DNA, 20 bp, Homo sapiens
tgctctggaaatggtctgag

SEQ ID NO: 7610053 - DNA, 22 bp, Homo sapiens
tgctctggaatagtcctaggca

SEQ ID NO: 7610054 - DNA, 22 bp, Homo sapiens
tgctctggaatagtcctaggca

SEQ ID NO: 7610055 - DNA, 22 bp, Homo sapiens
tgctctggaatagtcctaggca

SEQ ID NO: 7610056 - DNA, 22 bp, Homo sapiens
tgctctggaatagtcctaggca

SEQ ID NO: 7610057 - DNA, 22 bp, Homo sapiens
tgctctggaccatgactatgtg

SEQ ID NO: 7610058 - DNA, 22 bp, Homo sapiens
tgctctggaccatgactatgtg

SEQ ID NO: 7610059 - DNA, 22 bp, Homo sapiens
tgctctggaatagtcctaggca

SEQ ID NO: 7610060 - DNA, 22 bp, Homo sapiens
tgctctggaccatgactatgtg

SEQ ID NO: 7610061 - DNA, 22 bp, Homo sapiens
tgctctggacgctgagtggttt

SEQ ID NO: 7610062 - DNA, 22 bp, Homo sapiens
tgctctggacgctgagtggttt

SEQ ID NO: 7610063 - DNA, 22 bp, Homo sapiens
tgctctggaccatgactatgtg

SEQ ID NO: 7610064 - DNA, 22 bp, Homo sapiens
tgctctggaccatgactatgtg

SEQ ID NO: 7610065 - DNA, 22 bp, Homo sapiens
tgctctggagtggcttgtgcac

SEQ ID NO: 7610066 - DNA, 22 bp, Homo sapiens
tgctctggagtggcttgtgcac

SEQ ID NO: 7610067 - DNA, 22 bp, Homo sapiens
tgctctggagtgaatttgacaa

SEQ ID NO: 7610068 - DNA, 22 bp, Homo sapiens
tgctctggagtgaatttgacaa

SEQ ID NO: 7610069 - DNA, 22 bp, Homo sapiens
tgctctggagtgaatttgacaa

SEQ ID NO: 7610070 - DNA, 22 bp, Homo sapiens
tgctctggagggtgaagctttt

SEQ ID NO: 7610071 - DNA, 22 bp, Homo sapiens
tgctctggagggtgaagctttt

SEQ ID NO: 7610072 - DNA, 22 bp, Homo sapiens
tgctctggagggtgaagctttt

SEQ ID NO: 7610073 - DNA, 22 bp, Homo sapiens
tgctgcaggcaatagaaaacct

SEQ ID NO: 7610074 - DNA, 19 bp, Homo sapiens
tgctgcaggatgctgctgg

SEQ ID NO: 7610075 - DNA, 19 bp, Homo sapiens
tgctgcaggatgctgctgg

SEQ ID NO: 7610076 - DNA, 19 bp, Homo sapiens
tgctctggagccagctctc

SEQ ID NO: 7610077 - DNA, 22 bp, Homo sapiens
tgctctggacgctgagtggttt

SEQ ID NO: 7610078 - DNA, 22 bp, Homo sapiens
tgctctggacgctgagtggttt

SEQ ID NO: 7610079 - DNA, 22 bp, Homo sapiens
tgctctggacgctgagtggttt

SEQ ID NO: 7610080 - DNA, 19 bp, Homo sapiens
tgctctggagccagctctc

SEQ ID NO: 7610081 - DNA, 19 bp, Homo sapiens
tgctctggagccagctctc

SEQ ID NO: 7610082 - DNA, 22 bp, Homo sapiens
tgctctggacgctgagtggttt

SEQ ID NO: 7610083 - DNA, 19 bp, Homo sapiens
tgctctggagccagctctc

SEQ ID NO: 7610084 - DNA, 19 bp, Homo sapiens
tgctctggagccagctctc

SEQ ID NO: 7610085 - DNA, 19 bp, Homo sapiens
tgctctggagccagctctc

SEQ ID NO: 7610086 - DNA, 19 bp, Homo sapiens
tgctctggagccagctctc

SEQ ID NO: 7610087 - DNA, 22 bp, Homo sapiens
cctgcagggtgctgccacagat

SEQ ID NO: 7610088 - DNA, 22 bp, Homo sapiens
cctgcagggtgctgccacagat

SEQ ID NO: 7610089 - DNA, 22 bp, Homo sapiens
cctgcagggtgctgccacagat

SEQ ID NO: 7610090 - DNA, 22 bp, Homo sapiens
cctgcagggtgctgccacagat

SEQ ID NO: 7610091 - DNA, 22 bp, Homo sapiens
cctgcagggtgctgccacagat

SEQ ID NO: 7610092 - DNA, 22 bp, Homo sapiens
cctgcagggtgctgccacagat

SEQ ID NO: 7610093 - DNA, 22 bp, Homo sapiens
cctgcaggtccccggatgcgca

SEQ ID NO: 7610094 - DNA, 22 bp, Homo sapiens
cctgcaggtccccggatgcgca

SEQ ID NO: 7610095 - DNA, 22 bp, Homo sapiens
cctgcaggtccccggatgcgca

SEQ ID NO: 7610096 - DNA, 22 bp, Homo sapiens
cctgcaggtaaggctaactgcc

SEQ ID NO: 7610097 - DNA, 22 bp, Homo sapiens
cctgcaggtaaggctaactgcc

SEQ ID NO: 7610098 - DNA, 22 bp, Homo sapiens
cctgcaggtccccggatgcgca

SEQ ID NO: 7610099 - DNA, 19 bp, Homo sapiens
cctgcagggatgagaggtt

SEQ ID NO: 7610100 - DNA, 19 bp, Homo sapiens
cctgcagggatgagaggtt

SEQ ID NO: 7610101 - DNA, 19 bp, Homo sapiens
cctgcagggatgagaggtt

SEQ ID NO: 7610102 - DNA, 19 bp, Homo sapiens
cctgcagggatgagaggtt

SEQ ID NO: 7610103 - DNA, 22 bp, Homo sapiens
cctgcagggtgctgccacagat

SEQ ID NO: 7610104 - DNA, 22 bp, Homo sapiens
cctgcaggggagagacttctag

SEQ ID NO: 7610105 - DNA, 22 bp, Homo sapiens
cctgcaggggagagacttctag

SEQ ID NO: 7610106 - DNA, 22 bp, Homo sapiens
cctgcaggggagagacttctag

SEQ ID NO: 7610107 - DNA, 22 bp, Homo sapiens
cctgcaggttgcagaggcggaa

SEQ ID NO: 7610108 - DNA, 22 bp, Homo sapiens
cctgcaggttgcagaggcggaa

SEQ ID NO: 7610109 - DNA, 22 bp, Homo sapiens
cctgcaggttgcagaggcggaa

SEQ ID NO: 7610110 - DNA, 22 bp, Homo sapiens
cctgcaggtccccggatgcgca

SEQ ID NO: 7610111 - DNA, 22 bp, Homo sapiens
cctgcaggttgcagaggcggaa

SEQ ID NO: 7610112 - DNA, 22 bp, Homo sapiens
cctgcagtctacccaatgtgtg

SEQ ID NO: 7610113 - DNA, 22 bp, Homo sapiens
cctgcagtctacccaatgtgtg

SEQ ID NO: 7610114 - DNA, 17 bp, Homo sapiens
cctgcagtgcctgtcgg

SEQ ID NO: 7610115 - DNA, 22 bp, Homo sapiens
cctgcagtttgttgtgaccccg

SEQ ID NO: 7610116 - DNA, 22 bp, Homo sapiens
cctgcaggtttcccccggacgg

SEQ ID NO: 7610117 - DNA, 22 bp, Homo sapiens
cctgcaggtttcccccggacgg

SEQ ID NO: 7610118 - DNA, 22 bp, Homo sapiens
cctgcaggttgcagaggcggaa

SEQ ID NO: 7610119 - DNA, 22 bp, Homo sapiens
cctgccagaaaagagggagttc

SEQ ID NO: 7610120 - DNA, 22 bp, Homo sapiens
cctgccagaaaagagggagttc

SEQ ID NO: 7610121 - DNA, 22 bp, Homo sapiens
cctgccagaaaagagggagttc

SEQ ID NO: 7610122 - DNA, 22 bp, Homo sapiens
tgggtcagtttgggggccagcc

SEQ ID NO: 7610123 - DNA, 22 bp, Homo sapiens
cctgccagacgcaccagggggc

SEQ ID NO: 7610124 - DNA, 22 bp, Homo sapiens
cctgccactgtaggtgacagtt

SEQ ID NO: 7610125 - DNA, 22 bp, Homo sapiens
cctgccactgtaggtgacagtt

SEQ ID NO: 7610126 - DNA, 22 bp, Homo sapiens
cctgcatgtggtcagcactcct

SEQ ID NO: 7610127 - DNA, 22 bp, Homo sapiens
cctgcatgtggtcagcactcct

SEQ ID NO: 7610128 - DNA, 17 bp, Homo sapiens
cctgcagtgcctgtcgg

SEQ ID NO: 7610129 - DNA, 22 bp, Homo sapiens
cctgcatccgaaagtgatcata

SEQ ID NO: 7610130 - DNA, 22 bp, Homo sapiens
cctgcatgtggtcagcactcct

SEQ ID NO: 7610131 - DNA, 18 bp, Homo sapiens
tgggtggctagggagttt

SEQ ID NO: 7610132 - DNA, 18 bp, Homo sapiens
tgggtggctagggagttt

SEQ ID NO: 7610133 - DNA, 22 bp, Homo sapiens
tgggtggcggcctggttctgag

SEQ ID NO: 7610134 - DNA, 22 bp, Homo sapiens
tgggtggcggcctggttctgag

SEQ ID NO: 7610135 - DNA, 22 bp, Homo sapiens
tgggtggcggcctggttctgag

SEQ ID NO: 7610136 - DNA, 18 bp, Homo sapiens
tgggtggctagggagttt

SEQ ID NO: 7610137 - DNA, 18 bp, Homo sapiens
tgggtggctagggagttt

SEQ ID NO: 7610138 - DNA, 18 bp, Homo sapiens
tgggtggctagggagttt

SEQ ID NO: 7610139 - DNA, 18 bp, Homo sapiens
tgggtggctagggagttt

SEQ ID NO: 7610140 - DNA, 18 bp, Homo sapiens
tgggtggctagggagttt

SEQ ID NO: 7610141 - DNA, 22 bp, Homo sapiens
tgggtggcacttctggggtcca

SEQ ID NO: 7610142 - DNA, 22 bp, Homo sapiens
tgggtggcacttctggggtcca

SEQ ID NO: 7610143 - DNA, 22 bp, Homo sapiens
tgggtggcacttctggggtcca

SEQ ID NO: 7610144 - DNA, 22 bp, Homo sapiens
tgggtggcagcttcagcatgtt

SEQ ID NO: 7610145 - DNA, 22 bp, Homo sapiens
tgggtggcagcttcagcatgtt

SEQ ID NO: 7610146 - DNA, 22 bp, Homo sapiens
tgggtggcagcttcagcatgtt

SEQ ID NO: 7610147 - DNA, 22 bp, Homo sapiens
tgggtggcagcttcagcatgtt

SEQ ID NO: 7610148 - DNA, 22 bp, Homo sapiens
tgggtggcagcttcagcatgtt

SEQ ID NO: 7610149 - DNA, 22 bp, Homo sapiens
tgggtccacaaacatcagatat

SEQ ID NO: 7610150 - DNA, 22 bp, Homo sapiens
tgggtccacaaacatcagatat

SEQ ID NO: 7610151 - DNA, 22 bp, Homo sapiens
tgggtggaataaatcagttctg

SEQ ID NO: 7610152 - DNA, 22 bp, Homo sapiens
tgggtggagaagtggacctgct

SEQ ID NO: 7610153 - DNA, 22 bp, Homo sapiens
tgggtggagaagtggacctgct

SEQ ID NO: 7610154 - DNA, 22 bp, Homo sapiens
tgggtggagaagtggacctgct

SEQ ID NO: 7610155 - DNA, 22 bp, Homo sapiens
tgggtggaataaatcagttctg

SEQ ID NO: 7610156 - DNA, 22 bp, Homo sapiens
tgggtggaataaatcagttctg

SEQ ID NO: 7610157 - DNA, 22 bp, Homo sapiens
tgggtggaataaatcagttctg

SEQ ID NO: 7610158 - DNA, 22 bp, Homo sapiens
tgggtggcaaaggcccattgtc

SEQ ID NO: 7610159 - DNA, 22 bp, Homo sapiens
tgggtggcacttctggggtcca

SEQ ID NO: 7610160 - DNA, 22 bp, Homo sapiens
tgggtggcaaaggcccattgtc

SEQ ID NO: 7610161 - DNA, 22 bp, Homo sapiens
tgggtggcacttctggggtcca

SEQ ID NO: 7610162 - DNA, 22 bp, Homo sapiens
tgggtggagctccacaacctgt

SEQ ID NO: 7610163 - DNA, 22 bp, Homo sapiens
tgggtggagctccacaacctgt

SEQ ID NO: 7610164 - DNA, 22 bp, Homo sapiens
tgggtggattaggatagggtat

SEQ ID NO: 7610165 - DNA, 22 bp, Homo sapiens
tgggtggattaggatagggtat

SEQ ID NO: 7610166 - DNA, 22 bp, Homo sapiens
tgggtgggagcaccctgtctgg

SEQ ID NO: 7610167 - DNA, 22 bp, Homo sapiens
tgggtgggagcaccctgtctgg

SEQ ID NO: 7610168 - DNA, 22 bp, Homo sapiens
tgggtgggagcaccctgtctgg

SEQ ID NO: 7610169 - DNA, 18 bp, Homo sapiens
tgggtggctagggagttt

SEQ ID NO: 7610170 - DNA, 18 bp, Homo sapiens
tgggtggctagggagttt

SEQ ID NO: 7610171 - DNA, 22 bp, Homo sapiens
tgggtgggagcaccctgtctgg

SEQ ID NO: 7610172 - DNA, 22 bp, Homo sapiens
tgggtgggagcaccctgtctgg

SEQ ID NO: 7610173 - DNA, 22 bp, Homo sapiens
tgggtgggagcaccctgtctgg

SEQ ID NO: 7610174 - DNA, 22 bp, Homo sapiens
tgggtgggagcaccctgtctgg

SEQ ID NO: 7610175 - DNA, 22 bp, Homo sapiens
tgggtgggagcaccctgtctgg

SEQ ID NO: 7610176 - DNA, 22 bp, Homo sapiens
tgggtgggagcaccctgtctgg

SEQ ID NO: 7610177 - DNA, 22 bp, Homo sapiens
tggtaaggttctacagtgttga

SEQ ID NO: 7610178 - DNA, 22 bp, Homo sapiens
tggtaaggttccagatctagaa

SEQ ID NO: 7610179 - DNA, 22 bp, Homo sapiens
tggtaagtaagtgaaacatcca

SEQ ID NO: 7610180 - DNA, 22 bp, Homo sapiens
tggtaagtaagtgaaacatcca

SEQ ID NO: 7610181 - DNA, 23 bp, Homo sapiens
tggtaatagggagcagaaggtag

SEQ ID NO: 7610182 - DNA, 22 bp, Homo sapiens
tgggtgggagcgccctgtctgg

SEQ ID NO: 7610183 - DNA, 22 bp, Homo sapiens
tgggtgggagcaccctgtctgg

SEQ ID NO: 7610184 - DNA, 22 bp, Homo sapiens
tgggtgggagcaccctgtctgg

SEQ ID NO: 7610185 - DNA, 22 bp, Homo sapiens
tgggtgggagcaccctgtctgg

SEQ ID NO: 7610186 - DNA, 22 bp, Homo sapiens
tggtacacatgtccaaggtcag

SEQ ID NO: 7610187 - DNA, 22 bp, Homo sapiens
tggtacaatggcatctatctat

SEQ ID NO: 7610188 - DNA, 22 bp, Homo sapiens
tggtacaattaaaataattttg

SEQ ID NO: 7610189 - DNA, 22 bp, Homo sapiens
tggtacaattaaaataattttg

SEQ ID NO: 7610190 - DNA, 22 bp, Homo sapiens
tggtacaagggttgggagacag

SEQ ID NO: 7610191 - DNA, 22 bp, Homo sapiens
tggtacaagttctggcatgtga

SEQ ID NO: 7610192 - DNA, 22 bp, Homo sapiens
tggtacaatcacagctcactgt

SEQ ID NO: 7610193 - DNA, 22 bp, Homo sapiens
tggtacaaagcctctttgcctc

SEQ ID NO: 7610194 - DNA, 22 bp, Homo sapiens
tggtacaactgtattaggcaaa

SEQ ID NO: 7610195 - DNA, 22 bp, Homo sapiens
tggtacaagagtatttgcggtt

SEQ ID NO: 7610196 - DNA, 22 bp, Homo sapiens
tggtacaagatgttctaactga

SEQ ID NO: 7610197 - DNA, 22 bp, Homo sapiens
tggtacaagcagactcagcaga

SEQ ID NO: 7610198 - DNA, 22 bp, Homo sapiens
tggtacaagcagactcagcaga

SEQ ID NO: 7610199 - DNA, 22 bp, Homo sapiens
tggtaatttgagtggacttagt

SEQ ID NO: 7610200 - DNA, 22 bp, Homo sapiens
tggtaatttccgaagtgagtaa

SEQ ID NO: 7610201 - DNA, 22 bp, Homo sapiens
tggtacaaaagtaattgcgtga

SEQ ID NO: 7610202 - DNA, 22 bp, Homo sapiens
tggtaatttattttgagagatt

SEQ ID NO: 7610203 - DNA, 19 bp, Homo sapiens
tggtacaaaccaagagaga

SEQ ID NO: 7610204 - DNA, 22 bp, Homo sapiens
tggtaattatggatacttaaat

SEQ ID NO: 7610205 - DNA, 22 bp, Homo sapiens
tggtaattgagatgtcttttct

SEQ ID NO: 7610206 - DNA, 22 bp, Homo sapiens
tggtaatttacgcatttctgta

SEQ ID NO: 7610207 - DNA, 22 bp, Homo sapiens
tggtaatttattttgagagatt

SEQ ID NO: 7610208 - DNA, 22 bp, Homo sapiens
tggtaattaatttgataggttc

SEQ ID NO: 7610209 - DNA, 22 bp, Homo sapiens
tggtaattaatttgataggttc

SEQ ID NO: 7610210 - DNA, 22 bp, Homo sapiens
tggtaattataaaatgtttttg

SEQ ID NO: 7610211 - DNA, 22 bp, Homo sapiens
tggtaatatatgccagataaaa

SEQ ID NO: 7610212 - DNA, 22 bp, Homo sapiens
tggtaatgtaagcagcaaatgt

SEQ ID NO: 7610213 - DNA, 22 bp, Homo sapiens
tggtaatgtaagcagcaaatgt

SEQ ID NO: 7610214 - DNA, 22 bp, Homo sapiens
cctgccctgtcactggctaggg

SEQ ID NO: 7610215 - DNA, 22 bp, Homo sapiens
cctgccctgtcactggctaggg

SEQ ID NO: 7610216 - DNA, 22 bp, Homo sapiens
cctgccctgtcactggctaggg

SEQ ID NO: 7610217 - DNA, 22 bp, Homo sapiens
cctgccctgtcactggctaggg

SEQ ID NO: 7610218 - DNA, 22 bp, Homo sapiens
cctgccctgtcactggctaggg

SEQ ID NO: 7610219 - DNA, 22 bp, Homo sapiens
cctgccctgtcactggctaggg

SEQ ID NO: 7610220 - DNA, 22 bp, Homo sapiens
cctgcccagcttcacctcaggc

SEQ ID NO: 7610221 - DNA, 22 bp, Homo sapiens
tggtaccaggggttatttctgc

SEQ ID NO: 7610222 - DNA, 22 bp, Homo sapiens
cctgcccagcttcacctcaggc

SEQ ID NO: 7610223 - DNA, 22 bp, Homo sapiens
cctgcccagcttcacctcaggc

SEQ ID NO: 7610224 - DNA, 22 bp, Homo sapiens
tggtagcaacatctcagtggct

SEQ ID NO: 7610225 - DNA, 22 bp, Homo sapiens
tggtagcaacatctcagtggct

SEQ ID NO: 7610226 - DNA, 22 bp, Homo sapiens
tggtaggaatgattacgacttt

SEQ ID NO: 7610227 - DNA, 22 bp, Homo sapiens
tggtagcaacatctcagtggct

SEQ ID NO: 7610228 - DNA, 22 bp, Homo sapiens
tggtagcaggtgtgatagaaat

SEQ ID NO: 7610229 - DNA, 22 bp, Homo sapiens
cctgcccagcttcacctcaggc

SEQ ID NO: 7610230 - DNA, 22 bp, Homo sapiens
cctgcccagcttcacctcaggc

SEQ ID NO: 7610231 - DNA, 22 bp, Homo sapiens
cctgcccagcttcacctcaggc

SEQ ID NO: 7610232 - DNA, 22 bp, Homo sapiens
cctgcccagagcccctttcact

SEQ ID NO: 7610233 - DNA, 22 bp, Homo sapiens
cctgcccagagcccctttcact

SEQ ID NO: 7610234 - DNA, 22 bp, Homo sapiens
cctgcccagagcccctttcact

SEQ ID NO: 7610235 - DNA, 22 bp, Homo sapiens
cctgcccagagcccctttcact

SEQ ID NO: 7610236 - DNA, 21 bp, Homo sapiens
tggtacagaggaggtgaagtg

SEQ ID NO: 7610237 - DNA, 21 bp, Homo sapiens
tggtacagaggaggtgaagtg

SEQ ID NO: 7610238 - DNA, 17 bp, Homo sapiens
tggtacaggctgaggga

SEQ ID NO: 7610239 - DNA, 17 bp, Homo sapiens
tggtacaggctgaggga

SEQ ID NO: 7610240 - DNA, 21 bp, Homo sapiens
tggtacagaggaggtgaagtg

SEQ ID NO: 7610241 - DNA, 21 bp, Homo sapiens
tggtacaccttgcctgtcaga

SEQ ID NO: 7610242 - DNA, 21 bp, Homo sapiens
tggtacaccttgcctgtcaga

SEQ ID NO: 7610243 - DNA, 21 bp, Homo sapiens
tggtacaccttgcctgtcaga

SEQ ID NO: 7610244 - DNA, 21 bp, Homo sapiens
tggtacaccttgcctgtcaga

SEQ ID NO: 7610245 - DNA, 22 bp, Homo sapiens
tggtacacatgtccaaggtcag

SEQ ID NO: 7610246 - DNA, 22 bp, Homo sapiens
tggtacacatgtccaaggtcag

SEQ ID NO: 7610247 - DNA, 22 bp, Homo sapiens
tggtacacatgtccaaggtcag

SEQ ID NO: 7610248 - DNA, 22 bp, Homo sapiens
tggtacctgccaccttttccct

SEQ ID NO: 7610249 - DNA, 22 bp, Homo sapiens
tggtaccatgacaaatgtcagg

SEQ ID NO: 7610250 - DNA, 22 bp, Homo sapiens
tggtacttggaggcagaaaaat

SEQ ID NO: 7610251 - DNA, 17 bp, Homo sapiens
tggtagaatgacaggcc

SEQ ID NO: 7610252 - DNA, 17 bp, Homo sapiens
tggtagaatgacaggcc

SEQ ID NO: 7610253 - DNA, 22 bp, Homo sapiens
tggtacttggaggcagaaaaat

SEQ ID NO: 7610254 - DNA, 17 bp, Homo sapiens
tggtacaggctgaggga

SEQ ID NO: 7610255 - DNA, 22 bp, Homo sapiens
tggtacatgggtaggtatctct

SEQ ID NO: 7610256 - DNA, 22 bp, Homo sapiens
tggtaccatttcccaggagtgt

SEQ ID NO: 7610257 - DNA, 22 bp, Homo sapiens
tggtaccatgttgctttgattt

SEQ ID NO: 7610258 - DNA, 22 bp, Homo sapiens
cctgcctatgagacgttttgcc

SEQ ID NO: 7610259 - DNA, 22 bp, Homo sapiens
cctgcctcaggactctgcatat

SEQ ID NO: 7610260 - DNA, 22 bp, Homo sapiens
cctgcctactgagttttatatt

SEQ ID NO: 7610261 - DNA, 22 bp, Homo sapiens
cctgcctatgagacgttttgcc

SEQ ID NO: 7610262 - DNA, 22 bp, Homo sapiens
cctgcctatgagacgttttgcc

SEQ ID NO: 7610263 - DNA, 22 bp, Homo sapiens
cctgcctcatcaacttgtcgtg

SEQ ID NO: 7610264 - DNA, 22 bp, Homo sapiens
cctgcctcatcaacttgtcgtg

SEQ ID NO: 7610265 - DNA, 22 bp, Homo sapiens
cctgcctcatcaacttgtcgtg

SEQ ID NO: 7610266 - DNA, 22 bp, Homo sapiens
cctgcctcaggactctgcatat

SEQ ID NO: 7610267 - DNA, 22 bp, Homo sapiens
cctgcctcaggactctgcatat

SEQ ID NO: 7610268 - DNA, 22 bp, Homo sapiens
cctgcctcaggactctgcatat

SEQ ID NO: 7610269 - DNA, 22 bp, Homo sapiens
cctgcctcaggactctgcatat

SEQ ID NO: 7610270 - DNA, 22 bp, Homo sapiens
cctgcctcaggactctgcatat

SEQ ID NO: 7610271 - DNA, 23 bp, Homo sapiens
cctgccggacctggtggggagac

SEQ ID NO: 7610272 - DNA, 22 bp, Homo sapiens
cctgcccttctttccccagcat

SEQ ID NO: 7610273 - DNA, 22 bp, Homo sapiens
cctgcccttctttccccagcat

SEQ ID NO: 7610274 - DNA, 22 bp, Homo sapiens
cctgcccttctttccccagcat

SEQ ID NO: 7610275 - DNA, 22 bp, Homo sapiens
cctgcccttctttccccagcat

SEQ ID NO: 7610276 - DNA, 22 bp, Homo sapiens
cctgcccttctttccccagcat

SEQ ID NO: 7610277 - DNA, 22 bp, Homo sapiens
cctgcccttctttccccagcat

SEQ ID NO: 7610278 - DNA, 22 bp, Homo sapiens
cctgcccttctttccccagcat

SEQ ID NO: 7610279 - DNA, 22 bp, Homo sapiens
cctgcccttctttccccagcat

SEQ ID NO: 7610280 - DNA, 22 bp, Homo sapiens
cctgccctgtcactggctaggg

SEQ ID NO: 7610281 - DNA, 22 bp, Homo sapiens
cctgccctgtgtttggggacta

SEQ ID NO: 7610282 - DNA, 22 bp, Homo sapiens
cctgccctgtgtttggggacta

SEQ ID NO: 7610283 - DNA, 22 bp, Homo sapiens
cctgccctgtgtttggggacta

SEQ ID NO: 7610284 - DNA, 22 bp, Homo sapiens
cctgccctgtgtttggggacta

SEQ ID NO: 7610285 - DNA, 22 bp, Homo sapiens
cctgccctgtgtttggggacta

SEQ ID NO: 7610286 - DNA, 22 bp, Homo sapiens
cctgcccttctttccccagcat

SEQ ID NO: 7610287 - DNA, 22 bp, Homo sapiens
cctgcccttctttccccagcat

SEQ ID NO: 7610288 - DNA, 22 bp, Homo sapiens
cctgcccttctttccccagcat

SEQ ID NO: 7610289 - DNA, 22 bp, Homo sapiens
cctgccctgtcactggctaggg

SEQ ID NO: 7610290 - DNA, 22 bp, Homo sapiens
cctgccctgtgtttggggacta

SEQ ID NO: 7610291 - DNA, 22 bp, Homo sapiens
cctgccctgtgtttggggacta

SEQ ID NO: 7610292 - DNA, 22 bp, Homo sapiens
tggttagacacatgcatgtcat

SEQ ID NO: 7610293 - DNA, 22 bp, Homo sapiens
tggttacccagtcgctggagtt

SEQ ID NO: 7610294 - DNA, 22 bp, Homo sapiens
tggttacatatcctttggagcc

SEQ ID NO: 7610295 - DNA, 22 bp, Homo sapiens
tggtgggagtccgctgtgctgc

SEQ ID NO: 7610296 - DNA, 22 bp, Homo sapiens
tggttacataagaatagcactg

SEQ ID NO: 7610297 - DNA, 22 bp, Homo sapiens
tggttacagagatttttaagat

SEQ ID NO: 7610298 - DNA, 22 bp, Homo sapiens
tggttacatatcctttggagcc

SEQ ID NO: 7610299 - DNA, 22 bp, Homo sapiens
tggtgggagtccgctgtgctgc

SEQ ID NO: 7610300 - DNA, 22 bp, Homo sapiens
tggtgggagtccgctgtgctgc

SEQ ID NO: 7610301 - DNA, 22 bp, Homo sapiens
cctgcctgcagaaagtatctcc

SEQ ID NO: 7610302 - DNA, 22 bp, Homo sapiens
tggtgggacatctgaggagagg

SEQ ID NO: 7610303 - DNA, 22 bp, Homo sapiens
tggtgggagtccgctgtgctgc

SEQ ID NO: 7610304 - DNA, 22 bp, Homo sapiens
cctgcctgcagaaagtatctcc

SEQ ID NO: 7610305 - DNA, 22 bp, Homo sapiens
cctgcctgcagaaagtatctcc

SEQ ID NO: 7610306 - DNA, 22 bp, Homo sapiens
cctgcctgcagaaagtatctcc

SEQ ID NO: 7610307 - DNA, 22 bp, Homo sapiens
cctgcctgcaccttctctgggg

SEQ ID NO: 7610308 - DNA, 22 bp, Homo sapiens
cctgcctgcagaaagtatctcc

SEQ ID NO: 7610309 - DNA, 22 bp, Homo sapiens
cctgcctgcagaaagtatctcc

SEQ ID NO: 7610310 - DNA, 22 bp, Homo sapiens
cctgcctgcaccttctctgggg

SEQ ID NO: 7610311 - DNA, 22 bp, Homo sapiens
cctgcctgcaccttctctgggg

SEQ ID NO: 7610312 - DNA, 22 bp, Homo sapiens
cctgcctgcaccttctctgggg

SEQ ID NO: 7610313 - DNA, 22 bp, Homo sapiens
cctgcctgcaccttctctgggg

SEQ ID NO: 7610314 - DNA, 22 bp, Homo sapiens
cctgcctgcaccttctctgggg

SEQ ID NO: 7610315 - DNA, 22 bp, Homo sapiens
cctgcctgcaaaatgggacaag

SEQ ID NO: 7610316 - DNA, 22 bp, Homo sapiens
cctgcctgcaaaatgggacaag

SEQ ID NO: 7610317 - DNA, 22 bp, Homo sapiens
cctgcctgcaaaatgggacaag

SEQ ID NO: 7610318 - DNA, 22 bp, Homo sapiens
cctgcctgattccaggatggct

SEQ ID NO: 7610319 - DNA, 22 bp, Homo sapiens
cctgcctgcaaaatgggacaag

SEQ ID NO: 7610320 - DNA, 22 bp, Homo sapiens
cctgcctgcaaaatgggacaag

SEQ ID NO: 7610321 - DNA, 22 bp, Homo sapiens
cctgcctgattccaggatggct

SEQ ID NO: 7610322 - DNA, 22 bp, Homo sapiens
cctgcctgattccaggatggct

SEQ ID NO: 7610323 - DNA, 19 bp, Homo sapiens
cctgcctgaccccggctac

SEQ ID NO: 7610324 - DNA, 19 bp, Homo sapiens
cctgcctgaccccggctac

SEQ ID NO: 7610325 - DNA, 19 bp, Homo sapiens
cctgcctgaccccggctac

SEQ ID NO: 7610326 - DNA, 22 bp, Homo sapiens
cctgcctgacagagaaggttca

SEQ ID NO: 7610327 - DNA, 22 bp, Homo sapiens
cctgcctgaaggtcagccaccc

SEQ ID NO: 7610328 - DNA, 22 bp, Homo sapiens
cctgcctgattccaggatggct

SEQ ID NO: 7610329 - DNA, 22 bp, Homo sapiens
cctgcctgattccaggatggct

SEQ ID NO: 7610330 - DNA, 19 bp, Homo sapiens
cctgcctgagctgtccctc

SEQ ID NO: 7610331 - DNA, 19 bp, Homo sapiens
cctgcctgagctgtccctc

SEQ ID NO: 7610332 - DNA, 19 bp, Homo sapiens
cctgcctgagctgtccctc

SEQ ID NO: 7610333 - DNA, 19 bp, Homo sapiens
cctgcctgagctgtccctc

SEQ ID NO: 7610334 - DNA, 17 bp, Homo sapiens
cctgcctgagccatagc

SEQ ID NO: 7610335 - DNA, 17 bp, Homo sapiens
cctgcctgagccatagc

SEQ ID NO: 7610336 - DNA, 17 bp, Homo sapiens
cctgcctgagccatagc

SEQ ID NO: 7610337 - DNA, 17 bp, Homo sapiens
cctgcctgagccatagc

SEQ ID NO: 7610338 - DNA, 22 bp, Homo sapiens
cctgcctgaaggtcagccaccc

SEQ ID NO: 7610339 - DNA, 22 bp, Homo sapiens
cctgcctgaaggtcagccaccc

SEQ ID NO: 7610340 - DNA, 22 bp, Homo sapiens
cctgcctgaaggtcagccaccc

SEQ ID NO: 7610341 - DNA, 22 bp, Homo sapiens
cctgcctgaaggtcagccaccc

SEQ ID NO: 7610342 - DNA, 22 bp, Homo sapiens
cctgcctgaaggtcagccaccc

SEQ ID NO: 7610343 - DNA, 23 bp, Homo sapiens
cctgcctccccatcagttataca

SEQ ID NO: 7610344 - DNA, 23 bp, Homo sapiens
cctgcctccccatcagttataca

SEQ ID NO: 7610345 - DNA, 23 bp, Homo sapiens
cctgcctccccatcagttataca

SEQ ID NO: 7610346 - DNA, 23 bp, Homo sapiens
cctgcctccccatcagttataca

SEQ ID NO: 7610347 - DNA, 23 bp, Homo sapiens
cctgcctccccatcagttataca

SEQ ID NO: 7610348 - DNA, 22 bp, Homo sapiens
cctgcctcccagaggtcctcta

SEQ ID NO: 7610349 - DNA, 22 bp, Homo sapiens
cctgcctcccagaggtcctcta

SEQ ID NO: 7610350 - DNA, 22 bp, Homo sapiens
cctgcctcccagaggtcctcta

SEQ ID NO: 7610351 - DNA, 22 bp, Homo sapiens
cctgcctcccagaggtcctcta

SEQ ID NO: 7610352 - DNA, 22 bp, Homo sapiens
cctgcctcccagaggtcctcta

SEQ ID NO: 7610353 - DNA, 22 bp, Homo sapiens
cctgcctcccagaggtcctcta

SEQ ID NO: 7610354 - DNA, 22 bp, Homo sapiens
cctgcctcccagaggtcctcta

SEQ ID NO: 7610355 - DNA, 22 bp, Homo sapiens
cctgcctcatcaacttgtcgtg

SEQ ID NO: 7610356 - DNA, 22 bp, Homo sapiens
cctgcctcatcaacttgtcgtg

SEQ ID NO: 7610357 - DNA, 22 bp, Homo sapiens
cctgcagggaatcgaggcagaa

SEQ ID NO: 7610358 - DNA, 22 bp, Homo sapiens
cctgcagggaatcgaggcagaa

SEQ ID NO: 7610359 - DNA, 22 bp, Homo sapiens
cctgcagggaatcgaggcagaa

SEQ ID NO: 7610360 - DNA, 22 bp, Homo sapiens
cctgcagggaatcgaggcagaa

SEQ ID NO: 7610361 - DNA, 22 bp, Homo sapiens
cctgcagggaatcgaggcagaa

SEQ ID NO: 7610362 - DNA, 22 bp, Homo sapiens
cctgcagggaatcgaggcagaa

SEQ ID NO: 7610363 - DNA, 22 bp, Homo sapiens
cctgcaggctgcaggccagttc

SEQ ID NO: 7610364 - DNA, 22 bp, Homo sapiens
cctgcaggctgcaggccagttc

SEQ ID NO: 7610365 - DNA, 22 bp, Homo sapiens
cctgcaggctgcaggccagttc

SEQ ID NO: 7610366 - DNA, 22 bp, Homo sapiens
cctgcaggctgcaggccagttc

SEQ ID NO: 7610367 - DNA, 22 bp, Homo sapiens
cctgcagggaatcgaggcagaa

SEQ ID NO: 7610368 - DNA, 22 bp, Homo sapiens
cctgcagggaatcgaggcagaa

SEQ ID NO: 7610369 - DNA, 22 bp, Homo sapiens
cctgcaggctgcaggccagttc

SEQ ID NO: 7610370 - DNA, 22 bp, Homo sapiens
cctgcaggctgcaggccagttc

SEQ ID NO: 7610371 - DNA, 22 bp, Homo sapiens
cctgcaggctgcaggccagttc

SEQ ID NO: 7610372 - DNA, 22 bp, Homo sapiens
cctgcaggctgcaggccagttc

SEQ ID NO: 7610373 - DNA, 22 bp, Homo sapiens
cctgcaggctgcaggccagttc

SEQ ID NO: 7610374 - DNA, 22 bp, Homo sapiens
cctgcaggctgcaggccagttc

SEQ ID NO: 7610375 - DNA, 22 bp, Homo sapiens
cctgcaggctgcaggccagttc

SEQ ID NO: 7610376 - DNA, 22 bp, Homo sapiens
cctgcaggctgcaggccagttc

SEQ ID NO: 7610377 - DNA, 22 bp, Homo sapiens
cctgcagctttgcctcctgaac

SEQ ID NO: 7610378 - DNA, 22 bp, Homo sapiens
cctgcagctttgcctcctgaac

SEQ ID NO: 7610379 - DNA, 22 bp, Homo sapiens
cctgcagctttgcctcctgaac

SEQ ID NO: 7610380 - DNA, 22 bp, Homo sapiens
cctgcagctttgcctcctgaac

SEQ ID NO: 7610381 - DNA, 22 bp, Homo sapiens
tggggagcccactcacctcccc

SEQ ID NO: 7610382 - DNA, 22 bp, Homo sapiens
cctgcagctttgcctcctgaac

SEQ ID NO: 7610383 - DNA, 22 bp, Homo sapiens
cctgcagaccacactcagtcct

SEQ ID NO: 7610384 - DNA, 22 bp, Homo sapiens
cctgcagacacttgtccagcaa

SEQ ID NO: 7610385 - DNA, 22 bp, Homo sapiens
cctgcagaccacactcagtcct

SEQ ID NO: 7610386 - DNA, 22 bp, Homo sapiens
cctgcagaccacactcagtcct

SEQ ID NO: 7610387 - DNA, 22 bp, Homo sapiens
cctgcagctgtaggagaaggcg

SEQ ID NO: 7610388 - DNA, 22 bp, Homo sapiens
cctgcagctgtaggagaaggcg

SEQ ID NO: 7610389 - DNA, 22 bp, Homo sapiens
cctgcagctgtaggagaaggcg

SEQ ID NO: 7610390 - DNA, 22 bp, Homo sapiens
cctgcagctgtaggagaaggcg

SEQ ID NO: 7610391 - DNA, 22 bp, Homo sapiens
tggggagaggtatcattgagat

SEQ ID NO: 7610392 - DNA, 22 bp, Homo sapiens
tggggagaggtatcattgagat

SEQ ID NO: 7610393 - DNA, 22 bp, Homo sapiens
tggggagaggtatcattgagat

SEQ ID NO: 7610394 - DNA, 22 bp, Homo sapiens
tggggagaggtatcattgagat

SEQ ID NO: 7610395 - DNA, 22 bp, Homo sapiens
tggggagagttacaaggaatct

SEQ ID NO: 7610396 - DNA, 22 bp, Homo sapiens
tggggagaggaatttgaatgat

SEQ ID NO: 7610397 - DNA, 22 bp, Homo sapiens
tggggagaggaatttgaatgat

SEQ ID NO: 7610398 - DNA, 22 bp, Homo sapiens
tggggagagattgaggagtttt

SEQ ID NO: 7610399 - DNA, 22 bp, Homo sapiens
tggggagaggtatcattgagat

SEQ ID NO: 7610400 - DNA, 22 bp, Homo sapiens
tggggagaggaatttgaatgat

SEQ ID NO: 7610401 - DNA, 22 bp, Homo sapiens
tggggagagaccggaatgtttc

SEQ ID NO: 7610402 - DNA, 22 bp, Homo sapiens
tggggagagaccggaatgtttc

SEQ ID NO: 7610403 - DNA, 22 bp, Homo sapiens
tggggagagaccggaatgtttc

SEQ ID NO: 7610404 - DNA, 22 bp, Homo sapiens
tggggagagattgaggagtttt

SEQ ID NO: 7610405 - DNA, 22 bp, Homo sapiens
tggggagagattgaggagtttt

SEQ ID NO: 7610406 - DNA, 22 bp, Homo sapiens
tggggagagattgaggagtttt

SEQ ID NO: 7610407 - DNA, 22 bp, Homo sapiens
tggggagagattgaggagtttt

SEQ ID NO: 7610408 - DNA, 22 bp, Homo sapiens
tggggagagattgaggagtttt

SEQ ID NO: 7610409 - DNA, 22 bp, Homo sapiens
tggggagagattgaggagtttt

SEQ ID NO: 7610410 - DNA, 22 bp, Homo sapiens
tggggagagattgaggagtttt

SEQ ID NO: 7610411 - DNA, 22 bp, Homo sapiens
tggggagagttacaaggaatct

SEQ ID NO: 7610412 - DNA, 23 bp, Homo sapiens
tggggagagttaccctggaagcg

SEQ ID NO: 7610413 - DNA, 23 bp, Homo sapiens
tggggagagttaccctggaagcg

SEQ ID NO: 7610414 - DNA, 22 bp, Homo sapiens
tggggagagttacaaggaatct

SEQ ID NO: 7610415 - DNA, 22 bp, Homo sapiens
tggggagagttacaaggaatct

SEQ ID NO: 7610416 - DNA, 23 bp, Homo sapiens
tggggagagttaccctggaagcg

SEQ ID NO: 7610417 - DNA, 23 bp, Homo sapiens
tggggagagttaccctggaagcg

SEQ ID NO: 7610418 - DNA, 22 bp, Homo sapiens
tggggagcacggtagggaaatg

SEQ ID NO: 7610419 - DNA, 22 bp, Homo sapiens
tggggagcacggtagggaaatg

SEQ ID NO: 7610420 - DNA, 22 bp, Homo sapiens
tggggagattgttaaatttaga

SEQ ID NO: 7610421 - DNA, 22 bp, Homo sapiens
tggggagcacggtagggaaatg

SEQ ID NO: 7610422 - DNA, 22 bp, Homo sapiens
tggggagcacggtagggaaatg

SEQ ID NO: 7610423 - DNA, 22 bp, Homo sapiens
tggggagcacggtagggaaatg

SEQ ID NO: 7610424 - DNA, 22 bp, Homo sapiens
tggggagcacggtagggaaatg

SEQ ID NO: 7610425 - DNA, 22 bp, Homo sapiens
cctgcagaccacactcagtcct

SEQ ID NO: 7610426 - DNA, 22 bp, Homo sapiens
cctgcagaccacactcagtcct

SEQ ID NO: 7610427 - DNA, 22 bp, Homo sapiens
cctgcagacacttgtccagcaa

SEQ ID NO: 7610428 - DNA, 22 bp, Homo sapiens
cctgcagacacttgtccagcaa

SEQ ID NO: 7610429 - DNA, 22 bp, Homo sapiens
cctgatcaaagaggtcagcatt

SEQ ID NO: 7610430 - DNA, 22 bp, Homo sapiens
cctgatattaagaaggagtgag

SEQ ID NO: 7610431 - DNA, 22 bp, Homo sapiens
cctgatggagccctgctgcatg

SEQ ID NO: 7610432 - DNA, 22 bp, Homo sapiens
cctgatggagccctgctgcatg

SEQ ID NO: 7610433 - DNA, 22 bp, Homo sapiens
cctgataacacagatacaagat

SEQ ID NO: 7610434 - DNA, 19 bp, Homo sapiens
cctgagtgtttcagagaca

SEQ ID NO: 7610435 - DNA, 19 bp, Homo sapiens
cctgagtgtttcagagaca

SEQ ID NO: 7610436 - DNA, 22 bp, Homo sapiens
cctgagttcttatttccagtca

SEQ ID NO: 7610437 - DNA, 22 bp, Homo sapiens
cctgagttagttgctgtgtctc

SEQ ID NO: 7610438 - DNA, 22 bp, Homo sapiens
cctgagttgtcagttgctgtag

SEQ ID NO: 7610439 - DNA, 22 bp, Homo sapiens
cctgagttgtcagttgctgtag

SEQ ID NO: 7610440 - DNA, 22 bp, Homo sapiens
cctgagttcttatttccagtca

SEQ ID NO: 7610441 - DNA, 22 bp, Homo sapiens
cctgatggagccctgctgcatg

SEQ ID NO: 7610442 - DNA, 19 bp, Homo sapiens
cctgatggagctggtgcaa

SEQ ID NO: 7610443 - DNA, 19 bp, Homo sapiens
cctgatggagctggtgcaa

SEQ ID NO: 7610444 - DNA, 22 bp, Homo sapiens
cctgatggagccctgctgcatg

SEQ ID NO: 7610445 - DNA, 20 bp, Homo sapiens
cctgatcacaagggtccttg

SEQ ID NO: 7610446 - DNA, 22 bp, Homo sapiens
tggggagaaatgtctttgttcc

SEQ ID NO: 7610447 - DNA, 22 bp, Homo sapiens
tggggagaaatgtctttgttcc

SEQ ID NO: 7610448 - DNA, 22 bp, Homo sapiens
tggggacttgccttgttgctca

SEQ ID NO: 7610449 - DNA, 22 bp, Homo sapiens
tggggacttgccttgttgctca

SEQ ID NO: 7610450 - DNA, 22 bp, Homo sapiens
tggggagaagcaatagactcta

SEQ ID NO: 7610451 - DNA, 22 bp, Homo sapiens
tggggagactggccgagatcct

SEQ ID NO: 7610452 - DNA, 22 bp, Homo sapiens
tggggagactggccgagatcct

SEQ ID NO: 7610453 - DNA, 22 bp, Homo sapiens
tggggagactggccgagatcct

SEQ ID NO: 7610454 - DNA, 22 bp, Homo sapiens
tggggagagaccggaatgtttc

SEQ ID NO: 7610455 - DNA, 22 bp, Homo sapiens
tggggagagaccggaatgtttc

SEQ ID NO: 7610456 - DNA, 22 bp, Homo sapiens
tggggagagaccggaatgtttc

SEQ ID NO: 7610457 - DNA, 22 bp, Homo sapiens
tggggagaagcaatagactcta

SEQ ID NO: 7610458 - DNA, 22 bp, Homo sapiens
tggggagaagcaatagactcta

SEQ ID NO: 7610459 - DNA, 22 bp, Homo sapiens
tggggagaagcaatagactcta

SEQ ID NO: 7610460 - DNA, 22 bp, Homo sapiens
tggggagaagcaatagactcta

SEQ ID NO: 7610461 - DNA, 22 bp, Homo sapiens
tggggagactggccgagatcct

SEQ ID NO: 7610462 - DNA, 22 bp, Homo sapiens
tggggagaagcaatagactcta

SEQ ID NO: 7610463 - DNA, 22 bp, Homo sapiens
cctgagtgtaataatgaaggca

SEQ ID NO: 7610464 - DNA, 22 bp, Homo sapiens
cctgagtgtaataatgaaggca

SEQ ID NO: 7610465 - DNA, 22 bp, Homo sapiens
cctgagtggtgctaagcagata

SEQ ID NO: 7610466 - DNA, 22 bp, Homo sapiens
cctgagtggtgctaagcagata

SEQ ID NO: 7610467 - DNA, 22 bp, Homo sapiens
cctgagtggtgctaagcagata

SEQ ID NO: 7610468 - DNA, 22 bp, Homo sapiens
cctgagtggtgctaagcagata

SEQ ID NO: 7610469 - DNA, 22 bp, Homo sapiens
cctgagtggggagctaagtgag

SEQ ID NO: 7610470 - DNA, 22 bp, Homo sapiens
cctgagtggggagctaagtgag

SEQ ID NO: 7610471 - DNA, 17 bp, Homo sapiens
cctgagtgggagaggaa

SEQ ID NO: 7610472 - DNA, 17 bp, Homo sapiens
cctgagtgggagaggaa

SEQ ID NO: 7610473 - DNA, 17 bp, Homo sapiens
cctgagtgggagaggaa

SEQ ID NO: 7610474 - DNA, 22 bp, Homo sapiens
cctgagtggcagggtttgggct

SEQ ID NO: 7610475 - DNA, 22 bp, Homo sapiens
cctgagtggccaggcagctgtg

SEQ ID NO: 7610476 - DNA, 22 bp, Homo sapiens
cctgagtggccaggcagctgtg

SEQ ID NO: 7610477 - DNA, 22 bp, Homo sapiens
cctgagtggccaggcagctgtg

SEQ ID NO: 7610478 - DNA, 22 bp, Homo sapiens
cctgagtggccaggcagctgtg

SEQ ID NO: 7610479 - DNA, 22 bp, Homo sapiens
cctgagtggccaggcagctgtg

SEQ ID NO: 7610480 - DNA, 22 bp, Homo sapiens
cctgagtggccaggcagctgtg

SEQ ID NO: 7610481 - DNA, 22 bp, Homo sapiens
cctgagtggagggattctgcag

SEQ ID NO: 7610482 - DNA, 22 bp, Homo sapiens
cctgagtgcttccagagtcatg

SEQ ID NO: 7610483 - DNA, 22 bp, Homo sapiens
cctgagtggagggattctgcag

SEQ ID NO: 7610484 - DNA, 22 bp, Homo sapiens
cctgagtgcttccagagtcatg

SEQ ID NO: 7610485 - DNA, 22 bp, Homo sapiens
cctgagtgcttccagagtcatg

SEQ ID NO: 7610486 - DNA, 22 bp, Homo sapiens
cctgagtgcttccagagtcatg

SEQ ID NO: 7610487 - DNA, 22 bp, Homo sapiens
cctgagtgacctgaggtctagt

SEQ ID NO: 7610488 - DNA, 22 bp, Homo sapiens
cctgagtgaattccctcactgt

SEQ ID NO: 7610489 - DNA, 21 bp, Homo sapiens
cctgagtgagacctggcccgt

SEQ ID NO: 7610490 - DNA, 21 bp, Homo sapiens
cctgagtgagacctggcccgt

SEQ ID NO: 7610491 - DNA, 21 bp, Homo sapiens
cctgagtgagacctggcccgt

SEQ ID NO: 7610492 - DNA, 21 bp, Homo sapiens
cctgagtgagacctggcccgt

SEQ ID NO: 7610493 - DNA, 22 bp, Homo sapiens
cctgagtgacctgaggtctagt

SEQ ID NO: 7610494 - DNA, 22 bp, Homo sapiens
cctgagtgccatgagagcaccc

SEQ ID NO: 7610495 - DNA, 22 bp, Homo sapiens
cctgagtgccatgagagcaccc

SEQ ID NO: 7610496 - DNA, 22 bp, Homo sapiens
cctgagtgccatgagagcaccc

SEQ ID NO: 7610497 - DNA, 21 bp, Homo sapiens
cctgagtgagacctggcccgt

SEQ ID NO: 7610498 - DNA, 22 bp, Homo sapiens
cctgaggtcatggtccagtgtt

SEQ ID NO: 7610499 - DNA, 22 bp, Homo sapiens
cctgaggtctagagtcagggtg

SEQ ID NO: 7610500 - DNA, 22 bp, Homo sapiens
cctgagtctttcccattgcgct

SEQ ID NO: 7610501 - DNA, 22 bp, Homo sapiens
cctgagtgaattccctcactgt

SEQ ID NO: 7610502 - DNA, 22 bp, Homo sapiens
tgggctcatgtttctttgagga

SEQ ID NO: 7610503 - DNA, 19 bp, Homo sapiens
tgggctcattcaggtggtt

SEQ ID NO: 7610504 - DNA, 19 bp, Homo sapiens
tgggctcattcaggtggtt

SEQ ID NO: 7610505 - DNA, 19 bp, Homo sapiens
tgggctcattcaggtggtt

SEQ ID NO: 7610506 - DNA, 22 bp, Homo sapiens
tgggctcatgtttctttgagga

SEQ ID NO: 7610507 - DNA, 22 bp, Homo sapiens
tgggctcatggcccagcactgg

SEQ ID NO: 7610508 - DNA, 22 bp, Homo sapiens
tgggctcatggcccagcactgg

SEQ ID NO: 7610509 - DNA, 22 bp, Homo sapiens
tgggctcatgtttatacatatc

SEQ ID NO: 7610510 - DNA, 22 bp, Homo sapiens
tgggctcatggcccagcactgg

SEQ ID NO: 7610511 - DNA, 22 bp, Homo sapiens
tgggctcatgtttctttgagga

SEQ ID NO: 7610512 - DNA, 22 bp, Homo sapiens
tgggctcatgtttatacatatc

SEQ ID NO: 7610513 - DNA, 22 bp, Homo sapiens
tgggctccaatttgtcctttca

SEQ ID NO: 7610514 - DNA, 19 bp, Homo sapiens
tgggctcattcaggtggtt

SEQ ID NO: 7610515 - DNA, 22 bp, Homo sapiens
tgggctccagcacctgtgctct

SEQ ID NO: 7610516 - DNA, 22 bp, Homo sapiens
tgggctccagcacctgtgctct

SEQ ID NO: 7610517 - DNA, 22 bp, Homo sapiens
tgggctccagcacctgtgctct

SEQ ID NO: 7610518 - DNA, 22 bp, Homo sapiens
tgggctccagcacctgtgctct

SEQ ID NO: 7610519 - DNA, 22 bp, Homo sapiens
tgggctccagcacctgtgctct

SEQ ID NO: 7610520 - DNA, 22 bp, Homo sapiens
tgggctccggcggcctcaggct

SEQ ID NO: 7610521 - DNA, 22 bp, Homo sapiens
tgggctccggcggcctcaggct

SEQ ID NO: 7610522 - DNA, 22 bp, Homo sapiens
tgggctccggcggcctcaggct

SEQ ID NO: 7610523 - DNA, 22 bp, Homo sapiens
tgggctccggcggcctcaggct

SEQ ID NO: 7610524 - DNA, 22 bp, Homo sapiens
tgggctccggcggcctcaggct

SEQ ID NO: 7610525 - DNA, 22 bp, Homo sapiens
tgggctccggcggcctcaggct

SEQ ID NO: 7610526 - DNA, 22 bp, Homo sapiens
tgggctccggcggcctcaggct

SEQ ID NO: 7610527 - DNA, 22 bp, Homo sapiens
tgggctccggcggcctcaggct

SEQ ID NO: 7610528 - DNA, 22 bp, Homo sapiens
tgggctccgttgcctggggcag

SEQ ID NO: 7610529 - DNA, 22 bp, Homo sapiens
tgggctccgttgcctggggcag

SEQ ID NO: 7610530 - DNA, 22 bp, Homo sapiens
tgggctccgttgcctggggcag

SEQ ID NO: 7610531 - DNA, 22 bp, Homo sapiens
tgggctccgttgcctggggcag

SEQ ID NO: 7610532 - DNA, 22 bp, Homo sapiens
tgggctccgttgcctggggcag

SEQ ID NO: 7610533 - DNA, 22 bp, Homo sapiens
tgggctcctcgtcactcgctgt

SEQ ID NO: 7610534 - DNA, 22 bp, Homo sapiens
tgggcctggccctgtggaggag

SEQ ID NO: 7610535 - DNA, 22 bp, Homo sapiens
tgggcctggccctgtggaggag

SEQ ID NO: 7610536 - DNA, 22 bp, Homo sapiens
tgggcctggccctgtggaggag

SEQ ID NO: 7610537 - DNA, 22 bp, Homo sapiens
tgggcctggccctgtggaggag

SEQ ID NO: 7610538 - DNA, 22 bp, Homo sapiens
tgggcctggccctgtggaggag

SEQ ID NO: 7610539 - DNA, 22 bp, Homo sapiens
tgggcctggccctgtggaggag

SEQ ID NO: 7610540 - DNA, 22 bp, Homo sapiens
tgggcctggagtttgtccagag

SEQ ID NO: 7610541 - DNA, 22 bp, Homo sapiens
tgggcctggccctgtggaggag

SEQ ID NO: 7610542 - DNA, 22 bp, Homo sapiens
tgggcctggccctgtggaggag

SEQ ID NO: 7610543 - DNA, 22 bp, Homo sapiens
tgggcctggccctgtggaggag

SEQ ID NO: 7610544 - DNA, 23 bp, Homo sapiens
tgggcctggcctcccagtccagc

SEQ ID NO: 7610545 - DNA, 23 bp, Homo sapiens
tgggcctggcctcccagtccagc

SEQ ID NO: 7610546 - DNA, 23 bp, Homo sapiens
tgggcctggcctcccagtccagc

SEQ ID NO: 7610547 - DNA, 22 bp, Homo sapiens
tgggcctggccctgtggaggag

SEQ ID NO: 7610548 - DNA, 22 bp, Homo sapiens
tgggcctggccctgtggaggag

SEQ ID NO: 7610549 - DNA, 22 bp, Homo sapiens
tgggcctggccctgtggaggag

SEQ ID NO: 7610550 - DNA, 23 bp, Homo sapiens
tgggcctggcctcccagtccagc

SEQ ID NO: 7610551 - DNA, 23 bp, Homo sapiens
tgggcctggcctcccagtccagc

SEQ ID NO: 7610552 - DNA, 23 bp, Homo sapiens
tgggcctggcctcccagtccagc

SEQ ID NO: 7610553 - DNA, 23 bp, Homo sapiens
tgggcctggcctcccagtccagc

SEQ ID NO: 7610554 - DNA, 23 bp, Homo sapiens
tgggcctggcctcccagtccagc

SEQ ID NO: 7610555 - DNA, 22 bp, Homo sapiens
tgggcctgggagggcagacgct

SEQ ID NO: 7610556 - DNA, 22 bp, Homo sapiens
tgggcctgggagggcagacgct

SEQ ID NO: 7610557 - DNA, 22 bp, Homo sapiens
tgggcctgggagggcagacgct

SEQ ID NO: 7610558 - DNA, 22 bp, Homo sapiens
tgggcctgggagggcagacgct

SEQ ID NO: 7610559 - DNA, 22 bp, Homo sapiens
tgggcctgggagggcagacgct

SEQ ID NO: 7610560 - DNA, 22 bp, Homo sapiens
tgggcctgggagggcagacgct

SEQ ID NO: 7610561 - DNA, 22 bp, Homo sapiens
tgggctcatgctggagatgaga

SEQ ID NO: 7610562 - DNA, 22 bp, Homo sapiens
tgggctcatgctggagatgaga

SEQ ID NO: 7610563 - DNA, 22 bp, Homo sapiens
tgggctcagtgggagaaagggc

SEQ ID NO: 7610564 - DNA, 22 bp, Homo sapiens
tgggcctgggagggcagacgct

SEQ ID NO: 7610565 - DNA, 22 bp, Homo sapiens
tgggctcagtgggagaaagggc

SEQ ID NO: 7610566 - DNA, 22 bp, Homo sapiens
tgggctcatggcccagcactgg

SEQ ID NO: 7610567 - DNA, 22 bp, Homo sapiens
tgggctcatggcccagcactgg

SEQ ID NO: 7610568 - DNA, 22 bp, Homo sapiens
tgggctcatggcccagcactgg

SEQ ID NO: 7610569 - DNA, 22 bp, Homo sapiens
tgggctcatgctggagatgaga

SEQ ID NO: 7610570 - DNA, 22 bp, Homo sapiens
tgggcaggcaagtgaatacctt

SEQ ID NO: 7610571 - DNA, 22 bp, Homo sapiens
tgggcaggcaagtgaatacctt

SEQ ID NO: 7610572 - DNA, 22 bp, Homo sapiens
tgggcaggcaagtgaatacctt

SEQ ID NO: 7610573 - DNA, 22 bp, Homo sapiens
tgggcaggcaagtgaatacctt

SEQ ID NO: 7610574 - DNA, 22 bp, Homo sapiens
tgggcaggcaagtgaatacctt

SEQ ID NO: 7610575 - DNA, 22 bp, Homo sapiens
tgggcaggcaagtgaatacctt

SEQ ID NO: 7610576 - DNA, 22 bp, Homo sapiens
tgggcaggcaagtgaatacctt

SEQ ID NO: 7610577 - DNA, 22 bp, Homo sapiens
tgggcaggcaagtgaatacctt

SEQ ID NO: 7610578 - DNA, 22 bp, Homo sapiens
tgggcaggcaagtgaatacctt

SEQ ID NO: 7610579 - DNA, 22 bp, Homo sapiens
tgggcaggcaagtgaatacctt

SEQ ID NO: 7610580 - DNA, 22 bp, Homo sapiens
tgggcaggcaagtgaatacctt

SEQ ID NO: 7610581 - DNA, 22 bp, Homo sapiens
tgggcaggatgcgttgattctt

SEQ ID NO: 7610582 - DNA, 22 bp, Homo sapiens
tgggcaggatgcgttgattctt

SEQ ID NO: 7610583 - DNA, 22 bp, Homo sapiens
tgggcaggatgcgttgattctt

SEQ ID NO: 7610584 - DNA, 22 bp, Homo sapiens
tgggcaggatgcgttgattctt

SEQ ID NO: 7610585 - DNA, 22 bp, Homo sapiens
tgggcaggatgcgttgattctt

SEQ ID NO: 7610586 - DNA, 22 bp, Homo sapiens
tgggcaggatgcgttgattctt

SEQ ID NO: 7610587 - DNA, 22 bp, Homo sapiens
tgggcaggatgcgttgattctt

SEQ ID NO: 7610588 - DNA, 22 bp, Homo sapiens
tgggcaggatgcgttgattctt

SEQ ID NO: 7610589 - DNA, 22 bp, Homo sapiens
tgggcaggataatatctcatgt

SEQ ID NO: 7610590 - DNA, 22 bp, Homo sapiens
tgggcaggataatatctcatgt

SEQ ID NO: 7610591 - DNA, 22 bp, Homo sapiens
tgggcaggataatatctcatgt

SEQ ID NO: 7610592 - DNA, 22 bp, Homo sapiens
tgggcaggataatatctcatgt

SEQ ID NO: 7610593 - DNA, 22 bp, Homo sapiens
tgggcaggatgcgttgattctt

SEQ ID NO: 7610594 - DNA, 22 bp, Homo sapiens
tgggcaggagagaagctaaaga

SEQ ID NO: 7610595 - DNA, 22 bp, Homo sapiens
tgggcaggagagaagctaaaga

SEQ ID NO: 7610596 - DNA, 22 bp, Homo sapiens
tgggcaggagagaagctaaaga

SEQ ID NO: 7610597 - DNA, 22 bp, Homo sapiens
tgggcaggataatatctcatgt

SEQ ID NO: 7610598 - DNA, 22 bp, Homo sapiens
tgggcaggataatatctcatgt

SEQ ID NO: 7610599 - DNA, 22 bp, Homo sapiens
tgggcaggataatatctcatgt

SEQ ID NO: 7610600 - DNA, 22 bp, Homo sapiens
tgggcaggataatatctcatgt

SEQ ID NO: 7610601 - DNA, 19 bp, Homo sapiens
tgggcctcacaatgctccc

SEQ ID NO: 7610602 - DNA, 22 bp, Homo sapiens
tgggcctggacaaggccactag

SEQ ID NO: 7610603 - DNA, 19 bp, Homo sapiens
tgggcctcacaatgctccc

SEQ ID NO: 7610604 - DNA, 22 bp, Homo sapiens
tgggcctggacaaggccactag

SEQ ID NO: 7610605 - DNA, 22 bp, Homo sapiens
tgggcctggacatctgtatttt

SEQ ID NO: 7610606 - DNA, 22 bp, Homo sapiens
tgggcctggacatctgtatttt

SEQ ID NO: 7610607 - DNA, 22 bp, Homo sapiens
tgggcctggacatctgtatttt

SEQ ID NO: 7610608 - DNA, 23 bp, Homo sapiens
tgggccggattgtgaaggacgtg

SEQ ID NO: 7610609 - DNA, 23 bp, Homo sapiens
tgggcccttggaatctctatttt

SEQ ID NO: 7610610 - DNA, 23 bp, Homo sapiens
tgggcccttggaatctctatttt

SEQ ID NO: 7610611 - DNA, 22 bp, Homo sapiens
tgggccgtggagcactctgaga

SEQ ID NO: 7610612 - DNA, 22 bp, Homo sapiens
tgggcctatatatggctgagag

SEQ ID NO: 7610613 - DNA, 21 bp, Homo sapiens
tgggcctcaagtgggtggcag

SEQ ID NO: 7610614 - DNA, 21 bp, Homo sapiens
tgggcctcaagtgggtggcag

SEQ ID NO: 7610615 - DNA, 21 bp, Homo sapiens
tgggcctcaagtgggtggcag

SEQ ID NO: 7610616 - DNA, 21 bp, Homo sapiens
tgggcctcaagtgggtggcag

SEQ ID NO: 7610617 - DNA, 22 bp, Homo sapiens
tgggcctggagtttgtccagag

SEQ ID NO: 7610618 - DNA, 22 bp, Homo sapiens
tgggcctggagtttgtccagag

SEQ ID NO: 7610619 - DNA, 22 bp, Homo sapiens
tgggcctggagtttgtccagag

SEQ ID NO: 7610620 - DNA, 22 bp, Homo sapiens
tgggcctggagtttgtccagag

SEQ ID NO: 7610621 - DNA, 22 bp, Homo sapiens
tgggcctggagtttgtccagag

SEQ ID NO: 7610622 - DNA, 22 bp, Homo sapiens
tgggcctggagtttgtccagag

SEQ ID NO: 7610623 - DNA, 22 bp, Homo sapiens
tgggcctggagtttgtccagag

SEQ ID NO: 7610624 - DNA, 22 bp, Homo sapiens
tgggcctggagtttgtccagag

SEQ ID NO: 7610625 - DNA, 22 bp, Homo sapiens
tgggcctggagtttgtccagag

SEQ ID NO: 7610626 - DNA, 22 bp, Homo sapiens
tgggcctggagtttgtccagag

SEQ ID NO: 7610627 - DNA, 22 bp, Homo sapiens
tgggcctggagccctggagagt

SEQ ID NO: 7610628 - DNA, 22 bp, Homo sapiens
tgggcctggagccctggagagt

SEQ ID NO: 7610629 - DNA, 22 bp, Homo sapiens
tgggcctggagccctggagagt

SEQ ID NO: 7610630 - DNA, 22 bp, Homo sapiens
tgggcctggagccctggagagt

SEQ ID NO: 7610631 - DNA, 22 bp, Homo sapiens
tgggcctggagccctggagagt

SEQ ID NO: 7610632 - DNA, 22 bp, Homo sapiens
tgggcctggagccctggagagt

SEQ ID NO: 7610633 - DNA, 22 bp, Homo sapiens
tgggcctggagccctggagagt

SEQ ID NO: 7610634 - DNA, 22 bp, Homo sapiens
tgggcctggagccctggagagt

SEQ ID NO: 7610635 - DNA, 22 bp, Homo sapiens
tggcagtgtgggaggaaggtac

SEQ ID NO: 7610636 - DNA, 22 bp, Homo sapiens
tggcagtgtgggaggaaggtac

SEQ ID NO: 7610637 - DNA, 22 bp, Homo sapiens
tggcagtgtgggaggaaggtac

SEQ ID NO: 7610638 - DNA, 19 bp, Homo sapiens
tggcagtgtggcttccaga

SEQ ID NO: 7610639 - DNA, 19 bp, Homo sapiens
tggcagtgtggcttccaga

SEQ ID NO: 7610640 - DNA, 19 bp, Homo sapiens
tggcagtgtggcttccaga

SEQ ID NO: 7610641 - DNA, 22 bp, Homo sapiens
tggcagtgtcttgctggggcag

SEQ ID NO: 7610642 - DNA, 19 bp, Homo sapiens
tggcagtgtggcttccaga

SEQ ID NO: 7610643 - DNA, 22 bp, Homo sapiens
tggcagtgtgggaggaaggtac

SEQ ID NO: 7610644 - DNA, 22 bp, Homo sapiens
tggcagtgtgggaggaaggtac

SEQ ID NO: 7610645 - DNA, 22 bp, Homo sapiens
tggcatttctgttagactctca

SEQ ID NO: 7610646 - DNA, 22 bp, Homo sapiens
tggcatttctgttagactctca

SEQ ID NO: 7610647 - DNA, 22 bp, Homo sapiens
tggcatttgagctggaaggatg

SEQ ID NO: 7610648 - DNA, 22 bp, Homo sapiens
tggcatttgctcccttgtgttc

SEQ ID NO: 7610649 - DNA, 22 bp, Homo sapiens
tggcatttgagctggaaggatg

SEQ ID NO: 7610650 - DNA, 22 bp, Homo sapiens
tggcatttgagctggaaggatg

SEQ ID NO: 7610651 - DNA, 22 bp, Homo sapiens
tggcatttggcttacttatgtt

SEQ ID NO: 7610652 - DNA, 19 bp, Homo sapiens
tggcatttggaggcaacct

SEQ ID NO: 7610653 - DNA, 19 bp, Homo sapiens
tggcatttggaggcaacct

SEQ ID NO: 7610654 - DNA, 22 bp, Homo sapiens
tggcatttgctcccttgtgttc

SEQ ID NO: 7610655 - DNA, 22 bp, Homo sapiens
tggcatttgctcccttgtgttc

SEQ ID NO: 7610656 - DNA, 22 bp, Homo sapiens
tggcagtgtcctactggttggt

SEQ ID NO: 7610657 - DNA, 22 bp, Homo sapiens
tggcagtgtcctactggttggt

SEQ ID NO: 7610658 - DNA, 22 bp, Homo sapiens
tggcagtgtcctactggttggt

SEQ ID NO: 7610659 - DNA, 22 bp, Homo sapiens
tggcagtgtcttatcaggagtg

SEQ ID NO: 7610660 - DNA, 22 bp, Homo sapiens
tggcagtgtcttatcaggagtg

SEQ ID NO: 7610661 - DNA, 22 bp, Homo sapiens
tggcagtgtataggtggctcct

SEQ ID NO: 7610662 - DNA, 22 bp, Homo sapiens
tggcagtgtataggtggctcct

SEQ ID NO: 7610663 - DNA, 22 bp, Homo sapiens
tggcagtggtgtctgcacaggc

SEQ ID NO: 7610664 - DNA, 22 bp, Homo sapiens
tggcagtgtataggtggctcct

SEQ ID NO: 7610665 - DNA, 22 bp, Homo sapiens
tggcagtgtcttatcaggagtg

SEQ ID NO: 7610666 - DNA, 22 bp, Homo sapiens
tggcagtgtcttatcaggagtg

SEQ ID NO: 7610667 - DNA, 22 bp, Homo sapiens
tggcagtgtcttgctggggcag

SEQ ID NO: 7610668 - DNA, 22 bp, Homo sapiens
tggcagtgtcttgctggggcag

SEQ ID NO: 7610669 - DNA, 22 bp, Homo sapiens
tggcagtgtcttgctggggcag

SEQ ID NO: 7610670 - DNA, 22 bp, Homo sapiens
tggcagtgtcttgctggggcag

SEQ ID NO: 7610671 - DNA, 22 bp, Homo sapiens
tggcagtgtcttgctggggcag

SEQ ID NO: 7610672 - DNA, 22 bp, Homo sapiens
tggcagtggtgtctgcacaggc

SEQ ID NO: 7610673 - DNA, 22 bp, Homo sapiens
tggcagtggtgtctgcacaggc

SEQ ID NO: 7610674 - DNA, 22 bp, Homo sapiens
tggcagtggtgtctgcacaggc

SEQ ID NO: 7610675 - DNA, 22 bp, Homo sapiens
tggcagtgtataggtggctcct

SEQ ID NO: 7610676 - DNA, 22 bp, Homo sapiens
tggcagtgtataggtggctcct

SEQ ID NO: 7610677 - DNA, 22 bp, Homo sapiens
tggcagtggtaccggctctcag

SEQ ID NO: 7610678 - DNA, 22 bp, Homo sapiens
tggcagtggtaccggctctcag

SEQ ID NO: 7610679 - DNA, 22 bp, Homo sapiens
tggcagtgggaagctggaagtc

SEQ ID NO: 7610680 - DNA, 22 bp, Homo sapiens
tggcagtgggaagctggaagtc

SEQ ID NO: 7610681 - DNA, 22 bp, Homo sapiens
tggcagtgggaagctggaagtc

SEQ ID NO: 7610682 - DNA, 22 bp, Homo sapiens
tggcagtgggaatggacaaaca

SEQ ID NO: 7610683 - DNA, 22 bp, Homo sapiens
tggcagtggtaccggctctcag

SEQ ID NO: 7610684 - DNA, 22 bp, Homo sapiens
tggcagtggtaccggctctcag

SEQ ID NO: 7610685 - DNA, 22 bp, Homo sapiens
tggcagtgggaagctggaagtc

SEQ ID NO: 7610686 - DNA, 22 bp, Homo sapiens
tggcagtgggaagctggaagtc

SEQ ID NO: 7610687 - DNA, 22 bp, Homo sapiens
tggcagtgggaagctggaagtc

SEQ ID NO: 7610688 - DNA, 22 bp, Homo sapiens
tggcagtgggaagctggaagtc

SEQ ID NO: 7610689 - DNA, 22 bp, Homo sapiens
tggcagtgggaagctggaagtc

SEQ ID NO: 7610690 - DNA, 22 bp, Homo sapiens
tggcagtgggaagctggaagtc

SEQ ID NO: 7610691 - DNA, 19 bp, Homo sapiens
tggcaggtagtgagcagtc

SEQ ID NO: 7610692 - DNA, 19 bp, Homo sapiens
tggcaggtagtgagcagtc

SEQ ID NO: 7610693 - DNA, 22 bp, Homo sapiens
tggcagtggctttgctggtgga

SEQ ID NO: 7610694 - DNA, 22 bp, Homo sapiens
tggcagtggctttgctggtgga

SEQ ID NO: 7610695 - DNA, 22 bp, Homo sapiens
tggcagtggctttgctggtgga

SEQ ID NO: 7610696 - DNA, 22 bp, Homo sapiens
tggcagtggctcagagtgcaga

SEQ ID NO: 7610697 - DNA, 23 bp, Homo sapiens
tggcattttagttagcttcagtg

SEQ ID NO: 7610698 - DNA, 22 bp, Homo sapiens
tggcattttagacatgatggtg

SEQ ID NO: 7610699 - DNA, 22 bp, Homo sapiens
tggcattttagacatgatggtg

SEQ ID NO: 7610700 - DNA, 22 bp, Homo sapiens
tggcattttccaatgatatgtt

SEQ ID NO: 7610701 - DNA, 22 bp, Homo sapiens
tggcattttccaatgatatgtt

SEQ ID NO: 7610702 - DNA, 23 bp, Homo sapiens
tggcattttagttagcttcagtg

SEQ ID NO: 7610703 - DNA, 22 bp, Homo sapiens
tggcattttgtagctgtgtatc

SEQ ID NO: 7610704 - DNA, 22 bp, Homo sapiens
tggcattttgtagctgtgtatc

SEQ ID NO: 7610705 - DNA, 22 bp, Homo sapiens
tggcattttctcctttgagttt

SEQ ID NO: 7610706 - DNA, 22 bp, Homo sapiens
tggcattttctcctttgagttt

SEQ ID NO: 7610707 - DNA, 22 bp, Homo sapiens
tggcattttccaatgatatgtt

SEQ ID NO: 7610708 - DNA, 22 bp, Homo sapiens
tggcattttctcctttgagttt

SEQ ID NO: 7610709 - DNA, 22 bp, Homo sapiens
tggcattttagacatgatggtg

SEQ ID NO: 7610710 - DNA, 22 bp, Homo sapiens
tggcattttagacatgatggtg

SEQ ID NO: 7610711 - DNA, 22 bp, Homo sapiens
tggcatttgtagccacttgcct

SEQ ID NO: 7610712 - DNA, 21 bp, Homo sapiens
tggcatttgtacagggacttt

SEQ ID NO: 7610713 - DNA, 21 bp, Homo sapiens
tggcatttgtacagggacttt

SEQ ID NO: 7610714 - DNA, 22 bp, Homo sapiens
tggcatttggcttacttatgtt

SEQ ID NO: 7610715 - DNA, 22 bp, Homo sapiens
tggcatttggcttacttatgtt

SEQ ID NO: 7610716 - DNA, 22 bp, Homo sapiens
tggcatttggcttacttatgtt

SEQ ID NO: 7610717 - DNA, 22 bp, Homo sapiens
tggcatttgggctggcttttct

SEQ ID NO: 7610718 - DNA, 22 bp, Homo sapiens
tggcatttgggctggcttttct

SEQ ID NO: 7610719 - DNA, 22 bp, Homo sapiens
tggcattttgttcagtatatgg

SEQ ID NO: 7610720 - DNA, 22 bp, Homo sapiens
tggcattttgttcagtatatgg

SEQ ID NO: 7610721 - DNA, 22 bp, Homo sapiens
tggcattttgttcagtatatgg

SEQ ID NO: 7610722 - DNA, 22 bp, Homo sapiens
tggcattttgttcagtatatgg

SEQ ID NO: 7610723 - DNA, 22 bp, Homo sapiens
tggcattttgttcagtatatgg

SEQ ID NO: 7610724 - DNA, 22 bp, Homo sapiens
tggccaaagtagaaaataatag

SEQ ID NO: 7610725 - DNA, 21 bp, Homo sapiens
tggccaaactggagcatttga

SEQ ID NO: 7610726 - DNA, 23 bp, Homo sapiens
tggccaagataatctcagttttc

SEQ ID NO: 7610727 - DNA, 23 bp, Homo sapiens
tggccaagataatctcagttttc

SEQ ID NO: 7610728 - DNA, 23 bp, Homo sapiens
tggccaagataatctcagttttc

SEQ ID NO: 7610729 - DNA, 22 bp, Homo sapiens
tggccaagccactgctgggtct

SEQ ID NO: 7610730 - DNA, 22 bp, Homo sapiens
tggccaagccactgctgggtct

SEQ ID NO: 7610731 - DNA, 22 bp, Homo sapiens
tggccaagatgcgacctctcag

SEQ ID NO: 7610732 - DNA, 21 bp, Homo sapiens
tggccaaggaatagaagctct

SEQ ID NO: 7610733 - DNA, 21 bp, Homo sapiens
tggccaaggaatagaagctct

SEQ ID NO: 7610734 - DNA, 22 bp, Homo sapiens
tggccaagccactgctgggtct

SEQ ID NO: 7610735 - DNA, 22 bp, Homo sapiens
tggccaagccactgctgggtct

SEQ ID NO: 7610736 - DNA, 22 bp, Homo sapiens
cctccagggcagacggggagca

SEQ ID NO: 7610737 - DNA, 22 bp, Homo sapiens
cctccagggcccctctcactgg

SEQ ID NO: 7610738 - DNA, 22 bp, Homo sapiens
cctccagggcccctctcactgg

SEQ ID NO: 7610739 - DNA, 22 bp, Homo sapiens
cctccagggcccctctcactgg

SEQ ID NO: 7610740 - DNA, 22 bp, Homo sapiens
cctccagggcccctctcactgg

SEQ ID NO: 7610741 - DNA, 21 bp, Homo sapiens
cctccaggtgattccgtgctc

SEQ ID NO: 7610742 - DNA, 22 bp, Homo sapiens
cctccagggcccctctcactgg

SEQ ID NO: 7610743 - DNA, 21 bp, Homo sapiens
cctccaggtgattccgtgctc

SEQ ID NO: 7610744 - DNA, 22 bp, Homo sapiens
cctccagctgcctcagtctctt

SEQ ID NO: 7610745 - DNA, 22 bp, Homo sapiens
cctccagctgcctcagtctctt

SEQ ID NO: 7610746 - DNA, 22 bp, Homo sapiens
cctccagctgcctcagtctctt

SEQ ID NO: 7610747 - DNA, 22 bp, Homo sapiens
cctccagggcagacggggagca

SEQ ID NO: 7610748 - DNA, 22 bp, Homo sapiens
cctccagggcagacggggagca

SEQ ID NO: 7610749 - DNA, 22 bp, Homo sapiens
cctccaggctggttatcagctg

SEQ ID NO: 7610750 - DNA, 22 bp, Homo sapiens
tggccaatcactgacaaaatgc

SEQ ID NO: 7610751 - DNA, 22 bp, Homo sapiens
tggccacaaagagaacgaggtc

SEQ ID NO: 7610752 - DNA, 22 bp, Homo sapiens
cctccagcgcgatccactccgg

SEQ ID NO: 7610753 - DNA, 22 bp, Homo sapiens
cctccagcgcgatccactccgg

SEQ ID NO: 7610754 - DNA, 21 bp, Homo sapiens
tggccaaggaatagaagctct

SEQ ID NO: 7610755 - DNA, 21 bp, Homo sapiens
tggccaaggaatagaagctct

SEQ ID NO: 7610756 - DNA, 20 bp, Homo sapiens
tggccaagtatccaactgga

SEQ ID NO: 7610757 - DNA, 22 bp, Homo sapiens
cctcccacatcctagctctgct

SEQ ID NO: 7610758 - DNA, 17 bp, Homo sapiens
cctcccacaccgccctg

SEQ ID NO: 7610759 - DNA, 22 bp, Homo sapiens
cctcccacatcctagctctgct

SEQ ID NO: 7610760 - DNA, 22 bp, Homo sapiens
cctcccacatcctagctctgct

SEQ ID NO: 7610761 - DNA, 22 bp, Homo sapiens
cctcccacatcctagctctgct

SEQ ID NO: 7610762 - DNA, 22 bp, Homo sapiens
cctcccacatcctagctctgct

SEQ ID NO: 7610763 - DNA, 22 bp, Homo sapiens
cctcccacatcctagctctgct

SEQ ID NO: 7610764 - DNA, 22 bp, Homo sapiens
cctcccacatcctagctctgct

SEQ ID NO: 7610765 - DNA, 22 bp, Homo sapiens
cctcccacatcctagctctgct

SEQ ID NO: 7610766 - DNA, 22 bp, Homo sapiens
cctcccacatcctagctctgct

SEQ ID NO: 7610767 - DNA, 22 bp, Homo sapiens
cctcccacatcctagctctgct

SEQ ID NO: 7610768 - DNA, 17 bp, Homo sapiens
cctcccacaccgccctg

SEQ ID NO: 7610769 - DNA, 17 bp, Homo sapiens
cctcccacaccgccctg

SEQ ID NO: 7610770 - DNA, 17 bp, Homo sapiens
cctcccacaccgccctg

SEQ ID NO: 7610771 - DNA, 17 bp, Homo sapiens
cctcccacaccgccctg

SEQ ID NO: 7610772 - DNA, 17 bp, Homo sapiens
cctcccacaccgccctg

SEQ ID NO: 7610773 - DNA, 22 bp, Homo sapiens
cctccatgtaaaggtcccctca

SEQ ID NO: 7610774 - DNA, 22 bp, Homo sapiens
cctccatgtaaaggtcccctca

SEQ ID NO: 7610775 - DNA, 22 bp, Homo sapiens
cctccaggtgttacatatgact

SEQ ID NO: 7610776 - DNA, 22 bp, Homo sapiens
cctccaggtgttacatatgact

SEQ ID NO: 7610777 - DNA, 22 bp, Homo sapiens
cctccaggtgttacatatgact

SEQ ID NO: 7610778 - DNA, 22 bp, Homo sapiens
cctccaggtgttacatatgact

SEQ ID NO: 7610779 - DNA, 22 bp, Homo sapiens
cctccagtactccagtccagcg

SEQ ID NO: 7610780 - DNA, 22 bp, Homo sapiens
cctccagtactccagtccagcg

SEQ ID NO: 7610781 - DNA, 22 bp, Homo sapiens
cctccagtactccagtccagcg

SEQ ID NO: 7610782 - DNA, 22 bp, Homo sapiens
cctccatctccagcttctgcct

SEQ ID NO: 7610783 - DNA, 22 bp, Homo sapiens
cctccatctccagcttctgcct

SEQ ID NO: 7610784 - DNA, 22 bp, Homo sapiens
cctccagtcacctggatgagaa

SEQ ID NO: 7610785 - DNA, 22 bp, Homo sapiens
cctccatcaccatctgccctca

SEQ ID NO: 7610786 - DNA, 22 bp, Homo sapiens
cctccatcaccatctgccctca

SEQ ID NO: 7610787 - DNA, 22 bp, Homo sapiens
cctccatcaccatctgccctca

SEQ ID NO: 7610788 - DNA, 22 bp, Homo sapiens
cctccatcaccatctgccctca

SEQ ID NO: 7610789 - DNA, 22 bp, Homo sapiens
cctcccacttcttgctgaggtc

SEQ ID NO: 7610790 - DNA, 22 bp, Homo sapiens
cctcccacttcttgctgaggtc

SEQ ID NO: 7610791 - DNA, 22 bp, Homo sapiens
cctcccacttcttgctgaggtc

SEQ ID NO: 7610792 - DNA, 22 bp, Homo sapiens
cctcccacttcttgctgaggtc

SEQ ID NO: 7610793 - DNA, 22 bp, Homo sapiens
cctcccacttcttgctgaggtc

SEQ ID NO: 7610794 - DNA, 22 bp, Homo sapiens
cctcctctggtgctgccaaccc

SEQ ID NO: 7610795 - DNA, 22 bp, Homo sapiens
cctcccacttcttgctgaggtc

SEQ ID NO: 7610796 - DNA, 22 bp, Homo sapiens
cctcccacttcttgctgaggtc

SEQ ID NO: 7610797 - DNA, 22 bp, Homo sapiens
cctcccaccatttagagagagc

SEQ ID NO: 7610798 - DNA, 22 bp, Homo sapiens
cctcccaccgtatctcagtggc

SEQ ID NO: 7610799 - DNA, 22 bp, Homo sapiens
cctcccaccgtatctcagtggc

SEQ ID NO: 7610800 - DNA, 23 bp, Homo sapiens
cctcccacctatttcactttctt

SEQ ID NO: 7610801 - DNA, 23 bp, Homo sapiens
cctcccacctatttcactttctt

SEQ ID NO: 7610802 - DNA, 23 bp, Homo sapiens
cctcccacctatttcactttctt

SEQ ID NO: 7610803 - DNA, 23 bp, Homo sapiens
cctcccacctatttcactttctt

SEQ ID NO: 7610804 - DNA, 23 bp, Homo sapiens
cctcccacctatttcactttctt

SEQ ID NO: 7610805 - DNA, 23 bp, Homo sapiens
cctcccacctatttcactttctt

SEQ ID NO: 7610806 - DNA, 19 bp, Homo sapiens
cctcccacggattccttcc

SEQ ID NO: 7610807 - DNA, 19 bp, Homo sapiens
cctcccacggattccttcc

SEQ ID NO: 7610808 - DNA, 19 bp, Homo sapiens
cctcccacggattccttcc

SEQ ID NO: 7610809 - DNA, 22 bp, Homo sapiens
cctcccaccgtatctcagtggc

SEQ ID NO: 7610810 - DNA, 22 bp, Homo sapiens
cctcccaccgtatctcagtggc

SEQ ID NO: 7610811 - DNA, 22 bp, Homo sapiens
cctcccaccgtatctcagtggc

SEQ ID NO: 7610812 - DNA, 22 bp, Homo sapiens
cctcccaccgtatctcagtggc

SEQ ID NO: 7610813 - DNA, 22 bp, Homo sapiens
cctcccaccgtatctcagtggc

SEQ ID NO: 7610814 - DNA, 22 bp, Homo sapiens
cctcccaccatttagagagagc

SEQ ID NO: 7610815 - DNA, 22 bp, Homo sapiens
cctcccaccatttagagagagc

SEQ ID NO: 7610816 - DNA, 22 bp, Homo sapiens
cctcccacattgaggacatgct

SEQ ID NO: 7610817 - DNA, 22 bp, Homo sapiens
cctcccacattgaggacatgct

SEQ ID NO: 7610818 - DNA, 22 bp, Homo sapiens
cctcccacattgaggacatgct

SEQ ID NO: 7610819 - DNA, 22 bp, Homo sapiens
cctcccacattgaggacatgct

SEQ ID NO: 7610820 - DNA, 22 bp, Homo sapiens
cctcccacattgaggacatgct

SEQ ID NO: 7610821 - DNA, 22 bp, Homo sapiens
cctcccacattgaggacatgct

SEQ ID NO: 7610822 - DNA, 22 bp, Homo sapiens
cctcccacattgaggacatgct

SEQ ID NO: 7610823 - DNA, 22 bp, Homo sapiens
cctcccaccatttagagagagc

SEQ ID NO: 7610824 - DNA, 22 bp, Homo sapiens
cctcccaccatttagagagagc

SEQ ID NO: 7610825 - DNA, 22 bp, Homo sapiens
cctcctggggtgaaggatggga

SEQ ID NO: 7610826 - DNA, 22 bp, Homo sapiens
cctcctggggtgaaggatggga

SEQ ID NO: 7610827 - DNA, 22 bp, Homo sapiens
cctcctgggctcctgtctgcac

SEQ ID NO: 7610828 - DNA, 22 bp, Homo sapiens
cctcctgggctcctgtctgcac

SEQ ID NO: 7610829 - DNA, 22 bp, Homo sapiens
cctcctgggctcctgtctgcac

SEQ ID NO: 7610830 - DNA, 22 bp, Homo sapiens
cctcctgggctcctgtctgcac

SEQ ID NO: 7610831 - DNA, 22 bp, Homo sapiens
cctcctgggccttgctctgtga

SEQ ID NO: 7610832 - DNA, 22 bp, Homo sapiens
cctcctgggccttgctctgtga

SEQ ID NO: 7610833 - DNA, 22 bp, Homo sapiens
cctcctgggccttgctctgtga

SEQ ID NO: 7610834 - DNA, 22 bp, Homo sapiens
cctcctgggccttgctctgtga

SEQ ID NO: 7610835 - DNA, 22 bp, Homo sapiens
cctcctgggccttgctctgtga

SEQ ID NO: 7610836 - DNA, 22 bp, Homo sapiens
cctcctgggccttgctctgtga

SEQ ID NO: 7610837 - DNA, 23 bp, Homo sapiens
cctcctgggcacaggcctgatgg

SEQ ID NO: 7610838 - DNA, 23 bp, Homo sapiens
cctcctgggcacaggcctgatgg

SEQ ID NO: 7610839 - DNA, 22 bp, Homo sapiens
cctcctgggagagcacggaggg

SEQ ID NO: 7610840 - DNA, 23 bp, Homo sapiens
cctcctgggcacaggcctgatgg

SEQ ID NO: 7610841 - DNA, 23 bp, Homo sapiens
cctcctgggcacaggcctgatgg

SEQ ID NO: 7610842 - DNA, 22 bp, Homo sapiens
cctcctgggagagcacggaggg

SEQ ID NO: 7610843 - DNA, 22 bp, Homo sapiens
cctcctgggagagcacggaggg

SEQ ID NO: 7610844 - DNA, 22 bp, Homo sapiens
cctcctgggactcattagcacc

SEQ ID NO: 7610845 - DNA, 22 bp, Homo sapiens
cctcctgggagagcacggaggg

SEQ ID NO: 7610846 - DNA, 22 bp, Homo sapiens
cctcctgggagagcacggaggg

SEQ ID NO: 7610847 - DNA, 22 bp, Homo sapiens
cctcctgggagagcacggaggg

SEQ ID NO: 7610848 - DNA, 22 bp, Homo sapiens
cctcctgggagagcacggaggg

SEQ ID NO: 7610849 - DNA, 22 bp, Homo sapiens
cctcctgggacaggctggcaca

SEQ ID NO: 7610850 - DNA, 22 bp, Homo sapiens
cctcctgggacaggctggcaca

SEQ ID NO: 7610851 - DNA, 22 bp, Homo sapiens
cctcctggcttttcccattgaa

SEQ ID NO: 7610852 - DNA, 22 bp, Homo sapiens
cctcctgggacaggctggcaca

SEQ ID NO: 7610853 - DNA, 22 bp, Homo sapiens
cctcctggcttttcccattgaa

SEQ ID NO: 7610854 - DNA, 22 bp, Homo sapiens
cctcctggcttttcccattgaa

SEQ ID NO: 7610855 - DNA, 22 bp, Homo sapiens
cctcctggcctgtgcagagccc

SEQ ID NO: 7610856 - DNA, 22 bp, Homo sapiens
cctcctggcttttcccattgaa

SEQ ID NO: 7610857 - DNA, 22 bp, Homo sapiens
cctcctgggacaggctggcaca

SEQ ID NO: 7610858 - DNA, 22 bp, Homo sapiens
cctcctgggacaggctggcaca

SEQ ID NO: 7610859 - DNA, 22 bp, Homo sapiens
cctcctgggacaggctggcaca

SEQ ID NO: 7610860 - DNA, 22 bp, Homo sapiens
cctcctgggactcattagcacc

SEQ ID NO: 7610861 - DNA, 22 bp, Homo sapiens
cctcctgggactcattagcacc

SEQ ID NO: 7610862 - DNA, 22 bp, Homo sapiens
cctcctctggtgctgccaaccc

SEQ ID NO: 7610863 - DNA, 22 bp, Homo sapiens
cctcctctggtgctgccaaccc

SEQ ID NO: 7610864 - DNA, 22 bp, Homo sapiens
cctcctctgtgcagctgtgggt

SEQ ID NO: 7610865 - DNA, 22 bp, Homo sapiens
cctcctctgtgcagctgtgggt

SEQ ID NO: 7610866 - DNA, 22 bp, Homo sapiens
cctcctggccctgggcctggaa

SEQ ID NO: 7610867 - DNA, 22 bp, Homo sapiens
cctcctggccctgggcctggaa

SEQ ID NO: 7610868 - DNA, 22 bp, Homo sapiens
cctcctctgtgcagctgtgggt

SEQ ID NO: 7610869 - DNA, 22 bp, Homo sapiens
cctcctggcctgtgcagagccc

SEQ ID NO: 7610870 - DNA, 22 bp, Homo sapiens
cctcctggcctgtgcagagccc

SEQ ID NO: 7610871 - DNA, 22 bp, Homo sapiens
cctcctggcctgtgcagagccc

SEQ ID NO: 7610872 - DNA, 22 bp, Homo sapiens
cctcctggcctgtgcagagccc

SEQ ID NO: 7610873 - DNA, 22 bp, Homo sapiens
cctcctggcctgtgcagagccc

SEQ ID NO: 7610874 - DNA, 22 bp, Homo sapiens
cctcctggcctgtgcagagccc

SEQ ID NO: 7610875 - DNA, 22 bp, Homo sapiens
cctcctggcctgtgcagagccc

SEQ ID NO: 7610876 - DNA, 22 bp, Homo sapiens
tgggagagcagagaaccctctt

SEQ ID NO: 7610877 - DNA, 22 bp, Homo sapiens
tgggagagcactgcagccccgg

SEQ ID NO: 7610878 - DNA, 22 bp, Homo sapiens
tgggagagcactgcagccccgg

SEQ ID NO: 7610879 - DNA, 22 bp, Homo sapiens
tgggagagcagagaaccctctt

SEQ ID NO: 7610880 - DNA, 22 bp, Homo sapiens
tgggagagcagagaaccctctt

SEQ ID NO: 7610881 - DNA, 22 bp, Homo sapiens
tgggagagcagagaaccctctt

SEQ ID NO: 7610882 - DNA, 21 bp, Homo sapiens
tgggatagaaatatggctgct

SEQ ID NO: 7610883 - DNA, 21 bp, Homo sapiens
tgggatagaaatatggctgct

SEQ ID NO: 7610884 - DNA, 21 bp, Homo sapiens
tgggatagaaatatggctgct

SEQ ID NO: 7610885 - DNA, 23 bp, Homo sapiens
tgggatagaatttcatggctgct

SEQ ID NO: 7610886 - DNA, 23 bp, Homo sapiens
tgggatagaatttcatggctgct

SEQ ID NO: 7610887 - DNA, 22 bp, Homo sapiens
tgggataataaatagaggcaga

SEQ ID NO: 7610888 - DNA, 21 bp, Homo sapiens
tgggagagcgttgctgtcctc

SEQ ID NO: 7610889 - DNA, 21 bp, Homo sapiens
tgggagagcgttgctgtcctc

SEQ ID NO: 7610890 - DNA, 21 bp, Homo sapiens
tgggagagcgttgctgtcctc

SEQ ID NO: 7610891 - DNA, 21 bp, Homo sapiens
tgggagagcgttgctgtcctc

SEQ ID NO: 7610892 - DNA, 21 bp, Homo sapiens
tgggagagcgttgctgtcctc

SEQ ID NO: 7610893 - DNA, 22 bp, Homo sapiens
tgggcactgtagctggtgctgg

SEQ ID NO: 7610894 - DNA, 22 bp, Homo sapiens
tgggcactgtagctggtgctgg

SEQ ID NO: 7610895 - DNA, 22 bp, Homo sapiens
tgggcactgtgtgtggtaaaat

SEQ ID NO: 7610896 - DNA, 22 bp, Homo sapiens
tgggcactgtagctggtgctgg

SEQ ID NO: 7610897 - DNA, 22 bp, Homo sapiens
tgggcactgtagctggtgctgg

SEQ ID NO: 7610898 - DNA, 22 bp, Homo sapiens
tgggcactggggctccagaggt

SEQ ID NO: 7610899 - DNA, 22 bp, Homo sapiens
tgggcactggaagcctgctgtg

SEQ ID NO: 7610900 - DNA, 21 bp, Homo sapiens
tgggcactgagggtgctgctc

SEQ ID NO: 7610901 - DNA, 22 bp, Homo sapiens
tgggcactggaagcctgctgtg

SEQ ID NO: 7610902 - DNA, 21 bp, Homo sapiens
tgggcactgagggtgctgctc

SEQ ID NO: 7610903 - DNA, 21 bp, Homo sapiens
tgggcactgagggtgctgctc

SEQ ID NO: 7610904 - DNA, 22 bp, Homo sapiens
tgggcactcttctgtgcaaaca

SEQ ID NO: 7610905 - DNA, 22 bp, Homo sapiens
tgggcactgaagctttgagcag

SEQ ID NO: 7610906 - DNA, 22 bp, Homo sapiens
tgggcactgactgttagtgatg

SEQ ID NO: 7610907 - DNA, 22 bp, Homo sapiens
tgggcactgaagctttgagcag

SEQ ID NO: 7610908 - DNA, 22 bp, Homo sapiens
tgggcagacgctgttggaaggc

SEQ ID NO: 7610909 - DNA, 22 bp, Homo sapiens
tgggcagacgctgttggaaggc

SEQ ID NO: 7610910 - DNA, 22 bp, Homo sapiens
tgggcagacattgagtttgttc

SEQ ID NO: 7610911 - DNA, 22 bp, Homo sapiens
tgggcagacgctgttggaaggc

SEQ ID NO: 7610912 - DNA, 22 bp, Homo sapiens
tgggcagacattgagtttgttc

SEQ ID NO: 7610913 - DNA, 22 bp, Homo sapiens
tgggcagacattgagtttgttc

SEQ ID NO: 7610914 - DNA, 22 bp, Homo sapiens
tgggcagaattgtggtagttaa

SEQ ID NO: 7610915 - DNA, 22 bp, Homo sapiens
tgggcagaattgtggtagttaa

SEQ ID NO: 7610916 - DNA, 22 bp, Homo sapiens
tgggcagactaaggtcaaagct

SEQ ID NO: 7610917 - DNA, 22 bp, Homo sapiens
tgggcagactaaggtcaaagct

SEQ ID NO: 7610918 - DNA, 22 bp, Homo sapiens
tgggcagacgggagcttgcctt

SEQ ID NO: 7610919 - DNA, 22 bp, Homo sapiens
tgggcagacgggagcttgcctt

SEQ ID NO: 7610920 - DNA, 22 bp, Homo sapiens
tgggcagacgggagcttgcctt

SEQ ID NO: 7610921 - DNA, 22 bp, Homo sapiens
tgggcagacgggagcttgcctt

SEQ ID NO: 7610922 - DNA, 22 bp, Homo sapiens
tgggcagacgggagcttgcctt

SEQ ID NO: 7610923 - DNA, 22 bp, Homo sapiens
tgggcagactaaggtcaaagct

SEQ ID NO: 7610924 - DNA, 22 bp, Homo sapiens
tgggcagactaaggtcaaagct

SEQ ID NO: 7610925 - DNA, 22 bp, Homo sapiens
tgggcaggagagaagctaaaga

SEQ ID NO: 7610926 - DNA, 22 bp, Homo sapiens
tgggcaggagagaagctaaaga

SEQ ID NO: 7610927 - DNA, 22 bp, Homo sapiens
tgggcaggagagaagctaaaga

SEQ ID NO: 7610928 - DNA, 22 bp, Homo sapiens
tgggcagaaggaagagccacct

SEQ ID NO: 7610929 - DNA, 22 bp, Homo sapiens
tgggcagaaggaagagccacct

SEQ ID NO: 7610930 - DNA, 22 bp, Homo sapiens
tgggcagaaggaagagccacct

SEQ ID NO: 7610931 - DNA, 22 bp, Homo sapiens
tgggcagaaggaagagccacct

SEQ ID NO: 7610932 - DNA, 22 bp, Homo sapiens
tgggcagaaggaagagccacct

SEQ ID NO: 7610933 - DNA, 22 bp, Homo sapiens
tgggcagaaatcagtatcagat

SEQ ID NO: 7610934 - DNA, 22 bp, Homo sapiens
tgggcagaaatcagtatcagat

SEQ ID NO: 7610935 - DNA, 22 bp, Homo sapiens
tgggcagaaatcagtatcagat

SEQ ID NO: 7610936 - DNA, 22 bp, Homo sapiens
tgggcagaaatcagtatcagat

SEQ ID NO: 7610937 - DNA, 22 bp, Homo sapiens
tgggcagaaatcagtatcagat

SEQ ID NO: 7610938 - DNA, 22 bp, Homo sapiens
tgggcagaatgtgggatccaga

SEQ ID NO: 7610939 - DNA, 22 bp, Homo sapiens
tgggcagaattgtggtagttaa

SEQ ID NO: 7610940 - DNA, 22 bp, Homo sapiens
tgggcagaatgtgggatccaga

SEQ ID NO: 7610941 - DNA, 22 bp, Homo sapiens
tgggcagaatgtgggatccaga

SEQ ID NO: 7610942 - DNA, 22 bp, Homo sapiens
tgggcagaatgtgggatccaga

SEQ ID NO: 7610943 - DNA, 22 bp, Homo sapiens
tgggcagaatgtgggatccaga

SEQ ID NO: 7610944 - DNA, 22 bp, Homo sapiens
tgggcagaatgtgggatccaga

SEQ ID NO: 7610945 - DNA, 22 bp, Homo sapiens
tgggcagaaggaagagccacct

SEQ ID NO: 7610946 - DNA, 22 bp, Homo sapiens
tgggcagaaggaagagccacct

SEQ ID NO: 7610947 - DNA, 22 bp, Homo sapiens
tgggacagagtgagctttggcc

SEQ ID NO: 7610948 - DNA, 22 bp, Homo sapiens
tgggacagattataagtctgca

SEQ ID NO: 7610949 - DNA, 22 bp, Homo sapiens
tgggacagattataagtctgca

SEQ ID NO: 7610950 - DNA, 22 bp, Homo sapiens
tgggacagattataagtctgca

SEQ ID NO: 7610951 - DNA, 22 bp, Homo sapiens
tgggacagagtgagctttggcc

SEQ ID NO: 7610952 - DNA, 22 bp, Homo sapiens
tgggacagagtgagctttggcc

SEQ ID NO: 7610953 - DNA, 22 bp, Homo sapiens
tgggacagagtgagctttggcc

SEQ ID NO: 7610954 - DNA, 22 bp, Homo sapiens
tgggacagattataagtctgca

SEQ ID NO: 7610955 - DNA, 22 bp, Homo sapiens
tgggacagattataagtctgca

SEQ ID NO: 7610956 - DNA, 22 bp, Homo sapiens
tgggacagattataagtctgca

SEQ ID NO: 7610957 - DNA, 22 bp, Homo sapiens
tgggacaggaggcctctggaga

SEQ ID NO: 7610958 - DNA, 22 bp, Homo sapiens
tgggacaggaggcctctggaga

SEQ ID NO: 7610959 - DNA, 22 bp, Homo sapiens
tgggacagattataagtctgca

SEQ ID NO: 7610960 - DNA, 22 bp, Homo sapiens
tgggacaggaggcctctggaga

SEQ ID NO: 7610961 - DNA, 22 bp, Homo sapiens
tgggacaggaggcctctggaga

SEQ ID NO: 7610962 - DNA, 22 bp, Homo sapiens
tgggacaggaggcctctggaga

SEQ ID NO: 7610963 - DNA, 22 bp, Homo sapiens
tgggacaggaggcctctggaga

SEQ ID NO: 7610964 - DNA, 22 bp, Homo sapiens
tgggacaggaggcctctggaga

SEQ ID NO: 7610965 - DNA, 22 bp, Homo sapiens
tgggacaggaggcctctggaga

SEQ ID NO: 7610966 - DNA, 22 bp, Homo sapiens
tgggacaggaggcctctggaga

SEQ ID NO: 7610967 - DNA, 22 bp, Homo sapiens
tgggacaggaggcctctggaga

SEQ ID NO: 7610968 - DNA, 22 bp, Homo sapiens
tgggacaggaggcctctggaga

SEQ ID NO: 7610969 - DNA, 22 bp, Homo sapiens
tgggacaggatgaccagaaggt

SEQ ID NO: 7610970 - DNA, 22 bp, Homo sapiens
tgggacaggatgaccagaaggt

SEQ ID NO: 7610971 - DNA, 22 bp, Homo sapiens
tgggacaggatgaccagaaggt

SEQ ID NO: 7610972 - DNA, 22 bp, Homo sapiens
tgggacaggatgaccagaaggt

SEQ ID NO: 7610973 - DNA, 22 bp, Homo sapiens
tgggacaggatgaccagaaggt

SEQ ID NO: 7610974 - DNA, 22 bp, Homo sapiens
tgggacaggatgaccagaaggt

SEQ ID NO: 7610975 - DNA, 22 bp, Homo sapiens
tgggacaggatgaccagaaggt

SEQ ID NO: 7610976 - DNA, 22 bp, Homo sapiens
tgggacaggatgaccagaaggt

SEQ ID NO: 7610977 - DNA, 22 bp, Homo sapiens
tgggacaggatgaccagaaggt

SEQ ID NO: 7610978 - DNA, 22 bp, Homo sapiens
tgggagagaattctggtgactg

SEQ ID NO: 7610979 - DNA, 22 bp, Homo sapiens
tgggagagaattctggtgactg

SEQ ID NO: 7610980 - DNA, 22 bp, Homo sapiens
tgggagagaataatcaataggt

SEQ ID NO: 7610981 - DNA, 22 bp, Homo sapiens
tgggagagaattctggtgactg

SEQ ID NO: 7610982 - DNA, 22 bp, Homo sapiens
tgggagagaattctggtgactg

SEQ ID NO: 7610983 - DNA, 22 bp, Homo sapiens
tgggagagaattctggtgactg

SEQ ID NO: 7610984 - DNA, 22 bp, Homo sapiens
tgggagagaattctggtgactg

SEQ ID NO: 7610985 - DNA, 22 bp, Homo sapiens
tgggagagaattctggtgactg

SEQ ID NO: 7610986 - DNA, 22 bp, Homo sapiens
tgggacagggaatctgatcccc

SEQ ID NO: 7610987 - DNA, 22 bp, Homo sapiens
tgggacagggaatctgatcccc

SEQ ID NO: 7610988 - DNA, 22 bp, Homo sapiens
tgggacagggaatctgatcccc

SEQ ID NO: 7610989 - DNA, 22 bp, Homo sapiens
tgggacagggaatctgatcccc

SEQ ID NO: 7610990 - DNA, 22 bp, Homo sapiens
tgggacagggaatctgatcccc

SEQ ID NO: 7610991 - DNA, 22 bp, Homo sapiens
tgggacagggaatctgatcccc

SEQ ID NO: 7610992 - DNA, 22 bp, Homo sapiens
tgggagagaataatcaataggt

SEQ ID NO: 7610993 - DNA, 22 bp, Homo sapiens
tgggagagataggcttctggac

SEQ ID NO: 7610994 - DNA, 22 bp, Homo sapiens
tgggagagcactgcagccccgg

SEQ ID NO: 7610995 - DNA, 22 bp, Homo sapiens
tgggagagcactgcagccccgg

SEQ ID NO: 7610996 - DNA, 22 bp, Homo sapiens
tgggagagataggcttctggac

SEQ ID NO: 7610997 - DNA, 22 bp, Homo sapiens
tgggagagataggcttctggac

SEQ ID NO: 7610998 - DNA, 22 bp, Homo sapiens
tgggagagaattctggtgactg

SEQ ID NO: 7610999 - DNA, 22 bp, Homo sapiens
tgggagagaattctggtgactg

SEQ ID NO: 7611000 - DNA, 22 bp, Homo sapiens
tgggagagaattctggtgactg

SEQ ID NO: 7611001 - DNA, 22 bp, Homo sapiens
tgggagagagaattcccagtgg

SEQ ID NO: 7611002 - DNA, 22 bp, Homo sapiens
tgggagagagaattcccagtgg

SEQ ID NO: 7611003 - DNA, 22 bp, Homo sapiens
tgggagagagaattcccagtgg

SEQ ID NO: 7611004 - DNA, 22 bp, Homo sapiens
tgggagagagaattcccagtgg

SEQ ID NO: 7611005 - DNA, 22 bp, Homo sapiens
cctctcccctcccaaggcggga

SEQ ID NO: 7611006 - DNA, 22 bp, Homo sapiens
cctctcccctcccaaggcggga

SEQ ID NO: 7611007 - DNA, 19 bp, Homo sapiens
cctctcccatgcttacctc

SEQ ID NO: 7611008 - DNA, 19 bp, Homo sapiens
cctctcccatgcttacctc

SEQ ID NO: 7611009 - DNA, 19 bp, Homo sapiens
cctctcccatgcttacctc

SEQ ID NO: 7611010 - DNA, 22 bp, Homo sapiens
cctctcccagggagagcctgag

SEQ ID NO: 7611011 - DNA, 22 bp, Homo sapiens
cctctcccagggagagcctgag

SEQ ID NO: 7611012 - DNA, 22 bp, Homo sapiens
cctctcccagggagagcctgag

SEQ ID NO: 7611013 - DNA, 22 bp, Homo sapiens
cctctcccagggagagcctgag

SEQ ID NO: 7611014 - DNA, 22 bp, Homo sapiens
cctctcccagggagagcctgag

SEQ ID NO: 7611015 - DNA, 19 bp, Homo sapiens
cctctcccatgcttacctc

SEQ ID NO: 7611016 - DNA, 19 bp, Homo sapiens
cctctcccatgcttacctc

SEQ ID NO: 7611017 - DNA, 19 bp, Homo sapiens
cctctcccatgcttacctc

SEQ ID NO: 7611018 - DNA, 19 bp, Homo sapiens
cctctcccatgcttacctc

SEQ ID NO: 7611019 - DNA, 22 bp, Homo sapiens
cctctcccgggtgccgctgggc

SEQ ID NO: 7611020 - DNA, 22 bp, Homo sapiens
cctctcccgggtgccgctgggc

SEQ ID NO: 7611021 - DNA, 22 bp, Homo sapiens
cctctcccgggtgccgctgggc

SEQ ID NO: 7611022 - DNA, 22 bp, Homo sapiens
cctctcccgggtgccgctgggc

SEQ ID NO: 7611023 - DNA, 22 bp, Homo sapiens
cctctcccgggtgccgctgggc

SEQ ID NO: 7611024 - DNA, 22 bp, Homo sapiens
cctctcccgggtgccgctgggc

SEQ ID NO: 7611025 - DNA, 22 bp, Homo sapiens
cctctcccgggtgccgctgggc

SEQ ID NO: 7611026 - DNA, 22 bp, Homo sapiens
cctctcccgggtgccgctgggc

SEQ ID NO: 7611027 - DNA, 22 bp, Homo sapiens
cctctcccgggtgccgctgggc

SEQ ID NO: 7611028 - DNA, 22 bp, Homo sapiens
tgggaaggcgtggaagtagaag

SEQ ID NO: 7611029 - DNA, 22 bp, Homo sapiens
tgggaaggcagtcactgtccta

SEQ ID NO: 7611030 - DNA, 22 bp, Homo sapiens
tgggaaggcgtggaagtagaag

SEQ ID NO: 7611031 - DNA, 22 bp, Homo sapiens
tgggaaggcgtggaagtagaag

SEQ ID NO: 7611032 - DNA, 22 bp, Homo sapiens
tgggaaggcgtggaagtagaag

SEQ ID NO: 7611033 - DNA, 22 bp, Homo sapiens
tgggacacctcagatagtgtct

SEQ ID NO: 7611034 - DNA, 22 bp, Homo sapiens
tgggacacctcagatagtgtct

SEQ ID NO: 7611035 - DNA, 22 bp, Homo sapiens
tgggacacggaggccccagcac

SEQ ID NO: 7611036 - DNA, 19 bp, Homo sapiens
tgggacacgatctgcctgt

SEQ ID NO: 7611037 - DNA, 22 bp, Homo sapiens
tgggacagagtgagctttggcc

SEQ ID NO: 7611038 - DNA, 22 bp, Homo sapiens
tgggacagagtgagctttggcc

SEQ ID NO: 7611039 - DNA, 22 bp, Homo sapiens
tgggacagagtgagctttggcc

SEQ ID NO: 7611040 - DNA, 22 bp, Homo sapiens
cctctcccacgtggcagaggct

SEQ ID NO: 7611041 - DNA, 22 bp, Homo sapiens
cctctcccacgtggcagaggct

SEQ ID NO: 7611042 - DNA, 22 bp, Homo sapiens
cctctcccaggcgcggcggcag

SEQ ID NO: 7611043 - DNA, 22 bp, Homo sapiens
cctctcccaggcgcggcggcag

SEQ ID NO: 7611044 - DNA, 22 bp, Homo sapiens
cctctcccacgtggcagaggct

SEQ ID NO: 7611045 - DNA, 22 bp, Homo sapiens
cctctcccaggcgcggcggcag

SEQ ID NO: 7611046 - DNA, 22 bp, Homo sapiens
cctctcccagggagagcctgag

SEQ ID NO: 7611047 - DNA, 22 bp, Homo sapiens
cctctccagttttaacgtgacc

SEQ ID NO: 7611048 - DNA, 22 bp, Homo sapiens
cctctcccagggagagcctgag

SEQ ID NO: 7611049 - DNA, 22 bp, Homo sapiens
cctctcccaggcgcggcggcag

SEQ ID NO: 7611050 - DNA, 22 bp, Homo sapiens
cctctcccaggcgcggcggcag

SEQ ID NO: 7611051 - DNA, 22 bp, Homo sapiens
cctctcccacgtggcagaggct

SEQ ID NO: 7611052 - DNA, 22 bp, Homo sapiens
cctctcccacgtggcagaggct

SEQ ID NO: 7611053 - DNA, 22 bp, Homo sapiens
cctctcccacgtggcagaggct

SEQ ID NO: 7611054 - DNA, 22 bp, Homo sapiens
cctctcccacgtggcagaggct

SEQ ID NO: 7611055 - DNA, 22 bp, Homo sapiens
cctctcccacgtggcagaggct

SEQ ID NO: 7611056 - DNA, 22 bp, Homo sapiens
cctctcccacgtggcagaggct

SEQ ID NO: 7611057 - DNA, 22 bp, Homo sapiens
cctctccagttttaacgtgacc

SEQ ID NO: 7611058 - DNA, 22 bp, Homo sapiens
cctctccagttttaacgtgacc

SEQ ID NO: 7611059 - DNA, 20 bp, Homo sapiens
tggctttactagtggcactc

SEQ ID NO: 7611060 - DNA, 22 bp, Homo sapiens
tggctttactgtcattcttatg

SEQ ID NO: 7611061 - DNA, 22 bp, Homo sapiens
tggctttactgtcattcttatg

SEQ ID NO: 7611062 - DNA, 22 bp, Homo sapiens
tggctttacttaaactgaatca

SEQ ID NO: 7611063 - DNA, 20 bp, Homo sapiens
tggctttactagtggcactc

SEQ ID NO: 7611064 - DNA, 22 bp, Homo sapiens
tggctttacagtttgcaaacta

SEQ ID NO: 7611065 - DNA, 22 bp, Homo sapiens
tggctttacagtttgcaaacta

SEQ ID NO: 7611066 - DNA, 22 bp, Homo sapiens
tggctttaggagctatatacct

SEQ ID NO: 7611067 - DNA, 22 bp, Homo sapiens
tggctttaggagctatatacct

SEQ ID NO: 7611068 - DNA, 22 bp, Homo sapiens
tggctttaggagctatatacct

SEQ ID NO: 7611069 - DNA, 22 bp, Homo sapiens
tggctttaggagctatatacct

SEQ ID NO: 7611070 - DNA, 22 bp, Homo sapiens
tggctttaggagctatatacct

SEQ ID NO: 7611071 - DNA, 22 bp, Homo sapiens
tggctttaggccaaagcctaac

SEQ ID NO: 7611072 - DNA, 22 bp, Homo sapiens
tggctttaggccaaagcctaac

SEQ ID NO: 7611073 - DNA, 22 bp, Homo sapiens
cctctccagcggcctcagggcc

SEQ ID NO: 7611074 - DNA, 22 bp, Homo sapiens
cctctccagcggcctcagggcc

SEQ ID NO: 7611075 - DNA, 22 bp, Homo sapiens
tggctttaggttgcatgtttct

SEQ ID NO: 7611076 - DNA, 22 bp, Homo sapiens
tggctttagggttccttctacc

SEQ ID NO: 7611077 - DNA, 22 bp, Homo sapiens
cctctccagcggcctcagggcc

SEQ ID NO: 7611078 - DNA, 22 bp, Homo sapiens
cctctccagcggcctcagggcc

SEQ ID NO: 7611079 - DNA, 22 bp, Homo sapiens
cctcctggtaattagcgaaagg

SEQ ID NO: 7611080 - DNA, 22 bp, Homo sapiens
cctcctggtaattagcgaaagg

SEQ ID NO: 7611081 - DNA, 20 bp, Homo sapiens
cctcctggtcaggtgtgcag

SEQ ID NO: 7611082 - DNA, 20 bp, Homo sapiens
cctcctggtcaggtgtgcag

SEQ ID NO: 7611083 - DNA, 20 bp, Homo sapiens
cctcctggtcaggtgtgcag

SEQ ID NO: 7611084 - DNA, 22 bp, Homo sapiens
cctcctggggtgaaggatggga

SEQ ID NO: 7611085 - DNA, 22 bp, Homo sapiens
cctcctgggttcaagcgattct

SEQ ID NO: 7611086 - DNA, 22 bp, Homo sapiens
cctcctgggttcaagcgattct

SEQ ID NO: 7611087 - DNA, 22 bp, Homo sapiens
cctcctggtaattagcgaaagg

SEQ ID NO: 7611088 - DNA, 22 bp, Homo sapiens
cctcctggtaattagcgaaagg

SEQ ID NO: 7611089 - DNA, 22 bp, Homo sapiens
cctcctgggttcaagcgattct

SEQ ID NO: 7611090 - DNA, 22 bp, Homo sapiens
cctcctggtccagcatctcttt

SEQ ID NO: 7611091 - DNA, 22 bp, Homo sapiens
cctcctggtccagcatctcttt

SEQ ID NO: 7611092 - DNA, 22 bp, Homo sapiens
cctcctggtccagcatctcttt

SEQ ID NO: 7611093 - DNA, 22 bp, Homo sapiens
tggcttcccatagcttgctagt

SEQ ID NO: 7611094 - DNA, 22 bp, Homo sapiens
cctcctggtccagcatctcttt

SEQ ID NO: 7611095 - DNA, 22 bp, Homo sapiens
cctcctggtccagcatctcttt

SEQ ID NO: 7611096 - DNA, 22 bp, Homo sapiens
tggcttcccaggaaaggagaag

SEQ ID NO: 7611097 - DNA, 17 bp, Homo sapiens
tggcttccctgggccac

SEQ ID NO: 7611098 - DNA, 22 bp, Homo sapiens
tggcttcttgtttggtttaaga

SEQ ID NO: 7611099 - DNA, 22 bp, Homo sapiens
tggcttccccggagtgacatgt

SEQ ID NO: 7611100 - DNA, 22 bp, Homo sapiens
tggcttcccctaccttccaatt

SEQ ID NO: 7611101 - DNA, 22 bp, Homo sapiens
tggcttcccctaccttccaatt

SEQ ID NO: 7611102 - DNA, 22 bp, Homo sapiens
tggcttctttccactgtcctgt

SEQ ID NO: 7611103 - DNA, 22 bp, Homo sapiens
tggcttctttccactgtcctgt

SEQ ID NO: 7611104 - DNA, 22 bp, Homo sapiens
tggcttctttccactgtcctgt

SEQ ID NO: 7611105 - DNA, 22 bp, Homo sapiens
tggcttctttccactgtcctgt

SEQ ID NO: 7611106 - DNA, 22 bp, Homo sapiens
tggcttgtcatgtatctgaggc

SEQ ID NO: 7611107 - DNA, 22 bp, Homo sapiens
tggcttgtcatgtatctgaggc

SEQ ID NO: 7611108 - DNA, 22 bp, Homo sapiens
tggcttgtacggttgggagaaa

SEQ ID NO: 7611109 - DNA, 22 bp, Homo sapiens
tggcttgtagcctacacctggt

SEQ ID NO: 7611110 - DNA, 22 bp, Homo sapiens
tggcttgtaggcccaatccggg

SEQ ID NO: 7611111 - DNA, 22 bp, Homo sapiens
tggcttggtgagcagagtgtag

SEQ ID NO: 7611112 - DNA, 22 bp, Homo sapiens
tggcttggtaaggaccagcagg

SEQ ID NO: 7611113 - DNA, 22 bp, Homo sapiens
tggcttggtcctggcccttccc

SEQ ID NO: 7611114 - DNA, 22 bp, Homo sapiens
tggcttggtcctggcccttccc

SEQ ID NO: 7611115 - DNA, 22 bp, Homo sapiens
tggcttgtcatgtatctgaggc

SEQ ID NO: 7611116 - DNA, 22 bp, Homo sapiens
tggcttgtcatgtatctgaggc

SEQ ID NO: 7611117 - DNA, 22 bp, Homo sapiens
tggcttgtgttttatctcgcat

SEQ ID NO: 7611118 - DNA, 22 bp, Homo sapiens
tggctttaaaatggtttggtat

SEQ ID NO: 7611119 - DNA, 20 bp, Homo sapiens
tggcttgtttctatgggcag

SEQ ID NO: 7611120 - DNA, 22 bp, Homo sapiens
tggctttaaatctgtattcata

SEQ ID NO: 7611121 - DNA, 22 bp, Homo sapiens
tggctttaaatctgtattcata

SEQ ID NO: 7611122 - DNA, 22 bp, Homo sapiens
tggctttaagaagactgacagc

SEQ ID NO: 7611123 - DNA, 22 bp, Homo sapiens
tggctttaagaagactgacagc

SEQ ID NO: 7611124 - DNA, 22 bp, Homo sapiens
tggctttaagaagactgacagc

SEQ ID NO: 7611125 - DNA, 22 bp, Homo sapiens
tggctttaagaagactgacagc

SEQ ID NO: 7611126 - DNA, 22 bp, Homo sapiens
tggctttaagaagactgacagc

SEQ ID NO: 7611127 - DNA, 20 bp, Homo sapiens
tggctttaagttttttgcta

SEQ ID NO: 7611128 - DNA, 20 bp, Homo sapiens
tggctttaagttttttgcta

SEQ ID NO: 7611129 - DNA, 22 bp, Homo sapiens
tggctttacacatccactgcct

SEQ ID NO: 7611130 - DNA, 22 bp, Homo sapiens
tggctttacagtttgcaaacta

SEQ ID NO: 7611131 - DNA, 22 bp, Homo sapiens
tggctttacagtttgcaaacta

SEQ ID NO: 7611132 - DNA, 22 bp, Homo sapiens
tggcttctttgtagaaattgaa

SEQ ID NO: 7611133 - DNA, 22 bp, Homo sapiens
tggcttctttgtagaaattgaa

SEQ ID NO: 7611134 - DNA, 22 bp, Homo sapiens
tggcttctttgtagaaattgaa

SEQ ID NO: 7611135 - DNA, 22 bp, Homo sapiens
tggcttctttccactgtcctgt

SEQ ID NO: 7611136 - DNA, 22 bp, Homo sapiens
tggcttctttccactgtcctgt

SEQ ID NO: 7611137 - DNA, 22 bp, Homo sapiens
tggcttctttctttccatgtgt

SEQ ID NO: 7611138 - DNA, 22 bp, Homo sapiens
tggcttctttctttccatgtgt

SEQ ID NO: 7611139 - DNA, 22 bp, Homo sapiens
tggcttctttctttccatgtgt

SEQ ID NO: 7611140 - DNA, 22 bp, Homo sapiens
tggcttctttgtagaaattgaa

SEQ ID NO: 7611141 - DNA, 19 bp, Homo sapiens
tggcttggctgcagatgct

SEQ ID NO: 7611142 - DNA, 22 bp, Homo sapiens
tggcttggctaagatctaagct

SEQ ID NO: 7611143 - DNA, 22 bp, Homo sapiens
tggcttggctaagatctaagct

SEQ ID NO: 7611144 - DNA, 19 bp, Homo sapiens
tggcttggctgcagatgct

SEQ ID NO: 7611145 - DNA, 22 bp, Homo sapiens
tggcttggactaaatggaccgt

SEQ ID NO: 7611146 - DNA, 22 bp, Homo sapiens
tggcttggactaaatggaccgt

SEQ ID NO: 7611147 - DNA, 22 bp, Homo sapiens
tggcttgcttcttctgctgtcg

SEQ ID NO: 7611148 - DNA, 22 bp, Homo sapiens
tggcttgcttcttctgctgtcg

SEQ ID NO: 7611149 - DNA, 22 bp, Homo sapiens
tggcttgcttccccattctcat

SEQ ID NO: 7611150 - DNA, 22 bp, Homo sapiens
tggcttgcttccccattctcat

SEQ ID NO: 7611151 - DNA, 22 bp, Homo sapiens
tggcttgctactgaggtgtcag

SEQ ID NO: 7611152 - DNA, 22 bp, Homo sapiens
tggcttgcaaaattatttttct

SEQ ID NO: 7611153 - DNA, 23 bp, Homo sapiens
tggcttgctaatgttccaaataa

SEQ ID NO: 7611154 - DNA, 23 bp, Homo sapiens
tggcttgcccaaatcctgcctgc

SEQ ID NO: 7611155 - DNA, 22 bp, Homo sapiens
tggcttgctactgaggtgtcag

SEQ ID NO: 7611156 - DNA, 18 bp, Homo sapiens
ccatcaccctaactagtg

SEQ ID NO: 7611157 - DNA, 22 bp, Homo sapiens
ccatcagacaattctttctctt

SEQ ID NO: 7611158 - DNA, 18 bp, Homo sapiens
ccatcaccctaactagtg

SEQ ID NO: 7611159 - DNA, 18 bp, Homo sapiens
ccatcaccctaactagtg

SEQ ID NO: 7611160 - DNA, 22 bp, Homo sapiens
ccatcagcatgggagcatgggc

SEQ ID NO: 7611161 - DNA, 22 bp, Homo sapiens
ccatcagcatgggagcatgggc

SEQ ID NO: 7611162 - DNA, 22 bp, Homo sapiens
ccatcagagggctgctctgcaa

SEQ ID NO: 7611163 - DNA, 22 bp, Homo sapiens
ccatcagattagcaaaatccag

SEQ ID NO: 7611164 - DNA, 22 bp, Homo sapiens
ccatatatgattgcctctttca

SEQ ID NO: 7611165 - DNA, 23 bp, Homo sapiens
ccatatctctgtactgaatgtgg

SEQ ID NO: 7611166 - DNA, 22 bp, Homo sapiens
ccatatgtctactgctttctgt

SEQ ID NO: 7611167 - DNA, 22 bp, Homo sapiens
ccatatttgcttcttgctgata

SEQ ID NO: 7611168 - DNA, 22 bp, Homo sapiens
ccatcacagtccccatcgtgat

SEQ ID NO: 7611169 - DNA, 22 bp, Homo sapiens
ccatcagttttatctgacaaaa

SEQ ID NO: 7611170 - DNA, 22 bp, Homo sapiens
ccatcattatcactgacaacct

SEQ ID NO: 7611171 - DNA, 22 bp, Homo sapiens
ccatcatttgatacagctgtct

SEQ ID NO: 7611172 - DNA, 22 bp, Homo sapiens
ccatcatttgatacagctgtct

SEQ ID NO: 7611173 - DNA, 22 bp, Homo sapiens
ccatcatttgatacagctgtct

SEQ ID NO: 7611174 - DNA, 22 bp, Homo sapiens
ccatccagaaacttccatcccc

SEQ ID NO: 7611175 - DNA, 22 bp, Homo sapiens
ccatccagaagggtttgaaaga

SEQ ID NO: 7611176 - DNA, 22 bp, Homo sapiens
ccatccagaagggtttgaaaga

SEQ ID NO: 7611177 - DNA, 22 bp, Homo sapiens
ccatccagaccagtccatgggt

SEQ ID NO: 7611178 - DNA, 22 bp, Homo sapiens
ccatccagaaacttccatcccc

SEQ ID NO: 7611179 - DNA, 22 bp, Homo sapiens
ccatccagaaacttccatcccc

SEQ ID NO: 7611180 - DNA, 22 bp, Homo sapiens
ccatccagaaacttccatcccc

SEQ ID NO: 7611181 - DNA, 21 bp, Homo sapiens
ccatccactgagtggttccct

SEQ ID NO: 7611182 - DNA, 23 bp, Homo sapiens
ccatcaggcctccgtgtccagcc

SEQ ID NO: 7611183 - DNA, 23 bp, Homo sapiens
ccatcaggcctccgtgtccagcc

SEQ ID NO: 7611184 - DNA, 23 bp, Homo sapiens
ccatcaggcctccgtgtccagcc

SEQ ID NO: 7611185 - DNA, 23 bp, Homo sapiens
ccatcaggcctccgtgtccagcc

SEQ ID NO: 7611186 - DNA, 22 bp, Homo sapiens
ccatcagctccagtatcttctg

SEQ ID NO: 7611187 - DNA, 22 bp, Homo sapiens
ccatcagtgaaggagacagatt

SEQ ID NO: 7611188 - DNA, 23 bp, Homo sapiens
ccatcaggcctccgtgtccagcc

SEQ ID NO: 7611189 - DNA, 22 bp, Homo sapiens
ccatcagtggcaaataaacacc

SEQ ID NO: 7611190 - DNA, 22 bp, Homo sapiens
ccatcagttctcagaccacact

SEQ ID NO: 7611191 - DNA, 22 bp, Homo sapiens
tgaggctgagatatcagggagg

SEQ ID NO: 7611192 - DNA, 22 bp, Homo sapiens
tgaggctgagatatcagggagg

SEQ ID NO: 7611193 - DNA, 18 bp, Homo sapiens
tgaggctgagggtagagg

SEQ ID NO: 7611194 - DNA, 22 bp, Homo sapiens
tgaggctgagatatcagggagg

SEQ ID NO: 7611195 - DNA, 22 bp, Homo sapiens
tgaggctgagatatcagggagg

SEQ ID NO: 7611196 - DNA, 22 bp, Homo sapiens
tgaggctgagatatcagggagg

SEQ ID NO: 7611197 - DNA, 22 bp, Homo sapiens
tgaggctgagatatcagggagg

SEQ ID NO: 7611198 - DNA, 22 bp, Homo sapiens
tgaggctgagatatcagggagg

SEQ ID NO: 7611199 - DNA, 22 bp, Homo sapiens
tgaggctgagatatcagggagg

SEQ ID NO: 7611200 - DNA, 22 bp, Homo sapiens
ccagtgttttccagtttgccca

SEQ ID NO: 7611201 - DNA, 23 bp, Homo sapiens
tgaggctgattgatttttgctca

SEQ ID NO: 7611202 - DNA, 23 bp, Homo sapiens
tgaggctgattgatttttgctca

SEQ ID NO: 7611203 - DNA, 18 bp, Homo sapiens
tgaggctgagggtagagg

SEQ ID NO: 7611204 - DNA, 18 bp, Homo sapiens
tgaggctgagggtagagg

SEQ ID NO: 7611205 - DNA, 18 bp, Homo sapiens
tgaggctgagggtagagg

SEQ ID NO: 7611206 - DNA, 18 bp, Homo sapiens
tgaggctgagggtagagg

SEQ ID NO: 7611207 - DNA, 18 bp, Homo sapiens
tgaggctgagggtagagg

SEQ ID NO: 7611208 - DNA, 22 bp, Homo sapiens
ccatagcaagaggagcagaaat

SEQ ID NO: 7611209 - DNA, 22 bp, Homo sapiens
ccatagtgaattgtctcagacg

SEQ ID NO: 7611210 - DNA, 19 bp, Homo sapiens
ccatataaccagcaagtgt

SEQ ID NO: 7611211 - DNA, 22 bp, Homo sapiens
ccatagtgaattgtctcagacg

SEQ ID NO: 7611212 - DNA, 22 bp, Homo sapiens
ccatagcaagaggagcagaaat

SEQ ID NO: 7611213 - DNA, 22 bp, Homo sapiens
ccagttaattgggtgggtctcg

SEQ ID NO: 7611214 - DNA, 17 bp, Homo sapiens
ccatactgacatattga

SEQ ID NO: 7611215 - DNA, 22 bp, Homo sapiens
ccatacacacaccaaatttgta

SEQ ID NO: 7611216 - DNA, 22 bp, Homo sapiens
ccatacacacaccaaatttgta

SEQ ID NO: 7611217 - DNA, 22 bp, Homo sapiens
ccagttaatcactgagtcctgt

SEQ ID NO: 7611218 - DNA, 22 bp, Homo sapiens
ccagttacaagtgattcttggt

SEQ ID NO: 7611219 - DNA, 22 bp, Homo sapiens
tgaggctgacaaaagatgaggt

SEQ ID NO: 7611220 - DNA, 22 bp, Homo sapiens
tgaggctgacaaaagatgaggt

SEQ ID NO: 7611221 - DNA, 22 bp, Homo sapiens
tgaggctgacaaaagatgaggt

SEQ ID NO: 7611222 - DNA, 22 bp, Homo sapiens
tgaggctgacaaaagatgaggt

SEQ ID NO: 7611223 - DNA, 22 bp, Homo sapiens
tgaggctgacaaaagatgaggt

SEQ ID NO: 7611224 - DNA, 22 bp, Homo sapiens
tgaggctgacaaaagatgaggt

SEQ ID NO: 7611225 - DNA, 18 bp, Homo sapiens
tgaggctgaatatggggc

SEQ ID NO: 7611226 - DNA, 18 bp, Homo sapiens
tgaggctgaatatggggc

SEQ ID NO: 7611227 - DNA, 18 bp, Homo sapiens
tgaggctgaatatggggc

SEQ ID NO: 7611228 - DNA, 18 bp, Homo sapiens
tgaggctgaatatggggc

SEQ ID NO: 7611229 - DNA, 22 bp, Homo sapiens
tgaggctgagatatcagggagg

SEQ ID NO: 7611230 - DNA, 22 bp, Homo sapiens
tgaggctgagatatcagggagg

SEQ ID NO: 7611231 - DNA, 22 bp, Homo sapiens
tgaggctgacaaaagatgaggt

SEQ ID NO: 7611232 - DNA, 22 bp, Homo sapiens
tgaggctgacaaaagatgaggt

SEQ ID NO: 7611233 - DNA, 22 bp, Homo sapiens
tgaggctgacaaaagatgaggt

SEQ ID NO: 7611234 - DNA, 18 bp, Homo sapiens
tgaggctgaatatggggc

SEQ ID NO: 7611235 - DNA, 22 bp, Homo sapiens
tgaggctgaaactggcgataga

SEQ ID NO: 7611236 - DNA, 22 bp, Homo sapiens
tgaggctgaaactggcgataga

SEQ ID NO: 7611237 - DNA, 22 bp, Homo sapiens
tgaggctgaaactggcgataga

SEQ ID NO: 7611238 - DNA, 22 bp, Homo sapiens
tgaggccccgaagctgaggttt

SEQ ID NO: 7611239 - DNA, 22 bp, Homo sapiens
tgaggccccgaagctgaggttt

SEQ ID NO: 7611240 - DNA, 22 bp, Homo sapiens
tgaggccccgaagctgaggttt

SEQ ID NO: 7611241 - DNA, 22 bp, Homo sapiens
tgaggctcttctgtaaatgatc

SEQ ID NO: 7611242 - DNA, 22 bp, Homo sapiens
tgaggctgaaactggcgataga

SEQ ID NO: 7611243 - DNA, 22 bp, Homo sapiens
tgaggctgaaactggcgataga

SEQ ID NO: 7611244 - DNA, 22 bp, Homo sapiens
tgaggcccagccgccctgagag

SEQ ID NO: 7611245 - DNA, 22 bp, Homo sapiens
tgaggcccatctgagattttga

SEQ ID NO: 7611246 - DNA, 22 bp, Homo sapiens
tgaggcccagccgccctgagag

SEQ ID NO: 7611247 - DNA, 20 bp, Homo sapiens
tgaggcccagcagagtcggg

SEQ ID NO: 7611248 - DNA, 22 bp, Homo sapiens
tgaggcccagccgccctgagag

SEQ ID NO: 7611249 - DNA, 22 bp, Homo sapiens
tgaggcagtgtgagataataaa

SEQ ID NO: 7611250 - DNA, 22 bp, Homo sapiens
tgaggccaggcaaaggcgatct

SEQ ID NO: 7611251 - DNA, 22 bp, Homo sapiens
tgaggccaggcaaaggcgatct

SEQ ID NO: 7611252 - DNA, 22 bp, Homo sapiens
tgaggccaggcaaaggcgatct

SEQ ID NO: 7611253 - DNA, 22 bp, Homo sapiens
tgaggccaggcaaaggcgatct

SEQ ID NO: 7611254 - DNA, 22 bp, Homo sapiens
tgaggccagggattccatcatt

SEQ ID NO: 7611255 - DNA, 22 bp, Homo sapiens
tgaggccagggattccatcatt

SEQ ID NO: 7611256 - DNA, 22 bp, Homo sapiens
tgaggccagggattccatcatt

SEQ ID NO: 7611257 - DNA, 22 bp, Homo sapiens
tgaggccagggattccatcatt

SEQ ID NO: 7611258 - DNA, 22 bp, Homo sapiens
tgaggccagtctcatcacaggc

SEQ ID NO: 7611259 - DNA, 22 bp, Homo sapiens
tgaggccagtctcatcacaggc

SEQ ID NO: 7611260 - DNA, 22 bp, Homo sapiens
tgaggccagtctcatcacaggc

SEQ ID NO: 7611261 - DNA, 22 bp, Homo sapiens
tgaggccagtgacatatattaa

SEQ ID NO: 7611262 - DNA, 22 bp, Homo sapiens
tgaggccagtctcatcacaggc

SEQ ID NO: 7611263 - DNA, 22 bp, Homo sapiens
tgaggccatgcccgtgccggcc

SEQ ID NO: 7611264 - DNA, 22 bp, Homo sapiens
tgaggccagtgacatatattaa

SEQ ID NO: 7611265 - DNA, 22 bp, Homo sapiens
tgaggccatgcccgtgccggcc

SEQ ID NO: 7611266 - DNA, 17 bp, Homo sapiens
tgaggccatggcaccat

SEQ ID NO: 7611267 - DNA, 17 bp, Homo sapiens
tgaggccatggcaccat

SEQ ID NO: 7611268 - DNA, 22 bp, Homo sapiens
tgaggccatggtcttcccagtc

SEQ ID NO: 7611269 - DNA, 17 bp, Homo sapiens
tgaggccatggcaccat

SEQ ID NO: 7611270 - DNA, 17 bp, Homo sapiens
tgaggccatggcaccat

SEQ ID NO: 7611271 - DNA, 22 bp, Homo sapiens
tgaggccatggtcttcccagtc

SEQ ID NO: 7611272 - DNA, 20 bp, Homo sapiens
tgaggcccagcagagtcggg

SEQ ID NO: 7611273 - DNA, 20 bp, Homo sapiens
tgaggcccagcagagtcggg

SEQ ID NO: 7611274 - DNA, 22 bp, Homo sapiens
tgaggccatggtcttcccagtc

SEQ ID NO: 7611275 - DNA, 22 bp, Homo sapiens
tgaggccatggtcttcccagtc

SEQ ID NO: 7611276 - DNA, 22 bp, Homo sapiens
tgaggccatgcccgtgccggcc

SEQ ID NO: 7611277 - DNA, 22 bp, Homo sapiens
tgaggccatgcccgtgccggcc

SEQ ID NO: 7611278 - DNA, 22 bp, Homo sapiens
tgaggccatggaactagcttgg

SEQ ID NO: 7611279 - DNA, 22 bp, Homo sapiens
tgaggccatggaactagcttgg

SEQ ID NO: 7611280 - DNA, 22 bp, Homo sapiens
tgaggccatggaactagcttgg

SEQ ID NO: 7611281 - DNA, 17 bp, Homo sapiens
tgaggccatggcaccat

SEQ ID NO: 7611282 - DNA, 17 bp, Homo sapiens
tgaggccatggcaccat

SEQ ID NO: 7611283 - DNA, 22 bp, Homo sapiens
tgaggccatggaactagcttgg

SEQ ID NO: 7611284 - DNA, 22 bp, Homo sapiens
tgaggccatggaactagcttgg

SEQ ID NO: 7611285 - DNA, 17 bp, Homo sapiens
tgaggccatggcaccat

SEQ ID NO: 7611286 - DNA, 22 bp, Homo sapiens
ccatccaggctgtgggtgagct

SEQ ID NO: 7611287 - DNA, 22 bp, Homo sapiens
ccatccagaccagtccatgggt

SEQ ID NO: 7611288 - DNA, 22 bp, Homo sapiens
ccatccaggctgtgggtgagct

SEQ ID NO: 7611289 - DNA, 22 bp, Homo sapiens
ccatccaggctgtgggtgagct

SEQ ID NO: 7611290 - DNA, 22 bp, Homo sapiens
ccatccatatggtgacaaggtg

SEQ ID NO: 7611291 - DNA, 22 bp, Homo sapiens
ccatccatatggtgacaaggtg

SEQ ID NO: 7611292 - DNA, 21 bp, Homo sapiens
ccatccatctccctttgctgg

SEQ ID NO: 7611293 - DNA, 22 bp, Homo sapiens
ccatccatgaacgaggaagtgg

SEQ ID NO: 7611294 - DNA, 22 bp, Homo sapiens
ccatccatgaacgaggaagtgg

SEQ ID NO: 7611295 - DNA, 22 bp, Homo sapiens
ccatccctcctccaccagctag

SEQ ID NO: 7611296 - DNA, 22 bp, Homo sapiens
ccatccaggctgtgggtgagct

SEQ ID NO: 7611297 - DNA, 22 bp, Homo sapiens
ccatccattttcttgcttgcct

SEQ ID NO: 7611298 - DNA, 22 bp, Homo sapiens
ccatccattttcttgcttgcct

SEQ ID NO: 7611299 - DNA, 22 bp, Homo sapiens
ccatccatgcgccagacagatt

SEQ ID NO: 7611300 - DNA, 19 bp, Homo sapiens
ccatccatggggccagagg

SEQ ID NO: 7611301 - DNA, 22 bp, Homo sapiens
ccatccatggtgttggttgtat

SEQ ID NO: 7611302 - DNA, 22 bp, Homo sapiens
ccatccatgtggcagggctggc

SEQ ID NO: 7611303 - DNA, 22 bp, Homo sapiens
ccatccatgtggcagggctggc

SEQ ID NO: 7611304 - DNA, 22 bp, Homo sapiens
ccatccctgggccatgtcccct

SEQ ID NO: 7611305 - DNA, 22 bp, Homo sapiens
ccatccctgggccatgtcccct

SEQ ID NO: 7611306 - DNA, 22 bp, Homo sapiens
ccatccctgccattatagccca

SEQ ID NO: 7611307 - DNA, 22 bp, Homo sapiens
ccatccctgggccatgtcccct

SEQ ID NO: 7611308 - DNA, 22 bp, Homo sapiens
ccatccctgggccatgtcccct

SEQ ID NO: 7611309 - DNA, 22 bp, Homo sapiens
ccatccctgagtcacaggaggg

SEQ ID NO: 7611310 - DNA, 22 bp, Homo sapiens
ccatccctgagtcacaggaggg

SEQ ID NO: 7611311 - DNA, 22 bp, Homo sapiens
ccatccctcctccaccagctag

SEQ ID NO: 7611312 - DNA, 22 bp, Homo sapiens
ccatccctcctccaccagctag

SEQ ID NO: 7611313 - DNA, 22 bp, Homo sapiens
ccatcccttctctggccagcag

SEQ ID NO: 7611314 - DNA, 22 bp, Homo sapiens
ccatcccttctctggccagcag

SEQ ID NO: 7611315 - DNA, 22 bp, Homo sapiens
ccatcccttctctggccagcag

SEQ ID NO: 7611316 - DNA, 22 bp, Homo sapiens
ccatcccttctctggccagcag

SEQ ID NO: 7611317 - DNA, 22 bp, Homo sapiens
ccatcccttctctggccagcag

SEQ ID NO: 7611318 - DNA, 22 bp, Homo sapiens
ccatcctgaatggtctcagcca

SEQ ID NO: 7611319 - DNA, 22 bp, Homo sapiens
ccatcctgaatggtctcagcca

SEQ ID NO: 7611320 - DNA, 22 bp, Homo sapiens
ccatcctgaatggtctcagcca

SEQ ID NO: 7611321 - DNA, 22 bp, Homo sapiens
tgagtccactttaaaatgtcag

SEQ ID NO: 7611322 - DNA, 22 bp, Homo sapiens
tgagtccaccttagtatatggg

SEQ ID NO: 7611323 - DNA, 22 bp, Homo sapiens
tgagtccaataggggcctggaa

SEQ ID NO: 7611324 - DNA, 22 bp, Homo sapiens
tgagtccaccttagtatatggg

SEQ ID NO: 7611325 - DNA, 22 bp, Homo sapiens
tgagtccaggtgcttacctgga

SEQ ID NO: 7611326 - DNA, 22 bp, Homo sapiens
tgagtccagatgggccagcagg

SEQ ID NO: 7611327 - DNA, 20 bp, Homo sapiens
tgagtccagattttgcttta

SEQ ID NO: 7611328 - DNA, 22 bp, Homo sapiens
tgagtccagatgggccagcagg

SEQ ID NO: 7611329 - DNA, 22 bp, Homo sapiens
tgagtccagatgggccagcagg

SEQ ID NO: 7611330 - DNA, 22 bp, Homo sapiens
tgagtccagatgggccagcagg

SEQ ID NO: 7611331 - DNA, 22 bp, Homo sapiens
tgagtccaataggggcctggaa

SEQ ID NO: 7611332 - DNA, 22 bp, Homo sapiens
tgagtccaataggggcctggaa

SEQ ID NO: 7611333 - DNA, 22 bp, Homo sapiens
tgagtccaagagccagtgggaa

SEQ ID NO: 7611334 - DNA, 22 bp, Homo sapiens
tgagtccaagagccagtgggaa

SEQ ID NO: 7611335 - DNA, 22 bp, Homo sapiens
tgagtccaagagccagtgggaa

SEQ ID NO: 7611336 - DNA, 22 bp, Homo sapiens
tgagtccaaattctaccacctc

SEQ ID NO: 7611337 - DNA, 22 bp, Homo sapiens
tgagtcagtgacatgaacttgt

SEQ ID NO: 7611338 - DNA, 22 bp, Homo sapiens
tgagtcagtgacatgaacttgt

SEQ ID NO: 7611339 - DNA, 22 bp, Homo sapiens
ccatcctgaatggtctcagcca

SEQ ID NO: 7611340 - DNA, 22 bp, Homo sapiens
ccatcctgcaggacctccatat

SEQ ID NO: 7611341 - DNA, 22 bp, Homo sapiens
ccatcctgaatggtctcagcca

SEQ ID NO: 7611342 - DNA, 22 bp, Homo sapiens
tgaggtcatggctgatatttcc

SEQ ID NO: 7611343 - DNA, 22 bp, Homo sapiens
tgaggtcccaggggtagtgtgc

SEQ ID NO: 7611344 - DNA, 22 bp, Homo sapiens
tgaggtcccaggggtagtgtgc

SEQ ID NO: 7611345 - DNA, 22 bp, Homo sapiens
ccatcctgcaggacctccatat

SEQ ID NO: 7611346 - DNA, 22 bp, Homo sapiens
tgaggtcctgcatgttgaggtc

SEQ ID NO: 7611347 - DNA, 22 bp, Homo sapiens
tgaggtcctgcatgttgaggtc

SEQ ID NO: 7611348 - DNA, 22 bp, Homo sapiens
tgaggtcctgcatgttgaggtc

SEQ ID NO: 7611349 - DNA, 22 bp, Homo sapiens
tgaggtcctgcatgttgaggtc

SEQ ID NO: 7611350 - DNA, 19 bp, Homo sapiens
tgaggtctacatgggcatc

SEQ ID NO: 7611351 - DNA, 22 bp, Homo sapiens
tgaggtcctagagagtgtgtgg

SEQ ID NO: 7611352 - DNA, 19 bp, Homo sapiens
tgaggtctacatgggcatc

SEQ ID NO: 7611353 - DNA, 22 bp, Homo sapiens
tgaggtctcagctgggaagact

SEQ ID NO: 7611354 - DNA, 22 bp, Homo sapiens
tgagtcagccagagctgccatg

SEQ ID NO: 7611355 - DNA, 22 bp, Homo sapiens
tgagtcagtctgccctggcttc

SEQ ID NO: 7611356 - DNA, 22 bp, Homo sapiens
tgagtcagtctgccctggcttc

SEQ ID NO: 7611357 - DNA, 20 bp, Homo sapiens
tgagtcagctgcatgggtgg

SEQ ID NO: 7611358 - DNA, 22 bp, Homo sapiens
tgagtcagccttggcagcccct

SEQ ID NO: 7611359 - DNA, 20 bp, Homo sapiens
tgagtcagctgcatgggtgg

SEQ ID NO: 7611360 - DNA, 22 bp, Homo sapiens
tgataaacttagaaagaatgtt

SEQ ID NO: 7611361 - DNA, 22 bp, Homo sapiens
tgataaactggagaggtggagg

SEQ ID NO: 7611362 - DNA, 22 bp, Homo sapiens
tgataaactggagaggtggagg

SEQ ID NO: 7611363 - DNA, 22 bp, Homo sapiens
tgataaacattttaggaactaa

SEQ ID NO: 7611364 - DNA, 22 bp, Homo sapiens
tgataaacattttaggaactaa

SEQ ID NO: 7611365 - DNA, 22 bp, Homo sapiens
tgataaacttagaaagaatgtt

SEQ ID NO: 7611366 - DNA, 22 bp, Homo sapiens
tgataaatccatgtaaatggta

SEQ ID NO: 7611367 - DNA, 22 bp, Homo sapiens
tgataaatccatgtaaatggta

SEQ ID NO: 7611368 - DNA, 22 bp, Homo sapiens
tgataaactggagaggtggagg

SEQ ID NO: 7611369 - DNA, 22 bp, Homo sapiens
tgagttttttcaacatatgaag

SEQ ID NO: 7611370 - DNA, 22 bp, Homo sapiens
tgagttttttcaacatatgaag

SEQ ID NO: 7611371 - DNA, 22 bp, Homo sapiens
tgataaacagctgatgaagacc

SEQ ID NO: 7611372 - DNA, 22 bp, Homo sapiens
tgagtttggtatctagggggtc

SEQ ID NO: 7611373 - DNA, 22 bp, Homo sapiens
tgagttttggaagacaacacaa

SEQ ID NO: 7611374 - DNA, 22 bp, Homo sapiens
tgagtttgtctgagtggtaaca

SEQ ID NO: 7611375 - DNA, 22 bp, Homo sapiens
tgagttttgtaatattcaagat

SEQ ID NO: 7611376 - DNA, 22 bp, Homo sapiens
tgagttcttcacattacctacg

SEQ ID NO: 7611377 - DNA, 22 bp, Homo sapiens
tgagttgaaagactgacttctg

SEQ ID NO: 7611378 - DNA, 22 bp, Homo sapiens
tgagtctggcggagggaggagc

SEQ ID NO: 7611379 - DNA, 22 bp, Homo sapiens
tgagtctggcggagggaggagc

SEQ ID NO: 7611380 - DNA, 22 bp, Homo sapiens
tgagtctgggcatgttcacttt

SEQ ID NO: 7611381 - DNA, 19 bp, Homo sapiens
tgagttctgtggttctcaa

SEQ ID NO: 7611382 - DNA, 22 bp, Homo sapiens
tgagttcttcacattacctacg

SEQ ID NO: 7611383 - DNA, 22 bp, Homo sapiens
tgagtttaattggagcctgaat

SEQ ID NO: 7611384 - DNA, 22 bp, Homo sapiens
tgagtttaattggagcctgaat

SEQ ID NO: 7611385 - DNA, 22 bp, Homo sapiens
tgagtttagtgtgagacttatc

SEQ ID NO: 7611386 - DNA, 19 bp, Homo sapiens
tgagtttaatgcaaaactg

SEQ ID NO: 7611387 - DNA, 22 bp, Homo sapiens
tgagtttaatgatatttatatg

SEQ ID NO: 7611388 - DNA, 22 bp, Homo sapiens
tgagtttaatggggccctttga

SEQ ID NO: 7611389 - DNA, 22 bp, Homo sapiens
tgagtttaattggagcctgaat

SEQ ID NO: 7611390 - DNA, 22 bp, Homo sapiens
tgagtttaattggagcctgaat

SEQ ID NO: 7611391 - DNA, 22 bp, Homo sapiens
tgagtttaatgatatttatatg

SEQ ID NO: 7611392 - DNA, 22 bp, Homo sapiens
tgagtttaatgatatttatatg

SEQ ID NO: 7611393 - DNA, 22 bp, Homo sapiens
tgagtttaatgatatttatatg

SEQ ID NO: 7611394 - DNA, 22 bp, Homo sapiens
tgagttgccctgccctgtgctt

SEQ ID NO: 7611395 - DNA, 22 bp, Homo sapiens
tgagttgctatctagatccaga

SEQ ID NO: 7611396 - DNA, 22 bp, Homo sapiens
tgagtccatagtggatccttca

SEQ ID NO: 7611397 - DNA, 22 bp, Homo sapiens
tgagtccatagtggatccttca

SEQ ID NO: 7611398 - DNA, 22 bp, Homo sapiens
tgagtccatagtggatccttca

SEQ ID NO: 7611399 - DNA, 22 bp, Homo sapiens
tgagtccatgtggaggggaggt

SEQ ID NO: 7611400 - DNA, 22 bp, Homo sapiens
tgagtccatcgcagggaagtgg

SEQ ID NO: 7611401 - DNA, 22 bp, Homo sapiens
tgagtccattgatggatagtga

SEQ ID NO: 7611402 - DNA, 22 bp, Homo sapiens
tgagtccattctgttttcctgg

SEQ ID NO: 7611403 - DNA, 22 bp, Homo sapiens
tgagtcctaaagctgtgccctt

SEQ ID NO: 7611404 - DNA, 22 bp, Homo sapiens
tgagtcctgctctgggcagggt

SEQ ID NO: 7611405 - DNA, 22 bp, Homo sapiens
tgagtcctgctctgggcagggt

SEQ ID NO: 7611406 - DNA, 22 bp, Homo sapiens
tgagtcctgtctttgtcactta

SEQ ID NO: 7611407 - DNA, 22 bp, Homo sapiens
tgagtctaggacaagttcagga

SEQ ID NO: 7611408 - DNA, 23 bp, Homo sapiens
tgagtctactcaccacaactggg

SEQ ID NO: 7611409 - DNA, 22 bp, Homo sapiens
tgagtctaggtagagaaatgca

SEQ ID NO: 7611410 - DNA, 22 bp, Homo sapiens
tgagtcctgctgagcagagagg

SEQ ID NO: 7611411 - DNA, 22 bp, Homo sapiens
tgagtcctgctgagcagagagg

SEQ ID NO: 7611412 - DNA, 22 bp, Homo sapiens
tgagtcctggctttgggatgta

SEQ ID NO: 7611413 - DNA, 22 bp, Homo sapiens
tgagtcctgctctgggcagggt

SEQ ID NO: 7611414 - DNA, 22 bp, Homo sapiens
tgagtcctgctctgggcagggt

SEQ ID NO: 7611415 - DNA, 22 bp, Homo sapiens
tgagtcctgctctgggcagggt

SEQ ID NO: 7611416 - DNA, 22 bp, Homo sapiens
tgagtctcaactgggaattgat

SEQ ID NO: 7611417 - DNA, 22 bp, Homo sapiens
tgagtctcggtttcccctccaa

SEQ ID NO: 7611418 - DNA, 22 bp, Homo sapiens
tgagtctcccaagtagttggaa

SEQ ID NO: 7611419 - DNA, 21 bp, Homo sapiens
tgagtctctcagcttcaggta

SEQ ID NO: 7611420 - DNA, 21 bp, Homo sapiens
tgagtctctcagcttcaggta

SEQ ID NO: 7611421 - DNA, 22 bp, Homo sapiens
tgagtctgctcctggtagcaga

SEQ ID NO: 7611422 - DNA, 22 bp, Homo sapiens
tgagtctgctcctggtagcaga

SEQ ID NO: 7611423 - DNA, 22 bp, Homo sapiens
tgagtctgatttttctagcatt

SEQ ID NO: 7611424 - DNA, 22 bp, Homo sapiens
tgagtctgatttttctagcatt

SEQ ID NO: 7611425 - DNA, 22 bp, Homo sapiens
tgagcaggggagagcgaatgtg

SEQ ID NO: 7611426 - DNA, 22 bp, Homo sapiens
tgagcaggggagagcgaatgtg

SEQ ID NO: 7611427 - DNA, 22 bp, Homo sapiens
tgagcaggggagagcgaatgtg

SEQ ID NO: 7611428 - DNA, 22 bp, Homo sapiens
tgagcagagacttcaagggcag

SEQ ID NO: 7611429 - DNA, 22 bp, Homo sapiens
tgagcagagacttcaagggcag

SEQ ID NO: 7611430 - DNA, 22 bp, Homo sapiens
tgagcagggagctgggctgagc

SEQ ID NO: 7611431 - DNA, 22 bp, Homo sapiens
tgagcagggagctgggctgagc

SEQ ID NO: 7611432 - DNA, 22 bp, Homo sapiens
tgagcagggagctgggctgagc

SEQ ID NO: 7611433 - DNA, 22 bp, Homo sapiens
ccagggctgctgggggagttga

SEQ ID NO: 7611434 - DNA, 22 bp, Homo sapiens
ccagggctgctgtgggactcca

SEQ ID NO: 7611435 - DNA, 22 bp, Homo sapiens
ccagggctgctgtgggactcca

SEQ ID NO: 7611436 - DNA, 22 bp, Homo sapiens
ccagggctgctgtgggactcca

SEQ ID NO: 7611437 - DNA, 22 bp, Homo sapiens
ccagggctgctgtgggactcca

SEQ ID NO: 7611438 - DNA, 22 bp, Homo sapiens
ccagggctgctgtgggactcca

SEQ ID NO: 7611439 - DNA, 22 bp, Homo sapiens
tgagcagagacgggggcctcca

SEQ ID NO: 7611440 - DNA, 22 bp, Homo sapiens
tgagcagagacgggggcctcca

SEQ ID NO: 7611441 - DNA, 22 bp, Homo sapiens
ccagggctgctcattggctggt

SEQ ID NO: 7611442 - DNA, 22 bp, Homo sapiens
ccagggctgctcattggctggt

SEQ ID NO: 7611443 - DNA, 22 bp, Homo sapiens
ccagggctgctcattggctggt

SEQ ID NO: 7611444 - DNA, 22 bp, Homo sapiens
ccagggctgcctggccgtgtgt

SEQ ID NO: 7611445 - DNA, 22 bp, Homo sapiens
ccagggctgctcattggctggt

SEQ ID NO: 7611446 - DNA, 22 bp, Homo sapiens
ccagggctgctcattggctggt

SEQ ID NO: 7611447 - DNA, 22 bp, Homo sapiens
ccagggctgctcattggctggt

SEQ ID NO: 7611448 - DNA, 22 bp, Homo sapiens
ccagggctgctcattggctggt

SEQ ID NO: 7611449 - DNA, 22 bp, Homo sapiens
ccagggctgcctggccgtgtgt

SEQ ID NO: 7611450 - DNA, 22 bp, Homo sapiens
ccagggctgcctggccgtgtgt

SEQ ID NO: 7611451 - DNA, 22 bp, Homo sapiens
ccagggctgctgggggagttga

SEQ ID NO: 7611452 - DNA, 22 bp, Homo sapiens
ccagggctgctgggggagttga

SEQ ID NO: 7611453 - DNA, 22 bp, Homo sapiens
ccagggctgctgggggagttga

SEQ ID NO: 7611454 - DNA, 22 bp, Homo sapiens
ccagggctgctgggggagttga

SEQ ID NO: 7611455 - DNA, 22 bp, Homo sapiens
ccagggctgctgggggagttga

SEQ ID NO: 7611456 - DNA, 22 bp, Homo sapiens
ccagggctgctcattggctggt

SEQ ID NO: 7611457 - DNA, 18 bp, Homo sapiens
tgagcaggggctgacctt

SEQ ID NO: 7611458 - DNA, 18 bp, Homo sapiens
tgagcaggggctgacctt

SEQ ID NO: 7611459 - DNA, 18 bp, Homo sapiens
tgagcaggggctgacctt

SEQ ID NO: 7611460 - DNA, 18 bp, Homo sapiens
tgagcaggggctgacctt

SEQ ID NO: 7611461 - DNA, 18 bp, Homo sapiens
tgagcaggggctgacctt

SEQ ID NO: 7611462 - DNA, 22 bp, Homo sapiens
tgagcaggtcaagactccagct

SEQ ID NO: 7611463 - DNA, 22 bp, Homo sapiens
tgagcaggtcaagactccagct

SEQ ID NO: 7611464 - DNA, 22 bp, Homo sapiens
tgagcaggtcaagactccagct

SEQ ID NO: 7611465 - DNA, 22 bp, Homo sapiens
tgagcaggtcaagactccagct

SEQ ID NO: 7611466 - DNA, 22 bp, Homo sapiens
tgagcaggtcaagactccagct

SEQ ID NO: 7611467 - DNA, 22 bp, Homo sapiens
tgagcaggtcaagactccagct

SEQ ID NO: 7611468 - DNA, 22 bp, Homo sapiens
tgagcaggtcaggaagtacatt

SEQ ID NO: 7611469 - DNA, 22 bp, Homo sapiens
tgagcaggtgagtctagggcag

SEQ ID NO: 7611470 - DNA, 22 bp, Homo sapiens
tgagcaggtcaggaagtacatt

SEQ ID NO: 7611471 - DNA, 22 bp, Homo sapiens
tgagcaggtcaggaagtacatt

SEQ ID NO: 7611472 - DNA, 22 bp, Homo sapiens
tgagcaggtcaggaagtacatt

SEQ ID NO: 7611473 - DNA, 22 bp, Homo sapiens
tgagcaggtgagtctagggcag

SEQ ID NO: 7611474 - DNA, 22 bp, Homo sapiens
tgagcaggtgagtctagggcag

SEQ ID NO: 7611475 - DNA, 22 bp, Homo sapiens
tgagcaggtgagtctagggcag

SEQ ID NO: 7611476 - DNA, 22 bp, Homo sapiens
tgagcaggtgagtctagggcag

SEQ ID NO: 7611477 - DNA, 22 bp, Homo sapiens
tgagcaggtgagtctagggcag

SEQ ID NO: 7611478 - DNA, 22 bp, Homo sapiens
tgagcagtaggtctgaatagtg

SEQ ID NO: 7611479 - DNA, 17 bp, Homo sapiens
tgagcagtagaagatgc

SEQ ID NO: 7611480 - DNA, 21 bp, Homo sapiens
tgagcaggtgctgcttttatg

SEQ ID NO: 7611481 - DNA, 22 bp, Homo sapiens
tgagcagtaacagctcacaggg

SEQ ID NO: 7611482 - DNA, 22 bp, Homo sapiens
tgagcagtaacagctcacaggg

SEQ ID NO: 7611483 - DNA, 22 bp, Homo sapiens
tgagcagtaacagctcacaggg

SEQ ID NO: 7611484 - DNA, 22 bp, Homo sapiens
tgagcaggtgagtctagggcag

SEQ ID NO: 7611485 - DNA, 21 bp, Homo sapiens
tgagcaggtgcagggaagtgg

SEQ ID NO: 7611486 - DNA, 21 bp, Homo sapiens
tgagcaggtgcagggaagtgg

SEQ ID NO: 7611487 - DNA, 21 bp, Homo sapiens
tgagcaggtgcagggaagtgg

SEQ ID NO: 7611488 - DNA, 21 bp, Homo sapiens
tgagcaggtgcagggaagtgg

SEQ ID NO: 7611489 - DNA, 21 bp, Homo sapiens
tgagcaggtgcagggaagtgg

SEQ ID NO: 7611490 - DNA, 21 bp, Homo sapiens
tgagcaggtgcagggaagtgg

SEQ ID NO: 7611491 - DNA, 21 bp, Homo sapiens
tgagcaggtgcagggaagtgg

SEQ ID NO: 7611492 - DNA, 21 bp, Homo sapiens
tgagcaggtgctgcttttatg

SEQ ID NO: 7611493 - DNA, 21 bp, Homo sapiens
tgagcaggtgcagggaagtgg

SEQ ID NO: 7611494 - DNA, 21 bp, Homo sapiens
tgagcaggtgctgcttttatg

SEQ ID NO: 7611495 - DNA, 21 bp, Homo sapiens
tgagcaggtgctgcttttatg

SEQ ID NO: 7611496 - DNA, 22 bp, Homo sapiens
ccagtccacgtcaagaagaggt

SEQ ID NO: 7611497 - DNA, 20 bp, Homo sapiens
ccagtccacctgagacatgt

SEQ ID NO: 7611498 - DNA, 20 bp, Homo sapiens
ccagtccacctgagacatgt

SEQ ID NO: 7611499 - DNA, 22 bp, Homo sapiens
ccagtccacgtcaagaagaggt

SEQ ID NO: 7611500 - DNA, 20 bp, Homo sapiens
ccagtccacctgagacatgt

SEQ ID NO: 7611501 - DNA, 20 bp, Homo sapiens
ccagtccacctgagacatgt

SEQ ID NO: 7611502 - DNA, 22 bp, Homo sapiens
ccagtcagttctgattatgtgg

SEQ ID NO: 7611503 - DNA, 22 bp, Homo sapiens
ccagtcagttctgattatgtgg

SEQ ID NO: 7611504 - DNA, 22 bp, Homo sapiens
ccagtcattaagaacccttact

SEQ ID NO: 7611505 - DNA, 22 bp, Homo sapiens
ccagtcattaagaacccttact

SEQ ID NO: 7611506 - DNA, 22 bp, Homo sapiens
ccagtcagggcaggagcctggt

SEQ ID NO: 7611507 - DNA, 20 bp, Homo sapiens
ccagtccaaattccttatga

SEQ ID NO: 7611508 - DNA, 22 bp, Homo sapiens
ccagtccatatttatactgccg

SEQ ID NO: 7611509 - DNA, 22 bp, Homo sapiens
ccagtccatatttatactgccg

SEQ ID NO: 7611510 - DNA, 22 bp, Homo sapiens
ccagtccatatttatactgccg

SEQ ID NO: 7611511 - DNA, 22 bp, Homo sapiens
ccagtccaggccatggattttg

SEQ ID NO: 7611512 - DNA, 22 bp, Homo sapiens
ccagtccagtgccatgcatggc

SEQ ID NO: 7611513 - DNA, 22 bp, Homo sapiens
ccagtccatatttatactgccg

SEQ ID NO: 7611514 - DNA, 22 bp, Homo sapiens
ccagtccagtgccatgcatggc

SEQ ID NO: 7611515 - DNA, 22 bp, Homo sapiens
ccagtccagtgccatgcatggc

SEQ ID NO: 7611516 - DNA, 22 bp, Homo sapiens
ccagtccaggccatggattttg

SEQ ID NO: 7611517 - DNA, 22 bp, Homo sapiens
ccagtccaggccatggattttg

SEQ ID NO: 7611518 - DNA, 22 bp, Homo sapiens
ccagtcactggaaaatgggaat

SEQ ID NO: 7611519 - DNA, 17 bp, Homo sapiens
ccaggtgggaggtgggg

SEQ ID NO: 7611520 - DNA, 22 bp, Homo sapiens
ccagtcagagaaaatgtccact

SEQ ID NO: 7611521 - DNA, 22 bp, Homo sapiens
ccagtcagagaaaatgtccact

SEQ ID NO: 7611522 - DNA, 22 bp, Homo sapiens
ccaggtgtgtcaccattgccca

SEQ ID NO: 7611523 - DNA, 22 bp, Homo sapiens
ccagtcagccaagctgcagcgg

SEQ ID NO: 7611524 - DNA, 22 bp, Homo sapiens
ccagtcagccaagctgcagcgg

SEQ ID NO: 7611525 - DNA, 22 bp, Homo sapiens
ccagtcagagcagcgctcgcat

SEQ ID NO: 7611526 - DNA, 22 bp, Homo sapiens
ccagtcagccaagctgcagcgg

SEQ ID NO: 7611527 - DNA, 22 bp, Homo sapiens
ccagtcagggcaggagcctggt

SEQ ID NO: 7611528 - DNA, 22 bp, Homo sapiens
ccagtcagggcaggagcctggt

SEQ ID NO: 7611529 - DNA, 22 bp, Homo sapiens
ccagtcagccaagctgcagcgg

SEQ ID NO: 7611530 - DNA, 22 bp, Homo sapiens
ccagtcagggcaggagcctggt

SEQ ID NO: 7611531 - DNA, 22 bp, Homo sapiens
ccagtcagtcagttgctggcat

SEQ ID NO: 7611532 - DNA, 22 bp, Homo sapiens
ccagtcagtcagttgctggcat

SEQ ID NO: 7611533 - DNA, 22 bp, Homo sapiens
ccagtcagggcaggagcctggt

SEQ ID NO: 7611534 - DNA, 22 bp, Homo sapiens
ccagtcagtcagttgctggcat

SEQ ID NO: 7611535 - DNA, 22 bp, Homo sapiens
ccagtcagtcagttgctggcat

SEQ ID NO: 7611536 - DNA, 22 bp, Homo sapiens
ccagtcagtcagttgctggcat

SEQ ID NO: 7611537 - DNA, 22 bp, Homo sapiens
ccaggtggataaggtttctgga

SEQ ID NO: 7611538 - DNA, 22 bp, Homo sapiens
ccaggtggccctgccctactct

SEQ ID NO: 7611539 - DNA, 22 bp, Homo sapiens
ccaggtggccctgccctactct

SEQ ID NO: 7611540 - DNA, 22 bp, Homo sapiens
ccaggtggaggtgtgaggtcct

SEQ ID NO: 7611541 - DNA, 22 bp, Homo sapiens
ccaggtggaggtgtgaggtcct

SEQ ID NO: 7611542 - DNA, 22 bp, Homo sapiens
ccaggtggaggtgtgaggtcct

SEQ ID NO: 7611543 - DNA, 22 bp, Homo sapiens
ccaggtggaggtgtgaggtcct

SEQ ID NO: 7611544 - DNA, 22 bp, Homo sapiens
tgagcagtcagacaagcatcac

SEQ ID NO: 7611545 - DNA, 22 bp, Homo sapiens
tgagcagtcagacaagcatcac

SEQ ID NO: 7611546 - DNA, 22 bp, Homo sapiens
tgagcagtcatccatttctcct

SEQ ID NO: 7611547 - DNA, 22 bp, Homo sapiens
tgagcagtcatccatttctcct

SEQ ID NO: 7611548 - DNA, 22 bp, Homo sapiens
ccaggtggaggtgtgaggtcct

SEQ ID NO: 7611549 - DNA, 22 bp, Homo sapiens
ccaggtggacttgatttgaata

SEQ ID NO: 7611550 - DNA, 22 bp, Homo sapiens
ccaggtggaggtgtgaggtcct

SEQ ID NO: 7611551 - DNA, 22 bp, Homo sapiens
tgagcagtcatccatttctcct

SEQ ID NO: 7611552 - DNA, 22 bp, Homo sapiens
ccaggtggacggcgagtacagg

SEQ ID NO: 7611553 - DNA, 22 bp, Homo sapiens
ccaggtggacggcgagtacagg

SEQ ID NO: 7611554 - DNA, 22 bp, Homo sapiens
ccaggtggcttctgcccgatgt

SEQ ID NO: 7611555 - DNA, 22 bp, Homo sapiens
ccaggtgggaggaaagcagaga

SEQ ID NO: 7611556 - DNA, 22 bp, Homo sapiens
ccaggtggcttctgcccgatgt

SEQ ID NO: 7611557 - DNA, 22 bp, Homo sapiens
ccaggtggcttctgcccgatgt

SEQ ID NO: 7611558 - DNA, 22 bp, Homo sapiens
ccaggtgggaggaaagcagaga

SEQ ID NO: 7611559 - DNA, 17 bp, Homo sapiens
ccaggtgggaggtgggg

SEQ ID NO: 7611560 - DNA, 17 bp, Homo sapiens
ccaggtgggaggtgggg

SEQ ID NO: 7611561 - DNA, 17 bp, Homo sapiens
ccaggtgggaggtgggg

SEQ ID NO: 7611562 - DNA, 22 bp, Homo sapiens
ccaggtgtgtcaccattgccca

SEQ ID NO: 7611563 - DNA, 17 bp, Homo sapiens
ccaggtgggaggtgggg

SEQ ID NO: 7611564 - DNA, 22 bp, Homo sapiens
ccaggtgggaggaaagcagaga

SEQ ID NO: 7611565 - DNA, 22 bp, Homo sapiens
ccaggtggaggtgtgaggtcct

SEQ ID NO: 7611566 - DNA, 22 bp, Homo sapiens
ccaggtgggaggaaagcagaga

SEQ ID NO: 7611567 - DNA, 17 bp, Homo sapiens
ccaggtgggaggtgggg

SEQ ID NO: 7611568 - DNA, 22 bp, Homo sapiens
tgaggcagtgctgggaagcctg

SEQ ID NO: 7611569 - DNA, 22 bp, Homo sapiens
tgaggcagtgctgggaagcctg

SEQ ID NO: 7611570 - DNA, 22 bp, Homo sapiens
tgaggcagtgtgagataataaa

SEQ ID NO: 7611571 - DNA, 22 bp, Homo sapiens
tgaggcagtgtgagataataaa

SEQ ID NO: 7611572 - DNA, 22 bp, Homo sapiens
ccagtggccatgcacgagcagc

SEQ ID NO: 7611573 - DNA, 22 bp, Homo sapiens
ccagtggagtttttatacccag

SEQ ID NO: 7611574 - DNA, 22 bp, Homo sapiens
ccagtggccatgcacgagcagc

SEQ ID NO: 7611575 - DNA, 22 bp, Homo sapiens
tgaggcagtgctgggaagcctg

SEQ ID NO: 7611576 - DNA, 22 bp, Homo sapiens
ccagtggacttctccctgtggt

SEQ ID NO: 7611577 - DNA, 22 bp, Homo sapiens
ccagtggacttctccctgtggt

SEQ ID NO: 7611578 - DNA, 22 bp, Homo sapiens
ccagtggaaatgtggtcaggat

SEQ ID NO: 7611579 - DNA, 22 bp, Homo sapiens
ccagtggacaatttctgaggaa

SEQ ID NO: 7611580 - DNA, 22 bp, Homo sapiens
ccagtggacaatttctgaggaa

SEQ ID NO: 7611581 - DNA, 22 bp, Homo sapiens
ccagtggaattaaaaataagtg

SEQ ID NO: 7611582 - DNA, 22 bp, Homo sapiens
ccagtggaaatgtggtcaggat

SEQ ID NO: 7611583 - DNA, 22 bp, Homo sapiens
ccagtgctaaggtagcctctgc

SEQ ID NO: 7611584 - DNA, 22 bp, Homo sapiens
ccagtgctaaggtagcctctgc

SEQ ID NO: 7611585 - DNA, 22 bp, Homo sapiens
ccagtgcgcaggcgccacctgt

SEQ ID NO: 7611586 - DNA, 21 bp, Homo sapiens
ccagtgctacagctgcctgac

SEQ ID NO: 7611587 - DNA, 21 bp, Homo sapiens
ccagtgctacagctgcctgac

SEQ ID NO: 7611588 - DNA, 21 bp, Homo sapiens
ccagtgctacagctgcctgac

SEQ ID NO: 7611589 - DNA, 21 bp, Homo sapiens
ccagtgctacagctgcctgac

SEQ ID NO: 7611590 - DNA, 21 bp, Homo sapiens
ccagtgctacagctgcctgac

SEQ ID NO: 7611591 - DNA, 22 bp, Homo sapiens
ccagtgcttctttgctagctgg

SEQ ID NO: 7611592 - DNA, 22 bp, Homo sapiens
ccagtgctgaatgaggaggtct

SEQ ID NO: 7611593 - DNA, 22 bp, Homo sapiens
ccagtgctcttaaaggtcataa

SEQ ID NO: 7611594 - DNA, 22 bp, Homo sapiens
ccagtgcccagctgcccaggca

SEQ ID NO: 7611595 - DNA, 18 bp, Homo sapiens
ccagtgccaagagtggca

SEQ ID NO: 7611596 - DNA, 22 bp, Homo sapiens
ccagtgcccagctgcccaggca

SEQ ID NO: 7611597 - DNA, 18 bp, Homo sapiens
ccagtgccaagagtggca

SEQ ID NO: 7611598 - DNA, 22 bp, Homo sapiens
ccagtgcccagctgcccaggca

SEQ ID NO: 7611599 - DNA, 22 bp, Homo sapiens
ccagtgcccagctgcccaggca

SEQ ID NO: 7611600 - DNA, 22 bp, Homo sapiens
ccagtgcccagctgcccaggca

SEQ ID NO: 7611601 - DNA, 22 bp, Homo sapiens
ccagtgcccagctgcccaggca

SEQ ID NO: 7611602 - DNA, 22 bp, Homo sapiens
ccagtgcccagtctccctggtc

SEQ ID NO: 7611603 - DNA, 22 bp, Homo sapiens
ccagtgcccagtctccctggtc

SEQ ID NO: 7611604 - DNA, 22 bp, Homo sapiens
ccagtgcccagctgcccaggca

SEQ ID NO: 7611605 - DNA, 22 bp, Homo sapiens
ccagtgcccagctgcccaggca

SEQ ID NO: 7611606 - DNA, 22 bp, Homo sapiens
ccagtgcccagctgcccaggca

SEQ ID NO: 7611607 - DNA, 22 bp, Homo sapiens
ccagtgcccagctgcccaggca

SEQ ID NO: 7611608 - DNA, 22 bp, Homo sapiens
ccagtgcattgccgtgtctagg

SEQ ID NO: 7611609 - DNA, 22 bp, Homo sapiens
ccagtgcaggtgagcaccaggt

SEQ ID NO: 7611610 - DNA, 22 bp, Homo sapiens
ccagtgcataatcaatacagcc

SEQ ID NO: 7611611 - DNA, 22 bp, Homo sapiens
ccagtgcattgccgtgtctagg

SEQ ID NO: 7611612 - DNA, 22 bp, Homo sapiens
ccagtgcagtccccctgaactg

SEQ ID NO: 7611613 - DNA, 22 bp, Homo sapiens
ccagtgcagtccccctgaactg

SEQ ID NO: 7611614 - DNA, 22 bp, Homo sapiens
ccagtgcctgtgggcatggtgc

SEQ ID NO: 7611615 - DNA, 22 bp, Homo sapiens
ccagtgcctgtgggcatggtgc

SEQ ID NO: 7611616 - DNA, 22 bp, Homo sapiens
ccagtgcgagcctgtgctggcc

SEQ ID NO: 7611617 - DNA, 22 bp, Homo sapiens
ccagtgcctgtgggcatggtgc

SEQ ID NO: 7611618 - DNA, 22 bp, Homo sapiens
ccagtgcctgtgggcatggtgc

SEQ ID NO: 7611619 - DNA, 22 bp, Homo sapiens
ccagtgcctgtgggcatggtgc

SEQ ID NO: 7611620 - DNA, 17 bp, Homo sapiens
ccagtgcctgtggcaac

SEQ ID NO: 7611621 - DNA, 22 bp, Homo sapiens
ccagtgcctatctcctctggga

SEQ ID NO: 7611622 - DNA, 22 bp, Homo sapiens
ccagtgcctatctcctctggga

SEQ ID NO: 7611623 - DNA, 17 bp, Homo sapiens
ccagtgcctgtggcaac

SEQ ID NO: 7611624 - DNA, 17 bp, Homo sapiens
ccagtgcctgtggcaac

SEQ ID NO: 7611625 - DNA, 17 bp, Homo sapiens
ccagtgcctgtggcaac

SEQ ID NO: 7611626 - DNA, 19 bp, Homo sapiens
ccagtgccggcgctgggga

SEQ ID NO: 7611627 - DNA, 19 bp, Homo sapiens
ccagtgccggcgctgggga

SEQ ID NO: 7611628 - DNA, 22 bp, Homo sapiens
ccagtgcccagtctccctggtc

SEQ ID NO: 7611629 - DNA, 22 bp, Homo sapiens
ccagtgcccagctgcccaggca

SEQ ID NO: 7611630 - DNA, 22 bp, Homo sapiens
ccagtgcccagtctccctggtc

SEQ ID NO: 7611631 - DNA, 22 bp, Homo sapiens
ccagtgcccagtctccctggtc

SEQ ID NO: 7611632 - DNA, 22 bp, Homo sapiens
ccagtgcccagtctccctggtc

SEQ ID NO: 7611633 - DNA, 22 bp, Homo sapiens
ccagtgcctatctcctctggga

SEQ ID NO: 7611634 - DNA, 22 bp, Homo sapiens
ccagtgcctatctcctctggga

SEQ ID NO: 7611635 - DNA, 19 bp, Homo sapiens
ccagtgccggcgctgggga

SEQ ID NO: 7611636 - DNA, 22 bp, Homo sapiens
ccagtgcctatccttctcctgt

SEQ ID NO: 7611637 - DNA, 22 bp, Homo sapiens
tgagcccaggagtatgaggctg

SEQ ID NO: 7611638 - DNA, 22 bp, Homo sapiens
tgagcccaggagtatgaggctg

SEQ ID NO: 7611639 - DNA, 23 bp, Homo sapiens
tgagcccaggaggtcaaggctgc

SEQ ID NO: 7611640 - DNA, 23 bp, Homo sapiens
tgagcccaggaggtcaaggctgc

SEQ ID NO: 7611641 - DNA, 22 bp, Homo sapiens
tgagcccaggaggcagaggttg

SEQ ID NO: 7611642 - DNA, 22 bp, Homo sapiens
tgagcccagcgtcccgttctgt

SEQ ID NO: 7611643 - DNA, 22 bp, Homo sapiens
tgagcccagcgtcccgttctgt

SEQ ID NO: 7611644 - DNA, 22 bp, Homo sapiens
tgagcccaggaggcagaggttg

SEQ ID NO: 7611645 - DNA, 22 bp, Homo sapiens
tgagcccagaagcccactcggc

SEQ ID NO: 7611646 - DNA, 22 bp, Homo sapiens
tgagcccagaagcccactcggc

SEQ ID NO: 7611647 - DNA, 22 bp, Homo sapiens
tgagcccagagatctgagctat

SEQ ID NO: 7611648 - DNA, 22 bp, Homo sapiens
tgagcccagagatctgagctat

SEQ ID NO: 7611649 - DNA, 22 bp, Homo sapiens
tgagcccagagcccttgtaggg

SEQ ID NO: 7611650 - DNA, 22 bp, Homo sapiens
ccagtctgaggcctggtgaggg

SEQ ID NO: 7611651 - DNA, 22 bp, Homo sapiens
ccagtctgaggcctggtgaggg

SEQ ID NO: 7611652 - DNA, 22 bp, Homo sapiens
tgagcccaggagttggagaccg

SEQ ID NO: 7611653 - DNA, 22 bp, Homo sapiens
tgagcccaggagtatgaggctg

SEQ ID NO: 7611654 - DNA, 22 bp, Homo sapiens
ccagtgcaggtgagcaccaggt

SEQ ID NO: 7611655 - DNA, 22 bp, Homo sapiens
ccagtgcaggtgagcaccaggt

SEQ ID NO: 7611656 - DNA, 22 bp, Homo sapiens
ccagtgcagtccccctgaactg

SEQ ID NO: 7611657 - DNA, 22 bp, Homo sapiens
ccagtctgcagcccctggggac

SEQ ID NO: 7611658 - DNA, 22 bp, Homo sapiens
ccagtctgcagcccctggggac

SEQ ID NO: 7611659 - DNA, 22 bp, Homo sapiens
ccagtctgcagcccctggggac

SEQ ID NO: 7611660 - DNA, 22 bp, Homo sapiens
ccagtgcaggtgagcaccaggt

SEQ ID NO: 7611661 - DNA, 22 bp, Homo sapiens
ccagtgcaggtgagcaccaggt

SEQ ID NO: 7611662 - DNA, 22 bp, Homo sapiens
tgagcccagaagcccactcggc

SEQ ID NO: 7611663 - DNA, 22 bp, Homo sapiens
tgagccatgggactccaaggga

SEQ ID NO: 7611664 - DNA, 22 bp, Homo sapiens
tgagccatgggactccaaggga

SEQ ID NO: 7611665 - DNA, 22 bp, Homo sapiens
tgagccatgggactccaaggga

SEQ ID NO: 7611666 - DNA, 22 bp, Homo sapiens
tgagccatgggactccaaggga

SEQ ID NO: 7611667 - DNA, 22 bp, Homo sapiens
tgagccatgggactccaaggga

SEQ ID NO: 7611668 - DNA, 22 bp, Homo sapiens
tgagccatgggactccaaggga

SEQ ID NO: 7611669 - DNA, 22 bp, Homo sapiens
tgagccagttcttcagatccat

SEQ ID NO: 7611670 - DNA, 22 bp, Homo sapiens
tgagccagttcttcagatccat

SEQ ID NO: 7611671 - DNA, 22 bp, Homo sapiens
tgagccagttcttcagatccat

SEQ ID NO: 7611672 - DNA, 22 bp, Homo sapiens
tgagccagtggaagatggcagt

SEQ ID NO: 7611673 - DNA, 22 bp, Homo sapiens
tgagccagtggaagatggcagt

SEQ ID NO: 7611674 - DNA, 22 bp, Homo sapiens
tgagccagtgtggtaaagctga

SEQ ID NO: 7611675 - DNA, 22 bp, Homo sapiens
tgagccagttcttcagatccat

SEQ ID NO: 7611676 - DNA, 22 bp, Homo sapiens
ccagtcccaggcagaaatccag

SEQ ID NO: 7611677 - DNA, 22 bp, Homo sapiens
ccagtcccagctctgccatgct

SEQ ID NO: 7611678 - DNA, 22 bp, Homo sapiens
ccagtcccagctctgccatgct

SEQ ID NO: 7611679 - DNA, 22 bp, Homo sapiens
ccagtcccagctctgccatgct

SEQ ID NO: 7611680 - DNA, 22 bp, Homo sapiens
ccagtcccagctctgccatgct

SEQ ID NO: 7611681 - DNA, 22 bp, Homo sapiens
ccagtcccagctctgccatgct

SEQ ID NO: 7611682 - DNA, 22 bp, Homo sapiens
ccagtcccagctctgccatgct

SEQ ID NO: 7611683 - DNA, 22 bp, Homo sapiens
ccagtccatatttatactgccg

SEQ ID NO: 7611684 - DNA, 22 bp, Homo sapiens
ccagtccatggattcccaaggt

SEQ ID NO: 7611685 - DNA, 22 bp, Homo sapiens
ccagtccatggattcccaaggt

SEQ ID NO: 7611686 - DNA, 19 bp, Homo sapiens
ccagtcccatacaggagat

SEQ ID NO: 7611687 - DNA, 19 bp, Homo sapiens
ccagtcccatacaggagat

SEQ ID NO: 7611688 - DNA, 19 bp, Homo sapiens
ccagtcccatacaggagat

SEQ ID NO: 7611689 - DNA, 19 bp, Homo sapiens
ccagtcccatacaggagat

SEQ ID NO: 7611690 - DNA, 19 bp, Homo sapiens
ccagtcccatacaggagat

SEQ ID NO: 7611691 - DNA, 22 bp, Homo sapiens
ccagtcccatctctgtcgctta

SEQ ID NO: 7611692 - DNA, 22 bp, Homo sapiens
ccagtcccatctctgtcgctta

SEQ ID NO: 7611693 - DNA, 19 bp, Homo sapiens
ccagtcccatacaggagat

SEQ ID NO: 7611694 - DNA, 22 bp, Homo sapiens
ccagtcccatctctgtcgctta

SEQ ID NO: 7611695 - DNA, 22 bp, Homo sapiens
tgagccagtggaagatggcagt

SEQ ID NO: 7611696 - DNA, 19 bp, Homo sapiens
tgcactagtcatttctgta

SEQ ID NO: 7611697 - DNA, 22 bp, Homo sapiens
tgcactagccacatttcaaatg

SEQ ID NO: 7611698 - DNA, 22 bp, Homo sapiens
tgcactattgtgttcactatta

SEQ ID NO: 7611699 - DNA, 22 bp, Homo sapiens
tgcactattttcaggctttgtg

SEQ ID NO: 7611700 - DNA, 22 bp, Homo sapiens
tgcactattttcaggctttgtg

SEQ ID NO: 7611701 - DNA, 22 bp, Homo sapiens
tgcactatttcgccatggttgt

SEQ ID NO: 7611702 - DNA, 22 bp, Homo sapiens
tgcactattgtgttcactatta

SEQ ID NO: 7611703 - DNA, 22 bp, Homo sapiens
tgcactatttcgccatggttgt

SEQ ID NO: 7611704 - DNA, 22 bp, Homo sapiens
tgcacagatgctaggaggtgaa

SEQ ID NO: 7611705 - DNA, 22 bp, Homo sapiens
tgcacagatgggcttgttcata

SEQ ID NO: 7611706 - DNA, 22 bp, Homo sapiens
tgcacagatgggcttgttcata

SEQ ID NO: 7611707 - DNA, 18 bp, Homo sapiens
tgcactagatgctggcag

SEQ ID NO: 7611708 - DNA, 22 bp, Homo sapiens
tgcactccaggctgggtgacag

SEQ ID NO: 7611709 - DNA, 22 bp, Homo sapiens
tgcactccaggctgggtgacag

SEQ ID NO: 7611710 - DNA, 22 bp, Homo sapiens
tgcactccaggctgggtgacag

SEQ ID NO: 7611711 - DNA, 22 bp, Homo sapiens
tgcactccaggctgggtgacag

SEQ ID NO: 7611712 - DNA, 22 bp, Homo sapiens
tgcactccaggctgggtgacag

SEQ ID NO: 7611713 - DNA, 22 bp, Homo sapiens
tgcactccaggctgggtgacag

SEQ ID NO: 7611714 - DNA, 22 bp, Homo sapiens
tgcacagatctggtggcaagga

SEQ ID NO: 7611715 - DNA, 22 bp, Homo sapiens
tgcacagatgctaggaggtgaa

SEQ ID NO: 7611716 - DNA, 22 bp, Homo sapiens
cccaagggtgcccagcagagga

SEQ ID NO: 7611717 - DNA, 22 bp, Homo sapiens
cccaagggtgcccagcagagga

SEQ ID NO: 7611718 - DNA, 22 bp, Homo sapiens
cccaagggtgcccagcagagga

SEQ ID NO: 7611719 - DNA, 22 bp, Homo sapiens
cccaagggtgcccagcagagga

SEQ ID NO: 7611720 - DNA, 22 bp, Homo sapiens
cccaaggggtgttgatggagga

SEQ ID NO: 7611721 - DNA, 22 bp, Homo sapiens
cccaaggggtgttgatggagga

SEQ ID NO: 7611722 - DNA, 22 bp, Homo sapiens
cccaaggggtgttgatggagga

SEQ ID NO: 7611723 - DNA, 22 bp, Homo sapiens
cccaagggagtgcctggtcaac

SEQ ID NO: 7611724 - DNA, 22 bp, Homo sapiens
cccaagggagtgcctggtcaac

SEQ ID NO: 7611725 - DNA, 22 bp, Homo sapiens
cccaagggagtgcctggtcaac

SEQ ID NO: 7611726 - DNA, 22 bp, Homo sapiens
cccaagggatgcttgagtagtt

SEQ ID NO: 7611727 - DNA, 22 bp, Homo sapiens
cccaagggatgcttgagtagtt

SEQ ID NO: 7611728 - DNA, 22 bp, Homo sapiens
cccaagggatgcttgagtagtt

SEQ ID NO: 7611729 - DNA, 22 bp, Homo sapiens
cccaaggggagattttcttgag

SEQ ID NO: 7611730 - DNA, 22 bp, Homo sapiens
cccaaggggagattttcttgag

SEQ ID NO: 7611731 - DNA, 22 bp, Homo sapiens
cccaaggggtgttgatggagga

SEQ ID NO: 7611732 - DNA, 22 bp, Homo sapiens
cccaaggggtgttgatggagga

SEQ ID NO: 7611733 - DNA, 22 bp, Homo sapiens
cccaaggggtgttgatggagga

SEQ ID NO: 7611734 - DNA, 22 bp, Homo sapiens
cccaagggatgcttgagtagtt

SEQ ID NO: 7611735 - DNA, 22 bp, Homo sapiens
cccaagggatgcttgagtagtt

SEQ ID NO: 7611736 - DNA, 22 bp, Homo sapiens
cccaagggatgcttgagtagtt

SEQ ID NO: 7611737 - DNA, 22 bp, Homo sapiens
tgcaatcaggtaccatttgatt

SEQ ID NO: 7611738 - DNA, 21 bp, Homo sapiens
tgcaatccagcctgggcgaca

SEQ ID NO: 7611739 - DNA, 23 bp, Homo sapiens
cccaagcctgtgccctctgactc

SEQ ID NO: 7611740 - DNA, 23 bp, Homo sapiens
cccaagcctgtgccctctgactc

SEQ ID NO: 7611741 - DNA, 23 bp, Homo sapiens
cccaagcctgtgccctctgactc

SEQ ID NO: 7611742 - DNA, 23 bp, Homo sapiens
cccaagcctgtgccctctgactc

SEQ ID NO: 7611743 - DNA, 23 bp, Homo sapiens
cccaagcctgtgccctctgactc

SEQ ID NO: 7611744 - DNA, 22 bp, Homo sapiens
cccaaggaagacgcttgtgata

SEQ ID NO: 7611745 - DNA, 22 bp, Homo sapiens
cccaaggaagacgcttgtgata

SEQ ID NO: 7611746 - DNA, 22 bp, Homo sapiens
cccaagcctttcaaaactcaga

SEQ ID NO: 7611747 - DNA, 22 bp, Homo sapiens
cccaagcctttcaaaactcaga

SEQ ID NO: 7611748 - DNA, 23 bp, Homo sapiens
cccaagcctgtgccctctgactc

SEQ ID NO: 7611749 - DNA, 22 bp, Homo sapiens
cccaaggacacgggcagggaca

SEQ ID NO: 7611750 - DNA, 22 bp, Homo sapiens
cccaaggacacgggcagggaca

SEQ ID NO: 7611751 - DNA, 22 bp, Homo sapiens
cccaaggacacgggcagggaca

SEQ ID NO: 7611752 - DNA, 22 bp, Homo sapiens
cccaaggaataggatcccagga

SEQ ID NO: 7611753 - DNA, 19 bp, Homo sapiens
cccaaggccctgggcaggc

SEQ ID NO: 7611754 - DNA, 19 bp, Homo sapiens
cccaaggccctgggcaggc

SEQ ID NO: 7611755 - DNA, 19 bp, Homo sapiens
cccaaggccctgggcaggc

SEQ ID NO: 7611756 - DNA, 22 bp, Homo sapiens
cccaaggccttcaagccagctc

SEQ ID NO: 7611757 - DNA, 22 bp, Homo sapiens
cccaaggccttcaagccagctc

SEQ ID NO: 7611758 - DNA, 22 bp, Homo sapiens
cccaaggcctctccttggcttg

SEQ ID NO: 7611759 - DNA, 22 bp, Homo sapiens
cccaaggcctctccttggcttg

SEQ ID NO: 7611760 - DNA, 21 bp, Homo sapiens
cccaagggaggcaggataagg

SEQ ID NO: 7611761 - DNA, 21 bp, Homo sapiens
cccaagggaggcaggataagg

SEQ ID NO: 7611762 - DNA, 22 bp, Homo sapiens
cccaagggagtgcctggtcaac

SEQ ID NO: 7611763 - DNA, 21 bp, Homo sapiens
cccaagggaggcaggataagg

SEQ ID NO: 7611764 - DNA, 21 bp, Homo sapiens
cccaagggaggcaggataagg

SEQ ID NO: 7611765 - DNA, 21 bp, Homo sapiens
cccaagggaggcaggataagg

SEQ ID NO: 7611766 - DNA, 22 bp, Homo sapiens
cccaaggctgcagtgagcatga

SEQ ID NO: 7611767 - DNA, 22 bp, Homo sapiens
cccaaggctgcagtgagcatga

SEQ ID NO: 7611768 - DNA, 22 bp, Homo sapiens
cccaaggctgcagtgagcatga

SEQ ID NO: 7611769 - DNA, 22 bp, Homo sapiens
cccaaggctgcagtgagcatga

SEQ ID NO: 7611770 - DNA, 22 bp, Homo sapiens
cccaaggccttcaagccagctc

SEQ ID NO: 7611771 - DNA, 22 bp, Homo sapiens
tgcaaatattgggacagtctag

SEQ ID NO: 7611772 - DNA, 22 bp, Homo sapiens
tgcaaatattgggacagtctag

SEQ ID NO: 7611773 - DNA, 22 bp, Homo sapiens
tgcaaatattgggacagtctag

SEQ ID NO: 7611774 - DNA, 22 bp, Homo sapiens
tgcaaatattgggacagtctag

SEQ ID NO: 7611775 - DNA, 19 bp, Homo sapiens
tgcaagtgtcttggacaag

SEQ ID NO: 7611776 - DNA, 22 bp, Homo sapiens
tgcaagtgccatgtgcacagtg

SEQ ID NO: 7611777 - DNA, 22 bp, Homo sapiens
tgcaagtatgacagccccatgg

SEQ ID NO: 7611778 - DNA, 22 bp, Homo sapiens
tgcaagtgccatgtgcacagtg

SEQ ID NO: 7611779 - DNA, 22 bp, Homo sapiens
tgcaataacccagtatctgtga

SEQ ID NO: 7611780 - DNA, 22 bp, Homo sapiens
tgcaataaagtgctataaatcc

SEQ ID NO: 7611781 - DNA, 22 bp, Homo sapiens
tgcaataaagtgctataaatcc

SEQ ID NO: 7611782 - DNA, 22 bp, Homo sapiens
tgcaataacccagtatctgtga

SEQ ID NO: 7611783 - DNA, 22 bp, Homo sapiens
tgcaataacccagtatctgtga

SEQ ID NO: 7611784 - DNA, 22 bp, Homo sapiens
tgcaataaagtgctataaatcc

SEQ ID NO: 7611785 - DNA, 22 bp, Homo sapiens
tgcaataaagtgctataaatcc

SEQ ID NO: 7611786 - DNA, 22 bp, Homo sapiens
tgcaataaagtgctataaatcc

SEQ ID NO: 7611787 - DNA, 22 bp, Homo sapiens
tgcaataaagtgctataaatcc

SEQ ID NO: 7611788 - DNA, 22 bp, Homo sapiens
tgcaataaagtgctataaatcc

SEQ ID NO: 7611789 - DNA, 22 bp, Homo sapiens
tgataatattttgaatcataag

SEQ ID NO: 7611790 - DNA, 22 bp, Homo sapiens
tgataatattttgaatcataag

SEQ ID NO: 7611791 - DNA, 22 bp, Homo sapiens
tgataagatgctgagtgcattg

SEQ ID NO: 7611792 - DNA, 22 bp, Homo sapiens
tgataactttaatttgatctga

SEQ ID NO: 7611793 - DNA, 22 bp, Homo sapiens
tgataactttaatttgatctga

SEQ ID NO: 7611794 - DNA, 22 bp, Homo sapiens
tgataacttgtaaattagattc

SEQ ID NO: 7611795 - DNA, 22 bp, Homo sapiens
tgataaatccatgtaaatggta

SEQ ID NO: 7611796 - DNA, 22 bp, Homo sapiens
tgataactctcagtttctcatg

SEQ ID NO: 7611797 - DNA, 22 bp, Homo sapiens
tgataaatccatgtaaatggta

SEQ ID NO: 7611798 - DNA, 22 bp, Homo sapiens
tgataaatccatgtaaatggta

SEQ ID NO: 7611799 - DNA, 22 bp, Homo sapiens
tgataatattttgaatcataag

SEQ ID NO: 7611800 - DNA, 22 bp, Homo sapiens
tgataatattttgaatcataag

SEQ ID NO: 7611801 - DNA, 22 bp, Homo sapiens
tgataatgttcgagaatgaaga

SEQ ID NO: 7611802 - DNA, 22 bp, Homo sapiens
tgatacaatcatgagagaggac

SEQ ID NO: 7611803 - DNA, 22 bp, Homo sapiens
tgatacacagatttacatcaat

SEQ ID NO: 7611804 - DNA, 22 bp, Homo sapiens
tgatacacagatttacatcaat

SEQ ID NO: 7611805 - DNA, 22 bp, Homo sapiens
tgcaaatattccatgctgttca

SEQ ID NO: 7611806 - DNA, 22 bp, Homo sapiens
tgcaataagtattgcttacatg

SEQ ID NO: 7611807 - DNA, 22 bp, Homo sapiens
tgcaataagtattgcttacatg

SEQ ID NO: 7611808 - DNA, 22 bp, Homo sapiens
tgcaataaggagtaatagtaaa

SEQ ID NO: 7611809 - DNA, 22 bp, Homo sapiens
tgcaataaggagtaatagtaaa

SEQ ID NO: 7611810 - DNA, 22 bp, Homo sapiens
tgcaataaggagtaatagtaaa

SEQ ID NO: 7611811 - DNA, 22 bp, Homo sapiens
tgcaataagttgtgttatcact

SEQ ID NO: 7611812 - DNA, 22 bp, Homo sapiens
tgcaataagttgtgttatcact

SEQ ID NO: 7611813 - DNA, 22 bp, Homo sapiens
tgcaataagttgtgttatcact

SEQ ID NO: 7611814 - DNA, 22 bp, Homo sapiens
tgcaataagttgtgttatcact

SEQ ID NO: 7611815 - DNA, 22 bp, Homo sapiens
tgcaataagttgtgttatcact

SEQ ID NO: 7611816 - DNA, 22 bp, Homo sapiens
tgcaataaggagtaatagtaaa

SEQ ID NO: 7611817 - DNA, 22 bp, Homo sapiens
tgcaataaggagtaatagtaaa

SEQ ID NO: 7611818 - DNA, 22 bp, Homo sapiens
tgcaataaggagtaatagtaaa

SEQ ID NO: 7611819 - DNA, 22 bp, Homo sapiens
tgcaataactactttaatgttg

SEQ ID NO: 7611820 - DNA, 22 bp, Homo sapiens
tgcaataactactttaatgttg

SEQ ID NO: 7611821 - DNA, 22 bp, Homo sapiens
tgcaataactactttaatgttg

SEQ ID NO: 7611822 - DNA, 22 bp, Homo sapiens
tgcaataacccatgagatagaa

SEQ ID NO: 7611823 - DNA, 22 bp, Homo sapiens
tgcaataacccatgagatagaa

SEQ ID NO: 7611824 - DNA, 21 bp, Homo sapiens
tgcaatatatatttgcctgaa

SEQ ID NO: 7611825 - DNA, 22 bp, Homo sapiens
tgcaatacatacttagacccag

SEQ ID NO: 7611826 - DNA, 22 bp, Homo sapiens
tgcaatatcagattcaacacat

SEQ ID NO: 7611827 - DNA, 22 bp, Homo sapiens
tgcaatatcagattcaacacat

SEQ ID NO: 7611828 - DNA, 22 bp, Homo sapiens
tgcaatactcatcattggagat

SEQ ID NO: 7611829 - DNA, 22 bp, Homo sapiens
tgcaataatgtatgtcactccc

SEQ ID NO: 7611830 - DNA, 23 bp, Homo sapiens
tgcaatatgtcagtgcaaagtgg

SEQ ID NO: 7611831 - DNA, 23 bp, Homo sapiens
tgcaatatgtcagtgcaaagtgg

SEQ ID NO: 7611832 - DNA, 22 bp, Homo sapiens
tgcaatatgttgcattgtatgg

SEQ ID NO: 7611833 - DNA, 23 bp, Homo sapiens
tgcaatatgtcagtgcaaagtgg

SEQ ID NO: 7611834 - DNA, 22 bp, Homo sapiens
tgcaatatgttgcattgtatgg

SEQ ID NO: 7611835 - DNA, 22 bp, Homo sapiens
tgcaatatttggcactgagatg

SEQ ID NO: 7611836 - DNA, 22 bp, Homo sapiens
tgcaatatttggcactgagatg

SEQ ID NO: 7611837 - DNA, 22 bp, Homo sapiens
tgcaatatttggcactgagatg

SEQ ID NO: 7611838 - DNA, 22 bp, Homo sapiens
tgcaatcagaaagttcagcggt

SEQ ID NO: 7611839 - DNA, 22 bp, Homo sapiens
tgcaatatgttgcattgtatgg

SEQ ID NO: 7611840 - DNA, 22 bp, Homo sapiens
tgcaatatgttgcattgtatgg

SEQ ID NO: 7611841 - DNA, 22 bp, Homo sapiens
tgcactggtggtgagtgaggga

SEQ ID NO: 7611842 - DNA, 22 bp, Homo sapiens
tgcactggtggtgagtgaggga

SEQ ID NO: 7611843 - DNA, 22 bp, Homo sapiens
tgcactgttgctttatatgatt

SEQ ID NO: 7611844 - DNA, 22 bp, Homo sapiens
tgcacttattgacatagaaaaa

SEQ ID NO: 7611845 - DNA, 22 bp, Homo sapiens
tgcacttcaaaaatgtcactga

SEQ ID NO: 7611846 - DNA, 22 bp, Homo sapiens
tgcacttcaaaaatgtcactga

SEQ ID NO: 7611847 - DNA, 21 bp, Homo sapiens
tgcacttcagtggctaaattc

SEQ ID NO: 7611848 - DNA, 22 bp, Homo sapiens
tgcacttcattgtaaattgtac

SEQ ID NO: 7611849 - DNA, 22 bp, Homo sapiens
tgcactttaaaaaatggtgatg

SEQ ID NO: 7611850 - DNA, 22 bp, Homo sapiens
tgcactttatttcctctcacac

SEQ ID NO: 7611851 - DNA, 22 bp, Homo sapiens
tgcactttaaaaaatggtgatg

SEQ ID NO: 7611852 - DNA, 22 bp, Homo sapiens
tgcacttgtgttttcagaatct

SEQ ID NO: 7611853 - DNA, 19 bp, Homo sapiens
tgcacttgagatgtttgta

SEQ ID NO: 7611854 - DNA, 22 bp, Homo sapiens
tgcactgggaaagaaggaggga

SEQ ID NO: 7611855 - DNA, 22 bp, Homo sapiens
tgcactggggtcccagcgcacg

SEQ ID NO: 7611856 - DNA, 22 bp, Homo sapiens
tgcactggggtcccagcgcacg

SEQ ID NO: 7611857 - DNA, 22 bp, Homo sapiens
tgcactgatgttttgccaagga

SEQ ID NO: 7611858 - DNA, 22 bp, Homo sapiens
tgcactgatcctgaccagtgaa

SEQ ID NO: 7611859 - DNA, 22 bp, Homo sapiens
tgcactgatcctgaccagtgaa

SEQ ID NO: 7611860 - DNA, 22 bp, Homo sapiens
tgcactgctttgcaaagctgag

SEQ ID NO: 7611861 - DNA, 22 bp, Homo sapiens
tgcactgctttgcaaagctgag

SEQ ID NO: 7611862 - DNA, 22 bp, Homo sapiens
tgcactgatgttttgccaagga

SEQ ID NO: 7611863 - DNA, 22 bp, Homo sapiens
tgcactgcctttcttggcatga

SEQ ID NO: 7611864 - DNA, 22 bp, Homo sapiens
tgcactccaggctgggtgacag

SEQ ID NO: 7611865 - DNA, 22 bp, Homo sapiens
tgcactccaggctgggtgacag

SEQ ID NO: 7611866 - DNA, 22 bp, Homo sapiens
tgcactccaggctgggtgacag

SEQ ID NO: 7611867 - DNA, 22 bp, Homo sapiens
tgcactccaggctgggtgacag

SEQ ID NO: 7611868 - DNA, 22 bp, Homo sapiens
tgcactccaggctgggtgacag

SEQ ID NO: 7611869 - DNA, 22 bp, Homo sapiens
tgcactgatcctgaccagtgaa

SEQ ID NO: 7611870 - DNA, 22 bp, Homo sapiens
tgcactgaatagtagactgtac

SEQ ID NO: 7611871 - DNA, 22 bp, Homo sapiens
tgcactccaggctgggtgacag

SEQ ID NO: 7611872 - DNA, 22 bp, Homo sapiens
tgcagagaaagtgtagacaggc

SEQ ID NO: 7611873 - DNA, 22 bp, Homo sapiens
tgcagagaaagtgtagacaggc

SEQ ID NO: 7611874 - DNA, 22 bp, Homo sapiens
tgcagagaaaccagtggaggac

SEQ ID NO: 7611875 - DNA, 22 bp, Homo sapiens
tgcagagaaagtgtagacaggc

SEQ ID NO: 7611876 - DNA, 22 bp, Homo sapiens
tgcagagaaaccagtggaggac

SEQ ID NO: 7611877 - DNA, 22 bp, Homo sapiens
tgcagagaaagtgtagacaggc

SEQ ID NO: 7611878 - DNA, 22 bp, Homo sapiens
tgcagagaagaggacagttcta

SEQ ID NO: 7611879 - DNA, 22 bp, Homo sapiens
tgcagagacttgtgtgcatttg

SEQ ID NO: 7611880 - DNA, 22 bp, Homo sapiens
tgcagagacttgtgtgcatttg

SEQ ID NO: 7611881 - DNA, 22 bp, Homo sapiens
tgcagagacttgtgtgcatttg

SEQ ID NO: 7611882 - DNA, 22 bp, Homo sapiens
tgcagagaccactgtgccttcc

SEQ ID NO: 7611883 - DNA, 22 bp, Homo sapiens
tgcagagaccactgtgccttcc

SEQ ID NO: 7611884 - DNA, 22 bp, Homo sapiens
tgcagagaagaggacagttcta

SEQ ID NO: 7611885 - DNA, 22 bp, Homo sapiens
tgcagagaagaggacagttcta

SEQ ID NO: 7611886 - DNA, 22 bp, Homo sapiens
tgcagagaagaggacagttcta

SEQ ID NO: 7611887 - DNA, 22 bp, Homo sapiens
tgcagagaagaggacagttcta

SEQ ID NO: 7611888 - DNA, 19 bp, Homo sapiens
tgcagagagaggcaaagaa

SEQ ID NO: 7611889 - DNA, 19 bp, Homo sapiens
tgcagagagaggcaaagaa

SEQ ID NO: 7611890 - DNA, 19 bp, Homo sapiens
tgcagagagaggcaaagaa

SEQ ID NO: 7611891 - DNA, 19 bp, Homo sapiens
tgcagagagaggcaaagaa

SEQ ID NO: 7611892 - DNA, 22 bp, Homo sapiens
tgcagagagacccctgggccag

SEQ ID NO: 7611893 - DNA, 22 bp, Homo sapiens
tgcagagagacccctgggccag

SEQ ID NO: 7611894 - DNA, 22 bp, Homo sapiens
tgcagagacttgtgtgcatttg

SEQ ID NO: 7611895 - DNA, 22 bp, Homo sapiens
tgcagagaccactgtgccttcc

SEQ ID NO: 7611896 - DNA, 22 bp, Homo sapiens
tgcagagagacccctgggccag

SEQ ID NO: 7611897 - DNA, 22 bp, Homo sapiens
tgcagagagacccctgggccag

SEQ ID NO: 7611898 - DNA, 22 bp, Homo sapiens
tgcagagagatcctcagggttt

SEQ ID NO: 7611899 - DNA, 22 bp, Homo sapiens
tgcagagagatcctcagggttt

SEQ ID NO: 7611900 - DNA, 22 bp, Homo sapiens
tgcagagagatatggcaagagg

SEQ ID NO: 7611901 - DNA, 22 bp, Homo sapiens
tgcagagagatcctcagggttt

SEQ ID NO: 7611902 - DNA, 22 bp, Homo sapiens
tgcagagagatatggcaagagg

SEQ ID NO: 7611903 - DNA, 22 bp, Homo sapiens
tgcagagagatatggcaagagg

SEQ ID NO: 7611904 - DNA, 19 bp, Homo sapiens
tgcagagagaggcaaagaa

SEQ ID NO: 7611905 - DNA, 22 bp, Homo sapiens
tgcagagagatatggcaagagg

SEQ ID NO: 7611906 - DNA, 22 bp, Homo sapiens
tgcagagagatatggcaagagg

SEQ ID NO: 7611907 - DNA, 22 bp, Homo sapiens
cccagagcctcattctgttggg

SEQ ID NO: 7611908 - DNA, 22 bp, Homo sapiens
cccagagatgtcctgagtgata

SEQ ID NO: 7611909 - DNA, 22 bp, Homo sapiens
cccagagatgtcctgagtgata

SEQ ID NO: 7611910 - DNA, 22 bp, Homo sapiens
cccagagcctcattctgttggg

SEQ ID NO: 7611911 - DNA, 22 bp, Homo sapiens
cccagagcctcattctgttggg

SEQ ID NO: 7611912 - DNA, 22 bp, Homo sapiens
cccagagcctcattctgttggg

SEQ ID NO: 7611913 - DNA, 17 bp, Homo sapiens
cccagagatgctgcctt

SEQ ID NO: 7611914 - DNA, 17 bp, Homo sapiens
cccagagatgctgcctt

SEQ ID NO: 7611915 - DNA, 22 bp, Homo sapiens
cccagagatgggaggtgatcgg

SEQ ID NO: 7611916 - DNA, 22 bp, Homo sapiens
cccagagatgggaggtgatcgg

SEQ ID NO: 7611917 - DNA, 22 bp, Homo sapiens
cccagagatgggaggtgatcgg

SEQ ID NO: 7611918 - DNA, 22 bp, Homo sapiens
cccagagatgggaggtgatcgg

SEQ ID NO: 7611919 - DNA, 16 bp, Homo sapiens
tgcagagagcatggtg

SEQ ID NO: 7611920 - DNA, 22 bp, Homo sapiens
tgcagagagatcctcagggttt

SEQ ID NO: 7611921 - DNA, 16 bp, Homo sapiens
tgcagagagcatggtg

SEQ ID NO: 7611922 - DNA, 16 bp, Homo sapiens
tgcagagagcatggtg

SEQ ID NO: 7611923 - DNA, 16 bp, Homo sapiens
tgcagagagcatggtg

SEQ ID NO: 7611924 - DNA, 16 bp, Homo sapiens
tgcagagagcatggtg

SEQ ID NO: 7611925 - DNA, 22 bp, Homo sapiens
tgcagagagccagctctctcgg

SEQ ID NO: 7611926 - DNA, 22 bp, Homo sapiens
tgcagagagccctgccttcctc

SEQ ID NO: 7611927 - DNA, 22 bp, Homo sapiens
tgcagagagccagctctctcgg

SEQ ID NO: 7611928 - DNA, 22 bp, Homo sapiens
tgcagagagccctgccttcctc

SEQ ID NO: 7611929 - DNA, 22 bp, Homo sapiens
tgcagagagccctgccttcctc

SEQ ID NO: 7611930 - DNA, 22 bp, Homo sapiens
tgcagagagttagggcccgtat

SEQ ID NO: 7611931 - DNA, 22 bp, Homo sapiens
tgcagagagccctgccttcctc

SEQ ID NO: 7611932 - DNA, 22 bp, Homo sapiens
tgcagagagccagctctctcgg

SEQ ID NO: 7611933 - DNA, 22 bp, Homo sapiens
tgcagagagttagggcccgtat

SEQ ID NO: 7611934 - DNA, 22 bp, Homo sapiens
cccagagctcagtgtgcaaggt

SEQ ID NO: 7611935 - DNA, 22 bp, Homo sapiens
cccagagctcagtgtgcaaggt

SEQ ID NO: 7611936 - DNA, 22 bp, Homo sapiens
cccagagctcagtgtgcaaggt

SEQ ID NO: 7611937 - DNA, 22 bp, Homo sapiens
cccagagctcagtgtgcaaggt

SEQ ID NO: 7611938 - DNA, 22 bp, Homo sapiens
cccagagcctcattctgttggg

SEQ ID NO: 7611939 - DNA, 22 bp, Homo sapiens
cccagagcctcattctgttggg

SEQ ID NO: 7611940 - DNA, 22 bp, Homo sapiens
cccagagctccggtcctgccca

SEQ ID NO: 7611941 - DNA, 22 bp, Homo sapiens
cccagagctccggtcctgccca

SEQ ID NO: 7611942 - DNA, 22 bp, Homo sapiens
cccagagctccggtcctgccca

SEQ ID NO: 7611943 - DNA, 22 bp, Homo sapiens
cccagagctcagtgtgcaaggt

SEQ ID NO: 7611944 - DNA, 22 bp, Homo sapiens
cccagagctcagtgtgcaaggt

SEQ ID NO: 7611945 - DNA, 22 bp, Homo sapiens
cccagagctgagggggcacgtt

SEQ ID NO: 7611946 - DNA, 22 bp, Homo sapiens
cccagagctgagggggcacgtt

SEQ ID NO: 7611947 - DNA, 22 bp, Homo sapiens
cccagagctgagggggcacgtt

SEQ ID NO: 7611948 - DNA, 22 bp, Homo sapiens
cccagagctccggtcctgccca

SEQ ID NO: 7611949 - DNA, 22 bp, Homo sapiens
cccagagctccggtcctgccca

SEQ ID NO: 7611950 - DNA, 22 bp, Homo sapiens
cccagagctccggtcctgccca

SEQ ID NO: 7611951 - DNA, 22 bp, Homo sapiens
cccagagctccggtcctgccca

SEQ ID NO: 7611952 - DNA, 22 bp, Homo sapiens
cccagagctgagtctgatatat

SEQ ID NO: 7611953 - DNA, 22 bp, Homo sapiens
cccagagctgagtctgatatat

SEQ ID NO: 7611954 - DNA, 22 bp, Homo sapiens
cccagagctgagtctgatatat

SEQ ID NO: 7611955 - DNA, 22 bp, Homo sapiens
cccagagctgagggggcacgtt

SEQ ID NO: 7611956 - DNA, 22 bp, Homo sapiens
cccagagctgagggggcacgtt

SEQ ID NO: 7611957 - DNA, 22 bp, Homo sapiens
cccagagctgagggggcacgtt

SEQ ID NO: 7611958 - DNA, 22 bp, Homo sapiens
cccagagctgattgttggagcc

SEQ ID NO: 7611959 - DNA, 22 bp, Homo sapiens
cccagagctgattgttggagcc

SEQ ID NO: 7611960 - DNA, 22 bp, Homo sapiens
cccagagctgattgttggagcc

SEQ ID NO: 7611961 - DNA, 22 bp, Homo sapiens
cccagagctgattgttggagcc

SEQ ID NO: 7611962 - DNA, 22 bp, Homo sapiens
cccagagctgattgttggagcc

SEQ ID NO: 7611963 - DNA, 22 bp, Homo sapiens
cccagagctgattgttggagcc

SEQ ID NO: 7611964 - DNA, 22 bp, Homo sapiens
cccagagctgagggggcacgtt

SEQ ID NO: 7611965 - DNA, 22 bp, Homo sapiens
cccagagctgggtgggcagcgg

SEQ ID NO: 7611966 - DNA, 22 bp, Homo sapiens
cccagagctgggtgggcagcgg

SEQ ID NO: 7611967 - DNA, 22 bp, Homo sapiens
cccagagctgggtgggcagcgg

SEQ ID NO: 7611968 - DNA, 22 bp, Homo sapiens
cccagagctgggtgggcagcgg

SEQ ID NO: 7611969 - DNA, 22 bp, Homo sapiens
cccagagctgggtgggcagcgg

SEQ ID NO: 7611970 - DNA, 22 bp, Homo sapiens
cccagagctgggtgggcagcgg

SEQ ID NO: 7611971 - DNA, 22 bp, Homo sapiens
cccagagctgggtgggcagcgg

SEQ ID NO: 7611972 - DNA, 18 bp, Homo sapiens
cccagaggaatgcctgga

SEQ ID NO: 7611973 - DNA, 18 bp, Homo sapiens
cccagaggaatgcctgga

SEQ ID NO: 7611974 - DNA, 18 bp, Homo sapiens
cccagaggaatgcctgga

SEQ ID NO: 7611975 - DNA, 18 bp, Homo sapiens
cccagaggaatgcctgga

SEQ ID NO: 7611976 - DNA, 18 bp, Homo sapiens
cccagaggaatgcctgga

SEQ ID NO: 7611977 - DNA, 18 bp, Homo sapiens
cccagaggaatgcctgga

SEQ ID NO: 7611978 - DNA, 18 bp, Homo sapiens
cccagaggaatgcctgga

SEQ ID NO: 7611979 - DNA, 18 bp, Homo sapiens
cccagaggaatgcctgga

SEQ ID NO: 7611980 - DNA, 18 bp, Homo sapiens
cccagaggaatgcctgga

SEQ ID NO: 7611981 - DNA, 22 bp, Homo sapiens
cccagagctgggtgggcagcgg

SEQ ID NO: 7611982 - DNA, 18 bp, Homo sapiens
cccagaggaatgcctgga

SEQ ID NO: 7611983 - DNA, 19 bp, Homo sapiens
cccagaggaatgcctggaa

SEQ ID NO: 7611984 - DNA, 23 bp, Homo sapiens
cccagaggagcagggcgtgagat

SEQ ID NO: 7611985 - DNA, 23 bp, Homo sapiens
cccagaggagcagggcgtgagat

SEQ ID NO: 7611986 - DNA, 23 bp, Homo sapiens
cccagaggagcagggcgtgagat

SEQ ID NO: 7611987 - DNA, 23 bp, Homo sapiens
cccagaggagcagggcgtgagat

SEQ ID NO: 7611988 - DNA, 23 bp, Homo sapiens
cccagaggagcagggcgtgagat

SEQ ID NO: 7611989 - DNA, 23 bp, Homo sapiens
cccagaggagcagggcgtgagat

SEQ ID NO: 7611990 - DNA, 23 bp, Homo sapiens
cccagaggagcagggcgtgagat

SEQ ID NO: 7611991 - DNA, 23 bp, Homo sapiens
cccagaggagcagggcgtgagat

SEQ ID NO: 7611992 - DNA, 22 bp, Homo sapiens
cccagaggaggatctcggcccg

SEQ ID NO: 7611993 - DNA, 19 bp, Homo sapiens
cccagaggaatgcctggaa

SEQ ID NO: 7611994 - DNA, 19 bp, Homo sapiens
cccagaggaatgcctggaa

SEQ ID NO: 7611995 - DNA, 23 bp, Homo sapiens
cccagaggagcagggcgtgagat

SEQ ID NO: 7611996 - DNA, 19 bp, Homo sapiens
cccagaggaatgcctggaa

SEQ ID NO: 7611997 - DNA, 19 bp, Homo sapiens
cccagaggaatgcctggaa

SEQ ID NO: 7611998 - DNA, 19 bp, Homo sapiens
cccagaggaatgcctggaa

SEQ ID NO: 7611999 - DNA, 19 bp, Homo sapiens
cccagaggaatgcctggaa

SEQ ID NO: 7612000 - DNA, 19 bp, Homo sapiens
cccagaggaatgcctggaa

SEQ ID NO: 7612001 - DNA, 18 bp, Homo sapiens
cccagaggaatgcctgga

SEQ ID NO: 7612002 - DNA, 19 bp, Homo sapiens
cccagaggaatgcctggaa

SEQ ID NO: 7612003 - DNA, 23 bp, Homo sapiens
tgcagctgcctctggcgggccgg

SEQ ID NO: 7612004 - DNA, 23 bp, Homo sapiens
tgcagctgcctctggcgggccgg

SEQ ID NO: 7612005 - DNA, 23 bp, Homo sapiens
tgcagctgcctctggcgggccgg

SEQ ID NO: 7612006 - DNA, 23 bp, Homo sapiens
tgcagctgcctctggcgggccgg

SEQ ID NO: 7612007 - DNA, 22 bp, Homo sapiens
tgcagctgcctccttcccttgt

SEQ ID NO: 7612008 - DNA, 23 bp, Homo sapiens
tgcagctgcctctggcgggccgg

SEQ ID NO: 7612009 - DNA, 22 bp, Homo sapiens
tgcagctgcctccttcccttgt

SEQ ID NO: 7612010 - DNA, 22 bp, Homo sapiens
tgcagctgcctagggctggctt

SEQ ID NO: 7612011 - DNA, 22 bp, Homo sapiens
tgcagctgcctagggctggctt

SEQ ID NO: 7612012 - DNA, 22 bp, Homo sapiens
tgcagctgcctagggctggctt

SEQ ID NO: 7612013 - DNA, 22 bp, Homo sapiens
tgcagctgcctagggctggctt

SEQ ID NO: 7612014 - DNA, 22 bp, Homo sapiens
tgcagctgcctagggctggctt

SEQ ID NO: 7612015 - DNA, 22 bp, Homo sapiens
tgcagctgcctagggctggctt

SEQ ID NO: 7612016 - DNA, 22 bp, Homo sapiens
tgcagctgcctagggctggctt

SEQ ID NO: 7612017 - DNA, 22 bp, Homo sapiens
tgcagctgcctagggctggctt

SEQ ID NO: 7612018 - DNA, 22 bp, Homo sapiens
tgcagctgcctagggctggctt

SEQ ID NO: 7612019 - DNA, 22 bp, Homo sapiens
tgcagctgcctagggctggctt

SEQ ID NO: 7612020 - DNA, 22 bp, Homo sapiens
tgcagctgcaggagggtgggag

SEQ ID NO: 7612021 - DNA, 22 bp, Homo sapiens
tgcagctgcaggagggtgggag

SEQ ID NO: 7612022 - DNA, 22 bp, Homo sapiens
tgcagctgcaggagggtgggag

SEQ ID NO: 7612023 - DNA, 22 bp, Homo sapiens
tgcagctgcaggagggtgggag

SEQ ID NO: 7612024 - DNA, 22 bp, Homo sapiens
tgcagctgcaggagggtgggag

SEQ ID NO: 7612025 - DNA, 22 bp, Homo sapiens
tgcagctgcaggagggtgggag

SEQ ID NO: 7612026 - DNA, 22 bp, Homo sapiens
tgcagctgcaggagggtgggag

SEQ ID NO: 7612027 - DNA, 22 bp, Homo sapiens
tgcagctgcaggagggtgggag

SEQ ID NO: 7612028 - DNA, 22 bp, Homo sapiens
tgcagctgctcattctctcagt

SEQ ID NO: 7612029 - DNA, 22 bp, Homo sapiens
tgcagctgctcattctctcagt

SEQ ID NO: 7612030 - DNA, 22 bp, Homo sapiens
tgcagctgctcattctctcagt

SEQ ID NO: 7612031 - DNA, 22 bp, Homo sapiens
tgcagctgctcattctctcagt

SEQ ID NO: 7612032 - DNA, 22 bp, Homo sapiens
tgcagctgctcattctctcagt

SEQ ID NO: 7612033 - DNA, 22 bp, Homo sapiens
tgcaggaagtttcctgaacttt

SEQ ID NO: 7612034 - DNA, 22 bp, Homo sapiens
tgcaggaagtttcctgaacttt

SEQ ID NO: 7612035 - DNA, 22 bp, Homo sapiens
tgcaggaagtttcctgaacttt

SEQ ID NO: 7612036 - DNA, 22 bp, Homo sapiens
tgcaggaagtttcctgaacttt

SEQ ID NO: 7612037 - DNA, 22 bp, Homo sapiens
tgcaggaatagctacagagctg

SEQ ID NO: 7612038 - DNA, 22 bp, Homo sapiens
tgcaggaatagctacagagctg

SEQ ID NO: 7612039 - DNA, 22 bp, Homo sapiens
tgcaggaagtttcctgaacttt

SEQ ID NO: 7612040 - DNA, 22 bp, Homo sapiens
tgcaggaatagctacagagctg

SEQ ID NO: 7612041 - DNA, 22 bp, Homo sapiens
tgcaggaatattgatgaactta

SEQ ID NO: 7612042 - DNA, 22 bp, Homo sapiens
tgcaggaatattgatgaactta

SEQ ID NO: 7612043 - DNA, 22 bp, Homo sapiens
tgcaggaatattgatgaactta

SEQ ID NO: 7612044 - DNA, 22 bp, Homo sapiens
tgcaggaatattgatgaactta

SEQ ID NO: 7612045 - DNA, 22 bp, Homo sapiens
tgcaggaatattgatgaactta

SEQ ID NO: 7612046 - DNA, 22 bp, Homo sapiens
tgcaggaatattgatgaactta

SEQ ID NO: 7612047 - DNA, 22 bp, Homo sapiens
tgcaggaatattgatgaactta

SEQ ID NO: 7612048 - DNA, 22 bp, Homo sapiens
tgcaggaatagctacagagctg

SEQ ID NO: 7612049 - DNA, 22 bp, Homo sapiens
tgcaggaatagctacagagctg

SEQ ID NO: 7612050 - DNA, 22 bp, Homo sapiens
tgcaggaatagctacagagctg

SEQ ID NO: 7612051 - DNA, 22 bp, Homo sapiens
tgcaggaatagctacagagctg

SEQ ID NO: 7612052 - DNA, 22 bp, Homo sapiens
tgcaggaatagctacagagctg

SEQ ID NO: 7612053 - DNA, 20 bp, Homo sapiens
tgcaggacagagcctgtgtg

SEQ ID NO: 7612054 - DNA, 22 bp, Homo sapiens
tgcaggacagtttggaagagag

SEQ ID NO: 7612055 - DNA, 20 bp, Homo sapiens
tgcaggacagagcctgtgtg

SEQ ID NO: 7612056 - DNA, 20 bp, Homo sapiens
tgcaggacagagcctgtgtg

SEQ ID NO: 7612057 - DNA, 22 bp, Homo sapiens
tgcaggaattttttgcagaaag

SEQ ID NO: 7612058 - DNA, 22 bp, Homo sapiens
tgcaggaattttttgcagaaag

SEQ ID NO: 7612059 - DNA, 22 bp, Homo sapiens
tgcaggaattttttgcagaaag

SEQ ID NO: 7612060 - DNA, 22 bp, Homo sapiens
tgcaggaattttttgcagaaag

SEQ ID NO: 7612061 - DNA, 20 bp, Homo sapiens
tgcaggaatttgcattcctt

SEQ ID NO: 7612062 - DNA, 22 bp, Homo sapiens
tgcaggaattttttgcagaaag

SEQ ID NO: 7612063 - DNA, 22 bp, Homo sapiens
tgcaggaattttttgcagaaag

SEQ ID NO: 7612064 - DNA, 22 bp, Homo sapiens
tgcaggaattttttgcagaaag

SEQ ID NO: 7612065 - DNA, 22 bp, Homo sapiens
tgcaggaatcagaggggaagcg

SEQ ID NO: 7612066 - DNA, 22 bp, Homo sapiens
tgcaggaatcagaggggaagcg

SEQ ID NO: 7612067 - DNA, 22 bp, Homo sapiens
tgcaggaatcagaggggaagcg

SEQ ID NO: 7612068 - DNA, 22 bp, Homo sapiens
tgcaggaatcagaggggaagcg

SEQ ID NO: 7612069 - DNA, 22 bp, Homo sapiens
tgcaggaatcagaggggaagcg

SEQ ID NO: 7612070 - DNA, 22 bp, Homo sapiens
tgcaggaatattgatgaactta

SEQ ID NO: 7612071 - DNA, 22 bp, Homo sapiens
tgcaggaatattgatgaactta

SEQ ID NO: 7612072 - DNA, 22 bp, Homo sapiens
tgcaggaatcagaggggaagcg

SEQ ID NO: 7612073 - DNA, 22 bp, Homo sapiens
tgcaggaatgaggttctcagtt

SEQ ID NO: 7612074 - DNA, 22 bp, Homo sapiens
tgcaggaatgaggttctcagtt

SEQ ID NO: 7612075 - DNA, 22 bp, Homo sapiens
tgcaggaatgaggttctcagtt

SEQ ID NO: 7612076 - DNA, 22 bp, Homo sapiens
tgcaggaatgaggttctcagtt

SEQ ID NO: 7612077 - DNA, 22 bp, Homo sapiens
tgcaggaatgaggttctcagtt

SEQ ID NO: 7612078 - DNA, 20 bp, Homo sapiens
tgcaggaatttgcattcctt

SEQ ID NO: 7612079 - DNA, 20 bp, Homo sapiens
tgcaggaatttgcattcctt

SEQ ID NO: 7612080 - DNA, 20 bp, Homo sapiens
tgcaggaatttgcattcctt

SEQ ID NO: 7612081 - DNA, 22 bp, Homo sapiens
tgcaggactcaagggtagcagg

SEQ ID NO: 7612082 - DNA, 23 bp, Homo sapiens
tgcaggactcaagaaagaaaggc

SEQ ID NO: 7612083 - DNA, 22 bp, Homo sapiens
tgcaggactcaagggtagcagg

SEQ ID NO: 7612084 - DNA, 22 bp, Homo sapiens
tgcaggactggggagcggaagg

SEQ ID NO: 7612085 - DNA, 22 bp, Homo sapiens
tgcaggacttcaggactctgag

SEQ ID NO: 7612086 - DNA, 22 bp, Homo sapiens
tgcaggacttcaggactctgag

SEQ ID NO: 7612087 - DNA, 22 bp, Homo sapiens
tgcaggacttcaggactctgag

SEQ ID NO: 7612088 - DNA, 22 bp, Homo sapiens
tgcaggactggggagcggaagg

SEQ ID NO: 7612089 - DNA, 22 bp, Homo sapiens
tgcaggactggggagcggaagg

SEQ ID NO: 7612090 - DNA, 22 bp, Homo sapiens
tgcaggactgaaggagggctgg

SEQ ID NO: 7612091 - DNA, 22 bp, Homo sapiens
tgcaggactgaaggagggctgg

SEQ ID NO: 7612092 - DNA, 22 bp, Homo sapiens
tgcaggactgaaggagggctgg

SEQ ID NO: 7612093 - DNA, 22 bp, Homo sapiens
tgcaggacattagttatgaatt

SEQ ID NO: 7612094 - DNA, 22 bp, Homo sapiens
tgcaggacattagttatgaatt

SEQ ID NO: 7612095 - DNA, 22 bp, Homo sapiens
tgcaggacagtttggaagagag

SEQ ID NO: 7612096 - DNA, 22 bp, Homo sapiens
tgcaggaccggaaccatgggat

SEQ ID NO: 7612097 - DNA, 22 bp, Homo sapiens
tgcaggaccggaaccatgggat

SEQ ID NO: 7612098 - DNA, 22 bp, Homo sapiens
tgcaggacccgggctgtggtca

SEQ ID NO: 7612099 - DNA, 22 bp, Homo sapiens
tgcaggaccttgatcctggact

SEQ ID NO: 7612100 - DNA, 23 bp, Homo sapiens
tgcaggactactcgagcactgct

SEQ ID NO: 7612101 - DNA, 23 bp, Homo sapiens
tgcaggactactcgagcactgct

SEQ ID NO: 7612102 - DNA, 22 bp, Homo sapiens
tgcaggaccttgatcctggact

SEQ ID NO: 7612103 - DNA, 23 bp, Homo sapiens
tgcaggactactcgagcactgct

SEQ ID NO: 7612104 - DNA, 20 bp, Homo sapiens
tgcagctgcaggagggtggg

SEQ ID NO: 7612105 - DNA, 20 bp, Homo sapiens
tgcagctgcaggagggtggg

SEQ ID NO: 7612106 - DNA, 20 bp, Homo sapiens
tgcagctgcaggagggtggg

SEQ ID NO: 7612107 - DNA, 20 bp, Homo sapiens
tgcagctgcaggagggtggg

SEQ ID NO: 7612108 - DNA, 20 bp, Homo sapiens
tgcagctgcaggagggtggg

SEQ ID NO: 7612109 - DNA, 20 bp, Homo sapiens
tgcagctgcaggagggtggg

SEQ ID NO: 7612110 - DNA, 20 bp, Homo sapiens
tgcagctgcaggagggtggg

SEQ ID NO: 7612111 - DNA, 20 bp, Homo sapiens
tgcagctgcaggagggtggg

SEQ ID NO: 7612112 - DNA, 20 bp, Homo sapiens
tgcagctgcaggagggtggg

SEQ ID NO: 7612113 - DNA, 20 bp, Homo sapiens
tgcagctgcaggagggtggg

SEQ ID NO: 7612114 - DNA, 20 bp, Homo sapiens
tgcagctgcaggagggtggg

SEQ ID NO: 7612115 - DNA, 22 bp, Homo sapiens
tgcagctgcaagtccaggtcag

SEQ ID NO: 7612116 - DNA, 22 bp, Homo sapiens
tgcagctgcaagtccaggtcag

SEQ ID NO: 7612117 - DNA, 22 bp, Homo sapiens
tgcagctgcaagtccaggtcag

SEQ ID NO: 7612118 - DNA, 22 bp, Homo sapiens
tgcagctgcaagtccaggtcag

SEQ ID NO: 7612119 - DNA, 22 bp, Homo sapiens
tgcagctgattaaagggcagac

SEQ ID NO: 7612120 - DNA, 22 bp, Homo sapiens
tgcagctgcaagtccaggtcag

SEQ ID NO: 7612121 - DNA, 22 bp, Homo sapiens
tgcagctgattaaagggcagac

SEQ ID NO: 7612122 - DNA, 22 bp, Homo sapiens
tgcagctgattaaagggcagac

SEQ ID NO: 7612123 - DNA, 22 bp, Homo sapiens
tgcagctgattaaagggcagac

SEQ ID NO: 7612124 - DNA, 22 bp, Homo sapiens
tgcagctgattaaagggcagac

SEQ ID NO: 7612125 - DNA, 22 bp, Homo sapiens
tgcagctgattaaagggcagac

SEQ ID NO: 7612126 - DNA, 22 bp, Homo sapiens
tgcagctgcaagtccaggtcag

SEQ ID NO: 7612127 - DNA, 22 bp, Homo sapiens
tgcagccaccacctctgctgaa

SEQ ID NO: 7612128 - DNA, 22 bp, Homo sapiens
tgcagccacatgacctgggtct

SEQ ID NO: 7612129 - DNA, 22 bp, Homo sapiens
tgcagccaattcattcattctt

SEQ ID NO: 7612130 - DNA, 22 bp, Homo sapiens
tgcagccacatgacctgggtct

SEQ ID NO: 7612131 - DNA, 22 bp, Homo sapiens
cccagagggtggaggttgcagt

SEQ ID NO: 7612132 - DNA, 22 bp, Homo sapiens
cccagagggtggaggttgcagt

SEQ ID NO: 7612133 - DNA, 22 bp, Homo sapiens
cccagagggtggaggttgcagt

SEQ ID NO: 7612134 - DNA, 22 bp, Homo sapiens
cccagagggtggaggttgcagt

SEQ ID NO: 7612135 - DNA, 22 bp, Homo sapiens
cccagaggggtcgtctgagggg

SEQ ID NO: 7612136 - DNA, 22 bp, Homo sapiens
cccagaggggtcgtctgagggg

SEQ ID NO: 7612137 - DNA, 22 bp, Homo sapiens
cccagagggtggaggttgcagt

SEQ ID NO: 7612138 - DNA, 22 bp, Homo sapiens
tgcagccaccacctctgctgaa

SEQ ID NO: 7612139 - DNA, 22 bp, Homo sapiens
tgcagccaccacctctgctgaa

SEQ ID NO: 7612140 - DNA, 19 bp, Homo sapiens
tgcagccacgtgagagact

SEQ ID NO: 7612141 - DNA, 22 bp, Homo sapiens
tgcagctgattaaagggcagac

SEQ ID NO: 7612142 - DNA, 22 bp, Homo sapiens
tgcagctgattaaagggcagac

SEQ ID NO: 7612143 - DNA, 22 bp, Homo sapiens
tgcagctgattaaagggcagac

SEQ ID NO: 7612144 - DNA, 22 bp, Homo sapiens
tgcagctgattaaagggcagac

SEQ ID NO: 7612145 - DNA, 22 bp, Homo sapiens
tgcagctgattaaagggcagac

SEQ ID NO: 7612146 - DNA, 22 bp, Homo sapiens
tgcagctgattaaagggcagac

SEQ ID NO: 7612147 - DNA, 22 bp, Homo sapiens
tgcagctgattaaagggcagac

SEQ ID NO: 7612148 - DNA, 22 bp, Homo sapiens
cccagaggaggatctcggcccg

SEQ ID NO: 7612149 - DNA, 22 bp, Homo sapiens
cccagaggaggatctcggcccg

SEQ ID NO: 7612150 - DNA, 23 bp, Homo sapiens
cccagaggagcagggcgtgagat

SEQ ID NO: 7612151 - DNA, 22 bp, Homo sapiens
cccagaggaggatctcggcccg

SEQ ID NO: 7612152 - DNA, 23 bp, Homo sapiens
cccagaggagcagggcgtgagat

SEQ ID NO: 7612153 - DNA, 22 bp, Homo sapiens
cccagaggaggcaaagctctgt

SEQ ID NO: 7612154 - DNA, 22 bp, Homo sapiens
cccagaggaggatctcggcccg

SEQ ID NO: 7612155 - DNA, 22 bp, Homo sapiens
cccagaggaggcaaagctctgt

SEQ ID NO: 7612156 - DNA, 22 bp, Homo sapiens
cccagaggaggcaaagctctgt

SEQ ID NO: 7612157 - DNA, 22 bp, Homo sapiens
cccagaggaggcaaagctctgt

SEQ ID NO: 7612158 - DNA, 22 bp, Homo sapiens
cccagaggctgagttgggagca

SEQ ID NO: 7612159 - DNA, 22 bp, Homo sapiens
cccagaggctgagttgggagca

SEQ ID NO: 7612160 - DNA, 22 bp, Homo sapiens
cccagaggctgagttgggagca

SEQ ID NO: 7612161 - DNA, 22 bp, Homo sapiens
cccagaggctgagttgggagca

SEQ ID NO: 7612162 - DNA, 22 bp, Homo sapiens
cccagaggctgagttgggagca

SEQ ID NO: 7612163 - DNA, 22 bp, Homo sapiens
cccagaggctgagttgggagca

SEQ ID NO: 7612164 - DNA, 22 bp, Homo sapiens
cccagagggaagggaatgaggt

SEQ ID NO: 7612165 - DNA, 22 bp, Homo sapiens
cccagagggaagggaatgaggt

SEQ ID NO: 7612166 - DNA, 22 bp, Homo sapiens
cccagagggaagggaatgaggt

SEQ ID NO: 7612167 - DNA, 22 bp, Homo sapiens
cccagaggctgagttgggagca

SEQ ID NO: 7612168 - DNA, 22 bp, Homo sapiens
cccagagggaagggaatgaggt

SEQ ID NO: 7612169 - DNA, 22 bp, Homo sapiens
cccagaggggtcgtctgagggg

SEQ ID NO: 7612170 - DNA, 22 bp, Homo sapiens
cccagaggggtcgtctgagggg

SEQ ID NO: 7612171 - DNA, 22 bp, Homo sapiens
cccagaggggtcgtctgagggg

SEQ ID NO: 7612172 - DNA, 22 bp, Homo sapiens
cccagaggggtcgtctgagggg

SEQ ID NO: 7612173 - DNA, 22 bp, Homo sapiens
cccagaggggtcgtctgagggg

SEQ ID NO: 7612174 - DNA, 22 bp, Homo sapiens
cccagaggggtcgtctgagggg

SEQ ID NO: 7612175 - DNA, 22 bp, Homo sapiens
cccagaggggtcgtctgagggg

SEQ ID NO: 7612176 - DNA, 22 bp, Homo sapiens
cccagaggggtcgtctgagggg

SEQ ID NO: 7612177 - DNA, 22 bp, Homo sapiens
cccagaggggtcgtctgagggg

SEQ ID NO: 7612178 - DNA, 22 bp, Homo sapiens
cccagagggctgaggatatgaa

SEQ ID NO: 7612179 - DNA, 22 bp, Homo sapiens
cccagagggaagggaatgaggt

SEQ ID NO: 7612180 - DNA, 22 bp, Homo sapiens
cccagagggctgaggatatgaa

SEQ ID NO: 7612181 - DNA, 22 bp, Homo sapiens
cccagagggaagggaatgaggt

SEQ ID NO: 7612182 - DNA, 22 bp, Homo sapiens
cccagagggaagggaatgaggt

SEQ ID NO: 7612183 - DNA, 22 bp, Homo sapiens
cccagagggaagggaatgaggt

SEQ ID NO: 7612184 - DNA, 22 bp, Homo sapiens
cccagagggaagggaatgaggt

SEQ ID NO: 7612185 - DNA, 22 bp, Homo sapiens
cccagagggaagggaatgaggt

SEQ ID NO: 7612186 - DNA, 22 bp, Homo sapiens
cccagagggctgaggatatgaa

SEQ ID NO: 7612187 - DNA, 22 bp, Homo sapiens
cccagagggctgaggatatgaa

SEQ ID NO: 7612188 - DNA, 22 bp, Homo sapiens
cccagagggctgaggatatgaa

SEQ ID NO: 7612189 - DNA, 22 bp, Homo sapiens
cccagagggctgaggatatgaa

SEQ ID NO: 7612190 - DNA, 22 bp, Homo sapiens
cccagagggctgaggatatgaa

SEQ ID NO: 7612191 - DNA, 22 bp, Homo sapiens
cccagagggctgaggatatgaa

SEQ ID NO: 7612192 - DNA, 22 bp, Homo sapiens
tgcaggccagggtagggactag

SEQ ID NO: 7612193 - DNA, 22 bp, Homo sapiens
tgcaggcattggtgagagaagc

SEQ ID NO: 7612194 - DNA, 22 bp, Homo sapiens
tgcaggcattggtgagagaagc

SEQ ID NO: 7612195 - DNA, 22 bp, Homo sapiens
tgcaggcattggtgagagaagc

SEQ ID NO: 7612196 - DNA, 22 bp, Homo sapiens
tgcaggcattggtgagagaagc

SEQ ID NO: 7612197 - DNA, 22 bp, Homo sapiens
tgcaggcataaccgatgttgat

SEQ ID NO: 7612198 - DNA, 22 bp, Homo sapiens
tgcaggcataaccgatgttgat

SEQ ID NO: 7612199 - DNA, 22 bp, Homo sapiens
tgcaggcaggggatgagcagcc

SEQ ID NO: 7612200 - DNA, 22 bp, Homo sapiens
tgcaggcagtaggccagctcca

SEQ ID NO: 7612201 - DNA, 22 bp, Homo sapiens
tgcaggcaggggatgagcagcc

SEQ ID NO: 7612202 - DNA, 22 bp, Homo sapiens
tgcaggcaggggatgagcagcc

SEQ ID NO: 7612203 - DNA, 22 bp, Homo sapiens
tgcaggcaggggatgagcagcc

SEQ ID NO: 7612204 - DNA, 22 bp, Homo sapiens
tgcaggcaggggatgagcagcc

SEQ ID NO: 7612205 - DNA, 22 bp, Homo sapiens
tgcaggcaggggatgagcagcc

SEQ ID NO: 7612206 - DNA, 21 bp, Homo sapiens
tgcaggcaggcagagatgctg

SEQ ID NO: 7612207 - DNA, 21 bp, Homo sapiens
tgcaggcaggcagagatgctg

SEQ ID NO: 7612208 - DNA, 22 bp, Homo sapiens
tgcaggcagggccagcgtgagg

SEQ ID NO: 7612209 - DNA, 22 bp, Homo sapiens
tgcaggcagggccagcgtgagg

SEQ ID NO: 7612210 - DNA, 22 bp, Homo sapiens
tgcaggcaggggatgagcagcc

SEQ ID NO: 7612211 - DNA, 22 bp, Homo sapiens
tgcaggcaggggatgagcagcc

SEQ ID NO: 7612212 - DNA, 22 bp, Homo sapiens
tgcaggcaggggatgagcagcc

SEQ ID NO: 7612213 - DNA, 22 bp, Homo sapiens
tgcaggactttcagtgctcaaa

SEQ ID NO: 7612214 - DNA, 22 bp, Homo sapiens
tgcaggactttcagtgctcaaa

SEQ ID NO: 7612215 - DNA, 22 bp, Homo sapiens
tgcaggagaaagtacggagcgt

SEQ ID NO: 7612216 - DNA, 22 bp, Homo sapiens
tgcaggagaaagtacggagcgt

SEQ ID NO: 7612217 - DNA, 22 bp, Homo sapiens
tgcaggagaaagtacggagcgt

SEQ ID NO: 7612218 - DNA, 22 bp, Homo sapiens
tgcaggagaaagtacggagcgt

SEQ ID NO: 7612219 - DNA, 21 bp, Homo sapiens
tgcaggcaggcagagatgctg

SEQ ID NO: 7612220 - DNA, 22 bp, Homo sapiens
tgcaggagaaagtacggagcgt

SEQ ID NO: 7612221 - DNA, 21 bp, Homo sapiens
tgcaggcaggcagagatgctg

SEQ ID NO: 7612222 - DNA, 21 bp, Homo sapiens
tgcaggcaggcagagatgctg

SEQ ID NO: 7612223 - DNA, 22 bp, Homo sapiens
tgcaggccagggtagggactag

SEQ ID NO: 7612224 - DNA, 22 bp, Homo sapiens
tgcaggccagggtagggactag

SEQ ID NO: 7612225 - DNA, 22 bp, Homo sapiens
tgcaggccagggtagggactag

SEQ ID NO: 7612226 - DNA, 22 bp, Homo sapiens
tgcaggcccagtgtagaggctc

SEQ ID NO: 7612227 - DNA, 22 bp, Homo sapiens
tgcaggcccagtgtagaggctc

SEQ ID NO: 7612228 - DNA, 22 bp, Homo sapiens
tgcaggcccagtgtagaggctc

SEQ ID NO: 7612229 - DNA, 22 bp, Homo sapiens
tgcaggcccagtgtagaggctc

SEQ ID NO: 7612230 - DNA, 22 bp, Homo sapiens
tgcaggccggccctaggcctca

SEQ ID NO: 7612231 - DNA, 22 bp, Homo sapiens
tgcaggccggccctaggcctca

SEQ ID NO: 7612232 - DNA, 22 bp, Homo sapiens
tgcaggccggccctaggcctca

SEQ ID NO: 7612233 - DNA, 22 bp, Homo sapiens
tgcaggccggccctaggcctca

SEQ ID NO: 7612234 - DNA, 22 bp, Homo sapiens
tgcaggcccagtgtagaggctc

SEQ ID NO: 7612235 - DNA, 22 bp, Homo sapiens
tgcaggcccagtgtagaggctc

SEQ ID NO: 7612236 - DNA, 22 bp, Homo sapiens
tgcaggcctcacacctggcacc

SEQ ID NO: 7612237 - DNA, 22 bp, Homo sapiens
tgcaggcctatggtggggcccc

SEQ ID NO: 7612238 - DNA, 22 bp, Homo sapiens
tgcaggcctcacacctggcacc

SEQ ID NO: 7612239 - DNA, 22 bp, Homo sapiens
tgcaggcctcacacctggcacc

SEQ ID NO: 7612240 - DNA, 22 bp, Homo sapiens
tgcaggcctcacacctggcacc

SEQ ID NO: 7612241 - DNA, 22 bp, Homo sapiens
tgcaggcctatggtggggcccc

SEQ ID NO: 7612242 - DNA, 22 bp, Homo sapiens
tgcaggcctatggtggggcccc

SEQ ID NO: 7612243 - DNA, 22 bp, Homo sapiens
tgcaggcctatggtggggcccc

SEQ ID NO: 7612244 - DNA, 22 bp, Homo sapiens
tgcaggccggccctaggcctca

SEQ ID NO: 7612245 - DNA, 22 bp, Homo sapiens
tgcaggccggccctaggcctca

SEQ ID NO: 7612246 - DNA, 22 bp, Homo sapiens
cccagcagcctggatgttcttt

SEQ ID NO: 7612247 - DNA, 22 bp, Homo sapiens
cccagcagcctggatgttcttt

SEQ ID NO: 7612248 - DNA, 22 bp, Homo sapiens
cccagcagcctggatgttcttt

SEQ ID NO: 7612249 - DNA, 22 bp, Homo sapiens
cccagcagccttgtcccttctc

SEQ ID NO: 7612250 - DNA, 22 bp, Homo sapiens
cccagcagccttgtcccttctc

SEQ ID NO: 7612251 - DNA, 22 bp, Homo sapiens
cccagcagcttgcacagtgctg

SEQ ID NO: 7612252 - DNA, 22 bp, Homo sapiens
cccagcagcttgcacagtgctg

SEQ ID NO: 7612253 - DNA, 22 bp, Homo sapiens
cccagcagcttgcacagtgctg

SEQ ID NO: 7612254 - DNA, 22 bp, Homo sapiens
cccagcagcttgcacagtgctg

SEQ ID NO: 7612255 - DNA, 22 bp, Homo sapiens
cccagcagcttgcacagtgctg

SEQ ID NO: 7612256 - DNA, 22 bp, Homo sapiens
cccagcagcttgcacagtgctg

SEQ ID NO: 7612257 - DNA, 22 bp, Homo sapiens
cccagcagcttgcacagtgctg

SEQ ID NO: 7612258 - DNA, 22 bp, Homo sapiens
tgcagggatcctagctgaagag

SEQ ID NO: 7612259 - DNA, 22 bp, Homo sapiens
tgcagggatcctagctgaagag

SEQ ID NO: 7612260 - DNA, 22 bp, Homo sapiens
cccagcaggtcggtgctgcctg

SEQ ID NO: 7612261 - DNA, 22 bp, Homo sapiens
cccagcaggtcggtgctgcctg

SEQ ID NO: 7612262 - DNA, 22 bp, Homo sapiens
cccagcaggtcggtgctgcctg

SEQ ID NO: 7612263 - DNA, 22 bp, Homo sapiens
cccagcaggtcggtgctgcctg

SEQ ID NO: 7612264 - DNA, 22 bp, Homo sapiens
cccagcaggtcggtgctgcctg

SEQ ID NO: 7612265 - DNA, 22 bp, Homo sapiens
cccagcaggtcggtgctgcctg

SEQ ID NO: 7612266 - DNA, 22 bp, Homo sapiens
cccagcaggtcggtgctgcctg

SEQ ID NO: 7612267 - DNA, 22 bp, Homo sapiens
cccagcagggtctctgtgtcta

SEQ ID NO: 7612268 - DNA, 22 bp, Homo sapiens
cccagcagggtctctgtgtcta

SEQ ID NO: 7612269 - DNA, 22 bp, Homo sapiens
cccagcagggtctctgtgtcta

SEQ ID NO: 7612270 - DNA, 22 bp, Homo sapiens
cccagcagggtctctgtgtcta

SEQ ID NO: 7612271 - DNA, 22 bp, Homo sapiens
cccagcagggtctctgtgtcta

SEQ ID NO: 7612272 - DNA, 22 bp, Homo sapiens
cccagcagggtctctgtgtcta

SEQ ID NO: 7612273 - DNA, 22 bp, Homo sapiens
cccagcaggaggaggttgcagt

SEQ ID NO: 7612274 - DNA, 22 bp, Homo sapiens
cccagcaggaggaggttgcagt

SEQ ID NO: 7612275 - DNA, 22 bp, Homo sapiens
cccagcaggaggaggttgcagt

SEQ ID NO: 7612276 - DNA, 22 bp, Homo sapiens
cccagcaggaggaggttgcagt

SEQ ID NO: 7612277 - DNA, 22 bp, Homo sapiens
cccagcagcttgcacagtgctg

SEQ ID NO: 7612278 - DNA, 22 bp, Homo sapiens
cccagcaggaggaggttgcagt

SEQ ID NO: 7612279 - DNA, 22 bp, Homo sapiens
cccagcagcttgcacagtgctg

SEQ ID NO: 7612280 - DNA, 22 bp, Homo sapiens
cccagcagcttgcacagtgctg

SEQ ID NO: 7612281 - DNA, 22 bp, Homo sapiens
cccagcaggcatgttgggagga

SEQ ID NO: 7612282 - DNA, 22 bp, Homo sapiens
cccagcaggcatgttgggagga

SEQ ID NO: 7612283 - DNA, 22 bp, Homo sapiens
cccagcaggcatgttgggagga

SEQ ID NO: 7612284 - DNA, 22 bp, Homo sapiens
cccagcaggcatgttgggagga

SEQ ID NO: 7612285 - DNA, 22 bp, Homo sapiens
cccagcaggcatgttgggagga

SEQ ID NO: 7612286 - DNA, 22 bp, Homo sapiens
cccagcaggcatgttgggagga

SEQ ID NO: 7612287 - DNA, 22 bp, Homo sapiens
cccagcaggcatgttgggagga

SEQ ID NO: 7612288 - DNA, 22 bp, Homo sapiens
cccagcaggcatgttgggagga

SEQ ID NO: 7612289 - DNA, 22 bp, Homo sapiens
cccagcaggcatgttgggagga

SEQ ID NO: 7612290 - DNA, 22 bp, Homo sapiens
tgcagggccttgggatgtgtcc

SEQ ID NO: 7612291 - DNA, 22 bp, Homo sapiens
tgcagggccttgggatgtgtcc

SEQ ID NO: 7612292 - DNA, 22 bp, Homo sapiens
tgcagggccttgggatgtgtcc

SEQ ID NO: 7612293 - DNA, 22 bp, Homo sapiens
tgcagggccttgggatgtgtcc

SEQ ID NO: 7612294 - DNA, 22 bp, Homo sapiens
tgcagggccttgggatgtgtcc

SEQ ID NO: 7612295 - DNA, 22 bp, Homo sapiens
tgcagggccttgttgatgtgct

SEQ ID NO: 7612296 - DNA, 22 bp, Homo sapiens
tgcagggccttgttgatgtgct

SEQ ID NO: 7612297 - DNA, 22 bp, Homo sapiens
tgcagggccttgttgatgtgct

SEQ ID NO: 7612298 - DNA, 22 bp, Homo sapiens
tgcagggccttgttgatgtgct

SEQ ID NO: 7612299 - DNA, 22 bp, Homo sapiens
tgcagggccttgttgatgtgct

SEQ ID NO: 7612300 - DNA, 22 bp, Homo sapiens
tgcagggccttgttgatgtgct

SEQ ID NO: 7612301 - DNA, 22 bp, Homo sapiens
tgcagggctaagtcagagcctg

SEQ ID NO: 7612302 - DNA, 22 bp, Homo sapiens
tgcagggctaagtcagagcctg

SEQ ID NO: 7612303 - DNA, 22 bp, Homo sapiens
tgcagggctaagtcagagcctg

SEQ ID NO: 7612304 - DNA, 22 bp, Homo sapiens
tgcagggccgctggaggtcatg

SEQ ID NO: 7612305 - DNA, 20 bp, Homo sapiens
tgcagggcctaaaaagggaa

SEQ ID NO: 7612306 - DNA, 20 bp, Homo sapiens
tgcagggcctaaaaagggaa

SEQ ID NO: 7612307 - DNA, 22 bp, Homo sapiens
tgcagggatcctagctgaagag

SEQ ID NO: 7612308 - DNA, 22 bp, Homo sapiens
tgcagggccgctggaggtcatg

SEQ ID NO: 7612309 - DNA, 22 bp, Homo sapiens
tgcagggatcctagctgaagag

SEQ ID NO: 7612310 - DNA, 22 bp, Homo sapiens
tgcagggccttgggatgtgtcc

SEQ ID NO: 7612311 - DNA, 22 bp, Homo sapiens
tgcagggccttctagaccatgg

SEQ ID NO: 7612312 - DNA, 22 bp, Homo sapiens
tgcagggccttctagaccatgg

SEQ ID NO: 7612313 - DNA, 22 bp, Homo sapiens
tgcagggccttctagaccatgg

SEQ ID NO: 7612314 - DNA, 20 bp, Homo sapiens
tgcagggcctaaaaagggaa

SEQ ID NO: 7612315 - DNA, 22 bp, Homo sapiens
ccagggaagattagaagccact

SEQ ID NO: 7612316 - DNA, 22 bp, Homo sapiens
ccagggaagctggtcacgcagg

SEQ ID NO: 7612317 - DNA, 22 bp, Homo sapiens
ccagggaagctggtcacgcagg

SEQ ID NO: 7612318 - DNA, 22 bp, Homo sapiens
ccagggaagctggtcacgcagg

SEQ ID NO: 7612319 - DNA, 22 bp, Homo sapiens
ccagggaagctggtcacgcagg

SEQ ID NO: 7612320 - DNA, 23 bp, Homo sapiens
ccagggaaggccatcttcaactg

SEQ ID NO: 7612321 - DNA, 23 bp, Homo sapiens
ccagggaaggccatcttcaactg

SEQ ID NO: 7612322 - DNA, 22 bp, Homo sapiens
ccagggaaggactctctttccc

SEQ ID NO: 7612323 - DNA, 22 bp, Homo sapiens
ccagggaaggactctctttccc

SEQ ID NO: 7612324 - DNA, 17 bp, Homo sapiens
ccagggaggggccgcgc

SEQ ID NO: 7612325 - DNA, 23 bp, Homo sapiens
ccagggaaggccatcttcaactg

SEQ ID NO: 7612326 - DNA, 17 bp, Homo sapiens
ccagggaggggccgcgc

SEQ ID NO: 7612327 - DNA, 17 bp, Homo sapiens
ccagggaggggccgcgc

SEQ ID NO: 7612328 - DNA, 17 bp, Homo sapiens
ccagggaggggccgcgc

SEQ ID NO: 7612329 - DNA, 22 bp, Homo sapiens
tgaaatgatcagtttggttact

SEQ ID NO: 7612330 - DNA, 22 bp, Homo sapiens
tgaaatgatatctgataacaaa

SEQ ID NO: 7612331 - DNA, 22 bp, Homo sapiens
tgaaatgatatctgataacaaa

SEQ ID NO: 7612332 - DNA, 22 bp, Homo sapiens
tgaaatgatgtacaagaaggca

SEQ ID NO: 7612333 - DNA, 22 bp, Homo sapiens
ccagggaagattagaagccact

SEQ ID NO: 7612334 - DNA, 22 bp, Homo sapiens
tgaaatgatcagtttggttact

SEQ ID NO: 7612335 - DNA, 22 bp, Homo sapiens
tgaaatgatgtacaagaaggca

SEQ ID NO: 7612336 - DNA, 22 bp, Homo sapiens
tgaaatgatatctgataacaaa

SEQ ID NO: 7612337 - DNA, 22 bp, Homo sapiens
tgaaatgagcatttattcttta

SEQ ID NO: 7612338 - DNA, 22 bp, Homo sapiens
tgaaatgatatctgataacaaa

SEQ ID NO: 7612339 - DNA, 22 bp, Homo sapiens
tgaaatgagatagataatcagg

SEQ ID NO: 7612340 - DNA, 22 bp, Homo sapiens
tgaaatgagcatttattcttta

SEQ ID NO: 7612341 - DNA, 22 bp, Homo sapiens
tgaaatgagatagataatcagg

SEQ ID NO: 7612342 - DNA, 22 bp, Homo sapiens
tgaaatgagatagataatcagg

SEQ ID NO: 7612343 - DNA, 22 bp, Homo sapiens
tgaaatgagatagataatcagg

SEQ ID NO: 7612344 - DNA, 22 bp, Homo sapiens
tgaaatgagagcacagaataaa

SEQ ID NO: 7612345 - DNA, 22 bp, Homo sapiens
tgaaatgagataatttaagtgc

SEQ ID NO: 7612346 - DNA, 23 bp, Homo sapiens
ccagggagtgctactatcaagcc

SEQ ID NO: 7612347 - DNA, 23 bp, Homo sapiens
ccagggagtgctactatcaagcc

SEQ ID NO: 7612348 - DNA, 23 bp, Homo sapiens
ccagggagtgctactatcaagcc

SEQ ID NO: 7612349 - DNA, 23 bp, Homo sapiens
ccagggagtgctactatcaagcc

SEQ ID NO: 7612350 - DNA, 22 bp, Homo sapiens
ccagggagtttccaatctgaga

SEQ ID NO: 7612351 - DNA, 22 bp, Homo sapiens
ccagggagtttccaatctgaga

SEQ ID NO: 7612352 - DNA, 23 bp, Homo sapiens
ccagggagtgctactatcaagcc

SEQ ID NO: 7612353 - DNA, 22 bp, Homo sapiens
ccagggagtttccaatctgaga

SEQ ID NO: 7612354 - DNA, 18 bp, Homo sapiens
ccagggatgcatggtccc

SEQ ID NO: 7612355 - DNA, 22 bp, Homo sapiens
ccagggatgccaagctttacca

SEQ ID NO: 7612356 - DNA, 22 bp, Homo sapiens
ccagggatgctttcccaggact

SEQ ID NO: 7612357 - DNA, 18 bp, Homo sapiens
ccagggatgcatggtccc

SEQ ID NO: 7612358 - DNA, 22 bp, Homo sapiens
ccagggatgcagaggttgcagt

SEQ ID NO: 7612359 - DNA, 22 bp, Homo sapiens
ccagggagtttccaatctgaga

SEQ ID NO: 7612360 - DNA, 22 bp, Homo sapiens
ccagggagggtcctgtggcttc

SEQ ID NO: 7612361 - DNA, 22 bp, Homo sapiens
ccagggagggtcctgtggcttc

SEQ ID NO: 7612362 - DNA, 22 bp, Homo sapiens
ccagggagggtcctgtggcttc

SEQ ID NO: 7612363 - DNA, 22 bp, Homo sapiens
ccagggagggtcctgtggcttc

SEQ ID NO: 7612364 - DNA, 22 bp, Homo sapiens
ccagggagggtcctgtggcttc

SEQ ID NO: 7612365 - DNA, 22 bp, Homo sapiens
ccagggagggtcctgtggcttc

SEQ ID NO: 7612366 - DNA, 22 bp, Homo sapiens
ccagggagggtcctgtggcttc

SEQ ID NO: 7612367 - DNA, 17 bp, Homo sapiens
ccagggaggggccgcgc

SEQ ID NO: 7612368 - DNA, 17 bp, Homo sapiens
ccagggaggggccgcgc

SEQ ID NO: 7612369 - DNA, 23 bp, Homo sapiens
ccagggaggttgattggttaccc

SEQ ID NO: 7612370 - DNA, 23 bp, Homo sapiens
ccagggaggttgattggttaccc

SEQ ID NO: 7612371 - DNA, 23 bp, Homo sapiens
ccagggaggttgattggttaccc

SEQ ID NO: 7612372 - DNA, 22 bp, Homo sapiens
ccagggagggtcctgtggcttc

SEQ ID NO: 7612373 - DNA, 22 bp, Homo sapiens
ccagggagggtcctgtggcttc

SEQ ID NO: 7612374 - DNA, 22 bp, Homo sapiens
ccagggagggtcctgtggcttc

SEQ ID NO: 7612375 - DNA, 22 bp, Homo sapiens
ccagggcaaatgagatcatagc

SEQ ID NO: 7612376 - DNA, 22 bp, Homo sapiens
ccagggcaaatgagatcatagc

SEQ ID NO: 7612377 - DNA, 22 bp, Homo sapiens
ccagggcaacgctgtctcagag

SEQ ID NO: 7612378 - DNA, 22 bp, Homo sapiens
ccagggcaacgctgtctcagag

SEQ ID NO: 7612379 - DNA, 22 bp, Homo sapiens
ccagggcaacgctgtctcagag

SEQ ID NO: 7612380 - DNA, 22 bp, Homo sapiens
ccagggcaacgctgtctcagag

SEQ ID NO: 7612381 - DNA, 22 bp, Homo sapiens
ccagggcaacgctgtctcagag

SEQ ID NO: 7612382 - DNA, 22 bp, Homo sapiens
ccagggcaacgctgtctcagag

SEQ ID NO: 7612383 - DNA, 22 bp, Homo sapiens
ccagggcaaatgagatcatagc

SEQ ID NO: 7612384 - DNA, 22 bp, Homo sapiens
ccagggcaaatgagatcatagc

SEQ ID NO: 7612385 - DNA, 22 bp, Homo sapiens
ccagggcaaatgagatcatagc

SEQ ID NO: 7612386 - DNA, 22 bp, Homo sapiens
ccagggatgtggcagcaccata

SEQ ID NO: 7612387 - DNA, 21 bp, Homo sapiens
ccagggatgttgaactgaaag

SEQ ID NO: 7612388 - DNA, 21 bp, Homo sapiens
ccagggatgttgaactgaaag

SEQ ID NO: 7612389 - DNA, 22 bp, Homo sapiens
ccagggatgtggcagcaccata

SEQ ID NO: 7612390 - DNA, 22 bp, Homo sapiens
ccagggatgtggcagcaccata

SEQ ID NO: 7612391 - DNA, 22 bp, Homo sapiens
ccagggatgtggcagcaccata

SEQ ID NO: 7612392 - DNA, 22 bp, Homo sapiens
ccagggcaattatttggagggt

SEQ ID NO: 7612393 - DNA, 22 bp, Homo sapiens
ccagggcaattatttggagggt

SEQ ID NO: 7612394 - DNA, 22 bp, Homo sapiens
ccagggcaattatttggagggt

SEQ ID NO: 7612395 - DNA, 22 bp, Homo sapiens
ccagggcaataggaacactttt

SEQ ID NO: 7612396 - DNA, 22 bp, Homo sapiens
ccagggcaattatttggagggt

SEQ ID NO: 7612397 - DNA, 22 bp, Homo sapiens
ccagggcaattatttggagggt

SEQ ID NO: 7612398 - DNA, 22 bp, Homo sapiens
ccagggcaataggaacactttt

SEQ ID NO: 7612399 - DNA, 22 bp, Homo sapiens
ccagggcaataggaacactttt

SEQ ID NO: 7612400 - DNA, 22 bp, Homo sapiens
ccagggcaacgctgtctcagag

SEQ ID NO: 7612401 - DNA, 22 bp, Homo sapiens
ccagggcaacgctgtctcagag

SEQ ID NO: 7612402 - DNA, 22 bp, Homo sapiens
ccagggcaacgctgtctcagag

SEQ ID NO: 7612403 - DNA, 22 bp, Homo sapiens
ccagggcaacgctgtctcagag

SEQ ID NO: 7612404 - DNA, 22 bp, Homo sapiens
ccagggcaggggctggagttca

SEQ ID NO: 7612405 - DNA, 22 bp, Homo sapiens
ccagggcaggggctggagttca

SEQ ID NO: 7612406 - DNA, 22 bp, Homo sapiens
ccagggcaggggctggagttca

SEQ ID NO: 7612407 - DNA, 22 bp, Homo sapiens
ccagggcagggaccacgtgtct

SEQ ID NO: 7612408 - DNA, 22 bp, Homo sapiens
ccagggcaggggctggagttca

SEQ ID NO: 7612409 - DNA, 22 bp, Homo sapiens
ccagggcagggaccacgtgtct

SEQ ID NO: 7612410 - DNA, 22 bp, Homo sapiens
ccagggcagggaccacgtgtct

SEQ ID NO: 7612411 - DNA, 22 bp, Homo sapiens
ccagggcagggaccacgtgtct

SEQ ID NO: 7612412 - DNA, 22 bp, Homo sapiens
ccagggcaggagaaagactcac

SEQ ID NO: 7612413 - DNA, 22 bp, Homo sapiens
ccagggcaggagaaagactcac

SEQ ID NO: 7612414 - DNA, 22 bp, Homo sapiens
ccagggcaggagaaagactcac

SEQ ID NO: 7612415 - DNA, 22 bp, Homo sapiens
ccagggcacgttgggacagtac

SEQ ID NO: 7612416 - DNA, 22 bp, Homo sapiens
ccagggcacgttgggacagtac

SEQ ID NO: 7612417 - DNA, 22 bp, Homo sapiens
ccagggcacgttgggacagtac

SEQ ID NO: 7612418 - DNA, 22 bp, Homo sapiens
ccagggcacgttgggacagtac

SEQ ID NO: 7612419 - DNA, 22 bp, Homo sapiens
ccagggcacgttgggacagtac

SEQ ID NO: 7612420 - DNA, 22 bp, Homo sapiens
ccagggcacgttgggacagtac

SEQ ID NO: 7612421 - DNA, 22 bp, Homo sapiens
ccagggcaggagaaagactcac

SEQ ID NO: 7612422 - DNA, 22 bp, Homo sapiens
ccagggcaggagaaagactcac

SEQ ID NO: 7612423 - DNA, 22 bp, Homo sapiens
ccagggcacgttgggacagtac

SEQ ID NO: 7612424 - DNA, 22 bp, Homo sapiens
ccagggcaattatttggagggt

SEQ ID NO: 7612425 - DNA, 22 bp, Homo sapiens
ccagggcacgttgggacagtac

SEQ ID NO: 7612426 - DNA, 22 bp, Homo sapiens
ccagggcacgttgggacagtac

SEQ ID NO: 7612427 - DNA, 22 bp, Homo sapiens
ccagggcacgttgggacagtac

SEQ ID NO: 7612428 - DNA, 22 bp, Homo sapiens
ccagggcacgttgggacagtac

SEQ ID NO: 7612429 - DNA, 22 bp, Homo sapiens
ccagggcacgttgggacagtac

SEQ ID NO: 7612430 - DNA, 22 bp, Homo sapiens
ccagggcagtgggagaaggtgc

SEQ ID NO: 7612431 - DNA, 22 bp, Homo sapiens
ccagggcagtgggagaaggtgc

SEQ ID NO: 7612432 - DNA, 22 bp, Homo sapiens
ccagggcagtgggagaaggtgc

SEQ ID NO: 7612433 - DNA, 22 bp, Homo sapiens
ccagggcagtgggagaaggtgc

SEQ ID NO: 7612434 - DNA, 22 bp, Homo sapiens
ccagggcagtgggagaaggtgc

SEQ ID NO: 7612435 - DNA, 22 bp, Homo sapiens
ccagggcagtgggagaaggtgc

SEQ ID NO: 7612436 - DNA, 22 bp, Homo sapiens
ccagggcagtgggagaaggtgc

SEQ ID NO: 7612437 - DNA, 22 bp, Homo sapiens
ccagggcagtgggagaaggtgc

SEQ ID NO: 7612438 - DNA, 22 bp, Homo sapiens
ccagggcatcacatccagtgtt

SEQ ID NO: 7612439 - DNA, 22 bp, Homo sapiens
ccagggcatcacatccagtgtt

SEQ ID NO: 7612440 - DNA, 22 bp, Homo sapiens
ccagggcatcacatccagtgtt

SEQ ID NO: 7612441 - DNA, 22 bp, Homo sapiens
ccagggcatcacatccagtgtt

SEQ ID NO: 7612442 - DNA, 22 bp, Homo sapiens
ccagggcatgggaagaactgaa

SEQ ID NO: 7612443 - DNA, 22 bp, Homo sapiens
ccagggcatcctcacatcgcag

SEQ ID NO: 7612444 - DNA, 22 bp, Homo sapiens
ccagggcatgggaagaactgaa

SEQ ID NO: 7612445 - DNA, 22 bp, Homo sapiens
ccagggcatcctcacatcgcag

SEQ ID NO: 7612446 - DNA, 22 bp, Homo sapiens
ccagggcatcctcacatcgcag

SEQ ID NO: 7612447 - DNA, 22 bp, Homo sapiens
ccagggcatcacatccagtgtt

SEQ ID NO: 7612448 - DNA, 22 bp, Homo sapiens
ccagggcatcctcacatcgcag

SEQ ID NO: 7612449 - DNA, 22 bp, Homo sapiens
ccagggcatcctcacatcgcag

SEQ ID NO: 7612450 - DNA, 22 bp, Homo sapiens
ccagggcatcctcacatcgcag

SEQ ID NO: 7612451 - DNA, 22 bp, Homo sapiens
tgaaggtgtatgctgtgggtca

SEQ ID NO: 7612452 - DNA, 22 bp, Homo sapiens
tgaaggtgtatgctgtgggtca

SEQ ID NO: 7612453 - DNA, 19 bp, Homo sapiens
tgaaggtgtatgtgctggg

SEQ ID NO: 7612454 - DNA, 21 bp, Homo sapiens
tgaaggtgttcatgatgcggt

SEQ ID NO: 7612455 - DNA, 22 bp, Homo sapiens
tgaaggtgtctttgtgaacatc

SEQ ID NO: 7612456 - DNA, 22 bp, Homo sapiens
tgaaggtgtctttgtgaacatc

SEQ ID NO: 7612457 - DNA, 22 bp, Homo sapiens
tgaagtatctatggatataaga

SEQ ID NO: 7612458 - DNA, 22 bp, Homo sapiens
tgaagtatcccaagatttacag

SEQ ID NO: 7612459 - DNA, 22 bp, Homo sapiens
tgaagtatctatggatataaga

SEQ ID NO: 7612460 - DNA, 22 bp, Homo sapiens
tgaagtatctatggatataaga

SEQ ID NO: 7612461 - DNA, 22 bp, Homo sapiens
tgaagtcagggattccatgaag

SEQ ID NO: 7612462 - DNA, 22 bp, Homo sapiens
tgaagtcctaacttccagtaca

SEQ ID NO: 7612463 - DNA, 22 bp, Homo sapiens
tgaagtctattaactgatttct

SEQ ID NO: 7612464 - DNA, 22 bp, Homo sapiens
tgaagtatccatcttgttctag

SEQ ID NO: 7612465 - DNA, 22 bp, Homo sapiens
tgaagtatacggaaattgtgga

SEQ ID NO: 7612466 - DNA, 22 bp, Homo sapiens
tgaagtatccatcttgttctag

SEQ ID NO: 7612467 - DNA, 22 bp, Homo sapiens
tgaagtatccatcttgttctag

SEQ ID NO: 7612468 - DNA, 22 bp, Homo sapiens
tgaagtaggcagcatgctgaga

SEQ ID NO: 7612469 - DNA, 22 bp, Homo sapiens
tgaaggtgtttatacctcagat

SEQ ID NO: 7612470 - DNA, 22 bp, Homo sapiens
tgaagtaactgtccaggatcca

SEQ ID NO: 7612471 - DNA, 22 bp, Homo sapiens
tgaagtacccgtttttattgca

SEQ ID NO: 7612472 - DNA, 22 bp, Homo sapiens
tgaagtacccgtttttattgca

SEQ ID NO: 7612473 - DNA, 22 bp, Homo sapiens
tgaagtaggcagcatgctgaga

SEQ ID NO: 7612474 - DNA, 22 bp, Homo sapiens
tgaagtggaccctggacagacc

SEQ ID NO: 7612475 - DNA, 22 bp, Homo sapiens
tgaagtggaccctggacagacc

SEQ ID NO: 7612476 - DNA, 22 bp, Homo sapiens
tgaagtggaccctggacagacc

SEQ ID NO: 7612477 - DNA, 22 bp, Homo sapiens
tgaagtgattagaaccacttga

SEQ ID NO: 7612478 - DNA, 22 bp, Homo sapiens
tgaagtgattagaaccacttga

SEQ ID NO: 7612479 - DNA, 22 bp, Homo sapiens
tgaagtgattagaaccacttga

SEQ ID NO: 7612480 - DNA, 22 bp, Homo sapiens
tgaagtgacctggggcagtgta

SEQ ID NO: 7612481 - DNA, 22 bp, Homo sapiens
tgaagtgacctggggcagtgta

SEQ ID NO: 7612482 - DNA, 22 bp, Homo sapiens
tgaagtgacctggggcagtgta

SEQ ID NO: 7612483 - DNA, 22 bp, Homo sapiens
tgaagtgagtagtgtctagggg

SEQ ID NO: 7612484 - DNA, 22 bp, Homo sapiens
tgaagtgagtagtgtctagggg

SEQ ID NO: 7612485 - DNA, 23 bp, Homo sapiens
tgaagtgaaatttcacaagggac

SEQ ID NO: 7612486 - DNA, 23 bp, Homo sapiens
tgaagtgaaatttcacaagggac

SEQ ID NO: 7612487 - DNA, 22 bp, Homo sapiens
tgaagtgaagaagcatgaatag

SEQ ID NO: 7612488 - DNA, 22 bp, Homo sapiens
tgaagtgaagaagcatgaatag

SEQ ID NO: 7612489 - DNA, 22 bp, Homo sapiens
tgaagtctttctgatcatttac

SEQ ID NO: 7612490 - DNA, 22 bp, Homo sapiens
tgaagtcttccagggaaacgtg

SEQ ID NO: 7612491 - DNA, 22 bp, Homo sapiens
tgaagtctattctatgccaggt

SEQ ID NO: 7612492 - DNA, 22 bp, Homo sapiens
tgaagtctctgttttctcattt

SEQ ID NO: 7612493 - DNA, 22 bp, Homo sapiens
ccagggctgagctgtgaccatg

SEQ ID NO: 7612494 - DNA, 22 bp, Homo sapiens
ccagggctgagctgtgaccatg

SEQ ID NO: 7612495 - DNA, 22 bp, Homo sapiens
ccagggctgagctgtgaccatg

SEQ ID NO: 7612496 - DNA, 22 bp, Homo sapiens
ccagggctgagctgtgaccatg

SEQ ID NO: 7612497 - DNA, 22 bp, Homo sapiens
ccagggctgagctgtgaccatg

SEQ ID NO: 7612498 - DNA, 22 bp, Homo sapiens
ccagggctgagctgtgaccatg

SEQ ID NO: 7612499 - DNA, 22 bp, Homo sapiens
ccagggctgagctgtgaccatg

SEQ ID NO: 7612500 - DNA, 22 bp, Homo sapiens
ccagggctgccgcatccctggt

SEQ ID NO: 7612501 - DNA, 22 bp, Homo sapiens
ccagggctgcctggccgtgtgt

SEQ ID NO: 7612502 - DNA, 22 bp, Homo sapiens
ccagggctgccgcatccctggt

SEQ ID NO: 7612503 - DNA, 22 bp, Homo sapiens
ccagggctgccgcatccctggt

SEQ ID NO: 7612504 - DNA, 22 bp, Homo sapiens
ccagggctgccgcatccctggt

SEQ ID NO: 7612505 - DNA, 22 bp, Homo sapiens
ccagggctgagctgtgaccatg

SEQ ID NO: 7612506 - DNA, 22 bp, Homo sapiens
ccagggctgccgcatccctggt

SEQ ID NO: 7612507 - DNA, 22 bp, Homo sapiens
ccagggctgagactgtattggg

SEQ ID NO: 7612508 - DNA, 22 bp, Homo sapiens
ccagggctgagactgtattggg

SEQ ID NO: 7612509 - DNA, 22 bp, Homo sapiens
ccagggctgagactgtattggg

SEQ ID NO: 7612510 - DNA, 22 bp, Homo sapiens
ccagggctgagctgtgaccatg

SEQ ID NO: 7612511 - DNA, 22 bp, Homo sapiens
ccagggctctgcttctgccatg

SEQ ID NO: 7612512 - DNA, 22 bp, Homo sapiens
ccagggctctgcttctgccatg

SEQ ID NO: 7612513 - DNA, 22 bp, Homo sapiens
ccagggctctgcttctgccatg

SEQ ID NO: 7612514 - DNA, 22 bp, Homo sapiens
ccagggctctgcttctgccatg

SEQ ID NO: 7612515 - DNA, 22 bp, Homo sapiens
ccagggctctgcttctgccatg

SEQ ID NO: 7612516 - DNA, 22 bp, Homo sapiens
ccagggctctgcttctgccatg

SEQ ID NO: 7612517 - DNA, 22 bp, Homo sapiens
ccagggctctgcttctgccatg

SEQ ID NO: 7612518 - DNA, 22 bp, Homo sapiens
ccagggctctgcttctgccatg

SEQ ID NO: 7612519 - DNA, 22 bp, Homo sapiens
ccagggctctatgagggtggag

SEQ ID NO: 7612520 - DNA, 22 bp, Homo sapiens
ccagggctccccagaagtaccc

SEQ ID NO: 7612521 - DNA, 22 bp, Homo sapiens
ccagggctccattgctcatcct

SEQ ID NO: 7612522 - DNA, 22 bp, Homo sapiens
ccagggctccccagaagtaccc

SEQ ID NO: 7612523 - DNA, 22 bp, Homo sapiens
ccagggctccccagaagtaccc

SEQ ID NO: 7612524 - DNA, 22 bp, Homo sapiens
ccagggctccccagaagtaccc

SEQ ID NO: 7612525 - DNA, 22 bp, Homo sapiens
ccagggctccccagaagtaccc

SEQ ID NO: 7612526 - DNA, 22 bp, Homo sapiens
ccagggctccattgctcatcct

SEQ ID NO: 7612527 - DNA, 22 bp, Homo sapiens
ccagggctccattgctcatcct

SEQ ID NO: 7612528 - DNA, 22 bp, Homo sapiens
ccagggctccccagaagtaccc

SEQ ID NO: 7612529 - DNA, 22 bp, Homo sapiens
ccagggctctatgagggtggag

SEQ ID NO: 7612530 - DNA, 22 bp, Homo sapiens
ccagggctctatgagggtggag

SEQ ID NO: 7612531 - DNA, 22 bp, Homo sapiens
ccagggctctatgagggtggag

SEQ ID NO: 7612532 - DNA, 22 bp, Homo sapiens
ccagggctctatgagggtggag

SEQ ID NO: 7612533 - DNA, 22 bp, Homo sapiens
ccagggctctatgagggtggag

SEQ ID NO: 7612534 - DNA, 22 bp, Homo sapiens
ccagggctctatgagggtggag

SEQ ID NO: 7612535 - DNA, 22 bp, Homo sapiens
ccagggctcgggtgcttagtca

SEQ ID NO: 7612536 - DNA, 22 bp, Homo sapiens
ccagggctcgggtgcttagtca

SEQ ID NO: 7612537 - DNA, 22 bp, Homo sapiens
ccagggctctatgagggtggag

SEQ ID NO: 7612538 - DNA, 22 bp, Homo sapiens
ccagggctcgggtgcttagtca

SEQ ID NO: 7612539 - DNA, 22 bp, Homo sapiens
ccagggctcgggtgcttagtca

SEQ ID NO: 7612540 - DNA, 22 bp, Homo sapiens
ccagggctcgggtgcttagtca

SEQ ID NO: 7612541 - DNA, 22 bp, Homo sapiens
ccagggcctcgtgttctgagtg

SEQ ID NO: 7612542 - DNA, 22 bp, Homo sapiens
ccagggcctacagcttaagtcc

SEQ ID NO: 7612543 - DNA, 22 bp, Homo sapiens
ccagggcctacagcttaagtcc

SEQ ID NO: 7612544 - DNA, 22 bp, Homo sapiens
ccagggcctcgtgttctgagtg

SEQ ID NO: 7612545 - DNA, 22 bp, Homo sapiens
ccagggcctcgtgttctgagtg

SEQ ID NO: 7612546 - DNA, 22 bp, Homo sapiens
ccagggctccattgctcatcct

SEQ ID NO: 7612547 - DNA, 22 bp, Homo sapiens
ccagggctccattgctcatcct

SEQ ID NO: 7612548 - DNA, 22 bp, Homo sapiens
ccagggctccattgctcatcct

SEQ ID NO: 7612549 - DNA, 22 bp, Homo sapiens
ccagggctccattgctcatcct

SEQ ID NO: 7612550 - DNA, 22 bp, Homo sapiens
ccagggcctacagcttaagtcc

SEQ ID NO: 7612551 - DNA, 22 bp, Homo sapiens
ccagggcctacagcttaagtcc

SEQ ID NO: 7612552 - DNA, 17 bp, Homo sapiens
tgaagttaggctgcaga

SEQ ID NO: 7612553 - DNA, 22 bp, Homo sapiens
tgaagtgggggaacgagagttc

SEQ ID NO: 7612554 - DNA, 17 bp, Homo sapiens
tgaagttaggctgcaga

SEQ ID NO: 7612555 - DNA, 17 bp, Homo sapiens
tgaagttaggctgcaga

SEQ ID NO: 7612556 - DNA, 22 bp, Homo sapiens
tgaagttagaactatgaggata

SEQ ID NO: 7612557 - DNA, 22 bp, Homo sapiens
tgaagttagaactatgaggata

SEQ ID NO: 7612558 - DNA, 22 bp, Homo sapiens
tcttttgtgaggacaaggtacg

SEQ ID NO: 7612559 - DNA, 22 bp, Homo sapiens
tcttttgtcggtgtatcatgga

SEQ ID NO: 7612560 - DNA, 22 bp, Homo sapiens
tcttttgtcggtgtatcatgga

SEQ ID NO: 7612561 - DNA, 22 bp, Homo sapiens
tcttttgtgattcttcagttac

SEQ ID NO: 7612562 - DNA, 22 bp, Homo sapiens
tcttttgtgattcttcagttac

SEQ ID NO: 7612563 - DNA, 22 bp, Homo sapiens
tcttttgtgaggacaaggtacg

SEQ ID NO: 7612564 - DNA, 22 bp, Homo sapiens
tcttttgtgaggacaaggtacg

SEQ ID NO: 7612565 - DNA, 22 bp, Homo sapiens
tcttttgtcatcccttgtacat

SEQ ID NO: 7612566 - DNA, 22 bp, Homo sapiens
tcttttgtcatcccttgtacat

SEQ ID NO: 7612567 - DNA, 22 bp, Homo sapiens
tcttttgtcatagagcatggta

SEQ ID NO: 7612568 - DNA, 18 bp, Homo sapiens
tcttttgtcccctgctgc

SEQ ID NO: 7612569 - DNA, 22 bp, Homo sapiens
tcttttgtagctaacacattca

SEQ ID NO: 7612570 - DNA, 22 bp, Homo sapiens
tcttttgtactcagtattgaca

SEQ ID NO: 7612571 - DNA, 22 bp, Homo sapiens
tcttttgtactcagtattgaca

SEQ ID NO: 7612572 - DNA, 22 bp, Homo sapiens
tcttttgtagctaacacattca

SEQ ID NO: 7612573 - DNA, 22 bp, Homo sapiens
tcttttgtcatagagcatggta

SEQ ID NO: 7612574 - DNA, 21 bp, Homo sapiens
tcttttgtaactatttcagcc

SEQ ID NO: 7612575 - DNA, 21 bp, Homo sapiens
tcttttgtaactatttcagcc

SEQ ID NO: 7612576 - DNA, 21 bp, Homo sapiens
tcttttgtaactatttcagcc

SEQ ID NO: 7612577 - DNA, 21 bp, Homo sapiens
tcttttgtaactatttcagcc

SEQ ID NO: 7612578 - DNA, 22 bp, Homo sapiens
tcttttggaaatgatgtgcagg

SEQ ID NO: 7612579 - DNA, 22 bp, Homo sapiens
tcttttcttcttaatggttaat

SEQ ID NO: 7612580 - DNA, 22 bp, Homo sapiens
tcttttcttcttaatggttaat

SEQ ID NO: 7612581 - DNA, 22 bp, Homo sapiens
tcttttcttcttaatggttaat

SEQ ID NO: 7612582 - DNA, 22 bp, Homo sapiens
tcttttcttcttaatggttaat

SEQ ID NO: 7612583 - DNA, 22 bp, Homo sapiens
tcttttcttgcattattgcact

SEQ ID NO: 7612584 - DNA, 22 bp, Homo sapiens
tcttttcttgcattattgcact

SEQ ID NO: 7612585 - DNA, 22 bp, Homo sapiens
tcttttcttgcattattgcact

SEQ ID NO: 7612586 - DNA, 22 bp, Homo sapiens
tcttttcttgcattattgcact

SEQ ID NO: 7612587 - DNA, 22 bp, Homo sapiens
tcttttcttgcattattgcact

SEQ ID NO: 7612588 - DNA, 22 bp, Homo sapiens
tcttttcttgcattattgcact

SEQ ID NO: 7612589 - DNA, 22 bp, Homo sapiens
tcttttcttgcattattgcact

SEQ ID NO: 7612590 - DNA, 22 bp, Homo sapiens
tcttttcttgcattattgcact

SEQ ID NO: 7612591 - DNA, 22 bp, Homo sapiens
tcttttcttgcattattgcact

SEQ ID NO: 7612592 - DNA, 22 bp, Homo sapiens
tcttttcttgcattattgcact

SEQ ID NO: 7612593 - DNA, 22 bp, Homo sapiens
tcttttcttgcattattgcact

SEQ ID NO: 7612594 - DNA, 22 bp, Homo sapiens
tcttttgagggccagaggaaga

SEQ ID NO: 7612595 - DNA, 22 bp, Homo sapiens
tcttttcttgcattattgcact

SEQ ID NO: 7612596 - DNA, 22 bp, Homo sapiens
tcttttgagggccagaggaaga

SEQ ID NO: 7612597 - DNA, 22 bp, Homo sapiens
tcttttggaaatgatgtgcagg

SEQ ID NO: 7612598 - DNA, 22 bp, Homo sapiens
tcttgcagttgcgcagtgcatg

SEQ ID NO: 7612599 - DNA, 22 bp, Homo sapiens
tcttgcatacactatatgtaca

SEQ ID NO: 7612600 - DNA, 22 bp, Homo sapiens
tcttgcaggcggctcagcaacc

SEQ ID NO: 7612601 - DNA, 22 bp, Homo sapiens
tcttgcaggcggctcagcaacc

SEQ ID NO: 7612602 - DNA, 22 bp, Homo sapiens
tcttgcattccattctcgtgcc

SEQ ID NO: 7612603 - DNA, 22 bp, Homo sapiens
tcttgcattccattctcgtgcc

SEQ ID NO: 7612604 - DNA, 22 bp, Homo sapiens
tcttgcatgatattctgtattt

SEQ ID NO: 7612605 - DNA, 22 bp, Homo sapiens
tcttgcatgatattctgtattt

SEQ ID NO: 7612606 - DNA, 22 bp, Homo sapiens
tcttgcataggtcttttatcag

SEQ ID NO: 7612607 - DNA, 22 bp, Homo sapiens
tcttgccgcgcaggcgcagttc

SEQ ID NO: 7612608 - DNA, 22 bp, Homo sapiens
tctttggttgcactgcaggtgt

SEQ ID NO: 7612609 - DNA, 22 bp, Homo sapiens
tcttgcatttcagagttcagag

SEQ ID NO: 7612610 - DNA, 22 bp, Homo sapiens
tcttgccctcaacaagagcatg

SEQ ID NO: 7612611 - DNA, 22 bp, Homo sapiens
tcttgcatttaaggagctcata

SEQ ID NO: 7612612 - DNA, 22 bp, Homo sapiens
tcttgcattgctcattgtgcca

SEQ ID NO: 7612613 - DNA, 22 bp, Homo sapiens
tctttggtttctgtctctgtaa

SEQ ID NO: 7612614 - DNA, 22 bp, Homo sapiens
tctttggtttctgtctctgtaa

SEQ ID NO: 7612615 - DNA, 22 bp, Homo sapiens
tctttggttgcactgcaggtgt

SEQ ID NO: 7612616 - DNA, 22 bp, Homo sapiens
tctttggttgcactgcaggtgt

SEQ ID NO: 7612617 - DNA, 22 bp, Homo sapiens
tctttggttgcactgcaggtgt

SEQ ID NO: 7612618 - DNA, 22 bp, Homo sapiens
tcttttctggactctgcatgga

SEQ ID NO: 7612619 - DNA, 22 bp, Homo sapiens
tcttttctggactctgcatgga

SEQ ID NO: 7612620 - DNA, 22 bp, Homo sapiens
tcttttctggactctgcatgga

SEQ ID NO: 7612621 - DNA, 22 bp, Homo sapiens
tcttttctgccagctgagccct

SEQ ID NO: 7612622 - DNA, 22 bp, Homo sapiens
tcttttctgccacagcctgagc

SEQ ID NO: 7612623 - DNA, 22 bp, Homo sapiens
tcttttctgccagctgagccct

SEQ ID NO: 7612624 - DNA, 22 bp, Homo sapiens
tctttgtaaatgcctagcataa

SEQ ID NO: 7612625 - DNA, 22 bp, Homo sapiens
tctttgtaaatgcctagcataa

SEQ ID NO: 7612626 - DNA, 22 bp, Homo sapiens
tcttttctgccacagcctgagc

SEQ ID NO: 7612627 - DNA, 22 bp, Homo sapiens
tcttttctgccacagcctgagc

SEQ ID NO: 7612628 - DNA, 22 bp, Homo sapiens
tcttttctgccacagcctgagc

SEQ ID NO: 7612629 - DNA, 22 bp, Homo sapiens
tcttttctgtaactcagtgtct

SEQ ID NO: 7612630 - DNA, 22 bp, Homo sapiens
tcttttctggactctgcatgga

SEQ ID NO: 7612631 - DNA, 22 bp, Homo sapiens
tcttttctgtaactcagtgtct

SEQ ID NO: 7612632 - DNA, 22 bp, Homo sapiens
tcttttctggactctgcatgga

SEQ ID NO: 7612633 - DNA, 22 bp, Homo sapiens
tcttttctggactctgcatgga

SEQ ID NO: 7612634 - DNA, 22 bp, Homo sapiens
tcttttctgtaactcagtgtct

SEQ ID NO: 7612635 - DNA, 22 bp, Homo sapiens
tcttttcttcttaatggttaat

SEQ ID NO: 7612636 - DNA, 22 bp, Homo sapiens
tcttttcttcttaatggttaat

SEQ ID NO: 7612637 - DNA, 22 bp, Homo sapiens
tcttttctgtaactcagtgtct

SEQ ID NO: 7612638 - DNA, 22 bp, Homo sapiens
tcttttctgtaactcagtgtct

SEQ ID NO: 7612639 - DNA, 22 bp, Homo sapiens
tcttgatttattctacccagaa

SEQ ID NO: 7612640 - DNA, 22 bp, Homo sapiens
tcttgatttattctacccagaa

SEQ ID NO: 7612641 - DNA, 22 bp, Homo sapiens
tcttgatttgaattgcagttgt

SEQ ID NO: 7612642 - DNA, 22 bp, Homo sapiens
tcttgatttgtaaaagaaggat

SEQ ID NO: 7612643 - DNA, 22 bp, Homo sapiens
tcttgatttgaattgcagttgt

SEQ ID NO: 7612644 - DNA, 22 bp, Homo sapiens
ccaggcctgcatctgctgcgca

SEQ ID NO: 7612645 - DNA, 22 bp, Homo sapiens
ccaggcctgcatctgctgcgca

SEQ ID NO: 7612646 - DNA, 22 bp, Homo sapiens
ccaggcctgcatctgctgcgca

SEQ ID NO: 7612647 - DNA, 22 bp, Homo sapiens
ccaggcctgattgggaatcttg

SEQ ID NO: 7612648 - DNA, 22 bp, Homo sapiens
ccaggcctgattgggaatcttg

SEQ ID NO: 7612649 - DNA, 22 bp, Homo sapiens
ccaggcctgattgggaatcttg

SEQ ID NO: 7612650 - DNA, 22 bp, Homo sapiens
ccaggcctgattgggaatcttg

SEQ ID NO: 7612651 - DNA, 22 bp, Homo sapiens
ccaggcctgattgggaatcttg

SEQ ID NO: 7612652 - DNA, 19 bp, Homo sapiens
ccaggcctctggggcctgt

SEQ ID NO: 7612653 - DNA, 19 bp, Homo sapiens
ccaggcctctggggcctgt

SEQ ID NO: 7612654 - DNA, 19 bp, Homo sapiens
ccaggcctctggggcctgt

SEQ ID NO: 7612655 - DNA, 19 bp, Homo sapiens
ccaggcctctggggcctgt

SEQ ID NO: 7612656 - DNA, 22 bp, Homo sapiens
ccaggcctctggctgcttagtc

SEQ ID NO: 7612657 - DNA, 23 bp, Homo sapiens
ccaggcctctcagagggtgtgcc

SEQ ID NO: 7612658 - DNA, 22 bp, Homo sapiens
ccaggcctctggctgcttagtc

SEQ ID NO: 7612659 - DNA, 22 bp, Homo sapiens
ccaggcctctggctgcttagtc

SEQ ID NO: 7612660 - DNA, 23 bp, Homo sapiens
ccaggcctctcagagggtgtgcc

SEQ ID NO: 7612661 - DNA, 23 bp, Homo sapiens
ccaggcctctcagagggtgtgcc

SEQ ID NO: 7612662 - DNA, 23 bp, Homo sapiens
ccaggcctctcagagggtgtgcc

SEQ ID NO: 7612663 - DNA, 23 bp, Homo sapiens
ccaggcctctcagagggtgtgcc

SEQ ID NO: 7612664 - DNA, 23 bp, Homo sapiens
ccaggcctctcagagggtgtgcc

SEQ ID NO: 7612665 - DNA, 23 bp, Homo sapiens
ccaggcctctcagagggtgtgcc

SEQ ID NO: 7612666 - DNA, 19 bp, Homo sapiens
ccaggcctctggggcctgt

SEQ ID NO: 7612667 - DNA, 19 bp, Homo sapiens
ccaggcctctggggcctgt

SEQ ID NO: 7612668 - DNA, 19 bp, Homo sapiens
ccaggcctctggggcctgt

SEQ ID NO: 7612669 - DNA, 19 bp, Homo sapiens
ccaggcctctggggcctgt

SEQ ID NO: 7612670 - DNA, 22 bp, Homo sapiens
ccaggcctctggctgcttagtc

SEQ ID NO: 7612671 - DNA, 22 bp, Homo sapiens
ccaggcctctggctgcttagtc

SEQ ID NO: 7612672 - DNA, 22 bp, Homo sapiens
tcttgcaggcaaactacctcta

SEQ ID NO: 7612673 - DNA, 22 bp, Homo sapiens
tcttgcaggcatgaaaggactc

SEQ ID NO: 7612674 - DNA, 22 bp, Homo sapiens
tcttgcagcttcatctgcaatt

SEQ ID NO: 7612675 - DNA, 22 bp, Homo sapiens
tcttgcagcttcatctgcaatt

SEQ ID NO: 7612676 - DNA, 19 bp, Homo sapiens
tcttgcagccccagcaggc

SEQ ID NO: 7612677 - DNA, 20 bp, Homo sapiens
tcttgcagctcctgtaccat

SEQ ID NO: 7612678 - DNA, 19 bp, Homo sapiens
tcttgcagccccagcaggc

SEQ ID NO: 7612679 - DNA, 22 bp, Homo sapiens
tcttgcagactcacaaggtact

SEQ ID NO: 7612680 - DNA, 22 bp, Homo sapiens
tcttgcagacagcttccagcct

SEQ ID NO: 7612681 - DNA, 22 bp, Homo sapiens
tcttgcagacagcttccagcct

SEQ ID NO: 7612682 - DNA, 22 bp, Homo sapiens
tcttgcagactcacaaggtact

SEQ ID NO: 7612683 - DNA, 22 bp, Homo sapiens
tcttgcagaggcactgtgtcag

SEQ ID NO: 7612684 - DNA, 22 bp, Homo sapiens
tcttgcagaggcactgtgtcag

SEQ ID NO: 7612685 - DNA, 22 bp, Homo sapiens
tcttgcagaggcactgtgtcag

SEQ ID NO: 7612686 - DNA, 22 bp, Homo sapiens
tcttgcagagtggttcccctct

SEQ ID NO: 7612687 - DNA, 22 bp, Homo sapiens
tcttgcagagggcccttctgct

SEQ ID NO: 7612688 - DNA, 22 bp, Homo sapiens
tcttgcagaggcactgtgtcag

SEQ ID NO: 7612689 - DNA, 22 bp, Homo sapiens
tcttgcagaggcactgtgtcag

SEQ ID NO: 7612690 - DNA, 22 bp, Homo sapiens
tcttgcagagggcccttctgct

SEQ ID NO: 7612691 - DNA, 22 bp, Homo sapiens
tcttgcagaagaagctgccaag

SEQ ID NO: 7612692 - DNA, 22 bp, Homo sapiens
tcttgcagaaataagtttaaat

SEQ ID NO: 7612693 - DNA, 22 bp, Homo sapiens
tcttgcagaaataagtttaaat

SEQ ID NO: 7612694 - DNA, 22 bp, Homo sapiens
tcttgcagaagaagctgccaag

SEQ ID NO: 7612695 - DNA, 22 bp, Homo sapiens
tcttgcagacagcttccagcct

SEQ ID NO: 7612696 - DNA, 22 bp, Homo sapiens
tcttgcacttcatgaatatgtt

SEQ ID NO: 7612697 - DNA, 22 bp, Homo sapiens
tcttgcagaaaatagtatagat

SEQ ID NO: 7612698 - DNA, 22 bp, Homo sapiens
tcttgcagaaaatagtatagat

SEQ ID NO: 7612699 - DNA, 22 bp, Homo sapiens
tcttgcagaaataagtttaaat

SEQ ID NO: 7612700 - DNA, 22 bp, Homo sapiens
tcttgcagaaaatagtatagat

SEQ ID NO: 7612701 - DNA, 22 bp, Homo sapiens
tcttgcaccacacaaaaatttg

SEQ ID NO: 7612702 - DNA, 22 bp, Homo sapiens
tcttgcaccacacaaaaatttg

SEQ ID NO: 7612703 - DNA, 22 bp, Homo sapiens
tcttgcaccacacaaaaatttg

SEQ ID NO: 7612704 - DNA, 22 bp, Homo sapiens
tcttgcacttcatgaatatgtt

SEQ ID NO: 7612705 - DNA, 22 bp, Homo sapiens
tcttgcacttcatgaatatgtt

SEQ ID NO: 7612706 - DNA, 22 bp, Homo sapiens
tcttgcacttcatgaatatgtt

SEQ ID NO: 7612707 - DNA, 22 bp, Homo sapiens
tcttgcacttcatgaatatgtt

SEQ ID NO: 7612708 - DNA, 22 bp, Homo sapiens
tcttgcacttcatgaatatgtt

SEQ ID NO: 7612709 - DNA, 21 bp, Homo sapiens
tcttgattttggacttcttcc

SEQ ID NO: 7612710 - DNA, 22 bp, Homo sapiens
tcttgatttgtaaaagaaggat

SEQ ID NO: 7612711 - DNA, 21 bp, Homo sapiens
tcttgattttggacttcttcc

SEQ ID NO: 7612712 - DNA, 22 bp, Homo sapiens
tcttgattttgtgaataagttg

SEQ ID NO: 7612713 - DNA, 22 bp, Homo sapiens
tcttgattttgtgaataagttg

SEQ ID NO: 7612714 - DNA, 21 bp, Homo sapiens
tgaaatgagaatgctgagcac

SEQ ID NO: 7612715 - DNA, 21 bp, Homo sapiens
tgaaatgagaatgctgagcac

SEQ ID NO: 7612716 - DNA, 22 bp, Homo sapiens
tgaaatgacagtcttaagctct

SEQ ID NO: 7612717 - DNA, 22 bp, Homo sapiens
tgaaatgagagcacagaataaa

SEQ ID NO: 7612718 - DNA, 22 bp, Homo sapiens
tgaaatgaagggcttgttctgg

SEQ ID NO: 7612719 - DNA, 22 bp, Homo sapiens
tgaaatgaatgtgattcgatag

SEQ ID NO: 7612720 - DNA, 22 bp, Homo sapiens
tgaaatgaatgtgattcgatag

SEQ ID NO: 7612721 - DNA, 22 bp, Homo sapiens
tgaaatgacaaaggtttttctt

SEQ ID NO: 7612722 - DNA, 22 bp, Homo sapiens
tgaaatgacaaaggtttttctt

SEQ ID NO: 7612723 - DNA, 22 bp, Homo sapiens
tgaaatgacagtcttaagctct

SEQ ID NO: 7612724 - DNA, 22 bp, Homo sapiens
tgaaatgaaacagaacatatca

SEQ ID NO: 7612725 - DNA, 22 bp, Homo sapiens
tgaaatgaaacagaacatatca

SEQ ID NO: 7612726 - DNA, 22 bp, Homo sapiens
tgaaatgaagggcttgttctgg

SEQ ID NO: 7612727 - DNA, 22 bp, Homo sapiens
tgaaatgaagggcttgttctgg

SEQ ID NO: 7612728 - DNA, 22 bp, Homo sapiens
ccaggcttcctaatgtgtgcag

SEQ ID NO: 7612729 - DNA, 22 bp, Homo sapiens
ccaggcttcctaatgtgtgcag

SEQ ID NO: 7612730 - DNA, 22 bp, Homo sapiens
ccaggcttctgattccaggcac

SEQ ID NO: 7612731 - DNA, 22 bp, Homo sapiens
ccaggcttgaagggaagaatgg

SEQ ID NO: 7612732 - DNA, 22 bp, Homo sapiens
ccaggcttgaagggaagaatgg

SEQ ID NO: 7612733 - DNA, 22 bp, Homo sapiens
ccaggcttcccccatcctagga

SEQ ID NO: 7612734 - DNA, 22 bp, Homo sapiens
ccaggcttccctgagaggctgc

SEQ ID NO: 7612735 - DNA, 22 bp, Homo sapiens
ccaggcttcaggagtggtttcc

SEQ ID NO: 7612736 - DNA, 22 bp, Homo sapiens
ccaggcttattatcttctccat

SEQ ID NO: 7612737 - DNA, 22 bp, Homo sapiens
ccaggcttcaggagtggtttcc

SEQ ID NO: 7612738 - DNA, 22 bp, Homo sapiens
ccaggcttattatcttctccat

SEQ ID NO: 7612739 - DNA, 22 bp, Homo sapiens
ccaggcttcctaatgtgtgcag

SEQ ID NO: 7612740 - DNA, 22 bp, Homo sapiens
ccaggcttcctaatgtgtgcag

SEQ ID NO: 7612741 - DNA, 22 bp, Homo sapiens
ccaggcttccctgagaggctgc

SEQ ID NO: 7612742 - DNA, 22 bp, Homo sapiens
ccaggcttccctgagaggctgc

SEQ ID NO: 7612743 - DNA, 22 bp, Homo sapiens
ccaggcttccctgagaggctgc

SEQ ID NO: 7612744 - DNA, 21 bp, Homo sapiens
ccaggctgggagggcagttcc

SEQ ID NO: 7612745 - DNA, 21 bp, Homo sapiens
ccaggctgggagggcagttcc

SEQ ID NO: 7612746 - DNA, 21 bp, Homo sapiens
ccaggctgggagggcagttcc

SEQ ID NO: 7612747 - DNA, 22 bp, Homo sapiens
ccaggctgtaagagtgatgttg

SEQ ID NO: 7612748 - DNA, 22 bp, Homo sapiens
ccaggctgtaagagtgatgttg

SEQ ID NO: 7612749 - DNA, 22 bp, Homo sapiens
ccaggctgtaagagtgatgttg

SEQ ID NO: 7612750 - DNA, 21 bp, Homo sapiens
tgaaacagatggaagtatttg

SEQ ID NO: 7612751 - DNA, 22 bp, Homo sapiens
ccaggctgtaagagtgatgttg

SEQ ID NO: 7612752 - DNA, 22 bp, Homo sapiens
ccaggctgtgcttttcataaat

SEQ ID NO: 7612753 - DNA, 22 bp, Homo sapiens
ccaggctgtgcttttcataaat

SEQ ID NO: 7612754 - DNA, 22 bp, Homo sapiens
ccaggctgtgcttttcataaat

SEQ ID NO: 7612755 - DNA, 22 bp, Homo sapiens
ccaggctgtgcttttcataaat

SEQ ID NO: 7612756 - DNA, 22 bp, Homo sapiens
ccaggctgtgcttttcataaat

SEQ ID NO: 7612757 - DNA, 22 bp, Homo sapiens
ccaggctgttttcaaacttggg

SEQ ID NO: 7612758 - DNA, 22 bp, Homo sapiens
ccaggctgttttcaaacttggg

SEQ ID NO: 7612759 - DNA, 22 bp, Homo sapiens
ccaggctgttttcaaacttggg

SEQ ID NO: 7612760 - DNA, 22 bp, Homo sapiens
ccaggctgttttcaaacttggg

SEQ ID NO: 7612761 - DNA, 22 bp, Homo sapiens
ccaggctgtggtttagatagag

SEQ ID NO: 7612762 - DNA, 22 bp, Homo sapiens
ccaggctgttttcaaacttggg

SEQ ID NO: 7612763 - DNA, 22 bp, Homo sapiens
ccaggctgttttcaaacttggg

SEQ ID NO: 7612764 - DNA, 22 bp, Homo sapiens
ccaggctgtggtttagatagag

SEQ ID NO: 7612765 - DNA, 22 bp, Homo sapiens
ccaggctgtggtttagatagag

SEQ ID NO: 7612766 - DNA, 22 bp, Homo sapiens
ccaggctgtggtttagatagag

SEQ ID NO: 7612767 - DNA, 22 bp, Homo sapiens
ccaggctgtggtttagatagag

SEQ ID NO: 7612768 - DNA, 22 bp, Homo sapiens
ccaggctgtgcttttcataaat

SEQ ID NO: 7612769 - DNA, 22 bp, Homo sapiens
ccaggctgtggtttagatagag

SEQ ID NO: 7612770 - DNA, 22 bp, Homo sapiens
ccaggctgtggtttagatagag

SEQ ID NO: 7612771 - DNA, 22 bp, Homo sapiens
ccaggctgtggtttagatagag

SEQ ID NO: 7612772 - DNA, 22 bp, Homo sapiens
ccaggctgtggtttagatagag

SEQ ID NO: 7612773 - DNA, 22 bp, Homo sapiens
ccaggctgtggtttagatagag

SEQ ID NO: 7612774 - DNA, 21 bp, Homo sapiens
tgaaacaatcagacagagtct

SEQ ID NO: 7612775 - DNA, 21 bp, Homo sapiens
tgaaacaatcagacagagtct

SEQ ID NO: 7612776 - DNA, 21 bp, Homo sapiens
tgaaacaatcagacagagtct

SEQ ID NO: 7612777 - DNA, 21 bp, Homo sapiens
tgaaacaatcagacagagtct

SEQ ID NO: 7612778 - DNA, 22 bp, Homo sapiens
tgaaacaagggccatgggaaac

SEQ ID NO: 7612779 - DNA, 22 bp, Homo sapiens
tgaaacaagtttaagggatcta

SEQ ID NO: 7612780 - DNA, 22 bp, Homo sapiens
tgaaacaagggccatgggaaac

SEQ ID NO: 7612781 - DNA, 21 bp, Homo sapiens
tgaaacaatcagacagagtct

SEQ ID NO: 7612782 - DNA, 21 bp, Homo sapiens
tgaaacaatcagacagagtct

SEQ ID NO: 7612783 - DNA, 22 bp, Homo sapiens
tgaaacaagtttaagggatcta

SEQ ID NO: 7612784 - DNA, 22 bp, Homo sapiens
tgaaacaagtttaagggatcta

SEQ ID NO: 7612785 - DNA, 18 bp, Homo sapiens
tgaaacaagaatggtgca

SEQ ID NO: 7612786 - DNA, 22 bp, Homo sapiens
tgaaacaaatttggaaaatcta

SEQ ID NO: 7612787 - DNA, 18 bp, Homo sapiens
tgaaacaagaatggtgca

SEQ ID NO: 7612788 - DNA, 22 bp, Homo sapiens
tgaaacaagatccacagacttg

SEQ ID NO: 7612789 - DNA, 22 bp, Homo sapiens
tgaaacaagatccacagacttg

SEQ ID NO: 7612790 - DNA, 18 bp, Homo sapiens
tgaaacaagaatggtgca

SEQ ID NO: 7612791 - DNA, 22 bp, Homo sapiens
tgaaacaagatccacagacttg

SEQ ID NO: 7612792 - DNA, 22 bp, Homo sapiens
tgaaacaagatccacagacttg

SEQ ID NO: 7612793 - DNA, 22 bp, Homo sapiens
tgaaacaagatccacagacttg

SEQ ID NO: 7612794 - DNA, 22 bp, Homo sapiens
tgaaacaagggaccgtcctttc

SEQ ID NO: 7612795 - DNA, 22 bp, Homo sapiens
tgaaacaagggaccgtcctttc

SEQ ID NO: 7612796 - DNA, 22 bp, Homo sapiens
tcttttgtgattctttagttac

SEQ ID NO: 7612797 - DNA, 22 bp, Homo sapiens
tcttttgtgattctttagttac

SEQ ID NO: 7612798 - DNA, 22 bp, Homo sapiens
tcttttgtgattctttagttac

SEQ ID NO: 7612799 - DNA, 22 bp, Homo sapiens
tcttttgtgattcttcagttac

SEQ ID NO: 7612800 - DNA, 22 bp, Homo sapiens
tcttttgtgccaagtaatgaat

SEQ ID NO: 7612801 - DNA, 22 bp, Homo sapiens
tcttttgtggatgaagaaatgg

SEQ ID NO: 7612802 - DNA, 22 bp, Homo sapiens
tcttttgtgattctttagttac

SEQ ID NO: 7612803 - DNA, 22 bp, Homo sapiens
tgaaacaaatttggaaaatcta

SEQ ID NO: 7612804 - DNA, 22 bp, Homo sapiens
tgaaacaaatttggaaaatcta

SEQ ID NO: 7612805 - DNA, 22 bp, Homo sapiens
tgaaacaaatttggaaaatcta

SEQ ID NO: 7612806 - DNA, 22 bp, Homo sapiens
tgaaacaaatttggaaaatcta

SEQ ID NO: 7612807 - DNA, 22 bp, Homo sapiens
tcttttgtggatgaagaaatgg

SEQ ID NO: 7612808 - DNA, 22 bp, Homo sapiens
tcttttgtggatgaagaaatgg

SEQ ID NO: 7612809 - DNA, 22 bp, Homo sapiens
tcttttgtggatgaagaaatgg

SEQ ID NO: 7612810 - DNA, 22 bp, Homo sapiens
tgaaacagagtggatacagtga

SEQ ID NO: 7612811 - DNA, 22 bp, Homo sapiens
tgaaacagagtggatacagtga

SEQ ID NO: 7612812 - DNA, 22 bp, Homo sapiens
tgaaacactttcaattacatat

SEQ ID NO: 7612813 - DNA, 17 bp, Homo sapiens
tgaaacaccaagactgt

SEQ ID NO: 7612814 - DNA, 22 bp, Homo sapiens
tgaaacactgcgataaaatcct

SEQ ID NO: 7612815 - DNA, 22 bp, Homo sapiens
tgaaacactgcgataaaatcct

SEQ ID NO: 7612816 - DNA, 23 bp, Homo sapiens
tgaaacagatgccaatgatcaag

SEQ ID NO: 7612817 - DNA, 23 bp, Homo sapiens
tgaaacagatgccaatgatcaag

SEQ ID NO: 7612818 - DNA, 23 bp, Homo sapiens
tgaaacagatgccaatgatcaag

SEQ ID NO: 7612819 - DNA, 23 bp, Homo sapiens
tgaaacagatgccaatgatcaag

SEQ ID NO: 7612820 - DNA, 22 bp, Homo sapiens
tgaaacagagtggatacagtga

SEQ ID NO: 7612821 - DNA, 21 bp, Homo sapiens
ccaggctgggagggcagttcc

SEQ ID NO: 7612822 - DNA, 21 bp, Homo sapiens
ccaggctgggagggcagttcc

SEQ ID NO: 7612823 - DNA, 21 bp, Homo sapiens
ccaggctgggagggcagttcc

SEQ ID NO: 7612824 - DNA, 21 bp, Homo sapiens
ccaggctggccatggtattga

SEQ ID NO: 7612825 - DNA, 21 bp, Homo sapiens
ccaggctgggagggcagttcc

SEQ ID NO: 7612826 - DNA, 22 bp, Homo sapiens
tgaaacaattagaatgtaatga

SEQ ID NO: 7612827 - DNA, 22 bp, Homo sapiens
tgaaacaattagaatgtaatga

SEQ ID NO: 7612828 - DNA, 22 bp, Homo sapiens
tgaaacaattagaatgtaatga

SEQ ID NO: 7612829 - DNA, 22 bp, Homo sapiens
tgaaacaattagaatgtaatga

SEQ ID NO: 7612830 - DNA, 22 bp, Homo sapiens
tgaaacaattagaatgtaatga

SEQ ID NO: 7612831 - DNA, 22 bp, Homo sapiens
tgaaacaattagaatgtaatga

SEQ ID NO: 7612832 - DNA, 22 bp, Homo sapiens
tgaaacaattagaatgtaatga

SEQ ID NO: 7612833 - DNA, 22 bp, Homo sapiens
tgaaacaatgtgaagttgctga

SEQ ID NO: 7612834 - DNA, 22 bp, Homo sapiens
tgaaacaatgtgaagttgctga

SEQ ID NO: 7612835 - DNA, 22 bp, Homo sapiens
tgaaacaatgtgaagttgctga

SEQ ID NO: 7612836 - DNA, 22 bp, Homo sapiens
tgaaacaatgtgaagttgctga

SEQ ID NO: 7612837 - DNA, 22 bp, Homo sapiens
tgaaacaatgtgaagttgctga

SEQ ID NO: 7612838 - DNA, 21 bp, Homo sapiens
tgaaacaatcagacagagtct

SEQ ID NO: 7612839 - DNA, 22 bp, Homo sapiens
tgaaacaattagaatgtaatga

SEQ ID NO: 7612840 - DNA, 22 bp, Homo sapiens
tgaaacaattagaatgtaatga

SEQ ID NO: 7612841 - DNA, 22 bp, Homo sapiens
tgaaacaattagaatgtaatga

SEQ ID NO: 7612842 - DNA, 22 bp, Homo sapiens
tgaaacaattagaatgtaatga

SEQ ID NO: 7612843 - DNA, 17 bp, Homo sapiens
tgaaacaccaagactgt

SEQ ID NO: 7612844 - DNA, 17 bp, Homo sapiens
tgaaacaccaagactgt

SEQ ID NO: 7612845 - DNA, 21 bp, Homo sapiens
tgaaacactctttccatgaga

SEQ ID NO: 7612846 - DNA, 22 bp, Homo sapiens
tcttaattctgtgtcttcacta

SEQ ID NO: 7612847 - DNA, 22 bp, Homo sapiens
tcttaattgagaacagtgtagg

SEQ ID NO: 7612848 - DNA, 22 bp, Homo sapiens
tcttacaagaaataagccaatg

SEQ ID NO: 7612849 - DNA, 22 bp, Homo sapiens
tcttacaagaaggaaaagggag

SEQ ID NO: 7612850 - DNA, 22 bp, Homo sapiens
tcttacaagaaggaaaagggag

SEQ ID NO: 7612851 - DNA, 22 bp, Homo sapiens
tcttacaagaaataagccaatg

SEQ ID NO: 7612852 - DNA, 22 bp, Homo sapiens
tcttaatgctagccaatagaga

SEQ ID NO: 7612853 - DNA, 22 bp, Homo sapiens
tcttaatggcatgcaggtttca

SEQ ID NO: 7612854 - DNA, 22 bp, Homo sapiens
tcttaatgctagccaatagaga

SEQ ID NO: 7612855 - DNA, 22 bp, Homo sapiens
tcttaatgctagccaatagaga

SEQ ID NO: 7612856 - DNA, 22 bp, Homo sapiens
ccaggcagcaaattttctgaat

SEQ ID NO: 7612857 - DNA, 22 bp, Homo sapiens
ccaggcagcaaattttctgaat

SEQ ID NO: 7612858 - DNA, 22 bp, Homo sapiens
ccaggcagcaaattttctgaat

SEQ ID NO: 7612859 - DNA, 22 bp, Homo sapiens
ccaggcagatgggccggcttca

SEQ ID NO: 7612860 - DNA, 22 bp, Homo sapiens
ccaggcagcaaattttctgaat

SEQ ID NO: 7612861 - DNA, 22 bp, Homo sapiens
ccaggcagcaaattttctgaat

SEQ ID NO: 7612862 - DNA, 22 bp, Homo sapiens
ccaggcagcaaattttctgaat

SEQ ID NO: 7612863 - DNA, 22 bp, Homo sapiens
tcttactggaatttttaggaca

SEQ ID NO: 7612864 - DNA, 22 bp, Homo sapiens
tcttacatatagcatgagtaca

SEQ ID NO: 7612865 - DNA, 22 bp, Homo sapiens
tcttaccagctgagaagagggt

SEQ ID NO: 7612866 - DNA, 22 bp, Homo sapiens
tcttaccaggagccctctgagg

SEQ ID NO: 7612867 - DNA, 22 bp, Homo sapiens
tcttacaccattcaaatatttt

SEQ ID NO: 7612868 - DNA, 22 bp, Homo sapiens
tcttacagccactctgtgaagc

SEQ ID NO: 7612869 - DNA, 22 bp, Homo sapiens
tcttacatatagcatgagtaca

SEQ ID NO: 7612870 - DNA, 22 bp, Homo sapiens
tcttacatatacgtcatttagt

SEQ ID NO: 7612871 - DNA, 22 bp, Homo sapiens
tcttacatatacgtcatttagt

SEQ ID NO: 7612872 - DNA, 22 bp, Homo sapiens
tcttacatatacgtcatttagt

SEQ ID NO: 7612873 - DNA, 20 bp, Homo sapiens
tcttacaatcgttacatcca

SEQ ID NO: 7612874 - DNA, 20 bp, Homo sapiens
tcttacaatcgttacatcca

SEQ ID NO: 7612875 - DNA, 22 bp, Homo sapiens
tcttacagaaaatagataacat

SEQ ID NO: 7612876 - DNA, 22 bp, Homo sapiens
tcttacagaaaatagataacat

SEQ ID NO: 7612877 - DNA, 20 bp, Homo sapiens
tcttacaatcgttacatcca

SEQ ID NO: 7612878 - DNA, 20 bp, Homo sapiens
tcttacaatcgttacatcca

SEQ ID NO: 7612879 - DNA, 20 bp, Homo sapiens
tcttacaatcgttacatcca

SEQ ID NO: 7612880 - DNA, 22 bp, Homo sapiens
ccaggcagagggatccccatcc

SEQ ID NO: 7612881 - DNA, 22 bp, Homo sapiens
ccaggcagagggatccccatcc

SEQ ID NO: 7612882 - DNA, 22 bp, Homo sapiens
ccaggcagagggatccccatcc

SEQ ID NO: 7612883 - DNA, 22 bp, Homo sapiens
ccaggcagagggatccccatcc

SEQ ID NO: 7612884 - DNA, 22 bp, Homo sapiens
ccaggcagagggatccccatcc

SEQ ID NO: 7612885 - DNA, 22 bp, Homo sapiens
ccaggcagagggatccccatcc

SEQ ID NO: 7612886 - DNA, 22 bp, Homo sapiens
ccaggcagagggatccccatcc

SEQ ID NO: 7612887 - DNA, 22 bp, Homo sapiens
ccaggcagagggaatagcaagt

SEQ ID NO: 7612888 - DNA, 22 bp, Homo sapiens
ccaggcagagggatccccatcc

SEQ ID NO: 7612889 - DNA, 22 bp, Homo sapiens
ccaggcagagggaatagcaagt

SEQ ID NO: 7612890 - DNA, 22 bp, Homo sapiens
ccaggcagagggaatagcaagt

SEQ ID NO: 7612891 - DNA, 21 bp, Homo sapiens
ccaggcagagctgtgagttct

SEQ ID NO: 7612892 - DNA, 21 bp, Homo sapiens
ccaggcagagctgtgagttct

SEQ ID NO: 7612893 - DNA, 21 bp, Homo sapiens
ccaggcagagctgtgagttct

SEQ ID NO: 7612894 - DNA, 22 bp, Homo sapiens
ccaggcagagggaatagcaagt

SEQ ID NO: 7612895 - DNA, 22 bp, Homo sapiens
ccaggcagagggaatagcaagt

SEQ ID NO: 7612896 - DNA, 22 bp, Homo sapiens
ccaggcagagggaatagcaagt

SEQ ID NO: 7612897 - DNA, 22 bp, Homo sapiens
ccaggcagagggaatagcaagt

SEQ ID NO: 7612898 - DNA, 22 bp, Homo sapiens
ccaggcagagggaatagcaagt

SEQ ID NO: 7612899 - DNA, 22 bp, Homo sapiens
ccaggcagagggaatagcaagt

SEQ ID NO: 7612900 - DNA, 22 bp, Homo sapiens
ccaggcagagggaatagcaagt

SEQ ID NO: 7612901 - DNA, 22 bp, Homo sapiens
ccaggcagagtgctccagaaag

SEQ ID NO: 7612902 - DNA, 22 bp, Homo sapiens
ccaggcagagggatccccatcc

SEQ ID NO: 7612903 - DNA, 22 bp, Homo sapiens
ccaggcagagtgctccagaaag

SEQ ID NO: 7612904 - DNA, 22 bp, Homo sapiens
ccaggcagagtgctccagaaag

SEQ ID NO: 7612905 - DNA, 22 bp, Homo sapiens
ccaggcagagtgctccagaaag

SEQ ID NO: 7612906 - DNA, 22 bp, Homo sapiens
ccaggcagagtgctccagaaag

SEQ ID NO: 7612907 - DNA, 22 bp, Homo sapiens
ccaggcagagtgctccagaaag

SEQ ID NO: 7612908 - DNA, 22 bp, Homo sapiens
ccaggcagagtgctccagaaag

SEQ ID NO: 7612909 - DNA, 22 bp, Homo sapiens
ccaggcagagtgctccagaaag

SEQ ID NO: 7612910 - DNA, 22 bp, Homo sapiens
ccaggcagagtgctccagaaag

SEQ ID NO: 7612911 - DNA, 22 bp, Homo sapiens
ccaggcagagtgctccagaaag

SEQ ID NO: 7612912 - DNA, 22 bp, Homo sapiens
ccaggcagagtgctccagaaag

SEQ ID NO: 7612913 - DNA, 22 bp, Homo sapiens
ccaggcagatgggccggcttca

SEQ ID NO: 7612914 - DNA, 22 bp, Homo sapiens
ccaggcagatgggccggcttca

SEQ ID NO: 7612915 - DNA, 22 bp, Homo sapiens
ccaggcagatgggccggcttca

SEQ ID NO: 7612916 - DNA, 22 bp, Homo sapiens
ccaggcagatgggccggcttca

SEQ ID NO: 7612917 - DNA, 22 bp, Homo sapiens
ccaggcagatgggccggcttca

SEQ ID NO: 7612918 - DNA, 22 bp, Homo sapiens
ccaggcagatgggccggcttca

SEQ ID NO: 7612919 - DNA, 22 bp, Homo sapiens
ccaggaggctctgcccatccca

SEQ ID NO: 7612920 - DNA, 22 bp, Homo sapiens
ccaggaggctctgcccatccca

SEQ ID NO: 7612921 - DNA, 22 bp, Homo sapiens
ccaggaggctctgcccatccca

SEQ ID NO: 7612922 - DNA, 22 bp, Homo sapiens
ccaggaggctctgcccatccca

SEQ ID NO: 7612923 - DNA, 22 bp, Homo sapiens
ccaggaggctcttgtccctggt

SEQ ID NO: 7612924 - DNA, 22 bp, Homo sapiens
ccaggaggctcttgtccctggt

SEQ ID NO: 7612925 - DNA, 22 bp, Homo sapiens
ccaggaggctcttgtccctggt

SEQ ID NO: 7612926 - DNA, 22 bp, Homo sapiens
ccaggaggctcttgtccctggt

SEQ ID NO: 7612927 - DNA, 22 bp, Homo sapiens
ccaggaggctcttgtccctggt

SEQ ID NO: 7612928 - DNA, 22 bp, Homo sapiens
ccaggaggctcttgtccctggt

SEQ ID NO: 7612929 - DNA, 22 bp, Homo sapiens
ccaggaggctctgactggaccc

SEQ ID NO: 7612930 - DNA, 22 bp, Homo sapiens
ccaggaggctctgactggaccc

SEQ ID NO: 7612931 - DNA, 22 bp, Homo sapiens
ccaggaggctctgactggaccc

SEQ ID NO: 7612932 - DNA, 22 bp, Homo sapiens
ccaggaggctctgactggaccc

SEQ ID NO: 7612933 - DNA, 22 bp, Homo sapiens
ccaggaggctctgactggaccc

SEQ ID NO: 7612934 - DNA, 22 bp, Homo sapiens
ccaggaggctctgactggaccc

SEQ ID NO: 7612935 - DNA, 22 bp, Homo sapiens
ccaggaggctctgactggaccc

SEQ ID NO: 7612936 - DNA, 22 bp, Homo sapiens
ccaggaggctctgactggaccc

SEQ ID NO: 7612937 - DNA, 22 bp, Homo sapiens
ccaggaggctctgactggaccc

SEQ ID NO: 7612938 - DNA, 22 bp, Homo sapiens
ccaggaggctctgactggaccc

SEQ ID NO: 7612939 - DNA, 22 bp, Homo sapiens
ccaggaggctctgactggaccc

SEQ ID NO: 7612940 - DNA, 22 bp, Homo sapiens
ccaggaggctctgactggaccc

SEQ ID NO: 7612941 - DNA, 22 bp, Homo sapiens
ccaggaggcggaggttgcagtg

SEQ ID NO: 7612942 - DNA, 22 bp, Homo sapiens
ccaggaggcggaggttgcagtg

SEQ ID NO: 7612943 - DNA, 22 bp, Homo sapiens
ccaggaggcggaggttgcagtg

SEQ ID NO: 7612944 - DNA, 22 bp, Homo sapiens
ccaggaggcggaggttgcagtg

SEQ ID NO: 7612945 - DNA, 22 bp, Homo sapiens
ccaggaggcggaggttgcagtg

SEQ ID NO: 7612946 - DNA, 22 bp, Homo sapiens
ccaggaggcggaggttgcagcg

SEQ ID NO: 7612947 - DNA, 22 bp, Homo sapiens
ccaggaggcggaggttgcagcg

SEQ ID NO: 7612948 - DNA, 22 bp, Homo sapiens
ccaggaggcggaggttgcagtg

SEQ ID NO: 7612949 - DNA, 22 bp, Homo sapiens
ccaggaggcggaggttgcagtg

SEQ ID NO: 7612950 - DNA, 22 bp, Homo sapiens
ccaggaggcggaggttgcagtg

SEQ ID NO: 7612951 - DNA, 22 bp, Homo sapiens
ccaggaggcggaggttgcagtg

SEQ ID NO: 7612952 - DNA, 21 bp, Homo sapiens
ccaggcagagctgtgagttct

SEQ ID NO: 7612953 - DNA, 22 bp, Homo sapiens
ccaggcagaatgaaacccctgt

SEQ ID NO: 7612954 - DNA, 21 bp, Homo sapiens
ccaggcagagctgtgagttct

SEQ ID NO: 7612955 - DNA, 21 bp, Homo sapiens
ccaggcagagctgtgagttct

SEQ ID NO: 7612956 - DNA, 21 bp, Homo sapiens
ccaggcagagctgtgagttct

SEQ ID NO: 7612957 - DNA, 21 bp, Homo sapiens
ccaggcagagctgtgagttct

SEQ ID NO: 7612958 - DNA, 21 bp, Homo sapiens
ccaggcagagctgtgagttct

SEQ ID NO: 7612959 - DNA, 22 bp, Homo sapiens
ccaggcagaatgaaacccctgt

SEQ ID NO: 7612960 - DNA, 22 bp, Homo sapiens
ccaggcagaatgaaacccctgt

SEQ ID NO: 7612961 - DNA, 22 bp, Homo sapiens
ccaggcagaatgaaacccctgt

SEQ ID NO: 7612962 - DNA, 22 bp, Homo sapiens
ccaggcacttgtttgccaggca

SEQ ID NO: 7612963 - DNA, 22 bp, Homo sapiens
ccaggcagaatgaaacccctgt

SEQ ID NO: 7612964 - DNA, 22 bp, Homo sapiens
ccaggcacttgtttgccaggca

SEQ ID NO: 7612965 - DNA, 22 bp, Homo sapiens
ccaggcacaggtgggcctcaga

SEQ ID NO: 7612966 - DNA, 22 bp, Homo sapiens
ccaggcacttgtttgccaggca

SEQ ID NO: 7612967 - DNA, 22 bp, Homo sapiens
ccaggcacttgtttgccaggca

SEQ ID NO: 7612968 - DNA, 22 bp, Homo sapiens
ccaggcacaggtgggcctcaga

SEQ ID NO: 7612969 - DNA, 22 bp, Homo sapiens
ccaggcacactgccctgccctt

SEQ ID NO: 7612970 - DNA, 22 bp, Homo sapiens
ccaggcacactgccctgccctt

SEQ ID NO: 7612971 - DNA, 22 bp, Homo sapiens
ccaggcacttgtttgccaggca

SEQ ID NO: 7612972 - DNA, 22 bp, Homo sapiens
ccaggcagaatgaaacccctgt

SEQ ID NO: 7612973 - DNA, 22 bp, Homo sapiens
ccaggcacttgtttgccaggca

SEQ ID NO: 7612974 - DNA, 22 bp, Homo sapiens
ccaggcacttgtttgccaggca

SEQ ID NO: 7612975 - DNA, 16 bp, Homo sapiens
ccaggaggctgacacc

SEQ ID NO: 7612976 - DNA, 16 bp, Homo sapiens
ccaggaggctgacacc

SEQ ID NO: 7612977 - DNA, 16 bp, Homo sapiens
ccaggaggctgacacc

SEQ ID NO: 7612978 - DNA, 16 bp, Homo sapiens
ccaggaggctgacacc

SEQ ID NO: 7612979 - DNA, 22 bp, Homo sapiens
ccaggaggctcttgtccctggt

SEQ ID NO: 7612980 - DNA, 22 bp, Homo sapiens
ccaggaggcttcgtccgtggag

SEQ ID NO: 7612981 - DNA, 22 bp, Homo sapiens
ccaggaggcttcgtccgtggag

SEQ ID NO: 7612982 - DNA, 22 bp, Homo sapiens
ccaggaggcttcgtccgtggag

SEQ ID NO: 7612983 - DNA, 22 bp, Homo sapiens
ccaggaggcttcgtccgtggag

SEQ ID NO: 7612984 - DNA, 22 bp, Homo sapiens
ccaggaggcttcgtccgtggag

SEQ ID NO: 7612985 - DNA, 22 bp, Homo sapiens
ccaggcaagtagaagctgtggt

SEQ ID NO: 7612986 - DNA, 22 bp, Homo sapiens
ccaggcaagtagaagctgtggt

SEQ ID NO: 7612987 - DNA, 22 bp, Homo sapiens
ccaggcaagtagaagctgtggt

SEQ ID NO: 7612988 - DNA, 22 bp, Homo sapiens
ccaggagggaccgcggcatccc

SEQ ID NO: 7612989 - DNA, 22 bp, Homo sapiens
ccaggcacactgccctgccctt

SEQ ID NO: 7612990 - DNA, 22 bp, Homo sapiens
ccaggcacactgccctgccctt

SEQ ID NO: 7612991 - DNA, 22 bp, Homo sapiens
ccaggcacactgccctgccctt

SEQ ID NO: 7612992 - DNA, 22 bp, Homo sapiens
ccaggcaattctgaaagcattt

SEQ ID NO: 7612993 - DNA, 22 bp, Homo sapiens
ccaggcaattctgaaagcattt

SEQ ID NO: 7612994 - DNA, 22 bp, Homo sapiens
ccaggcaattctgaaagcattt

SEQ ID NO: 7612995 - DNA, 22 bp, Homo sapiens
ccaggcaattctgaaagcattt

SEQ ID NO: 7612996 - DNA, 22 bp, Homo sapiens
tcttctgagacttctctttggt

SEQ ID NO: 7612997 - DNA, 22 bp, Homo sapiens
tcttctgagacttctctttggt

SEQ ID NO: 7612998 - DNA, 19 bp, Homo sapiens
tcttctgacttcaagaaac

SEQ ID NO: 7612999 - DNA, 19 bp, Homo sapiens
tcttctgacttgagaaaga

SEQ ID NO: 7613000 - DNA, 19 bp, Homo sapiens
tcttctgacttgagaaaga

SEQ ID NO: 7613001 - DNA, 19 bp, Homo sapiens
tcttctgacttgagaaaga

SEQ ID NO: 7613002 - DNA, 19 bp, Homo sapiens
tcttctgacttcaagaaac

SEQ ID NO: 7613003 - DNA, 19 bp, Homo sapiens
tcttctgacttcaagaaac

SEQ ID NO: 7613004 - DNA, 19 bp, Homo sapiens
tcttctgacttcaagaaac

SEQ ID NO: 7613005 - DNA, 22 bp, Homo sapiens
tcttctgaaggtaggaagcatt

SEQ ID NO: 7613006 - DNA, 22 bp, Homo sapiens
tcttctgaaggtaggaagcatt

SEQ ID NO: 7613007 - DNA, 22 bp, Homo sapiens
tcttctggatcgatcacattgt

SEQ ID NO: 7613008 - DNA, 22 bp, Homo sapiens
tcttctgatgccagtaaccatg

SEQ ID NO: 7613009 - DNA, 22 bp, Homo sapiens
tcttctgatgccagtaaccatg

SEQ ID NO: 7613010 - DNA, 22 bp, Homo sapiens
tcttctggatcgatcacattgt

SEQ ID NO: 7613011 - DNA, 22 bp, Homo sapiens
ccaggcagcaaattttctgaat

SEQ ID NO: 7613012 - DNA, 17 bp, Homo sapiens
tcttctcttccagtctt

SEQ ID NO: 7613013 - DNA, 17 bp, Homo sapiens
tcttctcttccagtctt

SEQ ID NO: 7613014 - DNA, 17 bp, Homo sapiens
tcttctcttccagtctt

SEQ ID NO: 7613015 - DNA, 17 bp, Homo sapiens
tcttctcttccagtctt

SEQ ID NO: 7613016 - DNA, 17 bp, Homo sapiens
tcttctcttccagtctt

SEQ ID NO: 7613017 - DNA, 22 bp, Homo sapiens
tcttctgaaactagtgggaaag

SEQ ID NO: 7613018 - DNA, 22 bp, Homo sapiens
tcttctctgtggcctggtggtg

SEQ ID NO: 7613019 - DNA, 22 bp, Homo sapiens
tcttctctgtggcctggtggtg

SEQ ID NO: 7613020 - DNA, 17 bp, Homo sapiens
tcttctcttccagtctt

SEQ ID NO: 7613021 - DNA, 17 bp, Homo sapiens
tcttctcttccagtctt

SEQ ID NO: 7613022 - DNA, 17 bp, Homo sapiens
tcttctcttccagtctt

SEQ ID NO: 7613023 - DNA, 17 bp, Homo sapiens
tcttctcttccagtctt

SEQ ID NO: 7613024 - DNA, 22 bp, Homo sapiens
tcttagaaatgaagttctttct

SEQ ID NO: 7613025 - DNA, 22 bp, Homo sapiens
tcttagaaactgtatcgattag

SEQ ID NO: 7613026 - DNA, 22 bp, Homo sapiens
tcttagaaactgtatcgattag

SEQ ID NO: 7613027 - DNA, 22 bp, Homo sapiens
tcttagaaattccccagtggct

SEQ ID NO: 7613028 - DNA, 22 bp, Homo sapiens
tcttagaagttcatgttccagc

SEQ ID NO: 7613029 - DNA, 22 bp, Homo sapiens
tcttcctatggggctgcaggaa

SEQ ID NO: 7613030 - DNA, 22 bp, Homo sapiens
tcttctctgtggcctggtggtg

SEQ ID NO: 7613031 - DNA, 22 bp, Homo sapiens
tcttctctgtggcctggtggtg

SEQ ID NO: 7613032 - DNA, 22 bp, Homo sapiens
tcttctctcctgcttggcagaa

SEQ ID NO: 7613033 - DNA, 22 bp, Homo sapiens
tcttctctcctgcttggcagaa

SEQ ID NO: 7613034 - DNA, 22 bp, Homo sapiens
tcttctctcctgcttggcagaa

SEQ ID NO: 7613035 - DNA, 22 bp, Homo sapiens
tcttctctcatgtaggagggaa

SEQ ID NO: 7613036 - DNA, 22 bp, Homo sapiens
tcttcctcaatgtaacaacccc

SEQ ID NO: 7613037 - DNA, 22 bp, Homo sapiens
tcttcctcatgaattctcgtat

SEQ ID NO: 7613038 - DNA, 22 bp, Homo sapiens
tcttcctcatgaattctcgtat

SEQ ID NO: 7613039 - DNA, 22 bp, Homo sapiens
tcttcctcatgaattctcgtat

SEQ ID NO: 7613040 - DNA, 22 bp, Homo sapiens
tcttcctcatgaattctcgtat

SEQ ID NO: 7613041 - DNA, 21 bp, Homo sapiens
tcttcctccacagcgtgccac

SEQ ID NO: 7613042 - DNA, 21 bp, Homo sapiens
tcttcctccacagcgtgccac

SEQ ID NO: 7613043 - DNA, 22 bp, Homo sapiens
ccaggcccccgagcagaagaca

SEQ ID NO: 7613044 - DNA, 22 bp, Homo sapiens
ccaggcaggcgatggtgcagtg

SEQ ID NO: 7613045 - DNA, 22 bp, Homo sapiens
ccaggcccccgagcagaagaca

SEQ ID NO: 7613046 - DNA, 22 bp, Homo sapiens
ccaggcccccgagcagaagaca

SEQ ID NO: 7613047 - DNA, 22 bp, Homo sapiens
ccaggcccccgagcagaagaca

SEQ ID NO: 7613048 - DNA, 22 bp, Homo sapiens
ccaggcccccgagcagaagaca

SEQ ID NO: 7613049 - DNA, 22 bp, Homo sapiens
ccaggcccccgagcagaagaca

SEQ ID NO: 7613050 - DNA, 22 bp, Homo sapiens
ccaggcctcccttttccagcca

SEQ ID NO: 7613051 - DNA, 22 bp, Homo sapiens
ccaggcctcccttttccagcca

SEQ ID NO: 7613052 - DNA, 22 bp, Homo sapiens
ccaggcaggcgatggtgcagtg

SEQ ID NO: 7613053 - DNA, 22 bp, Homo sapiens
ccaggcaggcgatggtgcagtg

SEQ ID NO: 7613054 - DNA, 22 bp, Homo sapiens
ccaggcaggcgatggtgcagtg

SEQ ID NO: 7613055 - DNA, 22 bp, Homo sapiens
ccaggcaggcgatggtgcagtg

SEQ ID NO: 7613056 - DNA, 22 bp, Homo sapiens
ccaggcaggcgatggtgcagtg

SEQ ID NO: 7613057 - DNA, 22 bp, Homo sapiens
ccaggcaggcgatggtgcagtg

SEQ ID NO: 7613058 - DNA, 22 bp, Homo sapiens
ccaggcctcctgtgagtggacc

SEQ ID NO: 7613059 - DNA, 22 bp, Homo sapiens
ccaggcctcctgtgagtggacc

SEQ ID NO: 7613060 - DNA, 22 bp, Homo sapiens
ccaggcctcctgtgagtggacc

SEQ ID NO: 7613061 - DNA, 22 bp, Homo sapiens
ccaggcctcctgtgagtggacc

SEQ ID NO: 7613062 - DNA, 22 bp, Homo sapiens
ccaggcctcctgtgagtggacc

SEQ ID NO: 7613063 - DNA, 22 bp, Homo sapiens
ccaggcctcctgtgagtggacc

SEQ ID NO: 7613064 - DNA, 22 bp, Homo sapiens
ccaggcctcctgtgagtggacc

SEQ ID NO: 7613065 - DNA, 19 bp, Homo sapiens
ccaggcctcctgggaggtc

SEQ ID NO: 7613066 - DNA, 19 bp, Homo sapiens
ccaggcctcctgggaggtc

SEQ ID NO: 7613067 - DNA, 19 bp, Homo sapiens
ccaggcctcctgggaggtc

SEQ ID NO: 7613068 - DNA, 19 bp, Homo sapiens
ccaggcctcctgggaggtc

SEQ ID NO: 7613069 - DNA, 19 bp, Homo sapiens
ccaggcctcctgggaggtc

SEQ ID NO: 7613070 - DNA, 22 bp, Homo sapiens
ccaggcaggcgatggtgcagtg

SEQ ID NO: 7613071 - DNA, 22 bp, Homo sapiens
ccaggcaggcagcgttctcagg

SEQ ID NO: 7613072 - DNA, 22 bp, Homo sapiens
ccaggcaggcagcgttctcagg

SEQ ID NO: 7613073 - DNA, 22 bp, Homo sapiens
ccaggcaggcagcgttctcagg

SEQ ID NO: 7613074 - DNA, 22 bp, Homo sapiens
ccaggcaggcagcgttctcagg

SEQ ID NO: 7613075 - DNA, 22 bp, Homo sapiens
ccaggcaggcagcgttctcagg

SEQ ID NO: 7613076 - DNA, 22 bp, Homo sapiens
ccaggcaggcagcgttctcagg

SEQ ID NO: 7613077 - DNA, 22 bp, Homo sapiens
ccaggcaggcgatggtgcagtg

SEQ ID NO: 7613078 - DNA, 22 bp, Homo sapiens
ccaggcaggcgatggtgcagtg

SEQ ID NO: 7613079 - DNA, 22 bp, Homo sapiens
ccaggcaggcgatggtgcagtg

SEQ ID NO: 7613080 - DNA, 22 bp, Homo sapiens
ccaggcaggcgatggtgcagtg

SEQ ID NO: 7613081 - DNA, 22 bp, Homo sapiens
ccaggcaggcgatggtgcagtg

SEQ ID NO: 7613082 - DNA, 22 bp, Homo sapiens
ccaggcaggcgatggtgcagtg

SEQ ID NO: 7613083 - DNA, 22 bp, Homo sapiens
ccaggcaggcgatggtgcagtg

SEQ ID NO: 7613084 - DNA, 22 bp, Homo sapiens
ccaggcaggcgatggtgcagtg

SEQ ID NO: 7613085 - DNA, 22 bp, Homo sapiens
ccaggcaggcgatggtgcagtg

SEQ ID NO: 7613086 - DNA, 22 bp, Homo sapiens
ccaggcaggcgatggtgcagtg

SEQ ID NO: 7613087 - DNA, 22 bp, Homo sapiens
ccaggcaggcgatggtgcagtg

SEQ ID NO: 7613088 - DNA, 22 bp, Homo sapiens
ccaggcaggcgatggtgcagtg

SEQ ID NO: 7613089 - DNA, 22 bp, Homo sapiens
ccaggcagccaagtgtgtgtgt

SEQ ID NO: 7613090 - DNA, 22 bp, Homo sapiens
ccaggcagccaagtgtgtgtgt

SEQ ID NO: 7613091 - DNA, 22 bp, Homo sapiens
ccaggcagccaagtgtgtgtgt

SEQ ID NO: 7613092 - DNA, 22 bp, Homo sapiens
ccaggcagccaagtgtgtgtgt

SEQ ID NO: 7613093 - DNA, 22 bp, Homo sapiens
ccaggcagccaagtgtgtgtgt

SEQ ID NO: 7613094 - DNA, 22 bp, Homo sapiens
ccaggcagcctgctccattctg

SEQ ID NO: 7613095 - DNA, 22 bp, Homo sapiens
ccaggcagcctgctccattctg

SEQ ID NO: 7613096 - DNA, 22 bp, Homo sapiens
ccaggcagcctgctccattctg

SEQ ID NO: 7613097 - DNA, 22 bp, Homo sapiens
ccaggcagcctgctccattctg

SEQ ID NO: 7613098 - DNA, 22 bp, Homo sapiens
ccaggcagccaagtgtgtgtgt

SEQ ID NO: 7613099 - DNA, 22 bp, Homo sapiens
ccaggcagccaagtgtgtgtgt

SEQ ID NO: 7613100 - DNA, 22 bp, Homo sapiens
ccaggcagcctgctccattctg

SEQ ID NO: 7613101 - DNA, 22 bp, Homo sapiens
ccaggcagctctgatttatgtc

SEQ ID NO: 7613102 - DNA, 22 bp, Homo sapiens
ccaggcagctctgatttatgtc

SEQ ID NO: 7613103 - DNA, 22 bp, Homo sapiens
ccaggcagcctgctccattctg

SEQ ID NO: 7613104 - DNA, 22 bp, Homo sapiens
ccaggcagctctgatttatgtc

SEQ ID NO: 7613105 - DNA, 22 bp, Homo sapiens
ccaggcaggcagcgttctcagg

SEQ ID NO: 7613106 - DNA, 22 bp, Homo sapiens
ccaggcaggcagcgttctcagg

SEQ ID NO: 7613107 - DNA, 22 bp, Homo sapiens
ccaggcagctctgatttatgtc

SEQ ID NO: 7613108 - DNA, 22 bp, Homo sapiens
ccaggagcctgggccaggctgg

SEQ ID NO: 7613109 - DNA, 22 bp, Homo sapiens
ccaggagcctgggccaggctgg

SEQ ID NO: 7613110 - DNA, 22 bp, Homo sapiens
ccaggagccctgccacaatggt

SEQ ID NO: 7613111 - DNA, 22 bp, Homo sapiens
ccaggagcctgggccaggctgg

SEQ ID NO: 7613112 - DNA, 22 bp, Homo sapiens
ccaggagcctgggccaggctgg

SEQ ID NO: 7613113 - DNA, 22 bp, Homo sapiens
ccaggagcctgggccaggctgg

SEQ ID NO: 7613114 - DNA, 22 bp, Homo sapiens
tctgtggctatcatactgaagg

SEQ ID NO: 7613115 - DNA, 22 bp, Homo sapiens
ccaggagcctgggccaggctgg

SEQ ID NO: 7613116 - DNA, 20 bp, Homo sapiens
tctgttcaaatcttagttcc

SEQ ID NO: 7613117 - DNA, 20 bp, Homo sapiens
tctgttattgcatgtacata

SEQ ID NO: 7613118 - DNA, 20 bp, Homo sapiens
tctgttattgcatgtacata

SEQ ID NO: 7613119 - DNA, 21 bp, Homo sapiens
tctgtggcggactctaggccc

SEQ ID NO: 7613120 - DNA, 23 bp, Homo sapiens
tctgtggctccttcaggctgctg

SEQ ID NO: 7613121 - DNA, 23 bp, Homo sapiens
tctgtggctccttcaggctgctg

SEQ ID NO: 7613122 - DNA, 17 bp, Homo sapiens
tctgttcaagtgagagg

SEQ ID NO: 7613123 - DNA, 22 bp, Homo sapiens
tctgttcaagactgaggtgaca

SEQ ID NO: 7613124 - DNA, 21 bp, Homo sapiens
tctgttcaaggaactacggat

SEQ ID NO: 7613125 - DNA, 22 bp, Homo sapiens
tctgttcactgagcaatggcaa

SEQ ID NO: 7613126 - DNA, 22 bp, Homo sapiens
tctgttcagaaatggaagtgcc

SEQ ID NO: 7613127 - DNA, 22 bp, Homo sapiens
tctgttcagaagaggtgaaagt

SEQ ID NO: 7613128 - DNA, 22 bp, Homo sapiens
tctgttcagacactttacatgt

SEQ ID NO: 7613129 - DNA, 22 bp, Homo sapiens
tctgttcagaattgtaacactc

SEQ ID NO: 7613130 - DNA, 22 bp, Homo sapiens
tctgttcagctgcctcagggta

SEQ ID NO: 7613131 - DNA, 22 bp, Homo sapiens
tctgttcagctgcctcagggta

SEQ ID NO: 7613132 - DNA, 22 bp, Homo sapiens
tctgttcaggtttcagagaact

SEQ ID NO: 7613133 - DNA, 22 bp, Homo sapiens
tctgttcaggtttcagagaact

SEQ ID NO: 7613134 - DNA, 22 bp, Homo sapiens
tctgttcatctcatgggagaat

SEQ ID NO: 7613135 - DNA, 22 bp, Homo sapiens
tctgttcatcatctggacacat

SEQ ID NO: 7613136 - DNA, 22 bp, Homo sapiens
tctgttcatagtagtgtatatg

SEQ ID NO: 7613137 - DNA, 22 bp, Homo sapiens
tctgttcatacagagtatagta

SEQ ID NO: 7613138 - DNA, 22 bp, Homo sapiens
tctgttcagttgattagacaga

SEQ ID NO: 7613139 - DNA, 22 bp, Homo sapiens
tctgttcagttgatgtagtttt

SEQ ID NO: 7613140 - DNA, 22 bp, Homo sapiens
tctgttcaggtttcagagaact

SEQ ID NO: 7613141 - DNA, 22 bp, Homo sapiens
tctgttcagttgattagacaga

SEQ ID NO: 7613142 - DNA, 22 bp, Homo sapiens
tctgttctaagcattctatgtg

SEQ ID NO: 7613143 - DNA, 22 bp, Homo sapiens
tctgttctaagcattctatgtg

SEQ ID NO: 7613144 - DNA, 22 bp, Homo sapiens
tctgttcctcaaggtctgtgtg

SEQ ID NO: 7613145 - DNA, 22 bp, Homo sapiens
tctgttcctggtctctggagct

SEQ ID NO: 7613146 - DNA, 22 bp, Homo sapiens
tctgttcctgcatagtacctca

SEQ ID NO: 7613147 - DNA, 22 bp, Homo sapiens
tctgttcctgcatagtacctca

SEQ ID NO: 7613148 - DNA, 17 bp, Homo sapiens
tctgttcatgcatacct

SEQ ID NO: 7613149 - DNA, 22 bp, Homo sapiens
tctgttcatgttgggcttttcc

SEQ ID NO: 7613150 - DNA, 22 bp, Homo sapiens
tctgttcatgtctttttaagtg

SEQ ID NO: 7613151 - DNA, 22 bp, Homo sapiens
tctgttcatgtctttttaagtg

SEQ ID NO: 7613152 - DNA, 22 bp, Homo sapiens
tctgttcatgtctttttaagtg

SEQ ID NO: 7613153 - DNA, 22 bp, Homo sapiens
tctgttcttgcttttctccaac

SEQ ID NO: 7613154 - DNA, 22 bp, Homo sapiens
tctgttcttgcttttctccaac

SEQ ID NO: 7613155 - DNA, 22 bp, Homo sapiens
tctgttcttctccactgtatgt

SEQ ID NO: 7613156 - DNA, 22 bp, Homo sapiens
tctgttcttcctacattcacat

SEQ ID NO: 7613157 - DNA, 22 bp, Homo sapiens
tctgttcttctccactgtatgt

SEQ ID NO: 7613158 - DNA, 22 bp, Homo sapiens
tctgttcttcctacattcacat

SEQ ID NO: 7613159 - DNA, 22 bp, Homo sapiens
tctgttcttctccactgtatgt

SEQ ID NO: 7613160 - DNA, 22 bp, Homo sapiens
ccaggaggcggaggttgcagcg

SEQ ID NO: 7613161 - DNA, 22 bp, Homo sapiens
ccaggaggcggaggttgcagcg

SEQ ID NO: 7613162 - DNA, 22 bp, Homo sapiens
tctgttcttgcttttctccaac

SEQ ID NO: 7613163 - DNA, 22 bp, Homo sapiens
tctgttcttaaagcattcttgc

SEQ ID NO: 7613164 - DNA, 22 bp, Homo sapiens
tctgttcttaaagcattcttgc

SEQ ID NO: 7613165 - DNA, 22 bp, Homo sapiens
tctgttcttaaagcattcttgc

SEQ ID NO: 7613166 - DNA, 22 bp, Homo sapiens
tctgttctattggtctatgtgt

SEQ ID NO: 7613167 - DNA, 22 bp, Homo sapiens
tctgttctattggtctatgtgt

SEQ ID NO: 7613168 - DNA, 22 bp, Homo sapiens
tctgttctattggtctatgtgt

SEQ ID NO: 7613169 - DNA, 22 bp, Homo sapiens
tctgttcttcctacattcacat

SEQ ID NO: 7613170 - DNA, 22 bp, Homo sapiens
tctgttcttcctacattcacat

SEQ ID NO: 7613171 - DNA, 22 bp, Homo sapiens
tctgttcttaaagcattcttgc

SEQ ID NO: 7613172 - DNA, 22 bp, Homo sapiens
tctgttcttaaagcattcttgc

SEQ ID NO: 7613173 - DNA, 19 bp, Homo sapiens
ccaggagcagtggtgagct

SEQ ID NO: 7613174 - DNA, 19 bp, Homo sapiens
ccaggagcagtggtgagct

SEQ ID NO: 7613175 - DNA, 22 bp, Homo sapiens
ccaggagcagggctggctgcac

SEQ ID NO: 7613176 - DNA, 22 bp, Homo sapiens
ccaggagcagggctggctgcac

SEQ ID NO: 7613177 - DNA, 19 bp, Homo sapiens
ccaggagcagtggtgagct

SEQ ID NO: 7613178 - DNA, 19 bp, Homo sapiens
ccaggagcagtggtgagct

SEQ ID NO: 7613179 - DNA, 19 bp, Homo sapiens
ccaggagcagtggtgagct

SEQ ID NO: 7613180 - DNA, 19 bp, Homo sapiens
ccaggagcagtggtgagct

SEQ ID NO: 7613181 - DNA, 19 bp, Homo sapiens
ccaggagcagtggtgagct

SEQ ID NO: 7613182 - DNA, 22 bp, Homo sapiens
ccaggagcagggctggctgcac

SEQ ID NO: 7613183 - DNA, 22 bp, Homo sapiens
ccaggagcagggctggctgcac

SEQ ID NO: 7613184 - DNA, 22 bp, Homo sapiens
ccaggagcagggctggctgcac

SEQ ID NO: 7613185 - DNA, 22 bp, Homo sapiens
ccaggagcaggagctggacaga

SEQ ID NO: 7613186 - DNA, 22 bp, Homo sapiens
ccaggagcaggagctggacaga

SEQ ID NO: 7613187 - DNA, 22 bp, Homo sapiens
ccaggagcagggctggctgcac

SEQ ID NO: 7613188 - DNA, 22 bp, Homo sapiens
ccaggagcagggctggctgcac

SEQ ID NO: 7613189 - DNA, 22 bp, Homo sapiens
ccaggagcagggctggctgcac

SEQ ID NO: 7613190 - DNA, 22 bp, Homo sapiens
ccaggagcagggctggctgcac

SEQ ID NO: 7613191 - DNA, 22 bp, Homo sapiens
ccaggagccactcaggcccaca

SEQ ID NO: 7613192 - DNA, 22 bp, Homo sapiens
ccaggagccactcaggcccaca

SEQ ID NO: 7613193 - DNA, 22 bp, Homo sapiens
ccaggagccactcaggcccaca

SEQ ID NO: 7613194 - DNA, 22 bp, Homo sapiens
ccaggagccactcaggcccaca

SEQ ID NO: 7613195 - DNA, 22 bp, Homo sapiens
ccaggagccctgccacaatggt

SEQ ID NO: 7613196 - DNA, 22 bp, Homo sapiens
ccaggagccctgccacaatggt

SEQ ID NO: 7613197 - DNA, 22 bp, Homo sapiens
ccaggagccctgccacaatggt

SEQ ID NO: 7613198 - DNA, 22 bp, Homo sapiens
ccaggagccctgccacaatggt

SEQ ID NO: 7613199 - DNA, 22 bp, Homo sapiens
ccaggagccactcaggcccaca

SEQ ID NO: 7613200 - DNA, 22 bp, Homo sapiens
ccaggagcattaagagaacata

SEQ ID NO: 7613201 - DNA, 22 bp, Homo sapiens
ccaggagcattaagagaacata

SEQ ID NO: 7613202 - DNA, 22 bp, Homo sapiens
ccaggagcattaagagaacata

SEQ ID NO: 7613203 - DNA, 22 bp, Homo sapiens
ccaggagcattaagagaacata

SEQ ID NO: 7613204 - DNA, 22 bp, Homo sapiens
ccaggagcattaagagaacata

SEQ ID NO: 7613205 - DNA, 19 bp, Homo sapiens
ccaggagcagtggtgagct

SEQ ID NO: 7613206 - DNA, 22 bp, Homo sapiens
ccaggagcattaagagaacata

SEQ ID NO: 7613207 - DNA, 22 bp, Homo sapiens
ccaggagcaggagctggacaga

SEQ ID NO: 7613208 - DNA, 22 bp, Homo sapiens
ccaggagcagagtaggtgttca

SEQ ID NO: 7613209 - DNA, 22 bp, Homo sapiens
ccaggagcaggagctggacaga

SEQ ID NO: 7613210 - DNA, 22 bp, Homo sapiens
ccaggagcaggagctggacaga

SEQ ID NO: 7613211 - DNA, 22 bp, Homo sapiens
ccaggagcaggagctggacaga

SEQ ID NO: 7613212 - DNA, 22 bp, Homo sapiens
ccaggagcaggagctgcagctg

SEQ ID NO: 7613213 - DNA, 22 bp, Homo sapiens
ccaggagcaggagctgcagctg

SEQ ID NO: 7613214 - DNA, 22 bp, Homo sapiens
ccaggagcaggagctggacaga

SEQ ID NO: 7613215 - DNA, 22 bp, Homo sapiens
ccaggagcaggagctggacaga

SEQ ID NO: 7613216 - DNA, 22 bp, Homo sapiens
ccaggagcaggagctgcagctg

SEQ ID NO: 7613217 - DNA, 22 bp, Homo sapiens
ccaggagcaggagctgcagctg

SEQ ID NO: 7613218 - DNA, 22 bp, Homo sapiens
ccaggagcaggagctgcagctg

SEQ ID NO: 7613219 - DNA, 22 bp, Homo sapiens
ccaggagcaggagctgcagctg

SEQ ID NO: 7613220 - DNA, 22 bp, Homo sapiens
ccaggagcagccggcccacctg

SEQ ID NO: 7613221 - DNA, 22 bp, Homo sapiens
ccaggagcagccggcccacctg

SEQ ID NO: 7613222 - DNA, 22 bp, Homo sapiens
ccaggagcagccggcccacctg

SEQ ID NO: 7613223 - DNA, 22 bp, Homo sapiens
ccaggagcagagtaggtgttca

SEQ ID NO: 7613224 - DNA, 22 bp, Homo sapiens
ccaggagcagagtaggtgttca

SEQ ID NO: 7613225 - DNA, 22 bp, Homo sapiens
ccaggagcaccaggcctgtgcc

SEQ ID NO: 7613226 - DNA, 22 bp, Homo sapiens
ccaggagcaccaggcctgtgcc

SEQ ID NO: 7613227 - DNA, 22 bp, Homo sapiens
ccaggagcaccaggcctgtgcc

SEQ ID NO: 7613228 - DNA, 22 bp, Homo sapiens
ccaggagcaccaggcctgtgcc

SEQ ID NO: 7613229 - DNA, 22 bp, Homo sapiens
ccaggagcaccaggcctgtgcc

SEQ ID NO: 7613230 - DNA, 22 bp, Homo sapiens
ccaggagcaacttgaaggcaag

SEQ ID NO: 7613231 - DNA, 22 bp, Homo sapiens
ccaggagcaccaggcctgtgcc

SEQ ID NO: 7613232 - DNA, 22 bp, Homo sapiens
ccaggagcaccaggcctgtgcc

SEQ ID NO: 7613233 - DNA, 22 bp, Homo sapiens
ccaggagcagagtaggtgttca

SEQ ID NO: 7613234 - DNA, 22 bp, Homo sapiens
ccaggagcagatatggacataa

SEQ ID NO: 7613235 - DNA, 22 bp, Homo sapiens
ccaggagcagatatggacataa

SEQ ID NO: 7613236 - DNA, 22 bp, Homo sapiens
ccaggagcagagtaggtgttca

SEQ ID NO: 7613237 - DNA, 22 bp, Homo sapiens
ccaggagcagagtaggtgttca

SEQ ID NO: 7613238 - DNA, 22 bp, Homo sapiens
ccaggagcagatatggacataa

SEQ ID NO: 7613239 - DNA, 22 bp, Homo sapiens
ccaggagcagatatggacataa

SEQ ID NO: 7613240 - DNA, 22 bp, Homo sapiens
ccaggagcagatatggacataa

SEQ ID NO: 7613241 - DNA, 22 bp, Homo sapiens
ccaggagcagatatggacataa

SEQ ID NO: 7613242 - DNA, 22 bp, Homo sapiens
tctgggccctgagatgttcttc

SEQ ID NO: 7613243 - DNA, 22 bp, Homo sapiens
tctgggccctgagatgttcttc

SEQ ID NO: 7613244 - DNA, 22 bp, Homo sapiens
tctgggccctgagatgttcttc

SEQ ID NO: 7613245 - DNA, 22 bp, Homo sapiens
tctgggccgctgcgttccatga

SEQ ID NO: 7613246 - DNA, 22 bp, Homo sapiens
tctgggccgctgcgttccatga

SEQ ID NO: 7613247 - DNA, 22 bp, Homo sapiens
tctgggccggagccgacggcag

SEQ ID NO: 7613248 - DNA, 22 bp, Homo sapiens
tctgggccggagccgacggcag

SEQ ID NO: 7613249 - DNA, 22 bp, Homo sapiens
tctgggcctatagaagtctacc

SEQ ID NO: 7613250 - DNA, 22 bp, Homo sapiens
tctgggcctatagaagtctacc

SEQ ID NO: 7613251 - DNA, 22 bp, Homo sapiens
tctgggccggagccgacggcag

SEQ ID NO: 7613252 - DNA, 22 bp, Homo sapiens
tctgggcctcacctgctgctca

SEQ ID NO: 7613253 - DNA, 22 bp, Homo sapiens
tctgggcctcacctgctgctca

SEQ ID NO: 7613254 - DNA, 22 bp, Homo sapiens
tctgggcctcacctgctgctca

SEQ ID NO: 7613255 - DNA, 22 bp, Homo sapiens
tctgggcctatagaagtctacc

SEQ ID NO: 7613256 - DNA, 20 bp, Homo sapiens
tctgggagggacaagtctcc

SEQ ID NO: 7613257 - DNA, 20 bp, Homo sapiens
tctgggagggacaagtctcc

SEQ ID NO: 7613258 - DNA, 22 bp, Homo sapiens
tctgggagggagcctcagaatc

SEQ ID NO: 7613259 - DNA, 22 bp, Homo sapiens
ccagcactctgtcccagcttcc

SEQ ID NO: 7613260 - DNA, 22 bp, Homo sapiens
ccagcactctattgaatattct

SEQ ID NO: 7613261 - DNA, 22 bp, Homo sapiens
ccagcactctgtcccagcttcc

SEQ ID NO: 7613262 - DNA, 22 bp, Homo sapiens
tctgggaggctgggtcccgtcc

SEQ ID NO: 7613263 - DNA, 22 bp, Homo sapiens
tctgggaggctgggtcccgtcc

SEQ ID NO: 7613264 - DNA, 22 bp, Homo sapiens
ccagcaccttgatcttggagtt

SEQ ID NO: 7613265 - DNA, 22 bp, Homo sapiens
ccagcactcctgtctcaagtct

SEQ ID NO: 7613266 - DNA, 22 bp, Homo sapiens
ccagcactcctgtctcaagtct

SEQ ID NO: 7613267 - DNA, 22 bp, Homo sapiens
ccagcactctattgaatattct

SEQ ID NO: 7613268 - DNA, 22 bp, Homo sapiens
ccagcactcgctgattttagga

SEQ ID NO: 7613269 - DNA, 22 bp, Homo sapiens
ccagcactcctgtctcaagtct

SEQ ID NO: 7613270 - DNA, 22 bp, Homo sapiens
tctgggccttggagtggggaga

SEQ ID NO: 7613271 - DNA, 22 bp, Homo sapiens
tctgggctatatggtctctgct

SEQ ID NO: 7613272 - DNA, 22 bp, Homo sapiens
tctgggctatatggtctctgct

SEQ ID NO: 7613273 - DNA, 22 bp, Homo sapiens
tctgggctcacgagtctggaca

SEQ ID NO: 7613274 - DNA, 22 bp, Homo sapiens
tctgggctcacgagtctggaca

SEQ ID NO: 7613275 - DNA, 22 bp, Homo sapiens
tctgggctcacgagtctggaca

SEQ ID NO: 7613276 - DNA, 22 bp, Homo sapiens
tctgggctctgcgaagcccttc

SEQ ID NO: 7613277 - DNA, 22 bp, Homo sapiens
tctgggctctgcgaagcccttc

SEQ ID NO: 7613278 - DNA, 22 bp, Homo sapiens
tctgggctctgggaattaggga

SEQ ID NO: 7613279 - DNA, 22 bp, Homo sapiens
tctgggctctgggaattaggga

SEQ ID NO: 7613280 - DNA, 22 bp, Homo sapiens
tctgggcctgtctcagagctgg

SEQ ID NO: 7613281 - DNA, 22 bp, Homo sapiens
tctgggcctgatggctaaagcc

SEQ ID NO: 7613282 - DNA, 22 bp, Homo sapiens
tctgggcctgtctcagagctgg

SEQ ID NO: 7613283 - DNA, 22 bp, Homo sapiens
tctgggcctgtctcagagctgg

SEQ ID NO: 7613284 - DNA, 22 bp, Homo sapiens
tctgggccttggagtggggaga

SEQ ID NO: 7613285 - DNA, 22 bp, Homo sapiens
tctgggcctgtctcagagctgg

SEQ ID NO: 7613286 - DNA, 22 bp, Homo sapiens
tctgggcctgtctcagagctgg

SEQ ID NO: 7613287 - DNA, 22 bp, Homo sapiens
tctgggcctcagtttcttcatc

SEQ ID NO: 7613288 - DNA, 22 bp, Homo sapiens
tctgggcctcagtttcttcatc

SEQ ID NO: 7613289 - DNA, 22 bp, Homo sapiens
tctgggcctcagtttcttcatc

SEQ ID NO: 7613290 - DNA, 22 bp, Homo sapiens
tctgggcctcacctgctgctca

SEQ ID NO: 7613291 - DNA, 22 bp, Homo sapiens
tctgggcctcagtttcttcatc

SEQ ID NO: 7613292 - DNA, 22 bp, Homo sapiens
tctgggcctcagtttcttcatc

SEQ ID NO: 7613293 - DNA, 22 bp, Homo sapiens
tctgggcctgatggctaaagcc

SEQ ID NO: 7613294 - DNA, 22 bp, Homo sapiens
tctgggcctgatggctaaagcc

SEQ ID NO: 7613295 - DNA, 22 bp, Homo sapiens
tctgggcctgatggctaaagcc

SEQ ID NO: 7613296 - DNA, 22 bp, Homo sapiens
ccaggagcaaagatcactggga

SEQ ID NO: 7613297 - DNA, 22 bp, Homo sapiens
ccaggagcaacttgaaggcaag

SEQ ID NO: 7613298 - DNA, 22 bp, Homo sapiens
ccaggagagcaaaggtcactct

SEQ ID NO: 7613299 - DNA, 22 bp, Homo sapiens
ccaggagagcaaaggtcactct

SEQ ID NO: 7613300 - DNA, 22 bp, Homo sapiens
ccaggagagcaaaggtcactct

SEQ ID NO: 7613301 - DNA, 22 bp, Homo sapiens
ccaggagagcaaaggtcactct

SEQ ID NO: 7613302 - DNA, 22 bp, Homo sapiens
ccaggagagcaaaggtcactct

SEQ ID NO: 7613303 - DNA, 22 bp, Homo sapiens
ccaggagagcaaaggtcactct

SEQ ID NO: 7613304 - DNA, 22 bp, Homo sapiens
ccaggagagcaaaggtcactct

SEQ ID NO: 7613305 - DNA, 22 bp, Homo sapiens
ccaggagcaccaggcctgtgcc

SEQ ID NO: 7613306 - DNA, 22 bp, Homo sapiens
ccaggagcaacttgaaggcaag

SEQ ID NO: 7613307 - DNA, 22 bp, Homo sapiens
ccaggagcaacttgaaggcaag

SEQ ID NO: 7613308 - DNA, 22 bp, Homo sapiens
ccaggagcaacttgaaggcaag

SEQ ID NO: 7613309 - DNA, 22 bp, Homo sapiens
ccaggagcaacttgaaggcaag

SEQ ID NO: 7613310 - DNA, 22 bp, Homo sapiens
ccaggagcaacttgaaggcaag

SEQ ID NO: 7613311 - DNA, 22 bp, Homo sapiens
ccaggagcaacttgaaggcaag

SEQ ID NO: 7613312 - DNA, 22 bp, Homo sapiens
ccaggagcaacttgaaggcaag

SEQ ID NO: 7613313 - DNA, 22 bp, Homo sapiens
ccaggagcaacttgaaggcaag

SEQ ID NO: 7613314 - DNA, 22 bp, Homo sapiens
tctggggatgaggacctagatg

SEQ ID NO: 7613315 - DNA, 22 bp, Homo sapiens
tctggggatgaggacctagatg

SEQ ID NO: 7613316 - DNA, 22 bp, Homo sapiens
tctggggataagacccaggtat

SEQ ID NO: 7613317 - DNA, 22 bp, Homo sapiens
tctggggatgaggacctagatg

SEQ ID NO: 7613318 - DNA, 22 bp, Homo sapiens
tctggggataagacccaggtat

SEQ ID NO: 7613319 - DNA, 22 bp, Homo sapiens
tctggggataagacccaggtat

SEQ ID NO: 7613320 - DNA, 22 bp, Homo sapiens
tctggggagtgcctaagtggaa

SEQ ID NO: 7613321 - DNA, 22 bp, Homo sapiens
tctggggatgaggacctagatg

SEQ ID NO: 7613322 - DNA, 22 bp, Homo sapiens
tctggggatgaggacctagatg

SEQ ID NO: 7613323 - DNA, 22 bp, Homo sapiens
tctggggatgaggacctagatg

SEQ ID NO: 7613324 - DNA, 22 bp, Homo sapiens
tctggggatgaggtccagtgat

SEQ ID NO: 7613325 - DNA, 17 bp, Homo sapiens
ccaggagagatgcttgt

SEQ ID NO: 7613326 - DNA, 22 bp, Homo sapiens
tctggggagtgcctaagtggaa

SEQ ID NO: 7613327 - DNA, 22 bp, Homo sapiens
tctggggagtgcctaagtggaa

SEQ ID NO: 7613328 - DNA, 22 bp, Homo sapiens
tctggggagtgcctaagtggaa

SEQ ID NO: 7613329 - DNA, 22 bp, Homo sapiens
tctggggagtgcctaagtggaa

SEQ ID NO: 7613330 - DNA, 22 bp, Homo sapiens
tctggggagtcaaagagacctg

SEQ ID NO: 7613331 - DNA, 22 bp, Homo sapiens
tctggggagtcaaagagacctg

SEQ ID NO: 7613332 - DNA, 22 bp, Homo sapiens
tctggggagtcaaagagacctg

SEQ ID NO: 7613333 - DNA, 22 bp, Homo sapiens
tctggggagtcaaagagacctg

SEQ ID NO: 7613334 - DNA, 22 bp, Homo sapiens
tctggggagggagccacaggtc

SEQ ID NO: 7613335 - DNA, 22 bp, Homo sapiens
tctggggagtcaaagagacctg

SEQ ID NO: 7613336 - DNA, 22 bp, Homo sapiens
tctgggcttttccatgcctgtg

SEQ ID NO: 7613337 - DNA, 22 bp, Homo sapiens
tctgggcttttgcactggccat

SEQ ID NO: 7613338 - DNA, 22 bp, Homo sapiens
tctgggcttttgcactggccat

SEQ ID NO: 7613339 - DNA, 22 bp, Homo sapiens
tctgggctctgtcagcacctct

SEQ ID NO: 7613340 - DNA, 22 bp, Homo sapiens
tctgggctctgtcagcacctct

SEQ ID NO: 7613341 - DNA, 22 bp, Homo sapiens
tctgggctctgtcagcacctct

SEQ ID NO: 7613342 - DNA, 22 bp, Homo sapiens
tctgggcttttgcactggccat

SEQ ID NO: 7613343 - DNA, 21 bp, Homo sapiens
tctggggaagacatctaggat

SEQ ID NO: 7613344 - DNA, 21 bp, Homo sapiens
tctggggaagacatctaggat

SEQ ID NO: 7613345 - DNA, 22 bp, Homo sapiens
tctggggaatgttcatttctga

SEQ ID NO: 7613346 - DNA, 22 bp, Homo sapiens
tctggggaccatggcatctaaa

SEQ ID NO: 7613347 - DNA, 22 bp, Homo sapiens
tctggggaccatggcatctaaa

SEQ ID NO: 7613348 - DNA, 22 bp, Homo sapiens
tctggggaatgttcatttctga

SEQ ID NO: 7613349 - DNA, 21 bp, Homo sapiens
tctggggaagacatctaggat

SEQ ID NO: 7613350 - DNA, 21 bp, Homo sapiens
tctggggaagacatctaggat

SEQ ID NO: 7613351 - DNA, 21 bp, Homo sapiens
tctggggaagacatctaggat

SEQ ID NO: 7613352 - DNA, 22 bp, Homo sapiens
tctggggacggggcccagcaat

SEQ ID NO: 7613353 - DNA, 22 bp, Homo sapiens
tctggggacggggcccagcaat

SEQ ID NO: 7613354 - DNA, 22 bp, Homo sapiens
tctggggacggggcccagcaat

SEQ ID NO: 7613355 - DNA, 22 bp, Homo sapiens
tctggggacggggcccagcaat

SEQ ID NO: 7613356 - DNA, 22 bp, Homo sapiens
tctggggaccatggcatctaaa

SEQ ID NO: 7613357 - DNA, 22 bp, Homo sapiens
tctggggaccatggcatctaaa

SEQ ID NO: 7613358 - DNA, 22 bp, Homo sapiens
tctggggaccatggcatctaaa

SEQ ID NO: 7613359 - DNA, 22 bp, Homo sapiens
tctggggaccatggcatctaaa

SEQ ID NO: 7613360 - DNA, 22 bp, Homo sapiens
tctggggaccatggcatctaaa

SEQ ID NO: 7613361 - DNA, 22 bp, Homo sapiens
tctggggaccatggcatctaaa

SEQ ID NO: 7613362 - DNA, 22 bp, Homo sapiens
tctggggaccatggcatctaaa

SEQ ID NO: 7613363 - DNA, 22 bp, Homo sapiens
tctggggagcagccctggtgag

SEQ ID NO: 7613364 - DNA, 22 bp, Homo sapiens
tctggggagcagccctggtgag

SEQ ID NO: 7613365 - DNA, 22 bp, Homo sapiens
tctggggagcagccctggtgag

SEQ ID NO: 7613366 - DNA, 22 bp, Homo sapiens
tctggggagggagccacaggtc

SEQ ID NO: 7613367 - DNA, 22 bp, Homo sapiens
tctggggagcagccctggtgag

SEQ ID NO: 7613368 - DNA, 22 bp, Homo sapiens
tctggggagcagccctggtgag

SEQ ID NO: 7613369 - DNA, 22 bp, Homo sapiens
tctggggagggagccacaggtc

SEQ ID NO: 7613370 - DNA, 22 bp, Homo sapiens
tctggggagggagccacaggtc

SEQ ID NO: 7613371 - DNA, 22 bp, Homo sapiens
tctggggagggagccacaggtc

SEQ ID NO: 7613372 - DNA, 22 bp, Homo sapiens
tctggggagggagccacaggtc

SEQ ID NO: 7613373 - DNA, 20 bp, Homo sapiens
tcaaagcactgcctgtcatc

SEQ ID NO: 7613374 - DNA, 20 bp, Homo sapiens
tcaaagcactgcctgtcatc

SEQ ID NO: 7613375 - DNA, 20 bp, Homo sapiens
tcaaagcactgcctgtcatc

SEQ ID NO: 7613376 - DNA, 21 bp, Homo sapiens
tcaaagcacatatttgcacat

SEQ ID NO: 7613377 - DNA, 21 bp, Homo sapiens
tcaaagcacatatttgcacat

SEQ ID NO: 7613378 - DNA, 22 bp, Homo sapiens
tcaaagcactggggaaagcctg

SEQ ID NO: 7613379 - DNA, 22 bp, Homo sapiens
tcaaagcactggggaaagcctg

SEQ ID NO: 7613380 - DNA, 22 bp, Homo sapiens
tcaaagcagcacattcgcaagc

SEQ ID NO: 7613381 - DNA, 20 bp, Homo sapiens
tcaaagcactgcctgtcatc

SEQ ID NO: 7613382 - DNA, 20 bp, Homo sapiens
tcaaagcactgcctgtcatc

SEQ ID NO: 7613383 - DNA, 22 bp, Homo sapiens
tcaaagcaatttcaccagtgcc

SEQ ID NO: 7613384 - DNA, 22 bp, Homo sapiens
tcaaagcaatttcaccagtgcc

SEQ ID NO: 7613385 - DNA, 19 bp, Homo sapiens
tcaaagcaagcatgttctg

SEQ ID NO: 7613386 - DNA, 19 bp, Homo sapiens
tcaaagcaagcatgttctg

SEQ ID NO: 7613387 - DNA, 22 bp, Homo sapiens
tcaaagcaatttcaccagtgcc

SEQ ID NO: 7613388 - DNA, 22 bp, Homo sapiens
tcaaagcaatttcaccagtgcc

SEQ ID NO: 7613389 - DNA, 22 bp, Homo sapiens
tcaaagcaatttcaccagtgcc

SEQ ID NO: 7613390 - DNA, 22 bp, Homo sapiens
tcaaagcacacttagtggtaga

SEQ ID NO: 7613391 - DNA, 22 bp, Homo sapiens
tcaaagcaatttcaccagtgcc

SEQ ID NO: 7613392 - DNA, 22 bp, Homo sapiens
tcaaagcacacttagtggtaga

SEQ ID NO: 7613393 - DNA, 22 bp, Homo sapiens
tcaaagcacacttagtggtaga

SEQ ID NO: 7613394 - DNA, 22 bp, Homo sapiens
tcaaagcacacttagtggtaga

SEQ ID NO: 7613395 - DNA, 22 bp, Homo sapiens
tcaaaagaaacaccatgttcct

SEQ ID NO: 7613396 - DNA, 22 bp, Homo sapiens
tcaaaagaaacaccatgttcct

SEQ ID NO: 7613397 - DNA, 22 bp, Homo sapiens
tcaaaagaaacaccatgttcct

SEQ ID NO: 7613398 - DNA, 22 bp, Homo sapiens
tcaaaagaaacaccatgttcct

SEQ ID NO: 7613399 - DNA, 22 bp, Homo sapiens
tcaaaacctaggctctctgctt

SEQ ID NO: 7613400 - DNA, 22 bp, Homo sapiens
tattcctcccagtaagtacaac

SEQ ID NO: 7613401 - DNA, 22 bp, Homo sapiens
tattcctcccagtaagtacaac

SEQ ID NO: 7613402 - DNA, 22 bp, Homo sapiens
tattcctatttctaaacatatg

SEQ ID NO: 7613403 - DNA, 22 bp, Homo sapiens
tcaaaacctaggctctctgctt

SEQ ID NO: 7613404 - DNA, 22 bp, Homo sapiens
tattcctaaagtccctgtgctt

SEQ ID NO: 7613405 - DNA, 22 bp, Homo sapiens
tattcctaatacttgttttggg

SEQ ID NO: 7613406 - DNA, 22 bp, Homo sapiens
tattcctaaagtccctgtgctt

SEQ ID NO: 7613407 - DNA, 22 bp, Homo sapiens
tattcctaagtcccaactacat

SEQ ID NO: 7613408 - DNA, 22 bp, Homo sapiens
tattcctaatttgcagggcatg

SEQ ID NO: 7613409 - DNA, 22 bp, Homo sapiens
tattcctaatacttgttttggg

SEQ ID NO: 7613410 - DNA, 22 bp, Homo sapiens
tattcctaatttgcagggcatg

SEQ ID NO: 7613411 - DNA, 22 bp, Homo sapiens
tattcctacatctttcctggaa

SEQ ID NO: 7613412 - DNA, 22 bp, Homo sapiens
tattcctactaacgtcctgtgt

SEQ ID NO: 7613413 - DNA, 22 bp, Homo sapiens
tattcctagacctcacccgaga

SEQ ID NO: 7613414 - DNA, 19 bp, Homo sapiens
tattcctagttagggggga

SEQ ID NO: 7613415 - DNA, 22 bp, Homo sapiens
tattcctagtaaaaatgcgcac

SEQ ID NO: 7613416 - DNA, 22 bp, Homo sapiens
tattcctataagacgtggccag

SEQ ID NO: 7613417 - DNA, 22 bp, Homo sapiens
tattcctatggccactgctact

SEQ ID NO: 7613418 - DNA, 22 bp, Homo sapiens
tattcctatttctaaacatatg

SEQ ID NO: 7613419 - DNA, 22 bp, Homo sapiens
tcaaagcctgtggatagtttgg

SEQ ID NO: 7613420 - DNA, 22 bp, Homo sapiens
tcaaagcatggttttgaaagac

SEQ ID NO: 7613421 - DNA, 22 bp, Homo sapiens
tcaaagcatcagtcaatttagg

SEQ ID NO: 7613422 - DNA, 22 bp, Homo sapiens
tcaaagcatcagtcaatttagg

SEQ ID NO: 7613423 - DNA, 22 bp, Homo sapiens
tcaaagcagcacattcgcaagc

SEQ ID NO: 7613424 - DNA, 22 bp, Homo sapiens
tcaaagcagcacattcgcaagc

SEQ ID NO: 7613425 - DNA, 22 bp, Homo sapiens
tcaaagcagcacattcgcaagc

SEQ ID NO: 7613426 - DNA, 22 bp, Homo sapiens
tcaaagcatcagtcaatttagg

SEQ ID NO: 7613427 - DNA, 22 bp, Homo sapiens
tcaaagcatcagtcaatttagg

SEQ ID NO: 7613428 - DNA, 22 bp, Homo sapiens
tcaaaggaatttgattttgatg

SEQ ID NO: 7613429 - DNA, 22 bp, Homo sapiens
tcaaaggaatttgattttgatg

SEQ ID NO: 7613430 - DNA, 22 bp, Homo sapiens
tcaaaggagacacaaggagaaa

SEQ ID NO: 7613431 - DNA, 22 bp, Homo sapiens
tcaaaggaaacacaagcttctg

SEQ ID NO: 7613432 - DNA, 22 bp, Homo sapiens
tcaaaggaaacgtggtcctggc

SEQ ID NO: 7613433 - DNA, 22 bp, Homo sapiens
tcaaaggaaacacaagcttctg

SEQ ID NO: 7613434 - DNA, 22 bp, Homo sapiens
tcaaaggagtttaagttactgg

SEQ ID NO: 7613435 - DNA, 22 bp, Homo sapiens
tcaaaggagtttaagttactgg

SEQ ID NO: 7613436 - DNA, 22 bp, Homo sapiens
tcaaaggagtttaagttactgg

SEQ ID NO: 7613437 - DNA, 22 bp, Homo sapiens
tcaaaggagtttaagttactgg

SEQ ID NO: 7613438 - DNA, 23 bp, Homo sapiens
tcaaaggaggcatcgttctgcag

SEQ ID NO: 7613439 - DNA, 22 bp, Homo sapiens
tcaaaggagacacaaggagaaa

SEQ ID NO: 7613440 - DNA, 22 bp, Homo sapiens
cagtcccagacccagaaggtgg

SEQ ID NO: 7613441 - DNA, 22 bp, Homo sapiens
cagtagcactctgtcagtgaag

SEQ ID NO: 7613442 - DNA, 22 bp, Homo sapiens
cagtagcactctgtcagtgaag

SEQ ID NO: 7613443 - DNA, 22 bp, Homo sapiens
cagtagcactagatatgtgtgg

SEQ ID NO: 7613444 - DNA, 22 bp, Homo sapiens
cagtagcacctatgattttgta

SEQ ID NO: 7613445 - DNA, 22 bp, Homo sapiens
cagtagcactagatatgtgtgg

SEQ ID NO: 7613446 - DNA, 20 bp, Homo sapiens
cagtagcaataattagaagc

SEQ ID NO: 7613447 - DNA, 22 bp, Homo sapiens
cagtagcaggcaggtgcttttg

SEQ ID NO: 7613448 - DNA, 22 bp, Homo sapiens
cagtagcaggcaggtgcttttg

SEQ ID NO: 7613449 - DNA, 22 bp, Homo sapiens
cagtagcaggcaggtgcttttg

SEQ ID NO: 7613450 - DNA, 22 bp, Homo sapiens
cagtagcaggatttgggattat

SEQ ID NO: 7613451 - DNA, 22 bp, Homo sapiens
cagtagcaggcactcagcacgt

SEQ ID NO: 7613452 - DNA, 22 bp, Homo sapiens
cagtagcaggcactcagcacgt

SEQ ID NO: 7613453 - DNA, 22 bp, Homo sapiens
cagtagcagggattattttagg

SEQ ID NO: 7613454 - DNA, 22 bp, Homo sapiens
cagtagcagggattattttagg

SEQ ID NO: 7613455 - DNA, 22 bp, Homo sapiens
cagtagcagggattattttagg

SEQ ID NO: 7613456 - DNA, 22 bp, Homo sapiens
cagtagcatgcaccaggagggt

SEQ ID NO: 7613457 - DNA, 22 bp, Homo sapiens
cagtagcatgcttatcttttga

SEQ ID NO: 7613458 - DNA, 22 bp, Homo sapiens
tattccaacttcactattgtct

SEQ ID NO: 7613459 - DNA, 22 bp, Homo sapiens
tattccaacttcactattgtct

SEQ ID NO: 7613460 - DNA, 22 bp, Homo sapiens
tattccaactgtcatagtcata

SEQ ID NO: 7613461 - DNA, 22 bp, Homo sapiens
tattccaactgtcatagtcata

SEQ ID NO: 7613462 - DNA, 22 bp, Homo sapiens
cagtagaagcttgtttttcaga

SEQ ID NO: 7613463 - DNA, 22 bp, Homo sapiens
cagtagaagcttgtttttcaga

SEQ ID NO: 7613464 - DNA, 22 bp, Homo sapiens
cagtagaattattataaaacat

SEQ ID NO: 7613465 - DNA, 22 bp, Homo sapiens
cagtagacacattaatatggaa

SEQ ID NO: 7613466 - DNA, 22 bp, Homo sapiens
cagtagaattattataaaacat

SEQ ID NO: 7613467 - DNA, 22 bp, Homo sapiens
cagtagaagcttgtttttcaga

SEQ ID NO: 7613468 - DNA, 22 bp, Homo sapiens
cagtacttttctggctttctac

SEQ ID NO: 7613469 - DNA, 22 bp, Homo sapiens
cagtagatttggtaaactagga

SEQ ID NO: 7613470 - DNA, 22 bp, Homo sapiens
cagtagatttggtaaactagga

SEQ ID NO: 7613471 - DNA, 22 bp, Homo sapiens
cagtagacagctgatgatgggc

SEQ ID NO: 7613472 - DNA, 22 bp, Homo sapiens
cagtagacacatttgtttttcc

SEQ ID NO: 7613473 - DNA, 22 bp, Homo sapiens
cagtacttgtcctcaggtgtta

SEQ ID NO: 7613474 - DNA, 22 bp, Homo sapiens
tattccagttcaccttttcatc

SEQ ID NO: 7613475 - DNA, 22 bp, Homo sapiens
tattccagttcaccttttcatc

SEQ ID NO: 7613476 - DNA, 22 bp, Homo sapiens
tattccagtgtgatctttgtag

SEQ ID NO: 7613477 - DNA, 22 bp, Homo sapiens
tattccagtatgtctggtgtcc

SEQ ID NO: 7613478 - DNA, 22 bp, Homo sapiens
tattccagtcctatcctctttt

SEQ ID NO: 7613479 - DNA, 22 bp, Homo sapiens
tattccagtcctatcctctttt

SEQ ID NO: 7613480 - DNA, 22 bp, Homo sapiens
tattccagtgtgatctttgtag

SEQ ID NO: 7613481 - DNA, 22 bp, Homo sapiens
tattccagtgtgatctttgtag

SEQ ID NO: 7613482 - DNA, 22 bp, Homo sapiens
tattccagtatgtctggtgtcc

SEQ ID NO: 7613483 - DNA, 22 bp, Homo sapiens
tattccaggtttcttgttgtat

SEQ ID NO: 7613484 - DNA, 22 bp, Homo sapiens
tattccaggtattcttcaagag

SEQ ID NO: 7613485 - DNA, 22 bp, Homo sapiens
tattccaggtattcttcaagag

SEQ ID NO: 7613486 - DNA, 22 bp, Homo sapiens
tattccaggtttcttgttgtat

SEQ ID NO: 7613487 - DNA, 22 bp, Homo sapiens
tattccaggtttcttgttgtat

SEQ ID NO: 7613488 - DNA, 17 bp, Homo sapiens
tattccaggaaataaag

SEQ ID NO: 7613489 - DNA, 17 bp, Homo sapiens
tattccaggaaataaag

SEQ ID NO: 7613490 - DNA, 22 bp, Homo sapiens
tattccaggacaggtgtgctgt

SEQ ID NO: 7613491 - DNA, 22 bp, Homo sapiens
tattccaggacaggtgtgctgt

SEQ ID NO: 7613492 - DNA, 22 bp, Homo sapiens
tattccaggggaaggtatcctg

SEQ ID NO: 7613493 - DNA, 22 bp, Homo sapiens
tattcccagttgtggtgagtag

SEQ ID NO: 7613494 - DNA, 22 bp, Homo sapiens
tattcccatgaagaggtagaga

SEQ ID NO: 7613495 - DNA, 22 bp, Homo sapiens
tattcccaccctaagtagtagg

SEQ ID NO: 7613496 - DNA, 22 bp, Homo sapiens
tattccatgccagagtttattg

SEQ ID NO: 7613497 - DNA, 22 bp, Homo sapiens
tattccaccagagatgtgaatt

SEQ ID NO: 7613498 - DNA, 22 bp, Homo sapiens
tattccaccagagatgtgaatt

SEQ ID NO: 7613499 - DNA, 22 bp, Homo sapiens
tattccagaaatcaccatttcc

SEQ ID NO: 7613500 - DNA, 22 bp, Homo sapiens
tattccaattggttgtaaagaa

SEQ ID NO: 7613501 - DNA, 22 bp, Homo sapiens
tattccaattggttgtaaagaa

SEQ ID NO: 7613502 - DNA, 22 bp, Homo sapiens
tattccaattggttgtaaagaa

SEQ ID NO: 7613503 - DNA, 22 bp, Homo sapiens
tattccagatgaaatcattcag

SEQ ID NO: 7613504 - DNA, 22 bp, Homo sapiens
tattccagatgaaatcattcag

SEQ ID NO: 7613505 - DNA, 22 bp, Homo sapiens
tattccagatgaaatcattcag

SEQ ID NO: 7613506 - DNA, 22 bp, Homo sapiens
tattccagataccttgtgtaag

SEQ ID NO: 7613507 - DNA, 22 bp, Homo sapiens
tattccagaaatcaccatttcc

SEQ ID NO: 7613508 - DNA, 22 bp, Homo sapiens
tattccagataccttgtgtaag

SEQ ID NO: 7613509 - DNA, 22 bp, Homo sapiens
tattccagataccttgtgtaag

SEQ ID NO: 7613510 - DNA, 22 bp, Homo sapiens
tattccagatgaaatcattcag

SEQ ID NO: 7613511 - DNA, 22 bp, Homo sapiens
tattccagatgaaatcattcag

SEQ ID NO: 7613512 - DNA, 22 bp, Homo sapiens
tattccagcagtctgccccgct

SEQ ID NO: 7613513 - DNA, 22 bp, Homo sapiens
tattccagccgcttgagctcgc

SEQ ID NO: 7613514 - DNA, 22 bp, Homo sapiens
tattccaatgtcagttatatca

SEQ ID NO: 7613515 - DNA, 22 bp, Homo sapiens
tattccaatgtcagttatatca

SEQ ID NO: 7613516 - DNA, 22 bp, Homo sapiens
tattccaagtgcctagaagagt

SEQ ID NO: 7613517 - DNA, 22 bp, Homo sapiens
tattccaagtgcctagaagagt

SEQ ID NO: 7613518 - DNA, 22 bp, Homo sapiens
tattccaagtgcctagaagagt

SEQ ID NO: 7613519 - DNA, 22 bp, Homo sapiens
tattccaagtcactgtgtcctg

SEQ ID NO: 7613520 - DNA, 20 bp, Homo sapiens
tattccaagggtagagaaaa

SEQ ID NO: 7613521 - DNA, 20 bp, Homo sapiens
tattccaagggtagagaaaa

SEQ ID NO: 7613522 - DNA, 20 bp, Homo sapiens
tattccaagggtagagaaaa

SEQ ID NO: 7613523 - DNA, 22 bp, Homo sapiens
tattccaagcacagcaacccag

SEQ ID NO: 7613524 - DNA, 22 bp, Homo sapiens
tattccaacttcactattgtct

SEQ ID NO: 7613525 - DNA, 22 bp, Homo sapiens
tattccaacttcactattgtct

SEQ ID NO: 7613526 - DNA, 22 bp, Homo sapiens
cagtctggaggtcagctggctt

SEQ ID NO: 7613527 - DNA, 22 bp, Homo sapiens
cagtctggaggtcagctggctt

SEQ ID NO: 7613528 - DNA, 22 bp, Homo sapiens
cagtctggaggtcagctggctt

SEQ ID NO: 7613529 - DNA, 22 bp, Homo sapiens
cagtctggaggtcagctggctt

SEQ ID NO: 7613530 - DNA, 23 bp, Homo sapiens
cagtctgcagcccacttgggcag

SEQ ID NO: 7613531 - DNA, 22 bp, Homo sapiens
cagtctggactcaggcatacct

SEQ ID NO: 7613532 - DNA, 22 bp, Homo sapiens
cagtctggactcaggcatacct

SEQ ID NO: 7613533 - DNA, 22 bp, Homo sapiens
cagtctggaggtcagctggctt

SEQ ID NO: 7613534 - DNA, 22 bp, Homo sapiens
cagtctggaggtcagctggctt

SEQ ID NO: 7613535 - DNA, 22 bp, Homo sapiens
cagtctggaggtcagctggctt

SEQ ID NO: 7613536 - DNA, 22 bp, Homo sapiens
cagtctctcagctttcagctgt

SEQ ID NO: 7613537 - DNA, 23 bp, Homo sapiens
cagtctctccccggacagcaaaa

SEQ ID NO: 7613538 - DNA, 22 bp, Homo sapiens
cagtctctctccttgcaggcgt

SEQ ID NO: 7613539 - DNA, 22 bp, Homo sapiens
cagtctctaaatcaatctgaat

SEQ ID NO: 7613540 - DNA, 22 bp, Homo sapiens
cagtcctctcactcaggccttt

SEQ ID NO: 7613541 - DNA, 22 bp, Homo sapiens
cagtccctgggggagtcaccag

SEQ ID NO: 7613542 - DNA, 22 bp, Homo sapiens
cagtcctcagtgagtgatcctg

SEQ ID NO: 7613543 - DNA, 22 bp, Homo sapiens
cagtcctcagtgagtgatcctg

SEQ ID NO: 7613544 - DNA, 22 bp, Homo sapiens
cagtctctcagctttcagctgt

SEQ ID NO: 7613545 - DNA, 22 bp, Homo sapiens
cagtcttaggagaaactacaga

SEQ ID NO: 7613546 - DNA, 22 bp, Homo sapiens
cagtcttagccttccctcaccc

SEQ ID NO: 7613547 - DNA, 22 bp, Homo sapiens
cagtcttatcctgaaaacaaca

SEQ ID NO: 7613548 - DNA, 22 bp, Homo sapiens
cagtcttagaggtgactgtgga

SEQ ID NO: 7613549 - DNA, 22 bp, Homo sapiens
cagtcttagaggtgactgtgga

SEQ ID NO: 7613550 - DNA, 22 bp, Homo sapiens
cagtcttagaggtgactgtgga

SEQ ID NO: 7613551 - DNA, 22 bp, Homo sapiens
cagtctgtaatgggttttaaaa

SEQ ID NO: 7613552 - DNA, 22 bp, Homo sapiens
cagtctgggactgagctccacc

SEQ ID NO: 7613553 - DNA, 22 bp, Homo sapiens
cagtctgggactgagctccacc

SEQ ID NO: 7613554 - DNA, 22 bp, Homo sapiens
cagtctgggactgagctccacc

SEQ ID NO: 7613555 - DNA, 22 bp, Homo sapiens
cagtctgggactgagctccacc

SEQ ID NO: 7613556 - DNA, 22 bp, Homo sapiens
cagtctgggactgagctccacc

SEQ ID NO: 7613557 - DNA, 22 bp, Homo sapiens
cagtctggctcagcacaaaggg

SEQ ID NO: 7613558 - DNA, 22 bp, Homo sapiens
cagtctgggactgagctccacc

SEQ ID NO: 7613559 - DNA, 22 bp, Homo sapiens
cagtctggcacagcacactgaa

SEQ ID NO: 7613560 - DNA, 22 bp, Homo sapiens
cagtctggctcagcacaaaggg

SEQ ID NO: 7613561 - DNA, 22 bp, Homo sapiens
cagtctggctcagcacaaaggg

SEQ ID NO: 7613562 - DNA, 22 bp, Homo sapiens
cagtctggcacagcacactgaa

SEQ ID NO: 7613563 - DNA, 22 bp, Homo sapiens
cagtctggcacagcacactgaa

SEQ ID NO: 7613564 - DNA, 22 bp, Homo sapiens
cagtctggcacagcacactgaa

SEQ ID NO: 7613565 - DNA, 22 bp, Homo sapiens
cagtctggatctgtgctgctgt

SEQ ID NO: 7613566 - DNA, 22 bp, Homo sapiens
cagtcccagtttgagactctgg

SEQ ID NO: 7613567 - DNA, 22 bp, Homo sapiens
cagtcccagtttgagactctgg

SEQ ID NO: 7613568 - DNA, 22 bp, Homo sapiens
cagtcccagtttgagactctgg

SEQ ID NO: 7613569 - DNA, 22 bp, Homo sapiens
cagtcccagggttggttcagct

SEQ ID NO: 7613570 - DNA, 22 bp, Homo sapiens
cagtcccagggttggttcagct

SEQ ID NO: 7613571 - DNA, 22 bp, Homo sapiens
cagtcccagtttgagactctgg

SEQ ID NO: 7613572 - DNA, 22 bp, Homo sapiens
cagtcccagtttgagactctgg

SEQ ID NO: 7613573 - DNA, 15 bp, Homo sapiens
cagtcccagggaccc

SEQ ID NO: 7613574 - DNA, 22 bp, Homo sapiens
cagtcccagggttggttcagct

SEQ ID NO: 7613575 - DNA, 22 bp, Homo sapiens
cagtcccagggttggttcagct

SEQ ID NO: 7613576 - DNA, 22 bp, Homo sapiens
cagtcccagctgctcagaaggc

SEQ ID NO: 7613577 - DNA, 22 bp, Homo sapiens
cagtcccagctgctcagaaggc

SEQ ID NO: 7613578 - DNA, 22 bp, Homo sapiens
cagtcccagctgctcagaaggc

SEQ ID NO: 7613579 - DNA, 22 bp, Homo sapiens
cagtcccagctgctcagaaggc

SEQ ID NO: 7613580 - DNA, 22 bp, Homo sapiens
cagtcccagctgctcagaaggc

SEQ ID NO: 7613581 - DNA, 15 bp, Homo sapiens
cagtcccagggaccc

SEQ ID NO: 7613582 - DNA, 15 bp, Homo sapiens
cagtcccagggaccc

SEQ ID NO: 7613583 - DNA, 22 bp, Homo sapiens
cagtccctagtggagctcacag

SEQ ID NO: 7613584 - DNA, 22 bp, Homo sapiens
cagtcccatgagcccagaacat

SEQ ID NO: 7613585 - DNA, 22 bp, Homo sapiens
cagtcccatgagcccagaacat

SEQ ID NO: 7613586 - DNA, 22 bp, Homo sapiens
cagtccctgggggagtcaccag

SEQ ID NO: 7613587 - DNA, 22 bp, Homo sapiens
cagtccctagtggagctcacag

SEQ ID NO: 7613588 - DNA, 22 bp, Homo sapiens
cagtccctgggggagtcaccag

SEQ ID NO: 7613589 - DNA, 22 bp, Homo sapiens
cagtcccatgagcccagaacat

SEQ ID NO: 7613590 - DNA, 22 bp, Homo sapiens
cagtcccatgagcccagaacat

SEQ ID NO: 7613591 - DNA, 22 bp, Homo sapiens
cagtcccatctcccaggtggct

SEQ ID NO: 7613592 - DNA, 22 bp, Homo sapiens
cagtcccatctcccaggtggct

SEQ ID NO: 7613593 - DNA, 22 bp, Homo sapiens
cagtcccatctcccaggtggct

SEQ ID NO: 7613594 - DNA, 22 bp, Homo sapiens
cagtcccatctcccaggtggct

SEQ ID NO: 7613595 - DNA, 22 bp, Homo sapiens
cagtcccatctcccaggtggct

SEQ ID NO: 7613596 - DNA, 22 bp, Homo sapiens
cagtcccatctcccaggtggct

SEQ ID NO: 7613597 - DNA, 22 bp, Homo sapiens
cagtcccatctcccaggtggct

SEQ ID NO: 7613598 - DNA, 22 bp, Homo sapiens
cagtcccagtttgagactctgg

SEQ ID NO: 7613599 - DNA, 17 bp, Homo sapiens
cagtgaagagacattaa

SEQ ID NO: 7613600 - DNA, 17 bp, Homo sapiens
cagtgaagagacattaa

SEQ ID NO: 7613601 - DNA, 22 bp, Homo sapiens
cagtgaaatcacaactttagtt

SEQ ID NO: 7613602 - DNA, 22 bp, Homo sapiens
cagtgaacttgagtacttcatt

SEQ ID NO: 7613603 - DNA, 19 bp, Homo sapiens
tcaaatgccaatgtcacag

SEQ ID NO: 7613604 - DNA, 22 bp, Homo sapiens
tcaaatgccagtggtgtggatc

SEQ ID NO: 7613605 - DNA, 22 bp, Homo sapiens
tcaaatgccagtggtgtggatc

SEQ ID NO: 7613606 - DNA, 17 bp, Homo sapiens
cagtgaagagacattaa

SEQ ID NO: 7613607 - DNA, 19 bp, Homo sapiens
tcaaatgccaatgtcacag

SEQ ID NO: 7613608 - DNA, 22 bp, Homo sapiens
cagtgaaatcacaactttagtt

SEQ ID NO: 7613609 - DNA, 22 bp, Homo sapiens
cagtgaaatagtggacatcaaa

SEQ ID NO: 7613610 - DNA, 22 bp, Homo sapiens
cagtgaaatagtggacatcaaa

SEQ ID NO: 7613611 - DNA, 22 bp, Homo sapiens
tcaaatgcggtcatggctttta

SEQ ID NO: 7613612 - DNA, 22 bp, Homo sapiens
tcaaatgcggtcatggctttta

SEQ ID NO: 7613613 - DNA, 22 bp, Homo sapiens
tcaaatgctcagactcctgtgg

SEQ ID NO: 7613614 - DNA, 22 bp, Homo sapiens
tcaaatgctctttgcagagagg

SEQ ID NO: 7613615 - DNA, 22 bp, Homo sapiens
tcaaatgctctttgcagagagg

SEQ ID NO: 7613616 - DNA, 22 bp, Homo sapiens
tcaaatgctgcctttgtgtgcc

SEQ ID NO: 7613617 - DNA, 22 bp, Homo sapiens
tcaaatgctgcctttgtgtgcc

SEQ ID NO: 7613618 - DNA, 22 bp, Homo sapiens
tcaaatgctgcctttgtgtgcc

SEQ ID NO: 7613619 - DNA, 22 bp, Homo sapiens
tcaaatgctgtattgtagtaat

SEQ ID NO: 7613620 - DNA, 22 bp, Homo sapiens
tcaaatgctgtattgtagtaat

SEQ ID NO: 7613621 - DNA, 22 bp, Homo sapiens
tcaaatgcttctactcctaaga

SEQ ID NO: 7613622 - DNA, 22 bp, Homo sapiens
tcaaatgcttctactcctaaga

SEQ ID NO: 7613623 - DNA, 22 bp, Homo sapiens
cagtgaaatagtggacatcaaa

SEQ ID NO: 7613624 - DNA, 22 bp, Homo sapiens
cagtcttttgtatattagcaga

SEQ ID NO: 7613625 - DNA, 22 bp, Homo sapiens
cagtcttttgtatattagcaga

SEQ ID NO: 7613626 - DNA, 22 bp, Homo sapiens
cagtcttttgtatattagcaga

SEQ ID NO: 7613627 - DNA, 22 bp, Homo sapiens
cagtcttttgtatattagcaga

SEQ ID NO: 7613628 - DNA, 22 bp, Homo sapiens
cagtcttttgtatattagcaga

SEQ ID NO: 7613629 - DNA, 22 bp, Homo sapiens
cagtctttgttcccattactga

SEQ ID NO: 7613630 - DNA, 22 bp, Homo sapiens
cagtctttgttcccattactga

SEQ ID NO: 7613631 - DNA, 22 bp, Homo sapiens
cagtctttgttcccattactga

SEQ ID NO: 7613632 - DNA, 22 bp, Homo sapiens
cagtctttgttcccattactga

SEQ ID NO: 7613633 - DNA, 22 bp, Homo sapiens
cagtctttgatgcatcctagcc

SEQ ID NO: 7613634 - DNA, 22 bp, Homo sapiens
cagtcttctgagaaggcaaggg

SEQ ID NO: 7613635 - DNA, 22 bp, Homo sapiens
cagtcttgctttactgagatgg

SEQ ID NO: 7613636 - DNA, 22 bp, Homo sapiens
cagtcttgctttactgagatgg

SEQ ID NO: 7613637 - DNA, 22 bp, Homo sapiens
cagtcttgctttactgagatgg

SEQ ID NO: 7613638 - DNA, 22 bp, Homo sapiens
cagtcttctaacctagcagcct

SEQ ID NO: 7613639 - DNA, 22 bp, Homo sapiens
cagtcttatcctgaaaacaaca

SEQ ID NO: 7613640 - DNA, 22 bp, Homo sapiens
cagtcttatcctgaaaacaaca

SEQ ID NO: 7613641 - DNA, 22 bp, Homo sapiens
cagtctttgatgcatcctagcc

SEQ ID NO: 7613642 - DNA, 22 bp, Homo sapiens
cagtctttgatgcatcctagcc

SEQ ID NO: 7613643 - DNA, 22 bp, Homo sapiens
cagtctttgatgcatcctagcc

SEQ ID NO: 7613644 - DNA, 22 bp, Homo sapiens
cagtctttgatgcatcctagcc

SEQ ID NO: 7613645 - DNA, 22 bp, Homo sapiens
cagtcttctgagaaggcaaggg

SEQ ID NO: 7613646 - DNA, 22 bp, Homo sapiens
cagtctttgacaagccctttca

SEQ ID NO: 7613647 - DNA, 22 bp, Homo sapiens
cagtctttgacaagccctttca

SEQ ID NO: 7613648 - DNA, 22 bp, Homo sapiens
tcaaattcagtgtgacaacatt

SEQ ID NO: 7613649 - DNA, 22 bp, Homo sapiens
tcaaattcagtgtgacaacatt

SEQ ID NO: 7613650 - DNA, 22 bp, Homo sapiens
tcaaattcagtgtgacaacatt

SEQ ID NO: 7613651 - DNA, 22 bp, Homo sapiens
tcaaattatttaggatagtgct

SEQ ID NO: 7613652 - DNA, 22 bp, Homo sapiens
tcaaattatttaggatagtgct

SEQ ID NO: 7613653 - DNA, 22 bp, Homo sapiens
tcaaattagtggaataataatg

SEQ ID NO: 7613654 - DNA, 22 bp, Homo sapiens
tcaaattatttaggatagtgct

SEQ ID NO: 7613655 - DNA, 22 bp, Homo sapiens
tcaaattatttaggatagtgct

SEQ ID NO: 7613656 - DNA, 22 bp, Homo sapiens
tcaaattatttaggatagtgct

SEQ ID NO: 7613657 - DNA, 22 bp, Homo sapiens
tcaaattctattctatactcag

SEQ ID NO: 7613658 - DNA, 19 bp, Homo sapiens
tcaaattcctaagttctgg

SEQ ID NO: 7613659 - DNA, 19 bp, Homo sapiens
tcaaattcctaagttctgg

SEQ ID NO: 7613660 - DNA, 19 bp, Homo sapiens
tcaaattcctaagttctgg

SEQ ID NO: 7613661 - DNA, 19 bp, Homo sapiens
tcaaattcctaagttctgg

SEQ ID NO: 7613662 - DNA, 22 bp, Homo sapiens
tcaaattcagtgtgacaacatt

SEQ ID NO: 7613663 - DNA, 22 bp, Homo sapiens
tcaaattcagtgtgacaacatt

SEQ ID NO: 7613664 - DNA, 22 bp, Homo sapiens
tcaaattttaacatgcattaga

SEQ ID NO: 7613665 - DNA, 22 bp, Homo sapiens
tcaacaaatacttaaagcagag

SEQ ID NO: 7613666 - DNA, 22 bp, Homo sapiens
tcaacaaatacttaaagcagag

SEQ ID NO: 7613667 - DNA, 22 bp, Homo sapiens
tcaacaaatacttaaagcagag

SEQ ID NO: 7613668 - DNA, 22 bp, Homo sapiens
tcaaattttaacatgcattaga

SEQ ID NO: 7613669 - DNA, 22 bp, Homo sapiens
tcaaattttaacatgcattaga

SEQ ID NO: 7613670 - DNA, 22 bp, Homo sapiens
tcaaattgtcatcttgataatg

SEQ ID NO: 7613671 - DNA, 22 bp, Homo sapiens
tcaaattctattctatactcag

SEQ ID NO: 7613672 - DNA, 22 bp, Homo sapiens
tcaaattgtcatcttgataatg

SEQ ID NO: 7613673 - DNA, 22 bp, Homo sapiens
tcaaatgtgtaaggtcaggaca

SEQ ID NO: 7613674 - DNA, 22 bp, Homo sapiens
tcaaatgtgtaaggtcaggaca

SEQ ID NO: 7613675 - DNA, 22 bp, Homo sapiens
tcaaatgttccctgtactggcc

SEQ ID NO: 7613676 - DNA, 22 bp, Homo sapiens
tcaaatgttccctgtactggcc

SEQ ID NO: 7613677 - DNA, 22 bp, Homo sapiens
tcaaattagtggaataataatg

SEQ ID NO: 7613678 - DNA, 22 bp, Homo sapiens
tcaaattagtggaataataatg

SEQ ID NO: 7613679 - DNA, 22 bp, Homo sapiens
tcaaattagtggaataataatg

SEQ ID NO: 7613680 - DNA, 22 bp, Homo sapiens
tcaaattagtggaataataatg

SEQ ID NO: 7613681 - DNA, 22 bp, Homo sapiens
tcaaatgggtatgctttataat

SEQ ID NO: 7613682 - DNA, 22 bp, Homo sapiens
tcaaatgtaatttattgtttta

SEQ ID NO: 7613683 - DNA, 22 bp, Homo sapiens
tcaaattagtggaataataatg

SEQ ID NO: 7613684 - DNA, 22 bp, Homo sapiens
tcaaattagtggaataataatg

SEQ ID NO: 7613685 - DNA, 22 bp, Homo sapiens
tcaaattagtggaataataatg

SEQ ID NO: 7613686 - DNA, 22 bp, Homo sapiens
tcaaattagtggaataataatg

SEQ ID NO: 7613687 - DNA, 22 bp, Homo sapiens
tcaaattagtggaataataatg

SEQ ID NO: 7613688 - DNA, 22 bp, Homo sapiens
tcaaattagtggaataataatg

SEQ ID NO: 7613689 - DNA, 22 bp, Homo sapiens
tcaaattagtggaataataatg

SEQ ID NO: 7613690 - DNA, 22 bp, Homo sapiens
tcaaattagtggaataataatg

SEQ ID NO: 7613691 - DNA, 22 bp, Homo sapiens
tcaaattagtggaataataatg

SEQ ID NO: 7613692 - DNA, 22 bp, Homo sapiens
tcacattctcagcatctataca

SEQ ID NO: 7613693 - DNA, 22 bp, Homo sapiens
tcacattctcagcatctataca

SEQ ID NO: 7613694 - DNA, 22 bp, Homo sapiens
tcacattctagaatgttatcgt

SEQ ID NO: 7613695 - DNA, 22 bp, Homo sapiens
tcacattctagaatgttatcgt

SEQ ID NO: 7613696 - DNA, 22 bp, Homo sapiens
tcacattctagaatgttatcgt

SEQ ID NO: 7613697 - DNA, 22 bp, Homo sapiens
tcacattcatggtgctaataaa

SEQ ID NO: 7613698 - DNA, 22 bp, Homo sapiens
tcacattcatggtgctaataaa

SEQ ID NO: 7613699 - DNA, 22 bp, Homo sapiens
tcacattcatggtgctaataaa

SEQ ID NO: 7613700 - DNA, 19 bp, Homo sapiens
tcacattcagccttgctga

SEQ ID NO: 7613701 - DNA, 19 bp, Homo sapiens
tcacattcagccttgctga

SEQ ID NO: 7613702 - DNA, 18 bp, Homo sapiens
tcacattataatgtaaca

SEQ ID NO: 7613703 - DNA, 22 bp, Homo sapiens
tcacatgttaggtcgggcaagg

SEQ ID NO: 7613704 - DNA, 18 bp, Homo sapiens
tcacattataatgtaaca

SEQ ID NO: 7613705 - DNA, 22 bp, Homo sapiens
tcacatgtgtggcagtgcaagt

SEQ ID NO: 7613706 - DNA, 22 bp, Homo sapiens
tcacatgtgttttctcaccaac

SEQ ID NO: 7613707 - DNA, 22 bp, Homo sapiens
tcacatgtgttttctcaccaac

SEQ ID NO: 7613708 - DNA, 22 bp, Homo sapiens
tcacatgtgttttctcaccaac

SEQ ID NO: 7613709 - DNA, 22 bp, Homo sapiens
tcacatgtcaagaagataattt

SEQ ID NO: 7613710 - DNA, 22 bp, Homo sapiens
tcacatgtcaagaagataattt

SEQ ID NO: 7613711 - DNA, 22 bp, Homo sapiens
tcacatgtcacaaaacactgcc

SEQ ID NO: 7613712 - DNA, 22 bp, Homo sapiens
tcacatgtcacaaaacactgcc

SEQ ID NO: 7613713 - DNA, 22 bp, Homo sapiens
tcacatgtcacaaaacactgcc

SEQ ID NO: 7613714 - DNA, 22 bp, Homo sapiens
tcacatgtcacaaaacactgcc

SEQ ID NO: 7613715 - DNA, 22 bp, Homo sapiens
tcacatgtcacaaaacactgcc

SEQ ID NO: 7613716 - DNA, 22 bp, Homo sapiens
tcacatgtcaaaaactacataa

SEQ ID NO: 7613717 - DNA, 22 bp, Homo sapiens
tcacatgtcaaaaactacataa

SEQ ID NO: 7613718 - DNA, 22 bp, Homo sapiens
tcacatgtcaagaagataattt

SEQ ID NO: 7613719 - DNA, 22 bp, Homo sapiens
tcacatgtatatgcagcacagc

SEQ ID NO: 7613720 - DNA, 22 bp, Homo sapiens
tcacatgtcaaaaactacataa

SEQ ID NO: 7613721 - DNA, 22 bp, Homo sapiens
tcacatgtcaaaaactacataa

SEQ ID NO: 7613722 - DNA, 22 bp, Homo sapiens
tcacatgtgtggcagtgcaagt

SEQ ID NO: 7613723 - DNA, 22 bp, Homo sapiens
tcacatgtgtacagtcctccca

SEQ ID NO: 7613724 - DNA, 22 bp, Homo sapiens
tcacatgtgtggcagtgcaagt

SEQ ID NO: 7613725 - DNA, 22 bp, Homo sapiens
tcacatgtgtggcagtgcaagt

SEQ ID NO: 7613726 - DNA, 22 bp, Homo sapiens
tcacatgtcagtcttaaacaga

SEQ ID NO: 7613727 - DNA, 22 bp, Homo sapiens
tcacatgtcagaataagtgcat

SEQ ID NO: 7613728 - DNA, 22 bp, Homo sapiens
tcacatgtcagaataagtgcat

SEQ ID NO: 7613729 - DNA, 22 bp, Homo sapiens
tcacatgtcagtcttaaacaga

SEQ ID NO: 7613730 - DNA, 22 bp, Homo sapiens
tcacatgtcagaataagtgcat

SEQ ID NO: 7613731 - DNA, 22 bp, Homo sapiens
tcacatgtcagtcttaaacaga

SEQ ID NO: 7613732 - DNA, 22 bp, Homo sapiens
tcactgcaagctccgcctcccg

SEQ ID NO: 7613733 - DNA, 22 bp, Homo sapiens
tcactgcaagctcagcctcccg

SEQ ID NO: 7613734 - DNA, 22 bp, Homo sapiens
tcactgcaacctctgcctcttg

SEQ ID NO: 7613735 - DNA, 22 bp, Homo sapiens
tcactgcaacctctgccttccg

SEQ ID NO: 7613736 - DNA, 22 bp, Homo sapiens
tcactgcaacctctgcctcccg

SEQ ID NO: 7613737 - DNA, 22 bp, Homo sapiens
tcactgcaacctctgccttccg

SEQ ID NO: 7613738 - DNA, 22 bp, Homo sapiens
tcactgcaacctctgcctcttg

SEQ ID NO: 7613739 - DNA, 22 bp, Homo sapiens
tcactgcaagctcctcctcctg

SEQ ID NO: 7613740 - DNA, 22 bp, Homo sapiens
tcactgcaagctctgccttccg

SEQ ID NO: 7613741 - DNA, 22 bp, Homo sapiens
tcactgcaagctctgccttccg

SEQ ID NO: 7613742 - DNA, 22 bp, Homo sapiens
tcactgcaatctcagcctcctg

SEQ ID NO: 7613743 - DNA, 22 bp, Homo sapiens
tcactgcaacctccgcctcccg

SEQ ID NO: 7613744 - DNA, 22 bp, Homo sapiens
tcactgcaacctctgcctcccg

SEQ ID NO: 7613745 - DNA, 22 bp, Homo sapiens
tcactgcaacctccacctcctg

SEQ ID NO: 7613746 - DNA, 22 bp, Homo sapiens
tcactgcaacctccacctcctg

SEQ ID NO: 7613747 - DNA, 22 bp, Homo sapiens
tcactgcaacctccacctcctg

SEQ ID NO: 7613748 - DNA, 22 bp, Homo sapiens
tcactgcaacctccacctcctg

SEQ ID NO: 7613749 - DNA, 22 bp, Homo sapiens
tcactgcaacctccacctcctg

SEQ ID NO: 7613750 - DNA, 22 bp, Homo sapiens
tcacattcttccctgacttctt

SEQ ID NO: 7613751 - DNA, 22 bp, Homo sapiens
tcacattcttccctgacttctt

SEQ ID NO: 7613752 - DNA, 22 bp, Homo sapiens
tcacattctcagcatctataca

SEQ ID NO: 7613753 - DNA, 22 bp, Homo sapiens
tcactcctcattgctgcccatt

SEQ ID NO: 7613754 - DNA, 22 bp, Homo sapiens
tcactcctcattgctgcccatt

SEQ ID NO: 7613755 - DNA, 22 bp, Homo sapiens
tcactctgaatggtactgagga

SEQ ID NO: 7613756 - DNA, 22 bp, Homo sapiens
tcactctgaatggtactgagga

SEQ ID NO: 7613757 - DNA, 22 bp, Homo sapiens
tcactctctaagcatgacagac

SEQ ID NO: 7613758 - DNA, 22 bp, Homo sapiens
cagtggcaggatttcagctcag

SEQ ID NO: 7613759 - DNA, 22 bp, Homo sapiens
cagtggcaggatttcagctcag

SEQ ID NO: 7613760 - DNA, 22 bp, Homo sapiens
cagtggcaggatttcagctcag

SEQ ID NO: 7613761 - DNA, 22 bp, Homo sapiens
cagtggcaggatttcagctcag

SEQ ID NO: 7613762 - DNA, 22 bp, Homo sapiens
cagtgggtgaaagatggctaag

SEQ ID NO: 7613763 - DNA, 22 bp, Homo sapiens
cagtgggtcctgcgtctgccag

SEQ ID NO: 7613764 - DNA, 22 bp, Homo sapiens
cagtgggtgatgagtcctgggg

SEQ ID NO: 7613765 - DNA, 22 bp, Homo sapiens
cagtgggtgaaagatggctaag

SEQ ID NO: 7613766 - DNA, 22 bp, Homo sapiens
cagtgggtgatgagtcctgggg

SEQ ID NO: 7613767 - DNA, 22 bp, Homo sapiens
cagtggtttaggtcaaggggag

SEQ ID NO: 7613768 - DNA, 21 bp, Homo sapiens
cagtggtttataaacaacaga

SEQ ID NO: 7613769 - DNA, 21 bp, Homo sapiens
cagtggtttataaacaacaga

SEQ ID NO: 7613770 - DNA, 21 bp, Homo sapiens
cagtggtttataaacaacaga

SEQ ID NO: 7613771 - DNA, 22 bp, Homo sapiens
cagtggttgtcagcaacaatat

SEQ ID NO: 7613772 - DNA, 22 bp, Homo sapiens
cagtggttggtagatacttgag

SEQ ID NO: 7613773 - DNA, 22 bp, Homo sapiens
cagtggtttaggtcaaggggag

SEQ ID NO: 7613774 - DNA, 22 bp, Homo sapiens
cagtggttggtagatacttgag

SEQ ID NO: 7613775 - DNA, 22 bp, Homo sapiens
cagtggttgcttgcatggctcc

SEQ ID NO: 7613776 - DNA, 22 bp, Homo sapiens
cagtggttgcttgcatggctcc

SEQ ID NO: 7613777 - DNA, 22 bp, Homo sapiens
cagtggttgcttgcatggctcc

SEQ ID NO: 7613778 - DNA, 22 bp, Homo sapiens
cagtggttgtcagcaacaatat

SEQ ID NO: 7613779 - DNA, 22 bp, Homo sapiens
cagtggttgtcagcaacaatat

SEQ ID NO: 7613780 - DNA, 22 bp, Homo sapiens
cagtggcacttgtcatttctga

SEQ ID NO: 7613781 - DNA, 22 bp, Homo sapiens
cagtggcacttgtcatttctga

SEQ ID NO: 7613782 - DNA, 22 bp, Homo sapiens
cagtggcagagaacagagacct

SEQ ID NO: 7613783 - DNA, 22 bp, Homo sapiens
cagtggcagagaacagagacct

SEQ ID NO: 7613784 - DNA, 22 bp, Homo sapiens
cagtggcagagaacagagacct

SEQ ID NO: 7613785 - DNA, 22 bp, Homo sapiens
cagtggcagagaacagagacct

SEQ ID NO: 7613786 - DNA, 22 bp, Homo sapiens
cagtggcagagaacagagacct

SEQ ID NO: 7613787 - DNA, 22 bp, Homo sapiens
cagtggcagagaacagagacct

SEQ ID NO: 7613788 - DNA, 17 bp, Homo sapiens
cagtggcagatcttctc

SEQ ID NO: 7613789 - DNA, 17 bp, Homo sapiens
cagtggcagatcttctc

SEQ ID NO: 7613790 - DNA, 17 bp, Homo sapiens
cagtggcagatcttctc

SEQ ID NO: 7613791 - DNA, 22 bp, Homo sapiens
cagtggcaggatttcagctcag

SEQ ID NO: 7613792 - DNA, 17 bp, Homo sapiens
cagtggcagatcttctc

SEQ ID NO: 7613793 - DNA, 22 bp, Homo sapiens
cagtggcagagccgttgccatc

SEQ ID NO: 7613794 - DNA, 22 bp, Homo sapiens
cagtggcagagaacagagacct

SEQ ID NO: 7613795 - DNA, 22 bp, Homo sapiens
cagtggcagagccgttgccatc

SEQ ID NO: 7613796 - DNA, 22 bp, Homo sapiens
cagtggcagatcaccaactgga

SEQ ID NO: 7613797 - DNA, 22 bp, Homo sapiens
cagtggcagatcaccaactgga

SEQ ID NO: 7613798 - DNA, 22 bp, Homo sapiens
cagtggcagatcaccaactgga

SEQ ID NO: 7613799 - DNA, 22 bp, Homo sapiens
tcactgcaggtttttcaggagg

SEQ ID NO: 7613800 - DNA, 22 bp, Homo sapiens
cagtggcaatgggacagagcac

SEQ ID NO: 7613801 - DNA, 22 bp, Homo sapiens
cagtggcaatgggacagagcac

SEQ ID NO: 7613802 - DNA, 22 bp, Homo sapiens
cagtggcaatgggacagagcac

SEQ ID NO: 7613803 - DNA, 22 bp, Homo sapiens
cagtggcacccacgggctgggc

SEQ ID NO: 7613804 - DNA, 22 bp, Homo sapiens
cagtggcacatggaccttgtca

SEQ ID NO: 7613805 - DNA, 22 bp, Homo sapiens
cagtggcaatgggacagagcac

SEQ ID NO: 7613806 - DNA, 22 bp, Homo sapiens
cagtggcacgatctcagctcac

SEQ ID NO: 7613807 - DNA, 22 bp, Homo sapiens
cagtggcacccacgggctgggc

SEQ ID NO: 7613808 - DNA, 22 bp, Homo sapiens
cagtggcacgatctcagctcac

SEQ ID NO: 7613809 - DNA, 22 bp, Homo sapiens
cagtggcacgatctcagctcac

SEQ ID NO: 7613810 - DNA, 22 bp, Homo sapiens
cagtggcacgatctcagctcac

SEQ ID NO: 7613811 - DNA, 22 bp, Homo sapiens
cagtggcacgatctcagctcac

SEQ ID NO: 7613812 - DNA, 21 bp, Homo sapiens
cagtggcacgatttcggctca

SEQ ID NO: 7613813 - DNA, 21 bp, Homo sapiens
cagtggcacgatttcggctca

SEQ ID NO: 7613814 - DNA, 22 bp, Homo sapiens
cagtggcacccacgggctgggc

SEQ ID NO: 7613815 - DNA, 22 bp, Homo sapiens
cagtggcacccacgggctgggc

SEQ ID NO: 7613816 - DNA, 22 bp, Homo sapiens
cagtggcacccacgggctgggc

SEQ ID NO: 7613817 - DNA, 22 bp, Homo sapiens
cagtggcacccacgggctgggc

SEQ ID NO: 7613818 - DNA, 22 bp, Homo sapiens
cagtggcacccacgggctgggc

SEQ ID NO: 7613819 - DNA, 22 bp, Homo sapiens
cagtggcacccacgggctgggc

SEQ ID NO: 7613820 - DNA, 22 bp, Homo sapiens
cagtggcacccacgggctgggc

SEQ ID NO: 7613821 - DNA, 22 bp, Homo sapiens
cagtggcacccacgggctgggc

SEQ ID NO: 7613822 - DNA, 22 bp, Homo sapiens
tcactgcagacaacctcagtca

SEQ ID NO: 7613823 - DNA, 22 bp, Homo sapiens
tcactgcaggtttttcaggagg

SEQ ID NO: 7613824 - DNA, 22 bp, Homo sapiens
tcactgcagcctctgcctcccg

SEQ ID NO: 7613825 - DNA, 22 bp, Homo sapiens
tcactgcagcctctgcctcccg

SEQ ID NO: 7613826 - DNA, 22 bp, Homo sapiens
tcactgcagagacctctagtca

SEQ ID NO: 7613827 - DNA, 22 bp, Homo sapiens
tcactgcactccagcactcagg

SEQ ID NO: 7613828 - DNA, 21 bp, Homo sapiens
tcactgcaatgctaggagaaa

SEQ ID NO: 7613829 - DNA, 22 bp, Homo sapiens
tcactgcaatctctgccttcca

SEQ ID NO: 7613830 - DNA, 22 bp, Homo sapiens
tcactgcaatctctgccttcca

SEQ ID NO: 7613831 - DNA, 22 bp, Homo sapiens
tcactgcactccagcctggtga

SEQ ID NO: 7613832 - DNA, 22 bp, Homo sapiens
tcactgcactccagcctgggtg

SEQ ID NO: 7613833 - DNA, 22 bp, Homo sapiens
tcactgcactccagcctgggca

SEQ ID NO: 7613834 - DNA, 22 bp, Homo sapiens
tcactgcactccagcactcagg

SEQ ID NO: 7613835 - DNA, 22 bp, Homo sapiens
cagtggaggccttgggaccttt

SEQ ID NO: 7613836 - DNA, 22 bp, Homo sapiens
cagtggaggccttgggaccttt

SEQ ID NO: 7613837 - DNA, 22 bp, Homo sapiens
cagtggaggccttgggaccttt

SEQ ID NO: 7613838 - DNA, 22 bp, Homo sapiens
cagtggaggccttgggaccttt

SEQ ID NO: 7613839 - DNA, 19 bp, Homo sapiens
cagtggagattggaggagg

SEQ ID NO: 7613840 - DNA, 22 bp, Homo sapiens
cagtggaggccttgggaccttt

SEQ ID NO: 7613841 - DNA, 22 bp, Homo sapiens
cagtggaggctcaagtgtgctt

SEQ ID NO: 7613842 - DNA, 22 bp, Homo sapiens
cagtggagtgggactggtctga

SEQ ID NO: 7613843 - DNA, 22 bp, Homo sapiens
cagtggagtgggactggtctga

SEQ ID NO: 7613844 - DNA, 22 bp, Homo sapiens
cagtggagtgggactggtctga

SEQ ID NO: 7613845 - DNA, 22 bp, Homo sapiens
cagtggagtgggactggtctga

SEQ ID NO: 7613846 - DNA, 22 bp, Homo sapiens
cagtggagtgggactggtctga

SEQ ID NO: 7613847 - DNA, 22 bp, Homo sapiens
cagtggaggctcaagtgtgctt

SEQ ID NO: 7613848 - DNA, 22 bp, Homo sapiens
cagtggaggctcaagtgtgctt

SEQ ID NO: 7613849 - DNA, 22 bp, Homo sapiens
cagtggaggctcaagtgtgctt

SEQ ID NO: 7613850 - DNA, 22 bp, Homo sapiens
cagtggcaagtccggtattgaa

SEQ ID NO: 7613851 - DNA, 22 bp, Homo sapiens
cagtggcaaggacagtaataat

SEQ ID NO: 7613852 - DNA, 22 bp, Homo sapiens
cagtggcaagtccggtattgaa

SEQ ID NO: 7613853 - DNA, 22 bp, Homo sapiens
cagtggcaagtccggtattgaa

SEQ ID NO: 7613854 - DNA, 22 bp, Homo sapiens
cagtggcaagtccggtattgaa

SEQ ID NO: 7613855 - DNA, 22 bp, Homo sapiens
cagtggcaagaacagtaataat

SEQ ID NO: 7613856 - DNA, 22 bp, Homo sapiens
cagtggattagccagagctgga

SEQ ID NO: 7613857 - DNA, 22 bp, Homo sapiens
cagtggcaatgggacagagcac

SEQ ID NO: 7613858 - DNA, 22 bp, Homo sapiens
cagtggcaatgggacagagcac

SEQ ID NO: 7613859 - DNA, 22 bp, Homo sapiens
cagtggcaatgggacagagcac

SEQ ID NO: 7613860 - DNA, 22 bp, Homo sapiens
cagtggcaatgggacagagcac

SEQ ID NO: 7613861 - DNA, 22 bp, Homo sapiens
cagtggcaatgggacagagcac

SEQ ID NO: 7613862 - DNA, 22 bp, Homo sapiens
tcacatgcttgaggaaagaaaa

SEQ ID NO: 7613863 - DNA, 22 bp, Homo sapiens
tcacatgtactgtctgtgacat

SEQ ID NO: 7613864 - DNA, 22 bp, Homo sapiens
tcacatggcgagctttaaaata

SEQ ID NO: 7613865 - DNA, 22 bp, Homo sapiens
tcacatgtactgtctgtgacat

SEQ ID NO: 7613866 - DNA, 22 bp, Homo sapiens
tcacatgtactgtctgtgacat

SEQ ID NO: 7613867 - DNA, 22 bp, Homo sapiens
tcacatgtatatgcagcacagc

SEQ ID NO: 7613868 - DNA, 22 bp, Homo sapiens
tcacatgtatatgcagcacagc

SEQ ID NO: 7613869 - DNA, 19 bp, Homo sapiens
cagtggagattggaggagg

SEQ ID NO: 7613870 - DNA, 19 bp, Homo sapiens
cagtggagattggaggagg

SEQ ID NO: 7613871 - DNA, 19 bp, Homo sapiens
cagtggagattggaggagg

SEQ ID NO: 7613872 - DNA, 19 bp, Homo sapiens
cagtggagattggaggagg

SEQ ID NO: 7613873 - DNA, 22 bp, Homo sapiens
cagtggagaggcatgcttggca

SEQ ID NO: 7613874 - DNA, 22 bp, Homo sapiens
cagtggagaggcatgcttggca

SEQ ID NO: 7613875 - DNA, 19 bp, Homo sapiens
cagtggagattggaggagg

SEQ ID NO: 7613876 - DNA, 19 bp, Homo sapiens
cagtggagattggaggagg

SEQ ID NO: 7613877 - DNA, 19 bp, Homo sapiens
cagtggagattggaggagg

SEQ ID NO: 7613878 - DNA, 19 bp, Homo sapiens
cagtggagattggaggagg

SEQ ID NO: 7613879 - DNA, 22 bp, Homo sapiens
cagtgctgttgtaagctcattg

SEQ ID NO: 7613880 - DNA, 22 bp, Homo sapiens
cagtgctgttgtaagctcattg

SEQ ID NO: 7613881 - DNA, 22 bp, Homo sapiens
cagtgctgttgtaagctcattg

SEQ ID NO: 7613882 - DNA, 22 bp, Homo sapiens
tcacactgtgaagagacaagca

SEQ ID NO: 7613883 - DNA, 22 bp, Homo sapiens
tcacactgtgaagagacaagca

SEQ ID NO: 7613884 - DNA, 22 bp, Homo sapiens
tcacactgtgaagagacaagca

SEQ ID NO: 7613885 - DNA, 23 bp, Homo sapiens
tcacactggatacacatgcaaga

SEQ ID NO: 7613886 - DNA, 23 bp, Homo sapiens
tcacactggatacacatgcaaga

SEQ ID NO: 7613887 - DNA, 22 bp, Homo sapiens
tcacactaggatgttgtttcta

SEQ ID NO: 7613888 - DNA, 22 bp, Homo sapiens
tcacactaggatgttgtttcta

SEQ ID NO: 7613889 - DNA, 22 bp, Homo sapiens
tcacactaggatgttgtttcta

SEQ ID NO: 7613890 - DNA, 23 bp, Homo sapiens
tcacactatgaagtgtgttatcc

SEQ ID NO: 7613891 - DNA, 22 bp, Homo sapiens
tcacactctgcgggtgaccttt

SEQ ID NO: 7613892 - DNA, 22 bp, Homo sapiens
tcacactggcagtgctgaaggc

SEQ ID NO: 7613893 - DNA, 23 bp, Homo sapiens
tcacactggatacacatgcaaga

SEQ ID NO: 7613894 - DNA, 22 bp, Homo sapiens
tcacactggcagtgctgaaggc

SEQ ID NO: 7613895 - DNA, 22 bp, Homo sapiens
tcacactggcagtgctgaaggc

SEQ ID NO: 7613896 - DNA, 22 bp, Homo sapiens
tcacactgtgaagagacaagca

SEQ ID NO: 7613897 - DNA, 22 bp, Homo sapiens
tcacactaagacaaaataattt

SEQ ID NO: 7613898 - DNA, 22 bp, Homo sapiens
tcacactaagacaaaataattt

SEQ ID NO: 7613899 - DNA, 22 bp, Homo sapiens
tcacactaagacaaaataattt

SEQ ID NO: 7613900 - DNA, 22 bp, Homo sapiens
tcacactaagacaaaataattt

SEQ ID NO: 7613901 - DNA, 22 bp, Homo sapiens
tcacaccttgctggctgagtgc

SEQ ID NO: 7613902 - DNA, 22 bp, Homo sapiens
tcacaccttttagaattactat

SEQ ID NO: 7613903 - DNA, 22 bp, Homo sapiens
tcacaccagtttcctttcaatt

SEQ ID NO: 7613904 - DNA, 22 bp, Homo sapiens
tcacaccagtttcctttcaatt

SEQ ID NO: 7613905 - DNA, 22 bp, Homo sapiens
tcacacctgtaatcccaggcct

SEQ ID NO: 7613906 - DNA, 22 bp, Homo sapiens
cagtgcataatctaaatggggg

SEQ ID NO: 7613907 - DNA, 22 bp, Homo sapiens
cagtgcagtttcccagatgctg

SEQ ID NO: 7613908 - DNA, 22 bp, Homo sapiens
cagtgcagtttcccagatgctg

SEQ ID NO: 7613909 - DNA, 22 bp, Homo sapiens
cagtgcagtttcccagatgctg

SEQ ID NO: 7613910 - DNA, 22 bp, Homo sapiens
cagtgcagtttcccagatgctg

SEQ ID NO: 7613911 - DNA, 22 bp, Homo sapiens
cagtgcagtttcccagatgctg

SEQ ID NO: 7613912 - DNA, 22 bp, Homo sapiens
cagtgcagtttcccagatgctg

SEQ ID NO: 7613913 - DNA, 22 bp, Homo sapiens
tcacacatgtaagggctttgga

SEQ ID NO: 7613914 - DNA, 20 bp, Homo sapiens
tcacacatggtaagctatga

SEQ ID NO: 7613915 - DNA, 22 bp, Homo sapiens
cagtgcatagatcctgaggcct

SEQ ID NO: 7613916 - DNA, 22 bp, Homo sapiens
cagtgcatagatcctgaggcct

SEQ ID NO: 7613917 - DNA, 22 bp, Homo sapiens
cagtgcataatctaaatggggg

SEQ ID NO: 7613918 - DNA, 22 bp, Homo sapiens
cagtgcatagagagctcctgac

SEQ ID NO: 7613919 - DNA, 22 bp, Homo sapiens
cagtgcataccctttccctcat

SEQ ID NO: 7613920 - DNA, 22 bp, Homo sapiens
cagtgcataccctttccctcat

SEQ ID NO: 7613921 - DNA, 15 bp, Homo sapiens
cagtgcatacagtga

SEQ ID NO: 7613922 - DNA, 22 bp, Homo sapiens
tcacacattctaggtatgttga

SEQ ID NO: 7613923 - DNA, 16 bp, Homo sapiens
tcacacatttgttggt

SEQ ID NO: 7613924 - DNA, 22 bp, Homo sapiens
tcacaccaggagcagtgccaga

SEQ ID NO: 7613925 - DNA, 22 bp, Homo sapiens
tcacaccaggagcagtgccaga

SEQ ID NO: 7613926 - DNA, 22 bp, Homo sapiens
tcacaccaggagcagtgccaga

SEQ ID NO: 7613927 - DNA, 22 bp, Homo sapiens
tcacacatttgaaggcctgtca

SEQ ID NO: 7613928 - DNA, 22 bp, Homo sapiens
tcacacatttctcaagtgtagg

SEQ ID NO: 7613929 - DNA, 22 bp, Homo sapiens
cagtgcagaggtgcaagcatgt

SEQ ID NO: 7613930 - DNA, 22 bp, Homo sapiens
cagtgcagaggtgcaagcatgt

SEQ ID NO: 7613931 - DNA, 22 bp, Homo sapiens
cagtgcagaggtgcaagcatgt

SEQ ID NO: 7613932 - DNA, 22 bp, Homo sapiens
cagtgcaggtggcagaggacag

SEQ ID NO: 7613933 - DNA, 22 bp, Homo sapiens
cagtgcagaggtgcaagcatgt

SEQ ID NO: 7613934 - DNA, 22 bp, Homo sapiens
cagtgcagaggtgcaagcatgt

SEQ ID NO: 7613935 - DNA, 22 bp, Homo sapiens
cagtgcagaggtgcaagcatgt

SEQ ID NO: 7613936 - DNA, 22 bp, Homo sapiens
tcaacaaatacttaaagcagag

SEQ ID NO: 7613937 - DNA, 22 bp, Homo sapiens
cagtgcaggtttagggctgggg

SEQ ID NO: 7613938 - DNA, 22 bp, Homo sapiens
cagtgcaggtttagggctgggg

SEQ ID NO: 7613939 - DNA, 22 bp, Homo sapiens
cagtgcaggtttagggctgggg

SEQ ID NO: 7613940 - DNA, 22 bp, Homo sapiens
cagtgcaggtttagggctgggg

SEQ ID NO: 7613941 - DNA, 22 bp, Homo sapiens
cagtgcaggtttagggctgggg

SEQ ID NO: 7613942 - DNA, 22 bp, Homo sapiens
cagtgcaggtttagggctgggg

SEQ ID NO: 7613943 - DNA, 22 bp, Homo sapiens
cagtgcaggtggcagaggacag

SEQ ID NO: 7613944 - DNA, 22 bp, Homo sapiens
cagtgcaggtggcagaggacag

SEQ ID NO: 7613945 - DNA, 22 bp, Homo sapiens
cagtgcaggtggcagaggacag

SEQ ID NO: 7613946 - DNA, 22 bp, Homo sapiens
cagtgcaggtggcagaggacag

SEQ ID NO: 7613947 - DNA, 22 bp, Homo sapiens
cagtgcaggtggcagaggacag

SEQ ID NO: 7613948 - DNA, 22 bp, Homo sapiens
cagtgcaggtggcagaggacag

SEQ ID NO: 7613949 - DNA, 22 bp, Homo sapiens
cagtgcaggtggcagaggacag

SEQ ID NO: 7613950 - DNA, 22 bp, Homo sapiens
cagtgcagttggtggcaggggt

SEQ ID NO: 7613951 - DNA, 22 bp, Homo sapiens
cagtgcagttggtggcaggggt

SEQ ID NO: 7613952 - DNA, 22 bp, Homo sapiens
cagtgcagttggtggcaggggt

SEQ ID NO: 7613953 - DNA, 22 bp, Homo sapiens
cagtgcagttggtggcaggggt

SEQ ID NO: 7613954 - DNA, 22 bp, Homo sapiens
cagtgcagttggtggcaggggt

SEQ ID NO: 7613955 - DNA, 22 bp, Homo sapiens
cagtgcagttggtggcaggggt

SEQ ID NO: 7613956 - DNA, 22 bp, Homo sapiens
cagtgcagtcaaggaagaacca

SEQ ID NO: 7613957 - DNA, 22 bp, Homo sapiens
cagtgcagtcaaggaagaacca

SEQ ID NO: 7613958 - DNA, 22 bp, Homo sapiens
cagtgcagtcaaggaagaacca

SEQ ID NO: 7613959 - DNA, 22 bp, Homo sapiens
cagtgcagtcaaggaagaacca

SEQ ID NO: 7613960 - DNA, 22 bp, Homo sapiens
cagtgcagtcaaggaagaacca

SEQ ID NO: 7613961 - DNA, 22 bp, Homo sapiens
cagtgcaggtttagggctgggg

SEQ ID NO: 7613962 - DNA, 22 bp, Homo sapiens
cagtgcaggtttagggctgggg

SEQ ID NO: 7613963 - DNA, 22 bp, Homo sapiens
tagtaacaacaactagcatttt

SEQ ID NO: 7613964 - DNA, 22 bp, Homo sapiens
tagtaaattaaaatattgactt

SEQ ID NO: 7613965 - DNA, 22 bp, Homo sapiens
tagtaaattaaaatattgactt

SEQ ID NO: 7613966 - DNA, 22 bp, Homo sapiens
tagtaaattaaaatattgactt

SEQ ID NO: 7613967 - DNA, 22 bp, Homo sapiens
tagtaaattaaaatattgactt

SEQ ID NO: 7613968 - DNA, 22 bp, Homo sapiens
tagtaaattaaaatattgactt

SEQ ID NO: 7613969 - DNA, 22 bp, Homo sapiens
tagtaaattaaaatattgactt

SEQ ID NO: 7613970 - DNA, 22 bp, Homo sapiens
tagtaaatgtgaaatgtgggga

SEQ ID NO: 7613971 - DNA, 17 bp, Homo sapiens
tagtaaatgagtagagc

SEQ ID NO: 7613972 - DNA, 17 bp, Homo sapiens
tagtaaatgagtagagc

SEQ ID NO: 7613973 - DNA, 17 bp, Homo sapiens
tagtaaatgagtagagc

SEQ ID NO: 7613974 - DNA, 22 bp, Homo sapiens
tagtaaatctcagaaaaagatc

SEQ ID NO: 7613975 - DNA, 22 bp, Homo sapiens
tagtaaatacacagtggaaaaa

SEQ ID NO: 7613976 - DNA, 22 bp, Homo sapiens
tagtaaatctcagaaaaagatc

SEQ ID NO: 7613977 - DNA, 22 bp, Homo sapiens
tagtaaatctcagaaaaagatc

SEQ ID NO: 7613978 - DNA, 22 bp, Homo sapiens
tagtaaatctcagaaaaagatc

SEQ ID NO: 7613979 - DNA, 22 bp, Homo sapiens
taggtatacagagatttctggg

SEQ ID NO: 7613980 - DNA, 22 bp, Homo sapiens
taggtatacagagatttctggg

SEQ ID NO: 7613981 - DNA, 22 bp, Homo sapiens
tagtaacccacacaacagtaga

SEQ ID NO: 7613982 - DNA, 22 bp, Homo sapiens
tagtaactctacacacgacact

SEQ ID NO: 7613983 - DNA, 22 bp, Homo sapiens
tagtaacccacacaacagtaga

SEQ ID NO: 7613984 - DNA, 22 bp, Homo sapiens
tagtaacagatttatacagtct

SEQ ID NO: 7613985 - DNA, 22 bp, Homo sapiens
tagtaacagcagcttccctgtg

SEQ ID NO: 7613986 - DNA, 22 bp, Homo sapiens
tagtaacagatttatacagtct

SEQ ID NO: 7613987 - DNA, 22 bp, Homo sapiens
tagtaacagatttatacagtct

SEQ ID NO: 7613988 - DNA, 22 bp, Homo sapiens
tagtaacaacaactagcatttt

SEQ ID NO: 7613989 - DNA, 22 bp, Homo sapiens
tagtaacacactggtatttgga

SEQ ID NO: 7613990 - DNA, 22 bp, Homo sapiens
tagtaacacactggtatttgga

SEQ ID NO: 7613991 - DNA, 22 bp, Homo sapiens
tagtaacacattgaacgatcgc

SEQ ID NO: 7613992 - DNA, 22 bp, Homo sapiens
tagtaagtagctaatatttact

SEQ ID NO: 7613993 - DNA, 22 bp, Homo sapiens
tagtaagttctcgcattgttat

SEQ ID NO: 7613994 - DNA, 22 bp, Homo sapiens
tagtaataagttgtgctttgat

SEQ ID NO: 7613995 - DNA, 22 bp, Homo sapiens
tagtaataagttgtgctttgat

SEQ ID NO: 7613996 - DNA, 22 bp, Homo sapiens
tagtaatcagaggtaaacttta

SEQ ID NO: 7613997 - DNA, 22 bp, Homo sapiens
tagtaataagttgtgctttgat

SEQ ID NO: 7613998 - DNA, 22 bp, Homo sapiens
tagtaataagttgtgctttgat

SEQ ID NO: 7613999 - DNA, 22 bp, Homo sapiens
tagtaagcctctccagagacag

SEQ ID NO: 7614000 - DNA, 22 bp, Homo sapiens
tagtaaggaggacactgtgcct

SEQ ID NO: 7614001 - DNA, 22 bp, Homo sapiens
tagtaaggaggacactgtgcct

SEQ ID NO: 7614002 - DNA, 22 bp, Homo sapiens
tagtaacttttgttataaatca

SEQ ID NO: 7614003 - DNA, 22 bp, Homo sapiens
tagtaagagaatgcttgtttct

SEQ ID NO: 7614004 - DNA, 22 bp, Homo sapiens
tagtaagcacatggacaagtgg

SEQ ID NO: 7614005 - DNA, 22 bp, Homo sapiens
tagtaactggttgaacaactgt

SEQ ID NO: 7614006 - DNA, 22 bp, Homo sapiens
tagtaactggttgaacaactgt

SEQ ID NO: 7614007 - DNA, 22 bp, Homo sapiens
cagggccaagttggtgcctttt

SEQ ID NO: 7614008 - DNA, 22 bp, Homo sapiens
cagggccaagttggtgcctttt

SEQ ID NO: 7614009 - DNA, 22 bp, Homo sapiens
cagggccaagctgcagcatctg

SEQ ID NO: 7614010 - DNA, 22 bp, Homo sapiens
cagggccaagctgcagcatctg

SEQ ID NO: 7614011 - DNA, 22 bp, Homo sapiens
cagggccaagctgcagcatctg

SEQ ID NO: 7614012 - DNA, 21 bp, Homo sapiens
cagggccaatcctgacctcta

SEQ ID NO: 7614013 - DNA, 21 bp, Homo sapiens
cagggccaatcctgacctcta

SEQ ID NO: 7614014 - DNA, 22 bp, Homo sapiens
cagggccaagttggtgcctttt

SEQ ID NO: 7614015 - DNA, 22 bp, Homo sapiens
cagggccaagttggtgcctttt

SEQ ID NO: 7614016 - DNA, 22 bp, Homo sapiens
cagggccaagttggtgcctttt

SEQ ID NO: 7614017 - DNA, 22 bp, Homo sapiens
cagggccaagttggtgcctttt

SEQ ID NO: 7614018 - DNA, 21 bp, Homo sapiens
cagggccaatcctgacctcta

SEQ ID NO: 7614019 - DNA, 21 bp, Homo sapiens
cagggccaatcctgacctcta

SEQ ID NO: 7614020 - DNA, 21 bp, Homo sapiens
cagggccaatcctgacctcta

SEQ ID NO: 7614021 - DNA, 21 bp, Homo sapiens
cagggccaatcctgacctcta

SEQ ID NO: 7614022 - DNA, 21 bp, Homo sapiens
cagggccaatcctgacctcta

SEQ ID NO: 7614023 - DNA, 21 bp, Homo sapiens
cagggccaatcctgacctcta

SEQ ID NO: 7614024 - DNA, 22 bp, Homo sapiens
cagggccacacggaagggaaca

SEQ ID NO: 7614025 - DNA, 22 bp, Homo sapiens
cagggccacacggaagggaaca

SEQ ID NO: 7614026 - DNA, 22 bp, Homo sapiens
cagggccacacggaagggaaca

SEQ ID NO: 7614027 - DNA, 22 bp, Homo sapiens
cagggccaccctctgctgggtg

SEQ ID NO: 7614028 - DNA, 22 bp, Homo sapiens
cagggccaccctctgctgggtg

SEQ ID NO: 7614029 - DNA, 22 bp, Homo sapiens
cagggccaccctctgctgggtg

SEQ ID NO: 7614030 - DNA, 22 bp, Homo sapiens
cagggccaccgtgtttgctgct

SEQ ID NO: 7614031 - DNA, 22 bp, Homo sapiens
cagggccaccctctgctgggtg

SEQ ID NO: 7614032 - DNA, 22 bp, Homo sapiens
cagggccaccctctgctgggtg

SEQ ID NO: 7614033 - DNA, 22 bp, Homo sapiens
cagggccaccctctgctgggtg

SEQ ID NO: 7614034 - DNA, 20 bp, Homo sapiens
cagggccacgctccaaggca

SEQ ID NO: 7614035 - DNA, 20 bp, Homo sapiens
cagggccacgctccaaggca

SEQ ID NO: 7614036 - DNA, 20 bp, Homo sapiens
cagggccacgctccaaggca

SEQ ID NO: 7614037 - DNA, 22 bp, Homo sapiens
taggtaggtggaaaagtaattg

SEQ ID NO: 7614038 - DNA, 20 bp, Homo sapiens
cagggccacgctccaaggca

SEQ ID NO: 7614039 - DNA, 22 bp, Homo sapiens
taggtaggtgtcataatccatg

SEQ ID NO: 7614040 - DNA, 22 bp, Homo sapiens
cagggccactgcatgaggttca

SEQ ID NO: 7614041 - DNA, 22 bp, Homo sapiens
taggtagttacacagcaatgta

SEQ ID NO: 7614042 - DNA, 22 bp, Homo sapiens
taggtataatattttgaagaaa

SEQ ID NO: 7614043 - DNA, 22 bp, Homo sapiens
taggtagtttcctgttgttggg

SEQ ID NO: 7614044 - DNA, 22 bp, Homo sapiens
tagtacagtggcattcaaactt

SEQ ID NO: 7614045 - DNA, 22 bp, Homo sapiens
tagtacagtggagagcaaagaa

SEQ ID NO: 7614046 - DNA, 22 bp, Homo sapiens
tagtacagtggagagcaaagaa

SEQ ID NO: 7614047 - DNA, 22 bp, Homo sapiens
tagtacagtggagagcaaagaa

SEQ ID NO: 7614048 - DNA, 22 bp, Homo sapiens
tagtacagtggagagcaaagaa

SEQ ID NO: 7614049 - DNA, 22 bp, Homo sapiens
tagtacagagacactggaggaa

SEQ ID NO: 7614050 - DNA, 22 bp, Homo sapiens
tagtacagagacactggaggaa

SEQ ID NO: 7614051 - DNA, 22 bp, Homo sapiens
tagtacagagacactggaggaa

SEQ ID NO: 7614052 - DNA, 22 bp, Homo sapiens
tagtacagtactgggctctagt

SEQ ID NO: 7614053 - DNA, 19 bp, Homo sapiens
tagtacacactctaattcc

SEQ ID NO: 7614054 - DNA, 19 bp, Homo sapiens
tagtacacactctaattcc

SEQ ID NO: 7614055 - DNA, 22 bp, Homo sapiens
tagtaatgattgtatcttgtcc

SEQ ID NO: 7614056 - DNA, 22 bp, Homo sapiens
tagtaatcagaggtaaacttta

SEQ ID NO: 7614057 - DNA, 22 bp, Homo sapiens
tagtacactaccatcaggtttt

SEQ ID NO: 7614058 - DNA, 19 bp, Homo sapiens
tagtacacactctaattcc

SEQ ID NO: 7614059 - DNA, 19 bp, Homo sapiens
tagtacacactctaattcc

SEQ ID NO: 7614060 - DNA, 22 bp, Homo sapiens
tagtacactctgtaagtttaaa

SEQ ID NO: 7614061 - DNA, 22 bp, Homo sapiens
tagtacagaaaacctcagggtc

SEQ ID NO: 7614062 - DNA, 22 bp, Homo sapiens
tagtacagaaaacctcagggtc

SEQ ID NO: 7614063 - DNA, 22 bp, Homo sapiens
tagtacagaattaataattgtg

SEQ ID NO: 7614064 - DNA, 22 bp, Homo sapiens
tagtacagaattaataattgtg

SEQ ID NO: 7614065 - DNA, 22 bp, Homo sapiens
cagggctgagaatttagagaca

SEQ ID NO: 7614066 - DNA, 22 bp, Homo sapiens
cagggctgagaatttagagaca

SEQ ID NO: 7614067 - DNA, 22 bp, Homo sapiens
tagtacagttccatcaaagcag

SEQ ID NO: 7614068 - DNA, 22 bp, Homo sapiens
cagggctgagaatttagagaca

SEQ ID NO: 7614069 - DNA, 22 bp, Homo sapiens
cagggctgaggacacaagtaaa

SEQ ID NO: 7614070 - DNA, 22 bp, Homo sapiens
cagggctgaggacacaagtaaa

SEQ ID NO: 7614071 - DNA, 22 bp, Homo sapiens
cagggctgaggacacaagtaaa

SEQ ID NO: 7614072 - DNA, 22 bp, Homo sapiens
cagggctgaggacacaagtaaa

SEQ ID NO: 7614073 - DNA, 22 bp, Homo sapiens
cagggctgctggccgtgccctc

SEQ ID NO: 7614074 - DNA, 22 bp, Homo sapiens
cagggctgagtcatatagcctt

SEQ ID NO: 7614075 - DNA, 22 bp, Homo sapiens
cagggctgagtcatatagcctt

SEQ ID NO: 7614076 - DNA, 22 bp, Homo sapiens
cagggctgagtcatatagcctt

SEQ ID NO: 7614077 - DNA, 22 bp, Homo sapiens
cagggctgaggacacaagtaaa

SEQ ID NO: 7614078 - DNA, 22 bp, Homo sapiens
cagggctgaggacacaagtaaa

SEQ ID NO: 7614079 - DNA, 22 bp, Homo sapiens
cagggctgagtcatatagcctt

SEQ ID NO: 7614080 - DNA, 22 bp, Homo sapiens
cagggctgagtcatatagcctt

SEQ ID NO: 7614081 - DNA, 22 bp, Homo sapiens
cagggctggatcctccagactc

SEQ ID NO: 7614082 - DNA, 22 bp, Homo sapiens
cagggctggatcctccagactc

SEQ ID NO: 7614083 - DNA, 22 bp, Homo sapiens
cagggctggatcctccagactc

SEQ ID NO: 7614084 - DNA, 22 bp, Homo sapiens
cagggctggatcctccagactc

SEQ ID NO: 7614085 - DNA, 22 bp, Homo sapiens
cagggctggatcctccagactc

SEQ ID NO: 7614086 - DNA, 22 bp, Homo sapiens
cagggctggatcctccagactc

SEQ ID NO: 7614087 - DNA, 22 bp, Homo sapiens
cagggctggatcctccagactc

SEQ ID NO: 7614088 - DNA, 22 bp, Homo sapiens
cagggctgctggccgtgccctc

SEQ ID NO: 7614089 - DNA, 22 bp, Homo sapiens
cagggctgctggccgtgccctc

SEQ ID NO: 7614090 - DNA, 22 bp, Homo sapiens
cagggctgctggccgtgccctc

SEQ ID NO: 7614091 - DNA, 22 bp, Homo sapiens
cagggctgctggccgtgccctc

SEQ ID NO: 7614092 - DNA, 22 bp, Homo sapiens
cagggctggatcctccagactc

SEQ ID NO: 7614093 - DNA, 22 bp, Homo sapiens
cagggctgctggccgtgccctc

SEQ ID NO: 7614094 - DNA, 22 bp, Homo sapiens
cagggctgctggccgtgccctc

SEQ ID NO: 7614095 - DNA, 22 bp, Homo sapiens
cagggctggatttcatttctag

SEQ ID NO: 7614096 - DNA, 22 bp, Homo sapiens
tagtgattctgtgagcctttac

SEQ ID NO: 7614097 - DNA, 22 bp, Homo sapiens
tagtgattgctgatattccatt

SEQ ID NO: 7614098 - DNA, 22 bp, Homo sapiens
tagtgattgctgatattccatt

SEQ ID NO: 7614099 - DNA, 23 bp, Homo sapiens
tagtgattggaaaaactagtttt

SEQ ID NO: 7614100 - DNA, 23 bp, Homo sapiens
tagtgattggaaaaactagtttt

SEQ ID NO: 7614101 - DNA, 22 bp, Homo sapiens
tagtgatttaagaaaggtgact

SEQ ID NO: 7614102 - DNA, 22 bp, Homo sapiens
tagtgatttaatggcaagagga

SEQ ID NO: 7614103 - DNA, 22 bp, Homo sapiens
tagtgatttagaattcaaatgt

SEQ ID NO: 7614104 - DNA, 22 bp, Homo sapiens
tagtgatttcagtgggttttgc

SEQ ID NO: 7614105 - DNA, 22 bp, Homo sapiens
tagtgatttccatttcagggtt

SEQ ID NO: 7614106 - DNA, 22 bp, Homo sapiens
tagtgattttcatattacatta

SEQ ID NO: 7614107 - DNA, 22 bp, Homo sapiens
tagtgattttcatattacatta

SEQ ID NO: 7614108 - DNA, 22 bp, Homo sapiens
tagtgtctgaatgcacctgttt

SEQ ID NO: 7614109 - DNA, 22 bp, Homo sapiens
tagtgtctcttcctgtttgaaa

SEQ ID NO: 7614110 - DNA, 22 bp, Homo sapiens
tagtgtctcggggcccaggatt

SEQ ID NO: 7614111 - DNA, 22 bp, Homo sapiens
tagtgtctattgaccggaaaga

SEQ ID NO: 7614112 - DNA, 22 bp, Homo sapiens
tagtgtctcggggcccaggatt

SEQ ID NO: 7614113 - DNA, 22 bp, Homo sapiens
tagtgtctcttcctgtttgaaa

SEQ ID NO: 7614114 - DNA, 22 bp, Homo sapiens
tagtgtctattgaccggaaaga

SEQ ID NO: 7614115 - DNA, 22 bp, Homo sapiens
tagtgtctagtgagtttgatgc

SEQ ID NO: 7614116 - DNA, 20 bp, Homo sapiens
tagtgcaaaggcagccatag

SEQ ID NO: 7614117 - DNA, 22 bp, Homo sapiens
tagtgattttctgtttccatca

SEQ ID NO: 7614118 - DNA, 22 bp, Homo sapiens
tagttttagcagcaatgggatg

SEQ ID NO: 7614119 - DNA, 22 bp, Homo sapiens
tagttttagcagcaatgggatg

SEQ ID NO: 7614120 - DNA, 22 bp, Homo sapiens
tagttttagtcccattttacag

SEQ ID NO: 7614121 - DNA, 22 bp, Homo sapiens
tagttttagtcccattttacag

SEQ ID NO: 7614122 - DNA, 22 bp, Homo sapiens
tagttttagtcccattttacag

SEQ ID NO: 7614123 - DNA, 22 bp, Homo sapiens
tagttttagtcccattttacag

SEQ ID NO: 7614124 - DNA, 22 bp, Homo sapiens
tagttttagtcccattttacag

SEQ ID NO: 7614125 - DNA, 22 bp, Homo sapiens
tatacatcagtatgtttagata

SEQ ID NO: 7614126 - DNA, 22 bp, Homo sapiens
tatacatcagtatgtttagata

SEQ ID NO: 7614127 - DNA, 21 bp, Homo sapiens
tatacatgtgcacacacatgc

SEQ ID NO: 7614128 - DNA, 22 bp, Homo sapiens
tatataactactattttgctca

SEQ ID NO: 7614129 - DNA, 21 bp, Homo sapiens
tatacatgtgtgcatacgtgt

SEQ ID NO: 7614130 - DNA, 21 bp, Homo sapiens
tatacatgtgtgcatacgtgt

SEQ ID NO: 7614131 - DNA, 21 bp, Homo sapiens
tatacatgtgtgcatacgtgt

SEQ ID NO: 7614132 - DNA, 21 bp, Homo sapiens
tatacatgtgcacacacatgc

SEQ ID NO: 7614133 - DNA, 21 bp, Homo sapiens
tatacatgtgcacacacatgc

SEQ ID NO: 7614134 - DNA, 22 bp, Homo sapiens
tatataactactattttgctca

SEQ ID NO: 7614135 - DNA, 22 bp, Homo sapiens
tatataactactattttgctca

SEQ ID NO: 7614136 - DNA, 22 bp, Homo sapiens
tatataactactattttgctca

SEQ ID NO: 7614137 - DNA, 22 bp, Homo sapiens
tatataatttgtaaaagcacct

SEQ ID NO: 7614138 - DNA, 22 bp, Homo sapiens
tatataatttgtaaaagcacct

SEQ ID NO: 7614139 - DNA, 22 bp, Homo sapiens
tatataatttgtaaaagcacct

SEQ ID NO: 7614140 - DNA, 22 bp, Homo sapiens
tatataatttgtaaaagcacct

SEQ ID NO: 7614141 - DNA, 22 bp, Homo sapiens
tatataatttgtaaaagcacct

SEQ ID NO: 7614142 - DNA, 22 bp, Homo sapiens
tatataatttgtaaaagcacct

SEQ ID NO: 7614143 - DNA, 22 bp, Homo sapiens
tatataattttctgccatatcc

SEQ ID NO: 7614144 - DNA, 22 bp, Homo sapiens
tatataattttctgccatatcc

SEQ ID NO: 7614145 - DNA, 22 bp, Homo sapiens
tatataattttctgccatatcc

SEQ ID NO: 7614146 - DNA, 22 bp, Homo sapiens
tatataattttctgccatatcc

SEQ ID NO: 7614147 - DNA, 22 bp, Homo sapiens
tatataattttctgccatatcc

SEQ ID NO: 7614148 - DNA, 22 bp, Homo sapiens
tatataattttctgccatatcc

SEQ ID NO: 7614149 - DNA, 22 bp, Homo sapiens
tatataattttctgccatatcc

SEQ ID NO: 7614150 - DNA, 22 bp, Homo sapiens
tatatacaaggtaggtttaggt

SEQ ID NO: 7614151 - DNA, 22 bp, Homo sapiens
tatatacaaggtaggtttaggt

SEQ ID NO: 7614152 - DNA, 22 bp, Homo sapiens
tatatacaaggtaggtttaggt

SEQ ID NO: 7614153 - DNA, 22 bp, Homo sapiens
tatatacaaggtaggtttaggt

SEQ ID NO: 7614154 - DNA, 22 bp, Homo sapiens
tatatacaaggtaggtttaggt

SEQ ID NO: 7614155 - DNA, 22 bp, Homo sapiens
tatatacaaggtaggtttaggt

SEQ ID NO: 7614156 - DNA, 22 bp, Homo sapiens
tatataattttctgccatatcc

SEQ ID NO: 7614157 - DNA, 22 bp, Homo sapiens
tatataattttctgccatatcc

SEQ ID NO: 7614158 - DNA, 22 bp, Homo sapiens
tatatacaaggtaggtttaggt

SEQ ID NO: 7614159 - DNA, 22 bp, Homo sapiens
tatatacaaggtaggtttaggt

SEQ ID NO: 7614160 - DNA, 22 bp, Homo sapiens
tatatacaaggtaggtttaggt

SEQ ID NO: 7614161 - DNA, 22 bp, Homo sapiens
tatattcaatgattagtatcag

SEQ ID NO: 7614162 - DNA, 22 bp, Homo sapiens
tatattcaatgattagtatcag

SEQ ID NO: 7614163 - DNA, 22 bp, Homo sapiens
tatattcaatgattagtatcag

SEQ ID NO: 7614164 - DNA, 22 bp, Homo sapiens
tatattcaatgattagtatcag

SEQ ID NO: 7614165 - DNA, 22 bp, Homo sapiens
tatatatatgcacacacaccta

SEQ ID NO: 7614166 - DNA, 22 bp, Homo sapiens
tatatatatgcacacacaccta

SEQ ID NO: 7614167 - DNA, 22 bp, Homo sapiens
tatatatatgcacacacaccta

SEQ ID NO: 7614168 - DNA, 22 bp, Homo sapiens
tatatatatgcacacacaccta

SEQ ID NO: 7614169 - DNA, 22 bp, Homo sapiens
tatatatatgcacacacaccta

SEQ ID NO: 7614170 - DNA, 22 bp, Homo sapiens
tatatatatgcacacacaccta

SEQ ID NO: 7614171 - DNA, 22 bp, Homo sapiens
tatatatatgcacacacaccta

SEQ ID NO: 7614172 - DNA, 22 bp, Homo sapiens
tatattcattttaaagccatct

SEQ ID NO: 7614173 - DNA, 22 bp, Homo sapiens
tatattcattttaaagccatct

SEQ ID NO: 7614174 - DNA, 22 bp, Homo sapiens
tatattcatattgttgtctctc

SEQ ID NO: 7614175 - DNA, 22 bp, Homo sapiens
tatattcatattgttgtctctc

SEQ ID NO: 7614176 - DNA, 22 bp, Homo sapiens
tatattcacttgtgtccaacca

SEQ ID NO: 7614177 - DNA, 22 bp, Homo sapiens
tatattcaatgattagtatcag

SEQ ID NO: 7614178 - DNA, 22 bp, Homo sapiens
tatattcaatgattagtatcag

SEQ ID NO: 7614179 - DNA, 22 bp, Homo sapiens
tatatagaaaagcagatgttgg

SEQ ID NO: 7614180 - DNA, 22 bp, Homo sapiens
tatatagaaaagcagatgttgg

SEQ ID NO: 7614181 - DNA, 20 bp, Homo sapiens
tatataggaaatattgtgtt

SEQ ID NO: 7614182 - DNA, 22 bp, Homo sapiens
tatatatatgcacacacaccta

SEQ ID NO: 7614183 - DNA, 19 bp, Homo sapiens
tatatagatgtgtgtgtat

SEQ ID NO: 7614184 - DNA, 22 bp, Homo sapiens
tatatactatgcgattcctgcc

SEQ ID NO: 7614185 - DNA, 18 bp, Homo sapiens
tatatagagaaacccatt

SEQ ID NO: 7614186 - DNA, 19 bp, Homo sapiens
tatatagatgtgtgtgtat

SEQ ID NO: 7614187 - DNA, 22 bp, Homo sapiens
tatatagctaaaagagatattg

SEQ ID NO: 7614188 - DNA, 22 bp, Homo sapiens
tatatacaaggtaggtttaggt

SEQ ID NO: 7614189 - DNA, 22 bp, Homo sapiens
tatatacaaggtaggtttaggt

SEQ ID NO: 7614190 - DNA, 22 bp, Homo sapiens
tatatactttcttcctgggtag

SEQ ID NO: 7614191 - DNA, 22 bp, Homo sapiens
tatatagaaaagcagatgttgg

SEQ ID NO: 7614192 - DNA, 22 bp, Homo sapiens
tagtgtggtatcttctatggaa

SEQ ID NO: 7614193 - DNA, 22 bp, Homo sapiens
tagtgtgtatggtaatgatgaa

SEQ ID NO: 7614194 - DNA, 22 bp, Homo sapiens
tagtgtgtatggtaatgatgaa

SEQ ID NO: 7614195 - DNA, 22 bp, Homo sapiens
tagtgtgtccctggggagtgtt

SEQ ID NO: 7614196 - DNA, 22 bp, Homo sapiens
tagtgtgtccctggggagtgtt

SEQ ID NO: 7614197 - DNA, 22 bp, Homo sapiens
tagtgttccagaagcaaacaag

SEQ ID NO: 7614198 - DNA, 22 bp, Homo sapiens
tagtgtgtccctggggagtgtt

SEQ ID NO: 7614199 - DNA, 22 bp, Homo sapiens
tagtgtgtgggcttcagggact

SEQ ID NO: 7614200 - DNA, 22 bp, Homo sapiens
tagtgtgtggtctctcccttgt

SEQ ID NO: 7614201 - DNA, 22 bp, Homo sapiens
tagtgtgtggtctctcccttgt

SEQ ID NO: 7614202 - DNA, 22 bp, Homo sapiens
tagtttctagacagtaagaatt

SEQ ID NO: 7614203 - DNA, 22 bp, Homo sapiens
tagtttctagtcaatcttcttt

SEQ ID NO: 7614204 - DNA, 22 bp, Homo sapiens
tagtttctagtcaatcttcttt

SEQ ID NO: 7614205 - DNA, 22 bp, Homo sapiens
tagtttctagtaacaaacccat

SEQ ID NO: 7614206 - DNA, 22 bp, Homo sapiens
tagtgttctaagaacatccatg

SEQ ID NO: 7614207 - DNA, 22 bp, Homo sapiens
tagtgttctaagaacatccatg

SEQ ID NO: 7614208 - DNA, 22 bp, Homo sapiens
tagtttctagacagtaagaatt

SEQ ID NO: 7614209 - DNA, 22 bp, Homo sapiens
tagtgtctgacatttaagagca

SEQ ID NO: 7614210 - DNA, 22 bp, Homo sapiens
tagtgtctgaatgcacctgttt

SEQ ID NO: 7614211 - DNA, 22 bp, Homo sapiens
tagtgtctgacatttaagagca

SEQ ID NO: 7614212 - DNA, 22 bp, Homo sapiens
tagtgtctgatccgtagttaca

SEQ ID NO: 7614213 - DNA, 22 bp, Homo sapiens
tagtgtctgacatttaagagca

SEQ ID NO: 7614214 - DNA, 21 bp, Homo sapiens
tagtgtcttaagagccttgca

SEQ ID NO: 7614215 - DNA, 22 bp, Homo sapiens
tagtgtctgttgcttttgttca

SEQ ID NO: 7614216 - DNA, 22 bp, Homo sapiens
tagtgtctgtccatcagtaact

SEQ ID NO: 7614217 - DNA, 22 bp, Homo sapiens
tagtgtcttcaggagatatgag

SEQ ID NO: 7614218 - DNA, 22 bp, Homo sapiens
tagtgtcttcaggagatatgag

SEQ ID NO: 7614219 - DNA, 22 bp, Homo sapiens
tagtgtcttccaggacatggta

SEQ ID NO: 7614220 - DNA, 22 bp, Homo sapiens
tagtgtcttccaggacatggta

SEQ ID NO: 7614221 - DNA, 22 bp, Homo sapiens
tagtgtggccccaagaggatct

SEQ ID NO: 7614222 - DNA, 22 bp, Homo sapiens
tagtgtcttccaggacatggta

SEQ ID NO: 7614223 - DNA, 22 bp, Homo sapiens
tagtgtggtatcttctatggaa

SEQ ID NO: 7614224 - DNA, 22 bp, Homo sapiens
tagtgtggtaaataaatgtttt

SEQ ID NO: 7614225 - DNA, 22 bp, Homo sapiens
tagtgtggccccaagaggatct

SEQ ID NO: 7614226 - DNA, 22 bp, Homo sapiens
tagtgtggccccaagaggatct

SEQ ID NO: 7614227 - DNA, 22 bp, Homo sapiens
tagtgtggtaaataaatgtttt

SEQ ID NO: 7614228 - DNA, 22 bp, Homo sapiens
tagtttcttcacctgtaaaatg

SEQ ID NO: 7614229 - DNA, 22 bp, Homo sapiens
tagtttcttcacctgtaaaatg

SEQ ID NO: 7614230 - DNA, 22 bp, Homo sapiens
tagtttctggttcttgctctgg

SEQ ID NO: 7614231 - DNA, 22 bp, Homo sapiens
tagtttctggttcttgctctgg

SEQ ID NO: 7614232 - DNA, 22 bp, Homo sapiens
tagtttcttgattagccacttt

SEQ ID NO: 7614233 - DNA, 22 bp, Homo sapiens
tagtttcttgattagccacttt

SEQ ID NO: 7614234 - DNA, 22 bp, Homo sapiens
tagtttcttcacctgtaaaatg

SEQ ID NO: 7614235 - DNA, 22 bp, Homo sapiens
tagtttctgcctcggaagctga

SEQ ID NO: 7614236 - DNA, 22 bp, Homo sapiens
tagtttctgggttggcttctac

SEQ ID NO: 7614237 - DNA, 22 bp, Homo sapiens
tagtttctgaggattgaaagat

SEQ ID NO: 7614238 - DNA, 22 bp, Homo sapiens
tagtttctgaggattgaaagat

SEQ ID NO: 7614239 - DNA, 22 bp, Homo sapiens
tagtttctgaggattgaaagat

SEQ ID NO: 7614240 - DNA, 22 bp, Homo sapiens
tagtttctgaggattgaaagat

SEQ ID NO: 7614241 - DNA, 22 bp, Homo sapiens
tagtttctgaggattgaaagat

SEQ ID NO: 7614242 - DNA, 22 bp, Homo sapiens
tagtttctcagggaggaaagaa

SEQ ID NO: 7614243 - DNA, 22 bp, Homo sapiens
tagtttctagtcaatcttcttt

SEQ ID NO: 7614244 - DNA, 22 bp, Homo sapiens
tagtttctcagggaggaaagaa

SEQ ID NO: 7614245 - DNA, 22 bp, Homo sapiens
tagttttagcagcaatgggatg

SEQ ID NO: 7614246 - DNA, 22 bp, Homo sapiens
tagttttagcagcaatgggatg

SEQ ID NO: 7614247 - DNA, 22 bp, Homo sapiens
tagttttagcagcaatgggatg

SEQ ID NO: 7614248 - DNA, 22 bp, Homo sapiens
tagttttagcagcaatgggatg

SEQ ID NO: 7614249 - DNA, 22 bp, Homo sapiens
tagttttacttgcgatgataat

SEQ ID NO: 7614250 - DNA, 22 bp, Homo sapiens
tagttttacttgcgatgataat

SEQ ID NO: 7614251 - DNA, 22 bp, Homo sapiens
tagttttacttgcgatgataat

SEQ ID NO: 7614252 - DNA, 22 bp, Homo sapiens
tagttttacttgcgatgataat

SEQ ID NO: 7614253 - DNA, 22 bp, Homo sapiens
tagttttacttgcgatgataat

SEQ ID NO: 7614254 - DNA, 22 bp, Homo sapiens
tagttttacttgcgatgataat

SEQ ID NO: 7614255 - DNA, 22 bp, Homo sapiens
tagttttacttgcgatgataat

SEQ ID NO: 7614256 - DNA, 22 bp, Homo sapiens
tagttttacttgcgatgataat

SEQ ID NO: 7614257 - DNA, 22 bp, Homo sapiens
tagttttacttgcgatgataat

SEQ ID NO: 7614258 - DNA, 22 bp, Homo sapiens
tagttttacatcagccattgtt

SEQ ID NO: 7614259 - DNA, 22 bp, Homo sapiens
tagttttacttgcgatgataat

SEQ ID NO: 7614260 - DNA, 22 bp, Homo sapiens
tagttttacttgcgatgataat

SEQ ID NO: 7614261 - DNA, 22 bp, Homo sapiens
tagttttacttgcgatgataat

SEQ ID NO: 7614262 - DNA, 22 bp, Homo sapiens
tagtttgtcaaccactgtcaca

SEQ ID NO: 7614263 - DNA, 22 bp, Homo sapiens
tagtttgtcaaccactgtcaca

SEQ ID NO: 7614264 - DNA, 22 bp, Homo sapiens
tagttttacatcagccattgtt

SEQ ID NO: 7614265 - DNA, 22 bp, Homo sapiens
tagtttgtcaaccactgtcaca

SEQ ID NO: 7614266 - DNA, 22 bp, Homo sapiens
tagttttacatcagccattgtt

SEQ ID NO: 7614267 - DNA, 22 bp, Homo sapiens
tagttttacatcagccattgtt

SEQ ID NO: 7614268 - DNA, 22 bp, Homo sapiens
tagttttacatcagccattgtt

SEQ ID NO: 7614269 - DNA, 22 bp, Homo sapiens
tagtttgagaattgaaatagaa

SEQ ID NO: 7614270 - DNA, 22 bp, Homo sapiens
tagtttctttcacgtagtaata

SEQ ID NO: 7614271 - DNA, 22 bp, Homo sapiens
tagtttgagaattgaaatagaa

SEQ ID NO: 7614272 - DNA, 22 bp, Homo sapiens
tagtttgtagaaatctagaaat

SEQ ID NO: 7614273 - DNA, 22 bp, Homo sapiens
caggtggggcgccctcaggcag

SEQ ID NO: 7614274 - DNA, 22 bp, Homo sapiens
caggtggggcgccctcaggcag

SEQ ID NO: 7614275 - DNA, 22 bp, Homo sapiens
caggtggggcgccctcaggcag

SEQ ID NO: 7614276 - DNA, 22 bp, Homo sapiens
caggtggggcgccctcaggcag

SEQ ID NO: 7614277 - DNA, 22 bp, Homo sapiens
caggtggggcgccctcaggcag

SEQ ID NO: 7614278 - DNA, 22 bp, Homo sapiens
caggtggggcgccctcaggcag

SEQ ID NO: 7614279 - DNA, 22 bp, Homo sapiens
caggtggggcgccctcaggcag

SEQ ID NO: 7614280 - DNA, 22 bp, Homo sapiens
caggtggggcgccctcaggcag

SEQ ID NO: 7614281 - DNA, 22 bp, Homo sapiens
caggtggggggcttccgagcct

SEQ ID NO: 7614282 - DNA, 22 bp, Homo sapiens
caggtggggggcttccgagcct

SEQ ID NO: 7614283 - DNA, 22 bp, Homo sapiens
tatgtacatcgttgaattcaaa

SEQ ID NO: 7614284 - DNA, 22 bp, Homo sapiens
tatgtacatcgttgaattcaaa

SEQ ID NO: 7614285 - DNA, 22 bp, Homo sapiens
tatgtacatcgttgaattcaaa

SEQ ID NO: 7614286 - DNA, 22 bp, Homo sapiens
tatgtacatcgttgaattcaaa

SEQ ID NO: 7614287 - DNA, 22 bp, Homo sapiens
tatgtacatcgttgaattcaaa

SEQ ID NO: 7614288 - DNA, 22 bp, Homo sapiens
tatgtacatcgttgaattcaaa

SEQ ID NO: 7614289 - DNA, 22 bp, Homo sapiens
caggtggggggcttccgagcct

SEQ ID NO: 7614290 - DNA, 22 bp, Homo sapiens
tatgtacatcgttgaattcaaa

SEQ ID NO: 7614291 - DNA, 22 bp, Homo sapiens
caggtggggcgccctcaggcag

SEQ ID NO: 7614292 - DNA, 22 bp, Homo sapiens
caggtggggcgccctcaggcag

SEQ ID NO: 7614293 - DNA, 22 bp, Homo sapiens
caggtggggcagctgtgggagc

SEQ ID NO: 7614294 - DNA, 22 bp, Homo sapiens
caggtggggcagctgtgggagc

SEQ ID NO: 7614295 - DNA, 22 bp, Homo sapiens
caggtggggcagctgtgggagc

SEQ ID NO: 7614296 - DNA, 22 bp, Homo sapiens
caggtggggcagctgtgggagc

SEQ ID NO: 7614297 - DNA, 22 bp, Homo sapiens
caggtggggcagctgtgggagc

SEQ ID NO: 7614298 - DNA, 22 bp, Homo sapiens
caggtggggagagtgtggagca

SEQ ID NO: 7614299 - DNA, 22 bp, Homo sapiens
caggtggggagagtgtggagca

SEQ ID NO: 7614300 - DNA, 22 bp, Homo sapiens
caggtggggagagtgtggagca

SEQ ID NO: 7614301 - DNA, 22 bp, Homo sapiens
caggtggggagagtgtggagca

SEQ ID NO: 7614302 - DNA, 22 bp, Homo sapiens
caggtggggcagctgtgggagc

SEQ ID NO: 7614303 - DNA, 22 bp, Homo sapiens
caggtggggcagctgtgggagc

SEQ ID NO: 7614304 - DNA, 22 bp, Homo sapiens
caggtggggcagctgtgggagc

SEQ ID NO: 7614305 - DNA, 22 bp, Homo sapiens
caggtggggcagctgtgggagc

SEQ ID NO: 7614306 - DNA, 22 bp, Homo sapiens
caggtggggcagctgtgggagc

SEQ ID NO: 7614307 - DNA, 22 bp, Homo sapiens
caggtggcttattagggtcagt

SEQ ID NO: 7614308 - DNA, 22 bp, Homo sapiens
caggtggcttattagggtcagt

SEQ ID NO: 7614309 - DNA, 22 bp, Homo sapiens
caggtggcttattagggtcagt

SEQ ID NO: 7614310 - DNA, 22 bp, Homo sapiens
caggtggcttagtcccatttta

SEQ ID NO: 7614311 - DNA, 22 bp, Homo sapiens
caggtggcttattagggtcagt

SEQ ID NO: 7614312 - DNA, 22 bp, Homo sapiens
tatgcacacatgtatgcatgtg

SEQ ID NO: 7614313 - DNA, 22 bp, Homo sapiens
tatgcacacatgtatgcatgtg

SEQ ID NO: 7614314 - DNA, 22 bp, Homo sapiens
tatgcacacatgtatgcatgtg

SEQ ID NO: 7614315 - DNA, 22 bp, Homo sapiens
tatgcacacatcgcagcaggaa

SEQ ID NO: 7614316 - DNA, 22 bp, Homo sapiens
tatgcacacatgtatgcatgtg

SEQ ID NO: 7614317 - DNA, 22 bp, Homo sapiens
caggtggcttagtcccatttta

SEQ ID NO: 7614318 - DNA, 22 bp, Homo sapiens
caggtggcttagtcccatttta

SEQ ID NO: 7614319 - DNA, 22 bp, Homo sapiens
caggtgggcgtggcgagaaggc

SEQ ID NO: 7614320 - DNA, 22 bp, Homo sapiens
caggtgggcgtggcgagaaggc

SEQ ID NO: 7614321 - DNA, 22 bp, Homo sapiens
caggtgggcgtggcgagaaggc

SEQ ID NO: 7614322 - DNA, 22 bp, Homo sapiens
caggtgggcgtggcgagaaggc

SEQ ID NO: 7614323 - DNA, 22 bp, Homo sapiens
caggtgggcgtggcgagaaggc

SEQ ID NO: 7614324 - DNA, 22 bp, Homo sapiens
caggtgggcgtggcgagaaggc

SEQ ID NO: 7614325 - DNA, 22 bp, Homo sapiens
caggtggcttattagggtcagt

SEQ ID NO: 7614326 - DNA, 22 bp, Homo sapiens
caggtgggccggggtttgttct

SEQ ID NO: 7614327 - DNA, 22 bp, Homo sapiens
caggtgggcgtggcgagaaggc

SEQ ID NO: 7614328 - DNA, 22 bp, Homo sapiens
caggtgggctgcctctccagct

SEQ ID NO: 7614329 - DNA, 22 bp, Homo sapiens
caggtgggctgcctctccagct

SEQ ID NO: 7614330 - DNA, 22 bp, Homo sapiens
caggtgggctgcctctccagct

SEQ ID NO: 7614331 - DNA, 22 bp, Homo sapiens
caggtgggctgcctctccagct

SEQ ID NO: 7614332 - DNA, 22 bp, Homo sapiens
caggtgggctgcctctccagct

SEQ ID NO: 7614333 - DNA, 22 bp, Homo sapiens
caggtgggcttgggagaacact

SEQ ID NO: 7614334 - DNA, 22 bp, Homo sapiens
caggtgggcttgggagaacact

SEQ ID NO: 7614335 - DNA, 22 bp, Homo sapiens
caggtgggctgcctctccagct

SEQ ID NO: 7614336 - DNA, 22 bp, Homo sapiens
caggtgggcttgggagaacact

SEQ ID NO: 7614337 - DNA, 22 bp, Homo sapiens
caggtgggcttgggagaacact

SEQ ID NO: 7614338 - DNA, 22 bp, Homo sapiens
caggtggggagagtgtggagca

SEQ ID NO: 7614339 - DNA, 22 bp, Homo sapiens
caggtggggagagtgtggagca

SEQ ID NO: 7614340 - DNA, 22 bp, Homo sapiens
caggtggggagagtgtggagca

SEQ ID NO: 7614341 - DNA, 22 bp, Homo sapiens
caggtggggagagtgtggagca

SEQ ID NO: 7614342 - DNA, 22 bp, Homo sapiens
caggtggggagagtgtggagca

SEQ ID NO: 7614343 - DNA, 22 bp, Homo sapiens
caggtggggagagtgtggagca

SEQ ID NO: 7614344 - DNA, 22 bp, Homo sapiens
caggtggggagagtgtggagca

SEQ ID NO: 7614345 - DNA, 22 bp, Homo sapiens
caggtgggcttgggagaacact

SEQ ID NO: 7614346 - DNA, 22 bp, Homo sapiens
caggtgggcttgggagaacact

SEQ ID NO: 7614347 - DNA, 22 bp, Homo sapiens
caggtgggcttgggagaacact

SEQ ID NO: 7614348 - DNA, 22 bp, Homo sapiens
cagtactaagactccacctagc

SEQ ID NO: 7614349 - DNA, 22 bp, Homo sapiens
cagtaccagtcaccacattgat

SEQ ID NO: 7614350 - DNA, 22 bp, Homo sapiens
cagtacatttcatatgattcta

SEQ ID NO: 7614351 - DNA, 22 bp, Homo sapiens
cagtactcccagaacaaaccct

SEQ ID NO: 7614352 - DNA, 22 bp, Homo sapiens
cagtactgcttgtgggagcaga

SEQ ID NO: 7614353 - DNA, 22 bp, Homo sapiens
cagtacataatgcgcaaaaccg

SEQ ID NO: 7614354 - DNA, 22 bp, Homo sapiens
cagtacataatgcgcaaaaccg

SEQ ID NO: 7614355 - DNA, 22 bp, Homo sapiens
cagtacagtaaagcaagctgaa

SEQ ID NO: 7614356 - DNA, 22 bp, Homo sapiens
cagtacatttcatatgattcta

SEQ ID NO: 7614357 - DNA, 22 bp, Homo sapiens
cagtacatttcatatgattcta

SEQ ID NO: 7614358 - DNA, 22 bp, Homo sapiens
cagtacatttcatatgattcta

SEQ ID NO: 7614359 - DNA, 22 bp, Homo sapiens
cagtactggctcattgtgctgt

SEQ ID NO: 7614360 - DNA, 22 bp, Homo sapiens
cagtactggctcattgtgctgt

SEQ ID NO: 7614361 - DNA, 22 bp, Homo sapiens
cagtactaagactccacctagc

SEQ ID NO: 7614362 - DNA, 22 bp, Homo sapiens
cagtacttatttctatttaggg

SEQ ID NO: 7614363 - DNA, 22 bp, Homo sapiens
cagtaaaagatggaaatagaat

SEQ ID NO: 7614364 - DNA, 22 bp, Homo sapiens
cagtaaaagatggaaatagaat

SEQ ID NO: 7614365 - DNA, 22 bp, Homo sapiens
cagtaatagcagagtcttccat

SEQ ID NO: 7614366 - DNA, 22 bp, Homo sapiens
cagtaatagcagagtcttccat

SEQ ID NO: 7614367 - DNA, 22 bp, Homo sapiens
cagtaattccaagtgcttatac

SEQ ID NO: 7614368 - DNA, 22 bp, Homo sapiens
cagtaatgggcaagacaatatg

SEQ ID NO: 7614369 - DNA, 22 bp, Homo sapiens
cagtaatattttactctaggcc

SEQ ID NO: 7614370 - DNA, 22 bp, Homo sapiens
cagtaataggtaacattgccct

SEQ ID NO: 7614371 - DNA, 22 bp, Homo sapiens
cagtaataggtaacattgccct

SEQ ID NO: 7614372 - DNA, 22 bp, Homo sapiens
cagtaatatctgttgaagctat

SEQ ID NO: 7614373 - DNA, 22 bp, Homo sapiens
cagtaatatctgttgaagctat

SEQ ID NO: 7614374 - DNA, 22 bp, Homo sapiens
cagtaatatctgttgaagctat

SEQ ID NO: 7614375 - DNA, 22 bp, Homo sapiens
cagtaatattttactctaggcc

SEQ ID NO: 7614376 - DNA, 22 bp, Homo sapiens
cagtaatattttactctaggcc

SEQ ID NO: 7614377 - DNA, 23 bp, Homo sapiens
cagtacaatgtggaaaaggagtg

SEQ ID NO: 7614378 - DNA, 22 bp, Homo sapiens
cagtacaatgttgaaaaggagt

SEQ ID NO: 7614379 - DNA, 22 bp, Homo sapiens
cagtacaagaggccacctgccc

SEQ ID NO: 7614380 - DNA, 22 bp, Homo sapiens
cagtaattccaagtgcttatac

SEQ ID NO: 7614381 - DNA, 22 bp, Homo sapiens
cagtacaggctgccttgtccaa

SEQ ID NO: 7614382 - DNA, 22 bp, Homo sapiens
cagtacaggctgccttgtccaa

SEQ ID NO: 7614383 - DNA, 22 bp, Homo sapiens
cagtacagtaaagcaagctgaa

SEQ ID NO: 7614384 - DNA, 22 bp, Homo sapiens
cagtacagtaaagcaagctgaa

SEQ ID NO: 7614385 - DNA, 22 bp, Homo sapiens
cagtacagtaaagcaagctgaa

SEQ ID NO: 7614386 - DNA, 22 bp, Homo sapiens
cagtacacaagctttcatgtat

SEQ ID NO: 7614387 - DNA, 22 bp, Homo sapiens
cagtacaatgttgaaaaggagt

SEQ ID NO: 7614388 - DNA, 22 bp, Homo sapiens
tatgtacatcttgagcaatgaa

SEQ ID NO: 7614389 - DNA, 22 bp, Homo sapiens
tatgtacatcttgagcaatgaa

SEQ ID NO: 7614390 - DNA, 22 bp, Homo sapiens
tatgtacatcttgagcaatgaa

SEQ ID NO: 7614391 - DNA, 22 bp, Homo sapiens
tatgtacatcttgagcaatgaa

SEQ ID NO: 7614392 - DNA, 22 bp, Homo sapiens
tatgtacatcgttgaattcaaa

SEQ ID NO: 7614393 - DNA, 22 bp, Homo sapiens
tatgtacatcgttgaattcaaa

SEQ ID NO: 7614394 - DNA, 22 bp, Homo sapiens
tatgtacatcttgagcaatgaa

SEQ ID NO: 7614395 - DNA, 22 bp, Homo sapiens
tatgtacatcttgagcaatgaa

SEQ ID NO: 7614396 - DNA, 22 bp, Homo sapiens
tatgtacatcttgagcaatgaa

SEQ ID NO: 7614397 - DNA, 22 bp, Homo sapiens
tatgtacatgatttcatttgct

SEQ ID NO: 7614398 - DNA, 22 bp, Homo sapiens
tatgtacatgatttcatttgct

SEQ ID NO: 7614399 - DNA, 22 bp, Homo sapiens
tatgtacatgatttcatttgct

SEQ ID NO: 7614400 - DNA, 22 bp, Homo sapiens
tatgtacatgatttcatttgct

SEQ ID NO: 7614401 - DNA, 22 bp, Homo sapiens
tatgtacatgatttcatttgct

SEQ ID NO: 7614402 - DNA, 22 bp, Homo sapiens
tatgtacatgatttcatttgct

SEQ ID NO: 7614403 - DNA, 22 bp, Homo sapiens
tatgtacatgatttcatttgct

SEQ ID NO: 7614404 - DNA, 22 bp, Homo sapiens
tatgtacatcttgagcaatgaa

SEQ ID NO: 7614405 - DNA, 22 bp, Homo sapiens
tatgtacatgatttcatttgct

SEQ ID NO: 7614406 - DNA, 22 bp, Homo sapiens
tatgtacatggagagcaattga

SEQ ID NO: 7614407 - DNA, 22 bp, Homo sapiens
tatgtacatggagagcaattga

SEQ ID NO: 7614408 - DNA, 22 bp, Homo sapiens
tatgtacatggagagcaattga

SEQ ID NO: 7614409 - DNA, 22 bp, Homo sapiens
tatgtacatggagagcaattga

SEQ ID NO: 7614410 - DNA, 22 bp, Homo sapiens
tatgtacatggagagcaattga

SEQ ID NO: 7614411 - DNA, 22 bp, Homo sapiens
tatgtacatgatttcatttgct

SEQ ID NO: 7614412 - DNA, 22 bp, Homo sapiens
tatgtacatggagagcaattga

SEQ ID NO: 7614413 - DNA, 22 bp, Homo sapiens
tatgtacatggagagcaattga

SEQ ID NO: 7614414 - DNA, 22 bp, Homo sapiens
tatgtacatggagagcaattga

SEQ ID NO: 7614415 - DNA, 22 bp, Homo sapiens
cagtaaaagatggaaatagaat

SEQ ID NO: 7614416 - DNA, 22 bp, Homo sapiens
cagtaaaagatggaaatagaat

SEQ ID NO: 7614417 - DNA, 22 bp, Homo sapiens
cagtaaaagatggaaatagaat

SEQ ID NO: 7614418 - DNA, 22 bp, Homo sapiens
cagtaaaagatggaaatagaat

SEQ ID NO: 7614419 - DNA, 22 bp, Homo sapiens
cagtaaaagatggaaatagaat

SEQ ID NO: 7614420 - DNA, 22 bp, Homo sapiens
cagtaaaagatggaaatagaat

SEQ ID NO: 7614421 - DNA, 22 bp, Homo sapiens
cagtaaaagatggaaatagaat

SEQ ID NO: 7614422 - DNA, 22 bp, Homo sapiens
tatgtacatgttaaagggcaaa

SEQ ID NO: 7614423 - DNA, 22 bp, Homo sapiens
tatgtacatgttaaagggcaaa

SEQ ID NO: 7614424 - DNA, 22 bp, Homo sapiens
tatgtacatgttaaagggcaaa

SEQ ID NO: 7614425 - DNA, 22 bp, Homo sapiens
tatgaacatgttcattgactta

SEQ ID NO: 7614426 - DNA, 21 bp, Homo sapiens
tatgaacatgaccaatagtcc

SEQ ID NO: 7614427 - DNA, 21 bp, Homo sapiens
tatgaacatgaccaatagtcc

SEQ ID NO: 7614428 - DNA, 22 bp, Homo sapiens
tatgaacatgctgtggttataa

SEQ ID NO: 7614429 - DNA, 22 bp, Homo sapiens
tatgaacatgctgtggttataa

SEQ ID NO: 7614430 - DNA, 22 bp, Homo sapiens
tatgaacattgaagaggagccc

SEQ ID NO: 7614431 - DNA, 22 bp, Homo sapiens
tatgaacattgaagaggagccc

SEQ ID NO: 7614432 - DNA, 22 bp, Homo sapiens
tatgaacattttggtatatatg

SEQ ID NO: 7614433 - DNA, 22 bp, Homo sapiens
tatgaacattttggtatatatg

SEQ ID NO: 7614434 - DNA, 22 bp, Homo sapiens
tatgaacattttggtatatatg

SEQ ID NO: 7614435 - DNA, 22 bp, Homo sapiens
tatgaacattatttttgtctag

SEQ ID NO: 7614436 - DNA, 22 bp, Homo sapiens
tatgaacattatttttgtctag

SEQ ID NO: 7614437 - DNA, 22 bp, Homo sapiens
tatctgtagtctcatggttcct

SEQ ID NO: 7614438 - DNA, 22 bp, Homo sapiens
tatctgtatccccatctagcta

SEQ ID NO: 7614439 - DNA, 22 bp, Homo sapiens
tatctgtagtcagaataatttt

SEQ ID NO: 7614440 - DNA, 22 bp, Homo sapiens
tatgaacacttattggggaagg

SEQ ID NO: 7614441 - DNA, 22 bp, Homo sapiens
tatgaacacttattggggaagg

SEQ ID NO: 7614442 - DNA, 21 bp, Homo sapiens
tatgaacatgaccaatagtcc

SEQ ID NO: 7614443 - DNA, 23 bp, Homo sapiens
tatctgtatttgttcactgctgt

SEQ ID NO: 7614444 - DNA, 22 bp, Homo sapiens
tatgaactgctcttgtgttttg

SEQ ID NO: 7614445 - DNA, 23 bp, Homo sapiens
tatgaactgcattgctggtgtgt

SEQ ID NO: 7614446 - DNA, 22 bp, Homo sapiens
tatgaactagctgatttagttt

SEQ ID NO: 7614447 - DNA, 22 bp, Homo sapiens
tatgaactgtgagtgtgatggg

SEQ ID NO: 7614448 - DNA, 22 bp, Homo sapiens
tatgaactgtactgtactaagc

SEQ ID NO: 7614449 - DNA, 22 bp, Homo sapiens
tatgaactgtgagtgtgatggg

SEQ ID NO: 7614450 - DNA, 22 bp, Homo sapiens
tatgaagaaatctttgaaaatc

SEQ ID NO: 7614451 - DNA, 22 bp, Homo sapiens
tatgaagaagacaaatgacact

SEQ ID NO: 7614452 - DNA, 22 bp, Homo sapiens
tatgaacttttgatgtgacatg

SEQ ID NO: 7614453 - DNA, 22 bp, Homo sapiens
tatgaacttttgatgtgacatg

SEQ ID NO: 7614454 - DNA, 22 bp, Homo sapiens
tatgaagaaacctatcctctag

SEQ ID NO: 7614455 - DNA, 22 bp, Homo sapiens
tatattccagttcatctcttga

SEQ ID NO: 7614456 - DNA, 22 bp, Homo sapiens
tatattccagttcatctcttga

SEQ ID NO: 7614457 - DNA, 22 bp, Homo sapiens
tatattctattgtacctctcct

SEQ ID NO: 7614458 - DNA, 22 bp, Homo sapiens
tatattcattttaaagccatct

SEQ ID NO: 7614459 - DNA, 22 bp, Homo sapiens
tatattcattttaaagccatct

SEQ ID NO: 7614460 - DNA, 22 bp, Homo sapiens
tatattcattttaaagccatct

SEQ ID NO: 7614461 - DNA, 22 bp, Homo sapiens
tatattcattttaaagccatct

SEQ ID NO: 7614462 - DNA, 22 bp, Homo sapiens
tatattcattttaaagccatct

SEQ ID NO: 7614463 - DNA, 22 bp, Homo sapiens
tatattccagttcatctcttga

SEQ ID NO: 7614464 - DNA, 22 bp, Homo sapiens
tatattctgattccatctgtgt

SEQ ID NO: 7614465 - DNA, 22 bp, Homo sapiens
tatattctattgtacctctcct

SEQ ID NO: 7614466 - DNA, 22 bp, Homo sapiens
tatattctgattccatctgtgt

SEQ ID NO: 7614467 - DNA, 22 bp, Homo sapiens
tatattctgattccatctgtgt

SEQ ID NO: 7614468 - DNA, 22 bp, Homo sapiens
tatattctgattccatctgtgt

SEQ ID NO: 7614469 - DNA, 18 bp, Homo sapiens
tatattctgtgccctggt

SEQ ID NO: 7614470 - DNA, 22 bp, Homo sapiens
tatattctgattccatctgtgt

SEQ ID NO: 7614471 - DNA, 18 bp, Homo sapiens
tatattctgtgccctggt

SEQ ID NO: 7614472 - DNA, 22 bp, Homo sapiens
tatattcttaccagtgtatgta

SEQ ID NO: 7614473 - DNA, 22 bp, Homo sapiens
tatattgaccagtacaattggt

SEQ ID NO: 7614474 - DNA, 22 bp, Homo sapiens
tatattgagatttgagcattgt

SEQ ID NO: 7614475 - DNA, 22 bp, Homo sapiens
tatattgaccagtacaattggt

SEQ ID NO: 7614476 - DNA, 22 bp, Homo sapiens
tatattgaaatgattcagccct

SEQ ID NO: 7614477 - DNA, 22 bp, Homo sapiens
tatattcttaccagtgtatgta

SEQ ID NO: 7614478 - DNA, 22 bp, Homo sapiens
tatattctttcaccttcttcct

SEQ ID NO: 7614479 - DNA, 22 bp, Homo sapiens
tatattctttcaccttcttcct

SEQ ID NO: 7614480 - DNA, 22 bp, Homo sapiens
tatattctttcaccttcttcct

SEQ ID NO: 7614481 - DNA, 22 bp, Homo sapiens
tatattgtaggtgctatttgaa

SEQ ID NO: 7614482 - DNA, 22 bp, Homo sapiens
tatattgtaggtgctatttgaa

SEQ ID NO: 7614483 - DNA, 22 bp, Homo sapiens
tatattgtaggtgctatttgaa

SEQ ID NO: 7614484 - DNA, 22 bp, Homo sapiens
tatattgtagctgatgacaaat

SEQ ID NO: 7614485 - DNA, 22 bp, Homo sapiens
tatattgggacttcaggacttt

SEQ ID NO: 7614486 - DNA, 22 bp, Homo sapiens
tatattgtagctgatgacaaat

SEQ ID NO: 7614487 - DNA, 22 bp, Homo sapiens
tatattgtagctgatgacaaat

SEQ ID NO: 7614488 - DNA, 22 bp, Homo sapiens
tatattgactttaaagaagcaa

SEQ ID NO: 7614489 - DNA, 22 bp, Homo sapiens
tatattgctagtggtactgtaa

SEQ ID NO: 7614490 - DNA, 22 bp, Homo sapiens
tatgaagaagacaaatgacact

SEQ ID NO: 7614491 - DNA, 19 bp, Homo sapiens
tatgaagaatgtggcaaag

SEQ ID NO: 7614492 - DNA, 22 bp, Homo sapiens
tatgaagaagttctgtgaaatg

SEQ ID NO: 7614493 - DNA, 22 bp, Homo sapiens
tatgaagaaatctttgaaaatc

SEQ ID NO: 7614494 - DNA, 22 bp, Homo sapiens
tatgaagaagacaaatgacact

SEQ ID NO: 7614495 - DNA, 22 bp, Homo sapiens
tatgaagaagttctgtgaaatg

SEQ ID NO: 7614496 - DNA, 22 bp, Homo sapiens
tatgaagatatatctgatctct

SEQ ID NO: 7614497 - DNA, 22 bp, Homo sapiens
tatgaagatatatctgatctct

SEQ ID NO: 7614498 - DNA, 22 bp, Homo sapiens
tatgaagactcatttattgggt

SEQ ID NO: 7614499 - DNA, 22 bp, Homo sapiens
tatgaagacaatgatagcatga

SEQ ID NO: 7614500 - DNA, 22 bp, Homo sapiens
tatgaagacaatgatagcatga

SEQ ID NO: 7614501 - DNA, 22 bp, Homo sapiens
tatgaagacaatgatagcatga

SEQ ID NO: 7614502 - DNA, 22 bp, Homo sapiens
tatgatattctaaattgacacc

SEQ ID NO: 7614503 - DNA, 22 bp, Homo sapiens
tatgatgggaggaatggaattt

SEQ ID NO: 7614504 - DNA, 22 bp, Homo sapiens
tatgatattctaaattgacacc

SEQ ID NO: 7614505 - DNA, 23 bp, Homo sapiens
tatgatcatgatattgcagggga

SEQ ID NO: 7614506 - DNA, 23 bp, Homo sapiens
tatgatcatgatattgcagggga

SEQ ID NO: 7614507 - DNA, 22 bp, Homo sapiens
tatgatatgcactttatcagaa

SEQ ID NO: 7614508 - DNA, 22 bp, Homo sapiens
tatgatatgcactttatcagaa

SEQ ID NO: 7614509 - DNA, 22 bp, Homo sapiens
tatgatatgcactttatcagaa

SEQ ID NO: 7614510 - DNA, 20 bp, Homo sapiens
tatgaagatatgtgaacagc

SEQ ID NO: 7614511 - DNA, 22 bp, Homo sapiens
tatgaagatatatctgatctct

SEQ ID NO: 7614512 - DNA, 22 bp, Homo sapiens
tatgaagatatatctgatctct

SEQ ID NO: 7614513 - DNA, 22 bp, Homo sapiens
tatgaagatatatctgatctct

SEQ ID NO: 7614514 - DNA, 22 bp, Homo sapiens
tatgcaaacagttcaggtgaca

SEQ ID NO: 7614515 - DNA, 22 bp, Homo sapiens
tatgcaaacagttcaggtgaca

SEQ ID NO: 7614516 - DNA, 22 bp, Homo sapiens
tatgcaaactaagttgtttcct

SEQ ID NO: 7614517 - DNA, 22 bp, Homo sapiens
tatgcaaactaagttgtttcct

SEQ ID NO: 7614518 - DNA, 22 bp, Homo sapiens
tatgcaaactaagttgtttcct

SEQ ID NO: 7614519 - DNA, 22 bp, Homo sapiens
tatgcaaactaagttgtttcct

SEQ ID NO: 7614520 - DNA, 22 bp, Homo sapiens
tatgcaaactaagttgtttcct

SEQ ID NO: 7614521 - DNA, 22 bp, Homo sapiens
tatgcaaagccacccagggacg

SEQ ID NO: 7614522 - DNA, 22 bp, Homo sapiens
tatgcaaagccacccagggacg

SEQ ID NO: 7614523 - DNA, 22 bp, Homo sapiens
tatgcaaagtcctaagaaagaa

SEQ ID NO: 7614524 - DNA, 22 bp, Homo sapiens
tatgcaaagtcctaagaaagaa

SEQ ID NO: 7614525 - DNA, 22 bp, Homo sapiens
tatgatttgtagacatttgatt

SEQ ID NO: 7614526 - DNA, 22 bp, Homo sapiens
tatgattaatattcttaaaatt

SEQ ID NO: 7614527 - DNA, 22 bp, Homo sapiens
tatgattaatattcttaaaatt

SEQ ID NO: 7614528 - DNA, 23 bp, Homo sapiens
tatgatggtatcaggagatgggg

SEQ ID NO: 7614529 - DNA, 22 bp, Homo sapiens
tatgatgtgtacctaagtcacc

SEQ ID NO: 7614530 - DNA, 22 bp, Homo sapiens
tatgatgtgtacctaagtcacc

SEQ ID NO: 7614531 - DNA, 22 bp, Homo sapiens
tatgcaaacagttcaggtgaca

SEQ ID NO: 7614532 - DNA, 22 bp, Homo sapiens
tatgatttgtagacatttgatt

SEQ ID NO: 7614533 - DNA, 22 bp, Homo sapiens
tatgcaaagtcctaagaaagaa

SEQ ID NO: 7614534 - DNA, 22 bp, Homo sapiens
tatgcaaagtcctaagaaagaa

SEQ ID NO: 7614535 - DNA, 22 bp, Homo sapiens
tatgcaaatcattagatttcct

SEQ ID NO: 7614536 - DNA, 22 bp, Homo sapiens
tatgcaaatcattagatttcct

SEQ ID NO: 7614537 - DNA, 22 bp, Homo sapiens
tatgcaaatcattagatttcct

SEQ ID NO: 7614538 - DNA, 22 bp, Homo sapiens
tatgcaaatcattagatttcct

SEQ ID NO: 7614539 - DNA, 22 bp, Homo sapiens
tatgcaaatcattagatttcct

SEQ ID NO: 7614540 - DNA, 22 bp, Homo sapiens
tatgcaaatcattagatttcct

SEQ ID NO: 7614541 - DNA, 22 bp, Homo sapiens
tatgcaaatcattagatttcct

SEQ ID NO: 7614542 - DNA, 22 bp, Homo sapiens
tatgcaaatgactggtatgttt

SEQ ID NO: 7614543 - DNA, 22 bp, Homo sapiens
tatgcaaatgactggtatgttt

SEQ ID NO: 7614544 - DNA, 22 bp, Homo sapiens
tatgcaaatgactggtatgttt

SEQ ID NO: 7614545 - DNA, 22 bp, Homo sapiens
tatgcaaatgactggtatgttt

SEQ ID NO: 7614546 - DNA, 22 bp, Homo sapiens
tatgcacacatcgcagcaggaa

SEQ ID NO: 7614547 - DNA, 22 bp, Homo sapiens
tatgcacacatcgcagcaggaa

SEQ ID NO: 7614548 - DNA, 22 bp, Homo sapiens
tatgcacacaggcttaattcat

SEQ ID NO: 7614549 - DNA, 22 bp, Homo sapiens
tatgcacacaggcttaattcat

SEQ ID NO: 7614550 - DNA, 22 bp, Homo sapiens
tatgcacaacatgcaggtttgt

SEQ ID NO: 7614551 - DNA, 22 bp, Homo sapiens
tatgcacaacatgcaggtttgt

SEQ ID NO: 7614552 - DNA, 22 bp, Homo sapiens
tatgcacaatatgatctatttg

SEQ ID NO: 7614553 - DNA, 22 bp, Homo sapiens
tatgcacaatatgatctatttg

SEQ ID NO: 7614554 - DNA, 22 bp, Homo sapiens
tatgcaattctcttaatattct

SEQ ID NO: 7614555 - DNA, 22 bp, Homo sapiens
tatgcaattctcttaatattct

SEQ ID NO: 7614556 - DNA, 22 bp, Homo sapiens
tatgcaattctcttaatattct

SEQ ID NO: 7614557 - DNA, 22 bp, Homo sapiens
tatgcaacagcattattacaat

SEQ ID NO: 7614558 - DNA, 22 bp, Homo sapiens
tatgcaacatctggtagaaatc

SEQ ID NO: 7614559 - DNA, 22 bp, Homo sapiens
tatgcaacagcattattacaat

SEQ ID NO: 7614560 - DNA, 22 bp, Homo sapiens
tatgcaaatgactggtatgttt

SEQ ID NO: 7614561 - DNA, 22 bp, Homo sapiens
cagggagatcttggctcctggt

SEQ ID NO: 7614562 - DNA, 22 bp, Homo sapiens
tagacaggagtcaggctagaat

SEQ ID NO: 7614563 - DNA, 22 bp, Homo sapiens
tagacaggagtcaggctagaat

SEQ ID NO: 7614564 - DNA, 22 bp, Homo sapiens
tagacagtgagctatgagtggt

SEQ ID NO: 7614565 - DNA, 22 bp, Homo sapiens
tagacagggtggcttagaaaca

SEQ ID NO: 7614566 - DNA, 22 bp, Homo sapiens
tagacagttaaactactggtgg

SEQ ID NO: 7614567 - DNA, 22 bp, Homo sapiens
tagacatacagtgcagtacata

SEQ ID NO: 7614568 - DNA, 22 bp, Homo sapiens
tagacataggaagtggaagctt

SEQ ID NO: 7614569 - DNA, 22 bp, Homo sapiens
tagacataggaagtggaagctt

SEQ ID NO: 7614570 - DNA, 23 bp, Homo sapiens
tagacataagctctgtcaccttc

SEQ ID NO: 7614571 - DNA, 22 bp, Homo sapiens
tagacatacagtgcagtacata

SEQ ID NO: 7614572 - DNA, 22 bp, Homo sapiens
tagacatagtttttatgactta

SEQ ID NO: 7614573 - DNA, 22 bp, Homo sapiens
tagacatattgtatttacttaa

SEQ ID NO: 7614574 - DNA, 22 bp, Homo sapiens
tagacattatgtattaagttct

SEQ ID NO: 7614575 - DNA, 22 bp, Homo sapiens
tagacattaggtaggttcatgg

SEQ ID NO: 7614576 - DNA, 22 bp, Homo sapiens
tagacatttctggttattgaca

SEQ ID NO: 7614577 - DNA, 22 bp, Homo sapiens
tagacatttgaatgtgaaatga

SEQ ID NO: 7614578 - DNA, 22 bp, Homo sapiens
tagacatttgtcaagaatgact

SEQ ID NO: 7614579 - DNA, 22 bp, Homo sapiens
tagacatttgtcaagaatgact

SEQ ID NO: 7614580 - DNA, 22 bp, Homo sapiens
tagacatttgtcaagaatgact

SEQ ID NO: 7614581 - DNA, 22 bp, Homo sapiens
tagacatttggcatggttttca

SEQ ID NO: 7614582 - DNA, 22 bp, Homo sapiens
tagacattggccattcctgtgg

SEQ ID NO: 7614583 - DNA, 22 bp, Homo sapiens
tagacatttagatatctcgctg

SEQ ID NO: 7614584 - DNA, 22 bp, Homo sapiens
tagacattaggtaggttcatgg

SEQ ID NO: 7614585 - DNA, 22 bp, Homo sapiens
tagacatttatctccatgtgga

SEQ ID NO: 7614586 - DNA, 22 bp, Homo sapiens
tagacatttctggttattgaca

SEQ ID NO: 7614587 - DNA, 22 bp, Homo sapiens
tagacatttctggttattgaca

SEQ ID NO: 7614588 - DNA, 22 bp, Homo sapiens
cagggagaggcctctgttgccc

SEQ ID NO: 7614589 - DNA, 22 bp, Homo sapiens
cagggagaggcctctgttgccc

SEQ ID NO: 7614590 - DNA, 22 bp, Homo sapiens
cagggagaggcctctgttgccc

SEQ ID NO: 7614591 - DNA, 22 bp, Homo sapiens
cagggagaggcctctgttgccc

SEQ ID NO: 7614592 - DNA, 22 bp, Homo sapiens
cagggagaggcatcatagggaa

SEQ ID NO: 7614593 - DNA, 22 bp, Homo sapiens
cagggagaggctggtggagtaa

SEQ ID NO: 7614594 - DNA, 22 bp, Homo sapiens
cagggagaggctggtggagtaa

SEQ ID NO: 7614595 - DNA, 22 bp, Homo sapiens
cagggagaggcctctgttgccc

SEQ ID NO: 7614596 - DNA, 22 bp, Homo sapiens
cagggagaggcctctgttgccc

SEQ ID NO: 7614597 - DNA, 22 bp, Homo sapiens
cagggagatcttggctcctggt

SEQ ID NO: 7614598 - DNA, 22 bp, Homo sapiens
cagggagatcttggctcctggt

SEQ ID NO: 7614599 - DNA, 22 bp, Homo sapiens
cagggagaggctggtggagtaa

SEQ ID NO: 7614600 - DNA, 22 bp, Homo sapiens
cagggagatcttggctcctggt

SEQ ID NO: 7614601 - DNA, 22 bp, Homo sapiens
cagggagaggctggtggagtaa

SEQ ID NO: 7614602 - DNA, 22 bp, Homo sapiens
cagggagaggctggtggagtaa

SEQ ID NO: 7614603 - DNA, 22 bp, Homo sapiens
cagggagaggctggtggagtaa

SEQ ID NO: 7614604 - DNA, 22 bp, Homo sapiens
cagggagaggcatcatagggaa

SEQ ID NO: 7614605 - DNA, 22 bp, Homo sapiens
cagggagaggcatcatagggaa

SEQ ID NO: 7614606 - DNA, 22 bp, Homo sapiens
cagggagaagtctggtcagtcc

SEQ ID NO: 7614607 - DNA, 22 bp, Homo sapiens
cagggagaagtctggtcagtcc

SEQ ID NO: 7614608 - DNA, 22 bp, Homo sapiens
cagggagaagtctggtcagtcc

SEQ ID NO: 7614609 - DNA, 22 bp, Homo sapiens
cagggagaaatctccaggaggt

SEQ ID NO: 7614610 - DNA, 22 bp, Homo sapiens
cagggagaagtctggtcagtcc

SEQ ID NO: 7614611 - DNA, 22 bp, Homo sapiens
cagggagaagtctggtcagtcc

SEQ ID NO: 7614612 - DNA, 22 bp, Homo sapiens
cagggagaggcatcatagggaa

SEQ ID NO: 7614613 - DNA, 22 bp, Homo sapiens
cagggagaggcatcatagggaa

SEQ ID NO: 7614614 - DNA, 22 bp, Homo sapiens
cagggagaggcatcatagggaa

SEQ ID NO: 7614615 - DNA, 22 bp, Homo sapiens
cagggagaggcctctgttgccc

SEQ ID NO: 7614616 - DNA, 22 bp, Homo sapiens
cagggagaggcatcatagggaa

SEQ ID NO: 7614617 - DNA, 22 bp, Homo sapiens
cagggagaggcatcatagggaa

SEQ ID NO: 7614618 - DNA, 22 bp, Homo sapiens
cagggagaagtctggtcagtcc

SEQ ID NO: 7614619 - DNA, 22 bp, Homo sapiens
cagggagaagtctggtcagtcc

SEQ ID NO: 7614620 - DNA, 22 bp, Homo sapiens
cagggagaagtctggtcagtcc

SEQ ID NO: 7614621 - DNA, 22 bp, Homo sapiens
cagggagaaatctccaggaggt

SEQ ID NO: 7614622 - DNA, 22 bp, Homo sapiens
cagggacagcgggactctgaca

SEQ ID NO: 7614623 - DNA, 22 bp, Homo sapiens
cagggacagcgggactctgaca

SEQ ID NO: 7614624 - DNA, 22 bp, Homo sapiens
cagggacagcgggactctgaca

SEQ ID NO: 7614625 - DNA, 22 bp, Homo sapiens
cagggagaaatctccaggaggt

SEQ ID NO: 7614626 - DNA, 22 bp, Homo sapiens
cagggagaaatctccaggaggt

SEQ ID NO: 7614627 - DNA, 22 bp, Homo sapiens
cagggagaaatctccaggaggt

SEQ ID NO: 7614628 - DNA, 22 bp, Homo sapiens
cagggacagccttggggtggcg

SEQ ID NO: 7614629 - DNA, 22 bp, Homo sapiens
cagggacagccttggggtggcg

SEQ ID NO: 7614630 - DNA, 22 bp, Homo sapiens
cagggacagccttggggtggcg

SEQ ID NO: 7614631 - DNA, 22 bp, Homo sapiens
tagaacataagtcattcatttg

SEQ ID NO: 7614632 - DNA, 22 bp, Homo sapiens
cagggacagccttggggtggcg

SEQ ID NO: 7614633 - DNA, 22 bp, Homo sapiens
tagaacagagttccagtgatca

SEQ ID NO: 7614634 - DNA, 22 bp, Homo sapiens
tagaacagcatttggctattaa

SEQ ID NO: 7614635 - DNA, 22 bp, Homo sapiens
tagaacaggaataagggaaata

SEQ ID NO: 7614636 - DNA, 22 bp, Homo sapiens
tagaacagtataggctaaacat

SEQ ID NO: 7614637 - DNA, 22 bp, Homo sapiens
tagaacagtataggctaaacat

SEQ ID NO: 7614638 - DNA, 22 bp, Homo sapiens
tagaacaggctgtcagagcggg

SEQ ID NO: 7614639 - DNA, 22 bp, Homo sapiens
tagaacaggctgtcagagcggg

SEQ ID NO: 7614640 - DNA, 22 bp, Homo sapiens
tagaacaggctgtcagagcggg

SEQ ID NO: 7614641 - DNA, 22 bp, Homo sapiens
tagaacacagaaatgtgtggcc

SEQ ID NO: 7614642 - DNA, 22 bp, Homo sapiens
tagaacagagttccagtgatca

SEQ ID NO: 7614643 - DNA, 22 bp, Homo sapiens
tagaacagagttccagtgatca

SEQ ID NO: 7614644 - DNA, 22 bp, Homo sapiens
tagaacagagttccagtgatca

SEQ ID NO: 7614645 - DNA, 22 bp, Homo sapiens
tagaacagagttccagtgatca

SEQ ID NO: 7614646 - DNA, 22 bp, Homo sapiens
tagaaatgtgataatagcttaa

SEQ ID NO: 7614647 - DNA, 22 bp, Homo sapiens
tagaaatgtgataatagcttaa

SEQ ID NO: 7614648 - DNA, 22 bp, Homo sapiens
tagaaatgtgataatagcttaa

SEQ ID NO: 7614649 - DNA, 22 bp, Homo sapiens
tagaaatgtgataatagcttaa

SEQ ID NO: 7614650 - DNA, 22 bp, Homo sapiens
tagaaatgtgataatagcttaa

SEQ ID NO: 7614651 - DNA, 22 bp, Homo sapiens
tagaaatgtgataatagcttaa

SEQ ID NO: 7614652 - DNA, 22 bp, Homo sapiens
tagaaatgtgataatagcttaa

SEQ ID NO: 7614653 - DNA, 22 bp, Homo sapiens
tagaaatgtgataatagcttaa

SEQ ID NO: 7614654 - DNA, 22 bp, Homo sapiens
tagaaatgtgataatagcttaa

SEQ ID NO: 7614655 - DNA, 22 bp, Homo sapiens
tagaaagcatgcaagtttgatg

SEQ ID NO: 7614656 - DNA, 22 bp, Homo sapiens
tagaaagcagtatctccatttt

SEQ ID NO: 7614657 - DNA, 22 bp, Homo sapiens
tagaaagcatgcaagtttgatg

SEQ ID NO: 7614658 - DNA, 22 bp, Homo sapiens
tagaaatgtaggcttcctgaca

SEQ ID NO: 7614659 - DNA, 22 bp, Homo sapiens
tagaaatgtaggcttcctgaca

SEQ ID NO: 7614660 - DNA, 22 bp, Homo sapiens
tagaaatgtcgtctccacattt

SEQ ID NO: 7614661 - DNA, 22 bp, Homo sapiens
tagaaatgtaggcttcctgaca

SEQ ID NO: 7614662 - DNA, 22 bp, Homo sapiens
tagaaatgtcgtctccacattt

SEQ ID NO: 7614663 - DNA, 22 bp, Homo sapiens
tagaaatgtcgtctccacattt

SEQ ID NO: 7614664 - DNA, 22 bp, Homo sapiens
tagaaatgttagatgtattgag

SEQ ID NO: 7614665 - DNA, 22 bp, Homo sapiens
tagaaatgtgataatagcttaa

SEQ ID NO: 7614666 - DNA, 22 bp, Homo sapiens
tagaaatgttagatgtattgag

SEQ ID NO: 7614667 - DNA, 22 bp, Homo sapiens
tagaaatgttagatgtattgag

SEQ ID NO: 7614668 - DNA, 22 bp, Homo sapiens
tagaaatgttagatgtattgag

SEQ ID NO: 7614669 - DNA, 22 bp, Homo sapiens
tagaaatgttggtattaacatt

SEQ ID NO: 7614670 - DNA, 22 bp, Homo sapiens
tagaaatgttggtattaacatt

SEQ ID NO: 7614671 - DNA, 22 bp, Homo sapiens
tagaaatgttggtattaacatt

SEQ ID NO: 7614672 - DNA, 22 bp, Homo sapiens
tagaaatgttggtattaacatt

SEQ ID NO: 7614673 - DNA, 22 bp, Homo sapiens
tagaaatgttggtattaacatt

SEQ ID NO: 7614674 - DNA, 22 bp, Homo sapiens
tagaaatgttagatgtattgag

SEQ ID NO: 7614675 - DNA, 22 bp, Homo sapiens
tagaaattcaatgctctgagta

SEQ ID NO: 7614676 - DNA, 22 bp, Homo sapiens
tagaacaatgaatttctggagg

SEQ ID NO: 7614677 - DNA, 22 bp, Homo sapiens
tagaaattcaatgctctgagta

SEQ ID NO: 7614678 - DNA, 22 bp, Homo sapiens
tagaaatgttggtattaacatt

SEQ ID NO: 7614679 - DNA, 22 bp, Homo sapiens
tagaaagagcatagtattataa

SEQ ID NO: 7614680 - DNA, 22 bp, Homo sapiens
tagaaagagcatagtattataa

SEQ ID NO: 7614681 - DNA, 22 bp, Homo sapiens
tagaaagagcatagtattataa

SEQ ID NO: 7614682 - DNA, 22 bp, Homo sapiens
tagaaagactgtccagatttca

SEQ ID NO: 7614683 - DNA, 22 bp, Homo sapiens
tagaaagagcatagtattataa

SEQ ID NO: 7614684 - DNA, 22 bp, Homo sapiens
tagaaagagcatagtattataa

SEQ ID NO: 7614685 - DNA, 22 bp, Homo sapiens
tagaaagagcatagtattataa

SEQ ID NO: 7614686 - DNA, 22 bp, Homo sapiens
tagaaagagcatagtattataa

SEQ ID NO: 7614687 - DNA, 22 bp, Homo sapiens
tagaaagacatgggccagcagc

SEQ ID NO: 7614688 - DNA, 22 bp, Homo sapiens
tagaaagacatgggccagcagc

SEQ ID NO: 7614689 - DNA, 22 bp, Homo sapiens
tagaaagacatgggccagcagc

SEQ ID NO: 7614690 - DNA, 22 bp, Homo sapiens
tagaaagacatgggccagcagc

SEQ ID NO: 7614691 - DNA, 22 bp, Homo sapiens
tagaaagacagaggttttgtct

SEQ ID NO: 7614692 - DNA, 22 bp, Homo sapiens
tagaaagactgtccagatttca

SEQ ID NO: 7614693 - DNA, 22 bp, Homo sapiens
tagaaagactgtccagatttca

SEQ ID NO: 7614694 - DNA, 22 bp, Homo sapiens
tagaaagcagaaaccatcagag

SEQ ID NO: 7614695 - DNA, 22 bp, Homo sapiens
tagaaagcagaaaccatcagag

SEQ ID NO: 7614696 - DNA, 22 bp, Homo sapiens
tagaaagcaaaatcctaccaag

SEQ ID NO: 7614697 - DNA, 22 bp, Homo sapiens
tagaaagcagaaaccatcagag

SEQ ID NO: 7614698 - DNA, 22 bp, Homo sapiens
tagaaagcaaaatcctaccaag

SEQ ID NO: 7614699 - DNA, 19 bp, Homo sapiens
tagaaagatgatgggtggg

SEQ ID NO: 7614700 - DNA, 19 bp, Homo sapiens
tagaaagatgatgggtggg

SEQ ID NO: 7614701 - DNA, 19 bp, Homo sapiens
tagaaagatgatgggtggg

SEQ ID NO: 7614702 - DNA, 22 bp, Homo sapiens
tagaaagatctgtaggcaagag

SEQ ID NO: 7614703 - DNA, 22 bp, Homo sapiens
tagaaagatctgtaggcaagag

SEQ ID NO: 7614704 - DNA, 22 bp, Homo sapiens
tagaaagatctgtaggcaagag

SEQ ID NO: 7614705 - DNA, 22 bp, Homo sapiens
tagaaagatctgtaggcaagag

SEQ ID NO: 7614706 - DNA, 22 bp, Homo sapiens
tagaaagatctgtaggcaagag

SEQ ID NO: 7614707 - DNA, 22 bp, Homo sapiens
tagaaagagctttgcttccttt

SEQ ID NO: 7614708 - DNA, 22 bp, Homo sapiens
tagaaagagctttgcttccttt

SEQ ID NO: 7614709 - DNA, 22 bp, Homo sapiens
tagaaagagcatagtattataa

SEQ ID NO: 7614710 - DNA, 22 bp, Homo sapiens
tagaaagagctttgcttccttt

SEQ ID NO: 7614711 - DNA, 22 bp, Homo sapiens
tagaaagagctttgcttccttt

SEQ ID NO: 7614712 - DNA, 22 bp, Homo sapiens
tagaaagacagaggttttgtct

SEQ ID NO: 7614713 - DNA, 22 bp, Homo sapiens
tagaaagacagaggttttgtct

SEQ ID NO: 7614714 - DNA, 22 bp, Homo sapiens
tagaaagacagaggttttgtct

SEQ ID NO: 7614715 - DNA, 22 bp, Homo sapiens
tagaaagacagaggttttgtct

SEQ ID NO: 7614716 - DNA, 22 bp, Homo sapiens
tagaaagacaatgggaagtgct

SEQ ID NO: 7614717 - DNA, 22 bp, Homo sapiens
tagaaagacaatgggaagtgct

SEQ ID NO: 7614718 - DNA, 22 bp, Homo sapiens
tagaaagacaatgggaagtgct

SEQ ID NO: 7614719 - DNA, 22 bp, Homo sapiens
tagaaacaagggagaggattct

SEQ ID NO: 7614720 - DNA, 22 bp, Homo sapiens
tacctctctaaacccagggaca

SEQ ID NO: 7614721 - DNA, 22 bp, Homo sapiens
tagaaacaagggagaggattct

SEQ ID NO: 7614722 - DNA, 22 bp, Homo sapiens
tagaaacaagtttctctttggg

SEQ ID NO: 7614723 - DNA, 22 bp, Homo sapiens
tagaaacaagtttctctttggg

SEQ ID NO: 7614724 - DNA, 22 bp, Homo sapiens
tagaaacaagggagaggattct

SEQ ID NO: 7614725 - DNA, 22 bp, Homo sapiens
tagaaagaacttcatgtaaaac

SEQ ID NO: 7614726 - DNA, 22 bp, Homo sapiens
tagaaacaagtttctctttggg

SEQ ID NO: 7614727 - DNA, 22 bp, Homo sapiens
tagaaacaagtttctctttggg

SEQ ID NO: 7614728 - DNA, 22 bp, Homo sapiens
tacctataggtacaattacaag

SEQ ID NO: 7614729 - DNA, 23 bp, Homo sapiens
tacctattttcttaacacatcta

SEQ ID NO: 7614730 - DNA, 23 bp, Homo sapiens
tacctattttcttaacacatcta

SEQ ID NO: 7614731 - DNA, 22 bp, Homo sapiens
tacctattagaatgctttcagc

SEQ ID NO: 7614732 - DNA, 22 bp, Homo sapiens
tacctattttgcggggttacat

SEQ ID NO: 7614733 - DNA, 22 bp, Homo sapiens
tacctcaagttccaggaaagcg

SEQ ID NO: 7614734 - DNA, 22 bp, Homo sapiens
tacctcaagttccaggaaagcg

SEQ ID NO: 7614735 - DNA, 22 bp, Homo sapiens
tacctcaagttccaggaaagcg

SEQ ID NO: 7614736 - DNA, 22 bp, Homo sapiens
tacctcaagttccaggaaagcg

SEQ ID NO: 7614737 - DNA, 22 bp, Homo sapiens
tacctcaagttccaggaaagcg

SEQ ID NO: 7614738 - DNA, 22 bp, Homo sapiens
tacctcagattgctgccttggg

SEQ ID NO: 7614739 - DNA, 22 bp, Homo sapiens
tacctcagattgctgccttggg

SEQ ID NO: 7614740 - DNA, 22 bp, Homo sapiens
tacctcaagttccaggaaagcg

SEQ ID NO: 7614741 - DNA, 22 bp, Homo sapiens
tacctcaagttccaggaaagcg

SEQ ID NO: 7614742 - DNA, 22 bp, Homo sapiens
tacctcgaacttggtctttgat

SEQ ID NO: 7614743 - DNA, 22 bp, Homo sapiens
tacctctcggggtctgtttgtg

SEQ ID NO: 7614744 - DNA, 22 bp, Homo sapiens
tacctctctaaacccagggaca

SEQ ID NO: 7614745 - DNA, 22 bp, Homo sapiens
tacctctctaaacccagggaca

SEQ ID NO: 7614746 - DNA, 22 bp, Homo sapiens
caggctgcagaggcctttcatg

SEQ ID NO: 7614747 - DNA, 22 bp, Homo sapiens
caggctgcagaggcctttcatg

SEQ ID NO: 7614748 - DNA, 22 bp, Homo sapiens
caggctgcagaggcctttcatg

SEQ ID NO: 7614749 - DNA, 22 bp, Homo sapiens
caggctgcagaggcctttcatg

SEQ ID NO: 7614750 - DNA, 22 bp, Homo sapiens
caggctgcagaggcctttcatg

SEQ ID NO: 7614751 - DNA, 22 bp, Homo sapiens
caggctgcagcagcagtggccc

SEQ ID NO: 7614752 - DNA, 22 bp, Homo sapiens
caggctgcagcagcagtggccc

SEQ ID NO: 7614753 - DNA, 22 bp, Homo sapiens
caggctgcagcagcagtggccc

SEQ ID NO: 7614754 - DNA, 22 bp, Homo sapiens
caggctgcagcagcagtggccc

SEQ ID NO: 7614755 - DNA, 22 bp, Homo sapiens
caggctgattaggcctcgtcca

SEQ ID NO: 7614756 - DNA, 22 bp, Homo sapiens
caggctgcaagaaaggcattca

SEQ ID NO: 7614757 - DNA, 22 bp, Homo sapiens
caggctgcaagaaaggcattca

SEQ ID NO: 7614758 - DNA, 22 bp, Homo sapiens
caggctgcaagaaaggcattca

SEQ ID NO: 7614759 - DNA, 22 bp, Homo sapiens
caggctgcaagaaaggcattca

SEQ ID NO: 7614760 - DNA, 22 bp, Homo sapiens
caggctgattaggcctcgtcca

SEQ ID NO: 7614761 - DNA, 22 bp, Homo sapiens
caggctgcaagaaaggcattca

SEQ ID NO: 7614762 - DNA, 22 bp, Homo sapiens
caggctgcaagaaaggcattca

SEQ ID NO: 7614763 - DNA, 22 bp, Homo sapiens
caggctgcagaggcctttcatg

SEQ ID NO: 7614764 - DNA, 22 bp, Homo sapiens
caggctgatcagggctgggatg

SEQ ID NO: 7614765 - DNA, 22 bp, Homo sapiens
caggctgattaggcctcgtcca

SEQ ID NO: 7614766 - DNA, 22 bp, Homo sapiens
caggctgatcagggctgggatg

SEQ ID NO: 7614767 - DNA, 22 bp, Homo sapiens
caggctgatcagggctgggatg

SEQ ID NO: 7614768 - DNA, 22 bp, Homo sapiens
caggctgattaggcctcgtcca

SEQ ID NO: 7614769 - DNA, 22 bp, Homo sapiens
caggctgatagggtccaaagtt

SEQ ID NO: 7614770 - DNA, 22 bp, Homo sapiens
caggctgatcagggctgggatg

SEQ ID NO: 7614771 - DNA, 22 bp, Homo sapiens
caggctgatagggtccaaagtt

SEQ ID NO: 7614772 - DNA, 22 bp, Homo sapiens
caggctgatcagggctgggatg

SEQ ID NO: 7614773 - DNA, 22 bp, Homo sapiens
caggctgatcagggctgggatg

SEQ ID NO: 7614774 - DNA, 22 bp, Homo sapiens
caggctgagggttaggccttag

SEQ ID NO: 7614775 - DNA, 22 bp, Homo sapiens
caggctgagggttaggccttag

SEQ ID NO: 7614776 - DNA, 22 bp, Homo sapiens
caggctgaggcagtagggtttg

SEQ ID NO: 7614777 - DNA, 22 bp, Homo sapiens
caggctgaggcagtagggtttg

SEQ ID NO: 7614778 - DNA, 22 bp, Homo sapiens
taccctgggagcttagaagaat

SEQ ID NO: 7614779 - DNA, 20 bp, Homo sapiens
taccctggctatgcttctga

SEQ ID NO: 7614780 - DNA, 20 bp, Homo sapiens
taccctggctatgcttctga

SEQ ID NO: 7614781 - DNA, 22 bp, Homo sapiens
tacctaatagtttgagtgtgga

SEQ ID NO: 7614782 - DNA, 19 bp, Homo sapiens
taccctgggctctctgccc

SEQ ID NO: 7614783 - DNA, 22 bp, Homo sapiens
taccctgctagctagcatctct

SEQ ID NO: 7614784 - DNA, 22 bp, Homo sapiens
taccctgctagctagcatctct

SEQ ID NO: 7614785 - DNA, 22 bp, Homo sapiens
taccctggagcaagtttcctca

SEQ ID NO: 7614786 - DNA, 22 bp, Homo sapiens
taccctggagcaagtttcctca

SEQ ID NO: 7614787 - DNA, 22 bp, Homo sapiens
taccctgaagtagctctttccc

SEQ ID NO: 7614788 - DNA, 22 bp, Homo sapiens
taccctgaagtagctctttccc

SEQ ID NO: 7614789 - DNA, 22 bp, Homo sapiens
taccctgcaggattgctgtgca

SEQ ID NO: 7614790 - DNA, 19 bp, Homo sapiens
taccctcagggcctcattt

SEQ ID NO: 7614791 - DNA, 19 bp, Homo sapiens
taccctcagggcctcattt

SEQ ID NO: 7614792 - DNA, 22 bp, Homo sapiens
taccctctcccggtccagcttt

SEQ ID NO: 7614793 - DNA, 22 bp, Homo sapiens
taccctctcccggtccagcttt

SEQ ID NO: 7614794 - DNA, 22 bp, Homo sapiens
tacccagttattttgtctttgt

SEQ ID NO: 7614795 - DNA, 22 bp, Homo sapiens
tacccagttcagtgtttaaaaa

SEQ ID NO: 7614796 - DNA, 22 bp, Homo sapiens
tacccagttccacacactgatg

SEQ ID NO: 7614797 - DNA, 22 bp, Homo sapiens
taccccaagagtgtctgccatg

SEQ ID NO: 7614798 - DNA, 22 bp, Homo sapiens
taccccaagagtgtctgccatg

SEQ ID NO: 7614799 - DNA, 22 bp, Homo sapiens
caggctgcagcagcagtggccc

SEQ ID NO: 7614800 - DNA, 22 bp, Homo sapiens
caggctgcagcagcagtggccc

SEQ ID NO: 7614801 - DNA, 22 bp, Homo sapiens
caggctgcagcagcagtggccc

SEQ ID NO: 7614802 - DNA, 22 bp, Homo sapiens
caggctgcagcagcagtggccc

SEQ ID NO: 7614803 - DNA, 22 bp, Homo sapiens
caggctgcagcagcagtggccc

SEQ ID NO: 7614804 - DNA, 22 bp, Homo sapiens
caggctgcagcagcagtggccc

SEQ ID NO: 7614805 - DNA, 22 bp, Homo sapiens
tacccaggagaaacagcagggc

SEQ ID NO: 7614806 - DNA, 22 bp, Homo sapiens
tacccaggggctgagcagaggt

SEQ ID NO: 7614807 - DNA, 22 bp, Homo sapiens
tacccagtctggagtgcagtga

SEQ ID NO: 7614808 - DNA, 22 bp, Homo sapiens
tacccagtgcaactggagtctc

SEQ ID NO: 7614809 - DNA, 22 bp, Homo sapiens
tacccagtgcaactggagtctc

SEQ ID NO: 7614810 - DNA, 22 bp, Homo sapiens
tacccagtgccaccctctgagg

SEQ ID NO: 7614811 - DNA, 20 bp, Homo sapiens
tacccagtggtggatggtaa

SEQ ID NO: 7614812 - DNA, 22 bp, Homo sapiens
tacccagggcttttctgatgca

SEQ ID NO: 7614813 - DNA, 22 bp, Homo sapiens
tacccaggaggaaactgaggct

SEQ ID NO: 7614814 - DNA, 22 bp, Homo sapiens
cagggaggctgtcttatgcctg

SEQ ID NO: 7614815 - DNA, 22 bp, Homo sapiens
cagggaggctgtcttatgcctg

SEQ ID NO: 7614816 - DNA, 22 bp, Homo sapiens
cagggaggctgtcttatgcctg

SEQ ID NO: 7614817 - DNA, 22 bp, Homo sapiens
cagggaggctgtcttatgcctg

SEQ ID NO: 7614818 - DNA, 22 bp, Homo sapiens
cagggaggctgtcttatgcctg

SEQ ID NO: 7614819 - DNA, 22 bp, Homo sapiens
cagggaggctgtcttatgcctg

SEQ ID NO: 7614820 - DNA, 22 bp, Homo sapiens
cagggaggatgggctgttttgc

SEQ ID NO: 7614821 - DNA, 22 bp, Homo sapiens
cagggaggatgggctgttttgc

SEQ ID NO: 7614822 - DNA, 22 bp, Homo sapiens
cagggaggatgggctgttttgc

SEQ ID NO: 7614823 - DNA, 22 bp, Homo sapiens
cagggaggatgggctgttttgc

SEQ ID NO: 7614824 - DNA, 23 bp, Homo sapiens
cagggaggagatactgtgtatct

SEQ ID NO: 7614825 - DNA, 23 bp, Homo sapiens
cagggaggagatactgtgtatct

SEQ ID NO: 7614826 - DNA, 23 bp, Homo sapiens
cagggaggagatactgtgtatct

SEQ ID NO: 7614827 - DNA, 23 bp, Homo sapiens
cagggaggagatactgtgtatct

SEQ ID NO: 7614828 - DNA, 23 bp, Homo sapiens
cagggaggagatactgtgtatct

SEQ ID NO: 7614829 - DNA, 23 bp, Homo sapiens
cagggaggagatactgtgtatct

SEQ ID NO: 7614830 - DNA, 23 bp, Homo sapiens
cagggaggagatactgtgtatct

SEQ ID NO: 7614831 - DNA, 22 bp, Homo sapiens
cagggaggatgggctgttttgc

SEQ ID NO: 7614832 - DNA, 22 bp, Homo sapiens
cagggaggatgggctgttttgc

SEQ ID NO: 7614833 - DNA, 22 bp, Homo sapiens
cagggaggatgggctgttttgc

SEQ ID NO: 7614834 - DNA, 22 bp, Homo sapiens
cagggaggatgggctgttttgc

SEQ ID NO: 7614835 - DNA, 23 bp, Homo sapiens
cagggaggagatactgtgtatct

SEQ ID NO: 7614836 - DNA, 22 bp, Homo sapiens
cagggagctttcccaggaccct

SEQ ID NO: 7614837 - DNA, 22 bp, Homo sapiens
cagggagcggagtcccatgcct

SEQ ID NO: 7614838 - DNA, 22 bp, Homo sapiens
cagggagcggagtcccatgcct

SEQ ID NO: 7614839 - DNA, 22 bp, Homo sapiens
cagggagcggagtcccatgcct

SEQ ID NO: 7614840 - DNA, 22 bp, Homo sapiens
cagggagcctgaatgttccagg

SEQ ID NO: 7614841 - DNA, 22 bp, Homo sapiens
cagggagcctgaatgttccagg

SEQ ID NO: 7614842 - DNA, 22 bp, Homo sapiens
cagggagcctgaatgttccagg

SEQ ID NO: 7614843 - DNA, 22 bp, Homo sapiens
cagggagcctgaatgttccagg

SEQ ID NO: 7614844 - DNA, 22 bp, Homo sapiens
cagggagcctgaatgttccagg

SEQ ID NO: 7614845 - DNA, 22 bp, Homo sapiens
tagacattttaagacatatacc

SEQ ID NO: 7614846 - DNA, 22 bp, Homo sapiens
cagggagctttgtcttctcatt

SEQ ID NO: 7614847 - DNA, 22 bp, Homo sapiens
cagggagctttgtcttctcatt

SEQ ID NO: 7614848 - DNA, 22 bp, Homo sapiens
cagggagctttcccaggaccct

SEQ ID NO: 7614849 - DNA, 22 bp, Homo sapiens
cagggagctttcccaggaccct

SEQ ID NO: 7614850 - DNA, 22 bp, Homo sapiens
cagggagctttgtcttctcatt

SEQ ID NO: 7614851 - DNA, 22 bp, Homo sapiens
cagggagctttcccaggaccct

SEQ ID NO: 7614852 - DNA, 22 bp, Homo sapiens
cagggagggaggaaaatttgct

SEQ ID NO: 7614853 - DNA, 22 bp, Homo sapiens
cagggagggaggaaaatttgct

SEQ ID NO: 7614854 - DNA, 22 bp, Homo sapiens
cagggagggacaattgtcacct

SEQ ID NO: 7614855 - DNA, 22 bp, Homo sapiens
cagggagggacaattgtcacct

SEQ ID NO: 7614856 - DNA, 22 bp, Homo sapiens
cagggagtcaacaaacagatca

SEQ ID NO: 7614857 - DNA, 22 bp, Homo sapiens
cagggagggaggaaaatttgct

SEQ ID NO: 7614858 - DNA, 22 bp, Homo sapiens
cagggagggaggaaaatttgct

SEQ ID NO: 7614859 - DNA, 22 bp, Homo sapiens
cagggagggaggaaaatttgct

SEQ ID NO: 7614860 - DNA, 22 bp, Homo sapiens
cagggagggaggaaaatttgct

SEQ ID NO: 7614861 - DNA, 22 bp, Homo sapiens
cagggagggaggaaaatttgct

SEQ ID NO: 7614862 - DNA, 22 bp, Homo sapiens
cagggagggacaattgtcacct

SEQ ID NO: 7614863 - DNA, 22 bp, Homo sapiens
cagggaggctgtcttatgcctg

SEQ ID NO: 7614864 - DNA, 22 bp, Homo sapiens
cagggaggctgtcttatgcctg

SEQ ID NO: 7614865 - DNA, 22 bp, Homo sapiens
cagggaggctgtcttatgcctg

SEQ ID NO: 7614866 - DNA, 22 bp, Homo sapiens
cagggagggacaattgtcacct

SEQ ID NO: 7614867 - DNA, 22 bp, Homo sapiens
cagggagggacaattgtcacct

SEQ ID NO: 7614868 - DNA, 22 bp, Homo sapiens
cagggagggacaattgtcacct

SEQ ID NO: 7614869 - DNA, 22 bp, Homo sapiens
cagggagggacaattgtcacct

SEQ ID NO: 7614870 - DNA, 22 bp, Homo sapiens
cagggagggacaattgtcacct

SEQ ID NO: 7614871 - DNA, 22 bp, Homo sapiens
cagggagggacaattgtcacct

SEQ ID NO: 7614872 - DNA, 22 bp, Homo sapiens
cagggagggacaattgtcacct

SEQ ID NO: 7614873 - DNA, 22 bp, Homo sapiens
cagggatgagaaagctctctaa

SEQ ID NO: 7614874 - DNA, 22 bp, Homo sapiens
cagggatgagaaagctctctaa

SEQ ID NO: 7614875 - DNA, 22 bp, Homo sapiens
cagggatgagaaagctctctaa

SEQ ID NO: 7614876 - DNA, 22 bp, Homo sapiens
cagggatgagaaagctctctaa

SEQ ID NO: 7614877 - DNA, 22 bp, Homo sapiens
cagggatgagaaagctctctaa

SEQ ID NO: 7614878 - DNA, 22 bp, Homo sapiens
cagggatgaccagagggatgtg

SEQ ID NO: 7614879 - DNA, 22 bp, Homo sapiens
cagggatgaccagagggatgtg

SEQ ID NO: 7614880 - DNA, 22 bp, Homo sapiens
cagggatgaccagagggatgtg

SEQ ID NO: 7614881 - DNA, 22 bp, Homo sapiens
cagggatgaccagagggatgtg

SEQ ID NO: 7614882 - DNA, 22 bp, Homo sapiens
cagggatgaccagagggatgtg

SEQ ID NO: 7614883 - DNA, 22 bp, Homo sapiens
cagggatgaccagagggatgtg

SEQ ID NO: 7614884 - DNA, 22 bp, Homo sapiens
cagggatgaccagagggatgtg

SEQ ID NO: 7614885 - DNA, 22 bp, Homo sapiens
cagggatgaccagagggatgtg

SEQ ID NO: 7614886 - DNA, 22 bp, Homo sapiens
cagggagtcaacaaacagatca

SEQ ID NO: 7614887 - DNA, 22 bp, Homo sapiens
cagggagtgtacaccatgtgta

SEQ ID NO: 7614888 - DNA, 22 bp, Homo sapiens
cagggagtttttgttcctctag

SEQ ID NO: 7614889 - DNA, 22 bp, Homo sapiens
cagggagtttttgttcctctag

SEQ ID NO: 7614890 - DNA, 22 bp, Homo sapiens
cagggagtgtacaccatgtgta

SEQ ID NO: 7614891 - DNA, 22 bp, Homo sapiens
cagggagtgtacaccatgtgta

SEQ ID NO: 7614892 - DNA, 21 bp, Homo sapiens
tagcaattatagatgtctaaa

SEQ ID NO: 7614893 - DNA, 21 bp, Homo sapiens
tagcaattatagatgtctaaa

SEQ ID NO: 7614894 - DNA, 22 bp, Homo sapiens
tagcaatgtgttgacttggtca

SEQ ID NO: 7614895 - DNA, 22 bp, Homo sapiens
tagcaatgtgttgacttggtca

SEQ ID NO: 7614896 - DNA, 22 bp, Homo sapiens
cagggatggcctggcgggccac

SEQ ID NO: 7614897 - DNA, 22 bp, Homo sapiens
tagcaatgtgttgacttggtca

SEQ ID NO: 7614898 - DNA, 22 bp, Homo sapiens
cagggatggcctggcgggccac

SEQ ID NO: 7614899 - DNA, 22 bp, Homo sapiens
cagggatggcctggcgggccac

SEQ ID NO: 7614900 - DNA, 22 bp, Homo sapiens
cagggatggcctggcgggccac

SEQ ID NO: 7614901 - DNA, 22 bp, Homo sapiens
tagcagagtttggtacctgggg

SEQ ID NO: 7614902 - DNA, 22 bp, Homo sapiens
tagcagagtttggtacctgggg

SEQ ID NO: 7614903 - DNA, 22 bp, Homo sapiens
tagcagcaaaatgaccttctaa

SEQ ID NO: 7614904 - DNA, 17 bp, Homo sapiens
tagcacaaagcaggatt

SEQ ID NO: 7614905 - DNA, 22 bp, Homo sapiens
tagcacaaagagtctttcagag

SEQ ID NO: 7614906 - DNA, 22 bp, Homo sapiens
tagcagagtgattggccatgag

SEQ ID NO: 7614907 - DNA, 22 bp, Homo sapiens
tagcagcaaagcaggatctgct

SEQ ID NO: 7614908 - DNA, 22 bp, Homo sapiens
tagcagcaaagcaggatctgct

SEQ ID NO: 7614909 - DNA, 22 bp, Homo sapiens
tagcagcaaagcaggatctgct

SEQ ID NO: 7614910 - DNA, 22 bp, Homo sapiens
tagcagcaaagcaggatctgct

SEQ ID NO: 7614911 - DNA, 22 bp, Homo sapiens
tagcagagtttggtacctgggg

SEQ ID NO: 7614912 - DNA, 22 bp, Homo sapiens
tagcagagtttggtacctgggg

SEQ ID NO: 7614913 - DNA, 22 bp, Homo sapiens
tagcagcaattacacagtccgt

SEQ ID NO: 7614914 - DNA, 22 bp, Homo sapiens
tagcagcaattcaggtgtgatg

SEQ ID NO: 7614915 - DNA, 22 bp, Homo sapiens
tagcagcaattcaggtgtgatg

SEQ ID NO: 7614916 - DNA, 22 bp, Homo sapiens
tagcagcaattcaggtgtgatg

SEQ ID NO: 7614917 - DNA, 22 bp, Homo sapiens
tagcagcaattcaggtgtgatg

SEQ ID NO: 7614918 - DNA, 22 bp, Homo sapiens
tagcagcaattcaggtgtgatg

SEQ ID NO: 7614919 - DNA, 22 bp, Homo sapiens
tagcagcaattacacagtccgt

SEQ ID NO: 7614920 - DNA, 22 bp, Homo sapiens
tagcagcaattacacagtccgt

SEQ ID NO: 7614921 - DNA, 22 bp, Homo sapiens
tagcagcaattacacagtccgt

SEQ ID NO: 7614922 - DNA, 22 bp, Homo sapiens
tagcagcaagaatgggatgtgt

SEQ ID NO: 7614923 - DNA, 22 bp, Homo sapiens
tagcagcaagaatgggatgtgt

SEQ ID NO: 7614924 - DNA, 22 bp, Homo sapiens
tagcagcaagaatgggatgtgt

SEQ ID NO: 7614925 - DNA, 22 bp, Homo sapiens
tagcagcaagaatgggatgtgt

SEQ ID NO: 7614926 - DNA, 22 bp, Homo sapiens
tagcagcaagaatgggatgtgt

SEQ ID NO: 7614927 - DNA, 22 bp, Homo sapiens
tagcagcacagaaagcctggag

SEQ ID NO: 7614928 - DNA, 22 bp, Homo sapiens
tagcagcacaaatggactatga

SEQ ID NO: 7614929 - DNA, 22 bp, Homo sapiens
tagcagcacagaaagcctggag

SEQ ID NO: 7614930 - DNA, 22 bp, Homo sapiens
tagcagcacagaaagcctggag

SEQ ID NO: 7614931 - DNA, 22 bp, Homo sapiens
tagcagcacagaaagcctggag

SEQ ID NO: 7614932 - DNA, 22 bp, Homo sapiens
tagcagcaatttcagaagtttg

SEQ ID NO: 7614933 - DNA, 22 bp, Homo sapiens
tagcagcaatttcagaagtttg

SEQ ID NO: 7614934 - DNA, 22 bp, Homo sapiens
tagcagcaatttcagaagtttg

SEQ ID NO: 7614935 - DNA, 22 bp, Homo sapiens
tagcagcaattcaggtgtgatg

SEQ ID NO: 7614936 - DNA, 22 bp, Homo sapiens
tagcagcacaaatggactatga

SEQ ID NO: 7614937 - DNA, 22 bp, Homo sapiens
tagcagcaatttcagaagtttg

SEQ ID NO: 7614938 - DNA, 22 bp, Homo sapiens
tagcagcaatttcagaagtttg

SEQ ID NO: 7614939 - DNA, 22 bp, Homo sapiens
cagggatgagcagatggagcaa

SEQ ID NO: 7614940 - DNA, 22 bp, Homo sapiens
cagggatgagcagatggagcaa

SEQ ID NO: 7614941 - DNA, 22 bp, Homo sapiens
cagggatgagcagatggagcaa

SEQ ID NO: 7614942 - DNA, 22 bp, Homo sapiens
cagggatgagcagatggagcaa

SEQ ID NO: 7614943 - DNA, 22 bp, Homo sapiens
cagggatgagcagatggagcaa

SEQ ID NO: 7614944 - DNA, 22 bp, Homo sapiens
cagggatgagcagatggagcaa

SEQ ID NO: 7614945 - DNA, 22 bp, Homo sapiens
cagggatgagcagatggagcaa

SEQ ID NO: 7614946 - DNA, 22 bp, Homo sapiens
cagggatgagcagatggagcaa

SEQ ID NO: 7614947 - DNA, 22 bp, Homo sapiens
cagggatgagagatggcacaga

SEQ ID NO: 7614948 - DNA, 22 bp, Homo sapiens
cagggatgagagatggcacaga

SEQ ID NO: 7614949 - DNA, 22 bp, Homo sapiens
cagggatgagagatggcacaga

SEQ ID NO: 7614950 - DNA, 22 bp, Homo sapiens
cagggatgagagatggcacaga

SEQ ID NO: 7614951 - DNA, 22 bp, Homo sapiens
cagggatgagaaagctctctaa

SEQ ID NO: 7614952 - DNA, 22 bp, Homo sapiens
cagggatgagagatggcacaga

SEQ ID NO: 7614953 - DNA, 22 bp, Homo sapiens
cagggatgagagatggcacaga

SEQ ID NO: 7614954 - DNA, 22 bp, Homo sapiens
cagggatgagagatggcacaga

SEQ ID NO: 7614955 - DNA, 22 bp, Homo sapiens
cagggatggcctggcgggccac

SEQ ID NO: 7614956 - DNA, 22 bp, Homo sapiens
cagggatggcctggcgggccac

SEQ ID NO: 7614957 - DNA, 22 bp, Homo sapiens
cagggatggagagactactggc

SEQ ID NO: 7614958 - DNA, 22 bp, Homo sapiens
cagggatggagagactactggc

SEQ ID NO: 7614959 - DNA, 22 bp, Homo sapiens
cagggatgctgttaaacatcct

SEQ ID NO: 7614960 - DNA, 22 bp, Homo sapiens
cagggatggagagactactggc

SEQ ID NO: 7614961 - DNA, 22 bp, Homo sapiens
cagggatgctgttaaacatcct

SEQ ID NO: 7614962 - DNA, 22 bp, Homo sapiens
cagggatgctgcttaggcagtt

SEQ ID NO: 7614963 - DNA, 22 bp, Homo sapiens
cagggatgctgcttaggcagtt

SEQ ID NO: 7614964 - DNA, 22 bp, Homo sapiens
cagggatgagcagatggagcaa

SEQ ID NO: 7614965 - DNA, 22 bp, Homo sapiens
cagggatgctgcttaggcagtt

SEQ ID NO: 7614966 - DNA, 22 bp, Homo sapiens
cagggatgctgcttaggcagtt

SEQ ID NO: 7614967 - DNA, 22 bp, Homo sapiens
cagggatgctgcttaggcagtt

SEQ ID NO: 7614968 - DNA, 22 bp, Homo sapiens
cagggatgctgcttaggcagtt

SEQ ID NO: 7614969 - DNA, 22 bp, Homo sapiens
cagggatgctgcttaggcagtt

SEQ ID NO: 7614970 - DNA, 22 bp, Homo sapiens
cagggatgctgcttaggcagtt

SEQ ID NO: 7614971 - DNA, 22 bp, Homo sapiens
cagggatgctgcttaggcagtt

SEQ ID NO: 7614972 - DNA, 22 bp, Homo sapiens
tagcataacaggtaagagtgag

SEQ ID NO: 7614973 - DNA, 22 bp, Homo sapiens
tagcataacaggtaagagtgag

SEQ ID NO: 7614974 - DNA, 22 bp, Homo sapiens
tagcataacaggtaagagtgag

SEQ ID NO: 7614975 - DNA, 22 bp, Homo sapiens
tagcatcagccacaccttgtac

SEQ ID NO: 7614976 - DNA, 22 bp, Homo sapiens
tagcataatttgtagaaaatca

SEQ ID NO: 7614977 - DNA, 22 bp, Homo sapiens
tagcagttagagttgactgcaa

SEQ ID NO: 7614978 - DNA, 22 bp, Homo sapiens
tagcataacaggtaagagtgag

SEQ ID NO: 7614979 - DNA, 22 bp, Homo sapiens
tagcataacaggtaagagtgag

SEQ ID NO: 7614980 - DNA, 22 bp, Homo sapiens
tagcataacaggtaagagtgag

SEQ ID NO: 7614981 - DNA, 22 bp, Homo sapiens
tagcagttaatctgagccaaga

SEQ ID NO: 7614982 - DNA, 22 bp, Homo sapiens
tagcagtgtctaggtaggccat

SEQ ID NO: 7614983 - DNA, 22 bp, Homo sapiens
tagcagtgtctaggtaggccat

SEQ ID NO: 7614984 - DNA, 22 bp, Homo sapiens
tagcagtgtctaggtaggccat

SEQ ID NO: 7614985 - DNA, 22 bp, Homo sapiens
tagcagtgtaaagtggctagaa

SEQ ID NO: 7614986 - DNA, 22 bp, Homo sapiens
tagcagtgtgcaaaatctttaa

SEQ ID NO: 7614987 - DNA, 22 bp, Homo sapiens
tagcagtgtctaggtaggccat

SEQ ID NO: 7614988 - DNA, 22 bp, Homo sapiens
tagcagcaggggaaacagctgt

SEQ ID NO: 7614989 - DNA, 22 bp, Homo sapiens
tagcagcaggggaaacagctgt

SEQ ID NO: 7614990 - DNA, 20 bp, Homo sapiens
tagcagcagaaagaacttag

SEQ ID NO: 7614991 - DNA, 22 bp, Homo sapiens
tagcagcaggggaaacagctgt

SEQ ID NO: 7614992 - DNA, 18 bp, Homo sapiens
tagcagcactggccgctt

SEQ ID NO: 7614993 - DNA, 18 bp, Homo sapiens
tagcagcactggccgctt

SEQ ID NO: 7614994 - DNA, 18 bp, Homo sapiens
tagcagcactggccgctt

SEQ ID NO: 7614995 - DNA, 20 bp, Homo sapiens
tagcagcagaaagaacttag

SEQ ID NO: 7614996 - DNA, 20 bp, Homo sapiens
tagcagcagaaagaacttag

SEQ ID NO: 7614997 - DNA, 20 bp, Homo sapiens
tagcagcagaaagaacttag

SEQ ID NO: 7614998 - DNA, 22 bp, Homo sapiens
tagcagcacctacacgtcagag

SEQ ID NO: 7614999 - DNA, 22 bp, Homo sapiens
tagcagcacctacacgtcagag

SEQ ID NO: 7615000 - DNA, 22 bp, Homo sapiens
tagcagcacctacacgtcagag

SEQ ID NO: 7615001 - DNA, 22 bp, Homo sapiens
tagcagcactatttgttgtagt

SEQ ID NO: 7615002 - DNA, 22 bp, Homo sapiens
tagcagcactatttgttgtagt

SEQ ID NO: 7615003 - DNA, 22 bp, Homo sapiens
tagcagcacctacacgtcagag

SEQ ID NO: 7615004 - DNA, 22 bp, Homo sapiens
tagcagcacctttctaatctga

SEQ ID NO: 7615005 - DNA, 22 bp, Homo sapiens
cagggcaggacagatacattac

SEQ ID NO: 7615006 - DNA, 22 bp, Homo sapiens
cagggcaggacagatacattac

SEQ ID NO: 7615007 - DNA, 22 bp, Homo sapiens
tagcattaaaggtaagacatta

SEQ ID NO: 7615008 - DNA, 22 bp, Homo sapiens
tagcattagagatagaaatagt

SEQ ID NO: 7615009 - DNA, 22 bp, Homo sapiens
tagcattagtcagatatgtttt

SEQ ID NO: 7615010 - DNA, 22 bp, Homo sapiens
tagcattagtcagatatgtttt

SEQ ID NO: 7615011 - DNA, 22 bp, Homo sapiens
tagcattagagatagaaatagt

SEQ ID NO: 7615012 - DNA, 22 bp, Homo sapiens
tagcattaaaggtaagacatta

SEQ ID NO: 7615013 - DNA, 22 bp, Homo sapiens
tagcatgtcagtcgccacacgt

SEQ ID NO: 7615014 - DNA, 22 bp, Homo sapiens
tagcatgtcagtcgccacacgt

SEQ ID NO: 7615015 - DNA, 22 bp, Homo sapiens
tagcatgtcagtcgccacacgt

SEQ ID NO: 7615016 - DNA, 22 bp, Homo sapiens
tagcatgtcagtcgccacacgt

SEQ ID NO: 7615017 - DNA, 22 bp, Homo sapiens
tagcatggtctggaattctcag

SEQ ID NO: 7615018 - DNA, 22 bp, Homo sapiens
tagcatggtctgacatcctttg

SEQ ID NO: 7615019 - DNA, 20 bp, Homo sapiens
tagcatgggtgagggtagag

SEQ ID NO: 7615020 - DNA, 20 bp, Homo sapiens
tagcatgggtgagggtagag

SEQ ID NO: 7615021 - DNA, 22 bp, Homo sapiens
tagcatgggtcgcgtctctgga

SEQ ID NO: 7615022 - DNA, 22 bp, Homo sapiens
tagcatggggagcagaaagtca

SEQ ID NO: 7615023 - DNA, 22 bp, Homo sapiens
tagcatggctgtggtttcttct

SEQ ID NO: 7615024 - DNA, 22 bp, Homo sapiens
tagcatctttttctgtcttcta

SEQ ID NO: 7615025 - DNA, 22 bp, Homo sapiens
tagcatctgtttctctttgtga

SEQ ID NO: 7615026 - DNA, 22 bp, Homo sapiens
tagcatctgttctttcattaaa

SEQ ID NO: 7615027 - DNA, 22 bp, Homo sapiens
tagcatctgtactgacataatc

SEQ ID NO: 7615028 - DNA, 22 bp, Homo sapiens
tagcatcttgatttcagaccag

SEQ ID NO: 7615029 - DNA, 22 bp, Homo sapiens
tagcatctgtttctctttgtga

SEQ ID NO: 7615030 - DNA, 22 bp, Homo sapiens
tagcatctgtttctctttgtga

SEQ ID NO: 7615031 - DNA, 22 bp, Homo sapiens
tagcatctgcgttgggttggac

SEQ ID NO: 7615032 - DNA, 22 bp, Homo sapiens
tagcatctgcatttgtaactag

SEQ ID NO: 7615033 - DNA, 22 bp, Homo sapiens
tagcatctggagaaacaagtcc

SEQ ID NO: 7615034 - DNA, 22 bp, Homo sapiens
tagcatctggagaaacaagtcc

SEQ ID NO: 7615035 - DNA, 22 bp, Homo sapiens
tagcatctggagaaacaagtcc

SEQ ID NO: 7615036 - DNA, 22 bp, Homo sapiens
tagcatctgtactgacataatc

SEQ ID NO: 7615037 - DNA, 22 bp, Homo sapiens
tagcatctgtactgacataatc

SEQ ID NO: 7615038 - DNA, 22 bp, Homo sapiens
tagcatctgttctttcattaaa

SEQ ID NO: 7615039 - DNA, 22 bp, Homo sapiens
tagcatcatgatcagaactgtt

SEQ ID NO: 7615040 - DNA, 22 bp, Homo sapiens
tagcatcatgatcagaactgtt

SEQ ID NO: 7615041 - DNA, 22 bp, Homo sapiens
tagcatcagccacaccttgtac

SEQ ID NO: 7615042 - DNA, 22 bp, Homo sapiens
tagcatctgaactgttgaaaag

SEQ ID NO: 7615043 - DNA, 22 bp, Homo sapiens
tagcatctgcatttgtaactag

SEQ ID NO: 7615044 - DNA, 21 bp, Homo sapiens
tagcatctctactgtcataga

SEQ ID NO: 7615045 - DNA, 22 bp, Homo sapiens
tagcatctccttagggtaagga

SEQ ID NO: 7615046 - DNA, 22 bp, Homo sapiens
tagcatctcaacctcctgaaag

SEQ ID NO: 7615047 - DNA, 22 bp, Homo sapiens
tagcatctcaacctcctgaaag

SEQ ID NO: 7615048 - DNA, 22 bp, Homo sapiens
tagcatctaacatcttaggact

SEQ ID NO: 7615049 - DNA, 22 bp, Homo sapiens
cagggcagttttacttctctct

SEQ ID NO: 7615050 - DNA, 22 bp, Homo sapiens
cagggcagttttacttctctct

SEQ ID NO: 7615051 - DNA, 22 bp, Homo sapiens
cagggcagttttacttctctct

SEQ ID NO: 7615052 - DNA, 22 bp, Homo sapiens
cagggcagttttacttctctct

SEQ ID NO: 7615053 - DNA, 22 bp, Homo sapiens
cagggcagttttacttctctct

SEQ ID NO: 7615054 - DNA, 22 bp, Homo sapiens
cagggcagttttacttctctct

SEQ ID NO: 7615055 - DNA, 22 bp, Homo sapiens
cagggcataagatgaggctgta

SEQ ID NO: 7615056 - DNA, 22 bp, Homo sapiens
cagggcataagatgaggctgta

SEQ ID NO: 7615057 - DNA, 22 bp, Homo sapiens
cagggcagttttacttctctct

SEQ ID NO: 7615058 - DNA, 22 bp, Homo sapiens
cagggcagttttacttctctct

SEQ ID NO: 7615059 - DNA, 22 bp, Homo sapiens
cagggcagtttgtgcctatgag

SEQ ID NO: 7615060 - DNA, 22 bp, Homo sapiens
cagggcagtttgtgcctatgag

SEQ ID NO: 7615061 - DNA, 22 bp, Homo sapiens
cagggcagtttgtgcctatgag

SEQ ID NO: 7615062 - DNA, 22 bp, Homo sapiens
cagggcagtttgtgcctatgag

SEQ ID NO: 7615063 - DNA, 22 bp, Homo sapiens
cagggcagtttgtgcctatgag

SEQ ID NO: 7615064 - DNA, 22 bp, Homo sapiens
cagggcagttttacttctctct

SEQ ID NO: 7615065 - DNA, 22 bp, Homo sapiens
cagggcagttttacttctctct

SEQ ID NO: 7615066 - DNA, 22 bp, Homo sapiens
cagggcagttttacttctctct

SEQ ID NO: 7615067 - DNA, 22 bp, Homo sapiens
cagggcagttttacttctctct

SEQ ID NO: 7615068 - DNA, 22 bp, Homo sapiens
cagggccaagctgcagcatctg

SEQ ID NO: 7615069 - DNA, 22 bp, Homo sapiens
cagggccaagctgcagcatctg

SEQ ID NO: 7615070 - DNA, 22 bp, Homo sapiens
cagggccaagctgcagcatctg

SEQ ID NO: 7615071 - DNA, 22 bp, Homo sapiens
cagggccaagctgcagcatctg

SEQ ID NO: 7615072 - DNA, 22 bp, Homo sapiens
cagggccaagcccctttggctg

SEQ ID NO: 7615073 - DNA, 22 bp, Homo sapiens
cagggccaagcccctttggctg

SEQ ID NO: 7615074 - DNA, 22 bp, Homo sapiens
cagggccaagcccctttggctg

SEQ ID NO: 7615075 - DNA, 22 bp, Homo sapiens
cagggcatgaggtgtgcttctc

SEQ ID NO: 7615076 - DNA, 22 bp, Homo sapiens
cagggcatgaggtgtgcttctc

SEQ ID NO: 7615077 - DNA, 22 bp, Homo sapiens
cagggcattacttcaggtcctt

SEQ ID NO: 7615078 - DNA, 22 bp, Homo sapiens
cagggcatccgtgctccatgct

SEQ ID NO: 7615079 - DNA, 22 bp, Homo sapiens
cagggcatccgtgctccatgct

SEQ ID NO: 7615080 - DNA, 22 bp, Homo sapiens
cagggcatccgtgctccatgct

SEQ ID NO: 7615081 - DNA, 22 bp, Homo sapiens
cagggcataagatgaggctgta

SEQ ID NO: 7615082 - DNA, 22 bp, Homo sapiens
cagggcataagatgaggctgta

SEQ ID NO: 7615083 - DNA, 22 bp, Homo sapiens
cagggcataagatgaggctgta

SEQ ID NO: 7615084 - DNA, 22 bp, Homo sapiens
cagggcatccgtgctccatgct

SEQ ID NO: 7615085 - DNA, 22 bp, Homo sapiens
cagggcatgaggtgtgcttctc

SEQ ID NO: 7615086 - DNA, 22 bp, Homo sapiens
cagggcatgaggtgtgcttctc

SEQ ID NO: 7615087 - DNA, 22 bp, Homo sapiens
cagggcagtaccgccctctggc

SEQ ID NO: 7615088 - DNA, 22 bp, Homo sapiens
cagggcagtaccgccctctggc

SEQ ID NO: 7615089 - DNA, 22 bp, Homo sapiens
cagggcagtaccgccctctggc

SEQ ID NO: 7615090 - DNA, 22 bp, Homo sapiens
cagggcagtaccgccctctggc

SEQ ID NO: 7615091 - DNA, 22 bp, Homo sapiens
cagggcagtaccgccctctggc

SEQ ID NO: 7615092 - DNA, 22 bp, Homo sapiens
cagggcagtaccgccctctggc

SEQ ID NO: 7615093 - DNA, 22 bp, Homo sapiens
cagggcagtaccgccctctggc

SEQ ID NO: 7615094 - DNA, 22 bp, Homo sapiens
cagggcagtaccgccctctggc

SEQ ID NO: 7615095 - DNA, 22 bp, Homo sapiens
cagggcagtaccgccctctggc

SEQ ID NO: 7615096 - DNA, 22 bp, Homo sapiens
cagggcagtaccgccctctggc

SEQ ID NO: 7615097 - DNA, 22 bp, Homo sapiens
cagggcagtaccgccctctggc

SEQ ID NO: 7615098 - DNA, 22 bp, Homo sapiens
cagggcagtaccgccctctggc

SEQ ID NO: 7615099 - DNA, 22 bp, Homo sapiens
cagggcaggacagatacattac

SEQ ID NO: 7615100 - DNA, 22 bp, Homo sapiens
cagggcaggacagatacattac

SEQ ID NO: 7615101 - DNA, 22 bp, Homo sapiens
cagggcaggatgctgtgattat

SEQ ID NO: 7615102 - DNA, 22 bp, Homo sapiens
cagggcaggacagatacattac

SEQ ID NO: 7615103 - DNA, 22 bp, Homo sapiens
cagggcaggacagatacattac

SEQ ID NO: 7615104 - DNA, 22 bp, Homo sapiens
cagggcaggacagatacattac

SEQ ID NO: 7615105 - DNA, 22 bp, Homo sapiens
cagggcagtgaagaacacacgt

SEQ ID NO: 7615106 - DNA, 22 bp, Homo sapiens
cagggcagtgaagaacacacgt

SEQ ID NO: 7615107 - DNA, 22 bp, Homo sapiens
cagggcagtgaagaacacacgt

SEQ ID NO: 7615108 - DNA, 22 bp, Homo sapiens
cagggcagtgaagaacacacgt

SEQ ID NO: 7615109 - DNA, 22 bp, Homo sapiens
cagggcagtgaagaacacacgt

SEQ ID NO: 7615110 - DNA, 22 bp, Homo sapiens
cagggcagtgaagaacacacgt

SEQ ID NO: 7615111 - DNA, 22 bp, Homo sapiens
cagggcagtgaagaacacacgt

SEQ ID NO: 7615112 - DNA, 22 bp, Homo sapiens
cagggcagtgaagaacacacgt

SEQ ID NO: 7615113 - DNA, 22 bp, Homo sapiens
cagggcagtaccgccctctggc

SEQ ID NO: 7615114 - DNA, 22 bp, Homo sapiens
cagggcagtgaagaacacacgt

SEQ ID NO: 7615115 - DNA, 22 bp, Homo sapiens
cagggcagtgaagaacacacgt

SEQ ID NO: 7615116 - DNA, 22 bp, Homo sapiens
cagggcagtgaagaacacacgt

SEQ ID NO: 7615117 - DNA, 22 bp, Homo sapiens
cagggcagtttgtgcctatgag

SEQ ID NO: 7615118 - DNA, 22 bp, Homo sapiens
cagggcagtttgtgcctatgag

SEQ ID NO: 7615119 - DNA, 22 bp, Homo sapiens
cagggcagtttgtgcctatgag

SEQ ID NO: 7615120 - DNA, 22 bp, Homo sapiens
cagggcagtttgtgcctatgag

SEQ ID NO: 7615121 - DNA, 22 bp, Homo sapiens
cagggcagtttgtgcctatgag

SEQ ID NO: 7615122 - DNA, 22 bp, Homo sapiens
cagggcagtttgtgcctatgag

SEQ ID NO: 7615123 - DNA, 22 bp, Homo sapiens
cagggcagtttgtgcctatgag

SEQ ID NO: 7615124 - DNA, 22 bp, Homo sapiens
cagggcagtttgtgcctatgag

SEQ ID NO: 7615125 - DNA, 22 bp, Homo sapiens
cagggcagtttgtgcctatgag

SEQ ID NO: 7615126 - DNA, 22 bp, Homo sapiens
caggccctgccttggcatgtgt

SEQ ID NO: 7615127 - DNA, 22 bp, Homo sapiens
caggccctgccttgagggacct

SEQ ID NO: 7615128 - DNA, 22 bp, Homo sapiens
caggccctgccttggcatgtgt

SEQ ID NO: 7615129 - DNA, 22 bp, Homo sapiens
caggccctgccttggcatgtgt

SEQ ID NO: 7615130 - DNA, 22 bp, Homo sapiens
tacactggacaggagtaggaag

SEQ ID NO: 7615131 - DNA, 22 bp, Homo sapiens
tacactgctgctttgcccgtga

SEQ ID NO: 7615132 - DNA, 22 bp, Homo sapiens
tacactggacaggagtaggaag

SEQ ID NO: 7615133 - DNA, 22 bp, Homo sapiens
caggccctgctgctgagacctt

SEQ ID NO: 7615134 - DNA, 22 bp, Homo sapiens
tacactgagcaggaagaagtgg

SEQ ID NO: 7615135 - DNA, 22 bp, Homo sapiens
tacactggattagctgtcctac

SEQ ID NO: 7615136 - DNA, 22 bp, Homo sapiens
tacactggagcccttggggtct

SEQ ID NO: 7615137 - DNA, 22 bp, Homo sapiens
tacactggattagctgtcctac

SEQ ID NO: 7615138 - DNA, 22 bp, Homo sapiens
tacactggccccagggcggggc

SEQ ID NO: 7615139 - DNA, 22 bp, Homo sapiens
tacactggccccagggcggggc

SEQ ID NO: 7615140 - DNA, 22 bp, Homo sapiens
tacactggccaaatgcctttgg

SEQ ID NO: 7615141 - DNA, 22 bp, Homo sapiens
tacactgtaggtggcaggcagc

SEQ ID NO: 7615142 - DNA, 22 bp, Homo sapiens
tacactgtacgctctgcttcaa

SEQ ID NO: 7615143 - DNA, 22 bp, Homo sapiens
tacactggggctctgggagtga

SEQ ID NO: 7615144 - DNA, 22 bp, Homo sapiens
tacactggggctctgggagtga

SEQ ID NO: 7615145 - DNA, 22 bp, Homo sapiens
tacactggctgttttgcagaaa

SEQ ID NO: 7615146 - DNA, 22 bp, Homo sapiens
tacactgtggtaaactcaaagt

SEQ ID NO: 7615147 - DNA, 22 bp, Homo sapiens
tacactgtggtaaactcaaagt

SEQ ID NO: 7615148 - DNA, 22 bp, Homo sapiens
tacactgtgaggtttccaaggg

SEQ ID NO: 7615149 - DNA, 22 bp, Homo sapiens
tacactgtggtaaactcaaagt

SEQ ID NO: 7615150 - DNA, 22 bp, Homo sapiens
tacactgtgaggtttccaaggg

SEQ ID NO: 7615151 - DNA, 22 bp, Homo sapiens
tacactgtgacaatcatgacag

SEQ ID NO: 7615152 - DNA, 22 bp, Homo sapiens
tacactgtgaggtttccaaggg

SEQ ID NO: 7615153 - DNA, 22 bp, Homo sapiens
tacactgtgaggtttccaaggg

SEQ ID NO: 7615154 - DNA, 22 bp, Homo sapiens
tacactgtgtaaaatgcacttt

SEQ ID NO: 7615155 - DNA, 22 bp, Homo sapiens
tacactgtgtaaaatgcacttt

SEQ ID NO: 7615156 - DNA, 22 bp, Homo sapiens
tacactgtgtaaaatgcacttt

SEQ ID NO: 7615157 - DNA, 22 bp, Homo sapiens
tacactgtgtaaaatgcacttt

SEQ ID NO: 7615158 - DNA, 22 bp, Homo sapiens
tacactgtgacaatcatgacag

SEQ ID NO: 7615159 - DNA, 22 bp, Homo sapiens
tacactgtgacaatcatgacag

SEQ ID NO: 7615160 - DNA, 22 bp, Homo sapiens
tacactgtgacaatcatgacag

SEQ ID NO: 7615161 - DNA, 22 bp, Homo sapiens
tacactgtgacaatcatgacag

SEQ ID NO: 7615162 - DNA, 22 bp, Homo sapiens
tacactgtcttagaaaggggca

SEQ ID NO: 7615163 - DNA, 22 bp, Homo sapiens
tacactgtcagatttcgattgc

SEQ ID NO: 7615164 - DNA, 22 bp, Homo sapiens
tacactgtaggtggcaggcagc

SEQ ID NO: 7615165 - DNA, 22 bp, Homo sapiens
tacactgtaggtggcaggcagc

SEQ ID NO: 7615166 - DNA, 22 bp, Homo sapiens
tacactgtcagatttcgattgc

SEQ ID NO: 7615167 - DNA, 22 bp, Homo sapiens
tacactgtcagatttcgattgc

SEQ ID NO: 7615168 - DNA, 22 bp, Homo sapiens
tacactgtcagatttcgattgc

SEQ ID NO: 7615169 - DNA, 22 bp, Homo sapiens
tacagacattcaattttgaccc

SEQ ID NO: 7615170 - DNA, 22 bp, Homo sapiens
tacagacattcaattttgaccc

SEQ ID NO: 7615171 - DNA, 22 bp, Homo sapiens
tacagacattcaattttgaccc

SEQ ID NO: 7615172 - DNA, 22 bp, Homo sapiens
tacactttgtgatgccgggagc

SEQ ID NO: 7615173 - DNA, 22 bp, Homo sapiens
tacacttttcaatgtagtctgt

SEQ ID NO: 7615174 - DNA, 22 bp, Homo sapiens
tacactttcgtttgtggattag

SEQ ID NO: 7615175 - DNA, 22 bp, Homo sapiens
tacactttcgtttgtggattag

SEQ ID NO: 7615176 - DNA, 22 bp, Homo sapiens
tacactttcgtttgtggattag

SEQ ID NO: 7615177 - DNA, 22 bp, Homo sapiens
tacactttatggatcctacttt

SEQ ID NO: 7615178 - DNA, 22 bp, Homo sapiens
tacactttatggatcctacttt

SEQ ID NO: 7615179 - DNA, 22 bp, Homo sapiens
tacactttatggatcctacttt

SEQ ID NO: 7615180 - DNA, 22 bp, Homo sapiens
tacactttatggatcctacttt

SEQ ID NO: 7615181 - DNA, 22 bp, Homo sapiens
tacactttatggatcctacttt

SEQ ID NO: 7615182 - DNA, 22 bp, Homo sapiens
tacacttgttcaaacagcaaaa

SEQ ID NO: 7615183 - DNA, 19 bp, Homo sapiens
tacacttgtaatgagcaga

SEQ ID NO: 7615184 - DNA, 22 bp, Homo sapiens
tacacttgttcaaacagcaaaa

SEQ ID NO: 7615185 - DNA, 22 bp, Homo sapiens
tacactgtttttggaaagaaga

SEQ ID NO: 7615186 - DNA, 22 bp, Homo sapiens
tacacttataactctgtgtgtg

SEQ ID NO: 7615187 - DNA, 22 bp, Homo sapiens
tacactgtttttggaaagaaga

SEQ ID NO: 7615188 - DNA, 22 bp, Homo sapiens
tacactgtttgaactgtggtcg

SEQ ID NO: 7615189 - DNA, 22 bp, Homo sapiens
tacactgtgtaaaatgcacttt

SEQ ID NO: 7615190 - DNA, 22 bp, Homo sapiens
tacagagaataataggacaggt

SEQ ID NO: 7615191 - DNA, 22 bp, Homo sapiens
tacagagaataataggacaggt

SEQ ID NO: 7615192 - DNA, 22 bp, Homo sapiens
tacagagaataataggacaggt

SEQ ID NO: 7615193 - DNA, 22 bp, Homo sapiens
tacagagaataataggacaggt

SEQ ID NO: 7615194 - DNA, 22 bp, Homo sapiens
tacagagaataataggacaggt

SEQ ID NO: 7615195 - DNA, 22 bp, Homo sapiens
tacagagaactcatagaaagaa

SEQ ID NO: 7615196 - DNA, 22 bp, Homo sapiens
tacagagaactcatagaaagaa

SEQ ID NO: 7615197 - DNA, 22 bp, Homo sapiens
tacagagaactcatagaaagaa

SEQ ID NO: 7615198 - DNA, 22 bp, Homo sapiens
tacagagaactcatagaaagaa

SEQ ID NO: 7615199 - DNA, 22 bp, Homo sapiens
tacagagaactcatagaaagaa

SEQ ID NO: 7615200 - DNA, 22 bp, Homo sapiens
tacagacatttactccactcct

SEQ ID NO: 7615201 - DNA, 22 bp, Homo sapiens
tacagaccagtagttctcagcg

SEQ ID NO: 7615202 - DNA, 22 bp, Homo sapiens
tacagacattcaattttgaccc

SEQ ID NO: 7615203 - DNA, 22 bp, Homo sapiens
tacagacatttactccactcct

SEQ ID NO: 7615204 - DNA, 22 bp, Homo sapiens
tacagacatttactccactcct

SEQ ID NO: 7615205 - DNA, 22 bp, Homo sapiens
caggccaccagatacatgcccc

SEQ ID NO: 7615206 - DNA, 22 bp, Homo sapiens
caggccaccagatacatgcccc

SEQ ID NO: 7615207 - DNA, 22 bp, Homo sapiens
caggccaccagatacatgcccc

SEQ ID NO: 7615208 - DNA, 22 bp, Homo sapiens
caggccaccagatacatgcccc

SEQ ID NO: 7615209 - DNA, 22 bp, Homo sapiens
caggccaccagatacatgcccc

SEQ ID NO: 7615210 - DNA, 22 bp, Homo sapiens
caggccacagctaaagaggatt

SEQ ID NO: 7615211 - DNA, 22 bp, Homo sapiens
caggccacagctaaagaggatt

SEQ ID NO: 7615212 - DNA, 22 bp, Homo sapiens
caggccacacggcggctccctg

SEQ ID NO: 7615213 - DNA, 22 bp, Homo sapiens
caggccacacggcggctccctg

SEQ ID NO: 7615214 - DNA, 22 bp, Homo sapiens
caggccaatatcacatgctatg

SEQ ID NO: 7615215 - DNA, 22 bp, Homo sapiens
caggccaatatcacatgctatg

SEQ ID NO: 7615216 - DNA, 22 bp, Homo sapiens
caggccacaagttgggttcaag

SEQ ID NO: 7615217 - DNA, 22 bp, Homo sapiens
caggccacaagttgggttcaag

SEQ ID NO: 7615218 - DNA, 22 bp, Homo sapiens
caggccacaagttgggttcaag

SEQ ID NO: 7615219 - DNA, 22 bp, Homo sapiens
caggccacacggcggctccctg

SEQ ID NO: 7615220 - DNA, 22 bp, Homo sapiens
caggccacacggcggctccctg

SEQ ID NO: 7615221 - DNA, 22 bp, Homo sapiens
caggccacacggcggctccctg

SEQ ID NO: 7615222 - DNA, 22 bp, Homo sapiens
caggccacacggcggctccctg

SEQ ID NO: 7615223 - DNA, 22 bp, Homo sapiens
caggccacgccccggcgtgtga

SEQ ID NO: 7615224 - DNA, 22 bp, Homo sapiens
caggccacgccccggcgtgtga

SEQ ID NO: 7615225 - DNA, 22 bp, Homo sapiens
caggccaccagatacatgcccc

SEQ ID NO: 7615226 - DNA, 22 bp, Homo sapiens
caggccacagctaaagaggatt

SEQ ID NO: 7615227 - DNA, 22 bp, Homo sapiens
caggccaccagatacatgcccc

SEQ ID NO: 7615228 - DNA, 22 bp, Homo sapiens
caggccagagcgcgtggttggg

SEQ ID NO: 7615229 - DNA, 22 bp, Homo sapiens
caggcccagggagggagaccaa

SEQ ID NO: 7615230 - DNA, 22 bp, Homo sapiens
caggcccaggggtctggcccac

SEQ ID NO: 7615231 - DNA, 22 bp, Homo sapiens
caggcccaggggtctggcccac

SEQ ID NO: 7615232 - DNA, 22 bp, Homo sapiens
caggccacgccccggcgtgtga

SEQ ID NO: 7615233 - DNA, 22 bp, Homo sapiens
caggccacgccccggcgtgtga

SEQ ID NO: 7615234 - DNA, 22 bp, Homo sapiens
caggccacgccccggcgtgtga

SEQ ID NO: 7615235 - DNA, 22 bp, Homo sapiens
caggcccaggggtctggcccac

SEQ ID NO: 7615236 - DNA, 22 bp, Homo sapiens
caggcccaggggtctggcccac

SEQ ID NO: 7615237 - DNA, 22 bp, Homo sapiens
caggcccaggggtctggcccac

SEQ ID NO: 7615238 - DNA, 22 bp, Homo sapiens
caggcccaggggtctggcccac

SEQ ID NO: 7615239 - DNA, 22 bp, Homo sapiens
caggccctcaggcaagggctct

SEQ ID NO: 7615240 - DNA, 22 bp, Homo sapiens
caggccctcaggcaagggctct

SEQ ID NO: 7615241 - DNA, 22 bp, Homo sapiens
caggccctgcactaggccctgg

SEQ ID NO: 7615242 - DNA, 22 bp, Homo sapiens
caggccctgcactaggccctgg

SEQ ID NO: 7615243 - DNA, 22 bp, Homo sapiens
caggccctgcactaggccctgg

SEQ ID NO: 7615244 - DNA, 22 bp, Homo sapiens
caggccctgcactaggccctgg

SEQ ID NO: 7615245 - DNA, 22 bp, Homo sapiens
caggccctgccttgagggacct

SEQ ID NO: 7615246 - DNA, 22 bp, Homo sapiens
caggccctgcactaggccctgg

SEQ ID NO: 7615247 - DNA, 22 bp, Homo sapiens
caggccctgccttgagggacct

SEQ ID NO: 7615248 - DNA, 22 bp, Homo sapiens
caggccctgcacagtggtcctg

SEQ ID NO: 7615249 - DNA, 22 bp, Homo sapiens
caggccctgcacagtggtcctg

SEQ ID NO: 7615250 - DNA, 22 bp, Homo sapiens
caggccctctgcaccctcgtct

SEQ ID NO: 7615251 - DNA, 22 bp, Homo sapiens
caggccctgcacagtggtcctg

SEQ ID NO: 7615252 - DNA, 22 bp, Homo sapiens
caggccctgcacagtggtcctg

SEQ ID NO: 7615253 - DNA, 22 bp, Homo sapiens
caggccctgcacagtggtcctg

SEQ ID NO: 7615254 - DNA, 22 bp, Homo sapiens
caggccctgcacagtggtcctg

SEQ ID NO: 7615255 - DNA, 22 bp, Homo sapiens
caggccctctgcaccctcgtct

SEQ ID NO: 7615256 - DNA, 22 bp, Homo sapiens
caggccctcgtggtgagctggg

SEQ ID NO: 7615257 - DNA, 22 bp, Homo sapiens
caggccctctgcaccctcgtct

SEQ ID NO: 7615258 - DNA, 22 bp, Homo sapiens
caggccctcgtggtgagctggg

SEQ ID NO: 7615259 - DNA, 22 bp, Homo sapiens
caggccctcgtggtgagctggg

SEQ ID NO: 7615260 - DNA, 22 bp, Homo sapiens
caggccctcgtggtgagctggg

SEQ ID NO: 7615261 - DNA, 22 bp, Homo sapiens
caggccctcgtggtgagctggg

SEQ ID NO: 7615262 - DNA, 22 bp, Homo sapiens
caggccctcgtggtgagctggg

SEQ ID NO: 7615263 - DNA, 22 bp, Homo sapiens
caggccctcgcccgcagcgacc

SEQ ID NO: 7615264 - DNA, 22 bp, Homo sapiens
caggccctcctgtgatctgcct

SEQ ID NO: 7615265 - DNA, 22 bp, Homo sapiens
caggccctcctgtgatctgcct

SEQ ID NO: 7615266 - DNA, 22 bp, Homo sapiens
caggccctcctgtgatctgcct

SEQ ID NO: 7615267 - DNA, 22 bp, Homo sapiens
caggccctcctgtgatctgcct

SEQ ID NO: 7615268 - DNA, 22 bp, Homo sapiens
caggccctcaggcaagggctct

SEQ ID NO: 7615269 - DNA, 22 bp, Homo sapiens
caggccctcgcccgcagcgacc

SEQ ID NO: 7615270 - DNA, 22 bp, Homo sapiens
caggccctcgcccgcagcgacc

SEQ ID NO: 7615271 - DNA, 22 bp, Homo sapiens
caggccctcctgtgatctgcct

SEQ ID NO: 7615272 - DNA, 22 bp, Homo sapiens
caggccctcctgtgatctgcct

SEQ ID NO: 7615273 - DNA, 22 bp, Homo sapiens
cagctctgccacttcctagcta

SEQ ID NO: 7615274 - DNA, 22 bp, Homo sapiens
cagctctgccacttcctagcta

SEQ ID NO: 7615275 - DNA, 22 bp, Homo sapiens
cagctctgccacttcctagcta

SEQ ID NO: 7615276 - DNA, 22 bp, Homo sapiens
cagctctgccacttcctagcta

SEQ ID NO: 7615277 - DNA, 22 bp, Homo sapiens
cagctctgccacttcctagcta

SEQ ID NO: 7615278 - DNA, 22 bp, Homo sapiens
cagctctgccacttcctagcta

SEQ ID NO: 7615279 - DNA, 17 bp, Homo sapiens
cagctctgcatcttcct

SEQ ID NO: 7615280 - DNA, 17 bp, Homo sapiens
cagctctgcatcttcct

SEQ ID NO: 7615281 - DNA, 17 bp, Homo sapiens
cagctctgcatcttcct

SEQ ID NO: 7615282 - DNA, 17 bp, Homo sapiens
cagctctgcatcttcct

SEQ ID NO: 7615283 - DNA, 17 bp, Homo sapiens
cagctctgcatcttcct

SEQ ID NO: 7615284 - DNA, 17 bp, Homo sapiens
cagctctgcatcttcct

SEQ ID NO: 7615285 - DNA, 22 bp, Homo sapiens
cagctctgccatcatctgcctt

SEQ ID NO: 7615286 - DNA, 22 bp, Homo sapiens
cagctctgccatcatctgcctt

SEQ ID NO: 7615287 - DNA, 22 bp, Homo sapiens
cagctctgccatcatctgcctt

SEQ ID NO: 7615288 - DNA, 22 bp, Homo sapiens
cagctctgccacttcctagcta

SEQ ID NO: 7615289 - DNA, 22 bp, Homo sapiens
cagctctgccacttcctagcta

SEQ ID NO: 7615290 - DNA, 22 bp, Homo sapiens
cagctctgccacttcctagcta

SEQ ID NO: 7615291 - DNA, 22 bp, Homo sapiens
cagctctgctgggaggatgcag

SEQ ID NO: 7615292 - DNA, 22 bp, Homo sapiens
cagctctgctgggaggatgcag

SEQ ID NO: 7615293 - DNA, 22 bp, Homo sapiens
cagctctgctgggaggatgcag

SEQ ID NO: 7615294 - DNA, 22 bp, Homo sapiens
gtggagaggagcagctacctca

SEQ ID NO: 7615295 - DNA, 22 bp, Homo sapiens
gtggagaggagcagctacctca

SEQ ID NO: 7615296 - DNA, 22 bp, Homo sapiens
gtggagaggagcagctacctca

SEQ ID NO: 7615297 - DNA, 22 bp, Homo sapiens
gtggagaggagcagctacctca

SEQ ID NO: 7615298 - DNA, 22 bp, Homo sapiens
cagctctgctgggaggatgcag

SEQ ID NO: 7615299 - DNA, 22 bp, Homo sapiens
cagctctgctgggaggatgcag

SEQ ID NO: 7615300 - DNA, 22 bp, Homo sapiens
cagctctgcctctggggctgag

SEQ ID NO: 7615301 - DNA, 22 bp, Homo sapiens
cagctctgcctctggggctgag

SEQ ID NO: 7615302 - DNA, 22 bp, Homo sapiens
cagctctgcctctggggctgag

SEQ ID NO: 7615303 - DNA, 22 bp, Homo sapiens
cagctctgcctctggggctgag

SEQ ID NO: 7615304 - DNA, 22 bp, Homo sapiens
cagctctgcctctggggctgag

SEQ ID NO: 7615305 - DNA, 22 bp, Homo sapiens
cagctctgcctctggggctgag

SEQ ID NO: 7615306 - DNA, 22 bp, Homo sapiens
cagctctgcctctggggctgag

SEQ ID NO: 7615307 - DNA, 22 bp, Homo sapiens
cagctctgcctctggggctgag

SEQ ID NO: 7615308 - DNA, 22 bp, Homo sapiens
cagctctgccatcatctgcctt

SEQ ID NO: 7615309 - DNA, 22 bp, Homo sapiens
cagctctgccatcatctgcctt

SEQ ID NO: 7615310 - DNA, 22 bp, Homo sapiens
cagctctgcctctggggctgag

SEQ ID NO: 7615311 - DNA, 22 bp, Homo sapiens
cagctctgccatcatctgcctt

SEQ ID NO: 7615312 - DNA, 22 bp, Homo sapiens
cagctctgccatcatctgcctt

SEQ ID NO: 7615313 - DNA, 22 bp, Homo sapiens
cagctctgccatcatctgcctt

SEQ ID NO: 7615314 - DNA, 22 bp, Homo sapiens
gtggagcataacacactagcct

SEQ ID NO: 7615315 - DNA, 22 bp, Homo sapiens
gtggagcataacacactagcct

SEQ ID NO: 7615316 - DNA, 22 bp, Homo sapiens
gtggagcatgtgaggactgagt

SEQ ID NO: 7615317 - DNA, 22 bp, Homo sapiens
gtggagcataacacactagcct

SEQ ID NO: 7615318 - DNA, 22 bp, Homo sapiens
gtggagcaggactagctgagaa

SEQ ID NO: 7615319 - DNA, 22 bp, Homo sapiens
gtggagcaggactagctgagaa

SEQ ID NO: 7615320 - DNA, 22 bp, Homo sapiens
gtggagcaggactagctgagaa

SEQ ID NO: 7615321 - DNA, 22 bp, Homo sapiens
gtggagcaggactagctgagaa

SEQ ID NO: 7615322 - DNA, 22 bp, Homo sapiens
gtggagcaggactagctgagaa

SEQ ID NO: 7615323 - DNA, 22 bp, Homo sapiens
gtggagccaggatctccgcaca

SEQ ID NO: 7615324 - DNA, 23 bp, Homo sapiens
gtggagccacatcacaggctcct

SEQ ID NO: 7615325 - DNA, 22 bp, Homo sapiens
gtggagccaggatctccgcaca

SEQ ID NO: 7615326 - DNA, 23 bp, Homo sapiens
gtggagccacatcacaggctcct

SEQ ID NO: 7615327 - DNA, 23 bp, Homo sapiens
gtggagccacatcacaggctcct

SEQ ID NO: 7615328 - DNA, 23 bp, Homo sapiens
gtggagccacatcacaggctcct

SEQ ID NO: 7615329 - DNA, 22 bp, Homo sapiens
gtggagcatgtgaggactgagt

SEQ ID NO: 7615330 - DNA, 22 bp, Homo sapiens
gtggagcatgtgaggactgagt

SEQ ID NO: 7615331 - DNA, 22 bp, Homo sapiens
gtggagcacggaggaggcccct

SEQ ID NO: 7615332 - DNA, 22 bp, Homo sapiens
gtggagcacggaggaggcccct

SEQ ID NO: 7615333 - DNA, 22 bp, Homo sapiens
gtggagcaggactagctgagaa

SEQ ID NO: 7615334 - DNA, 22 bp, Homo sapiens
gtggagcaggactagctgagaa

SEQ ID NO: 7615335 - DNA, 22 bp, Homo sapiens
gtggagcaggactagctgagaa

SEQ ID NO: 7615336 - DNA, 22 bp, Homo sapiens
gtggagcaatcagagggtcagt

SEQ ID NO: 7615337 - DNA, 22 bp, Homo sapiens
gtggagcacggaggaggcccct

SEQ ID NO: 7615338 - DNA, 22 bp, Homo sapiens
gtggagcacggaggaggcccct

SEQ ID NO: 7615339 - DNA, 22 bp, Homo sapiens
gtggagcaatcagagggtcagt

SEQ ID NO: 7615340 - DNA, 22 bp, Homo sapiens
gtggagaggagcagctacctca

SEQ ID NO: 7615341 - DNA, 20 bp, Homo sapiens
gtggagaggctggcgggact

SEQ ID NO: 7615342 - DNA, 20 bp, Homo sapiens
gtggagaggctggcgggact

SEQ ID NO: 7615343 - DNA, 20 bp, Homo sapiens
gtggagaggctggcgggact

SEQ ID NO: 7615344 - DNA, 20 bp, Homo sapiens
gtggagaggctggcgggact

SEQ ID NO: 7615345 - DNA, 20 bp, Homo sapiens
gtggagaggctggcgggact

SEQ ID NO: 7615346 - DNA, 20 bp, Homo sapiens
gtggagaggctggcgggact

SEQ ID NO: 7615347 - DNA, 20 bp, Homo sapiens
gtggagaggctggcgggact

SEQ ID NO: 7615348 - DNA, 22 bp, Homo sapiens
gtggagcaatcagagggtcagt

SEQ ID NO: 7615349 - DNA, 21 bp, Homo sapiens
gtggagagtgattttgatgca

SEQ ID NO: 7615350 - DNA, 21 bp, Homo sapiens
gtggagagtgattttgatgca

SEQ ID NO: 7615351 - DNA, 22 bp, Homo sapiens
caggccaagcctccccagctcc

SEQ ID NO: 7615352 - DNA, 22 bp, Homo sapiens
caggccaactgcatggtgacca

SEQ ID NO: 7615353 - DNA, 22 bp, Homo sapiens
caggccaagcctccccagctcc

SEQ ID NO: 7615354 - DNA, 22 bp, Homo sapiens
caggccaagtcccaagtgcggg

SEQ ID NO: 7615355 - DNA, 22 bp, Homo sapiens
caggccaataaatgtgatggcc

SEQ ID NO: 7615356 - DNA, 22 bp, Homo sapiens
caggccaaagatcccattgaca

SEQ ID NO: 7615357 - DNA, 22 bp, Homo sapiens
caggccaactgcatggtgacca

SEQ ID NO: 7615358 - DNA, 22 bp, Homo sapiens
caggccaaagatcccattgaca

SEQ ID NO: 7615359 - DNA, 22 bp, Homo sapiens
caggccaaagatcccattgaca

SEQ ID NO: 7615360 - DNA, 22 bp, Homo sapiens
caggccaaaattcaggcattct

SEQ ID NO: 7615361 - DNA, 22 bp, Homo sapiens
tacacagtaaatggtaaataca

SEQ ID NO: 7615362 - DNA, 22 bp, Homo sapiens
tacacagtaaatggtaaataca

SEQ ID NO: 7615363 - DNA, 22 bp, Homo sapiens
tacacagggagagattggaaac

SEQ ID NO: 7615364 - DNA, 22 bp, Homo sapiens
tacacagggagagattggaaac

SEQ ID NO: 7615365 - DNA, 22 bp, Homo sapiens
tacacagggagagattggaaac

SEQ ID NO: 7615366 - DNA, 22 bp, Homo sapiens
tacacagggtatggcttgagga

SEQ ID NO: 7615367 - DNA, 22 bp, Homo sapiens
tacacagggtatggcttgagga

SEQ ID NO: 7615368 - DNA, 22 bp, Homo sapiens
tacacaggggagcatggttgac

SEQ ID NO: 7615369 - DNA, 22 bp, Homo sapiens
tacacaggctgcctctttgcat

SEQ ID NO: 7615370 - DNA, 22 bp, Homo sapiens
tacacaggctgcctctttgcat

SEQ ID NO: 7615371 - DNA, 22 bp, Homo sapiens
tacacagggaaaggtctcagag

SEQ ID NO: 7615372 - DNA, 22 bp, Homo sapiens
tacacagggagagattggaaac

SEQ ID NO: 7615373 - DNA, 22 bp, Homo sapiens
tacacagggagagattggaaac

SEQ ID NO: 7615374 - DNA, 22 bp, Homo sapiens
tacacagggaaaggtctcagag

SEQ ID NO: 7615375 - DNA, 22 bp, Homo sapiens
tacacagggaaaggtctcagag

SEQ ID NO: 7615376 - DNA, 22 bp, Homo sapiens
tacacagatttcagtatcatca

SEQ ID NO: 7615377 - DNA, 22 bp, Homo sapiens
tacacagatttcagtatcatca

SEQ ID NO: 7615378 - DNA, 22 bp, Homo sapiens
tacacagatttcagtatcatca

SEQ ID NO: 7615379 - DNA, 22 bp, Homo sapiens
tacacagatttaaaagcaggga

SEQ ID NO: 7615380 - DNA, 22 bp, Homo sapiens
tacacagatttaaaagcaggga

SEQ ID NO: 7615381 - DNA, 22 bp, Homo sapiens
tacacagatttaaaagcaggga

SEQ ID NO: 7615382 - DNA, 22 bp, Homo sapiens
tacaatatgtgaactttggtgt

SEQ ID NO: 7615383 - DNA, 22 bp, Homo sapiens
tacaatatgtgaactttggtgt

SEQ ID NO: 7615384 - DNA, 22 bp, Homo sapiens
tacaatatgtgaactttggtgt

SEQ ID NO: 7615385 - DNA, 22 bp, Homo sapiens
gtggagccaggggctgtaggta

SEQ ID NO: 7615386 - DNA, 22 bp, Homo sapiens
gtggagccaggatctccgcaca

SEQ ID NO: 7615387 - DNA, 22 bp, Homo sapiens
gtggagccaggggctgtaggta

SEQ ID NO: 7615388 - DNA, 22 bp, Homo sapiens
gtggagccaggggctgtaggta

SEQ ID NO: 7615389 - DNA, 22 bp, Homo sapiens
tacaatagggcttttgtttatg

SEQ ID NO: 7615390 - DNA, 22 bp, Homo sapiens
tacacagaagccagaaggcctg

SEQ ID NO: 7615391 - DNA, 22 bp, Homo sapiens
tacacagaagccagaaggcctg

SEQ ID NO: 7615392 - DNA, 22 bp, Homo sapiens
tacacagaagccagaaggcctg

SEQ ID NO: 7615393 - DNA, 22 bp, Homo sapiens
tacacagactcttcaattcaga

SEQ ID NO: 7615394 - DNA, 22 bp, Homo sapiens
tacacagactcttcaattcaga

SEQ ID NO: 7615395 - DNA, 22 bp, Homo sapiens
tacacagactcttcaattcaga

SEQ ID NO: 7615396 - DNA, 22 bp, Homo sapiens
tacacagactcttcaattcaga

SEQ ID NO: 7615397 - DNA, 22 bp, Homo sapiens
tacacagactcttcaattcaga

SEQ ID NO: 7615398 - DNA, 22 bp, Homo sapiens
tacacagactcttcaattcaga

SEQ ID NO: 7615399 - DNA, 22 bp, Homo sapiens
tacacagactcttcaattcaga

SEQ ID NO: 7615400 - DNA, 22 bp, Homo sapiens
tacacagactcttcaattcaga

SEQ ID NO: 7615401 - DNA, 22 bp, Homo sapiens
tacacagaggctgatgtcttag

SEQ ID NO: 7615402 - DNA, 22 bp, Homo sapiens
tacacagatatgtgatcaatca

SEQ ID NO: 7615403 - DNA, 22 bp, Homo sapiens
tacacagatatgtgatcaatca

SEQ ID NO: 7615404 - DNA, 22 bp, Homo sapiens
tacacagaggctgatgtcttag

SEQ ID NO: 7615405 - DNA, 22 bp, Homo sapiens
tacacagaggctgatgtcttag

SEQ ID NO: 7615406 - DNA, 22 bp, Homo sapiens
tacacagatatgtgatcaatca

SEQ ID NO: 7615407 - DNA, 22 bp, Homo sapiens
tacacagatatgtgatcaatca

SEQ ID NO: 7615408 - DNA, 22 bp, Homo sapiens
tacacagatatgtgatcaatca

SEQ ID NO: 7615409 - DNA, 22 bp, Homo sapiens
tacacagaggctgatgtcttag

SEQ ID NO: 7615410 - DNA, 22 bp, Homo sapiens
tacacagaggcagctgtctgct

SEQ ID NO: 7615411 - DNA, 22 bp, Homo sapiens
tacacagaggctgatgtcttag

SEQ ID NO: 7615412 - DNA, 22 bp, Homo sapiens
tacacagagactcaaaagggca

SEQ ID NO: 7615413 - DNA, 22 bp, Homo sapiens
tacacagaggcagctgtctgct

SEQ ID NO: 7615414 - DNA, 22 bp, Homo sapiens
tacacagaggcagctgtctgct

SEQ ID NO: 7615415 - DNA, 22 bp, Homo sapiens
tacacagactcttcaattcaga

SEQ ID NO: 7615416 - DNA, 22 bp, Homo sapiens
tacacagactcttcaattcaga

SEQ ID NO: 7615417 - DNA, 22 bp, Homo sapiens
tacacagagactcaaaagggca

SEQ ID NO: 7615418 - DNA, 22 bp, Homo sapiens
tacacagagactcaaaagggca

SEQ ID NO: 7615419 - DNA, 22 bp, Homo sapiens
tacagttatatgtgataagtaa

SEQ ID NO: 7615420 - DNA, 22 bp, Homo sapiens
tacagttatatgtgataagtaa

SEQ ID NO: 7615421 - DNA, 22 bp, Homo sapiens
tacagttcacagtatcataaat

SEQ ID NO: 7615422 - DNA, 22 bp, Homo sapiens
tacagttcacagtatcataaat

SEQ ID NO: 7615423 - DNA, 22 bp, Homo sapiens
tacagttcctctcgtggaggtg

SEQ ID NO: 7615424 - DNA, 22 bp, Homo sapiens
tacagttccaggatcatagggt

SEQ ID NO: 7615425 - DNA, 22 bp, Homo sapiens
tacagttctagtcaaaaatcac

SEQ ID NO: 7615426 - DNA, 20 bp, Homo sapiens
tacagttctgtagaagtaga

SEQ ID NO: 7615427 - DNA, 22 bp, Homo sapiens
tacagtttacatgagaggaagc

SEQ ID NO: 7615428 - DNA, 22 bp, Homo sapiens
tacagtttaacactttggagaa

SEQ ID NO: 7615429 - DNA, 22 bp, Homo sapiens
tacagtttacatgagaggaagc

SEQ ID NO: 7615430 - DNA, 22 bp, Homo sapiens
tacagtttacatgagaggaagc

SEQ ID NO: 7615431 - DNA, 22 bp, Homo sapiens
tacagttctttgaaggatctag

SEQ ID NO: 7615432 - DNA, 22 bp, Homo sapiens
tacagttctttgaaggatctag

SEQ ID NO: 7615433 - DNA, 22 bp, Homo sapiens
tacagtttaacactttggagaa

SEQ ID NO: 7615434 - DNA, 22 bp, Homo sapiens
tacagtttaacactttggagaa

SEQ ID NO: 7615435 - DNA, 22 bp, Homo sapiens
tacagtttaacactttggagaa

SEQ ID NO: 7615436 - DNA, 22 bp, Homo sapiens
tacagtttcccagcagatgcaa

SEQ ID NO: 7615437 - DNA, 22 bp, Homo sapiens
tacagtttcccagcagatgcaa

SEQ ID NO: 7615438 - DNA, 22 bp, Homo sapiens
tacagtttccaagggcttgaag

SEQ ID NO: 7615439 - DNA, 22 bp, Homo sapiens
tacagtttagaaccatagatgg

SEQ ID NO: 7615440 - DNA, 22 bp, Homo sapiens
tacagtttagaaccatagatgg

SEQ ID NO: 7615441 - DNA, 22 bp, Homo sapiens
tacagtttagaaccatagatgg

SEQ ID NO: 7615442 - DNA, 22 bp, Homo sapiens
tacagtttagaaccatagatgg

SEQ ID NO: 7615443 - DNA, 22 bp, Homo sapiens
tacagtttctcattatgctctc

SEQ ID NO: 7615444 - DNA, 22 bp, Homo sapiens
tacagtttctgtccttgtggag

SEQ ID NO: 7615445 - DNA, 22 bp, Homo sapiens
tacagtttctgtccttgtggag

SEQ ID NO: 7615446 - DNA, 22 bp, Homo sapiens
tacagtttctcattatgctctc

SEQ ID NO: 7615447 - DNA, 22 bp, Homo sapiens
tacagtttctcattatgctctc

SEQ ID NO: 7615448 - DNA, 22 bp, Homo sapiens
tacagtttcccagcagatgcaa

SEQ ID NO: 7615449 - DNA, 22 bp, Homo sapiens
tacagtttcccagcagatgcaa

SEQ ID NO: 7615450 - DNA, 22 bp, Homo sapiens
caggctccagcttcctgctcag

SEQ ID NO: 7615451 - DNA, 22 bp, Homo sapiens
caggctccagcttcctgctcag

SEQ ID NO: 7615452 - DNA, 22 bp, Homo sapiens
caggctccagcttcctgctcag

SEQ ID NO: 7615453 - DNA, 22 bp, Homo sapiens
caggctccagcttcctgctcag

SEQ ID NO: 7615454 - DNA, 22 bp, Homo sapiens
caggctccactgtaggcagctc

SEQ ID NO: 7615455 - DNA, 22 bp, Homo sapiens
caggctccagcttcctgctcag

SEQ ID NO: 7615456 - DNA, 22 bp, Homo sapiens
caggctccattaatcatcctgc

SEQ ID NO: 7615457 - DNA, 22 bp, Homo sapiens
tacagtttgtatggtcaggaat

SEQ ID NO: 7615458 - DNA, 22 bp, Homo sapiens
tacagtttctgtccttgtggag

SEQ ID NO: 7615459 - DNA, 22 bp, Homo sapiens
tacagtttgtatggtcaggaat

SEQ ID NO: 7615460 - DNA, 22 bp, Homo sapiens
tacagtttgtatggtcaggaat

SEQ ID NO: 7615461 - DNA, 22 bp, Homo sapiens
caggctcactgtaaggtcagct

SEQ ID NO: 7615462 - DNA, 22 bp, Homo sapiens
caggctcaatggccacttgggc

SEQ ID NO: 7615463 - DNA, 22 bp, Homo sapiens
caggctcaatggccacttgggc

SEQ ID NO: 7615464 - DNA, 22 bp, Homo sapiens
caggctcaatggccacttgggc

SEQ ID NO: 7615465 - DNA, 22 bp, Homo sapiens
caggctcaaggctgacttccat

SEQ ID NO: 7615466 - DNA, 22 bp, Homo sapiens
caggctcccaccctcctgcagc

SEQ ID NO: 7615467 - DNA, 22 bp, Homo sapiens
caggctcccaccctcctgcagc

SEQ ID NO: 7615468 - DNA, 22 bp, Homo sapiens
caggctcccaccctcctgcagc

SEQ ID NO: 7615469 - DNA, 22 bp, Homo sapiens
caggctcccaccctcctgcagc

SEQ ID NO: 7615470 - DNA, 22 bp, Homo sapiens
caggctcccacaagctcccagc

SEQ ID NO: 7615471 - DNA, 22 bp, Homo sapiens
caggctcccaccctcctgcagc

SEQ ID NO: 7615472 - DNA, 22 bp, Homo sapiens
caggctcccacaagctcccagc

SEQ ID NO: 7615473 - DNA, 22 bp, Homo sapiens
caggctcccacaagctcccagc

SEQ ID NO: 7615474 - DNA, 22 bp, Homo sapiens
caggctcccacaagctcccagc

SEQ ID NO: 7615475 - DNA, 22 bp, Homo sapiens
caggctcccgaaatcacccatg

SEQ ID NO: 7615476 - DNA, 22 bp, Homo sapiens
caggctcccgaaatcacccatg

SEQ ID NO: 7615477 - DNA, 22 bp, Homo sapiens
caggctcccgctccactgggca

SEQ ID NO: 7615478 - DNA, 22 bp, Homo sapiens
caggctcccgctccactgggca

SEQ ID NO: 7615479 - DNA, 22 bp, Homo sapiens
caggctcccgctccactgggca

SEQ ID NO: 7615480 - DNA, 22 bp, Homo sapiens
caggctcccgctccactgggca

SEQ ID NO: 7615481 - DNA, 22 bp, Homo sapiens
caggctcccgaaatcacccatg

SEQ ID NO: 7615482 - DNA, 22 bp, Homo sapiens
caggctcccgaaatcacccatg

SEQ ID NO: 7615483 - DNA, 22 bp, Homo sapiens
caggctcctcactcatgctccc

SEQ ID NO: 7615484 - DNA, 22 bp, Homo sapiens
caggctcctcactcatgctccc

SEQ ID NO: 7615485 - DNA, 22 bp, Homo sapiens
caggctcctcactcatgctccc

SEQ ID NO: 7615486 - DNA, 22 bp, Homo sapiens
caggctcctcactcatgctccc

SEQ ID NO: 7615487 - DNA, 22 bp, Homo sapiens
caggctcctcactcatgctccc

SEQ ID NO: 7615488 - DNA, 20 bp, Homo sapiens
caggctccgcaggactaggg

SEQ ID NO: 7615489 - DNA, 20 bp, Homo sapiens
caggctccgcaggactaggg

SEQ ID NO: 7615490 - DNA, 20 bp, Homo sapiens
caggctccgcaggactaggg

SEQ ID NO: 7615491 - DNA, 20 bp, Homo sapiens
caggctccgcaggactaggg

SEQ ID NO: 7615492 - DNA, 20 bp, Homo sapiens
caggctccgcaggactaggg

SEQ ID NO: 7615493 - DNA, 22 bp, Homo sapiens
caggctcctcactcatgctccc

SEQ ID NO: 7615494 - DNA, 22 bp, Homo sapiens
caggctcctcactcatgctccc

SEQ ID NO: 7615495 - DNA, 22 bp, Homo sapiens
caggctccttatcttacaactt

SEQ ID NO: 7615496 - DNA, 17 bp, Homo sapiens
caggctccttccagatt

SEQ ID NO: 7615497 - DNA, 17 bp, Homo sapiens
caggctccttccagatt

SEQ ID NO: 7615498 - DNA, 21 bp, Homo sapiens
caggctctgctagaggagcct

SEQ ID NO: 7615499 - DNA, 22 bp, Homo sapiens
caggctcggtccagtggcaccc

SEQ ID NO: 7615500 - DNA, 22 bp, Homo sapiens
caggctctaggttagtaggaga

SEQ ID NO: 7615501 - DNA, 21 bp, Homo sapiens
caggctctgctagaggagcct

SEQ ID NO: 7615502 - DNA, 22 bp, Homo sapiens
caggctcggtccagtggcaccc

SEQ ID NO: 7615503 - DNA, 22 bp, Homo sapiens
caggctcggtccagtggcaccc

SEQ ID NO: 7615504 - DNA, 22 bp, Homo sapiens
caggctctaggttagtaggaga

SEQ ID NO: 7615505 - DNA, 22 bp, Homo sapiens
caggctctaggttagtaggaga

SEQ ID NO: 7615506 - DNA, 22 bp, Homo sapiens
caggctctaggttagtaggaga

SEQ ID NO: 7615507 - DNA, 22 bp, Homo sapiens
caggctcggaagtgctggcttt

SEQ ID NO: 7615508 - DNA, 22 bp, Homo sapiens
caggctccttcccagggatggt

SEQ ID NO: 7615509 - DNA, 22 bp, Homo sapiens
caggctccttcccagggatggt

SEQ ID NO: 7615510 - DNA, 22 bp, Homo sapiens
caggctccttcccagggatggt

SEQ ID NO: 7615511 - DNA, 22 bp, Homo sapiens
caggctccttcccagggatggt

SEQ ID NO: 7615512 - DNA, 22 bp, Homo sapiens
caggctccttcccagggatggt

SEQ ID NO: 7615513 - DNA, 22 bp, Homo sapiens
caggctccttcccagggatggt

SEQ ID NO: 7615514 - DNA, 22 bp, Homo sapiens
caggctccttcccagggatggt

SEQ ID NO: 7615515 - DNA, 22 bp, Homo sapiens
caggctccctaagtcagcagcc

SEQ ID NO: 7615516 - DNA, 22 bp, Homo sapiens
caggctccctaagtcagcagcc

SEQ ID NO: 7615517 - DNA, 22 bp, Homo sapiens
caggctccctaagtcagcagcc

SEQ ID NO: 7615518 - DNA, 22 bp, Homo sapiens
caggctccctaagtcagcagcc

SEQ ID NO: 7615519 - DNA, 22 bp, Homo sapiens
caggctccctaagtcagcagcc

SEQ ID NO: 7615520 - DNA, 22 bp, Homo sapiens
caggctccctaagtcagcagcc

SEQ ID NO: 7615521 - DNA, 22 bp, Homo sapiens
caggctccctaagtcagcagcc

SEQ ID NO: 7615522 - DNA, 22 bp, Homo sapiens
caggctccctgcaggccagtga

SEQ ID NO: 7615523 - DNA, 22 bp, Homo sapiens
caggctccctgcaggccagtga

SEQ ID NO: 7615524 - DNA, 22 bp, Homo sapiens
caggctccctgcaggccagtga

SEQ ID NO: 7615525 - DNA, 22 bp, Homo sapiens
caggctccctgcaggccagtga

SEQ ID NO: 7615526 - DNA, 23 bp, Homo sapiens
caggctcccggaccaggatccgc

SEQ ID NO: 7615527 - DNA, 22 bp, Homo sapiens
caggctcccgctccactgggca

SEQ ID NO: 7615528 - DNA, 22 bp, Homo sapiens
caggctcccgctccactgggca

SEQ ID NO: 7615529 - DNA, 23 bp, Homo sapiens
caggctcccggaccaggatccgc

SEQ ID NO: 7615530 - DNA, 23 bp, Homo sapiens
caggctcccggaccaggatccgc

SEQ ID NO: 7615531 - DNA, 23 bp, Homo sapiens
caggctcccggaccaggatccgc

SEQ ID NO: 7615532 - DNA, 22 bp, Homo sapiens
caggctccctgggcagtggcag

SEQ ID NO: 7615533 - DNA, 22 bp, Homo sapiens
caggctccctgggcagtggcag

SEQ ID NO: 7615534 - DNA, 22 bp, Homo sapiens
caggctccctgggcagtggcag

SEQ ID NO: 7615535 - DNA, 20 bp, Homo sapiens
caggctccgcaggactaggg

SEQ ID NO: 7615536 - DNA, 22 bp, Homo sapiens
caggctccctgggcagtggcag

SEQ ID NO: 7615537 - DNA, 22 bp, Homo sapiens
caggctccctgccagggccggc

SEQ ID NO: 7615538 - DNA, 22 bp, Homo sapiens
caggctccctgcaggccagtga

SEQ ID NO: 7615539 - DNA, 22 bp, Homo sapiens
caggctccctgccagggccggc

SEQ ID NO: 7615540 - DNA, 22 bp, Homo sapiens
caggctccctgccagggccggc

SEQ ID NO: 7615541 - DNA, 22 bp, Homo sapiens
caggctccctgggcagtggcag

SEQ ID NO: 7615542 - DNA, 22 bp, Homo sapiens
caggctccctgggcagtggcag

SEQ ID NO: 7615543 - DNA, 22 bp, Homo sapiens
caggctccctgggcagtggcag

SEQ ID NO: 7615544 - DNA, 22 bp, Homo sapiens
caggctccctgccagggccggc

SEQ ID NO: 7615545 - DNA, 22 bp, Homo sapiens
caggctccctgccagggccggc

SEQ ID NO: 7615546 - DNA, 22 bp, Homo sapiens
tacagctgagtttaggtacagg

SEQ ID NO: 7615547 - DNA, 22 bp, Homo sapiens
tacagctgagtttaggtacagg

SEQ ID NO: 7615548 - DNA, 22 bp, Homo sapiens
tacagctgagtttaggtacagg

SEQ ID NO: 7615549 - DNA, 22 bp, Homo sapiens
tacagctgctggtgctccatgc

SEQ ID NO: 7615550 - DNA, 22 bp, Homo sapiens
tacagctgctggtgctccatgc

SEQ ID NO: 7615551 - DNA, 22 bp, Homo sapiens
tacagctggactggtagctgtg

SEQ ID NO: 7615552 - DNA, 22 bp, Homo sapiens
caggcctggagtgcaatggcac

SEQ ID NO: 7615553 - DNA, 22 bp, Homo sapiens
caggcctggagtgcaatggcac

SEQ ID NO: 7615554 - DNA, 22 bp, Homo sapiens
caggcctggagtgcaatggcac

SEQ ID NO: 7615555 - DNA, 22 bp, Homo sapiens
caggcctggagtgcaatggcac

SEQ ID NO: 7615556 - DNA, 22 bp, Homo sapiens
caggcctgtctgcacatgaggc

SEQ ID NO: 7615557 - DNA, 22 bp, Homo sapiens
caggcctgtctgcacatgaggc

SEQ ID NO: 7615558 - DNA, 22 bp, Homo sapiens
caggcctggagtgcaatggcac

SEQ ID NO: 7615559 - DNA, 22 bp, Homo sapiens
caggccttaaggactcggagaa

SEQ ID NO: 7615560 - DNA, 22 bp, Homo sapiens
caggccttaaggactcggagaa

SEQ ID NO: 7615561 - DNA, 22 bp, Homo sapiens
caggccttaaggactcggagaa

SEQ ID NO: 7615562 - DNA, 22 bp, Homo sapiens
caggcctgtgagttgaggcccc

SEQ ID NO: 7615563 - DNA, 22 bp, Homo sapiens
caggcctgtgagttgaggcccc

SEQ ID NO: 7615564 - DNA, 22 bp, Homo sapiens
caggcctgtgagttgaggcccc

SEQ ID NO: 7615565 - DNA, 22 bp, Homo sapiens
caggcctgtgagttgaggcccc

SEQ ID NO: 7615566 - DNA, 22 bp, Homo sapiens
caggcctgtgagttgaggcccc

SEQ ID NO: 7615567 - DNA, 22 bp, Homo sapiens
caggcctgtgacaccgtgtctg

SEQ ID NO: 7615568 - DNA, 22 bp, Homo sapiens
caggcctgtgacaccgtgtctg

SEQ ID NO: 7615569 - DNA, 22 bp, Homo sapiens
caggcctgtgacaccgtgtctg

SEQ ID NO: 7615570 - DNA, 22 bp, Homo sapiens
caggcctgtgacaccgtgtctg

SEQ ID NO: 7615571 - DNA, 22 bp, Homo sapiens
caggcctgtgagttgaggcccc

SEQ ID NO: 7615572 - DNA, 22 bp, Homo sapiens
caggcctgtgacaccgtgtctg

SEQ ID NO: 7615573 - DNA, 22 bp, Homo sapiens
caggcctgtgacaccgtgtctg

SEQ ID NO: 7615574 - DNA, 22 bp, Homo sapiens
caggcctgtctgcacatgaggc

SEQ ID NO: 7615575 - DNA, 22 bp, Homo sapiens
caggcctgtgacaccgtgtctg

SEQ ID NO: 7615576 - DNA, 22 bp, Homo sapiens
caggccttgagttttgggcttt

SEQ ID NO: 7615577 - DNA, 22 bp, Homo sapiens
caggccttgagttttgggcttt

SEQ ID NO: 7615578 - DNA, 22 bp, Homo sapiens
caggccttgagttttgggcttt

SEQ ID NO: 7615579 - DNA, 22 bp, Homo sapiens
caggccttgcagtctgttgtaa

SEQ ID NO: 7615580 - DNA, 22 bp, Homo sapiens
caggccttgcagtctgttgtaa

SEQ ID NO: 7615581 - DNA, 22 bp, Homo sapiens
caggccttgcagtctgttgtaa

SEQ ID NO: 7615582 - DNA, 22 bp, Homo sapiens
caggccttgcgtcccatggcct

SEQ ID NO: 7615583 - DNA, 22 bp, Homo sapiens
caggccttgcgtcccatggcct

SEQ ID NO: 7615584 - DNA, 22 bp, Homo sapiens
caggccttgcgtcccatggcct

SEQ ID NO: 7615585 - DNA, 22 bp, Homo sapiens
caggccttgcgtcccatggcct

SEQ ID NO: 7615586 - DNA, 22 bp, Homo sapiens
caggccttgggacacccttcac

SEQ ID NO: 7615587 - DNA, 22 bp, Homo sapiens
caggccttgggacccagactgg

SEQ ID NO: 7615588 - DNA, 22 bp, Homo sapiens
caggccttgggacccagactgg

SEQ ID NO: 7615589 - DNA, 22 bp, Homo sapiens
caggccttgggacccagactgg

SEQ ID NO: 7615590 - DNA, 22 bp, Homo sapiens
caggccttgggagagggtagat

SEQ ID NO: 7615591 - DNA, 22 bp, Homo sapiens
caggccttgggagagggtagat

SEQ ID NO: 7615592 - DNA, 22 bp, Homo sapiens
tacagttactttgaaaattgat

SEQ ID NO: 7615593 - DNA, 22 bp, Homo sapiens
tacagttagtgcctggctactt

SEQ ID NO: 7615594 - DNA, 22 bp, Homo sapiens
tacagttatatgtgataagtaa

SEQ ID NO: 7615595 - DNA, 22 bp, Homo sapiens
tacagttagcctgtctactccc

SEQ ID NO: 7615596 - DNA, 17 bp, Homo sapiens
tacagttagaatctgga

SEQ ID NO: 7615597 - DNA, 22 bp, Homo sapiens
caggccttagtaggtgctccct

SEQ ID NO: 7615598 - DNA, 22 bp, Homo sapiens
caggccttatctccaccctgca

SEQ ID NO: 7615599 - DNA, 22 bp, Homo sapiens
caggccttatctccaccctgca

SEQ ID NO: 7615600 - DNA, 22 bp, Homo sapiens
caggccttaaggactcggagaa

SEQ ID NO: 7615601 - DNA, 22 bp, Homo sapiens
caggccttagtaggtgctccct

SEQ ID NO: 7615602 - DNA, 22 bp, Homo sapiens
caggccttagtaggtgctccct

SEQ ID NO: 7615603 - DNA, 22 bp, Homo sapiens
caggccttatctccaccctgca

SEQ ID NO: 7615604 - DNA, 22 bp, Homo sapiens
caggccttatctccaccctgca

SEQ ID NO: 7615605 - DNA, 20 bp, Homo sapiens
caggccttcaggatggctgg

SEQ ID NO: 7615606 - DNA, 20 bp, Homo sapiens
caggccttcaggatggctgg

SEQ ID NO: 7615607 - DNA, 22 bp, Homo sapiens
caggccttctccctccctcaac

SEQ ID NO: 7615608 - DNA, 22 bp, Homo sapiens
caggccttctccctccctcaac

SEQ ID NO: 7615609 - DNA, 22 bp, Homo sapiens
caggccttctccctccctcaac

SEQ ID NO: 7615610 - DNA, 22 bp, Homo sapiens
caggccttgaaggcctgcggga

SEQ ID NO: 7615611 - DNA, 22 bp, Homo sapiens
caggccttgaaggcctgcggga

SEQ ID NO: 7615612 - DNA, 22 bp, Homo sapiens
caggccttgaaggcctgcggga

SEQ ID NO: 7615613 - DNA, 22 bp, Homo sapiens
caggccttgaaggcctgcggga

SEQ ID NO: 7615614 - DNA, 22 bp, Homo sapiens
caggccttgaaggcctgcggga

SEQ ID NO: 7615615 - DNA, 22 bp, Homo sapiens
caggccttgaaggcctgcggga

SEQ ID NO: 7615616 - DNA, 17 bp, Homo sapiens
caggccttgagccttta

SEQ ID NO: 7615617 - DNA, 22 bp, Homo sapiens
caggccttgagttttgggcttt

SEQ ID NO: 7615618 - DNA, 17 bp, Homo sapiens
caggccttgagccttta

SEQ ID NO: 7615619 - DNA, 17 bp, Homo sapiens
caggccttgagccttta

SEQ ID NO: 7615620 - DNA, 17 bp, Homo sapiens
caggccttgagccttta

SEQ ID NO: 7615621 - DNA, 22 bp, Homo sapiens
tacagcatgtccttagcaaggc

SEQ ID NO: 7615622 - DNA, 22 bp, Homo sapiens
tacagcatgtccttagcaaggc

SEQ ID NO: 7615623 - DNA, 22 bp, Homo sapiens
tacagcatgtccttagcaaggc

SEQ ID NO: 7615624 - DNA, 22 bp, Homo sapiens
tacagcattgcattttcctttg

SEQ ID NO: 7615625 - DNA, 22 bp, Homo sapiens
tacagcattgtgtcttcactca

SEQ ID NO: 7615626 - DNA, 22 bp, Homo sapiens
tacagccatcatgtatgtatat

SEQ ID NO: 7615627 - DNA, 22 bp, Homo sapiens
tacagccacggtctatggaggc

SEQ ID NO: 7615628 - DNA, 22 bp, Homo sapiens
tacagccacggtctatggaggc

SEQ ID NO: 7615629 - DNA, 22 bp, Homo sapiens
tacagccatcatgtatgtatat

SEQ ID NO: 7615630 - DNA, 22 bp, Homo sapiens
tacagccatcatgtatgtatat

SEQ ID NO: 7615631 - DNA, 22 bp, Homo sapiens
tacagcattttgtagagtacta

SEQ ID NO: 7615632 - DNA, 22 bp, Homo sapiens
tacagcattttgtagagtacta

SEQ ID NO: 7615633 - DNA, 20 bp, Homo sapiens
tacagcccctgcttctgttg

SEQ ID NO: 7615634 - DNA, 20 bp, Homo sapiens
tacagcctattcaccacata

SEQ ID NO: 7615635 - DNA, 22 bp, Homo sapiens
tacagcctcatcacgggagctg

SEQ ID NO: 7615636 - DNA, 22 bp, Homo sapiens
tacagcctcatcacgggagctg

SEQ ID NO: 7615637 - DNA, 22 bp, Homo sapiens
tacagcccaagaagtttatacg

SEQ ID NO: 7615638 - DNA, 23 bp, Homo sapiens
tacagccatgtcgctgatttaac

SEQ ID NO: 7615639 - DNA, 23 bp, Homo sapiens
tacagccatgtcgctgatttaac

SEQ ID NO: 7615640 - DNA, 23 bp, Homo sapiens
tacagccatgtcgctgatttaac

SEQ ID NO: 7615641 - DNA, 22 bp, Homo sapiens
tacagccatggttaatttacct

SEQ ID NO: 7615642 - DNA, 22 bp, Homo sapiens
tacagccatcatgtatgtatat

SEQ ID NO: 7615643 - DNA, 22 bp, Homo sapiens
tacagccacaggtgactctcat

SEQ ID NO: 7615644 - DNA, 22 bp, Homo sapiens
tacagccatggttaatttacct

SEQ ID NO: 7615645 - DNA, 22 bp, Homo sapiens
tacagccttcatctttgccttg

SEQ ID NO: 7615646 - DNA, 22 bp, Homo sapiens
tacagccttcatctttgccttg

SEQ ID NO: 7615647 - DNA, 22 bp, Homo sapiens
tacagcctgttacctatatttg

SEQ ID NO: 7615648 - DNA, 22 bp, Homo sapiens
tacagcctgttacctatatttg

SEQ ID NO: 7615649 - DNA, 22 bp, Homo sapiens
tacagcctggcactaccctggg

SEQ ID NO: 7615650 - DNA, 22 bp, Homo sapiens
tacagcctcgaactcctgcatt

SEQ ID NO: 7615651 - DNA, 22 bp, Homo sapiens
tacagcctcgaactcctgcatt

SEQ ID NO: 7615652 - DNA, 22 bp, Homo sapiens
tacagcctcgaactcctgcatt

SEQ ID NO: 7615653 - DNA, 22 bp, Homo sapiens
tacagcctcttccctggagtgg

SEQ ID NO: 7615654 - DNA, 22 bp, Homo sapiens
tacagcgatcagtgtcattagc

SEQ ID NO: 7615655 - DNA, 22 bp, Homo sapiens
tacagctagagggcacgtgaac

SEQ ID NO: 7615656 - DNA, 22 bp, Homo sapiens
tacagctatgtcttggtgttct

SEQ ID NO: 7615657 - DNA, 22 bp, Homo sapiens
tacagctccaaaaatcactgtt

SEQ ID NO: 7615658 - DNA, 22 bp, Homo sapiens
tacagctcccggggagcttcgt

SEQ ID NO: 7615659 - DNA, 21 bp, Homo sapiens
tacagctcggcagataaagcc

SEQ ID NO: 7615660 - DNA, 22 bp, Homo sapiens
tacagctcagaacctcactgtc

SEQ ID NO: 7615661 - DNA, 22 bp, Homo sapiens
tacagctcagaacctcactgtc

SEQ ID NO: 7615662 - DNA, 22 bp, Homo sapiens
tacagctcagaacctcactgtc

SEQ ID NO: 7615663 - DNA, 22 bp, Homo sapiens
tacagctccaaaaatcactgtt

SEQ ID NO: 7615664 - DNA, 22 bp, Homo sapiens
tacagagaggtgacccttgggc

SEQ ID NO: 7615665 - DNA, 22 bp, Homo sapiens
tacagagaggtgacccttgggc

SEQ ID NO: 7615666 - DNA, 22 bp, Homo sapiens
tacagagagtacagcatccaca

SEQ ID NO: 7615667 - DNA, 22 bp, Homo sapiens
tacagagagctccggacattca

SEQ ID NO: 7615668 - DNA, 22 bp, Homo sapiens
tacagcatgatcacaatggaaa

SEQ ID NO: 7615669 - DNA, 22 bp, Homo sapiens
tacagcatatacagaatgaaca

SEQ ID NO: 7615670 - DNA, 22 bp, Homo sapiens
tacagcagggcgctgtgatgaa

SEQ ID NO: 7615671 - DNA, 22 bp, Homo sapiens
tacagcagggcgctgtgatgaa

SEQ ID NO: 7615672 - DNA, 22 bp, Homo sapiens
tacagcagggcgctgtgatgaa

SEQ ID NO: 7615673 - DNA, 22 bp, Homo sapiens
tacagagactttatggcacaaa

SEQ ID NO: 7615674 - DNA, 22 bp, Homo sapiens
tacagagactttatggcacaaa

SEQ ID NO: 7615675 - DNA, 22 bp, Homo sapiens
tacagagacccacaagagactg

SEQ ID NO: 7615676 - DNA, 22 bp, Homo sapiens
tacagagacccacaagagactg

SEQ ID NO: 7615677 - DNA, 22 bp, Homo sapiens
tacagagacccacaagagactg

SEQ ID NO: 7615678 - DNA, 22 bp, Homo sapiens
tacagagacccacaagagactg

SEQ ID NO: 7615679 - DNA, 22 bp, Homo sapiens
tacagagacccacaagagactg

SEQ ID NO: 7615680 - DNA, 22 bp, Homo sapiens
tacagagagataagtgtaaaag

SEQ ID NO: 7615681 - DNA, 22 bp, Homo sapiens
tacagagagataagtgtaaaag

SEQ ID NO: 7615682 - DNA, 22 bp, Homo sapiens
tacagagagataagtgtaaaag

SEQ ID NO: 7615683 - DNA, 22 bp, Homo sapiens
tacagagagataagtgtaaaag

SEQ ID NO: 7615684 - DNA, 23 bp, Homo sapiens
tcctgagggtttcccagccttgg

SEQ ID NO: 7615685 - DNA, 22 bp, Homo sapiens
tcctgagggctgcagtcatagg

SEQ ID NO: 7615686 - DNA, 22 bp, Homo sapiens
tcctgagggctgcagtcatagg

SEQ ID NO: 7615687 - DNA, 22 bp, Homo sapiens
tcctgagggctgcagtcatagg

SEQ ID NO: 7615688 - DNA, 23 bp, Homo sapiens
tcctgagggtttcccagccttgg

SEQ ID NO: 7615689 - DNA, 23 bp, Homo sapiens
tcctgagggtttcccagccttgg

SEQ ID NO: 7615690 - DNA, 23 bp, Homo sapiens
tcctgagggtttcccagccttgg

SEQ ID NO: 7615691 - DNA, 23 bp, Homo sapiens
tcctgagggtttcccagccttgg

SEQ ID NO: 7615692 - DNA, 22 bp, Homo sapiens
tcctgaggtgctcagccaggaa

SEQ ID NO: 7615693 - DNA, 22 bp, Homo sapiens
tcctgaggtgctcagccaggaa

SEQ ID NO: 7615694 - DNA, 22 bp, Homo sapiens
tcctgaggtgctcagccaggaa

SEQ ID NO: 7615695 - DNA, 22 bp, Homo sapiens
tcctgaggtgctcagccaggaa

SEQ ID NO: 7615696 - DNA, 22 bp, Homo sapiens
tcctgaggtgctcagccaggaa

SEQ ID NO: 7615697 - DNA, 22 bp, Homo sapiens
tcctgaggtatatgctttgcag

SEQ ID NO: 7615698 - DNA, 22 bp, Homo sapiens
tcctgaggtatatgctttgcag

SEQ ID NO: 7615699 - DNA, 22 bp, Homo sapiens
tcctgaggtatatgctttgcag

SEQ ID NO: 7615700 - DNA, 22 bp, Homo sapiens
tcctgaggtctgaaaaaggagc

SEQ ID NO: 7615701 - DNA, 22 bp, Homo sapiens
tcctgaggtgctcagccaggaa

SEQ ID NO: 7615702 - DNA, 22 bp, Homo sapiens
tcctgaggtgctcagccaggaa

SEQ ID NO: 7615703 - DNA, 22 bp, Homo sapiens
tcctgaggtggattgagcagag

SEQ ID NO: 7615704 - DNA, 22 bp, Homo sapiens
tcctgaggtggattgagcagag

SEQ ID NO: 7615705 - DNA, 22 bp, Homo sapiens
tcctgaggtggattgagcagag

SEQ ID NO: 7615706 - DNA, 22 bp, Homo sapiens
tcctgaggtggattgagcagag

SEQ ID NO: 7615707 - DNA, 22 bp, Homo sapiens
tcctgaggtggattgagcagag

SEQ ID NO: 7615708 - DNA, 22 bp, Homo sapiens
tcctgaggtggattgagcagag

SEQ ID NO: 7615709 - DNA, 22 bp, Homo sapiens
tcctgaggtggattgagcagag

SEQ ID NO: 7615710 - DNA, 22 bp, Homo sapiens
tcctgaggtggattgagcagag

SEQ ID NO: 7615711 - DNA, 22 bp, Homo sapiens
tcctgaggtggattgagcagag

SEQ ID NO: 7615712 - DNA, 22 bp, Homo sapiens
ccaacacagatgtgttagtgtt

SEQ ID NO: 7615713 - DNA, 22 bp, Homo sapiens
ccaaattctgtgttcaaactca

SEQ ID NO: 7615714 - DNA, 22 bp, Homo sapiens
ccaaattctgtgttcaaactca

SEQ ID NO: 7615715 - DNA, 22 bp, Homo sapiens
ccaaattctgtgttcaaactca

SEQ ID NO: 7615716 - DNA, 22 bp, Homo sapiens
ccaaattctgtgttcaaactca

SEQ ID NO: 7615717 - DNA, 22 bp, Homo sapiens
ccaaattaaatcatacagacag

SEQ ID NO: 7615718 - DNA, 22 bp, Homo sapiens
ccaaattaaatcatacagacag

SEQ ID NO: 7615719 - DNA, 22 bp, Homo sapiens
tcctgaggtggattgagcagag

SEQ ID NO: 7615720 - DNA, 22 bp, Homo sapiens
ccaaattaaatcatacagacag

SEQ ID NO: 7615721 - DNA, 22 bp, Homo sapiens
ccaaccagctatggaatcttgt

SEQ ID NO: 7615722 - DNA, 22 bp, Homo sapiens
ccaacctgaggcaggctgcagc

SEQ ID NO: 7615723 - DNA, 22 bp, Homo sapiens
ccaacctgaggcaggctgcagc

SEQ ID NO: 7615724 - DNA, 22 bp, Homo sapiens
ccaactctgaaaatccagatat

SEQ ID NO: 7615725 - DNA, 22 bp, Homo sapiens
ccaacttctccatcagataaga

SEQ ID NO: 7615726 - DNA, 23 bp, Homo sapiens
ccaagactgttaggagtggggag

SEQ ID NO: 7615727 - DNA, 21 bp, Homo sapiens
ccaagactcccatctagtggt

SEQ ID NO: 7615728 - DNA, 23 bp, Homo sapiens
ccaagactgttaggagtggggag

SEQ ID NO: 7615729 - DNA, 23 bp, Homo sapiens
ccaagactgttaggagtggggag

SEQ ID NO: 7615730 - DNA, 23 bp, Homo sapiens
ccaagactgttaggagtggggag

SEQ ID NO: 7615731 - DNA, 22 bp, Homo sapiens
ccaacaggttgagagtctgaat

SEQ ID NO: 7615732 - DNA, 22 bp, Homo sapiens
ccaacaggttgagagtctgaat

SEQ ID NO: 7615733 - DNA, 22 bp, Homo sapiens
ccaacaccatctgagctccagc

SEQ ID NO: 7615734 - DNA, 22 bp, Homo sapiens
ccaacacagatgtgttagtgtt

SEQ ID NO: 7615735 - DNA, 22 bp, Homo sapiens
ccaacaccatctgagctccagc

SEQ ID NO: 7615736 - DNA, 22 bp, Homo sapiens
ccaacaccatctgagctccagc

SEQ ID NO: 7615737 - DNA, 19 bp, Homo sapiens
ccaacagtactgaagcact

SEQ ID NO: 7615738 - DNA, 19 bp, Homo sapiens
ccaacagtactgaagcact

SEQ ID NO: 7615739 - DNA, 22 bp, Homo sapiens
ccaacagtccagatgagatggt

SEQ ID NO: 7615740 - DNA, 22 bp, Homo sapiens
ccaacagtccagatgagatggt

SEQ ID NO: 7615741 - DNA, 22 bp, Homo sapiens
ccaagaggcagaatgcagagaa

SEQ ID NO: 7615742 - DNA, 22 bp, Homo sapiens
ccaagaggaccttgccagggca

SEQ ID NO: 7615743 - DNA, 22 bp, Homo sapiens
ccaagaggcagaatgcagagaa

SEQ ID NO: 7615744 - DNA, 22 bp, Homo sapiens
ccaagaggcagaatgcagagaa

SEQ ID NO: 7615745 - DNA, 22 bp, Homo sapiens
ccaagaggaccttgccagggca

SEQ ID NO: 7615746 - DNA, 22 bp, Homo sapiens
ccaagaggaccttgccagggca

SEQ ID NO: 7615747 - DNA, 22 bp, Homo sapiens
ccaagagctacagatatgaaat

SEQ ID NO: 7615748 - DNA, 22 bp, Homo sapiens
ccaagaggaccttgccagggca

SEQ ID NO: 7615749 - DNA, 22 bp, Homo sapiens
ccaagagcctcagctgccgtgc

SEQ ID NO: 7615750 - DNA, 22 bp, Homo sapiens
ccaagagctacagatatgaaat

SEQ ID NO: 7615751 - DNA, 22 bp, Homo sapiens
ccaagagctacagatatgaaat

SEQ ID NO: 7615752 - DNA, 20 bp, Homo sapiens
ccaagagcatgcatgaggaa

SEQ ID NO: 7615753 - DNA, 22 bp, Homo sapiens
ccaagagccatcctggtcaaca

SEQ ID NO: 7615754 - DNA, 22 bp, Homo sapiens
ccaagagccatcctggtcaaca

SEQ ID NO: 7615755 - DNA, 21 bp, Homo sapiens
ccaagagcaatgctaaggaga

SEQ ID NO: 7615756 - DNA, 21 bp, Homo sapiens
ccaagagcaatgctaaggaga

SEQ ID NO: 7615757 - DNA, 23 bp, Homo sapiens
ccaagactgttaggagtggggag

SEQ ID NO: 7615758 - DNA, 23 bp, Homo sapiens
tcctgctgaaagctccagctggc

SEQ ID NO: 7615759 - DNA, 23 bp, Homo sapiens
tcctgctgaaagctccagctggc

SEQ ID NO: 7615760 - DNA, 23 bp, Homo sapiens
tcctgctgaaagctccagctggc

SEQ ID NO: 7615761 - DNA, 22 bp, Homo sapiens
tcctggagccaatgtgctgctg

SEQ ID NO: 7615762 - DNA, 22 bp, Homo sapiens
tcctgctccaccgtgggctgga

SEQ ID NO: 7615763 - DNA, 22 bp, Homo sapiens
tcctgctccaccgtgggctgga

SEQ ID NO: 7615764 - DNA, 22 bp, Homo sapiens
tcctgctctgatgggttctcct

SEQ ID NO: 7615765 - DNA, 22 bp, Homo sapiens
tcctgctagagaataacagcac

SEQ ID NO: 7615766 - DNA, 22 bp, Homo sapiens
tcctgctagagaataacagcac

SEQ ID NO: 7615767 - DNA, 22 bp, Homo sapiens
tcctgcggttcatgctcattct

SEQ ID NO: 7615768 - DNA, 22 bp, Homo sapiens
tcctgcgttcccctggcgccgg

SEQ ID NO: 7615769 - DNA, 22 bp, Homo sapiens
tcctgcgttcccctggcgccgg

SEQ ID NO: 7615770 - DNA, 22 bp, Homo sapiens
tcctggagccatgattcccctc

SEQ ID NO: 7615771 - DNA, 22 bp, Homo sapiens
tcctggagccaggacccttccc

SEQ ID NO: 7615772 - DNA, 22 bp, Homo sapiens
tcctggagccaggacccttccc

SEQ ID NO: 7615773 - DNA, 22 bp, Homo sapiens
tcctggagccacggagctttca

SEQ ID NO: 7615774 - DNA, 22 bp, Homo sapiens
tcctgccttcatactgctgtat

SEQ ID NO: 7615775 - DNA, 22 bp, Homo sapiens
tcctgccttcatactgctgtat

SEQ ID NO: 7615776 - DNA, 22 bp, Homo sapiens
tcctgccttcatactgctgtat

SEQ ID NO: 7615777 - DNA, 22 bp, Homo sapiens
tcctgccttcatactgctgtat

SEQ ID NO: 7615778 - DNA, 22 bp, Homo sapiens
tcctgccttcatactgctgtat

SEQ ID NO: 7615779 - DNA, 22 bp, Homo sapiens
tcctgccttcatactgctgtat

SEQ ID NO: 7615780 - DNA, 22 bp, Homo sapiens
tcctgccttcatactgctgtat

SEQ ID NO: 7615781 - DNA, 22 bp, Homo sapiens
tcctgccttcatactgctgtat

SEQ ID NO: 7615782 - DNA, 22 bp, Homo sapiens
tcctgccttgcctgggacatca

SEQ ID NO: 7615783 - DNA, 22 bp, Homo sapiens
tcctgccttgcctgggacatca

SEQ ID NO: 7615784 - DNA, 22 bp, Homo sapiens
tcctgccttgcctgggacatca

SEQ ID NO: 7615785 - DNA, 22 bp, Homo sapiens
tcctgccttgcctgggacatca

SEQ ID NO: 7615786 - DNA, 22 bp, Homo sapiens
tcctgccttgcctgggacatca

SEQ ID NO: 7615787 - DNA, 22 bp, Homo sapiens
tcctgccttgcctgggacatca

SEQ ID NO: 7615788 - DNA, 22 bp, Homo sapiens
tcctgccttgcctgggacatca

SEQ ID NO: 7615789 - DNA, 22 bp, Homo sapiens
tcctgcgcgccagggccgtcga

SEQ ID NO: 7615790 - DNA, 22 bp, Homo sapiens
ccaagaggtatcttgccataaa

SEQ ID NO: 7615791 - DNA, 22 bp, Homo sapiens
ccaagaggtatcttgccataaa

SEQ ID NO: 7615792 - DNA, 22 bp, Homo sapiens
ccaagagggttgccctgagcgt

SEQ ID NO: 7615793 - DNA, 22 bp, Homo sapiens
ccaagaggtaatacgagatatc

SEQ ID NO: 7615794 - DNA, 22 bp, Homo sapiens
ccaagaggggcagagggctgca

SEQ ID NO: 7615795 - DNA, 22 bp, Homo sapiens
ccaagagggttgccctgagcgt

SEQ ID NO: 7615796 - DNA, 22 bp, Homo sapiens
ccaagaggcagaatgcagagaa

SEQ ID NO: 7615797 - DNA, 22 bp, Homo sapiens
ccaagaggggcagagggctgca

SEQ ID NO: 7615798 - DNA, 22 bp, Homo sapiens
ccaagaggggaagggccgcagc

SEQ ID NO: 7615799 - DNA, 22 bp, Homo sapiens
ccaagaggggcagagggctgca

SEQ ID NO: 7615800 - DNA, 22 bp, Homo sapiens
ccaagaggttgaggctgcagtg

SEQ ID NO: 7615801 - DNA, 22 bp, Homo sapiens
ccaagaggttgaggctgcagtg

SEQ ID NO: 7615802 - DNA, 19 bp, Homo sapiens
tcctgcccaccagccaggg

SEQ ID NO: 7615803 - DNA, 22 bp, Homo sapiens
tcctgcccagagctctccactc

SEQ ID NO: 7615804 - DNA, 22 bp, Homo sapiens
tcctgcccagagctctccactc

SEQ ID NO: 7615805 - DNA, 22 bp, Homo sapiens
tcctgcccagagctctccactc

SEQ ID NO: 7615806 - DNA, 21 bp, Homo sapiens
tcctgccttagtccagagcag

SEQ ID NO: 7615807 - DNA, 21 bp, Homo sapiens
tcctgccttagtccagagcag

SEQ ID NO: 7615808 - DNA, 21 bp, Homo sapiens
tcctgccttagtccagagcag

SEQ ID NO: 7615809 - DNA, 22 bp, Homo sapiens
tcctgccttagagcaaggaaaa

SEQ ID NO: 7615810 - DNA, 22 bp, Homo sapiens
tcctgcccagagctctccactc

SEQ ID NO: 7615811 - DNA, 21 bp, Homo sapiens
tcctgccttagtccagagcag

SEQ ID NO: 7615812 - DNA, 21 bp, Homo sapiens
tcctgccttagtccagagcag

SEQ ID NO: 7615813 - DNA, 21 bp, Homo sapiens
tcctgccttagtccagagcag

SEQ ID NO: 7615814 - DNA, 22 bp, Homo sapiens
tcctgccttagagcaaggaaaa

SEQ ID NO: 7615815 - DNA, 22 bp, Homo sapiens
tcctgccttagagcaaggaaaa

SEQ ID NO: 7615816 - DNA, 21 bp, Homo sapiens
tcctgccttagtccagagcag

SEQ ID NO: 7615817 - DNA, 21 bp, Homo sapiens
tcctgccttagtccagagcag

SEQ ID NO: 7615818 - DNA, 21 bp, Homo sapiens
tcctgccttagtccagagcag

SEQ ID NO: 7615819 - DNA, 21 bp, Homo sapiens
tcctgccttagtccagagcag

SEQ ID NO: 7615820 - DNA, 21 bp, Homo sapiens
tcctgccttagtccagagcag

SEQ ID NO: 7615821 - DNA, 21 bp, Homo sapiens
tcctgccttagtccagagcag

SEQ ID NO: 7615822 - DNA, 21 bp, Homo sapiens
tcctgccttagtccagagcag

SEQ ID NO: 7615823 - DNA, 22 bp, Homo sapiens
tcctgccttcatactgctgtat

SEQ ID NO: 7615824 - DNA, 22 bp, Homo sapiens
ccacaggcggagtggcgggcag

SEQ ID NO: 7615825 - DNA, 22 bp, Homo sapiens
ccacaggcggagtggcgggcag

SEQ ID NO: 7615826 - DNA, 22 bp, Homo sapiens
ccacagctgaccgcaggtgagc

SEQ ID NO: 7615827 - DNA, 22 bp, Homo sapiens
ccacagctgaccgcaggtgagc

SEQ ID NO: 7615828 - DNA, 22 bp, Homo sapiens
ccacagctgaccgcaggtgagc

SEQ ID NO: 7615829 - DNA, 22 bp, Homo sapiens
ccacagctgaccgcaggtgagc

SEQ ID NO: 7615830 - DNA, 22 bp, Homo sapiens
ccacagctgacaatggatagac

SEQ ID NO: 7615831 - DNA, 22 bp, Homo sapiens
ccacagctgacaatggatagac

SEQ ID NO: 7615832 - DNA, 22 bp, Homo sapiens
tcctggaggacagaggcatctc

SEQ ID NO: 7615833 - DNA, 22 bp, Homo sapiens
tcctggaggaataagttttcca

SEQ ID NO: 7615834 - DNA, 22 bp, Homo sapiens
tcctggagcttccttcatggta

SEQ ID NO: 7615835 - DNA, 22 bp, Homo sapiens
tcctggagcttccttcatggta

SEQ ID NO: 7615836 - DNA, 22 bp, Homo sapiens
tcctggagcttccttcatggta

SEQ ID NO: 7615837 - DNA, 22 bp, Homo sapiens
tcctggagcctcattcaaacac

SEQ ID NO: 7615838 - DNA, 20 bp, Homo sapiens
tcctggagctgcttgaattc

SEQ ID NO: 7615839 - DNA, 20 bp, Homo sapiens
tcctggagctgcttgaattc

SEQ ID NO: 7615840 - DNA, 22 bp, Homo sapiens
tcctggagctgactccgtttga

SEQ ID NO: 7615841 - DNA, 22 bp, Homo sapiens
tcctggagcttcagtttccttt

SEQ ID NO: 7615842 - DNA, 22 bp, Homo sapiens
tcctggagcttcagtttccttt

SEQ ID NO: 7615843 - DNA, 22 bp, Homo sapiens
tcctggagcttcagtttccttt

SEQ ID NO: 7615844 - DNA, 22 bp, Homo sapiens
tcctggagctggtgtctttccc

SEQ ID NO: 7615845 - DNA, 22 bp, Homo sapiens
tcctggagctggtgtctttccc

SEQ ID NO: 7615846 - DNA, 22 bp, Homo sapiens
ccacagggcctttcctgctggc

SEQ ID NO: 7615847 - DNA, 22 bp, Homo sapiens
ccacagggcctttcctgctggc

SEQ ID NO: 7615848 - DNA, 22 bp, Homo sapiens
ccacagggcctttcctgctggc

SEQ ID NO: 7615849 - DNA, 22 bp, Homo sapiens
ccacagggcctttcctgctggc

SEQ ID NO: 7615850 - DNA, 22 bp, Homo sapiens
ccacagggcctttcctgctggc

SEQ ID NO: 7615851 - DNA, 22 bp, Homo sapiens
ccacagggcctttcctgctggc

SEQ ID NO: 7615852 - DNA, 22 bp, Homo sapiens
ccacagggcctttcctgctggc

SEQ ID NO: 7615853 - DNA, 22 bp, Homo sapiens
ccacagggcacagacaggaagc

SEQ ID NO: 7615854 - DNA, 22 bp, Homo sapiens
ccacagggcacagacaggaagc

SEQ ID NO: 7615855 - DNA, 22 bp, Homo sapiens
ccacagggataggaatggggct

SEQ ID NO: 7615856 - DNA, 22 bp, Homo sapiens
ccacagggaacatgacagcctt

SEQ ID NO: 7615857 - DNA, 16 bp, Homo sapiens
ccacagggcaaggggc

SEQ ID NO: 7615858 - DNA, 22 bp, Homo sapiens
ccacagggcacaagggaggttg

SEQ ID NO: 7615859 - DNA, 22 bp, Homo sapiens
ccacagggcacagacaggaagc

SEQ ID NO: 7615860 - DNA, 22 bp, Homo sapiens
ccacagggcacagacaggaagc

SEQ ID NO: 7615861 - DNA, 22 bp, Homo sapiens
ccacagggcacagacaggaagc

SEQ ID NO: 7615862 - DNA, 22 bp, Homo sapiens
ccacagggcacagacaggaagc

SEQ ID NO: 7615863 - DNA, 22 bp, Homo sapiens
ccacagggcacaagggaggttg

SEQ ID NO: 7615864 - DNA, 22 bp, Homo sapiens
ccacagggcacaagggaggttg

SEQ ID NO: 7615865 - DNA, 22 bp, Homo sapiens
ccacagggcacaagggaggttg

SEQ ID NO: 7615866 - DNA, 22 bp, Homo sapiens
ccacagggaacatgacagcctt

SEQ ID NO: 7615867 - DNA, 22 bp, Homo sapiens
ccacagggactgttaaaaccct

SEQ ID NO: 7615868 - DNA, 22 bp, Homo sapiens
ccacagggataggaatggggct

SEQ ID NO: 7615869 - DNA, 22 bp, Homo sapiens
ccacagggactgttaaaaccct

SEQ ID NO: 7615870 - DNA, 22 bp, Homo sapiens
ccacaggctgctgcaggtcccg

SEQ ID NO: 7615871 - DNA, 22 bp, Homo sapiens
ccacagggaacatgacagcctt

SEQ ID NO: 7615872 - DNA, 22 bp, Homo sapiens
ccacagggaacatgacagcctt

SEQ ID NO: 7615873 - DNA, 22 bp, Homo sapiens
ccacagggaacatgacagcctt

SEQ ID NO: 7615874 - DNA, 22 bp, Homo sapiens
ccacagggaacatgacagcctt

SEQ ID NO: 7615875 - DNA, 22 bp, Homo sapiens
ccacaggctgctgcaggtcccg

SEQ ID NO: 7615876 - DNA, 22 bp, Homo sapiens
ccacaggctgctgcaggtcccg

SEQ ID NO: 7615877 - DNA, 22 bp, Homo sapiens
ccacaggctgctgcaggtcccg

SEQ ID NO: 7615878 - DNA, 22 bp, Homo sapiens
ccacaggcggagtggcgggcag

SEQ ID NO: 7615879 - DNA, 22 bp, Homo sapiens
ccacaggctgctgcaggtcccg

SEQ ID NO: 7615880 - DNA, 22 bp, Homo sapiens
ccacaggctgctgcaggtcccg

SEQ ID NO: 7615881 - DNA, 22 bp, Homo sapiens
ccacaggctgctgcaggtcccg

SEQ ID NO: 7615882 - DNA, 22 bp, Homo sapiens
ccacaggctgctgcaggtcccg

SEQ ID NO: 7615883 - DNA, 22 bp, Homo sapiens
ccacaggctgctgcaggtcccg

SEQ ID NO: 7615884 - DNA, 22 bp, Homo sapiens
ccacaggctgctgcaggtcccg

SEQ ID NO: 7615885 - DNA, 22 bp, Homo sapiens
ccacaggctgctgcaggtcccg

SEQ ID NO: 7615886 - DNA, 22 bp, Homo sapiens
ccacaggggtctctgtagctga

SEQ ID NO: 7615887 - DNA, 22 bp, Homo sapiens
ccacaggggtctctgtagctga

SEQ ID NO: 7615888 - DNA, 21 bp, Homo sapiens
ccacaggggctcccctgtcag

SEQ ID NO: 7615889 - DNA, 21 bp, Homo sapiens
ccacaggggctcccctgtcag

SEQ ID NO: 7615890 - DNA, 17 bp, Homo sapiens
tcctggcctggtgtgtg

SEQ ID NO: 7615891 - DNA, 22 bp, Homo sapiens
ccacaggggtctctgtagctga

SEQ ID NO: 7615892 - DNA, 22 bp, Homo sapiens
ccacaggggtctctgtagctga

SEQ ID NO: 7615893 - DNA, 22 bp, Homo sapiens
ccacaggggtctctgtagctga

SEQ ID NO: 7615894 - DNA, 22 bp, Homo sapiens
ccacagggcctttcctgctggc

SEQ ID NO: 7615895 - DNA, 22 bp, Homo sapiens
ccacagggctctaggcgcttcc

SEQ ID NO: 7615896 - DNA, 22 bp, Homo sapiens
ccacagggctctaggcgcttcc

SEQ ID NO: 7615897 - DNA, 21 bp, Homo sapiens
ccacaggggctcccctgtcag

SEQ ID NO: 7615898 - DNA, 21 bp, Homo sapiens
ccacaggggctcccctgtcag

SEQ ID NO: 7615899 - DNA, 21 bp, Homo sapiens
ccacaggggctcccctgtcag

SEQ ID NO: 7615900 - DNA, 22 bp, Homo sapiens
ccacaggggcccacgagccgct

SEQ ID NO: 7615901 - DNA, 22 bp, Homo sapiens
ccacagggctctaggcgcttcc

SEQ ID NO: 7615902 - DNA, 20 bp, Homo sapiens
tcctggccttctcgggcagt

SEQ ID NO: 7615903 - DNA, 20 bp, Homo sapiens
tcctggccttctcgggcagt

SEQ ID NO: 7615904 - DNA, 20 bp, Homo sapiens
tcctggccttctcgggcagt

SEQ ID NO: 7615905 - DNA, 20 bp, Homo sapiens
tcctggccttctcgggcagt

SEQ ID NO: 7615906 - DNA, 22 bp, Homo sapiens
tcctggccttatccccaaactg

SEQ ID NO: 7615907 - DNA, 22 bp, Homo sapiens
tcctggccttatccccaaactg

SEQ ID NO: 7615908 - DNA, 22 bp, Homo sapiens
tcctggccttatccccaaactg

SEQ ID NO: 7615909 - DNA, 22 bp, Homo sapiens
tcctggccttatccccaaactg

SEQ ID NO: 7615910 - DNA, 22 bp, Homo sapiens
tcctggccttagcgaggcggtc

SEQ ID NO: 7615911 - DNA, 22 bp, Homo sapiens
tcctggccttagcgaggcggtc

SEQ ID NO: 7615912 - DNA, 20 bp, Homo sapiens
tcctggccttctcgggcagt

SEQ ID NO: 7615913 - DNA, 22 bp, Homo sapiens
tcctggccttatccccaaactg

SEQ ID NO: 7615914 - DNA, 22 bp, Homo sapiens
tcctggccttatccccaaactg

SEQ ID NO: 7615915 - DNA, 22 bp, Homo sapiens
tcctggccttagcgaggcggtc

SEQ ID NO: 7615916 - DNA, 22 bp, Homo sapiens
tcctggcctgtctggagtagct

SEQ ID NO: 7615917 - DNA, 22 bp, Homo sapiens
tcctggcctgtctggagtagct

SEQ ID NO: 7615918 - DNA, 22 bp, Homo sapiens
tcctggcctgtctggagtagct

SEQ ID NO: 7615919 - DNA, 22 bp, Homo sapiens
tcctggcctgtctggagtagct

SEQ ID NO: 7615920 - DNA, 22 bp, Homo sapiens
tcctggccttagcgaggcggtc

SEQ ID NO: 7615921 - DNA, 22 bp, Homo sapiens
tcctggccttagcgaggcggtc

SEQ ID NO: 7615922 - DNA, 22 bp, Homo sapiens
tcctggccttagcgaggcggtc

SEQ ID NO: 7615923 - DNA, 22 bp, Homo sapiens
tcctggccttagcgaggcggtc

SEQ ID NO: 7615924 - DNA, 22 bp, Homo sapiens
tcctggccttagcgaggcggtc

SEQ ID NO: 7615925 - DNA, 22 bp, Homo sapiens
tcctggccttgcgtcttgggag

SEQ ID NO: 7615926 - DNA, 22 bp, Homo sapiens
tcctggccttgcgtcttgggag

SEQ ID NO: 7615927 - DNA, 22 bp, Homo sapiens
tcctggccttgcgtcttgggag

SEQ ID NO: 7615928 - DNA, 22 bp, Homo sapiens
tcctggccttgcgtcttgggag

SEQ ID NO: 7615929 - DNA, 22 bp, Homo sapiens
tcctggccttgctcctgatgcc

SEQ ID NO: 7615930 - DNA, 22 bp, Homo sapiens
tcctggccttgcgtcttgggag

SEQ ID NO: 7615931 - DNA, 22 bp, Homo sapiens
tcctggccttgctcctgatgcc

SEQ ID NO: 7615932 - DNA, 22 bp, Homo sapiens
tcctggccttgctcctgatgcc

SEQ ID NO: 7615933 - DNA, 16 bp, Homo sapiens
tcctggcctttggaag

SEQ ID NO: 7615934 - DNA, 16 bp, Homo sapiens
tcctggcctttggaag

SEQ ID NO: 7615935 - DNA, 22 bp, Homo sapiens
tcctggccttgctcctgatgcc

SEQ ID NO: 7615936 - DNA, 22 bp, Homo sapiens
tcctggccttgctcctgatgcc

SEQ ID NO: 7615937 - DNA, 22 bp, Homo sapiens
tcctggccttgctcctgatgcc

SEQ ID NO: 7615938 - DNA, 22 bp, Homo sapiens
tcctggccttgctcctgatgcc

SEQ ID NO: 7615939 - DNA, 16 bp, Homo sapiens
tcctggcctttggaag

SEQ ID NO: 7615940 - DNA, 22 bp, Homo sapiens
tcctggctaacacggtgacacc

SEQ ID NO: 7615941 - DNA, 22 bp, Homo sapiens
tcctggctaacacggtgacacc

SEQ ID NO: 7615942 - DNA, 22 bp, Homo sapiens
tcctggctaatgctgctgatgg

SEQ ID NO: 7615943 - DNA, 22 bp, Homo sapiens
tcctggctaacacggtgacacc

SEQ ID NO: 7615944 - DNA, 22 bp, Homo sapiens
tcctggctagttttgctgaaat

SEQ ID NO: 7615945 - DNA, 22 bp, Homo sapiens
tcctggctagttttgctgaaat

SEQ ID NO: 7615946 - DNA, 22 bp, Homo sapiens
tcctggctaatgctgctgatgg

SEQ ID NO: 7615947 - DNA, 22 bp, Homo sapiens
tcctggctaatgctgctgatgg

SEQ ID NO: 7615948 - DNA, 22 bp, Homo sapiens
tcctggctaatgctgctgatgg

SEQ ID NO: 7615949 - DNA, 22 bp, Homo sapiens
tcctggctcaggcccctggtgc

SEQ ID NO: 7615950 - DNA, 22 bp, Homo sapiens
tcctggctcaggcccctggtgc

SEQ ID NO: 7615951 - DNA, 22 bp, Homo sapiens
tcctggctagttttgctgaaat

SEQ ID NO: 7615952 - DNA, 22 bp, Homo sapiens
tcctggctcaggcccctggtgc

SEQ ID NO: 7615953 - DNA, 22 bp, Homo sapiens
ccaccaggacagccctgagggg

SEQ ID NO: 7615954 - DNA, 22 bp, Homo sapiens
ccaccaggacagccctgagggg

SEQ ID NO: 7615955 - DNA, 22 bp, Homo sapiens
ccaccaggcactcacagggaag

SEQ ID NO: 7615956 - DNA, 22 bp, Homo sapiens
ccaccaggacagccctgagggg

SEQ ID NO: 7615957 - DNA, 22 bp, Homo sapiens
tcctggctccactgagcaggcc

SEQ ID NO: 7615958 - DNA, 22 bp, Homo sapiens
tcctggctccactgagcaggcc

SEQ ID NO: 7615959 - DNA, 22 bp, Homo sapiens
tcctggctccactgagcaggcc

SEQ ID NO: 7615960 - DNA, 22 bp, Homo sapiens
tcctggctccactgagcaggcc

SEQ ID NO: 7615961 - DNA, 22 bp, Homo sapiens
cattttgtgctagacactatgg

SEQ ID NO: 7615962 - DNA, 22 bp, Homo sapiens
cattttgtgctagacactatgg

SEQ ID NO: 7615963 - DNA, 22 bp, Homo sapiens
cattttgtgctagacactatgg

SEQ ID NO: 7615964 - DNA, 22 bp, Homo sapiens
cattttgtgctagacactatgg

SEQ ID NO: 7615965 - DNA, 22 bp, Homo sapiens
cattttgtgctagacactatgg

SEQ ID NO: 7615966 - DNA, 22 bp, Homo sapiens
cattttgtgctagacactatgg

SEQ ID NO: 7615967 - DNA, 22 bp, Homo sapiens
cattttgtagcaatgactgttg

SEQ ID NO: 7615968 - DNA, 22 bp, Homo sapiens
cattttgtagcaatgactgttg

SEQ ID NO: 7615969 - DNA, 22 bp, Homo sapiens
cattttgtgcacacgtggagtt

SEQ ID NO: 7615970 - DNA, 22 bp, Homo sapiens
cattttgtgcacacgtggagtt

SEQ ID NO: 7615971 - DNA, 22 bp, Homo sapiens
cattttgtgcacacgtggagtt

SEQ ID NO: 7615972 - DNA, 22 bp, Homo sapiens
cattttgtaagtctctcttgtt

SEQ ID NO: 7615973 - DNA, 22 bp, Homo sapiens
cattttgtaagtctctcttgtt

SEQ ID NO: 7615974 - DNA, 22 bp, Homo sapiens
cattttgtaagtctctcttgtt

SEQ ID NO: 7615975 - DNA, 22 bp, Homo sapiens
cattttgtaagtctctcttgtt

SEQ ID NO: 7615976 - DNA, 22 bp, Homo sapiens
cattttgtagcaatgactgttg

SEQ ID NO: 7615977 - DNA, 22 bp, Homo sapiens
cattttgtagcaatgactgttg

SEQ ID NO: 7615978 - DNA, 19 bp, Homo sapiens
cattttctcattgtgcccc

SEQ ID NO: 7615979 - DNA, 19 bp, Homo sapiens
cattttctcattgtgcccc

SEQ ID NO: 7615980 - DNA, 22 bp, Homo sapiens
cattttctcaatgaaccctctt

SEQ ID NO: 7615981 - DNA, 22 bp, Homo sapiens
cattttggctattgtaaatagt

SEQ ID NO: 7615982 - DNA, 19 bp, Homo sapiens
cattttctcattgtgcccc

SEQ ID NO: 7615983 - DNA, 19 bp, Homo sapiens
cattttctcattgtgcccc

SEQ ID NO: 7615984 - DNA, 19 bp, Homo sapiens
cattttcccatcatccttt

SEQ ID NO: 7615985 - DNA, 19 bp, Homo sapiens
cattttcccatcatccttt

SEQ ID NO: 7615986 - DNA, 22 bp, Homo sapiens
cattttccacaggcctatttcc

SEQ ID NO: 7615987 - DNA, 19 bp, Homo sapiens
cattttcccatcatccttt

SEQ ID NO: 7615988 - DNA, 22 bp, Homo sapiens
cattttccacaggcctatttcc

SEQ ID NO: 7615989 - DNA, 19 bp, Homo sapiens
cattttcccatcatccttt

SEQ ID NO: 7615990 - DNA, 22 bp, Homo sapiens
cattttcctctgctggtgttca

SEQ ID NO: 7615991 - DNA, 22 bp, Homo sapiens
cattttctcaatgaaccctctt

SEQ ID NO: 7615992 - DNA, 22 bp, Homo sapiens
cattttctcaatgaaccctctt

SEQ ID NO: 7615993 - DNA, 22 bp, Homo sapiens
cattttcctctgctggtgttca

SEQ ID NO: 7615994 - DNA, 22 bp, Homo sapiens
cattttctcaatgaaccctctt

SEQ ID NO: 7615995 - DNA, 22 bp, Homo sapiens
cattttctcaatgaaccctctt

SEQ ID NO: 7615996 - DNA, 22 bp, Homo sapiens
cattttccacaggcctatttcc

SEQ ID NO: 7615997 - DNA, 22 bp, Homo sapiens
cattttcatgagtttctgttca

SEQ ID NO: 7615998 - DNA, 22 bp, Homo sapiens
cattttcatgagtttctgttca

SEQ ID NO: 7615999 - DNA, 22 bp, Homo sapiens
cattttcatgagtttctgttca

SEQ ID NO: 7616000 - DNA, 22 bp, Homo sapiens
cattttcatgagtttctgttca

SEQ ID NO: 7616001 - DNA, 22 bp, Homo sapiens
cattttcatgagtttctgttca

SEQ ID NO: 7616002 - DNA, 22 bp, Homo sapiens
cattttcatgagtttctgttca

SEQ ID NO: 7616003 - DNA, 22 bp, Homo sapiens
tcctgagggactggttcctcgc

SEQ ID NO: 7616004 - DNA, 22 bp, Homo sapiens
tcctgagggactggttcctcgc

SEQ ID NO: 7616005 - DNA, 22 bp, Homo sapiens
tcctgagggactggttcctcgc

SEQ ID NO: 7616006 - DNA, 22 bp, Homo sapiens
tcctgagggcattttggtgact

SEQ ID NO: 7616007 - DNA, 22 bp, Homo sapiens
tcctgagggcgattcagcaggt

SEQ ID NO: 7616008 - DNA, 22 bp, Homo sapiens
tcctgagggcgattcagcaggt

SEQ ID NO: 7616009 - DNA, 22 bp, Homo sapiens
tcctgagggcgattcagcaggt

SEQ ID NO: 7616010 - DNA, 22 bp, Homo sapiens
tcctgagggcgattcagcaggt

SEQ ID NO: 7616011 - DNA, 22 bp, Homo sapiens
tcctgagggctcggggctcatg

SEQ ID NO: 7616012 - DNA, 22 bp, Homo sapiens
tcctgagggcgattcagcaggt

SEQ ID NO: 7616013 - DNA, 22 bp, Homo sapiens
tcctgagggctcggggctcatg

SEQ ID NO: 7616014 - DNA, 22 bp, Homo sapiens
tcctgagggctcggggctcatg

SEQ ID NO: 7616015 - DNA, 22 bp, Homo sapiens
tcctgagggctcggggctcatg

SEQ ID NO: 7616016 - DNA, 22 bp, Homo sapiens
tcctgagggcgattcagcaggt

SEQ ID NO: 7616017 - DNA, 22 bp, Homo sapiens
tcctgagggcgattcagcaggt

SEQ ID NO: 7616018 - DNA, 22 bp, Homo sapiens
tcctgagggactggttcctcgc

SEQ ID NO: 7616019 - DNA, 22 bp, Homo sapiens
tcctgagggactggttcctcgc

SEQ ID NO: 7616020 - DNA, 20 bp, Homo sapiens
tcctgaggcttcgccagtgt

SEQ ID NO: 7616021 - DNA, 22 bp, Homo sapiens
tcctgagaaggcacagcttgca

SEQ ID NO: 7616022 - DNA, 22 bp, Homo sapiens
tcctgaggctcactttgaatgt

SEQ ID NO: 7616023 - DNA, 22 bp, Homo sapiens
tcctgagaaggcacagcttgca

SEQ ID NO: 7616024 - DNA, 22 bp, Homo sapiens
tcctgacttggctgttggccct

SEQ ID NO: 7616025 - DNA, 22 bp, Homo sapiens
tcctgacttcagggggaggtga

SEQ ID NO: 7616026 - DNA, 22 bp, Homo sapiens
tcctgacttggctgttggccct

SEQ ID NO: 7616027 - DNA, 22 bp, Homo sapiens
ccaaaaattagatacacatata

SEQ ID NO: 7616028 - DNA, 22 bp, Homo sapiens
tcctgacttaactactctctgg

SEQ ID NO: 7616029 - DNA, 22 bp, Homo sapiens
ccaaaaattagatacacatata

SEQ ID NO: 7616030 - DNA, 22 bp, Homo sapiens
ccaaaaattagatacacatata

SEQ ID NO: 7616031 - DNA, 22 bp, Homo sapiens
ccaaaaattagatacacatata

SEQ ID NO: 7616032 - DNA, 22 bp, Homo sapiens
ccaaaaattagatacacatata

SEQ ID NO: 7616033 - DNA, 22 bp, Homo sapiens
ccaaaaagctcagagatatgtt

SEQ ID NO: 7616034 - DNA, 22 bp, Homo sapiens
ccaaaaagctcagagatatgtt

SEQ ID NO: 7616035 - DNA, 22 bp, Homo sapiens
ccaaaaagtacatttaggtgtg

SEQ ID NO: 7616036 - DNA, 22 bp, Homo sapiens
ccaaaaagtacatttaggtgtg

SEQ ID NO: 7616037 - DNA, 22 bp, Homo sapiens
ccaaaaattagatacacatata

SEQ ID NO: 7616038 - DNA, 22 bp, Homo sapiens
ccaaaaagctcagagatatgtt

SEQ ID NO: 7616039 - DNA, 22 bp, Homo sapiens
ccaaaaagctcagagatatgtt

SEQ ID NO: 7616040 - DNA, 22 bp, Homo sapiens
ccaaaaagtacatttaggtgtg

SEQ ID NO: 7616041 - DNA, 22 bp, Homo sapiens
cattttaaatgatttaagccaa

SEQ ID NO: 7616042 - DNA, 22 bp, Homo sapiens
cattttaaatgatttaagccaa

SEQ ID NO: 7616043 - DNA, 22 bp, Homo sapiens
cattttaaatgatttaagccaa

SEQ ID NO: 7616044 - DNA, 22 bp, Homo sapiens
cattttaaatgatttaagccaa

SEQ ID NO: 7616045 - DNA, 22 bp, Homo sapiens
cattttaaatgatttaagccaa

SEQ ID NO: 7616046 - DNA, 22 bp, Homo sapiens
catttgttaaccagtgtggatt

SEQ ID NO: 7616047 - DNA, 22 bp, Homo sapiens
catttgttaaccagtgtggatt

SEQ ID NO: 7616048 - DNA, 22 bp, Homo sapiens
cattttaagatgacctggtttc

SEQ ID NO: 7616049 - DNA, 22 bp, Homo sapiens
cattttaagatgacctggtttc

SEQ ID NO: 7616050 - DNA, 22 bp, Homo sapiens
cattttaagatgacctggtttc

SEQ ID NO: 7616051 - DNA, 22 bp, Homo sapiens
cattttaagatgacctggtttc

SEQ ID NO: 7616052 - DNA, 22 bp, Homo sapiens
cattttaagatgacctggtttc

SEQ ID NO: 7616053 - DNA, 22 bp, Homo sapiens
cattttaagatgacctggtttc

SEQ ID NO: 7616054 - DNA, 22 bp, Homo sapiens
cattttaagatgacctggtttc

SEQ ID NO: 7616055 - DNA, 19 bp, Homo sapiens
cattttaagcatccccagt

SEQ ID NO: 7616056 - DNA, 19 bp, Homo sapiens
cattttaagcatccccagt

SEQ ID NO: 7616057 - DNA, 19 bp, Homo sapiens
cattttaagcatccccagt

SEQ ID NO: 7616058 - DNA, 19 bp, Homo sapiens
cattttaagcatccccagt

SEQ ID NO: 7616059 - DNA, 19 bp, Homo sapiens
cattttaagcatccccagt

SEQ ID NO: 7616060 - DNA, 19 bp, Homo sapiens
cattttaagcatccccagt

SEQ ID NO: 7616061 - DNA, 19 bp, Homo sapiens
cattttaagcatccccagt

SEQ ID NO: 7616062 - DNA, 19 bp, Homo sapiens
cattttaagcatccccagt

SEQ ID NO: 7616063 - DNA, 22 bp, Homo sapiens
catttctatggcaatgggaaaa

SEQ ID NO: 7616064 - DNA, 21 bp, Homo sapiens
catttctattgatgagaaaag

SEQ ID NO: 7616065 - DNA, 21 bp, Homo sapiens
catttctattgatgagaaaag

SEQ ID NO: 7616066 - DNA, 21 bp, Homo sapiens
catttctattgatgagaaaag

SEQ ID NO: 7616067 - DNA, 21 bp, Homo sapiens
catttctattgatgagaaaag

SEQ ID NO: 7616068 - DNA, 22 bp, Homo sapiens
catttctagggatcataaagta

SEQ ID NO: 7616069 - DNA, 22 bp, Homo sapiens
catttctatggcaatgggaaaa

SEQ ID NO: 7616070 - DNA, 23 bp, Homo sapiens
catttctaggtgtgtttggccat

SEQ ID NO: 7616071 - DNA, 22 bp, Homo sapiens
catttctatggcaatgggaaaa

SEQ ID NO: 7616072 - DNA, 21 bp, Homo sapiens
catttctattgatgagaaaag

SEQ ID NO: 7616073 - DNA, 21 bp, Homo sapiens
catttctattgatgagaaaag

SEQ ID NO: 7616074 - DNA, 22 bp, Homo sapiens
catttgtgtgggaacccatcag

SEQ ID NO: 7616075 - DNA, 22 bp, Homo sapiens
catttgtgcttttataaaatag

SEQ ID NO: 7616076 - DNA, 22 bp, Homo sapiens
catttgtctctaggaagtgagg

SEQ ID NO: 7616077 - DNA, 22 bp, Homo sapiens
catttgtctctaggaagtgagg

SEQ ID NO: 7616078 - DNA, 22 bp, Homo sapiens
catttgtgcttttataaaatag

SEQ ID NO: 7616079 - DNA, 22 bp, Homo sapiens
cattttatcctctgggaagcta

SEQ ID NO: 7616080 - DNA, 22 bp, Homo sapiens
cattttatcctctgggaagcta

SEQ ID NO: 7616081 - DNA, 22 bp, Homo sapiens
cattttactgactcttgaatta

SEQ ID NO: 7616082 - DNA, 22 bp, Homo sapiens
cattttatcctctgggaagcta

SEQ ID NO: 7616083 - DNA, 22 bp, Homo sapiens
cattttatcctctgggaagcta

SEQ ID NO: 7616084 - DNA, 22 bp, Homo sapiens
cattttatgtttatggagtgct

SEQ ID NO: 7616085 - DNA, 22 bp, Homo sapiens
cattttactgactcttgaatta

SEQ ID NO: 7616086 - DNA, 22 bp, Homo sapiens
cattttactgactcttgaatta

SEQ ID NO: 7616087 - DNA, 22 bp, Homo sapiens
cattttacctagaagctgaaag

SEQ ID NO: 7616088 - DNA, 22 bp, Homo sapiens
cattttacctagaagctgaaag

SEQ ID NO: 7616089 - DNA, 22 bp, Homo sapiens
cattttatgtttatggagtgct

SEQ ID NO: 7616090 - DNA, 22 bp, Homo sapiens
cattttatgtttatggagtgct

SEQ ID NO: 7616091 - DNA, 22 bp, Homo sapiens
cattttcagcacccatctgaaa

SEQ ID NO: 7616092 - DNA, 22 bp, Homo sapiens
cattttcagcacccatctgaaa

SEQ ID NO: 7616093 - DNA, 22 bp, Homo sapiens
cattttcagcacccatctgaaa

SEQ ID NO: 7616094 - DNA, 22 bp, Homo sapiens
cattttatgtttatggagtgct

SEQ ID NO: 7616095 - DNA, 22 bp, Homo sapiens
cattttcagcacccatctgaaa

SEQ ID NO: 7616096 - DNA, 22 bp, Homo sapiens
cattttcagcacccatctgaaa

SEQ ID NO: 7616097 - DNA, 22 bp, Homo sapiens
cattttcagcacccatctgaaa

SEQ ID NO: 7616098 - DNA, 22 bp, Homo sapiens
cattttcagcacccatctgaaa

SEQ ID NO: 7616099 - DNA, 22 bp, Homo sapiens
cattttcagcacccatctgaaa

SEQ ID NO: 7616100 - DNA, 22 bp, Homo sapiens
cattttcagcacccatctgaaa

SEQ ID NO: 7616101 - DNA, 22 bp, Homo sapiens
catttattgagtggccacagtg

SEQ ID NO: 7616102 - DNA, 22 bp, Homo sapiens
catttattggcatgtagtaggt

SEQ ID NO: 7616103 - DNA, 22 bp, Homo sapiens
catttattggcatgtagtaggt

SEQ ID NO: 7616104 - DNA, 22 bp, Homo sapiens
catttattggcatgtagtaggt

SEQ ID NO: 7616105 - DNA, 22 bp, Homo sapiens
catttattggcatgtagtaggt

SEQ ID NO: 7616106 - DNA, 22 bp, Homo sapiens
tccatattaactaaaactagaa

SEQ ID NO: 7616107 - DNA, 22 bp, Homo sapiens
catttattggcatgtagtaggt

SEQ ID NO: 7616108 - DNA, 22 bp, Homo sapiens
catttcacagtaaagtgatttc

SEQ ID NO: 7616109 - DNA, 22 bp, Homo sapiens
catttattggcatgtagtaggt

SEQ ID NO: 7616110 - DNA, 22 bp, Homo sapiens
catttcaccttagagaattatt

SEQ ID NO: 7616111 - DNA, 22 bp, Homo sapiens
catttcaccttagagaattatt

SEQ ID NO: 7616112 - DNA, 22 bp, Homo sapiens
catttcacagtatattcaaaat

SEQ ID NO: 7616113 - DNA, 22 bp, Homo sapiens
catttcacagtatattcaaaat

SEQ ID NO: 7616114 - DNA, 22 bp, Homo sapiens
catttcaccttagagaattatt

SEQ ID NO: 7616115 - DNA, 22 bp, Homo sapiens
catttcactattcactaaaagg

SEQ ID NO: 7616116 - DNA, 22 bp, Homo sapiens
catttcactattcactaaaagg

SEQ ID NO: 7616117 - DNA, 22 bp, Homo sapiens
catttcactattcactaaaagg

SEQ ID NO: 7616118 - DNA, 22 bp, Homo sapiens
catttcacgcacactcattact

SEQ ID NO: 7616119 - DNA, 22 bp, Homo sapiens
catttcacgcacactcattact

SEQ ID NO: 7616120 - DNA, 22 bp, Homo sapiens
catttcacgcacactcattact

SEQ ID NO: 7616121 - DNA, 22 bp, Homo sapiens
tccatacatacagatatgcatt

SEQ ID NO: 7616122 - DNA, 22 bp, Homo sapiens
tccatacatacagatatgcatt

SEQ ID NO: 7616123 - DNA, 22 bp, Homo sapiens
tccatacatacagatatgcatt

SEQ ID NO: 7616124 - DNA, 22 bp, Homo sapiens
tccatacatatccaaagagaag

SEQ ID NO: 7616125 - DNA, 22 bp, Homo sapiens
tccatactcagaaagtattgca

SEQ ID NO: 7616126 - DNA, 22 bp, Homo sapiens
tccatacatatccaaagagaag

SEQ ID NO: 7616127 - DNA, 22 bp, Homo sapiens
tccatacccagctttctcacac

SEQ ID NO: 7616128 - DNA, 22 bp, Homo sapiens
tccatataatgggattccttat

SEQ ID NO: 7616129 - DNA, 22 bp, Homo sapiens
tccatatatattagtcttcctt

SEQ ID NO: 7616130 - DNA, 22 bp, Homo sapiens
tccatagtgaatgggtaatgca

SEQ ID NO: 7616131 - DNA, 22 bp, Homo sapiens
tccatagtagaaaatgggacag

SEQ ID NO: 7616132 - DNA, 22 bp, Homo sapiens
tccatagtagaaaatgggacag

SEQ ID NO: 7616133 - DNA, 23 bp, Homo sapiens
tccatactctaaacatgttattt

SEQ ID NO: 7616134 - DNA, 23 bp, Homo sapiens
tccatactctaaacatgttattt

SEQ ID NO: 7616135 - DNA, 22 bp, Homo sapiens
tccatagaatgcagtgtaaatt

SEQ ID NO: 7616136 - DNA, 18 bp, Homo sapiens
tccaggtcccaggggaag

SEQ ID NO: 7616137 - DNA, 22 bp, Homo sapiens
tccaggtcctactggcccatag

SEQ ID NO: 7616138 - DNA, 18 bp, Homo sapiens
tccaggtcccaggggaag

SEQ ID NO: 7616139 - DNA, 22 bp, Homo sapiens
tccaggtccctggggagatttt

SEQ ID NO: 7616140 - DNA, 19 bp, Homo sapiens
tccagtttggcaggaagac

SEQ ID NO: 7616141 - DNA, 19 bp, Homo sapiens
tccagtttggcaggaagac

SEQ ID NO: 7616142 - DNA, 19 bp, Homo sapiens
tccagtttggcaggaagac

SEQ ID NO: 7616143 - DNA, 22 bp, Homo sapiens
tccagtttctctcaatcaatta

SEQ ID NO: 7616144 - DNA, 22 bp, Homo sapiens
tccagttttaatactcactgcc

SEQ ID NO: 7616145 - DNA, 22 bp, Homo sapiens
tccagttttaatactcactgcc

SEQ ID NO: 7616146 - DNA, 18 bp, Homo sapiens
tccagttttcccagcatc

SEQ ID NO: 7616147 - DNA, 20 bp, Homo sapiens
tccagttttggagacattct

SEQ ID NO: 7616148 - DNA, 22 bp, Homo sapiens
tccataaaccagaaaatcaaga

SEQ ID NO: 7616149 - DNA, 20 bp, Homo sapiens
tccagttttggagacattct

SEQ ID NO: 7616150 - DNA, 23 bp, Homo sapiens
tccataatcccagaaagctcaga

SEQ ID NO: 7616151 - DNA, 19 bp, Homo sapiens
tccataatgaagatagagg

SEQ ID NO: 7616152 - DNA, 21 bp, Homo sapiens
tccataagagaccatctccta

SEQ ID NO: 7616153 - DNA, 22 bp, Homo sapiens
tccataaaccagaaaatcaaga

SEQ ID NO: 7616154 - DNA, 22 bp, Homo sapiens
tccataaatgaaatagaacgct

SEQ ID NO: 7616155 - DNA, 22 bp, Homo sapiens
tccataaaccatgcttccaggt

SEQ ID NO: 7616156 - DNA, 22 bp, Homo sapiens
tccatacacattgaattttagt

SEQ ID NO: 7616157 - DNA, 22 bp, Homo sapiens
tccatacacattgaattttagt

SEQ ID NO: 7616158 - DNA, 19 bp, Homo sapiens
tccatacaaactgttgaaa

SEQ ID NO: 7616159 - DNA, 22 bp, Homo sapiens
tccatacataaaatgtttaatg

SEQ ID NO: 7616160 - DNA, 22 bp, Homo sapiens
tccatacagtgactcaggaatc

SEQ ID NO: 7616161 - DNA, 22 bp, Homo sapiens
tccatacagtgactcaggaatc

SEQ ID NO: 7616162 - DNA, 22 bp, Homo sapiens
tccatacagaatgcagtaaggg

SEQ ID NO: 7616163 - DNA, 20 bp, Homo sapiens
catttcattgtgtcttcact

SEQ ID NO: 7616164 - DNA, 22 bp, Homo sapiens
catttccactctgggagtcaga

SEQ ID NO: 7616165 - DNA, 22 bp, Homo sapiens
catttccactctgggagtcaga

SEQ ID NO: 7616166 - DNA, 22 bp, Homo sapiens
catttcattcctttgaaagtgg

SEQ ID NO: 7616167 - DNA, 21 bp, Homo sapiens
catttcatgattatagaaatg

SEQ ID NO: 7616168 - DNA, 21 bp, Homo sapiens
catttcatgattatagaaatg

SEQ ID NO: 7616169 - DNA, 21 bp, Homo sapiens
catttcatgattatagaaatg

SEQ ID NO: 7616170 - DNA, 21 bp, Homo sapiens
catttcatgattatagaaatg

SEQ ID NO: 7616171 - DNA, 21 bp, Homo sapiens
catttcatgattatagaaatg

SEQ ID NO: 7616172 - DNA, 21 bp, Homo sapiens
catttcatgattatagaaatg

SEQ ID NO: 7616173 - DNA, 21 bp, Homo sapiens
catttcatgattatagaaatg

SEQ ID NO: 7616174 - DNA, 21 bp, Homo sapiens
catttcatgattatagaaatg

SEQ ID NO: 7616175 - DNA, 21 bp, Homo sapiens
catttcatgattatagaaatg

SEQ ID NO: 7616176 - DNA, 22 bp, Homo sapiens
catttcatagttgtcacaataa

SEQ ID NO: 7616177 - DNA, 22 bp, Homo sapiens
catttcatagttgtcacaataa

SEQ ID NO: 7616178 - DNA, 22 bp, Homo sapiens
catttcagtgtcttgtgatgaa

SEQ ID NO: 7616179 - DNA, 22 bp, Homo sapiens
catttcagtgttattctaattt

SEQ ID NO: 7616180 - DNA, 21 bp, Homo sapiens
catttcagtaaggaagcctgt

SEQ ID NO: 7616181 - DNA, 21 bp, Homo sapiens
catttcagtaaggaagcctgt

SEQ ID NO: 7616182 - DNA, 22 bp, Homo sapiens
catttcactattcactaaaagg

SEQ ID NO: 7616183 - DNA, 22 bp, Homo sapiens
catttctagggatcataaagta

SEQ ID NO: 7616184 - DNA, 22 bp, Homo sapiens
catttctagggatcataaagta

SEQ ID NO: 7616185 - DNA, 22 bp, Homo sapiens
catttctagggatcataaagta

SEQ ID NO: 7616186 - DNA, 22 bp, Homo sapiens
catttctagggatcataaagta

SEQ ID NO: 7616187 - DNA, 22 bp, Homo sapiens
catttctaccaaatgtgactgg

SEQ ID NO: 7616188 - DNA, 22 bp, Homo sapiens
catttctagacaagtcctggag

SEQ ID NO: 7616189 - DNA, 22 bp, Homo sapiens
catttctaccaaatgtgactgg

SEQ ID NO: 7616190 - DNA, 22 bp, Homo sapiens
catttctacagcttcttcagaa

SEQ ID NO: 7616191 - DNA, 22 bp, Homo sapiens
catttctaccaaatgtgactgg

SEQ ID NO: 7616192 - DNA, 22 bp, Homo sapiens
catttctacagcttcttcagaa

SEQ ID NO: 7616193 - DNA, 21 bp, Homo sapiens
catttctaagcctggctatag

SEQ ID NO: 7616194 - DNA, 21 bp, Homo sapiens
catttctaagcctggctatag

SEQ ID NO: 7616195 - DNA, 22 bp, Homo sapiens
catttctaagaaggctgcacat

SEQ ID NO: 7616196 - DNA, 22 bp, Homo sapiens
catttctaagaaggctgcacat

SEQ ID NO: 7616197 - DNA, 22 bp, Homo sapiens
catttctaagaaggctgcacat

SEQ ID NO: 7616198 - DNA, 22 bp, Homo sapiens
catttccttcctgctgctcctc

SEQ ID NO: 7616199 - DNA, 22 bp, Homo sapiens
catttccttcctgctgctcctc

SEQ ID NO: 7616200 - DNA, 22 bp, Homo sapiens
catttctaagaagatctgggta

SEQ ID NO: 7616201 - DNA, 22 bp, Homo sapiens
catttctaagaaggctgcacat

SEQ ID NO: 7616202 - DNA, 22 bp, Homo sapiens
catttccccctcatgttgcagc

SEQ ID NO: 7616203 - DNA, 22 bp, Homo sapiens
catttcctgtctggaggtcaaa

SEQ ID NO: 7616204 - DNA, 22 bp, Homo sapiens
catttccttcctgctgctcctc

SEQ ID NO: 7616205 - DNA, 22 bp, Homo sapiens
catttccagctcctgcatcatg

SEQ ID NO: 7616206 - DNA, 22 bp, Homo sapiens
catttccagctcctgcatcatg

SEQ ID NO: 7616207 - DNA, 22 bp, Homo sapiens
catttccagctcctgcatcatg

SEQ ID NO: 7616208 - DNA, 22 bp, Homo sapiens
catttccacttctgaaaactgg

SEQ ID NO: 7616209 - DNA, 22 bp, Homo sapiens
catttccacttctgaaaactgg

SEQ ID NO: 7616210 - DNA, 22 bp, Homo sapiens
catttccacttctgaaaactgg

SEQ ID NO: 7616211 - DNA, 22 bp, Homo sapiens
catttccacttctgaaaactgg

SEQ ID NO: 7616212 - DNA, 22 bp, Homo sapiens
catttccacttctgaaaactgg

SEQ ID NO: 7616213 - DNA, 22 bp, Homo sapiens
tctatagacttggacatatagt

SEQ ID NO: 7616214 - DNA, 22 bp, Homo sapiens
tctataccaggggcctgcagtg

SEQ ID NO: 7616215 - DNA, 22 bp, Homo sapiens
tctatacctttgctgtgacttt

SEQ ID NO: 7616216 - DNA, 22 bp, Homo sapiens
tctatagagccttttattaccc

SEQ ID NO: 7616217 - DNA, 22 bp, Homo sapiens
tctatagatcagtaaatatctc

SEQ ID NO: 7616218 - DNA, 22 bp, Homo sapiens
tctatagacttggacatatagt

SEQ ID NO: 7616219 - DNA, 22 bp, Homo sapiens
tctatagattttattgtgtatc

SEQ ID NO: 7616220 - DNA, 22 bp, Homo sapiens
tctcagagaagtgatgagcaat

SEQ ID NO: 7616221 - DNA, 22 bp, Homo sapiens
tctcagagaagtgatgagcaat

SEQ ID NO: 7616222 - DNA, 22 bp, Homo sapiens
tctcagagaagtgatgagcaat

SEQ ID NO: 7616223 - DNA, 22 bp, Homo sapiens
tctcagagaagtgatgagcaat

SEQ ID NO: 7616224 - DNA, 22 bp, Homo sapiens
tctatacatgtgcacacacatc

SEQ ID NO: 7616225 - DNA, 22 bp, Homo sapiens
tctatacatgtgcacacacatc

SEQ ID NO: 7616226 - DNA, 22 bp, Homo sapiens
tctatacatgtgcacacacatc

SEQ ID NO: 7616227 - DNA, 22 bp, Homo sapiens
tctatacatgtgcacacacatc

SEQ ID NO: 7616228 - DNA, 23 bp, Homo sapiens
tctatacatactgcagcctctgg

SEQ ID NO: 7616229 - DNA, 22 bp, Homo sapiens
tctatacacacaaagaatgctt

SEQ ID NO: 7616230 - DNA, 22 bp, Homo sapiens
tctatacacacaaagaatgctt

SEQ ID NO: 7616231 - DNA, 22 bp, Homo sapiens
tctatacacacaaagaatgctt

SEQ ID NO: 7616232 - DNA, 23 bp, Homo sapiens
tctatacatactgcagcctctgg

SEQ ID NO: 7616233 - DNA, 23 bp, Homo sapiens
tctatacatactgcagcctctgg

SEQ ID NO: 7616234 - DNA, 22 bp, Homo sapiens
tctcagagacctgaactccctg

SEQ ID NO: 7616235 - DNA, 22 bp, Homo sapiens
tctcagctgcctgccctgctcc

SEQ ID NO: 7616236 - DNA, 22 bp, Homo sapiens
tctcagagacctgaactccctg

SEQ ID NO: 7616237 - DNA, 22 bp, Homo sapiens
tctcagcttgagtggatgagct

SEQ ID NO: 7616238 - DNA, 22 bp, Homo sapiens
tctcagctgcctgccctgctcc

SEQ ID NO: 7616239 - DNA, 22 bp, Homo sapiens
tctcagcttgagtggatgagct

SEQ ID NO: 7616240 - DNA, 22 bp, Homo sapiens
tctcaggaagattagggctaag

SEQ ID NO: 7616241 - DNA, 22 bp, Homo sapiens
tctcaggaagattagggctaag

SEQ ID NO: 7616242 - DNA, 22 bp, Homo sapiens
tctcaggaagattagggctaag

SEQ ID NO: 7616243 - DNA, 22 bp, Homo sapiens
tctcaggaaaaatccctagctt

SEQ ID NO: 7616244 - DNA, 22 bp, Homo sapiens
tctcaggaaataggatttgagt

SEQ ID NO: 7616245 - DNA, 22 bp, Homo sapiens
tctcaggaaataggatttgagt

SEQ ID NO: 7616246 - DNA, 22 bp, Homo sapiens
tctcaggaatagagtggcagca

SEQ ID NO: 7616247 - DNA, 22 bp, Homo sapiens
tctcaggaatagagtggcagca

SEQ ID NO: 7616248 - DNA, 21 bp, Homo sapiens
tctataactatagtgacagat

SEQ ID NO: 7616249 - DNA, 21 bp, Homo sapiens
tctataactatagtgacagat

SEQ ID NO: 7616250 - DNA, 21 bp, Homo sapiens
tctataactatagtgacagat

SEQ ID NO: 7616251 - DNA, 22 bp, Homo sapiens
tctataaattatgcagtctcag

SEQ ID NO: 7616252 - DNA, 22 bp, Homo sapiens
tctataaattatgcagtctcag

SEQ ID NO: 7616253 - DNA, 22 bp, Homo sapiens
tctataaatgcagatatgtgtg

SEQ ID NO: 7616254 - DNA, 22 bp, Homo sapiens
tctataaattatgcagtctcag

SEQ ID NO: 7616255 - DNA, 22 bp, Homo sapiens
tctatacaagtttcactttgac

SEQ ID NO: 7616256 - DNA, 22 bp, Homo sapiens
tctatacaagtttcactttgac

SEQ ID NO: 7616257 - DNA, 22 bp, Homo sapiens
tctataatggaaagtggatgtg

SEQ ID NO: 7616258 - DNA, 22 bp, Homo sapiens
tctatacaagtttcactttgac

SEQ ID NO: 7616259 - DNA, 22 bp, Homo sapiens
tctatacaagtttcactttgac

SEQ ID NO: 7616260 - DNA, 22 bp, Homo sapiens
tctatacaagtttcactttgac

SEQ ID NO: 7616261 - DNA, 22 bp, Homo sapiens
tctataatcctatttcaactgc

SEQ ID NO: 7616262 - DNA, 21 bp, Homo sapiens
tctataatatgcaggtcatca

SEQ ID NO: 7616263 - DNA, 22 bp, Homo sapiens
tctataatcctatttcaactgc

SEQ ID NO: 7616264 - DNA, 22 bp, Homo sapiens
tctataaatgcagatatgtgtg

SEQ ID NO: 7616265 - DNA, 22 bp, Homo sapiens
tctataaatgcagatatgtgtg

SEQ ID NO: 7616266 - DNA, 22 bp, Homo sapiens
tctagaatttgcgtaggttaga

SEQ ID NO: 7616267 - DNA, 22 bp, Homo sapiens
tctataaatgcagatatgtgtg

SEQ ID NO: 7616268 - DNA, 22 bp, Homo sapiens
tctagaattcccttttgacaat

SEQ ID NO: 7616269 - DNA, 22 bp, Homo sapiens
tctagaattcccttttgacaat

SEQ ID NO: 7616270 - DNA, 22 bp, Homo sapiens
tctagaatctaaactatagttt

SEQ ID NO: 7616271 - DNA, 22 bp, Homo sapiens
tctagaatctaaactatagttt

SEQ ID NO: 7616272 - DNA, 22 bp, Homo sapiens
tctagaatgacatgcaagagta

SEQ ID NO: 7616273 - DNA, 22 bp, Homo sapiens
tctagaatggctgggcacagct

SEQ ID NO: 7616274 - DNA, 22 bp, Homo sapiens
tctagaatgttccaccttgttt

SEQ ID NO: 7616275 - DNA, 22 bp, Homo sapiens
tctagaatgttccaccttgttt

SEQ ID NO: 7616276 - DNA, 22 bp, Homo sapiens
tctcagtggatctcagaatttt

SEQ ID NO: 7616277 - DNA, 22 bp, Homo sapiens
tctcagtggatctcagaatttt

SEQ ID NO: 7616278 - DNA, 20 bp, Homo sapiens
tctcaggccccagttttctt

SEQ ID NO: 7616279 - DNA, 20 bp, Homo sapiens
tctcaggccccagttttctt

SEQ ID NO: 7616280 - DNA, 22 bp, Homo sapiens
tctcagtggatctcagaatttt

SEQ ID NO: 7616281 - DNA, 20 bp, Homo sapiens
tctcaggccccagttttctt

SEQ ID NO: 7616282 - DNA, 22 bp, Homo sapiens
tctcaggcccactgtgttgaaa

SEQ ID NO: 7616283 - DNA, 22 bp, Homo sapiens
tctcaggcattcccacatagaa

SEQ ID NO: 7616284 - DNA, 22 bp, Homo sapiens
tctcaggcatggtttgttcatc

SEQ ID NO: 7616285 - DNA, 22 bp, Homo sapiens
tctcaggcattcccacatagaa

SEQ ID NO: 7616286 - DNA, 22 bp, Homo sapiens
tctcaggcatggtttgttcatc

SEQ ID NO: 7616287 - DNA, 22 bp, Homo sapiens
tctcaggcatctgtgtggcaca

SEQ ID NO: 7616288 - DNA, 22 bp, Homo sapiens
tctcaggcatctgtgtggcaca

SEQ ID NO: 7616289 - DNA, 22 bp, Homo sapiens
tctcaggcactgggtgccaact

SEQ ID NO: 7616290 - DNA, 17 bp, Homo sapiens
tctcaggcacgtgtggc

SEQ ID NO: 7616291 - DNA, 22 bp, Homo sapiens
tctcaggcatctgtgtggcaca

SEQ ID NO: 7616292 - DNA, 22 bp, Homo sapiens
tctcaggcatctgtgtggcaca

SEQ ID NO: 7616293 - DNA, 22 bp, Homo sapiens
tctcaggcactgggtgccaact

SEQ ID NO: 7616294 - DNA, 23 bp, Homo sapiens
tctcaggacacacatgtctatca

SEQ ID NO: 7616295 - DNA, 22 bp, Homo sapiens
tctcaggactcctctggccata

SEQ ID NO: 7616296 - DNA, 22 bp, Homo sapiens
tctcaggactcctctggccata

SEQ ID NO: 7616297 - DNA, 22 bp, Homo sapiens
tctcaggactcctctggccata

SEQ ID NO: 7616298 - DNA, 22 bp, Homo sapiens
tctcaggagccacagcgggagt

SEQ ID NO: 7616299 - DNA, 22 bp, Homo sapiens
tctcaggagccacagcgggagt

SEQ ID NO: 7616300 - DNA, 22 bp, Homo sapiens
tctcaggactttgggaagctca

SEQ ID NO: 7616301 - DNA, 22 bp, Homo sapiens
tctcaggactttgggaagctca

SEQ ID NO: 7616302 - DNA, 22 bp, Homo sapiens
tctcaggagtagtgggatccat

SEQ ID NO: 7616303 - DNA, 22 bp, Homo sapiens
tctcaggatctaatacatggta

SEQ ID NO: 7616304 - DNA, 23 bp, Homo sapiens
tctcaggcaaaccaggacaagtt

SEQ ID NO: 7616305 - DNA, 23 bp, Homo sapiens
tctcaggcaaaccaggacaagtt

SEQ ID NO: 7616306 - DNA, 22 bp, Homo sapiens
tctcagtggcttcctcactttt

SEQ ID NO: 7616307 - DNA, 22 bp, Homo sapiens
tctcagtggcttcctcactttt

SEQ ID NO: 7616308 - DNA, 22 bp, Homo sapiens
tctcagtgggaagggcacagtt

SEQ ID NO: 7616309 - DNA, 22 bp, Homo sapiens
tctcagtggcttcctcactttt

SEQ ID NO: 7616310 - DNA, 22 bp, Homo sapiens
tctcagtgggaagggcacagtt

SEQ ID NO: 7616311 - DNA, 22 bp, Homo sapiens
tctcagtggtggcattccagac

SEQ ID NO: 7616312 - DNA, 22 bp, Homo sapiens
tctcagtgggaagggcacagtt

SEQ ID NO: 7616313 - DNA, 22 bp, Homo sapiens
tctcagtgggttaaaagagaag

SEQ ID NO: 7616314 - DNA, 22 bp, Homo sapiens
tctcagtgggaagggcacagtt

SEQ ID NO: 7616315 - DNA, 22 bp, Homo sapiens
tctcagtgtgttttctctcaga

SEQ ID NO: 7616316 - DNA, 22 bp, Homo sapiens
tctcagtgtgttttctctcaga

SEQ ID NO: 7616317 - DNA, 22 bp, Homo sapiens
tctcagtgtgttgagaggtctg

SEQ ID NO: 7616318 - DNA, 22 bp, Homo sapiens
tctcagtgtgttgagaggtctg

SEQ ID NO: 7616319 - DNA, 22 bp, Homo sapiens
tctcagtgtgttgagaggtctg

SEQ ID NO: 7616320 - DNA, 22 bp, Homo sapiens
tctcagtgtgttgagaggtctg

SEQ ID NO: 7616321 - DNA, 22 bp, Homo sapiens
tctcagtgtggtgcttaggata

SEQ ID NO: 7616322 - DNA, 22 bp, Homo sapiens
tctcagtgtggtgcttaggata

SEQ ID NO: 7616323 - DNA, 22 bp, Homo sapiens
tctcagtgtggtgcttaggata

SEQ ID NO: 7616324 - DNA, 22 bp, Homo sapiens
tctcagtggtgttttgagtcca

SEQ ID NO: 7616325 - DNA, 22 bp, Homo sapiens
tctcagtggtgttttgagtcca

SEQ ID NO: 7616326 - DNA, 22 bp, Homo sapiens
tctcagtgttatctatctgcct

SEQ ID NO: 7616327 - DNA, 22 bp, Homo sapiens
tctcagtgttgttctgcagatg

SEQ ID NO: 7616328 - DNA, 22 bp, Homo sapiens
tctcagtgtgttttctctcaga

SEQ ID NO: 7616329 - DNA, 22 bp, Homo sapiens
tctcagtgtttaaaaagatttc

SEQ ID NO: 7616330 - DNA, 22 bp, Homo sapiens
tctcagtgtttaaaaagatttc

SEQ ID NO: 7616331 - DNA, 22 bp, Homo sapiens
tctcagtgtttaaaaagatttc

SEQ ID NO: 7616332 - DNA, 22 bp, Homo sapiens
tctcagtgttgttctgcagatg

SEQ ID NO: 7616333 - DNA, 22 bp, Homo sapiens
tctcagtgttgttctgcagatg

SEQ ID NO: 7616334 - DNA, 22 bp, Homo sapiens
tctcagtgtttaaaaagatttc

SEQ ID NO: 7616335 - DNA, 22 bp, Homo sapiens
tctcagtgtttaaaaagatttc

SEQ ID NO: 7616336 - DNA, 22 bp, Homo sapiens
tctcagttcttctcattccaga

SEQ ID NO: 7616337 - DNA, 22 bp, Homo sapiens
tctcagttctgccgcaagtatt

SEQ ID NO: 7616338 - DNA, 22 bp, Homo sapiens
tctcagtgtgttttctctcaga

SEQ ID NO: 7616339 - DNA, 22 bp, Homo sapiens
ccagagaggccttggcaagaca

SEQ ID NO: 7616340 - DNA, 23 bp, Homo sapiens
tctcagttccagaggctacaagt

SEQ ID NO: 7616341 - DNA, 23 bp, Homo sapiens
tctcagttccagaggctacaagt

SEQ ID NO: 7616342 - DNA, 22 bp, Homo sapiens
ccagagaggccttggcaagaca

SEQ ID NO: 7616343 - DNA, 22 bp, Homo sapiens
ccagagaggccttggcaagaca

SEQ ID NO: 7616344 - DNA, 22 bp, Homo sapiens
ccagagaggccttggcaagaca

SEQ ID NO: 7616345 - DNA, 22 bp, Homo sapiens
ccagagaggccttggcaagaca

SEQ ID NO: 7616346 - DNA, 20 bp, Homo sapiens
ccaccctccaggaacacata

SEQ ID NO: 7616347 - DNA, 22 bp, Homo sapiens
ccaccctaacaatccttactgt

SEQ ID NO: 7616348 - DNA, 22 bp, Homo sapiens
ccaccctgagccgcaagagcag

SEQ ID NO: 7616349 - DNA, 19 bp, Homo sapiens
ccacccctttgctgggccc

SEQ ID NO: 7616350 - DNA, 19 bp, Homo sapiens
ccacccctttgctgggccc

SEQ ID NO: 7616351 - DNA, 19 bp, Homo sapiens
ccacccctttgctgggccc

SEQ ID NO: 7616352 - DNA, 19 bp, Homo sapiens
ccacccctttgctgggccc

SEQ ID NO: 7616353 - DNA, 19 bp, Homo sapiens
ccacccctttgctgggccc

SEQ ID NO: 7616354 - DNA, 19 bp, Homo sapiens
ccacccctttgctgggccc

SEQ ID NO: 7616355 - DNA, 22 bp, Homo sapiens
ccacccctgtagagggacagac

SEQ ID NO: 7616356 - DNA, 22 bp, Homo sapiens
ccacccctgggtgcagggagcg

SEQ ID NO: 7616357 - DNA, 22 bp, Homo sapiens
ccacccatgtgactacctcatg

SEQ ID NO: 7616358 - DNA, 22 bp, Homo sapiens
ccacccctgggtgcagggagcg

SEQ ID NO: 7616359 - DNA, 22 bp, Homo sapiens
ccacccctgggtgcagggagcg

SEQ ID NO: 7616360 - DNA, 19 bp, Homo sapiens
ccacccctttgctgggccc

SEQ ID NO: 7616361 - DNA, 19 bp, Homo sapiens
ccacccctttgctgggccc

SEQ ID NO: 7616362 - DNA, 19 bp, Homo sapiens
ccacccctttgctgggccc

SEQ ID NO: 7616363 - DNA, 19 bp, Homo sapiens
ccacccctttgctgggccc

SEQ ID NO: 7616364 - DNA, 22 bp, Homo sapiens
ccacccctgtagagggacagac

SEQ ID NO: 7616365 - DNA, 22 bp, Homo sapiens
ccacccctgtagagggacagac

SEQ ID NO: 7616366 - DNA, 22 bp, Homo sapiens
ccacccctgtagagggacagac

SEQ ID NO: 7616367 - DNA, 22 bp, Homo sapiens
ccacccctgggtgcagggagcg

SEQ ID NO: 7616368 - DNA, 22 bp, Homo sapiens
ccacccctgggtgcagggagcg

SEQ ID NO: 7616369 - DNA, 22 bp, Homo sapiens
ccacccctgggtgcagggagcg

SEQ ID NO: 7616370 - DNA, 22 bp, Homo sapiens
ccacccatgtgactacctcatg

SEQ ID NO: 7616371 - DNA, 22 bp, Homo sapiens
ccaccccaaatgaagacctctc

SEQ ID NO: 7616372 - DNA, 22 bp, Homo sapiens
ccaccccaaatgaagacctctc

SEQ ID NO: 7616373 - DNA, 22 bp, Homo sapiens
ccaccccaaatgaagacctctc

SEQ ID NO: 7616374 - DNA, 18 bp, Homo sapiens
ccacccatctctgccttt

SEQ ID NO: 7616375 - DNA, 18 bp, Homo sapiens
ccacccagggggagagga

SEQ ID NO: 7616376 - DNA, 18 bp, Homo sapiens
ccacccagggggagagga

SEQ ID NO: 7616377 - DNA, 22 bp, Homo sapiens
ccaccaggcactcacagggaag

SEQ ID NO: 7616378 - DNA, 22 bp, Homo sapiens
ccaccaggcactcacagggaag

SEQ ID NO: 7616379 - DNA, 22 bp, Homo sapiens
ccaccaggcactcacagggaag

SEQ ID NO: 7616380 - DNA, 18 bp, Homo sapiens
ccacccagggggagagga

SEQ ID NO: 7616381 - DNA, 18 bp, Homo sapiens
ccacccagggggagagga

SEQ ID NO: 7616382 - DNA, 20 bp, Homo sapiens
ccaccctgctaagaatacac

SEQ ID NO: 7616383 - DNA, 22 bp, Homo sapiens
ccaccctggacaggcctctgag

SEQ ID NO: 7616384 - DNA, 20 bp, Homo sapiens
ccaccctgctaagaatacac

SEQ ID NO: 7616385 - DNA, 20 bp, Homo sapiens
ccaccctgctaagaatacac

SEQ ID NO: 7616386 - DNA, 20 bp, Homo sapiens
ccaccctgctaagaatacac

SEQ ID NO: 7616387 - DNA, 22 bp, Homo sapiens
ccaccctggacaggcctctgag

SEQ ID NO: 7616388 - DNA, 22 bp, Homo sapiens
ccaccctggacaggcctctgag

SEQ ID NO: 7616389 - DNA, 22 bp, Homo sapiens
ccaccctggacaggcctctgag

SEQ ID NO: 7616390 - DNA, 22 bp, Homo sapiens
tcctgtggtcattcttctgccc

SEQ ID NO: 7616391 - DNA, 22 bp, Homo sapiens
tcctgtggtcattcttctgccc

SEQ ID NO: 7616392 - DNA, 22 bp, Homo sapiens
ccaccctgccttgggccagtga

SEQ ID NO: 7616393 - DNA, 22 bp, Homo sapiens
ccaccctgccttgggccagtga

SEQ ID NO: 7616394 - DNA, 22 bp, Homo sapiens
ccaccctgccttgggccagtga

SEQ ID NO: 7616395 - DNA, 22 bp, Homo sapiens
ccaccctgccttgggccagtga

SEQ ID NO: 7616396 - DNA, 22 bp, Homo sapiens
ccaccctgccttgggccagtga

SEQ ID NO: 7616397 - DNA, 22 bp, Homo sapiens
ccaccctgccttgggccagtga

SEQ ID NO: 7616398 - DNA, 22 bp, Homo sapiens
ccaccctgaggaatggtccggc

SEQ ID NO: 7616399 - DNA, 22 bp, Homo sapiens
ccaccctgaggaatggtccggc

SEQ ID NO: 7616400 - DNA, 22 bp, Homo sapiens
ccaccctgagccgcaagagcag

SEQ ID NO: 7616401 - DNA, 22 bp, Homo sapiens
tcctgtgtctcagcgtgaagca

SEQ ID NO: 7616402 - DNA, 22 bp, Homo sapiens
tcctgtgtgctttctttaggtt

SEQ ID NO: 7616403 - DNA, 22 bp, Homo sapiens
tcctgtgtgggcaggatgagaa

SEQ ID NO: 7616404 - DNA, 22 bp, Homo sapiens
tcctgtgtgggcaggatgagaa

SEQ ID NO: 7616405 - DNA, 22 bp, Homo sapiens
tcctgtgtgggcaggatgagaa

SEQ ID NO: 7616406 - DNA, 22 bp, Homo sapiens
tcctgtgttaaagggggtgcta

SEQ ID NO: 7616407 - DNA, 22 bp, Homo sapiens
tcctgtgtgtggcctttcccag

SEQ ID NO: 7616408 - DNA, 20 bp, Homo sapiens
tcctgtgtgtctcatcaacc

SEQ ID NO: 7616409 - DNA, 22 bp, Homo sapiens
tcctgtggtctggaaggaatgg

SEQ ID NO: 7616410 - DNA, 22 bp, Homo sapiens
tcctgtggtctggaaggaatgg

SEQ ID NO: 7616411 - DNA, 22 bp, Homo sapiens
tcctgtgtaaatagatctggtt

SEQ ID NO: 7616412 - DNA, 22 bp, Homo sapiens
tcctgtgtaaatagatctggtt

SEQ ID NO: 7616413 - DNA, 22 bp, Homo sapiens
tcctgtggtcattcttctgccc

SEQ ID NO: 7616414 - DNA, 22 bp, Homo sapiens
tcctgtggtcattcttctgccc

SEQ ID NO: 7616415 - DNA, 22 bp, Homo sapiens
tcctgtgtctcagcgtgaagca

SEQ ID NO: 7616416 - DNA, 22 bp, Homo sapiens
tcctgtgtcaattcctcattct

SEQ ID NO: 7616417 - DNA, 22 bp, Homo sapiens
tctagaaagtttgtactgattt

SEQ ID NO: 7616418 - DNA, 22 bp, Homo sapiens
tctagaaagtttgtactgattt

SEQ ID NO: 7616419 - DNA, 22 bp, Homo sapiens
tctagaaattttgccttgtatt

SEQ ID NO: 7616420 - DNA, 22 bp, Homo sapiens
tctagaaagtttgtactgattt

SEQ ID NO: 7616421 - DNA, 22 bp, Homo sapiens
tctagaaagtttgtactgattt

SEQ ID NO: 7616422 - DNA, 22 bp, Homo sapiens
tctagaaagtactagagctggt

SEQ ID NO: 7616423 - DNA, 22 bp, Homo sapiens
tctagaaagtactagagctggt

SEQ ID NO: 7616424 - DNA, 22 bp, Homo sapiens
tctagaaagtactagagctggt

SEQ ID NO: 7616425 - DNA, 22 bp, Homo sapiens
tctagaaagtactagagctggt

SEQ ID NO: 7616426 - DNA, 22 bp, Homo sapiens
tctagaaagtttgtactgattt

SEQ ID NO: 7616427 - DNA, 18 bp, Homo sapiens
tctagaaacttctctcct

SEQ ID NO: 7616428 - DNA, 22 bp, Homo sapiens
tctagaaagccaaattaggaat

SEQ ID NO: 7616429 - DNA, 22 bp, Homo sapiens
tctagaaagccaaattaggaat

SEQ ID NO: 7616430 - DNA, 18 bp, Homo sapiens
tctagaaacccagactct

SEQ ID NO: 7616431 - DNA, 18 bp, Homo sapiens
tctagaaacccagactct

SEQ ID NO: 7616432 - DNA, 18 bp, Homo sapiens
tctagaaacccagactct

SEQ ID NO: 7616433 - DNA, 18 bp, Homo sapiens
tctagaaacccagactct

SEQ ID NO: 7616434 - DNA, 21 bp, Homo sapiens
tctagaatcctgtataagact

SEQ ID NO: 7616435 - DNA, 22 bp, Homo sapiens
tctagaatcactgtttccatct

SEQ ID NO: 7616436 - DNA, 22 bp, Homo sapiens
tctagaatagattctgctgatc

SEQ ID NO: 7616437 - DNA, 22 bp, Homo sapiens
tctagaatagattctgctgatc

SEQ ID NO: 7616438 - DNA, 17 bp, Homo sapiens
tctagaagtgcttacat

SEQ ID NO: 7616439 - DNA, 17 bp, Homo sapiens
tctagaagtgcttacat

SEQ ID NO: 7616440 - DNA, 22 bp, Homo sapiens
tctagaagtatattgtagggtg

SEQ ID NO: 7616441 - DNA, 22 bp, Homo sapiens
tctagaagggtgccgatcttag

SEQ ID NO: 7616442 - DNA, 22 bp, Homo sapiens
tctagaagtatattgtagggtg

SEQ ID NO: 7616443 - DNA, 22 bp, Homo sapiens
tctagaagtccaaagttaaata

SEQ ID NO: 7616444 - DNA, 22 bp, Homo sapiens
tctagaacttctctaaaatgaa

SEQ ID NO: 7616445 - DNA, 21 bp, Homo sapiens
tctagaagaggttgagaatat

SEQ ID NO: 7616446 - DNA, 22 bp, Homo sapiens
tctagaagatacctgctgccaa

SEQ ID NO: 7616447 - DNA, 21 bp, Homo sapiens
tctagaagaggttgagaatat

SEQ ID NO: 7616448 - DNA, 22 bp, Homo sapiens
tctagaagatacctgctgccaa

SEQ ID NO: 7616449 - DNA, 22 bp, Homo sapiens
tctagaactccagttaggcaat

SEQ ID NO: 7616450 - DNA, 22 bp, Homo sapiens
tctagaactccagttaggcaat

SEQ ID NO: 7616451 - DNA, 22 bp, Homo sapiens
tctagaaattttgccttgtatt

SEQ ID NO: 7616452 - DNA, 22 bp, Homo sapiens
tctagaaattttgccttgtatt

SEQ ID NO: 7616453 - DNA, 22 bp, Homo sapiens
tctagaaattttgccttgtatt

SEQ ID NO: 7616454 - DNA, 22 bp, Homo sapiens
tcctgtttccaatttgttgggt

SEQ ID NO: 7616455 - DNA, 22 bp, Homo sapiens
tcctgtttccaatttgttgggt

SEQ ID NO: 7616456 - DNA, 22 bp, Homo sapiens
tcctgtttatctgtgtgactcg

SEQ ID NO: 7616457 - DNA, 22 bp, Homo sapiens
tcctgtttcaacccttacactg

SEQ ID NO: 7616458 - DNA, 22 bp, Homo sapiens
tcctgtttcaacccttacactg

SEQ ID NO: 7616459 - DNA, 22 bp, Homo sapiens
tcctgtttctcctgcaaaatcc

SEQ ID NO: 7616460 - DNA, 22 bp, Homo sapiens
tcctgtttttgtaatcgactct

SEQ ID NO: 7616461 - DNA, 22 bp, Homo sapiens
tctaatgaaagatgtaggaact

SEQ ID NO: 7616462 - DNA, 21 bp, Homo sapiens
tctaatgacatcctctgacaa

SEQ ID NO: 7616463 - DNA, 22 bp, Homo sapiens
tctagaaacatgacattgatct

SEQ ID NO: 7616464 - DNA, 22 bp, Homo sapiens
tctagaaacatgacattgatct

SEQ ID NO: 7616465 - DNA, 22 bp, Homo sapiens
tctagaaacatgacattgatct

SEQ ID NO: 7616466 - DNA, 22 bp, Homo sapiens
tctaatgctctgagaacagtgc

SEQ ID NO: 7616467 - DNA, 22 bp, Homo sapiens
tctagaaacatgacattgatct

SEQ ID NO: 7616468 - DNA, 22 bp, Homo sapiens
tctagaaacatgacattgatct

SEQ ID NO: 7616469 - DNA, 22 bp, Homo sapiens
tctagaaacatgacattgatct

SEQ ID NO: 7616470 - DNA, 23 bp, Homo sapiens
tctaatgcaattagaaattaggg

SEQ ID NO: 7616471 - DNA, 22 bp, Homo sapiens
tctaatgagttagataattttg

SEQ ID NO: 7616472 - DNA, 22 bp, Homo sapiens
tcctgttgttcgcctgcgatgg

SEQ ID NO: 7616473 - DNA, 22 bp, Homo sapiens
tcctgtttaggctgtggtctgg

SEQ ID NO: 7616474 - DNA, 22 bp, Homo sapiens
tcctgtttaggctgtggtctgg

SEQ ID NO: 7616475 - DNA, 17 bp, Homo sapiens
tcctgtttatcattgat

SEQ ID NO: 7616476 - DNA, 17 bp, Homo sapiens
tcctgtttatcattgat

SEQ ID NO: 7616477 - DNA, 22 bp, Homo sapiens
tcctgtttatctgtgtgactcg

SEQ ID NO: 7616478 - DNA, 22 bp, Homo sapiens
tcctgtttatctgtgtgactcg

SEQ ID NO: 7616479 - DNA, 22 bp, Homo sapiens
tcctgtgttactgcctggagcg

SEQ ID NO: 7616480 - DNA, 22 bp, Homo sapiens
tcctgtgttacccttgcagtga

SEQ ID NO: 7616481 - DNA, 22 bp, Homo sapiens
tcctgtgttactgcctggagcg

SEQ ID NO: 7616482 - DNA, 22 bp, Homo sapiens
tcctgtgttctaggtatggtct

SEQ ID NO: 7616483 - DNA, 22 bp, Homo sapiens
tcctgtgttgatagagatggtt

SEQ ID NO: 7616484 - DNA, 22 bp, Homo sapiens
ccagaggctggcagccagctga

SEQ ID NO: 7616485 - DNA, 22 bp, Homo sapiens
ccagaggctggcagccagctga

SEQ ID NO: 7616486 - DNA, 22 bp, Homo sapiens
ccagaggctggcagccagctga

SEQ ID NO: 7616487 - DNA, 22 bp, Homo sapiens
ccagaggctggcagccagctga

SEQ ID NO: 7616488 - DNA, 22 bp, Homo sapiens
ccagaggctggggaaggataca

SEQ ID NO: 7616489 - DNA, 22 bp, Homo sapiens
ccagaggctggggaaggataca

SEQ ID NO: 7616490 - DNA, 22 bp, Homo sapiens
ccagaggctggggaaggataca

SEQ ID NO: 7616491 - DNA, 22 bp, Homo sapiens
ccagaggctggggaaggataca

SEQ ID NO: 7616492 - DNA, 22 bp, Homo sapiens
ccagaggctgggttcacctcag

SEQ ID NO: 7616493 - DNA, 22 bp, Homo sapiens
ccagaggctgggttcacctcag

SEQ ID NO: 7616494 - DNA, 22 bp, Homo sapiens
ccagaggctgggttcacctcag

SEQ ID NO: 7616495 - DNA, 22 bp, Homo sapiens
ccagaggctgggttcacctcag

SEQ ID NO: 7616496 - DNA, 22 bp, Homo sapiens
ccagagggaagaggaagcgctg

SEQ ID NO: 7616497 - DNA, 22 bp, Homo sapiens
ccagagggaagaggaagcgctg

SEQ ID NO: 7616498 - DNA, 22 bp, Homo sapiens
ccagagggacgttaccagttca

SEQ ID NO: 7616499 - DNA, 22 bp, Homo sapiens
ccagagggacgttaccagttca

SEQ ID NO: 7616500 - DNA, 22 bp, Homo sapiens
ccagagggacgttaccagttca

SEQ ID NO: 7616501 - DNA, 22 bp, Homo sapiens
ccagagggagccaccagggtgt

SEQ ID NO: 7616502 - DNA, 22 bp, Homo sapiens
ccagagggagccaccagggtgt

SEQ ID NO: 7616503 - DNA, 22 bp, Homo sapiens
ccagagggagccaccagggtgt

SEQ ID NO: 7616504 - DNA, 22 bp, Homo sapiens
ccagagggagccaccagggtgt

SEQ ID NO: 7616505 - DNA, 22 bp, Homo sapiens
ccagagggagccaccagggtgt

SEQ ID NO: 7616506 - DNA, 22 bp, Homo sapiens
ccagagggcaaaatgaagctta

SEQ ID NO: 7616507 - DNA, 22 bp, Homo sapiens
ccagagggagccaccagggtgt

SEQ ID NO: 7616508 - DNA, 22 bp, Homo sapiens
ccagagggagccaccagggtgt

SEQ ID NO: 7616509 - DNA, 22 bp, Homo sapiens
ccagagggaactgggcctcatt

SEQ ID NO: 7616510 - DNA, 22 bp, Homo sapiens
ccagagggaagaggaagcgctg

SEQ ID NO: 7616511 - DNA, 22 bp, Homo sapiens
ccagagggaagaggaagcgctg

SEQ ID NO: 7616512 - DNA, 22 bp, Homo sapiens
ccagagggaagaggaagcgctg

SEQ ID NO: 7616513 - DNA, 22 bp, Homo sapiens
ccagagggaagaggaagcgctg

SEQ ID NO: 7616514 - DNA, 22 bp, Homo sapiens
ccagagggaagaggaagcgctg

SEQ ID NO: 7616515 - DNA, 22 bp, Homo sapiens
ccagagggaagaggaagcgctg

SEQ ID NO: 7616516 - DNA, 22 bp, Homo sapiens
ccagagggaactgggcctcatt

SEQ ID NO: 7616517 - DNA, 22 bp, Homo sapiens
ccagagggaactgggcctcatt

SEQ ID NO: 7616518 - DNA, 22 bp, Homo sapiens
ccagagggaactgggcctcatt

SEQ ID NO: 7616519 - DNA, 22 bp, Homo sapiens
ccagagggaactgggcctcatt

SEQ ID NO: 7616520 - DNA, 22 bp, Homo sapiens
ccagagggaactgggcctcatt

SEQ ID NO: 7616521 - DNA, 22 bp, Homo sapiens
ccagagggaactgggcctcatt

SEQ ID NO: 7616522 - DNA, 22 bp, Homo sapiens
ccagagggaactgggcctcatt

SEQ ID NO: 7616523 - DNA, 22 bp, Homo sapiens
ccagaggatcagtactggctgg

SEQ ID NO: 7616524 - DNA, 22 bp, Homo sapiens
ccagaggatcagtactggctgg

SEQ ID NO: 7616525 - DNA, 22 bp, Homo sapiens
ccagaggatcagtactggctgg

SEQ ID NO: 7616526 - DNA, 22 bp, Homo sapiens
ccagaggatcagtactggctgg

SEQ ID NO: 7616527 - DNA, 22 bp, Homo sapiens
ccagagcctgctgagccccatt

SEQ ID NO: 7616528 - DNA, 21 bp, Homo sapiens
ccagagcctgagaggattatg

SEQ ID NO: 7616529 - DNA, 22 bp, Homo sapiens
ccagaggatcagtactggctgg

SEQ ID NO: 7616530 - DNA, 21 bp, Homo sapiens
ccagagcctgagaggattatg

SEQ ID NO: 7616531 - DNA, 22 bp, Homo sapiens
ccagagcctcttatgaagatcg

SEQ ID NO: 7616532 - DNA, 22 bp, Homo sapiens
ccagagcctcttatgaagatcg

SEQ ID NO: 7616533 - DNA, 22 bp, Homo sapiens
ccagaggctggcagccagctga

SEQ ID NO: 7616534 - DNA, 22 bp, Homo sapiens
ccagaggctggcagccagctga

SEQ ID NO: 7616535 - DNA, 22 bp, Homo sapiens
ccagaggctggcagccagctga

SEQ ID NO: 7616536 - DNA, 22 bp, Homo sapiens
ccagaggctggcagccagctga

SEQ ID NO: 7616537 - DNA, 22 bp, Homo sapiens
ccagaggatcagtactggctgg

SEQ ID NO: 7616538 - DNA, 22 bp, Homo sapiens
ccagaggatcagtactggctgg

SEQ ID NO: 7616539 - DNA, 22 bp, Homo sapiens
ccagaggatcagtactggctgg

SEQ ID NO: 7616540 - DNA, 22 bp, Homo sapiens
ccagaggatcagtactggctgg

SEQ ID NO: 7616541 - DNA, 22 bp, Homo sapiens
ccagagcctcaacacaggtcct

SEQ ID NO: 7616542 - DNA, 22 bp, Homo sapiens
ccagagcctcaacacaggtcct

SEQ ID NO: 7616543 - DNA, 22 bp, Homo sapiens
ccagagcctcaacacaggtcct

SEQ ID NO: 7616544 - DNA, 22 bp, Homo sapiens
ccagagcctcaacacaggtcct

SEQ ID NO: 7616545 - DNA, 22 bp, Homo sapiens
ccagagcctaagatctgatcct

SEQ ID NO: 7616546 - DNA, 22 bp, Homo sapiens
ccagagcctaagatctgatcct

SEQ ID NO: 7616547 - DNA, 22 bp, Homo sapiens
ccagagcctcgcccggagcctc

SEQ ID NO: 7616548 - DNA, 22 bp, Homo sapiens
ccagagcctcaacacaggtcct

SEQ ID NO: 7616549 - DNA, 22 bp, Homo sapiens
ccagagcctcgcccggagcctc

SEQ ID NO: 7616550 - DNA, 22 bp, Homo sapiens
ccagagcctcgcccggagcctc

SEQ ID NO: 7616551 - DNA, 22 bp, Homo sapiens
ccagagcctcttatgaagatcg

SEQ ID NO: 7616552 - DNA, 22 bp, Homo sapiens
ccagagcctcttatgaagatcg

SEQ ID NO: 7616553 - DNA, 22 bp, Homo sapiens
ccagagcctcgcccggagcctc

SEQ ID NO: 7616554 - DNA, 22 bp, Homo sapiens
ccagagcctcgcccggagcctc

SEQ ID NO: 7616555 - DNA, 22 bp, Homo sapiens
ccagagcccgggacctggactt

SEQ ID NO: 7616556 - DNA, 22 bp, Homo sapiens
ccagagcccgggacctggactt

SEQ ID NO: 7616557 - DNA, 22 bp, Homo sapiens
ccagagcccgggacctggactt

SEQ ID NO: 7616558 - DNA, 22 bp, Homo sapiens
ccagagcccgggacctggactt

SEQ ID NO: 7616559 - DNA, 19 bp, Homo sapiens
ccagagcccgccagatggg

SEQ ID NO: 7616560 - DNA, 22 bp, Homo sapiens
ccagagcccgggacctggactt

SEQ ID NO: 7616561 - DNA, 22 bp, Homo sapiens
ccagagccggctccctcagctt

SEQ ID NO: 7616562 - DNA, 22 bp, Homo sapiens
ccagagccggattgtgaagtgc

SEQ ID NO: 7616563 - DNA, 22 bp, Homo sapiens
ccagagccggctccctcagctt

SEQ ID NO: 7616564 - DNA, 22 bp, Homo sapiens
ccagagccggctccctcagctt

SEQ ID NO: 7616565 - DNA, 22 bp, Homo sapiens
ccagagccggctccctcagctt

SEQ ID NO: 7616566 - DNA, 22 bp, Homo sapiens
ccagagccggctccctcagctt

SEQ ID NO: 7616567 - DNA, 22 bp, Homo sapiens
ccagagccggctccctcagctt

SEQ ID NO: 7616568 - DNA, 22 bp, Homo sapiens
ccagagccggctccctcagctt

SEQ ID NO: 7616569 - DNA, 22 bp, Homo sapiens
ccagagccggctccctcagctt

SEQ ID NO: 7616570 - DNA, 22 bp, Homo sapiens
ccagagcccagggtcatgcagg

SEQ ID NO: 7616571 - DNA, 22 bp, Homo sapiens
ccagagcccctgagcttccctg

SEQ ID NO: 7616572 - DNA, 22 bp, Homo sapiens
ccagagcccctgagcttccctg

SEQ ID NO: 7616573 - DNA, 19 bp, Homo sapiens
ccagagcccgccagatggg

SEQ ID NO: 7616574 - DNA, 19 bp, Homo sapiens
ccagagcccgccagatggg

SEQ ID NO: 7616575 - DNA, 19 bp, Homo sapiens
ccagagcccgccagatggg

SEQ ID NO: 7616576 - DNA, 19 bp, Homo sapiens
ccagagcccgccagatggg

SEQ ID NO: 7616577 - DNA, 22 bp, Homo sapiens
ccagagccagagaggtgcctgc

SEQ ID NO: 7616578 - DNA, 22 bp, Homo sapiens
ccagagcccagcacacggtgct

SEQ ID NO: 7616579 - DNA, 22 bp, Homo sapiens
ccagagcccagcacacggtgct

SEQ ID NO: 7616580 - DNA, 22 bp, Homo sapiens
ccagagcccagcacacggtgct

SEQ ID NO: 7616581 - DNA, 22 bp, Homo sapiens
ccagagcccagggtcatgcagg

SEQ ID NO: 7616582 - DNA, 22 bp, Homo sapiens
ccagagcccagggtcatgcagg

SEQ ID NO: 7616583 - DNA, 22 bp, Homo sapiens
ccagagcccagcacacggtgct

SEQ ID NO: 7616584 - DNA, 22 bp, Homo sapiens
ccagagcagggcagcagggctc

SEQ ID NO: 7616585 - DNA, 22 bp, Homo sapiens
ccagagcatgaagggcaatgac

SEQ ID NO: 7616586 - DNA, 22 bp, Homo sapiens
ccagagcatgaagggcaatgac

SEQ ID NO: 7616587 - DNA, 22 bp, Homo sapiens
ccagagcatgaagggcaatgac

SEQ ID NO: 7616588 - DNA, 22 bp, Homo sapiens
ccagagccagagaggtgcctgc

SEQ ID NO: 7616589 - DNA, 22 bp, Homo sapiens
ccagagcatgaagggcaatgac

SEQ ID NO: 7616590 - DNA, 22 bp, Homo sapiens
ccagagccagagaggtgcctgc

SEQ ID NO: 7616591 - DNA, 22 bp, Homo sapiens
ccagagccagagaggtgcctgc

SEQ ID NO: 7616592 - DNA, 22 bp, Homo sapiens
ccagagccagagaggtgcctgc

SEQ ID NO: 7616593 - DNA, 20 bp, Homo sapiens
ccagagcagccactgaagtt

SEQ ID NO: 7616594 - DNA, 22 bp, Homo sapiens
ccagagcagggcagcagggctc

SEQ ID NO: 7616595 - DNA, 22 bp, Homo sapiens
ccagagcagggcagcagggctc

SEQ ID NO: 7616596 - DNA, 22 bp, Homo sapiens
ccagagcagggcagcagggctc

SEQ ID NO: 7616597 - DNA, 22 bp, Homo sapiens
ccagagcagggcagcagggctc

SEQ ID NO: 7616598 - DNA, 22 bp, Homo sapiens
ccagagcagggcagcagggctc

SEQ ID NO: 7616599 - DNA, 22 bp, Homo sapiens
ccagagcagggcagcagggctc

SEQ ID NO: 7616600 - DNA, 22 bp, Homo sapiens
ccagagcagggcagcagggctc

SEQ ID NO: 7616601 - DNA, 22 bp, Homo sapiens
ccagagcagggcagcagggctc

SEQ ID NO: 7616602 - DNA, 22 bp, Homo sapiens
ccagagcagggcagcagggctc

SEQ ID NO: 7616603 - DNA, 22 bp, Homo sapiens
ccagagcagggcagcagggctc

SEQ ID NO: 7616604 - DNA, 22 bp, Homo sapiens
ccagagcagggcagcagggctc

SEQ ID NO: 7616605 - DNA, 22 bp, Homo sapiens
ccagagcagggcagcagggctc

SEQ ID NO: 7616606 - DNA, 22 bp, Homo sapiens
ccagagcagggcagcagggctc

SEQ ID NO: 7616607 - DNA, 20 bp, Homo sapiens
ccagagcagccactgaagtt

SEQ ID NO: 7616608 - DNA, 22 bp, Homo sapiens
ccagagagggcgccacctggag

SEQ ID NO: 7616609 - DNA, 22 bp, Homo sapiens
ccagagagggcgccacctggag

SEQ ID NO: 7616610 - DNA, 22 bp, Homo sapiens
ccagagagggcgccacctggag

SEQ ID NO: 7616611 - DNA, 22 bp, Homo sapiens
ccagagagggcgccacctggag

SEQ ID NO: 7616612 - DNA, 22 bp, Homo sapiens
ccagagcagggcagcagggctc

SEQ ID NO: 7616613 - DNA, 20 bp, Homo sapiens
ccagagcagccactgaagtt

SEQ ID NO: 7616614 - DNA, 20 bp, Homo sapiens
ccagagcagccactgaagtt

SEQ ID NO: 7616615 - DNA, 20 bp, Homo sapiens
ccagagcagccactgaagtt

SEQ ID NO: 7616616 - DNA, 22 bp, Homo sapiens
ccagatttgagcgtcttaaacc

SEQ ID NO: 7616617 - DNA, 22 bp, Homo sapiens
ccagatttgagcgtcttaaacc

SEQ ID NO: 7616618 - DNA, 23 bp, Homo sapiens
ccagatttgccacgagagaggct

SEQ ID NO: 7616619 - DNA, 22 bp, Homo sapiens
ccagatttgagcgtcttaaacc

SEQ ID NO: 7616620 - DNA, 22 bp, Homo sapiens
ccagattcatagaaactcatag

SEQ ID NO: 7616621 - DNA, 22 bp, Homo sapiens
ccagatgttcccctggaggcct

SEQ ID NO: 7616622 - DNA, 22 bp, Homo sapiens
ccagatgttcccctggaggcct

SEQ ID NO: 7616623 - DNA, 20 bp, Homo sapiens
ccagatgtttacattcatac

SEQ ID NO: 7616624 - DNA, 20 bp, Homo sapiens
ccagatgtttacattcatac

SEQ ID NO: 7616625 - DNA, 22 bp, Homo sapiens
ccagattcagatatggcagtgg

SEQ ID NO: 7616626 - DNA, 22 bp, Homo sapiens
ccagattcatagaaactcatag

SEQ ID NO: 7616627 - DNA, 22 bp, Homo sapiens
ccagatgtctgagccacactcc

SEQ ID NO: 7616628 - DNA, 22 bp, Homo sapiens
tctctgtcacacaatctacaca

SEQ ID NO: 7616629 - DNA, 22 bp, Homo sapiens
ccagatgtgagcagagccttga

SEQ ID NO: 7616630 - DNA, 17 bp, Homo sapiens
ccagatgtgtaggtcgt

SEQ ID NO: 7616631 - DNA, 22 bp, Homo sapiens
ccagatgtgagcagagccttga

SEQ ID NO: 7616632 - DNA, 22 bp, Homo sapiens
ccagatgttcccctggaggcct

SEQ ID NO: 7616633 - DNA, 22 bp, Homo sapiens
ccagatgttcccctggaggcct

SEQ ID NO: 7616634 - DNA, 22 bp, Homo sapiens
ccagatgtccctctcaggtttg

SEQ ID NO: 7616635 - DNA, 22 bp, Homo sapiens
ccagatgtccctctcaggtttg

SEQ ID NO: 7616636 - DNA, 22 bp, Homo sapiens
ccagatgtccctctcaggtttg

SEQ ID NO: 7616637 - DNA, 22 bp, Homo sapiens
ccagatgtccctctcaggtttg

SEQ ID NO: 7616638 - DNA, 22 bp, Homo sapiens
ccagcaccttgatcttggagtt

SEQ ID NO: 7616639 - DNA, 22 bp, Homo sapiens
ccagcacacagtgggtgcccag

SEQ ID NO: 7616640 - DNA, 20 bp, Homo sapiens
ccagcaccctctcagctgaa

SEQ ID NO: 7616641 - DNA, 20 bp, Homo sapiens
ccagcaccctctcagctgaa

SEQ ID NO: 7616642 - DNA, 20 bp, Homo sapiens
ccagcaccctctcagctgaa

SEQ ID NO: 7616643 - DNA, 22 bp, Homo sapiens
ccagcacacagtgggtgcccag

SEQ ID NO: 7616644 - DNA, 22 bp, Homo sapiens
ccagcaagtgcagatggccaag

SEQ ID NO: 7616645 - DNA, 20 bp, Homo sapiens
ccagcaccctctcagctgaa

SEQ ID NO: 7616646 - DNA, 22 bp, Homo sapiens
ccagcaaggtccagcataggga

SEQ ID NO: 7616647 - DNA, 22 bp, Homo sapiens
ccagcaagccaggtctgtggct

SEQ ID NO: 7616648 - DNA, 22 bp, Homo sapiens
ccagcaagccaggtctgtggct

SEQ ID NO: 7616649 - DNA, 22 bp, Homo sapiens
ccagcaagccaggtctgtggct

SEQ ID NO: 7616650 - DNA, 22 bp, Homo sapiens
ccagcaaggtccagcataggga

SEQ ID NO: 7616651 - DNA, 22 bp, Homo sapiens
ccagcaaggtccagcataggga

SEQ ID NO: 7616652 - DNA, 22 bp, Homo sapiens
ccagcaaggtccagcataggga

SEQ ID NO: 7616653 - DNA, 22 bp, Homo sapiens
ccagcaagtgcagatggccaag

SEQ ID NO: 7616654 - DNA, 22 bp, Homo sapiens
ccagcaagtgcagatggccaag

SEQ ID NO: 7616655 - DNA, 22 bp, Homo sapiens
ccagcaagtgcagatggccaag

SEQ ID NO: 7616656 - DNA, 22 bp, Homo sapiens
tctctgtacagtacatgccgtg

SEQ ID NO: 7616657 - DNA, 22 bp, Homo sapiens
tctctgtacagtacatgccgtg

SEQ ID NO: 7616658 - DNA, 22 bp, Homo sapiens
tctctgtagagacagcactgtg

SEQ ID NO: 7616659 - DNA, 22 bp, Homo sapiens
tctctgtagacctgaccagcac

SEQ ID NO: 7616660 - DNA, 22 bp, Homo sapiens
tctctgtagacctgaccagcac

SEQ ID NO: 7616661 - DNA, 22 bp, Homo sapiens
tctctgtaaggaagaattagat

SEQ ID NO: 7616662 - DNA, 22 bp, Homo sapiens
tctctgtaaggaagaattagat

SEQ ID NO: 7616663 - DNA, 22 bp, Homo sapiens
tctctgtaaggaagaattagat

SEQ ID NO: 7616664 - DNA, 22 bp, Homo sapiens
tctctgtaaggaagaattagat

SEQ ID NO: 7616665 - DNA, 23 bp, Homo sapiens
tctctgtacagatgaggacacac

SEQ ID NO: 7616666 - DNA, 22 bp, Homo sapiens
tctctgtaatatcttttacaac

SEQ ID NO: 7616667 - DNA, 22 bp, Homo sapiens
tctctgggatcaggtggcccag

SEQ ID NO: 7616668 - DNA, 21 bp, Homo sapiens
tctctggttggagttgtgcca

SEQ ID NO: 7616669 - DNA, 22 bp, Homo sapiens
tctctgggatcaggtggcccag

SEQ ID NO: 7616670 - DNA, 22 bp, Homo sapiens
tctctgggataaactgggccag

SEQ ID NO: 7616671 - DNA, 22 bp, Homo sapiens
tctctgggataaactgggccag

SEQ ID NO: 7616672 - DNA, 22 bp, Homo sapiens
tctctgtaaaatgtggatgata

SEQ ID NO: 7616673 - DNA, 22 bp, Homo sapiens
tctctgtaaaatgtggatgata

SEQ ID NO: 7616674 - DNA, 22 bp, Homo sapiens
tctctgtaaaatgtggatgata

SEQ ID NO: 7616675 - DNA, 22 bp, Homo sapiens
tctctgtagagacagcactgtg

SEQ ID NO: 7616676 - DNA, 22 bp, Homo sapiens
tctctgtagagacagcactgtg

SEQ ID NO: 7616677 - DNA, 22 bp, Homo sapiens
tctctgtagagacagcactgtg

SEQ ID NO: 7616678 - DNA, 22 bp, Homo sapiens
tctctgtagggctgcttgagta

SEQ ID NO: 7616679 - DNA, 22 bp, Homo sapiens
tctctgtagttgggcagctgct

SEQ ID NO: 7616680 - DNA, 22 bp, Homo sapiens
tctctgtagggctgcttgagta

SEQ ID NO: 7616681 - DNA, 22 bp, Homo sapiens
tctctgtatcagcacctgctgg

SEQ ID NO: 7616682 - DNA, 22 bp, Homo sapiens
tctctgtagttgggcagctgct

SEQ ID NO: 7616683 - DNA, 22 bp, Homo sapiens
tctctgtatcccagaaccaaaa

SEQ ID NO: 7616684 - DNA, 22 bp, Homo sapiens
tctctgtatcccagaaccaaaa

SEQ ID NO: 7616685 - DNA, 22 bp, Homo sapiens
tctctgtatcccagaaccaaaa

SEQ ID NO: 7616686 - DNA, 21 bp, Homo sapiens
tctctgtatccatgggttcca

SEQ ID NO: 7616687 - DNA, 22 bp, Homo sapiens
tctctgtattctgatattcact

SEQ ID NO: 7616688 - DNA, 22 bp, Homo sapiens
tctctgtattctgatattcact

SEQ ID NO: 7616689 - DNA, 22 bp, Homo sapiens
tctctgtattctgatattcact

SEQ ID NO: 7616690 - DNA, 22 bp, Homo sapiens
ccagatgtccctctcaggtttg

SEQ ID NO: 7616691 - DNA, 22 bp, Homo sapiens
ccagaggtctcctgcacgggat

SEQ ID NO: 7616692 - DNA, 22 bp, Homo sapiens
ccagaggtcctgtgatgctgca

SEQ ID NO: 7616693 - DNA, 22 bp, Homo sapiens
ccagaggtcctgtgatgctgca

SEQ ID NO: 7616694 - DNA, 22 bp, Homo sapiens
ccagaggtctcctgcacgggat

SEQ ID NO: 7616695 - DNA, 22 bp, Homo sapiens
ccagaggtgaacaggaggctgt

SEQ ID NO: 7616696 - DNA, 22 bp, Homo sapiens
ccagaggtctctctatactggg

SEQ ID NO: 7616697 - DNA, 22 bp, Homo sapiens
ccagaggtctctctatactggg

SEQ ID NO: 7616698 - DNA, 22 bp, Homo sapiens
ccagaggtctcctgcacgggat

SEQ ID NO: 7616699 - DNA, 22 bp, Homo sapiens
ccagaggtctcctgcacgggat

SEQ ID NO: 7616700 - DNA, 22 bp, Homo sapiens
ccagaggtctcctgcacgggat

SEQ ID NO: 7616701 - DNA, 22 bp, Homo sapiens
tctctgggataaactgggccag

SEQ ID NO: 7616702 - DNA, 22 bp, Homo sapiens
ccagaggtgagggggattcttg

SEQ ID NO: 7616703 - DNA, 22 bp, Homo sapiens
tctctgggataaactgggccag

SEQ ID NO: 7616704 - DNA, 22 bp, Homo sapiens
ccagaggtgagggggattcttg

SEQ ID NO: 7616705 - DNA, 22 bp, Homo sapiens
ccagaggtctctctatactggg

SEQ ID NO: 7616706 - DNA, 22 bp, Homo sapiens
ccagaggtgagggggattcttg

SEQ ID NO: 7616707 - DNA, 22 bp, Homo sapiens
ccagaggtgaacaggaggctgt

SEQ ID NO: 7616708 - DNA, 22 bp, Homo sapiens
ccagaggtgaacaggaggctgt

SEQ ID NO: 7616709 - DNA, 22 bp, Homo sapiens
ccagaggtgaacaggaggctgt

SEQ ID NO: 7616710 - DNA, 22 bp, Homo sapiens
ccagaggtgaacaggaggctgt

SEQ ID NO: 7616711 - DNA, 22 bp, Homo sapiens
ccagaggtgaacaggaggctgt

SEQ ID NO: 7616712 - DNA, 22 bp, Homo sapiens
ccagaggtcctgtgatgctgca

SEQ ID NO: 7616713 - DNA, 22 bp, Homo sapiens
ccagaggtcctgctcactggtg

SEQ ID NO: 7616714 - DNA, 22 bp, Homo sapiens
ccagaggtcctgtgatgctgca

SEQ ID NO: 7616715 - DNA, 22 bp, Homo sapiens
ccagaggtcctgtgatgctgca

SEQ ID NO: 7616716 - DNA, 22 bp, Homo sapiens
ccagaggtcctgctcactggtg

SEQ ID NO: 7616717 - DNA, 22 bp, Homo sapiens
ccagaggtcctgctcactggtg

SEQ ID NO: 7616718 - DNA, 22 bp, Homo sapiens
ccagaggtcccctgccaggagg

SEQ ID NO: 7616719 - DNA, 22 bp, Homo sapiens
ccagaggtcctgctcactggtg

SEQ ID NO: 7616720 - DNA, 22 bp, Homo sapiens
ccagaggtcccctgccaggagg

SEQ ID NO: 7616721 - DNA, 22 bp, Homo sapiens
ccagaggtcccctgccaggagg

SEQ ID NO: 7616722 - DNA, 22 bp, Homo sapiens
ccagaggtcccctgccaggagg

SEQ ID NO: 7616723 - DNA, 18 bp, Homo sapiens
ccagagggtgcgtcagct

SEQ ID NO: 7616724 - DNA, 18 bp, Homo sapiens
ccagagggtgcgtcagct

SEQ ID NO: 7616725 - DNA, 18 bp, Homo sapiens
ccagagggtgcgtcagct

SEQ ID NO: 7616726 - DNA, 18 bp, Homo sapiens
ccagagggtgcgtcagct

SEQ ID NO: 7616727 - DNA, 18 bp, Homo sapiens
ccagagggtgcgtcagct

SEQ ID NO: 7616728 - DNA, 18 bp, Homo sapiens
ccagagggtgcgtcagct

SEQ ID NO: 7616729 - DNA, 18 bp, Homo sapiens
ccagagggtgcgtcagct

SEQ ID NO: 7616730 - DNA, 22 bp, Homo sapiens
ccagaggtcccctgccaggagg

SEQ ID NO: 7616731 - DNA, 18 bp, Homo sapiens
ccagagggtgcgtcagct

SEQ ID NO: 7616732 - DNA, 18 bp, Homo sapiens
ccagagggtgcgtcagct

SEQ ID NO: 7616733 - DNA, 22 bp, Homo sapiens
ccagaggggtgggcctggttta

SEQ ID NO: 7616734 - DNA, 22 bp, Homo sapiens
ccagaggggtgggcctggttta

SEQ ID NO: 7616735 - DNA, 20 bp, Homo sapiens
ccagagggtagggccgcccc

SEQ ID NO: 7616736 - DNA, 20 bp, Homo sapiens
ccagagggtagggccgcccc

SEQ ID NO: 7616737 - DNA, 20 bp, Homo sapiens
ccagagggtagggccgcccc

SEQ ID NO: 7616738 - DNA, 20 bp, Homo sapiens
ccagagggtagggccgcccc

SEQ ID NO: 7616739 - DNA, 18 bp, Homo sapiens
ccagagggtgcgtcagct

SEQ ID NO: 7616740 - DNA, 20 bp, Homo sapiens
ccagagggtagggccgcccc

SEQ ID NO: 7616741 - DNA, 20 bp, Homo sapiens
ccagagggtagggccgcccc

SEQ ID NO: 7616742 - DNA, 20 bp, Homo sapiens
ccagagggtagggccgcccc

SEQ ID NO: 7616743 - DNA, 22 bp, Homo sapiens
ccagaggggctgagcaggtcac

SEQ ID NO: 7616744 - DNA, 22 bp, Homo sapiens
ccagaggggctgagcaggtcac

SEQ ID NO: 7616745 - DNA, 22 bp, Homo sapiens
ccagaggggtgggcctggttta

SEQ ID NO: 7616746 - DNA, 22 bp, Homo sapiens
ccagaggggtgggcctggttta

SEQ ID NO: 7616747 - DNA, 22 bp, Homo sapiens
ccagaggggtgggcctggttta

SEQ ID NO: 7616748 - DNA, 22 bp, Homo sapiens
ccagaggggctgagcaggtcac

SEQ ID NO: 7616749 - DNA, 22 bp, Homo sapiens
ccagaggggctgagcaggtcac

SEQ ID NO: 7616750 - DNA, 22 bp, Homo sapiens
ccagaggggctgagcaggtcac

SEQ ID NO: 7616751 - DNA, 22 bp, Homo sapiens
ccagaggggctgagcaggtcac

SEQ ID NO: 7616752 - DNA, 22 bp, Homo sapiens
ccagaggggctgagcaggtcac

SEQ ID NO: 7616753 - DNA, 22 bp, Homo sapiens
ccagaggggctgagcaggtcac

SEQ ID NO: 7616754 - DNA, 22 bp, Homo sapiens
ccagaggggctgagcaggtcac

SEQ ID NO: 7616755 - DNA, 22 bp, Homo sapiens
ccagaggggctgagcaggtcac

SEQ ID NO: 7616756 - DNA, 22 bp, Homo sapiens
ccagaggggctgagcaggtcac

SEQ ID NO: 7616757 - DNA, 22 bp, Homo sapiens
ccagaggggctgagcaggtcac

SEQ ID NO: 7616758 - DNA, 22 bp, Homo sapiens
ccagagggccctggtctcagct

SEQ ID NO: 7616759 - DNA, 22 bp, Homo sapiens
ccagagggccctggtctcagct

SEQ ID NO: 7616760 - DNA, 22 bp, Homo sapiens
ccagagggccctggtctcagct

SEQ ID NO: 7616761 - DNA, 22 bp, Homo sapiens
ccagagggccctggtctcagct

SEQ ID NO: 7616762 - DNA, 22 bp, Homo sapiens
ccagagggcaaaatgaagctta

SEQ ID NO: 7616763 - DNA, 22 bp, Homo sapiens
ccagagggccctggtctcagct

SEQ ID NO: 7616764 - DNA, 22 bp, Homo sapiens
ccagagggccctggtctcagct

SEQ ID NO: 7616765 - DNA, 22 bp, Homo sapiens
ccagagggccctggtctcagct

SEQ ID NO: 7616766 - DNA, 22 bp, Homo sapiens
ccagagggcaaaatgaagctta

SEQ ID NO: 7616767 - DNA, 22 bp, Homo sapiens
ccagagggcaaaatgaagctta

SEQ ID NO: 7616768 - DNA, 22 bp, Homo sapiens
ccagagggcaaaatgaagctta

SEQ ID NO: 7616769 - DNA, 22 bp, Homo sapiens
ccagaggggcacaaaagtagaa

SEQ ID NO: 7616770 - DNA, 22 bp, Homo sapiens
ccagaggggcacaaaagtagaa

SEQ ID NO: 7616771 - DNA, 22 bp, Homo sapiens
ccagaggggcacaaaagtagaa

SEQ ID NO: 7616772 - DNA, 22 bp, Homo sapiens
ccagaggggcacaaaagtagaa

SEQ ID NO: 7616773 - DNA, 22 bp, Homo sapiens
ccagaggggcacaaaagtagaa

SEQ ID NO: 7616774 - DNA, 22 bp, Homo sapiens
ccagaggggcacaaaagtagaa

SEQ ID NO: 7616775 - DNA, 22 bp, Homo sapiens
ccagagggcctttggagttatc

SEQ ID NO: 7616776 - DNA, 22 bp, Homo sapiens
ccagagggcttggtttgggcca

SEQ ID NO: 7616777 - DNA, 22 bp, Homo sapiens
ccagagggcctttggagttatc

SEQ ID NO: 7616778 - DNA, 22 bp, Homo sapiens
ccagagggcttggtttgggcca

SEQ ID NO: 7616779 - DNA, 22 bp, Homo sapiens
ccagagggcttggtttgggcca

SEQ ID NO: 7616780 - DNA, 22 bp, Homo sapiens
ccagagggcctttggagttatc

SEQ ID NO: 7616781 - DNA, 22 bp, Homo sapiens
ccagagggcctttggagttatc

SEQ ID NO: 7616782 - DNA, 22 bp, Homo sapiens
ccagagggcctttggagttatc

SEQ ID NO: 7616783 - DNA, 22 bp, Homo sapiens
ccagagggcctttggagttatc

SEQ ID NO: 7616784 - DNA, 22 bp, Homo sapiens
cagtgtaagctctagactagaa

SEQ ID NO: 7616785 - DNA, 22 bp, Homo sapiens
cagtgtaagctctagactagaa

SEQ ID NO: 7616786 - DNA, 22 bp, Homo sapiens
cagtgtacttggaatgtaacag

SEQ ID NO: 7616787 - DNA, 22 bp, Homo sapiens
cagtgtacttggaatgtaacag

SEQ ID NO: 7616788 - DNA, 22 bp, Homo sapiens
cagtgtaagaattcaaagccta

SEQ ID NO: 7616789 - DNA, 22 bp, Homo sapiens
cagtgtaagctctagactagaa

SEQ ID NO: 7616790 - DNA, 22 bp, Homo sapiens
cagtgtaagctctagactagaa

SEQ ID NO: 7616791 - DNA, 22 bp, Homo sapiens
cagtgtatcattagtgtgatga

SEQ ID NO: 7616792 - DNA, 22 bp, Homo sapiens
cagtgtcaccaggcgagtctcc

SEQ ID NO: 7616793 - DNA, 22 bp, Homo sapiens
cagtgtcaccaggcgagtctcc

SEQ ID NO: 7616794 - DNA, 22 bp, Homo sapiens
cagtgtataaactttaacatag

SEQ ID NO: 7616795 - DNA, 22 bp, Homo sapiens
cagtggttttgagattcagggt

SEQ ID NO: 7616796 - DNA, 22 bp, Homo sapiens
cagtggttttcagctgggagtt

SEQ ID NO: 7616797 - DNA, 22 bp, Homo sapiens
cagtggttttgagattcagggt

SEQ ID NO: 7616798 - DNA, 22 bp, Homo sapiens
cagtggttttatatctaagctt

SEQ ID NO: 7616799 - DNA, 22 bp, Homo sapiens
cagtggttttatatctaagctt

SEQ ID NO: 7616800 - DNA, 22 bp, Homo sapiens
cagtggttttcagctgggagtt

SEQ ID NO: 7616801 - DNA, 22 bp, Homo sapiens
cagtggtttctgaacagtgtgc

SEQ ID NO: 7616802 - DNA, 22 bp, Homo sapiens
cagtggtttctgaacagtgtgc

SEQ ID NO: 7616803 - DNA, 22 bp, Homo sapiens
cagtggtttccaaacttgttcc

SEQ ID NO: 7616804 - DNA, 22 bp, Homo sapiens
cagtggtttccaaacttgttcc

SEQ ID NO: 7616805 - DNA, 22 bp, Homo sapiens
cagtggtttccaaacttgttcc

SEQ ID NO: 7616806 - DNA, 22 bp, Homo sapiens
cagtggtttctgaacagtgtgc

SEQ ID NO: 7616807 - DNA, 22 bp, Homo sapiens
cagtgtctacagtggctggagg

SEQ ID NO: 7616808 - DNA, 22 bp, Homo sapiens
cagtgtctcaaaacaagttgct

SEQ ID NO: 7616809 - DNA, 22 bp, Homo sapiens
cagtgtctcaaaacaagttgct

SEQ ID NO: 7616810 - DNA, 22 bp, Homo sapiens
cagtgtctcaaaacaagttgct

SEQ ID NO: 7616811 - DNA, 22 bp, Homo sapiens
cagtgtctcaaaacaagttgct

SEQ ID NO: 7616812 - DNA, 22 bp, Homo sapiens
cagtgtctcaaaacaagttgct

SEQ ID NO: 7616813 - DNA, 22 bp, Homo sapiens
tcactgtttcatccctagcact

SEQ ID NO: 7616814 - DNA, 22 bp, Homo sapiens
tcactgtttcctgtactggaca

SEQ ID NO: 7616815 - DNA, 22 bp, Homo sapiens
tcactgtttcatccctagcact

SEQ ID NO: 7616816 - DNA, 22 bp, Homo sapiens
cagtgtcctcagccagcagcta

SEQ ID NO: 7616817 - DNA, 22 bp, Homo sapiens
cagtgtctacagtggctggagg

SEQ ID NO: 7616818 - DNA, 22 bp, Homo sapiens
cagtgtcctcagccagcagcta

SEQ ID NO: 7616819 - DNA, 22 bp, Homo sapiens
cagtgtataaactttaacatag

SEQ ID NO: 7616820 - DNA, 22 bp, Homo sapiens
cagtgtcaggatcagtatattt

SEQ ID NO: 7616821 - DNA, 22 bp, Homo sapiens
cagtgtcaggatcagtatattt

SEQ ID NO: 7616822 - DNA, 22 bp, Homo sapiens
cagtgtcaggatcagtatattt

SEQ ID NO: 7616823 - DNA, 22 bp, Homo sapiens
cagtgtcaggatcagtatattt

SEQ ID NO: 7616824 - DNA, 22 bp, Homo sapiens
tcactgttttgcctgcacttcc

SEQ ID NO: 7616825 - DNA, 22 bp, Homo sapiens
tcacttaaaaattctagttatg

SEQ ID NO: 7616826 - DNA, 22 bp, Homo sapiens
tcacttagatggggatcatcac

SEQ ID NO: 7616827 - DNA, 22 bp, Homo sapiens
tcacttaaaaattctagttatg

SEQ ID NO: 7616828 - DNA, 22 bp, Homo sapiens
tcactgttttgcctgcacttcc

SEQ ID NO: 7616829 - DNA, 22 bp, Homo sapiens
tcactgtttcctgtactggaca

SEQ ID NO: 7616830 - DNA, 22 bp, Homo sapiens
tcacttagatggggatcatcac

SEQ ID NO: 7616831 - DNA, 22 bp, Homo sapiens
tcacttagatggggatcatcac

SEQ ID NO: 7616832 - DNA, 22 bp, Homo sapiens
tcacttagatggggatcatcac

SEQ ID NO: 7616833 - DNA, 21 bp, Homo sapiens
tcacttataatgtatttgctg

SEQ ID NO: 7616834 - DNA, 22 bp, Homo sapiens
tcacttataaaatgcaagatct

SEQ ID NO: 7616835 - DNA, 22 bp, Homo sapiens
tcacttataaaatgcaagatct

SEQ ID NO: 7616836 - DNA, 22 bp, Homo sapiens
tcacttcacacccactatcatg

SEQ ID NO: 7616837 - DNA, 22 bp, Homo sapiens
tcacttcacacccactatcatg

SEQ ID NO: 7616838 - DNA, 22 bp, Homo sapiens
tcacttcacacccactatcatg

SEQ ID NO: 7616839 - DNA, 22 bp, Homo sapiens
tcacttattttctaaccaaagg

SEQ ID NO: 7616840 - DNA, 22 bp, Homo sapiens
tcacttcccagacggggtggca

SEQ ID NO: 7616841 - DNA, 22 bp, Homo sapiens
tcacttcccagacggggtggca

SEQ ID NO: 7616842 - DNA, 22 bp, Homo sapiens
tcaggaagttttgaatcaactg

SEQ ID NO: 7616843 - DNA, 22 bp, Homo sapiens
tcaggaagttttgaatcaactg

SEQ ID NO: 7616844 - DNA, 22 bp, Homo sapiens
tcaggaagttttgaatcaactg

SEQ ID NO: 7616845 - DNA, 22 bp, Homo sapiens
tcaggaagttttgaatcaactg

SEQ ID NO: 7616846 - DNA, 22 bp, Homo sapiens
tcacttattgctcatctcatgc

SEQ ID NO: 7616847 - DNA, 22 bp, Homo sapiens
tcacttattgctcatctcatgc

SEQ ID NO: 7616848 - DNA, 22 bp, Homo sapiens
tcacttattaactcataccatt

SEQ ID NO: 7616849 - DNA, 20 bp, Homo sapiens
tcacttattctcaacttgtg

SEQ ID NO: 7616850 - DNA, 22 bp, Homo sapiens
tcacttattaactcataccatt

SEQ ID NO: 7616851 - DNA, 22 bp, Homo sapiens
tcacttatgtgtgattgatgcc

SEQ ID NO: 7616852 - DNA, 22 bp, Homo sapiens
tcacttatgccagctctggaag

SEQ ID NO: 7616853 - DNA, 22 bp, Homo sapiens
tcaggaggcctgagtagctcta

SEQ ID NO: 7616854 - DNA, 22 bp, Homo sapiens
tcaggaggccgtgtgctcagtg

SEQ ID NO: 7616855 - DNA, 22 bp, Homo sapiens
tcaggaggccgtgtgctcagtg

SEQ ID NO: 7616856 - DNA, 22 bp, Homo sapiens
tcaggaggccgtgtgctcagtg

SEQ ID NO: 7616857 - DNA, 22 bp, Homo sapiens
tcaggaggcctgagtagctcta

SEQ ID NO: 7616858 - DNA, 22 bp, Homo sapiens
tcaggaggcctgagtagctcta

SEQ ID NO: 7616859 - DNA, 22 bp, Homo sapiens
tcaggaggcctgagtagctcta

SEQ ID NO: 7616860 - DNA, 22 bp, Homo sapiens
tcaggaggcctgagtagctcta

SEQ ID NO: 7616861 - DNA, 22 bp, Homo sapiens
tcaggaggcggtgctgcctttg

SEQ ID NO: 7616862 - DNA, 22 bp, Homo sapiens
tcaggaggcggtgctgcctttg

SEQ ID NO: 7616863 - DNA, 22 bp, Homo sapiens
tcaggaggcggtgctgcctttg

SEQ ID NO: 7616864 - DNA, 22 bp, Homo sapiens
tcaggaggcggtgctgcctttg

SEQ ID NO: 7616865 - DNA, 22 bp, Homo sapiens
tcaggaggcggaggttgcagtg

SEQ ID NO: 7616866 - DNA, 22 bp, Homo sapiens
tcaggaggcggaggttgcagtg

SEQ ID NO: 7616867 - DNA, 22 bp, Homo sapiens
tcaggaggcggaggttgcagtg

SEQ ID NO: 7616868 - DNA, 22 bp, Homo sapiens
tcaggaggcggaggttgcagtg

SEQ ID NO: 7616869 - DNA, 22 bp, Homo sapiens
tcaggaggcctgagtagctcta

SEQ ID NO: 7616870 - DNA, 22 bp, Homo sapiens
tcaggaggcggaggttgcagtg

SEQ ID NO: 7616871 - DNA, 22 bp, Homo sapiens
tcaggaggcggaggttgcagtg

SEQ ID NO: 7616872 - DNA, 22 bp, Homo sapiens
tcaggaggccaccaggacctgt

SEQ ID NO: 7616873 - DNA, 22 bp, Homo sapiens
tcaggaggccaccaggacctgt

SEQ ID NO: 7616874 - DNA, 22 bp, Homo sapiens
tcaggaatgaggataaacattg

SEQ ID NO: 7616875 - DNA, 22 bp, Homo sapiens
tcaggaatgaggataaacattg

SEQ ID NO: 7616876 - DNA, 22 bp, Homo sapiens
tcaggaggccaccaggacctgt

SEQ ID NO: 7616877 - DNA, 22 bp, Homo sapiens
tcaggaggccaccaggacctgt

SEQ ID NO: 7616878 - DNA, 22 bp, Homo sapiens
tcaggaggccaccaggacctgt

SEQ ID NO: 7616879 - DNA, 22 bp, Homo sapiens
tcaggaggccaccaggacctgt

SEQ ID NO: 7616880 - DNA, 22 bp, Homo sapiens
tcaggaggccaccaggacctgt

SEQ ID NO: 7616881 - DNA, 22 bp, Homo sapiens
tcaggaggccgtgtgctcagtg

SEQ ID NO: 7616882 - DNA, 22 bp, Homo sapiens
tcaggaggccgtgtgctcagtg

SEQ ID NO: 7616883 - DNA, 22 bp, Homo sapiens
tcaggaggccgtgtgctcagtg

SEQ ID NO: 7616884 - DNA, 22 bp, Homo sapiens
tcaggaggccgtgtgctcagtg

SEQ ID NO: 7616885 - DNA, 22 bp, Homo sapiens
tcaggaggccgtgtgctcagtg

SEQ ID NO: 7616886 - DNA, 22 bp, Homo sapiens
tcaggaggccgtgtgctcagtg

SEQ ID NO: 7616887 - DNA, 22 bp, Homo sapiens
tcaggaggccggcaggatttga

SEQ ID NO: 7616888 - DNA, 22 bp, Homo sapiens
tcaggaggccggcaggatttga

SEQ ID NO: 7616889 - DNA, 22 bp, Homo sapiens
tcaggaggccggcaggatttga

SEQ ID NO: 7616890 - DNA, 22 bp, Homo sapiens
tcaggaggccggcaggatttga

SEQ ID NO: 7616891 - DNA, 22 bp, Homo sapiens
tcaggcagaattatcaaaagat

SEQ ID NO: 7616892 - DNA, 22 bp, Homo sapiens
tcaggcagaaaaatcactaatt

SEQ ID NO: 7616893 - DNA, 22 bp, Homo sapiens
tcaggcagaattatcaaaagat

SEQ ID NO: 7616894 - DNA, 22 bp, Homo sapiens
tcaggcagaattatcaaaagat

SEQ ID NO: 7616895 - DNA, 22 bp, Homo sapiens
tcaggcagaattatcaaaagat

SEQ ID NO: 7616896 - DNA, 22 bp, Homo sapiens
tcaggcagaattatcaaaagat

SEQ ID NO: 7616897 - DNA, 21 bp, Homo sapiens
tcaggaggctcagactcctgc

SEQ ID NO: 7616898 - DNA, 21 bp, Homo sapiens
tcaggaggctcagactcctgc

SEQ ID NO: 7616899 - DNA, 21 bp, Homo sapiens
tcaggaggctcagactcctgc

SEQ ID NO: 7616900 - DNA, 21 bp, Homo sapiens
tcaggaggctcagactcctgc

SEQ ID NO: 7616901 - DNA, 22 bp, Homo sapiens
tcaggagggagtgtggatagag

SEQ ID NO: 7616902 - DNA, 21 bp, Homo sapiens
tcaggaggctcagactcctgc

SEQ ID NO: 7616903 - DNA, 22 bp, Homo sapiens
tcaggagggagtgtggatagag

SEQ ID NO: 7616904 - DNA, 22 bp, Homo sapiens
tcaggagggagtgtggatagag

SEQ ID NO: 7616905 - DNA, 22 bp, Homo sapiens
tcaggagggagtgtggatagag

SEQ ID NO: 7616906 - DNA, 22 bp, Homo sapiens
tcaggagggagtgtggatagag

SEQ ID NO: 7616907 - DNA, 22 bp, Homo sapiens
tcaggcagaaaaatcactaatt

SEQ ID NO: 7616908 - DNA, 22 bp, Homo sapiens
tcaggagggagtgtggatagag

SEQ ID NO: 7616909 - DNA, 22 bp, Homo sapiens
tcaggcagaaaaatcactaatt

SEQ ID NO: 7616910 - DNA, 22 bp, Homo sapiens
tcaggaggcgtctcgctggggc

SEQ ID NO: 7616911 - DNA, 22 bp, Homo sapiens
tcaggaggcggaggttgcagtg

SEQ ID NO: 7616912 - DNA, 22 bp, Homo sapiens
tcaggaggcgtctcgctggggc

SEQ ID NO: 7616913 - DNA, 22 bp, Homo sapiens
tcaggaggcgtctcgctggggc

SEQ ID NO: 7616914 - DNA, 22 bp, Homo sapiens
tcaggaggcggtgctgcctttg

SEQ ID NO: 7616915 - DNA, 22 bp, Homo sapiens
tcaggaggcgtctcgctggggc

SEQ ID NO: 7616916 - DNA, 22 bp, Homo sapiens
tcaggaggcggtgctgcctttg

SEQ ID NO: 7616917 - DNA, 22 bp, Homo sapiens
tcaggaggcgtctcgctggggc

SEQ ID NO: 7616918 - DNA, 22 bp, Homo sapiens
tcaggaggcgtctcgctggggc

SEQ ID NO: 7616919 - DNA, 22 bp, Homo sapiens
tcaggaggcgtctcgctggggc

SEQ ID NO: 7616920 - DNA, 22 bp, Homo sapiens
tcaggaggcgtctcgctggggc

SEQ ID NO: 7616921 - DNA, 22 bp, Homo sapiens
tcaggaggcgtctcgctggggc

SEQ ID NO: 7616922 - DNA, 22 bp, Homo sapiens
tcaggaggcgtctcgctggggc

SEQ ID NO: 7616923 - DNA, 22 bp, Homo sapiens
tcaggaggctcaagacctggca

SEQ ID NO: 7616924 - DNA, 22 bp, Homo sapiens
tcaggaggcgtgctggggtaca

SEQ ID NO: 7616925 - DNA, 22 bp, Homo sapiens
tcaggaggcgtgctggggtaca

SEQ ID NO: 7616926 - DNA, 22 bp, Homo sapiens
tcaggaggcgtgctggggtaca

SEQ ID NO: 7616927 - DNA, 22 bp, Homo sapiens
tcaggaggcgtgctggggtaca

SEQ ID NO: 7616928 - DNA, 22 bp, Homo sapiens
tcaggaggcgtgctggggtaca

SEQ ID NO: 7616929 - DNA, 22 bp, Homo sapiens
tcaggaggctcaagacctggca

SEQ ID NO: 7616930 - DNA, 22 bp, Homo sapiens
tcaggaggctcaagacctggca

SEQ ID NO: 7616931 - DNA, 22 bp, Homo sapiens
tcaggaggctcaagacctggca

SEQ ID NO: 7616932 - DNA, 22 bp, Homo sapiens
tcaggaggctcaagacctggca

SEQ ID NO: 7616933 - DNA, 22 bp, Homo sapiens
tcaggaggctcaagacctggca

SEQ ID NO: 7616934 - DNA, 22 bp, Homo sapiens
tcaggaggctcaagacctggca

SEQ ID NO: 7616935 - DNA, 22 bp, Homo sapiens
catcaaatgccatatatggttg

SEQ ID NO: 7616936 - DNA, 22 bp, Homo sapiens
catcaaattatgtgtcaaagca

SEQ ID NO: 7616937 - DNA, 22 bp, Homo sapiens
catcaaattatgtgtcaaagca

SEQ ID NO: 7616938 - DNA, 22 bp, Homo sapiens
catcaaatggcaagtgaaagct

SEQ ID NO: 7616939 - DNA, 22 bp, Homo sapiens
catcaaatggcaagtgaaagct

SEQ ID NO: 7616940 - DNA, 22 bp, Homo sapiens
catcaaatggcaagtgaaagct

SEQ ID NO: 7616941 - DNA, 22 bp, Homo sapiens
catcaaatctgacttttcttcc

SEQ ID NO: 7616942 - DNA, 22 bp, Homo sapiens
catcaaatactacatgggttgg

SEQ ID NO: 7616943 - DNA, 22 bp, Homo sapiens
catcaaataggaatatttggca

SEQ ID NO: 7616944 - DNA, 22 bp, Homo sapiens
catcaaataaagaaattccttg

SEQ ID NO: 7616945 - DNA, 22 bp, Homo sapiens
catcaaataaagaaattccttg

SEQ ID NO: 7616946 - DNA, 22 bp, Homo sapiens
catcaaagttgatatccaatta

SEQ ID NO: 7616947 - DNA, 21 bp, Homo sapiens
catattaaatcggtgccttta

SEQ ID NO: 7616948 - DNA, 21 bp, Homo sapiens
catattaaatcggtgccttta

SEQ ID NO: 7616949 - DNA, 22 bp, Homo sapiens
catatgttgacatttaaacctc

SEQ ID NO: 7616950 - DNA, 19 bp, Homo sapiens
catatttttgggctggcat

SEQ ID NO: 7616951 - DNA, 21 bp, Homo sapiens
catattaaatcggtgccttta

SEQ ID NO: 7616952 - DNA, 19 bp, Homo sapiens
catatttttgggctggcat

SEQ ID NO: 7616953 - DNA, 19 bp, Homo sapiens
catatttttgggctggcat

SEQ ID NO: 7616954 - DNA, 22 bp, Homo sapiens
catcaaaattagacattgttga

SEQ ID NO: 7616955 - DNA, 22 bp, Homo sapiens
catcaaaattagacattgttga

SEQ ID NO: 7616956 - DNA, 22 bp, Homo sapiens
catcaaaattagacattgttga

SEQ ID NO: 7616957 - DNA, 22 bp, Homo sapiens
catcaaagcttttttctgtgtt

SEQ ID NO: 7616958 - DNA, 22 bp, Homo sapiens
catcaaagggcctgtggtgcag

SEQ ID NO: 7616959 - DNA, 22 bp, Homo sapiens
catcaaagggcctgtggtgcag

SEQ ID NO: 7616960 - DNA, 22 bp, Homo sapiens
catcaaagttgatatccaatta

SEQ ID NO: 7616961 - DNA, 22 bp, Homo sapiens
catcaaaattagacattgttga

SEQ ID NO: 7616962 - DNA, 22 bp, Homo sapiens
catcaaacaaatgcttttagat

SEQ ID NO: 7616963 - DNA, 17 bp, Homo sapiens
catcaaagaaatttcca

SEQ ID NO: 7616964 - DNA, 22 bp, Homo sapiens
catcaaaattagacattgttga

SEQ ID NO: 7616965 - DNA, 22 bp, Homo sapiens
catcaaaattagacattgttga

SEQ ID NO: 7616966 - DNA, 22 bp, Homo sapiens
catcaaaattagacattgttga

SEQ ID NO: 7616967 - DNA, 22 bp, Homo sapiens
tcaggcagagggagaagccaag

SEQ ID NO: 7616968 - DNA, 22 bp, Homo sapiens
tcaggcagagggagaagccaag

SEQ ID NO: 7616969 - DNA, 22 bp, Homo sapiens
tcaggcagagggagaagccaag

SEQ ID NO: 7616970 - DNA, 22 bp, Homo sapiens
tcaggcagagtggaagctgcaa

SEQ ID NO: 7616971 - DNA, 22 bp, Homo sapiens
tcaggcagaggatggggagcgt

SEQ ID NO: 7616972 - DNA, 22 bp, Homo sapiens
tcaggcagagggagaagccaag

SEQ ID NO: 7616973 - DNA, 22 bp, Homo sapiens
tcaggcagagggagaagccaag

SEQ ID NO: 7616974 - DNA, 22 bp, Homo sapiens
tcaggcagagggagaagccaag

SEQ ID NO: 7616975 - DNA, 22 bp, Homo sapiens
tcaggcagagggagaagccaag

SEQ ID NO: 7616976 - DNA, 22 bp, Homo sapiens
tcaggcagagggagaagccaag

SEQ ID NO: 7616977 - DNA, 22 bp, Homo sapiens
tcaggcagaggatggggagcgt

SEQ ID NO: 7616978 - DNA, 22 bp, Homo sapiens
tcaggcagaggatggggagcgt

SEQ ID NO: 7616979 - DNA, 22 bp, Homo sapiens
tcaggcagaggatggggagcgt

SEQ ID NO: 7616980 - DNA, 22 bp, Homo sapiens
tcaggcagaggatggggagcgt

SEQ ID NO: 7616981 - DNA, 22 bp, Homo sapiens
tcaggcagaggatggggagcgt

SEQ ID NO: 7616982 - DNA, 22 bp, Homo sapiens
tcaggcagagggagaagccaag

SEQ ID NO: 7616983 - DNA, 22 bp, Homo sapiens
tcaggcagagggagaagccaag

SEQ ID NO: 7616984 - DNA, 22 bp, Homo sapiens
tcaggcagaccaccgtgggcag

SEQ ID NO: 7616985 - DNA, 22 bp, Homo sapiens
tcaggcagaccaccgtgggcag

SEQ ID NO: 7616986 - DNA, 22 bp, Homo sapiens
tcaggcagaccaccgtgggcag

SEQ ID NO: 7616987 - DNA, 22 bp, Homo sapiens
tcaggcagaccaccgtgggcag

SEQ ID NO: 7616988 - DNA, 22 bp, Homo sapiens
tcaggcagaccaccgtgggcag

SEQ ID NO: 7616989 - DNA, 22 bp, Homo sapiens
tcaggcagaccaccgtgggcag

SEQ ID NO: 7616990 - DNA, 22 bp, Homo sapiens
tcaggcagaccaccgtgggcag

SEQ ID NO: 7616991 - DNA, 22 bp, Homo sapiens
tcaggcagaccaccgtgggcag

SEQ ID NO: 7616992 - DNA, 22 bp, Homo sapiens
tcaggcagaattatcaaaagat

SEQ ID NO: 7616993 - DNA, 22 bp, Homo sapiens
tcaggcagaccaccgtgggcag

SEQ ID NO: 7616994 - DNA, 22 bp, Homo sapiens
tcaggcagaccaccgtgggcag

SEQ ID NO: 7616995 - DNA, 22 bp, Homo sapiens
tcaggcagagctgtggagctct

SEQ ID NO: 7616996 - DNA, 22 bp, Homo sapiens
tcaggcagagctgtggagctct

SEQ ID NO: 7616997 - DNA, 22 bp, Homo sapiens
tcaggcagagctgtggagctct

SEQ ID NO: 7616998 - DNA, 22 bp, Homo sapiens
tcaggcagagctgtggagctct

SEQ ID NO: 7616999 - DNA, 22 bp, Homo sapiens
tcaggcagagctgtggagctct

SEQ ID NO: 7617000 - DNA, 22 bp, Homo sapiens
tcaggcagagctgtggagctct

SEQ ID NO: 7617001 - DNA, 22 bp, Homo sapiens
tcaggcagagctgtggagctct

SEQ ID NO: 7617002 - DNA, 22 bp, Homo sapiens
tcaggcagagctgtggagctct

SEQ ID NO: 7617003 - DNA, 22 bp, Homo sapiens
tcaggcagagctgtggagctct

SEQ ID NO: 7617004 - DNA, 22 bp, Homo sapiens
catcaatgtgcagagatgaacg

SEQ ID NO: 7617005 - DNA, 22 bp, Homo sapiens
catcaatagggtttgaaagcaa

SEQ ID NO: 7617006 - DNA, 22 bp, Homo sapiens
catcaatagggtttgaaagcaa

SEQ ID NO: 7617007 - DNA, 22 bp, Homo sapiens
catcaatagggtttgaaagcaa

SEQ ID NO: 7617008 - DNA, 22 bp, Homo sapiens
catcaagtcatcaaagaattca

SEQ ID NO: 7617009 - DNA, 23 bp, Homo sapiens
catcaagtacttttgacaagtgt

SEQ ID NO: 7617010 - DNA, 23 bp, Homo sapiens
catcaagtacttttgacaagtgt

SEQ ID NO: 7617011 - DNA, 20 bp, Homo sapiens
catcaacaccttgtcagcct

SEQ ID NO: 7617012 - DNA, 20 bp, Homo sapiens
catcaacaccttgtcagcct

SEQ ID NO: 7617013 - DNA, 20 bp, Homo sapiens
catcaacaccttgtcagcct

SEQ ID NO: 7617014 - DNA, 22 bp, Homo sapiens
catcaacagtgtcagatgatgc

SEQ ID NO: 7617015 - DNA, 22 bp, Homo sapiens
catcaacagtgtcagatgatgc

SEQ ID NO: 7617016 - DNA, 22 bp, Homo sapiens
catcaacagtgtcagatgatgc

SEQ ID NO: 7617017 - DNA, 21 bp, Homo sapiens
catcaactcttgtgctcacac

SEQ ID NO: 7617018 - DNA, 22 bp, Homo sapiens
catcaagagtcttactatcagt

SEQ ID NO: 7617019 - DNA, 22 bp, Homo sapiens
catcaagagtcttactatcagt

SEQ ID NO: 7617020 - DNA, 22 bp, Homo sapiens
catcaagagtcttactatcagt

SEQ ID NO: 7617021 - DNA, 22 bp, Homo sapiens
tcaggctgcagctgtcagcagc

SEQ ID NO: 7617022 - DNA, 22 bp, Homo sapiens
tcaggctgatttcttttgaggg

SEQ ID NO: 7617023 - DNA, 22 bp, Homo sapiens
tcaggctgatttcttttgaggg

SEQ ID NO: 7617024 - DNA, 22 bp, Homo sapiens
tcaggctgatttcttttgaggg

SEQ ID NO: 7617025 - DNA, 22 bp, Homo sapiens
catcacaaatgtaataatgtct

SEQ ID NO: 7617026 - DNA, 22 bp, Homo sapiens
catcacaaatgtaataatgtct

SEQ ID NO: 7617027 - DNA, 22 bp, Homo sapiens
catcaattggccaaggagcagt

SEQ ID NO: 7617028 - DNA, 22 bp, Homo sapiens
catcaattggccaaggagcagt

SEQ ID NO: 7617029 - DNA, 22 bp, Homo sapiens
tcaggctgcagtggcaaaagac

SEQ ID NO: 7617030 - DNA, 22 bp, Homo sapiens
tcaggctgcagtggcaaaagac

SEQ ID NO: 7617031 - DNA, 22 bp, Homo sapiens
tcaggctgcagtggcaaaagac

SEQ ID NO: 7617032 - DNA, 22 bp, Homo sapiens
tcaggctgcagctgtcagcagc

SEQ ID NO: 7617033 - DNA, 22 bp, Homo sapiens
tcaggctgcagctgtcagcagc

SEQ ID NO: 7617034 - DNA, 22 bp, Homo sapiens
tcaggctgcagctgtcagcagc

SEQ ID NO: 7617035 - DNA, 22 bp, Homo sapiens
tcaggctgcagctgtcagcagc

SEQ ID NO: 7617036 - DNA, 22 bp, Homo sapiens
tcaggctgcagctgtcagcagc

SEQ ID NO: 7617037 - DNA, 22 bp, Homo sapiens
tcaggctgcctatcagactgtg

SEQ ID NO: 7617038 - DNA, 18 bp, Homo sapiens
tcaggctgccctgtgtct

SEQ ID NO: 7617039 - DNA, 18 bp, Homo sapiens
tcaggctgccctgtgtct

SEQ ID NO: 7617040 - DNA, 22 bp, Homo sapiens
tcaggctgcctatcagactgtg

SEQ ID NO: 7617041 - DNA, 22 bp, Homo sapiens
tcaggctgcctatcagactgtg

SEQ ID NO: 7617042 - DNA, 22 bp, Homo sapiens
tcaggctgcctatcagactgtg

SEQ ID NO: 7617043 - DNA, 22 bp, Homo sapiens
catcacatttaaggggaaggac

SEQ ID NO: 7617044 - DNA, 22 bp, Homo sapiens
catcagagtcagagctctttct

SEQ ID NO: 7617045 - DNA, 22 bp, Homo sapiens
catcagagtggtggcctggtgt

SEQ ID NO: 7617046 - DNA, 22 bp, Homo sapiens
catcagagtggtggcctggtgt

SEQ ID NO: 7617047 - DNA, 22 bp, Homo sapiens
catcacattagtctcaagagaa

SEQ ID NO: 7617048 - DNA, 22 bp, Homo sapiens
catcacattagtctcaagagaa

SEQ ID NO: 7617049 - DNA, 22 bp, Homo sapiens
catcacattagtctcaagagaa

SEQ ID NO: 7617050 - DNA, 21 bp, Homo sapiens
catcacattactcaaagtcct

SEQ ID NO: 7617051 - DNA, 22 bp, Homo sapiens
tcaggctgcctatcagactgtg

SEQ ID NO: 7617052 - DNA, 22 bp, Homo sapiens
tcaggctgcctatcagactgtg

SEQ ID NO: 7617053 - DNA, 21 bp, Homo sapiens
catcacattactcaaagtcct

SEQ ID NO: 7617054 - DNA, 22 bp, Homo sapiens
tcaggctgcatctgtaagggtg

SEQ ID NO: 7617055 - DNA, 22 bp, Homo sapiens
tcaggctgcatctgtaagggtg

SEQ ID NO: 7617056 - DNA, 22 bp, Homo sapiens
tcaggctgcagtggcaaaagac

SEQ ID NO: 7617057 - DNA, 22 bp, Homo sapiens
tcaggctgcatctgtaagggtg

SEQ ID NO: 7617058 - DNA, 22 bp, Homo sapiens
tcaggctgcatctgtaagggtg

SEQ ID NO: 7617059 - DNA, 22 bp, Homo sapiens
tcaggctgcccgttcagggctc

SEQ ID NO: 7617060 - DNA, 22 bp, Homo sapiens
tcaggctgcatctgtaagggtg

SEQ ID NO: 7617061 - DNA, 22 bp, Homo sapiens
tcaggctgcatctgtaagggtg

SEQ ID NO: 7617062 - DNA, 22 bp, Homo sapiens
tcaggctgcatctgtaagggtg

SEQ ID NO: 7617063 - DNA, 22 bp, Homo sapiens
tcaggctgcatctgtaagggtg

SEQ ID NO: 7617064 - DNA, 18 bp, Homo sapiens
tcaggctgccctgtgtct

SEQ ID NO: 7617065 - DNA, 22 bp, Homo sapiens
tcaggctgcccgttcagggctc

SEQ ID NO: 7617066 - DNA, 18 bp, Homo sapiens
tcaggctgccctgtgtct

SEQ ID NO: 7617067 - DNA, 22 bp, Homo sapiens
tcaggctgcccgttcagggctc

SEQ ID NO: 7617068 - DNA, 22 bp, Homo sapiens
tcaggctgcccgttcagggctc

SEQ ID NO: 7617069 - DNA, 22 bp, Homo sapiens
tcaggctgcccgttcagggctc

SEQ ID NO: 7617070 - DNA, 22 bp, Homo sapiens
tcaggctgcccgttcagggctc

SEQ ID NO: 7617071 - DNA, 22 bp, Homo sapiens
tcaggctgcccgttcagggctc

SEQ ID NO: 7617072 - DNA, 22 bp, Homo sapiens
tcaggctgcccgttcagggctc

SEQ ID NO: 7617073 - DNA, 22 bp, Homo sapiens
tcagtttcattatccataaaat

SEQ ID NO: 7617074 - DNA, 22 bp, Homo sapiens
tcagtttcctcatctacaaaag

SEQ ID NO: 7617075 - DNA, 22 bp, Homo sapiens
tcagtttcacagtctgtgcaga

SEQ ID NO: 7617076 - DNA, 22 bp, Homo sapiens
tcagtttcctggttgtgatatt

SEQ ID NO: 7617077 - DNA, 22 bp, Homo sapiens
tcagtttcctggttgtgatatt

SEQ ID NO: 7617078 - DNA, 22 bp, Homo sapiens
tcagtttcctggttttaatatt

SEQ ID NO: 7617079 - DNA, 19 bp, Homo sapiens
tcataaggagagaggaaat

SEQ ID NO: 7617080 - DNA, 19 bp, Homo sapiens
tcataaggagagaggaaat

SEQ ID NO: 7617081 - DNA, 22 bp, Homo sapiens
tcataagattgaaacttggaag

SEQ ID NO: 7617082 - DNA, 22 bp, Homo sapiens
tcataagctagctgcaccatat

SEQ ID NO: 7617083 - DNA, 22 bp, Homo sapiens
tcataacaggctgagaggattt

SEQ ID NO: 7617084 - DNA, 22 bp, Homo sapiens
tcataacaggctgagaggattt

SEQ ID NO: 7617085 - DNA, 22 bp, Homo sapiens
tcataacaacctggaaggccag

SEQ ID NO: 7617086 - DNA, 22 bp, Homo sapiens
tcataacactggtgattaagaa

SEQ ID NO: 7617087 - DNA, 22 bp, Homo sapiens
tcataacactggtgattaagaa

SEQ ID NO: 7617088 - DNA, 22 bp, Homo sapiens
tcataacaacctggaaggccag

SEQ ID NO: 7617089 - DNA, 22 bp, Homo sapiens
catctaccagaattgctataaa

SEQ ID NO: 7617090 - DNA, 22 bp, Homo sapiens
catctacctccaccctatatat

SEQ ID NO: 7617091 - DNA, 22 bp, Homo sapiens
catctacctccaccctatatat

SEQ ID NO: 7617092 - DNA, 22 bp, Homo sapiens
catctactttaaggattctggg

SEQ ID NO: 7617093 - DNA, 22 bp, Homo sapiens
catctacatgcttgccactgct

SEQ ID NO: 7617094 - DNA, 22 bp, Homo sapiens
catctagaaaaaagacctgttg

SEQ ID NO: 7617095 - DNA, 22 bp, Homo sapiens
catctaccagaattgctataaa

SEQ ID NO: 7617096 - DNA, 22 bp, Homo sapiens
catctagaaaaaagacctgttg

SEQ ID NO: 7617097 - DNA, 23 bp, Homo sapiens
catctagcatccagtgagtagtg

SEQ ID NO: 7617098 - DNA, 23 bp, Homo sapiens
catctagcatccagtgagtagtg

SEQ ID NO: 7617099 - DNA, 19 bp, Homo sapiens
catctatcctcattctctg

SEQ ID NO: 7617100 - DNA, 22 bp, Homo sapiens
catctacactgattaggtgaac

SEQ ID NO: 7617101 - DNA, 22 bp, Homo sapiens
catctacaggagaatgtcactg

SEQ ID NO: 7617102 - DNA, 22 bp, Homo sapiens
catctacaggagaatgtcactg

SEQ ID NO: 7617103 - DNA, 22 bp, Homo sapiens
catctacaggagaatgtcactg

SEQ ID NO: 7617104 - DNA, 22 bp, Homo sapiens
catctacaggagaatgtcactg

SEQ ID NO: 7617105 - DNA, 22 bp, Homo sapiens
catctacatgcttgccactgct

SEQ ID NO: 7617106 - DNA, 18 bp, Homo sapiens
catctacaaatgccagaa

SEQ ID NO: 7617107 - DNA, 18 bp, Homo sapiens
catctacaaatgccagaa

SEQ ID NO: 7617108 - DNA, 22 bp, Homo sapiens
catctacactgattaggtgaac

SEQ ID NO: 7617109 - DNA, 22 bp, Homo sapiens
catctaaatttgactccaagga

SEQ ID NO: 7617110 - DNA, 22 bp, Homo sapiens
catctaaatttgactccaagga

SEQ ID NO: 7617111 - DNA, 22 bp, Homo sapiens
catctaaccagtcgtttttgga

SEQ ID NO: 7617112 - DNA, 22 bp, Homo sapiens
catcgccctggggtcctgcctt

SEQ ID NO: 7617113 - DNA, 22 bp, Homo sapiens
catccttctcaaagagtgcatg

SEQ ID NO: 7617114 - DNA, 22 bp, Homo sapiens
catcgtgtctaggtgtgcagca

SEQ ID NO: 7617115 - DNA, 22 bp, Homo sapiens
catctaaatttgactccaagga

SEQ ID NO: 7617116 - DNA, 18 bp, Homo sapiens
catccttatagctgagaa

SEQ ID NO: 7617117 - DNA, 22 bp, Homo sapiens
catccttcaaaggctacaatta

SEQ ID NO: 7617118 - DNA, 22 bp, Homo sapiens
catccttcaaaggctacaatta

SEQ ID NO: 7617119 - DNA, 22 bp, Homo sapiens
catccttcatacgactgaccct

SEQ ID NO: 7617120 - DNA, 22 bp, Homo sapiens
catcctgagaaaataaaggaga

SEQ ID NO: 7617121 - DNA, 22 bp, Homo sapiens
catcctgagaaaataaaggaga

SEQ ID NO: 7617122 - DNA, 22 bp, Homo sapiens
catcctgactgtaactaagaga

SEQ ID NO: 7617123 - DNA, 22 bp, Homo sapiens
catcctgactgtaactaagaga

SEQ ID NO: 7617124 - DNA, 22 bp, Homo sapiens
catcctgactgggtaaagctta

SEQ ID NO: 7617125 - DNA, 22 bp, Homo sapiens
catcctgacccatgggagggga

SEQ ID NO: 7617126 - DNA, 22 bp, Homo sapiens
catcctgagaggtctctctacc

SEQ ID NO: 7617127 - DNA, 22 bp, Homo sapiens
catcctgcggggagcagagggc

SEQ ID NO: 7617128 - DNA, 22 bp, Homo sapiens
catcctgcggggagcagagggc

SEQ ID NO: 7617129 - DNA, 22 bp, Homo sapiens
catcctgcggggagcagagggc

SEQ ID NO: 7617130 - DNA, 22 bp, Homo sapiens
tcagtgtgtagtaaattgtagg

SEQ ID NO: 7617131 - DNA, 19 bp, Homo sapiens
tcagtgtgtgggaggtggt

SEQ ID NO: 7617132 - DNA, 22 bp, Homo sapiens
tcagtgtgtctctgcatttggg

SEQ ID NO: 7617133 - DNA, 19 bp, Homo sapiens
tcagtgtgtgggaggtggt

SEQ ID NO: 7617134 - DNA, 22 bp, Homo sapiens
catccctgtctgccactctgaa

SEQ ID NO: 7617135 - DNA, 22 bp, Homo sapiens
catccctgtctgccactctgaa

SEQ ID NO: 7617136 - DNA, 19 bp, Homo sapiens
tcagtgtgtgggaggtggt

SEQ ID NO: 7617137 - DNA, 22 bp, Homo sapiens
catcctgacaagaaagccagaa

SEQ ID NO: 7617138 - DNA, 22 bp, Homo sapiens
catcctgacccatgggagggga

SEQ ID NO: 7617139 - DNA, 22 bp, Homo sapiens
catcctgaagaagccgcactgt

SEQ ID NO: 7617140 - DNA, 19 bp, Homo sapiens
tcagtgtgtgggaggtggt

SEQ ID NO: 7617141 - DNA, 22 bp, Homo sapiens
catcccttcccccgagcatggc

SEQ ID NO: 7617142 - DNA, 22 bp, Homo sapiens
catccgcatgcaagtgctgtcc

SEQ ID NO: 7617143 - DNA, 22 bp, Homo sapiens
catccgcatgcaagtgctgtcc

SEQ ID NO: 7617144 - DNA, 22 bp, Homo sapiens
catccgcatgcaagtgctgtcc

SEQ ID NO: 7617145 - DNA, 17 bp, Homo sapiens
catccgtgagctcggca

SEQ ID NO: 7617146 - DNA, 22 bp, Homo sapiens
tcatcactgtatcattgataga

SEQ ID NO: 7617147 - DNA, 22 bp, Homo sapiens
tcatcactgtatcattgataga

SEQ ID NO: 7617148 - DNA, 22 bp, Homo sapiens
tcatcactgtatcattgataga

SEQ ID NO: 7617149 - DNA, 22 bp, Homo sapiens
tcatcagaatcagggctttgaa

SEQ ID NO: 7617150 - DNA, 19 bp, Homo sapiens
tcatcacttcagaggaaaa

SEQ ID NO: 7617151 - DNA, 22 bp, Homo sapiens
tcatcagactgactgtggttct

SEQ ID NO: 7617152 - DNA, 22 bp, Homo sapiens
tcatcagagaacattttgcctt

SEQ ID NO: 7617153 - DNA, 22 bp, Homo sapiens
tcatcagagccattgttaagaa

SEQ ID NO: 7617154 - DNA, 22 bp, Homo sapiens
tcatcagagctcccccaaacgt

SEQ ID NO: 7617155 - DNA, 20 bp, Homo sapiens
tcatcagataggttagtaca

SEQ ID NO: 7617156 - DNA, 22 bp, Homo sapiens
tcatcagctcatctgctcctag

SEQ ID NO: 7617157 - DNA, 22 bp, Homo sapiens
tcatcagaggcatctggcaagg

SEQ ID NO: 7617158 - DNA, 20 bp, Homo sapiens
tcatcagataggttagtaca

SEQ ID NO: 7617159 - DNA, 22 bp, Homo sapiens
tcatcagcaccctatgtccttt

SEQ ID NO: 7617160 - DNA, 19 bp, Homo sapiens
tcatcacctaattctctat

SEQ ID NO: 7617161 - DNA, 22 bp, Homo sapiens
tcatcacatgtgtagtcatccc

SEQ ID NO: 7617162 - DNA, 19 bp, Homo sapiens
tcatcacccctcctctcta

SEQ ID NO: 7617163 - DNA, 22 bp, Homo sapiens
tcatcacatgtgtagtcatccc

SEQ ID NO: 7617164 - DNA, 22 bp, Homo sapiens
tcatcacatgtgtagtcatccc

SEQ ID NO: 7617165 - DNA, 22 bp, Homo sapiens
tcatcacatgtgtagtcatccc

SEQ ID NO: 7617166 - DNA, 22 bp, Homo sapiens
tcatacataacttgtacagtga

SEQ ID NO: 7617167 - DNA, 22 bp, Homo sapiens
tcatacataacttgtacagtga

SEQ ID NO: 7617168 - DNA, 22 bp, Homo sapiens
tcatacataacttgtacagtga

SEQ ID NO: 7617169 - DNA, 22 bp, Homo sapiens
tcatcaaagtcaaagaatgact

SEQ ID NO: 7617170 - DNA, 22 bp, Homo sapiens
tcatacacctatctctctgtgc

SEQ ID NO: 7617171 - DNA, 22 bp, Homo sapiens
tcatacaggctcaagctatacg

SEQ ID NO: 7617172 - DNA, 22 bp, Homo sapiens
tcatacataaataagagtttag

SEQ ID NO: 7617173 - DNA, 22 bp, Homo sapiens
tcatacataaataagagtttag

SEQ ID NO: 7617174 - DNA, 22 bp, Homo sapiens
tcatacataaataagagtttag

SEQ ID NO: 7617175 - DNA, 22 bp, Homo sapiens
tcatacataaataagagtttag

SEQ ID NO: 7617176 - DNA, 22 bp, Homo sapiens
tcatcaaagtcaaagaatgact

SEQ ID NO: 7617177 - DNA, 22 bp, Homo sapiens
tcatcacaattttatgaccctc

SEQ ID NO: 7617178 - DNA, 22 bp, Homo sapiens
tcatcacaattttatgaccctc

SEQ ID NO: 7617179 - DNA, 22 bp, Homo sapiens
tcatcacatatgtcatgatttg

SEQ ID NO: 7617180 - DNA, 22 bp, Homo sapiens
tcatcacatatgtcatgatttg

SEQ ID NO: 7617181 - DNA, 22 bp, Homo sapiens
tcatcacatatgtcatgatttg

SEQ ID NO: 7617182 - DNA, 22 bp, Homo sapiens
tcatcacatatgtcatgatttg

SEQ ID NO: 7617183 - DNA, 22 bp, Homo sapiens
tcatcacatatgtcatgatttg

SEQ ID NO: 7617184 - DNA, 22 bp, Homo sapiens
tcatcacatatgtcatgatttg

SEQ ID NO: 7617185 - DNA, 22 bp, Homo sapiens
tcataatgtagttcatggctgg

SEQ ID NO: 7617186 - DNA, 22 bp, Homo sapiens
tcataatgaccccagagtccgc

SEQ ID NO: 7617187 - DNA, 22 bp, Homo sapiens
tcataatgacaaacatactcag

SEQ ID NO: 7617188 - DNA, 22 bp, Homo sapiens
tcataatgacaaacatactcag

SEQ ID NO: 7617189 - DNA, 23 bp, Homo sapiens
tcataagtgctcagttactgtta

SEQ ID NO: 7617190 - DNA, 22 bp, Homo sapiens
tcataatacaaagagttctgca

SEQ ID NO: 7617191 - DNA, 22 bp, Homo sapiens
tcataagtggtttatatgcttg

SEQ ID NO: 7617192 - DNA, 22 bp, Homo sapiens
tcatacaactaagagtttcaga

SEQ ID NO: 7617193 - DNA, 22 bp, Homo sapiens
tcataattgtatacatttatgg

SEQ ID NO: 7617194 - DNA, 22 bp, Homo sapiens
tcataatacaaagagttctgca

SEQ ID NO: 7617195 - DNA, 22 bp, Homo sapiens
tcataatgtagttcatggctgg

SEQ ID NO: 7617196 - DNA, 22 bp, Homo sapiens
tcataattgtatacatttatgg

SEQ ID NO: 7617197 - DNA, 22 bp, Homo sapiens
tcatacaattcaatctctgatt

SEQ ID NO: 7617198 - DNA, 20 bp, Homo sapiens
tcatacacatgagcatgcag

SEQ ID NO: 7617199 - DNA, 20 bp, Homo sapiens
tcatacacatgagcatgcag

SEQ ID NO: 7617200 - DNA, 20 bp, Homo sapiens
tcatacacatgagcatgcag

SEQ ID NO: 7617201 - DNA, 22 bp, Homo sapiens
tcatacacctatctctctgtgc

SEQ ID NO: 7617202 - DNA, 22 bp, Homo sapiens
tcatacacctatctctctgtgc

SEQ ID NO: 7617203 - DNA, 22 bp, Homo sapiens
tcatacaggctcaagctatacg

SEQ ID NO: 7617204 - DNA, 22 bp, Homo sapiens
tcatacacctatctctctgtgc

SEQ ID NO: 7617205 - DNA, 22 bp, Homo sapiens
tcatacacattcttattacttt

SEQ ID NO: 7617206 - DNA, 22 bp, Homo sapiens
tcatacacattcttattacttt

SEQ ID NO: 7617207 - DNA, 20 bp, Homo sapiens
tcatacacatgagcatgcag

SEQ ID NO: 7617208 - DNA, 22 bp, Homo sapiens
tcatacacattcttattacttt

SEQ ID NO: 7617209 - DNA, 22 bp, Homo sapiens
tcatacacattcttattacttt

SEQ ID NO: 7617210 - DNA, 22 bp, Homo sapiens
tcatacaaggagggtgttcaaa

SEQ ID NO: 7617211 - DNA, 22 bp, Homo sapiens
tcatacaagatcactttggcca

SEQ ID NO: 7617212 - DNA, 22 bp, Homo sapiens
tcatacaagatcactttggcca

SEQ ID NO: 7617213 - DNA, 22 bp, Homo sapiens
tcatacaactaagagtttcaga

SEQ ID NO: 7617214 - DNA, 22 bp, Homo sapiens
tcatacaactaagagtttcaga

SEQ ID NO: 7617215 - DNA, 22 bp, Homo sapiens
tcatacaactaagagtttcaga

SEQ ID NO: 7617216 - DNA, 22 bp, Homo sapiens
tcatacaactaagagtttcaga

SEQ ID NO: 7617217 - DNA, 22 bp, Homo sapiens
tcatacaactaagagtttcaga

SEQ ID NO: 7617218 - DNA, 22 bp, Homo sapiens
tcatacaaggagggtgttcaaa

SEQ ID NO: 7617219 - DNA, 22 bp, Homo sapiens
tcatacaaggagggtgttcaaa

SEQ ID NO: 7617220 - DNA, 22 bp, Homo sapiens
tcatacaaggagggtgttcaaa

SEQ ID NO: 7617221 - DNA, 22 bp, Homo sapiens
tcatacaattcaatctctgatt

SEQ ID NO: 7617222 - DNA, 22 bp, Homo sapiens
tcatacaattcaatctctgatt

SEQ ID NO: 7617223 - DNA, 22 bp, Homo sapiens
tcatacaattcaatctctgatt

SEQ ID NO: 7617224 - DNA, 22 bp, Homo sapiens
tcatacacaagagcatgtaaca

SEQ ID NO: 7617225 - DNA, 22 bp, Homo sapiens
tcatacacaagagcatgtaaca

SEQ ID NO: 7617226 - DNA, 22 bp, Homo sapiens
catcagtgaaagtgaatgttct

SEQ ID NO: 7617227 - DNA, 22 bp, Homo sapiens
catcagtgagccccttgatgag

SEQ ID NO: 7617228 - DNA, 22 bp, Homo sapiens
catcagtcagtctcttcagtat

SEQ ID NO: 7617229 - DNA, 22 bp, Homo sapiens
catcagtcagtcaacgcagttt

SEQ ID NO: 7617230 - DNA, 22 bp, Homo sapiens
catcagtcccacggagcagccc

SEQ ID NO: 7617231 - DNA, 22 bp, Homo sapiens
catcagtctagattctagtacc

SEQ ID NO: 7617232 - DNA, 22 bp, Homo sapiens
catcagtgcccttggggatgcc

SEQ ID NO: 7617233 - DNA, 22 bp, Homo sapiens
catcagtctgaaagccagggag

SEQ ID NO: 7617234 - DNA, 22 bp, Homo sapiens
catcagtgcccttggggatgcc

SEQ ID NO: 7617235 - DNA, 22 bp, Homo sapiens
catcagtgagccccttgatgag

SEQ ID NO: 7617236 - DNA, 22 bp, Homo sapiens
catcagtgcggcatctgtcatc

SEQ ID NO: 7617237 - DNA, 22 bp, Homo sapiens
catcagtgcggcatctgtcatc

SEQ ID NO: 7617238 - DNA, 20 bp, Homo sapiens
catcagtgcctgacaggtcc

SEQ ID NO: 7617239 - DNA, 20 bp, Homo sapiens
catcagtgcctgacaggtcc

SEQ ID NO: 7617240 - DNA, 22 bp, Homo sapiens
catcagtgcccttggggatgcc

SEQ ID NO: 7617241 - DNA, 22 bp, Homo sapiens
catcagtggatatagattagcg

SEQ ID NO: 7617242 - DNA, 22 bp, Homo sapiens
catcagtggatatagattagcg

SEQ ID NO: 7617243 - DNA, 22 bp, Homo sapiens
catcagtggtaactgaatggtt

SEQ ID NO: 7617244 - DNA, 22 bp, Homo sapiens
catcagtgtggcagttcactgt

SEQ ID NO: 7617245 - DNA, 22 bp, Homo sapiens
catcagtgttgatccaccagca

SEQ ID NO: 7617246 - DNA, 22 bp, Homo sapiens
catcagtgttcactattccttc

SEQ ID NO: 7617247 - DNA, 22 bp, Homo sapiens
catcagttcccaggcccagaca

SEQ ID NO: 7617248 - DNA, 22 bp, Homo sapiens
catcagttcccaggcccagaca

SEQ ID NO: 7617249 - DNA, 22 bp, Homo sapiens
catcagtttggtcaatgatggg

SEQ ID NO: 7617250 - DNA, 22 bp, Homo sapiens
catcagtgttggcttctcagag

SEQ ID NO: 7617251 - DNA, 22 bp, Homo sapiens
catcagttcatgtctagctgct

SEQ ID NO: 7617252 - DNA, 22 bp, Homo sapiens
catcagcctggaaggcagcctg

SEQ ID NO: 7617253 - DNA, 22 bp, Homo sapiens
catcagcctggaaggcagcctg

SEQ ID NO: 7617254 - DNA, 23 bp, Homo sapiens
catcagcctcagtctgtggaccc

SEQ ID NO: 7617255 - DNA, 22 bp, Homo sapiens
catcagctaaacttagtgaaat

SEQ ID NO: 7617256 - DNA, 22 bp, Homo sapiens
catcagctgagggtgagcagaa

SEQ ID NO: 7617257 - DNA, 22 bp, Homo sapiens
catcagctcttcattcttgatt

SEQ ID NO: 7617258 - DNA, 22 bp, Homo sapiens
catcagcaggcaacactcttgg

SEQ ID NO: 7617259 - DNA, 22 bp, Homo sapiens
catcagcactatgattaaagta

SEQ ID NO: 7617260 - DNA, 22 bp, Homo sapiens
catcagcaggcaacactcttgg

SEQ ID NO: 7617261 - DNA, 22 bp, Homo sapiens
catcagcactatgattaaagta

SEQ ID NO: 7617262 - DNA, 22 bp, Homo sapiens
catcagagttaacatcatgact

SEQ ID NO: 7617263 - DNA, 22 bp, Homo sapiens
catcagagttaacatcatgact

SEQ ID NO: 7617264 - DNA, 22 bp, Homo sapiens
catcagagtggtggcctggtgt

SEQ ID NO: 7617265 - DNA, 22 bp, Homo sapiens
catcagagtggtggcctggtgt

SEQ ID NO: 7617266 - DNA, 22 bp, Homo sapiens
catcaggaaaggacgtctagcc

SEQ ID NO: 7617267 - DNA, 22 bp, Homo sapiens
catcaggaaaggacgtctagcc

SEQ ID NO: 7617268 - DNA, 22 bp, Homo sapiens
catcaggaaaaaactggagcca

SEQ ID NO: 7617269 - DNA, 22 bp, Homo sapiens
catcaggaaaaaactggagcca

SEQ ID NO: 7617270 - DNA, 22 bp, Homo sapiens
catcaggaaaaaactggagcca

SEQ ID NO: 7617271 - DNA, 22 bp, Homo sapiens
catcaggaaaaaactggagcca

SEQ ID NO: 7617272 - DNA, 22 bp, Homo sapiens
catcagcttttctatgtggtga

SEQ ID NO: 7617273 - DNA, 21 bp, Homo sapiens
catcagatttagaagttctat

SEQ ID NO: 7617274 - DNA, 22 bp, Homo sapiens
catcagcttttctatgtggtga

SEQ ID NO: 7617275 - DNA, 22 bp, Homo sapiens
catcagctttggcgctgagcat

SEQ ID NO: 7617276 - DNA, 22 bp, Homo sapiens
catcaggaattatcctaattat

SEQ ID NO: 7617277 - DNA, 22 bp, Homo sapiens
catcaggaattatcctaattat

SEQ ID NO: 7617278 - DNA, 22 bp, Homo sapiens
catcaggaattatcctaattat

SEQ ID NO: 7617279 - DNA, 22 bp, Homo sapiens
catcaggaataaatgaggctgt

SEQ ID NO: 7617280 - DNA, 22 bp, Homo sapiens
catcaggaataaatgaggctgt

SEQ ID NO: 7617281 - DNA, 22 bp, Homo sapiens
catcaggaataaatgaggctgt

SEQ ID NO: 7617282 - DNA, 22 bp, Homo sapiens
catcaggaaaggacgtctagcc

SEQ ID NO: 7617283 - DNA, 22 bp, Homo sapiens
catcaggacagcttcttttcac

SEQ ID NO: 7617284 - DNA, 22 bp, Homo sapiens
catcaggacagcttcttttcac

SEQ ID NO: 7617285 - DNA, 22 bp, Homo sapiens
catcaggacagcttcttttcac

SEQ ID NO: 7617286 - DNA, 20 bp, Homo sapiens
catcaggaccctcagttttt

SEQ ID NO: 7617287 - DNA, 20 bp, Homo sapiens
catcaggaccctcagttttt

SEQ ID NO: 7617288 - DNA, 20 bp, Homo sapiens
catcaggaccctcagttttt

SEQ ID NO: 7617289 - DNA, 22 bp, Homo sapiens
catcaggagaccaggtcctgct

SEQ ID NO: 7617290 - DNA, 22 bp, Homo sapiens
catcaggagaccaggtcctgct

SEQ ID NO: 7617291 - DNA, 22 bp, Homo sapiens
catcaggaggagatgaagaaaa

SEQ ID NO: 7617292 - DNA, 22 bp, Homo sapiens
catcaggaggagatgaagaaaa

SEQ ID NO: 7617293 - DNA, 22 bp, Homo sapiens
catcaggaggagatgaagaaaa

SEQ ID NO: 7617294 - DNA, 22 bp, Homo sapiens
catcaggagaccaggtcctgct

SEQ ID NO: 7617295 - DNA, 22 bp, Homo sapiens
catcaggagaccaggtcctgct

SEQ ID NO: 7617296 - DNA, 22 bp, Homo sapiens
catcaggataagttccaggtgg

SEQ ID NO: 7617297 - DNA, 22 bp, Homo sapiens
catcaggataagttccaggtgg

SEQ ID NO: 7617298 - DNA, 22 bp, Homo sapiens
catcaggataagttccaggtgg

SEQ ID NO: 7617299 - DNA, 22 bp, Homo sapiens
catcaggatctctctggaatgc

SEQ ID NO: 7617300 - DNA, 22 bp, Homo sapiens
catcaggatctctctggaatgc

SEQ ID NO: 7617301 - DNA, 22 bp, Homo sapiens
catcaggatctctctggaatgc

SEQ ID NO: 7617302 - DNA, 22 bp, Homo sapiens
catcaggagaccaggtcctgct

SEQ ID NO: 7617303 - DNA, 22 bp, Homo sapiens
catcagtcagtcaacgcagttt

SEQ ID NO: 7617304 - DNA, 22 bp, Homo sapiens
catcagtaaggcaacatagctt

SEQ ID NO: 7617305 - DNA, 22 bp, Homo sapiens
catcaggtgcctctgtgcagtg

SEQ ID NO: 7617306 - DNA, 22 bp, Homo sapiens
tcagtgtcttctctttcctacc

SEQ ID NO: 7617307 - DNA, 22 bp, Homo sapiens
tcagtgtcttctctttcctacc

SEQ ID NO: 7617308 - DNA, 22 bp, Homo sapiens
tcagtgtctgtgggcaggatgg

SEQ ID NO: 7617309 - DNA, 22 bp, Homo sapiens
tcagtgtcttctctttcctacc

SEQ ID NO: 7617310 - DNA, 22 bp, Homo sapiens
tcagtgtcttctctttcctacc

SEQ ID NO: 7617311 - DNA, 22 bp, Homo sapiens
tcagtgtcttctctttcctacc

SEQ ID NO: 7617312 - DNA, 22 bp, Homo sapiens
tcagtgtcttgacctgggtgtg

SEQ ID NO: 7617313 - DNA, 22 bp, Homo sapiens
tcagtgtcttgacctgggtgtg

SEQ ID NO: 7617314 - DNA, 22 bp, Homo sapiens
catcatcaaactggggggctgg

SEQ ID NO: 7617315 - DNA, 22 bp, Homo sapiens
catcatcaacaggtagactggt

SEQ ID NO: 7617316 - DNA, 22 bp, Homo sapiens
catcatcaactggcaggtaagt

SEQ ID NO: 7617317 - DNA, 20 bp, Homo sapiens
catcatcacatgagccaatt

SEQ ID NO: 7617318 - DNA, 20 bp, Homo sapiens
catcatcacatgagccaatt

SEQ ID NO: 7617319 - DNA, 22 bp, Homo sapiens
catcatcacctgctatacgatc

SEQ ID NO: 7617320 - DNA, 22 bp, Homo sapiens
catcatcacctgctatacgatc

SEQ ID NO: 7617321 - DNA, 22 bp, Homo sapiens
tcagtgctgtaaacaaaaggaa

SEQ ID NO: 7617322 - DNA, 22 bp, Homo sapiens
tcagtgctgtaaacaaaaggaa

SEQ ID NO: 7617323 - DNA, 22 bp, Homo sapiens
tcagtgctgtgtaaatgtatta

SEQ ID NO: 7617324 - DNA, 22 bp, Homo sapiens
tcagtgctgtgtaaatgtatta

SEQ ID NO: 7617325 - DNA, 22 bp, Homo sapiens
catcataaaattgagataactg

SEQ ID NO: 7617326 - DNA, 22 bp, Homo sapiens
catcataaaattgagataactg

SEQ ID NO: 7617327 - DNA, 22 bp, Homo sapiens
catcataataacccagacacag

SEQ ID NO: 7617328 - DNA, 22 bp, Homo sapiens
catcataataacccagacacag

SEQ ID NO: 7617329 - DNA, 22 bp, Homo sapiens
catcatatatttctacaagtgc

SEQ ID NO: 7617330 - DNA, 22 bp, Homo sapiens
catcatactgtttacactcaaa

SEQ ID NO: 7617331 - DNA, 22 bp, Homo sapiens
catcatactgtttacactcaaa

SEQ ID NO: 7617332 - DNA, 22 bp, Homo sapiens
catcatatatttctacaagtgc

SEQ ID NO: 7617333 - DNA, 22 bp, Homo sapiens
catcatatatttctacaagtgc

SEQ ID NO: 7617334 - DNA, 22 bp, Homo sapiens
catcatatggaatttaaagtca

SEQ ID NO: 7617335 - DNA, 22 bp, Homo sapiens
catcatcaaaacaaatggagtc

SEQ ID NO: 7617336 - DNA, 22 bp, Homo sapiens
catcatcaaaagtgacagagaa

SEQ ID NO: 7617337 - DNA, 22 bp, Homo sapiens
catcatcaaaagtgacagagaa

SEQ ID NO: 7617338 - DNA, 22 bp, Homo sapiens
catcatcaaaacaaatggagtc

SEQ ID NO: 7617339 - DNA, 22 bp, Homo sapiens
catcatcaaaagtgacagagaa

SEQ ID NO: 7617340 - DNA, 22 bp, Homo sapiens
tcagtgtgagtaccatgctcag

SEQ ID NO: 7617341 - DNA, 22 bp, Homo sapiens
tcagtgtgagtaccatgctcag

SEQ ID NO: 7617342 - DNA, 22 bp, Homo sapiens
tcagtgtgagtaccatgctcag

SEQ ID NO: 7617343 - DNA, 22 bp, Homo sapiens
tcagtgtgagtaccatgctcag

SEQ ID NO: 7617344 - DNA, 22 bp, Homo sapiens
tcagtgtgagtaccatgctcag

SEQ ID NO: 7617345 - DNA, 22 bp, Homo sapiens
tcagtgtgattaggctatctga

SEQ ID NO: 7617346 - DNA, 22 bp, Homo sapiens
tcagtgtgattaggctatctga

SEQ ID NO: 7617347 - DNA, 22 bp, Homo sapiens
tcagtgtgattaggctatctga

SEQ ID NO: 7617348 - DNA, 22 bp, Homo sapiens
tcagtgtgaggtcttccacccg

SEQ ID NO: 7617349 - DNA, 22 bp, Homo sapiens
tcagtgtgaggtcttccacccg

SEQ ID NO: 7617350 - DNA, 21 bp, Homo sapiens
tcagtgtgactggcaaattga

SEQ ID NO: 7617351 - DNA, 19 bp, Homo sapiens
tcagtgtgacttggtcagt

SEQ ID NO: 7617352 - DNA, 19 bp, Homo sapiens
tcagtgtgacttggtcagt

SEQ ID NO: 7617353 - DNA, 22 bp, Homo sapiens
tcagtgtgaggggctgggtcct

SEQ ID NO: 7617354 - DNA, 22 bp, Homo sapiens
tcagtgtgaggggctgggtcct

SEQ ID NO: 7617355 - DNA, 22 bp, Homo sapiens
tcagtgtcttgacctgggtgtg

SEQ ID NO: 7617356 - DNA, 22 bp, Homo sapiens
tcagtgtcttgggcttgaatgc

SEQ ID NO: 7617357 - DNA, 22 bp, Homo sapiens
tcagtgtcttgggcttgaatgc

SEQ ID NO: 7617358 - DNA, 22 bp, Homo sapiens
tcagtgtgaattcaggagccta

SEQ ID NO: 7617359 - DNA, 22 bp, Homo sapiens
tcagtgtgaattcaggagccta

SEQ ID NO: 7617360 - DNA, 21 bp, Homo sapiens
tcagtgtgactggcaaattga

SEQ ID NO: 7617361 - DNA, 22 bp, Homo sapiens
tcagtgtgactgatggctttat

SEQ ID NO: 7617362 - DNA, 22 bp, Homo sapiens
tcagtgtgaattcattttagat

SEQ ID NO: 7617363 - DNA, 22 bp, Homo sapiens
tcagtgtgggtaagcatgctgt

SEQ ID NO: 7617364 - DNA, 22 bp, Homo sapiens
tcagtgtggaaaatcctttggc

SEQ ID NO: 7617365 - DNA, 20 bp, Homo sapiens
tcagtgtggcggggacctca

SEQ ID NO: 7617366 - DNA, 22 bp, Homo sapiens
tcagtgtgggtaagcatgctgt

SEQ ID NO: 7617367 - DNA, 22 bp, Homo sapiens
tcagtgtgggtaagcatgctgt

SEQ ID NO: 7617368 - DNA, 20 bp, Homo sapiens
tcagtgtggcggggacctca

SEQ ID NO: 7617369 - DNA, 20 bp, Homo sapiens
tcagtgtggcggggacctca

SEQ ID NO: 7617370 - DNA, 22 bp, Homo sapiens
tcagtgtggaaaatcctttggc

SEQ ID NO: 7617371 - DNA, 22 bp, Homo sapiens
tcagtgtggcccagggaagcag

SEQ ID NO: 7617372 - DNA, 22 bp, Homo sapiens
tcagtgtgtacactgagcattt

SEQ ID NO: 7617373 - DNA, 22 bp, Homo sapiens
tcagtgtgtacactgagcattt

SEQ ID NO: 7617374 - DNA, 22 bp, Homo sapiens
tcagtgtgtagtaaattgtagg

SEQ ID NO: 7617375 - DNA, 22 bp, Homo sapiens
tcagtgtgtaattctttgtttc

SEQ ID NO: 7617376 - DNA, 22 bp, Homo sapiens
tcagtgtgtacactgagcattt

SEQ ID NO: 7617377 - DNA, 22 bp, Homo sapiens
tcagtgtgtacactgagcattt

SEQ ID NO: 7617378 - DNA, 23 bp, Homo sapiens
tcagtgtgcaagaatggagaagc

SEQ ID NO: 7617379 - DNA, 23 bp, Homo sapiens
tcagtgtgcaagaatggagaagc

SEQ ID NO: 7617380 - DNA, 22 bp, Homo sapiens
tcagtgtgcacatggtagcagt

SEQ ID NO: 7617381 - DNA, 22 bp, Homo sapiens
tcagtgtgcacatggtagcagt

SEQ ID NO: 7617382 - DNA, 23 bp, Homo sapiens
tcagtgtgcaagaatggagaagc

SEQ ID NO: 7617383 - DNA, 22 bp, Homo sapiens
tcagtgtgcacatggtagcagt

SEQ ID NO: 7617384 - DNA, 22 bp, Homo sapiens
tcagtgtgcacgatacagattg

SEQ ID NO: 7617385 - DNA, 22 bp, Homo sapiens
tcagtgtgcacatggtagcagt

SEQ ID NO: 7617386 - DNA, 22 bp, Homo sapiens
tcagtgtgcacgatacagattg

SEQ ID NO: 7617387 - DNA, 22 bp, Homo sapiens
tcagtgtgcacgatacagattg

SEQ ID NO: 7617388 - DNA, 22 bp, Homo sapiens
tcagtgtgcacgatacagattg

SEQ ID NO: 7617389 - DNA, 22 bp, Homo sapiens
tcagtgtgcactctgtgaccca

SEQ ID NO: 7617390 - DNA, 22 bp, Homo sapiens
tcagtgtgcactctgtgaccca

SEQ ID NO: 7617391 - DNA, 22 bp, Homo sapiens
tcagtgtggaaaatcctttggc

SEQ ID NO: 7617392 - DNA, 22 bp, Homo sapiens
tcagtgtgcactctgtgaccca

SEQ ID NO: 7617393 - DNA, 22 bp, Homo sapiens
tcagtgtggcccagggaagcag

SEQ ID NO: 7617394 - DNA, 22 bp, Homo sapiens
tcagtgtggcccagggaagcag

SEQ ID NO: 7617395 - DNA, 22 bp, Homo sapiens
tccaagcaacaactaatttaca

SEQ ID NO: 7617396 - DNA, 22 bp, Homo sapiens
tccaagatctacagcagtttag

SEQ ID NO: 7617397 - DNA, 22 bp, Homo sapiens
tccaagatctacagcagtttag

SEQ ID NO: 7617398 - DNA, 22 bp, Homo sapiens
tccaagatctacagcagtttag

SEQ ID NO: 7617399 - DNA, 22 bp, Homo sapiens
tccaagatctacagcagtttag

SEQ ID NO: 7617400 - DNA, 22 bp, Homo sapiens
tccaagatctacagcagtttag

SEQ ID NO: 7617401 - DNA, 22 bp, Homo sapiens
tccaagatctacagcagtttag

SEQ ID NO: 7617402 - DNA, 22 bp, Homo sapiens
tccaagagttcaaggctacagt

SEQ ID NO: 7617403 - DNA, 22 bp, Homo sapiens
tccaagagttcaaggctacagt

SEQ ID NO: 7617404 - DNA, 22 bp, Homo sapiens
tccaagagtatagtttattggc

SEQ ID NO: 7617405 - DNA, 22 bp, Homo sapiens
tccaagagtatagtttattggc

SEQ ID NO: 7617406 - DNA, 20 bp, Homo sapiens
tccaagagtgatgtttcata

SEQ ID NO: 7617407 - DNA, 22 bp, Homo sapiens
tccaagagtaagaggactcttt

SEQ ID NO: 7617408 - DNA, 22 bp, Homo sapiens
tccaagagtaagaggactcttt

SEQ ID NO: 7617409 - DNA, 22 bp, Homo sapiens
tccaagagtaagaggactcttt

SEQ ID NO: 7617410 - DNA, 22 bp, Homo sapiens
catgctgtggtaaatcactgaa

SEQ ID NO: 7617411 - DNA, 22 bp, Homo sapiens
tccaagaagtcatctaaactgt

SEQ ID NO: 7617412 - DNA, 22 bp, Homo sapiens
tccaagaagtcatctaaactgt

SEQ ID NO: 7617413 - DNA, 23 bp, Homo sapiens
tccaagaagtagggcctggactt

SEQ ID NO: 7617414 - DNA, 22 bp, Homo sapiens
tccaagaagtttatgttgtttc

SEQ ID NO: 7617415 - DNA, 16 bp, Homo sapiens
tccaagaagtgcccct

SEQ ID NO: 7617416 - DNA, 22 bp, Homo sapiens
tccaagaagtcatctaaactgt

SEQ ID NO: 7617417 - DNA, 22 bp, Homo sapiens
tccaagaagtttcgttaaatgt

SEQ ID NO: 7617418 - DNA, 22 bp, Homo sapiens
tccaagagaatactggagagta

SEQ ID NO: 7617419 - DNA, 22 bp, Homo sapiens
tccaagagaatactggagagta

SEQ ID NO: 7617420 - DNA, 22 bp, Homo sapiens
tccaagagaatactggagagta

SEQ ID NO: 7617421 - DNA, 22 bp, Homo sapiens
tccaagaggagacactgggatg

SEQ ID NO: 7617422 - DNA, 22 bp, Homo sapiens
tccaagagaatactggagagta

SEQ ID NO: 7617423 - DNA, 22 bp, Homo sapiens
tccaagaatcactgacacagct

SEQ ID NO: 7617424 - DNA, 22 bp, Homo sapiens
tccaagaatcactgacacagct

SEQ ID NO: 7617425 - DNA, 22 bp, Homo sapiens
tccaagaatacagatttgtgaa

SEQ ID NO: 7617426 - DNA, 22 bp, Homo sapiens
tccaagaatacagatttgtgaa

SEQ ID NO: 7617427 - DNA, 22 bp, Homo sapiens
tccaagaatcagtctcttttgg

SEQ ID NO: 7617428 - DNA, 22 bp, Homo sapiens
tccaagagaatactggagagta

SEQ ID NO: 7617429 - DNA, 17 bp, Homo sapiens
tccagagaggcttccct

SEQ ID NO: 7617430 - DNA, 17 bp, Homo sapiens
tccagagaggcttccct

SEQ ID NO: 7617431 - DNA, 18 bp, Homo sapiens
tccagagagggagaagtg

SEQ ID NO: 7617432 - DNA, 18 bp, Homo sapiens
tccagagagggagaagtg

SEQ ID NO: 7617433 - DNA, 18 bp, Homo sapiens
tccagagagggagaagtg

SEQ ID NO: 7617434 - DNA, 18 bp, Homo sapiens
tccagagagggagaagtg

SEQ ID NO: 7617435 - DNA, 18 bp, Homo sapiens
tccagagagggagaagtg

SEQ ID NO: 7617436 - DNA, 18 bp, Homo sapiens
tccagagagggagaagtg

SEQ ID NO: 7617437 - DNA, 18 bp, Homo sapiens
tccagagagggagaagtg

SEQ ID NO: 7617438 - DNA, 18 bp, Homo sapiens
tccagagagggagaagtg

SEQ ID NO: 7617439 - DNA, 22 bp, Homo sapiens
tccagaggtatgtagagagtat

SEQ ID NO: 7617440 - DNA, 18 bp, Homo sapiens
tccagagagggagaagtg

SEQ ID NO: 7617441 - DNA, 22 bp, Homo sapiens
tccagaggtgaacacccaggca

SEQ ID NO: 7617442 - DNA, 22 bp, Homo sapiens
tccaagcatgtggtcaggagcc

SEQ ID NO: 7617443 - DNA, 22 bp, Homo sapiens
tccaagcatgtggtcaggagcc

SEQ ID NO: 7617444 - DNA, 22 bp, Homo sapiens
tccaagcatgtggtcaggagcc

SEQ ID NO: 7617445 - DNA, 22 bp, Homo sapiens
tccaagcatgtggtcaggagcc

SEQ ID NO: 7617446 - DNA, 22 bp, Homo sapiens
tccaagcatgtggtcaggagcc

SEQ ID NO: 7617447 - DNA, 22 bp, Homo sapiens
tccaagcactgttaattaaact

SEQ ID NO: 7617448 - DNA, 22 bp, Homo sapiens
tccaagcaacaactaatttaca

SEQ ID NO: 7617449 - DNA, 22 bp, Homo sapiens
tccaagcaacaactaatttaca

SEQ ID NO: 7617450 - DNA, 22 bp, Homo sapiens
tccaagcactgttaattaaact

SEQ ID NO: 7617451 - DNA, 22 bp, Homo sapiens
tccaagcactgttaattaaact

SEQ ID NO: 7617452 - DNA, 22 bp, Homo sapiens
tccaagcactgttaattaaact

SEQ ID NO: 7617453 - DNA, 22 bp, Homo sapiens
tccaagcactgttaattaaact

SEQ ID NO: 7617454 - DNA, 22 bp, Homo sapiens
tccaagcactgttaattaaact

SEQ ID NO: 7617455 - DNA, 22 bp, Homo sapiens
tccagatagagtcctgttagta

SEQ ID NO: 7617456 - DNA, 22 bp, Homo sapiens
tccagatagagtcctgttagta

SEQ ID NO: 7617457 - DNA, 20 bp, Homo sapiens
tccagatattaagacaggca

SEQ ID NO: 7617458 - DNA, 20 bp, Homo sapiens
tccagatattaagacaggca

SEQ ID NO: 7617459 - DNA, 23 bp, Homo sapiens
tccagagtgtgagcttgccgtgc

SEQ ID NO: 7617460 - DNA, 22 bp, Homo sapiens
tccagagttgtaagtgttgaca

SEQ ID NO: 7617461 - DNA, 22 bp, Homo sapiens
tccagagtttgagtctccttcc

SEQ ID NO: 7617462 - DNA, 22 bp, Homo sapiens
tccagagtttgagtctccttcc

SEQ ID NO: 7617463 - DNA, 18 bp, Homo sapiens
tccagaggtgttggagcc

SEQ ID NO: 7617464 - DNA, 18 bp, Homo sapiens
tccagaggtgttggagcc

SEQ ID NO: 7617465 - DNA, 22 bp, Homo sapiens
tccagagtacggaagagtcatc

SEQ ID NO: 7617466 - DNA, 22 bp, Homo sapiens
tccagagtgacaaatgactgat

SEQ ID NO: 7617467 - DNA, 22 bp, Homo sapiens
tccagagtgctgacgcagaccc

SEQ ID NO: 7617468 - DNA, 18 bp, Homo sapiens
tccagaggtgttggagcc

SEQ ID NO: 7617469 - DNA, 18 bp, Homo sapiens
tccagaggtgttggagcc

SEQ ID NO: 7617470 - DNA, 18 bp, Homo sapiens
tccagaggtgttggagcc

SEQ ID NO: 7617471 - DNA, 18 bp, Homo sapiens
tccagaggtgttggagcc

SEQ ID NO: 7617472 - DNA, 18 bp, Homo sapiens
tccagaggtgttggagcc

SEQ ID NO: 7617473 - DNA, 22 bp, Homo sapiens
tccagaggtgaacacccaggca

SEQ ID NO: 7617474 - DNA, 22 bp, Homo sapiens
tccagaggtgaacacccaggca

SEQ ID NO: 7617475 - DNA, 22 bp, Homo sapiens
tccagaggtgaacacccaggca

SEQ ID NO: 7617476 - DNA, 22 bp, Homo sapiens
tccagaggtgaacacccaggca

SEQ ID NO: 7617477 - DNA, 22 bp, Homo sapiens
tccagaggtgaacacccaggca

SEQ ID NO: 7617478 - DNA, 22 bp, Homo sapiens
tccagaggtgaacacccaggca

SEQ ID NO: 7617479 - DNA, 22 bp, Homo sapiens
tccagaggtgaacacccaggca

SEQ ID NO: 7617480 - DNA, 22 bp, Homo sapiens
catgctattttccaataatgta

SEQ ID NO: 7617481 - DNA, 22 bp, Homo sapiens
catgctattttccaataatgta

SEQ ID NO: 7617482 - DNA, 22 bp, Homo sapiens
catgctatttatacataagtct

SEQ ID NO: 7617483 - DNA, 22 bp, Homo sapiens
catgctattttccaataatgta

SEQ ID NO: 7617484 - DNA, 22 bp, Homo sapiens
catgctcacaaaagatggcaaa

SEQ ID NO: 7617485 - DNA, 22 bp, Homo sapiens
catgctcacttttatactgtaa

SEQ ID NO: 7617486 - DNA, 22 bp, Homo sapiens
catgctcacttttatactgtaa

SEQ ID NO: 7617487 - DNA, 22 bp, Homo sapiens
catgctactgaacaagtccatg

SEQ ID NO: 7617488 - DNA, 22 bp, Homo sapiens
catgctaattcccaggccccaa

SEQ ID NO: 7617489 - DNA, 22 bp, Homo sapiens
catgctaattaattccacctgc

SEQ ID NO: 7617490 - DNA, 22 bp, Homo sapiens
catgctatataggaagagcact

SEQ ID NO: 7617491 - DNA, 22 bp, Homo sapiens
catgctatataggaagagcact

SEQ ID NO: 7617492 - DNA, 22 bp, Homo sapiens
catgctacttgctatgcaaaaa

SEQ ID NO: 7617493 - DNA, 22 bp, Homo sapiens
catgctacttgctatgcaaaaa

SEQ ID NO: 7617494 - DNA, 22 bp, Homo sapiens
catgctctctggcaacttgtgt

SEQ ID NO: 7617495 - DNA, 22 bp, Homo sapiens
catgctctctggcaacttgtgt

SEQ ID NO: 7617496 - DNA, 22 bp, Homo sapiens
catgctctccattggacacaga

SEQ ID NO: 7617497 - DNA, 22 bp, Homo sapiens
catgctctccattggacacaga

SEQ ID NO: 7617498 - DNA, 22 bp, Homo sapiens
catgctctagattctctctaat

SEQ ID NO: 7617499 - DNA, 22 bp, Homo sapiens
catgctccagctccagacaggt

SEQ ID NO: 7617500 - DNA, 22 bp, Homo sapiens
catgctcacttttatactgtaa

SEQ ID NO: 7617501 - DNA, 22 bp, Homo sapiens
catgctctagattctctctaat

SEQ ID NO: 7617502 - DNA, 22 bp, Homo sapiens
catgctctagattctctctaat

SEQ ID NO: 7617503 - DNA, 22 bp, Homo sapiens
catgcattttctattcactcag

SEQ ID NO: 7617504 - DNA, 22 bp, Homo sapiens
tcatcagtccttttcattatga

SEQ ID NO: 7617505 - DNA, 22 bp, Homo sapiens
tcatcagtccttttcattatga

SEQ ID NO: 7617506 - DNA, 22 bp, Homo sapiens
tcatcagggatattggcctgaa

SEQ ID NO: 7617507 - DNA, 22 bp, Homo sapiens
tcatcagtcagaacttaagctt

SEQ ID NO: 7617508 - DNA, 22 bp, Homo sapiens
tcatcagtccttttcattatga

SEQ ID NO: 7617509 - DNA, 22 bp, Homo sapiens
tcatcagggatattggcctgaa

SEQ ID NO: 7617510 - DNA, 22 bp, Homo sapiens
tcatcagggatattggcctgaa

SEQ ID NO: 7617511 - DNA, 22 bp, Homo sapiens
tcatcaggaaacttatgcagtg

SEQ ID NO: 7617512 - DNA, 22 bp, Homo sapiens
tcatcagggatattggcctgaa

SEQ ID NO: 7617513 - DNA, 22 bp, Homo sapiens
tcatcagctcatctgctcctag

SEQ ID NO: 7617514 - DNA, 22 bp, Homo sapiens
tcatcagctcatctgctcctag

SEQ ID NO: 7617515 - DNA, 22 bp, Homo sapiens
catgccaacaacaagcaatgag

SEQ ID NO: 7617516 - DNA, 22 bp, Homo sapiens
catgccaagcatgttcagaagt

SEQ ID NO: 7617517 - DNA, 22 bp, Homo sapiens
tcatcagtccttttcattatga

SEQ ID NO: 7617518 - DNA, 22 bp, Homo sapiens
catgccaggactctggaggctt

SEQ ID NO: 7617519 - DNA, 22 bp, Homo sapiens
catgctaagtcataaaagagta

SEQ ID NO: 7617520 - DNA, 22 bp, Homo sapiens
catgctaagtcataaaagagta

SEQ ID NO: 7617521 - DNA, 22 bp, Homo sapiens
catgctgtggtaaatcactgaa

SEQ ID NO: 7617522 - DNA, 22 bp, Homo sapiens
catgctgtcctgaaaagatatt

SEQ ID NO: 7617523 - DNA, 22 bp, Homo sapiens
catgctgtcctgccagggatgg

SEQ ID NO: 7617524 - DNA, 23 bp, Homo sapiens
catgctgtgatacaggaaggttg

SEQ ID NO: 7617525 - DNA, 22 bp, Homo sapiens
catgctggtcagccagtggatg

SEQ ID NO: 7617526 - DNA, 22 bp, Homo sapiens
catgctggtcagccagtggatg

SEQ ID NO: 7617527 - DNA, 22 bp, Homo sapiens
catgctggtcagccagtggatg

SEQ ID NO: 7617528 - DNA, 22 bp, Homo sapiens
catgctgggtaaaggtggtgaa

SEQ ID NO: 7617529 - DNA, 22 bp, Homo sapiens
catgctggtcagccagtggatg

SEQ ID NO: 7617530 - DNA, 20 bp, Homo sapiens
catgctgcctccattgatgc

SEQ ID NO: 7617531 - DNA, 22 bp, Homo sapiens
catgctgcaggagctcttctca

SEQ ID NO: 7617532 - DNA, 22 bp, Homo sapiens
catgctgcaggagctcttctca

SEQ ID NO: 7617533 - DNA, 22 bp, Homo sapiens
catgctgattcttcctgagctt

SEQ ID NO: 7617534 - DNA, 22 bp, Homo sapiens
catgctgggccttgggtgcact

SEQ ID NO: 7617535 - DNA, 22 bp, Homo sapiens
catgctgggtaaaggtggtgaa

SEQ ID NO: 7617536 - DNA, 22 bp, Homo sapiens
catgctgggtaaaggtggtgaa

SEQ ID NO: 7617537 - DNA, 22 bp, Homo sapiens
catgctgggtaaaggtggtgaa

SEQ ID NO: 7617538 - DNA, 22 bp, Homo sapiens
catgctgggccttgggtgcact

SEQ ID NO: 7617539 - DNA, 22 bp, Homo sapiens
catgctgggccttgggtgcact

SEQ ID NO: 7617540 - DNA, 22 bp, Homo sapiens
catgctgggccttgggtgcact

SEQ ID NO: 7617541 - DNA, 22 bp, Homo sapiens
catgctctctggcaacttgtgt

SEQ ID NO: 7617542 - DNA, 22 bp, Homo sapiens
catgctctgcagcagacctgtg

SEQ ID NO: 7617543 - DNA, 22 bp, Homo sapiens
catgctctccattggacacaga

SEQ ID NO: 7617544 - DNA, 22 bp, Homo sapiens
catgctctccattggacacaga

SEQ ID NO: 7617545 - DNA, 22 bp, Homo sapiens
catgctctctggcaacttgtgt

SEQ ID NO: 7617546 - DNA, 22 bp, Homo sapiens
catgctctgcagcagacctgtg

SEQ ID NO: 7617547 - DNA, 22 bp, Homo sapiens
catgctctgcagcagacctgtg

SEQ ID NO: 7617548 - DNA, 19 bp, Homo sapiens
catgctgacctgctgtggt

SEQ ID NO: 7617549 - DNA, 22 bp, Homo sapiens
catgctgagcacattctgtatt

SEQ ID NO: 7617550 - DNA, 22 bp, Homo sapiens
catgctgagcacattctgtatt

SEQ ID NO: 7617551 - DNA, 22 bp, Homo sapiens
tccagcagaaccagagacctgg

SEQ ID NO: 7617552 - DNA, 22 bp, Homo sapiens
catgctgttgaatatgacattg

SEQ ID NO: 7617553 - DNA, 22 bp, Homo sapiens
tccagcagaaccagagacctgg

SEQ ID NO: 7617554 - DNA, 22 bp, Homo sapiens
tccagcagaaccagagacctgg

SEQ ID NO: 7617555 - DNA, 22 bp, Homo sapiens
tccagcagaaccagagacctgg

SEQ ID NO: 7617556 - DNA, 22 bp, Homo sapiens
tccagcagaaaagaggtaggga

SEQ ID NO: 7617557 - DNA, 22 bp, Homo sapiens
tccagcagaaaagaggtaggga

SEQ ID NO: 7617558 - DNA, 22 bp, Homo sapiens
tccagcagaaaagaggtaggga

SEQ ID NO: 7617559 - DNA, 22 bp, Homo sapiens
tccagcactcgcccagggcttg

SEQ ID NO: 7617560 - DNA, 22 bp, Homo sapiens
tccagcagaaaagaggtaggga

SEQ ID NO: 7617561 - DNA, 22 bp, Homo sapiens
tccagcacctggaggcgtcccc

SEQ ID NO: 7617562 - DNA, 22 bp, Homo sapiens
tccagcacctggaggcgtcccc

SEQ ID NO: 7617563 - DNA, 22 bp, Homo sapiens
tccagcacctggaggcgtcccc

SEQ ID NO: 7617564 - DNA, 22 bp, Homo sapiens
tccagcacctggaggcgtcccc

SEQ ID NO: 7617565 - DNA, 22 bp, Homo sapiens
tccagcactcgcccagggcttg

SEQ ID NO: 7617566 - DNA, 22 bp, Homo sapiens
tccagcacctggaggcgtcccc

SEQ ID NO: 7617567 - DNA, 22 bp, Homo sapiens
tccagcactcgcccagggcttg

SEQ ID NO: 7617568 - DNA, 22 bp, Homo sapiens
tccagcactcgcccagggcttg

SEQ ID NO: 7617569 - DNA, 20 bp, Homo sapiens
tccagcaccctcacagagaa

SEQ ID NO: 7617570 - DNA, 20 bp, Homo sapiens
tccagcaccctcacagagaa

SEQ ID NO: 7617571 - DNA, 20 bp, Homo sapiens
tccagcaccctcacagagaa

SEQ ID NO: 7617572 - DNA, 22 bp, Homo sapiens
tccagcacccaatgtggctaag

SEQ ID NO: 7617573 - DNA, 22 bp, Homo sapiens
tccagcacccaatgtggctaag

SEQ ID NO: 7617574 - DNA, 22 bp, Homo sapiens
tccagcaccaccacagggaaga

SEQ ID NO: 7617575 - DNA, 21 bp, Homo sapiens
tccagcacagatgacctcccc

SEQ ID NO: 7617576 - DNA, 21 bp, Homo sapiens
tccagcacagatgacctcccc

SEQ ID NO: 7617577 - DNA, 22 bp, Homo sapiens
tccagcacccaatgtggctaag

SEQ ID NO: 7617578 - DNA, 22 bp, Homo sapiens
tccagcacccaatgtggctaag

SEQ ID NO: 7617579 - DNA, 22 bp, Homo sapiens
tccagcacccaatgtggctaag

SEQ ID NO: 7617580 - DNA, 22 bp, Homo sapiens
tccagcaccaccacagggaaga

SEQ ID NO: 7617581 - DNA, 22 bp, Homo sapiens
tccagcacagaatttcctagct

SEQ ID NO: 7617582 - DNA, 22 bp, Homo sapiens
tccagcacagaatttcctagct

SEQ ID NO: 7617583 - DNA, 22 bp, Homo sapiens
tccagcacagaatttcctagct

SEQ ID NO: 7617584 - DNA, 22 bp, Homo sapiens
tccagatggatttaagacctaa

SEQ ID NO: 7617585 - DNA, 22 bp, Homo sapiens
tccagatgctgcacattcctga

SEQ ID NO: 7617586 - DNA, 22 bp, Homo sapiens
tccagatggatttaagacctaa

SEQ ID NO: 7617587 - DNA, 22 bp, Homo sapiens
tccagcaaagtgataggatttc

SEQ ID NO: 7617588 - DNA, 22 bp, Homo sapiens
catgctttaccaaagcagtgat

SEQ ID NO: 7617589 - DNA, 22 bp, Homo sapiens
catgctttctgtccaaatgtta

SEQ ID NO: 7617590 - DNA, 22 bp, Homo sapiens
catgctttctgtccaaatgtta

SEQ ID NO: 7617591 - DNA, 22 bp, Homo sapiens
catgctttaccaaagcagtgat

SEQ ID NO: 7617592 - DNA, 22 bp, Homo sapiens
catgcttcacacactgaatgac

SEQ ID NO: 7617593 - DNA, 22 bp, Homo sapiens
catgcttcatgcaaaattctga

SEQ ID NO: 7617594 - DNA, 22 bp, Homo sapiens
catgcttcctccaaactaccct

SEQ ID NO: 7617595 - DNA, 22 bp, Homo sapiens
catgctgttgaatatgacattg

SEQ ID NO: 7617596 - DNA, 22 bp, Homo sapiens
catgctgttgaatatgacattg

SEQ ID NO: 7617597 - DNA, 22 bp, Homo sapiens
catgcttacctgccaaagcact

SEQ ID NO: 7617598 - DNA, 22 bp, Homo sapiens
catgcttaattggagcattcat

SEQ ID NO: 7617599 - DNA, 22 bp, Homo sapiens
catgcttaaaaatgcagagagt

SEQ ID NO: 7617600 - DNA, 22 bp, Homo sapiens
catgcttacttgtctcagcaga

SEQ ID NO: 7617601 - DNA, 22 bp, Homo sapiens
catgcttacttgtctcagcaga

SEQ ID NO: 7617602 - DNA, 22 bp, Homo sapiens
catgcttatatggaaaggaaga

SEQ ID NO: 7617603 - DNA, 22 bp, Homo sapiens
catgcttatgatttgctaagcc

SEQ ID NO: 7617604 - DNA, 22 bp, Homo sapiens
catgcttattcattctgctaac

SEQ ID NO: 7617605 - DNA, 22 bp, Homo sapiens
catgctttgggtcagaaatgcc

SEQ ID NO: 7617606 - DNA, 22 bp, Homo sapiens
catgctttgggtcagaaatgcc

SEQ ID NO: 7617607 - DNA, 22 bp, Homo sapiens
catgctttgggtcagaaatgcc

SEQ ID NO: 7617608 - DNA, 22 bp, Homo sapiens
catgcttttcaatctatcttaa

SEQ ID NO: 7617609 - DNA, 22 bp, Homo sapiens
catgcttttcaatctatcttaa

SEQ ID NO: 7617610 - DNA, 22 bp, Homo sapiens
catgctttgggtcagaaatgcc

SEQ ID NO: 7617611 - DNA, 22 bp, Homo sapiens
catgctttgggtcagaaatgcc

SEQ ID NO: 7617612 - DNA, 22 bp, Homo sapiens
catgctttctgtccaaatgtta

SEQ ID NO: 7617613 - DNA, 22 bp, Homo sapiens
catgctttctgtccaaatgtta

SEQ ID NO: 7617614 - DNA, 22 bp, Homo sapiens
catgctttctgtccaaatgtta

SEQ ID NO: 7617615 - DNA, 22 bp, Homo sapiens
catgctttctgtccaaatgtta

SEQ ID NO: 7617616 - DNA, 22 bp, Homo sapiens
catgctttctgtccaaatgtta

SEQ ID NO: 7617617 - DNA, 22 bp, Homo sapiens
catgctttgggtcagaaatgcc

SEQ ID NO: 7617618 - DNA, 22 bp, Homo sapiens
catgcttttttctagtataaat

SEQ ID NO: 7617619 - DNA, 22 bp, Homo sapiens
catgctttttgacaacaagctg

SEQ ID NO: 7617620 - DNA, 22 bp, Homo sapiens
catgcttttttctagtataaat

SEQ ID NO: 7617621 - DNA, 23 bp, Homo sapiens
catggaaaactgaaagctgacct

SEQ ID NO: 7617622 - DNA, 22 bp, Homo sapiens
catgcttttttctagtataaat

SEQ ID NO: 7617623 - DNA, 22 bp, Homo sapiens
catgcttttttctagtataaat

SEQ ID NO: 7617624 - DNA, 22 bp, Homo sapiens
catgcttttcaatctatcttaa

SEQ ID NO: 7617625 - DNA, 22 bp, Homo sapiens
catgcttttcaatctatcttaa

SEQ ID NO: 7617626 - DNA, 22 bp, Homo sapiens
catgctttttgacaacaagctg

SEQ ID NO: 7617627 - DNA, 22 bp, Homo sapiens
catgcttttcaatctatcttaa

SEQ ID NO: 7617628 - DNA, 22 bp, Homo sapiens
catgctttttgacaacaagctg

SEQ ID NO: 7617629 - DNA, 19 bp, Homo sapiens
catggtgaaaccccgtctc

SEQ ID NO: 7617630 - DNA, 19 bp, Homo sapiens
catggtgaaaccccgtctc

SEQ ID NO: 7617631 - DNA, 19 bp, Homo sapiens
catggtgaaaccccgtctc

SEQ ID NO: 7617632 - DNA, 19 bp, Homo sapiens
catggtgaaaccccgtctc

SEQ ID NO: 7617633 - DNA, 19 bp, Homo sapiens
catggtgaaaccccgtctc

SEQ ID NO: 7617634 - DNA, 22 bp, Homo sapiens
catggtgcagggcacatgagga

SEQ ID NO: 7617635 - DNA, 22 bp, Homo sapiens
catggtgcagggcacatgagga

SEQ ID NO: 7617636 - DNA, 22 bp, Homo sapiens
catggtgaggggtgaagggcag

SEQ ID NO: 7617637 - DNA, 22 bp, Homo sapiens
catggtgaggggtgaagggcag

SEQ ID NO: 7617638 - DNA, 22 bp, Homo sapiens
catggtgcaggagagaaggcag

SEQ ID NO: 7617639 - DNA, 20 bp, Homo sapiens
catggtggaggagcagggcc

SEQ ID NO: 7617640 - DNA, 22 bp, Homo sapiens
catggtttggtctttgtagtgg

SEQ ID NO: 7617641 - DNA, 22 bp, Homo sapiens
catggtttcatgagaattaccc

SEQ ID NO: 7617642 - DNA, 22 bp, Homo sapiens
catgggctctctgagctccagg

SEQ ID NO: 7617643 - DNA, 22 bp, Homo sapiens
catgggctctctgagctccagg

SEQ ID NO: 7617644 - DNA, 22 bp, Homo sapiens
catgggctctctgagctccagg

SEQ ID NO: 7617645 - DNA, 22 bp, Homo sapiens
catggaaagcactcagcccagt

SEQ ID NO: 7617646 - DNA, 22 bp, Homo sapiens
catggaacaaggaagatgtttg

SEQ ID NO: 7617647 - DNA, 23 bp, Homo sapiens
catggaaaactgaaagctgacct

SEQ ID NO: 7617648 - DNA, 22 bp, Homo sapiens
catggaacaaggaagatgtttg

SEQ ID NO: 7617649 - DNA, 23 bp, Homo sapiens
catggaaaactgaaagctgacct

SEQ ID NO: 7617650 - DNA, 23 bp, Homo sapiens
catggaaaactgaaagctgacct

SEQ ID NO: 7617651 - DNA, 22 bp, Homo sapiens
catgggctcttctggactgcac

SEQ ID NO: 7617652 - DNA, 22 bp, Homo sapiens
catgggctcttctggactgcac

SEQ ID NO: 7617653 - DNA, 22 bp, Homo sapiens
catgggctctctgagctccagg

SEQ ID NO: 7617654 - DNA, 22 bp, Homo sapiens
catgggctcttctggactgcac

SEQ ID NO: 7617655 - DNA, 22 bp, Homo sapiens
catgggctcttctggactgcac

SEQ ID NO: 7617656 - DNA, 19 bp, Homo sapiens
catggtgaaaccccgtctc

SEQ ID NO: 7617657 - DNA, 19 bp, Homo sapiens
catggtgaaaccccgtctc

SEQ ID NO: 7617658 - DNA, 22 bp, Homo sapiens
catgtaaagcacttcataacag

SEQ ID NO: 7617659 - DNA, 22 bp, Homo sapiens
catgtaaagaatttcacacaag

SEQ ID NO: 7617660 - DNA, 22 bp, Homo sapiens
catgtaaagaatttcacacaag

SEQ ID NO: 7617661 - DNA, 22 bp, Homo sapiens
catgtaaagaatttcacacaag

SEQ ID NO: 7617662 - DNA, 22 bp, Homo sapiens
catgtaaagaatttcacacaag

SEQ ID NO: 7617663 - DNA, 22 bp, Homo sapiens
catgtaaagaatttcacacaag

SEQ ID NO: 7617664 - DNA, 22 bp, Homo sapiens
catgtaaagcacttcataacag

SEQ ID NO: 7617665 - DNA, 22 bp, Homo sapiens
catgtaaagcacttcataacag

SEQ ID NO: 7617666 - DNA, 22 bp, Homo sapiens
catgtaaagcatccttctaggg

SEQ ID NO: 7617667 - DNA, 22 bp, Homo sapiens
catgtaatcctggggagatgaa

SEQ ID NO: 7617668 - DNA, 22 bp, Homo sapiens
catgtacaaaaggcaaatgcct

SEQ ID NO: 7617669 - DNA, 22 bp, Homo sapiens
catgtacaaaaggcaaatgcct

SEQ ID NO: 7617670 - DNA, 22 bp, Homo sapiens
catgtaatcctggggagatgaa

SEQ ID NO: 7617671 - DNA, 22 bp, Homo sapiens
catgtaatgctgggagctgggc

SEQ ID NO: 7617672 - DNA, 22 bp, Homo sapiens
catgtacaaaaggcaaatgcct

SEQ ID NO: 7617673 - DNA, 22 bp, Homo sapiens
catgtacaaaaggcaaatgcct

SEQ ID NO: 7617674 - DNA, 22 bp, Homo sapiens
catgtaaaacactcagaacagt

SEQ ID NO: 7617675 - DNA, 22 bp, Homo sapiens
catgtaaaccattgtgagcatc

SEQ ID NO: 7617676 - DNA, 22 bp, Homo sapiens
catgtaaaccattgtgagcatc

SEQ ID NO: 7617677 - DNA, 22 bp, Homo sapiens
catgtaaaccattgtgagcatc

SEQ ID NO: 7617678 - DNA, 22 bp, Homo sapiens
catgtaaaccattgtgagcatc

SEQ ID NO: 7617679 - DNA, 22 bp, Homo sapiens
catgtaaaacactcagaacagt

SEQ ID NO: 7617680 - DNA, 22 bp, Homo sapiens
catgtaaaacactcagaacagt

SEQ ID NO: 7617681 - DNA, 22 bp, Homo sapiens
catgtaaaacactcagaacagt

SEQ ID NO: 7617682 - DNA, 22 bp, Homo sapiens
catgtaaaacactcagaacagt

SEQ ID NO: 7617683 - DNA, 22 bp, Homo sapiens
catgtaaaaagaagaatctgga

SEQ ID NO: 7617684 - DNA, 22 bp, Homo sapiens
catgtaaaaaattaggtcatct

SEQ ID NO: 7617685 - DNA, 22 bp, Homo sapiens
catgtaaaaaattaggtcatct

SEQ ID NO: 7617686 - DNA, 22 bp, Homo sapiens
catgtaaaaaattaggtcatct

SEQ ID NO: 7617687 - DNA, 22 bp, Homo sapiens
catgtaaaaaattaggtcatct

SEQ ID NO: 7617688 - DNA, 22 bp, Homo sapiens
catggtttttaccctacaccat

SEQ ID NO: 7617689 - DNA, 22 bp, Homo sapiens
catgtaaaaaattaggtcatct

SEQ ID NO: 7617690 - DNA, 22 bp, Homo sapiens
catgtaaaaaattaggtcatct

SEQ ID NO: 7617691 - DNA, 22 bp, Homo sapiens
catgtaaaaagaagaatctgga

SEQ ID NO: 7617692 - DNA, 22 bp, Homo sapiens
catgtaaaaagaagaatctgga

SEQ ID NO: 7617693 - DNA, 22 bp, Homo sapiens
cattacaaacatgttaagattt

SEQ ID NO: 7617694 - DNA, 22 bp, Homo sapiens
cattacaaacatgttaagattt

SEQ ID NO: 7617695 - DNA, 22 bp, Homo sapiens
cattacaaacatgttaagattt

SEQ ID NO: 7617696 - DNA, 22 bp, Homo sapiens
cattacaaacatgttaagattt

SEQ ID NO: 7617697 - DNA, 22 bp, Homo sapiens
cattaatttaatattcaaagaa

SEQ ID NO: 7617698 - DNA, 22 bp, Homo sapiens
cattacaaacatgttaagattt

SEQ ID NO: 7617699 - DNA, 22 bp, Homo sapiens
cattaatttaatattcaaagaa

SEQ ID NO: 7617700 - DNA, 22 bp, Homo sapiens
cattacaaacatgttaagattt

SEQ ID NO: 7617701 - DNA, 22 bp, Homo sapiens
cattacaaacatgttaagattt

SEQ ID NO: 7617702 - DNA, 22 bp, Homo sapiens
cattaattgtatttttcaaagt

SEQ ID NO: 7617703 - DNA, 22 bp, Homo sapiens
cattaattgtatttttcaaagt

SEQ ID NO: 7617704 - DNA, 22 bp, Homo sapiens
cattaatattgttcttctttag

SEQ ID NO: 7617705 - DNA, 22 bp, Homo sapiens
cattaatattgttcttctttag

SEQ ID NO: 7617706 - DNA, 22 bp, Homo sapiens
cattaatattgttcttctttag

SEQ ID NO: 7617707 - DNA, 22 bp, Homo sapiens
cattaatattgttcttctttag

SEQ ID NO: 7617708 - DNA, 22 bp, Homo sapiens
cattaatattgttcttctttag

SEQ ID NO: 7617709 - DNA, 22 bp, Homo sapiens
cattaataaacatttcagaaga

SEQ ID NO: 7617710 - DNA, 22 bp, Homo sapiens
cattaataaacatttcagaaga

SEQ ID NO: 7617711 - DNA, 22 bp, Homo sapiens
cattaataaacatttcagaaga

SEQ ID NO: 7617712 - DNA, 22 bp, Homo sapiens
cattacaaagttataaacagtt

SEQ ID NO: 7617713 - DNA, 22 bp, Homo sapiens
cattacaaagttataaacagtt

SEQ ID NO: 7617714 - DNA, 22 bp, Homo sapiens
cattacaaagttataaacagtt

SEQ ID NO: 7617715 - DNA, 22 bp, Homo sapiens
cattacaaagttataaacagtt

SEQ ID NO: 7617716 - DNA, 22 bp, Homo sapiens
cattacaaagttataaacagtt

SEQ ID NO: 7617717 - DNA, 22 bp, Homo sapiens
cattacaaagttataaacagtt

SEQ ID NO: 7617718 - DNA, 22 bp, Homo sapiens
cattacaaagttataaacagtt

SEQ ID NO: 7617719 - DNA, 22 bp, Homo sapiens
cattacaaagttataaacagtt

SEQ ID NO: 7617720 - DNA, 22 bp, Homo sapiens
cattacaacaatctgccatggc

SEQ ID NO: 7617721 - DNA, 19 bp, Homo sapiens
cattacaaatttgtaggga

SEQ ID NO: 7617722 - DNA, 19 bp, Homo sapiens
cattacaaatttgtaggga

SEQ ID NO: 7617723 - DNA, 19 bp, Homo sapiens
cattacaaatttgtaggga

SEQ ID NO: 7617724 - DNA, 22 bp, Homo sapiens
cattacaaccccaaattacaaa

SEQ ID NO: 7617725 - DNA, 22 bp, Homo sapiens
cattacaacaatctgccatggc

SEQ ID NO: 7617726 - DNA, 22 bp, Homo sapiens
cattacaaccccaaattacaaa

SEQ ID NO: 7617727 - DNA, 22 bp, Homo sapiens
cattacaaccccaaattacaaa

SEQ ID NO: 7617728 - DNA, 22 bp, Homo sapiens
cattacaaccccaaattacaaa

SEQ ID NO: 7617729 - DNA, 22 bp, Homo sapiens
cattacaaccccaaattacaaa

SEQ ID NO: 7617730 - DNA, 22 bp, Homo sapiens
cattacaaccccaaattacaaa

SEQ ID NO: 7617731 - DNA, 22 bp, Homo sapiens
cattacaaccccaaattacaaa

SEQ ID NO: 7617732 - DNA, 21 bp, Homo sapiens
cattacaagatttccaatttg

SEQ ID NO: 7617733 - DNA, 22 bp, Homo sapiens
cattacaaccccaaattacaaa

SEQ ID NO: 7617734 - DNA, 22 bp, Homo sapiens
cattacaaccccaaattacaaa

SEQ ID NO: 7617735 - DNA, 22 bp, Homo sapiens
cattacaaccccaaattacaaa

SEQ ID NO: 7617736 - DNA, 22 bp, Homo sapiens
cattacaaccccaaattacaaa

SEQ ID NO: 7617737 - DNA, 22 bp, Homo sapiens
cattacaaccccaaattacaaa

SEQ ID NO: 7617738 - DNA, 22 bp, Homo sapiens
tccagggcaggtgctgggctct

SEQ ID NO: 7617739 - DNA, 22 bp, Homo sapiens
tccagggcaggtgctgggctct

SEQ ID NO: 7617740 - DNA, 22 bp, Homo sapiens
tccagggcaggtgctgggctct

SEQ ID NO: 7617741 - DNA, 22 bp, Homo sapiens
tccagggcagggtgcgcatggg

SEQ ID NO: 7617742 - DNA, 22 bp, Homo sapiens
cattacagaatatgtaatgatc

SEQ ID NO: 7617743 - DNA, 21 bp, Homo sapiens
cattacaagatttccaatttg

SEQ ID NO: 7617744 - DNA, 22 bp, Homo sapiens
tccagggcagggtgcgcatggg

SEQ ID NO: 7617745 - DNA, 22 bp, Homo sapiens
tccagggcagtgactacagcgg

SEQ ID NO: 7617746 - DNA, 22 bp, Homo sapiens
tccagggcagtgactacagcgg

SEQ ID NO: 7617747 - DNA, 22 bp, Homo sapiens
tccagggcagtgactacagcgg

SEQ ID NO: 7617748 - DNA, 22 bp, Homo sapiens
tccagggcaggtgctgggctct

SEQ ID NO: 7617749 - DNA, 22 bp, Homo sapiens
tccagggcaggtgctgggctct

SEQ ID NO: 7617750 - DNA, 22 bp, Homo sapiens
tccagggcaggtgctgggctct

SEQ ID NO: 7617751 - DNA, 22 bp, Homo sapiens
tccagggcagtgactacagcgg

SEQ ID NO: 7617752 - DNA, 23 bp, Homo sapiens
tccagggcagtggctgggtctgc

SEQ ID NO: 7617753 - DNA, 23 bp, Homo sapiens
tccagggcagtggctgggtctgc

SEQ ID NO: 7617754 - DNA, 22 bp, Homo sapiens
tccagggcagtgactacagcgg

SEQ ID NO: 7617755 - DNA, 22 bp, Homo sapiens
tccagggcagtgactacagcgg

SEQ ID NO: 7617756 - DNA, 22 bp, Homo sapiens
tccaggtatctttatgaaactt

SEQ ID NO: 7617757 - DNA, 22 bp, Homo sapiens
tccaggtatctggcttccacat

SEQ ID NO: 7617758 - DNA, 22 bp, Homo sapiens
tccaggtagatttattccagcc

SEQ ID NO: 7617759 - DNA, 22 bp, Homo sapiens
tccaggtaggccaagacagcta

SEQ ID NO: 7617760 - DNA, 22 bp, Homo sapiens
tccaggtcccagactgggcagc

SEQ ID NO: 7617761 - DNA, 22 bp, Homo sapiens
tccaggtcccagactgggcagc

SEQ ID NO: 7617762 - DNA, 22 bp, Homo sapiens
tccaggtcccagactgggcagc

SEQ ID NO: 7617763 - DNA, 22 bp, Homo sapiens
tccaggtccagaggttcaactg

SEQ ID NO: 7617764 - DNA, 22 bp, Homo sapiens
tccaggtcatcttggagagctg

SEQ ID NO: 7617765 - DNA, 22 bp, Homo sapiens
tccaggtcatcttggagagctg

SEQ ID NO: 7617766 - DNA, 22 bp, Homo sapiens
tccaggtcagacttctgtgccc

SEQ ID NO: 7617767 - DNA, 22 bp, Homo sapiens
tccaggggtaccggccaggcag

SEQ ID NO: 7617768 - DNA, 22 bp, Homo sapiens
tccaggggctgtcttggaatct

SEQ ID NO: 7617769 - DNA, 19 bp, Homo sapiens
tccaggggctccacctcct

SEQ ID NO: 7617770 - DNA, 22 bp, Homo sapiens
tccaggggtaccggccaggcag

SEQ ID NO: 7617771 - DNA, 22 bp, Homo sapiens
tccaggggtgatttttgacttg

SEQ ID NO: 7617772 - DNA, 22 bp, Homo sapiens
tccaggggtgatttttgacttg

SEQ ID NO: 7617773 - DNA, 20 bp, Homo sapiens
tccagggtagatgaattctg

SEQ ID NO: 7617774 - DNA, 22 bp, Homo sapiens
tccagggttgtgggcttcagca

SEQ ID NO: 7617775 - DNA, 22 bp, Homo sapiens
tccagggttgtgggcttcagca

SEQ ID NO: 7617776 - DNA, 19 bp, Homo sapiens
tccagggtcattaacaatg

SEQ ID NO: 7617777 - DNA, 22 bp, Homo sapiens
tccagggttgtgggcttcagca

SEQ ID NO: 7617778 - DNA, 22 bp, Homo sapiens
tccagggtgtgtttactggggt

SEQ ID NO: 7617779 - DNA, 21 bp, Homo sapiens
tccagggtcagaagttcagtg

SEQ ID NO: 7617780 - DNA, 22 bp, Homo sapiens
tccagggtcagaagtcacatac

SEQ ID NO: 7617781 - DNA, 19 bp, Homo sapiens
tccaggggctccacctcct

SEQ ID NO: 7617782 - DNA, 19 bp, Homo sapiens
tccaggggctccacctcct

SEQ ID NO: 7617783 - DNA, 21 bp, Homo sapiens
tccaggggccagcacccaagc

SEQ ID NO: 7617784 - DNA, 21 bp, Homo sapiens
tccaggggccagcacccaagc

SEQ ID NO: 7617785 - DNA, 21 bp, Homo sapiens
tccaggggccagcacccaagc

SEQ ID NO: 7617786 - DNA, 22 bp, Homo sapiens
tccaggggagactagacccaca

SEQ ID NO: 7617787 - DNA, 22 bp, Homo sapiens
tccaggggagactagacccaca

SEQ ID NO: 7617788 - DNA, 22 bp, Homo sapiens
tccaggggagtgctacgcacag

SEQ ID NO: 7617789 - DNA, 22 bp, Homo sapiens
tccaggggagactagacccaca

SEQ ID NO: 7617790 - DNA, 22 bp, Homo sapiens
tccagggcatggggagagagtg

SEQ ID NO: 7617791 - DNA, 22 bp, Homo sapiens
tccagggcatggggagagagtg

SEQ ID NO: 7617792 - DNA, 22 bp, Homo sapiens
tccagggcatggggagagagtg

SEQ ID NO: 7617793 - DNA, 22 bp, Homo sapiens
tccagggcatggggagagagtg

SEQ ID NO: 7617794 - DNA, 22 bp, Homo sapiens
tccaggggacactgtttctcca

SEQ ID NO: 7617795 - DNA, 22 bp, Homo sapiens
tccaggggacactgtttctcca

SEQ ID NO: 7617796 - DNA, 22 bp, Homo sapiens
tccagggccaagtcatggaacc

SEQ ID NO: 7617797 - DNA, 22 bp, Homo sapiens
tccagggccaagtcatggaacc

SEQ ID NO: 7617798 - DNA, 22 bp, Homo sapiens
tccagggccaagtcatggaacc

SEQ ID NO: 7617799 - DNA, 22 bp, Homo sapiens
tccagggcatccacgcgtgggg

SEQ ID NO: 7617800 - DNA, 22 bp, Homo sapiens
tccagggcatccacgcgtgggg

SEQ ID NO: 7617801 - DNA, 23 bp, Homo sapiens
tccagggcagtggctgggtctgc

SEQ ID NO: 7617802 - DNA, 23 bp, Homo sapiens
tccagggcagtggctgggtctgc

SEQ ID NO: 7617803 - DNA, 22 bp, Homo sapiens
tccagggcatgctcagactcag

SEQ ID NO: 7617804 - DNA, 22 bp, Homo sapiens
tccagggcatgctcagactcag

SEQ ID NO: 7617805 - DNA, 22 bp, Homo sapiens
tccagggcatgctcagactcag

SEQ ID NO: 7617806 - DNA, 22 bp, Homo sapiens
tccagggcatccacgcgtgggg

SEQ ID NO: 7617807 - DNA, 22 bp, Homo sapiens
tccagggcatgctcagactcag

SEQ ID NO: 7617808 - DNA, 22 bp, Homo sapiens
tccagggcatggggagagagtg

SEQ ID NO: 7617809 - DNA, 22 bp, Homo sapiens
tccagggcatgctcagactcag

SEQ ID NO: 7617810 - DNA, 22 bp, Homo sapiens
tccagggcatgctcagactcag

SEQ ID NO: 7617811 - DNA, 22 bp, Homo sapiens
tccagggcatgctcagactcag

SEQ ID NO: 7617812 - DNA, 22 bp, Homo sapiens
catgttttgtgtacagaatatt

SEQ ID NO: 7617813 - DNA, 22 bp, Homo sapiens
catgttttgtgtacagaatatt

SEQ ID NO: 7617814 - DNA, 22 bp, Homo sapiens
catgttttgtgtacagaatatt

SEQ ID NO: 7617815 - DNA, 22 bp, Homo sapiens
catgttttgtgtacagaatatt

SEQ ID NO: 7617816 - DNA, 22 bp, Homo sapiens
catgttttctaggctttcacaa

SEQ ID NO: 7617817 - DNA, 22 bp, Homo sapiens
cattaagtatttcagttactgt

SEQ ID NO: 7617818 - DNA, 22 bp, Homo sapiens
cattaagtatttcagttactgt

SEQ ID NO: 7617819 - DNA, 22 bp, Homo sapiens
catgttttgtgtacagaatatt

SEQ ID NO: 7617820 - DNA, 22 bp, Homo sapiens
catgttttgtgtacagaatatt

SEQ ID NO: 7617821 - DNA, 22 bp, Homo sapiens
cattaagtatttcagttactgt

SEQ ID NO: 7617822 - DNA, 22 bp, Homo sapiens
cattaagtctgttaactggaga

SEQ ID NO: 7617823 - DNA, 22 bp, Homo sapiens
cattaataaacatttcagaaga

SEQ ID NO: 7617824 - DNA, 22 bp, Homo sapiens
cattaataaacatttcagaaga

SEQ ID NO: 7617825 - DNA, 22 bp, Homo sapiens
catgtgtattattcttgtggaa

SEQ ID NO: 7617826 - DNA, 17 bp, Homo sapiens
catgtgtatgtgggagt

SEQ ID NO: 7617827 - DNA, 22 bp, Homo sapiens
catgtgggacaatctcaggtat

SEQ ID NO: 7617828 - DNA, 22 bp, Homo sapiens
catgtgggaagaggccagctgg

SEQ ID NO: 7617829 - DNA, 22 bp, Homo sapiens
catgtggttcaagtactccaca

SEQ ID NO: 7617830 - DNA, 22 bp, Homo sapiens
catgtggtattgtgagatccac

SEQ ID NO: 7617831 - DNA, 22 bp, Homo sapiens
catgtggtctgcccggggatgt

SEQ ID NO: 7617832 - DNA, 22 bp, Homo sapiens
catgtgtacccttcctctgggg

SEQ ID NO: 7617833 - DNA, 22 bp, Homo sapiens
catgtgtaggtataacttgtga

SEQ ID NO: 7617834 - DNA, 22 bp, Homo sapiens
catgtgtaattgtaaaaggtaa

SEQ ID NO: 7617835 - DNA, 22 bp, Homo sapiens
catgtgtagtgaaataagcagt

SEQ ID NO: 7617836 - DNA, 22 bp, Homo sapiens
catgtgtatgcattcatacata

SEQ ID NO: 7617837 - DNA, 22 bp, Homo sapiens
catgtgccccgggtcccttggt

SEQ ID NO: 7617838 - DNA, 22 bp, Homo sapiens
catgtgctgtagcagagaggaa

SEQ ID NO: 7617839 - DNA, 22 bp, Homo sapiens
catgtgctgtagcagagaggaa

SEQ ID NO: 7617840 - DNA, 22 bp, Homo sapiens
tccaggctttttcatgctgtct

SEQ ID NO: 7617841 - DNA, 22 bp, Homo sapiens
tccaggctttttcatgctgtct

SEQ ID NO: 7617842 - DNA, 22 bp, Homo sapiens
tccaggctttttcatgctgtct

SEQ ID NO: 7617843 - DNA, 22 bp, Homo sapiens
catgtggcacaaagaaggaaat

SEQ ID NO: 7617844 - DNA, 22 bp, Homo sapiens
catgtggcacaaagaaggaaat

SEQ ID NO: 7617845 - DNA, 22 bp, Homo sapiens
catgtggcacaaagaaggaaat

SEQ ID NO: 7617846 - DNA, 22 bp, Homo sapiens
catgtggagaattaaaaaatac

SEQ ID NO: 7617847 - DNA, 22 bp, Homo sapiens
catgtggatggtctcctcatca

SEQ ID NO: 7617848 - DNA, 22 bp, Homo sapiens
catgtggctttggcatgtgccc

SEQ ID NO: 7617849 - DNA, 22 bp, Homo sapiens
catgtgggaagaggccagctgg

SEQ ID NO: 7617850 - DNA, 22 bp, Homo sapiens
catgtggctttggcatgtgccc

SEQ ID NO: 7617851 - DNA, 22 bp, Homo sapiens
catgtggctttggcatgtgccc

SEQ ID NO: 7617852 - DNA, 22 bp, Homo sapiens
catgtggctttggcatgtgccc

SEQ ID NO: 7617853 - DNA, 22 bp, Homo sapiens
tccaggctttggggcaggagcg

SEQ ID NO: 7617854 - DNA, 22 bp, Homo sapiens
tccaggctttttcatgctgtct

SEQ ID NO: 7617855 - DNA, 22 bp, Homo sapiens
tccaggctttggggcaggagcg

SEQ ID NO: 7617856 - DNA, 22 bp, Homo sapiens
tccaggctttggggcaggagcg

SEQ ID NO: 7617857 - DNA, 22 bp, Homo sapiens
tccaggctttggggcaggagcg

SEQ ID NO: 7617858 - DNA, 22 bp, Homo sapiens
tccaggcttgagaccaggctct

SEQ ID NO: 7617859 - DNA, 22 bp, Homo sapiens
tccaggctttggggcaggagcg

SEQ ID NO: 7617860 - DNA, 22 bp, Homo sapiens
tccaggctttggggcaggagcg

SEQ ID NO: 7617861 - DNA, 22 bp, Homo sapiens
tccaggcttgagaccaggctct

SEQ ID NO: 7617862 - DNA, 22 bp, Homo sapiens
tccaggcttgagaccaggctct

SEQ ID NO: 7617863 - DNA, 22 bp, Homo sapiens
tccaggcttgagaccaggctct

SEQ ID NO: 7617864 - DNA, 22 bp, Homo sapiens
tccaggcttgagaccaggctct

SEQ ID NO: 7617865 - DNA, 22 bp, Homo sapiens
tccaggcttgagaccaggctct

SEQ ID NO: 7617866 - DNA, 23 bp, Homo sapiens
catgtacacacagctgtacagtg

SEQ ID NO: 7617867 - DNA, 23 bp, Homo sapiens
catgtacacacagctgtacagtg

SEQ ID NO: 7617868 - DNA, 23 bp, Homo sapiens
catgtacacacagctgtacagtg

SEQ ID NO: 7617869 - DNA, 23 bp, Homo sapiens
catgtacacacagctgtacagtg

SEQ ID NO: 7617870 - DNA, 23 bp, Homo sapiens
catgtacacacagctgtacagtg

SEQ ID NO: 7617871 - DNA, 23 bp, Homo sapiens
catgtacacacagctgtacagtg

SEQ ID NO: 7617872 - DNA, 22 bp, Homo sapiens
catgtacacacaaagggacaat

SEQ ID NO: 7617873 - DNA, 22 bp, Homo sapiens
catgtacaaggatgctcagagt

SEQ ID NO: 7617874 - DNA, 22 bp, Homo sapiens
catgtacaaggatgctcagagt

SEQ ID NO: 7617875 - DNA, 22 bp, Homo sapiens
catgtacaaggatgctcagagt

SEQ ID NO: 7617876 - DNA, 22 bp, Homo sapiens
catgtacagccagggttgagaa

SEQ ID NO: 7617877 - DNA, 22 bp, Homo sapiens
catgtacagccagggttgagaa

SEQ ID NO: 7617878 - DNA, 23 bp, Homo sapiens
catgtacagagtttgataaagtg

SEQ ID NO: 7617879 - DNA, 23 bp, Homo sapiens
catgtacagagtttgataaagtg

SEQ ID NO: 7617880 - DNA, 22 bp, Homo sapiens
catgtacagccagggttgagaa

SEQ ID NO: 7617881 - DNA, 23 bp, Homo sapiens
catgtacagagtttgataaagtg

SEQ ID NO: 7617882 - DNA, 23 bp, Homo sapiens
catgtacagagtttgataaagtg

SEQ ID NO: 7617883 - DNA, 23 bp, Homo sapiens
catgtacagagtttgataaagtg

SEQ ID NO: 7617884 - DNA, 23 bp, Homo sapiens
catgtacagagtttgataaagtg

SEQ ID NO: 7617885 - DNA, 23 bp, Homo sapiens
catgtacagagtttgataaagtg

SEQ ID NO: 7617886 - DNA, 22 bp, Homo sapiens
catgtacactcatgtaactata

SEQ ID NO: 7617887 - DNA, 23 bp, Homo sapiens
catgtacagagtttgataaagtg

SEQ ID NO: 7617888 - DNA, 22 bp, Homo sapiens
catgtacactcatgtaactata

SEQ ID NO: 7617889 - DNA, 22 bp, Homo sapiens
catgtacactcatgtaactata

SEQ ID NO: 7617890 - DNA, 23 bp, Homo sapiens
catgtacacacagctgtacagtg

SEQ ID NO: 7617891 - DNA, 22 bp, Homo sapiens
catgtacactcatgtaactata

SEQ ID NO: 7617892 - DNA, 22 bp, Homo sapiens
catgtacactcatgtaactata

SEQ ID NO: 7617893 - DNA, 22 bp, Homo sapiens
catgtacactcatgtaactata

SEQ ID NO: 7617894 - DNA, 22 bp, Homo sapiens
tccaggcttgagaccaggctct

SEQ ID NO: 7617895 - DNA, 22 bp, Homo sapiens
tccaggcttgagaccaggctct

SEQ ID NO: 7617896 - DNA, 22 bp, Homo sapiens
tccaggcttgagaccaggctct

SEQ ID NO: 7617897 - DNA, 22 bp, Homo sapiens
tccaggcttgagaccaggctct

SEQ ID NO: 7617898 - DNA, 22 bp, Homo sapiens
tccaggcttcacgtctgccctc

SEQ ID NO: 7617899 - DNA, 22 bp, Homo sapiens
tccaggcttcacgtctgccctc

SEQ ID NO: 7617900 - DNA, 22 bp, Homo sapiens
tccaggcttcacgtctgccctc

SEQ ID NO: 7617901 - DNA, 22 bp, Homo sapiens
tccaggcttcacgtctgccctc

SEQ ID NO: 7617902 - DNA, 22 bp, Homo sapiens
tccaggcttcacgtctgccctc

SEQ ID NO: 7617903 - DNA, 22 bp, Homo sapiens
tccaggctgtgcgcaccgtgtg

SEQ ID NO: 7617904 - DNA, 22 bp, Homo sapiens
tccaggctgggctgaagggtgc

SEQ ID NO: 7617905 - DNA, 22 bp, Homo sapiens
tccaggctgtgcatgagtttag

SEQ ID NO: 7617906 - DNA, 22 bp, Homo sapiens
tccaggctgtgcgcaccgtgtg

SEQ ID NO: 7617907 - DNA, 22 bp, Homo sapiens
tccaggctgtgcgcaccgtgtg

SEQ ID NO: 7617908 - DNA, 22 bp, Homo sapiens
tccaggctgtgcgcaccgtgtg

SEQ ID NO: 7617909 - DNA, 22 bp, Homo sapiens
tccaggctgtgcgcaccgtgtg

SEQ ID NO: 7617910 - DNA, 22 bp, Homo sapiens
tccaggctgtgcgcaccgtgtg

SEQ ID NO: 7617911 - DNA, 22 bp, Homo sapiens
tccaggcttcacgtctgccctc

SEQ ID NO: 7617912 - DNA, 22 bp, Homo sapiens
tccaggcttcacgtctgccctc

SEQ ID NO: 7617913 - DNA, 22 bp, Homo sapiens
tccaggcttcacgtctgccctc

SEQ ID NO: 7617914 - DNA, 22 bp, Homo sapiens
tccaggcttcacgtctgccctc

SEQ ID NO: 7617915 - DNA, 22 bp, Homo sapiens
tccaggctgggctgaagggtgc

SEQ ID NO: 7617916 - DNA, 22 bp, Homo sapiens
tccaggctgtgcatgagtttag

SEQ ID NO: 7617917 - DNA, 22 bp, Homo sapiens
tccaggctgtgcatgagtttag

SEQ ID NO: 7617918 - DNA, 22 bp, Homo sapiens
tccaggctgtgcatgagtttag

SEQ ID NO: 7617919 - DNA, 22 bp, Homo sapiens
tccaggctcctgactttttggg

SEQ ID NO: 7617920 - DNA, 22 bp, Homo sapiens
tccaggctcctgactttttggg

SEQ ID NO: 7617921 - DNA, 22 bp, Homo sapiens
tccaggctcctgactttttggg

SEQ ID NO: 7617922 - DNA, 22 bp, Homo sapiens
tccaggctgggctgaagggtgc

SEQ ID NO: 7617923 - DNA, 20 bp, Homo sapiens
tccaggctcctccacttagt

SEQ ID NO: 7617924 - DNA, 22 bp, Homo sapiens
catgtacatgcatgggcactgt

SEQ ID NO: 7617925 - DNA, 22 bp, Homo sapiens
catgtacatgcatgggcactgt

SEQ ID NO: 7617926 - DNA, 22 bp, Homo sapiens
catgtacatgcatgggcactgt

SEQ ID NO: 7617927 - DNA, 22 bp, Homo sapiens
catgtacagtttttctgtcctg

SEQ ID NO: 7617928 - DNA, 22 bp, Homo sapiens
catgtacagtttttctgtcctg

SEQ ID NO: 7617929 - DNA, 22 bp, Homo sapiens
catgtacagtttttctgtcctg

SEQ ID NO: 7617930 - DNA, 22 bp, Homo sapiens
ttttggggagaacggttgctat

SEQ ID NO: 7617931 - DNA, 22 bp, Homo sapiens
ttttgggtgaatttgccagtta

SEQ ID NO: 7617932 - DNA, 22 bp, Homo sapiens
ttttggcttttcctcagcaagc

SEQ ID NO: 7617933 - DNA, 22 bp, Homo sapiens
ttttggcttaaagagaatgtat

SEQ ID NO: 7617934 - DNA, 22 bp, Homo sapiens
ttttggggagaacggttgctat

SEQ ID NO: 7617935 - DNA, 22 bp, Homo sapiens
ttttggtaaataatcaactttg

SEQ ID NO: 7617936 - DNA, 22 bp, Homo sapiens
ttttgggtggaagctgttatgg

SEQ ID NO: 7617937 - DNA, 22 bp, Homo sapiens
ttttgggtggaagctgttatgg

SEQ ID NO: 7617938 - DNA, 22 bp, Homo sapiens
ttttgggtgaatttgccagtta

SEQ ID NO: 7617939 - DNA, 22 bp, Homo sapiens
ttttgggtatagaggtgttcat

SEQ ID NO: 7617940 - DNA, 22 bp, Homo sapiens
ttttggctcttggtaggtcaga

SEQ ID NO: 7617941 - DNA, 22 bp, Homo sapiens
ttttggctgtagctggaaatct

SEQ ID NO: 7617942 - DNA, 22 bp, Homo sapiens
ttttggctgtagctggaaatct

SEQ ID NO: 7617943 - DNA, 22 bp, Homo sapiens
ttttggcttaaagagaatgtat

SEQ ID NO: 7617944 - DNA, 22 bp, Homo sapiens
ttttggctctgtctgtatcttt

SEQ ID NO: 7617945 - DNA, 22 bp, Homo sapiens
ttttggctctgtctgtatcttt

SEQ ID NO: 7617946 - DNA, 19 bp, Homo sapiens
ttttccttctatatgtttc

SEQ ID NO: 7617947 - DNA, 19 bp, Homo sapiens
ttttccttctatatgtttc

SEQ ID NO: 7617948 - DNA, 19 bp, Homo sapiens
ttttccttctatatgtttc

SEQ ID NO: 7617949 - DNA, 19 bp, Homo sapiens
ttttccttctatatgtttc

SEQ ID NO: 7617950 - DNA, 22 bp, Homo sapiens
ttttccttctagagcagatttc

SEQ ID NO: 7617951 - DNA, 19 bp, Homo sapiens
ttttccttctatatgtttc

SEQ ID NO: 7617952 - DNA, 19 bp, Homo sapiens
ttttccttctatatgtttc

SEQ ID NO: 7617953 - DNA, 19 bp, Homo sapiens
ttttccttctatatgtttc

SEQ ID NO: 7617954 - DNA, 19 bp, Homo sapiens
ttttccttctatatgtttc

SEQ ID NO: 7617955 - DNA, 19 bp, Homo sapiens
ttttccttctatatgtttc

SEQ ID NO: 7617956 - DNA, 19 bp, Homo sapiens
ttttccttctatatgtttc

SEQ ID NO: 7617957 - DNA, 19 bp, Homo sapiens
ttttccttctatatgtttc

SEQ ID NO: 7617958 - DNA, 19 bp, Homo sapiens
ttttccttctatatgtttc

SEQ ID NO: 7617959 - DNA, 18 bp, Homo sapiens
ttttccttccaccttgaa

SEQ ID NO: 7617960 - DNA, 18 bp, Homo sapiens
ttttccttccaccttgaa

SEQ ID NO: 7617961 - DNA, 18 bp, Homo sapiens
ttttccttccaccttgaa

SEQ ID NO: 7617962 - DNA, 18 bp, Homo sapiens
ttttccttccaccttgaa

SEQ ID NO: 7617963 - DNA, 18 bp, Homo sapiens
ttttccttccaccttgaa

SEQ ID NO: 7617964 - DNA, 18 bp, Homo sapiens
ttttccttccaccttgaa

SEQ ID NO: 7617965 - DNA, 22 bp, Homo sapiens
ttttccttctagagcagatttc

SEQ ID NO: 7617966 - DNA, 22 bp, Homo sapiens
ttttccttctagagcagatttc

SEQ ID NO: 7617967 - DNA, 22 bp, Homo sapiens
ttttccttctagagcagatttc

SEQ ID NO: 7617968 - DNA, 22 bp, Homo sapiens
ttttccttctagagcagatttc

SEQ ID NO: 7617969 - DNA, 22 bp, Homo sapiens
ttttccttctagagcagatttc

SEQ ID NO: 7617970 - DNA, 22 bp, Homo sapiens
ttttccttctagagcagatttc

SEQ ID NO: 7617971 - DNA, 22 bp, Homo sapiens
ttttccttctagagcagatttc

SEQ ID NO: 7617972 - DNA, 22 bp, Homo sapiens
ttttccttctagagcagatttc

SEQ ID NO: 7617973 - DNA, 22 bp, Homo sapiens
ttttggtctccaagccatgtgt

SEQ ID NO: 7617974 - DNA, 21 bp, Homo sapiens
ttttggtcctggcttaggagc

SEQ ID NO: 7617975 - DNA, 20 bp, Homo sapiens
ttttggtcttcagacaaggc

SEQ ID NO: 7617976 - DNA, 22 bp, Homo sapiens
ttttggtcagtgtactgggctg

SEQ ID NO: 7617977 - DNA, 22 bp, Homo sapiens
ttttggtagccaacaaaatgtt

SEQ ID NO: 7617978 - DNA, 22 bp, Homo sapiens
ttttggtaattaagtagatatt

SEQ ID NO: 7617979 - DNA, 22 bp, Homo sapiens
ttttggtaattaagtagatatt

SEQ ID NO: 7617980 - DNA, 22 bp, Homo sapiens
ttttggtaatgcctaacttcgt

SEQ ID NO: 7617981 - DNA, 22 bp, Homo sapiens
ttttggtacatgcaatagcaat

SEQ ID NO: 7617982 - DNA, 22 bp, Homo sapiens
ttttggtagaatgatattggat

SEQ ID NO: 7617983 - DNA, 22 bp, Homo sapiens
ttttggtagaatcaacaatgta

SEQ ID NO: 7617984 - DNA, 22 bp, Homo sapiens
ttttggtagaatcaacaatgta

SEQ ID NO: 7617985 - DNA, 20 bp, Homo sapiens
ttttggtgaattccagaata

SEQ ID NO: 7617986 - DNA, 20 bp, Homo sapiens
ttttggtgaattccagaata

SEQ ID NO: 7617987 - DNA, 22 bp, Homo sapiens
ttttggtgaatttaagtgctgt

SEQ ID NO: 7617988 - DNA, 16 bp, Homo sapiens
ttttggtgaccctgga

SEQ ID NO: 7617989 - DNA, 17 bp, Homo sapiens
ttttggtgaccttggcc

SEQ ID NO: 7617990 - DNA, 18 bp, Homo sapiens
ttttggtgaggaagtgag

SEQ ID NO: 7617991 - DNA, 18 bp, Homo sapiens
ttttggtgaggaagtgag

SEQ ID NO: 7617992 - DNA, 17 bp, Homo sapiens
ttttggtgagttgtttc

SEQ ID NO: 7617993 - DNA, 17 bp, Homo sapiens
ttttggtgagttgtttc

SEQ ID NO: 7617994 - DNA, 22 bp, Homo sapiens
ttttggtgattttactgaaggt

SEQ ID NO: 7617995 - DNA, 22 bp, Homo sapiens
ttttggtgattttactgaaggt

SEQ ID NO: 7617996 - DNA, 22 bp, Homo sapiens
ttttggtgattttactgaaggt

SEQ ID NO: 7617997 - DNA, 22 bp, Homo sapiens
ttttggttctgggatacagaga

SEQ ID NO: 7617998 - DNA, 22 bp, Homo sapiens
ttttggttctgggatacagaga

SEQ ID NO: 7617999 - DNA, 22 bp, Homo sapiens
ttttggtgcacctagctttttc

SEQ ID NO: 7618000 - DNA, 22 bp, Homo sapiens
ttttggtgccctggttcccacc

SEQ ID NO: 7618001 - DNA, 22 bp, Homo sapiens
ttttgtaagaaactgccaagcc

SEQ ID NO: 7618002 - DNA, 22 bp, Homo sapiens
ttttgtaagaaactgccaagcc

SEQ ID NO: 7618003 - DNA, 22 bp, Homo sapiens
ttttggtttcccttcttatggt

SEQ ID NO: 7618004 - DNA, 22 bp, Homo sapiens
ttttggtttcccttcttatggt

SEQ ID NO: 7618005 - DNA, 22 bp, Homo sapiens
ttttggttgttgggtaagagta

SEQ ID NO: 7618006 - DNA, 22 bp, Homo sapiens
ttttggtttcccttcttatggt

SEQ ID NO: 7618007 - DNA, 22 bp, Homo sapiens
ttttggtggtgggcttggcagc

SEQ ID NO: 7618008 - DNA, 22 bp, Homo sapiens
ttttggtttcccttcttatggt

SEQ ID NO: 7618009 - DNA, 21 bp, Homo sapiens
ttttcccactgaaagctccca

SEQ ID NO: 7618010 - DNA, 21 bp, Homo sapiens
ttttcccactgaaagctccca

SEQ ID NO: 7618011 - DNA, 21 bp, Homo sapiens
ttttcccactgaaagctccca

SEQ ID NO: 7618012 - DNA, 22 bp, Homo sapiens
ttttcccagagctgtcctcaag

SEQ ID NO: 7618013 - DNA, 22 bp, Homo sapiens
ttttcccagagctgtcctcaag

SEQ ID NO: 7618014 - DNA, 22 bp, Homo sapiens
ttttccagattggacttagtcc

SEQ ID NO: 7618015 - DNA, 22 bp, Homo sapiens
ttttccagattggacttagtcc

SEQ ID NO: 7618016 - DNA, 19 bp, Homo sapiens
ttttcccaccctttagaat

SEQ ID NO: 7618017 - DNA, 19 bp, Homo sapiens
ttttcccaccctttagaat

SEQ ID NO: 7618018 - DNA, 22 bp, Homo sapiens
ttttccagcataggtacatata

SEQ ID NO: 7618019 - DNA, 22 bp, Homo sapiens
ttttccagcataggtacatata

SEQ ID NO: 7618020 - DNA, 22 bp, Homo sapiens
ttttccagatggatactagaat

SEQ ID NO: 7618021 - DNA, 22 bp, Homo sapiens
ttttccagatggatactagaat

SEQ ID NO: 7618022 - DNA, 22 bp, Homo sapiens
ttttccagatggatactagaat

SEQ ID NO: 7618023 - DNA, 22 bp, Homo sapiens
ttttccagatggatactagaat

SEQ ID NO: 7618024 - DNA, 22 bp, Homo sapiens
ttttccagagctgtctcttgca

SEQ ID NO: 7618025 - DNA, 22 bp, Homo sapiens
ttttccagatgaattccacagt

SEQ ID NO: 7618026 - DNA, 22 bp, Homo sapiens
ttttccagatgaattccacagt

SEQ ID NO: 7618027 - DNA, 23 bp, Homo sapiens
ttttccagaatcgactctgtaga

SEQ ID NO: 7618028 - DNA, 22 bp, Homo sapiens
ttttccagagctgtctcttgca

SEQ ID NO: 7618029 - DNA, 23 bp, Homo sapiens
ttttccagaatcgactctgtaga

SEQ ID NO: 7618030 - DNA, 23 bp, Homo sapiens
ttttccagaatcgactctgtaga

SEQ ID NO: 7618031 - DNA, 22 bp, Homo sapiens
ttttcctactgataaacagtta

SEQ ID NO: 7618032 - DNA, 22 bp, Homo sapiens
ttttcctactgataaacagtta

SEQ ID NO: 7618033 - DNA, 22 bp, Homo sapiens
ttttcctagtaggcctattaga

SEQ ID NO: 7618034 - DNA, 22 bp, Homo sapiens
ttttcctagtaggcctattaga

SEQ ID NO: 7618035 - DNA, 22 bp, Homo sapiens
ttttcctagtaggcctattaga

SEQ ID NO: 7618036 - DNA, 22 bp, Homo sapiens
ttttcccatctacaaagcaggg

SEQ ID NO: 7618037 - DNA, 22 bp, Homo sapiens
ttttcctactgataaacagtta

SEQ ID NO: 7618038 - DNA, 22 bp, Homo sapiens
ttttcccatctacaaagcaggg

SEQ ID NO: 7618039 - DNA, 22 bp, Homo sapiens
ttttcccatctacaaagcaggg

SEQ ID NO: 7618040 - DNA, 22 bp, Homo sapiens
ttttcccatctacaaagcaggg

SEQ ID NO: 7618041 - DNA, 22 bp, Homo sapiens
ttttcctatatgcaaagaatgc

SEQ ID NO: 7618042 - DNA, 22 bp, Homo sapiens
ttttcctatatgcaaagaatgc

SEQ ID NO: 7618043 - DNA, 22 bp, Homo sapiens
ttttcctatatgcaaagaatgc

SEQ ID NO: 7618044 - DNA, 22 bp, Homo sapiens
ttttcctcaggaatgctaagct

SEQ ID NO: 7618045 - DNA, 22 bp, Homo sapiens
ttttcctcacctaactcaaggt

SEQ ID NO: 7618046 - DNA, 22 bp, Homo sapiens
ttttcctcacctaactcaaggt

SEQ ID NO: 7618047 - DNA, 22 bp, Homo sapiens
ttttccttcatatcccttatgt

SEQ ID NO: 7618048 - DNA, 22 bp, Homo sapiens
ttttccttcatatcccttatgt

SEQ ID NO: 7618049 - DNA, 22 bp, Homo sapiens
ttttccttcatatcccttatgt

SEQ ID NO: 7618050 - DNA, 22 bp, Homo sapiens
ttttccttcatatcccttatgt

SEQ ID NO: 7618051 - DNA, 22 bp, Homo sapiens
ttttccttcatatcccttatgt

SEQ ID NO: 7618052 - DNA, 22 bp, Homo sapiens
ttttccttcacctcttgagcct

SEQ ID NO: 7618053 - DNA, 22 bp, Homo sapiens
ttttccttcacctcttgagcct

SEQ ID NO: 7618054 - DNA, 22 bp, Homo sapiens
ttttccttcacctcttgagcct

SEQ ID NO: 7618055 - DNA, 22 bp, Homo sapiens
ttttccttcacctcttgagcct

SEQ ID NO: 7618056 - DNA, 22 bp, Homo sapiens
ttttccttcacctcttgagcct

SEQ ID NO: 7618057 - DNA, 22 bp, Homo sapiens
ttttccttagcttctctgcgag

SEQ ID NO: 7618058 - DNA, 22 bp, Homo sapiens
ttttccttaacagagggagaaa

SEQ ID NO: 7618059 - DNA, 22 bp, Homo sapiens
ttttccttagcttctctgcgag

SEQ ID NO: 7618060 - DNA, 22 bp, Homo sapiens
ttttccttaacagagggagaaa

SEQ ID NO: 7618061 - DNA, 22 bp, Homo sapiens
ttttcctctgtatgcgtgagat

SEQ ID NO: 7618062 - DNA, 22 bp, Homo sapiens
ttttccttaacagagggagaaa

SEQ ID NO: 7618063 - DNA, 22 bp, Homo sapiens
ttttccttaacagagggagaaa

SEQ ID NO: 7618064 - DNA, 22 bp, Homo sapiens
ttttccttcacctcttgagcct

SEQ ID NO: 7618065 - DNA, 22 bp, Homo sapiens
ttttccttcacctcttgagcct

SEQ ID NO: 7618066 - DNA, 22 bp, Homo sapiens
ttttccttagcttctctgcgag

SEQ ID NO: 7618067 - DNA, 22 bp, Homo sapiens
ttttccttagcttctctgcgag

SEQ ID NO: 7618068 - DNA, 22 bp, Homo sapiens
ttttccttagcttctctgcgag

SEQ ID NO: 7618069 - DNA, 20 bp, Homo sapiens
ttttcctcgtgtttgttcta

SEQ ID NO: 7618070 - DNA, 20 bp, Homo sapiens
ttttcctcgtgtttgttcta

SEQ ID NO: 7618071 - DNA, 22 bp, Homo sapiens
ttttcctcaggaatgctaagct

SEQ ID NO: 7618072 - DNA, 22 bp, Homo sapiens
ttttcctcaggaatgctaagct

SEQ ID NO: 7618073 - DNA, 20 bp, Homo sapiens
ttttcctcgtgtttgttcta

SEQ ID NO: 7618074 - DNA, 20 bp, Homo sapiens
ttttcctcgtgtttgttcta

SEQ ID NO: 7618075 - DNA, 22 bp, Homo sapiens
ttttcctctgagctttgaataa

SEQ ID NO: 7618076 - DNA, 22 bp, Homo sapiens
ttttcctctgagctttgaataa

SEQ ID NO: 7618077 - DNA, 22 bp, Homo sapiens
ttttcctctgagctttgaataa

SEQ ID NO: 7618078 - DNA, 22 bp, Homo sapiens
ttttcctctgagctttgaataa

SEQ ID NO: 7618079 - DNA, 22 bp, Homo sapiens
ttttcctctgagctttgaataa

SEQ ID NO: 7618080 - DNA, 22 bp, Homo sapiens
ttttcctctgagctttgaataa

SEQ ID NO: 7618081 - DNA, 22 bp, Homo sapiens
ttttcctctgcaataaaagcag

SEQ ID NO: 7618082 - DNA, 22 bp, Homo sapiens
ttttcctctgcaataaaagcag

SEQ ID NO: 7618083 - DNA, 22 bp, Homo sapiens
ttttcctctgcagagcagttag

SEQ ID NO: 7618084 - DNA, 22 bp, Homo sapiens
ttttcctctgcagagcagttag

SEQ ID NO: 7618085 - DNA, 22 bp, Homo sapiens
ttttcctctgcagagcagttag

SEQ ID NO: 7618086 - DNA, 22 bp, Homo sapiens
ttttcctctgtatgcgtgagat

SEQ ID NO: 7618087 - DNA, 22 bp, Homo sapiens
ttttcctctgcagagcagttag

SEQ ID NO: 7618088 - DNA, 22 bp, Homo sapiens
ttttcctctgtatgcgtgagat

SEQ ID NO: 7618089 - DNA, 22 bp, Homo sapiens
ttttgtgagatgcgtatgaatg

SEQ ID NO: 7618090 - DNA, 22 bp, Homo sapiens
ttttgtgagatgcgtatgaatg

SEQ ID NO: 7618091 - DNA, 22 bp, Homo sapiens
ttttgtgacagaaagattaagt

SEQ ID NO: 7618092 - DNA, 22 bp, Homo sapiens
ttttgtgaatagtttatctaag

SEQ ID NO: 7618093 - DNA, 19 bp, Homo sapiens
ttttgtcttcccttagttt

SEQ ID NO: 7618094 - DNA, 22 bp, Homo sapiens
ttttgtgaatagtttatctaag

SEQ ID NO: 7618095 - DNA, 22 bp, Homo sapiens
ttttgtgacacttcttgagaca

SEQ ID NO: 7618096 - DNA, 22 bp, Homo sapiens
ttttgtgaatagtttatctaag

SEQ ID NO: 7618097 - DNA, 22 bp, Homo sapiens
ttttgtctaagaactttgcaaa

SEQ ID NO: 7618098 - DNA, 22 bp, Homo sapiens
ttttgtctaagaactttgcaaa

SEQ ID NO: 7618099 - DNA, 22 bp, Homo sapiens
ttttgtctaagaactttgcaaa

SEQ ID NO: 7618100 - DNA, 22 bp, Homo sapiens
ttttgtcagtgagaacagagtt

SEQ ID NO: 7618101 - DNA, 19 bp, Homo sapiens
ttttgtcttcccttagttt

SEQ ID NO: 7618102 - DNA, 19 bp, Homo sapiens
ttttgtcttcccttagttt

SEQ ID NO: 7618103 - DNA, 22 bp, Homo sapiens
ttttgtctaagaactttgcaaa

SEQ ID NO: 7618104 - DNA, 22 bp, Homo sapiens
ttttgtctaagaactttgcaaa

SEQ ID NO: 7618105 - DNA, 22 bp, Homo sapiens
ttttgtctaagaactttgcaaa

SEQ ID NO: 7618106 - DNA, 22 bp, Homo sapiens
ttttgtctaagaactttgcaaa

SEQ ID NO: 7618107 - DNA, 22 bp, Homo sapiens
ttttgtaatttcctgacgacta

SEQ ID NO: 7618108 - DNA, 22 bp, Homo sapiens
ttttgtatagtcaaagacaaga

SEQ ID NO: 7618109 - DNA, 22 bp, Homo sapiens
ttttgtatagtcaaagacaaga

SEQ ID NO: 7618110 - DNA, 22 bp, Homo sapiens
ttttgtatagtcaaagacaaga

SEQ ID NO: 7618111 - DNA, 22 bp, Homo sapiens
ttttgtaatttcctgacgacta

SEQ ID NO: 7618112 - DNA, 22 bp, Homo sapiens
ttttgtaatttcctgacgacta

SEQ ID NO: 7618113 - DNA, 22 bp, Homo sapiens
ttttgtaagaaactgccaagcc

SEQ ID NO: 7618114 - DNA, 22 bp, Homo sapiens
ttttgtaagaaactgccaagcc

SEQ ID NO: 7618115 - DNA, 22 bp, Homo sapiens
ttttgtatgagaagtgctttac

SEQ ID NO: 7618116 - DNA, 22 bp, Homo sapiens
ttttgtcacctgatttgcccac

SEQ ID NO: 7618117 - DNA, 22 bp, Homo sapiens
ttttgtcacctgatttgcccac

SEQ ID NO: 7618118 - DNA, 22 bp, Homo sapiens
ttttgtatgagaagtgctttac

SEQ ID NO: 7618119 - DNA, 22 bp, Homo sapiens
ttttgtatgagaagtgctttac

SEQ ID NO: 7618120 - DNA, 22 bp, Homo sapiens
ttttgtatgagaagtgctttac

SEQ ID NO: 7618121 - DNA, 22 bp, Homo sapiens
ttttgtatgagaagtgctttac

SEQ ID NO: 7618122 - DNA, 22 bp, Homo sapiens
ttttgtgagctgagaaatgtat

SEQ ID NO: 7618123 - DNA, 22 bp, Homo sapiens
ttttgtgagctccttggaggta

SEQ ID NO: 7618124 - DNA, 22 bp, Homo sapiens
ttttgtgagcccataaatgcca

SEQ ID NO: 7618125 - DNA, 22 bp, Homo sapiens
ttttgtgatggcattacattta

SEQ ID NO: 7618126 - DNA, 19 bp, Homo sapiens
ttttgtgtagctgctggtt

SEQ ID NO: 7618127 - DNA, 22 bp, Homo sapiens
ttttgtgagctgagaaatgtat

SEQ ID NO: 7618128 - DNA, 22 bp, Homo sapiens
ttttgtgtgtggtgatacaaag

SEQ ID NO: 7618129 - DNA, 22 bp, Homo sapiens
ttttgtgttgccatgttaagca

SEQ ID NO: 7618130 - DNA, 22 bp, Homo sapiens
ttttgtgttgccatgttaagca

SEQ ID NO: 7618131 - DNA, 23 bp, Homo sapiens
ttttgtgtgacttaatatctctt

SEQ ID NO: 7618132 - DNA, 22 bp, Homo sapiens
ttttgtgtccttcacatcatgt

SEQ ID NO: 7618133 - DNA, 22 bp, Homo sapiens
ttttgtgtccttcacatcatgt

SEQ ID NO: 7618134 - DNA, 22 bp, Homo sapiens
tttttgtatagaaatgaactaa

SEQ ID NO: 7618135 - DNA, 22 bp, Homo sapiens
tttttgtatagaaatgaactaa

SEQ ID NO: 7618136 - DNA, 22 bp, Homo sapiens
tttttgtatagaaatgaactaa

SEQ ID NO: 7618137 - DNA, 22 bp, Homo sapiens
tttttgtatagaaatgaactaa

SEQ ID NO: 7618138 - DNA, 22 bp, Homo sapiens
tttttgtatagaaatgaactaa

SEQ ID NO: 7618139 - DNA, 22 bp, Homo sapiens
tttttgtatagaaatgaactaa

SEQ ID NO: 7618140 - DNA, 22 bp, Homo sapiens
tttttgtagtcattagaagagg

SEQ ID NO: 7618141 - DNA, 22 bp, Homo sapiens
tttttgtagtcattagaagagg

SEQ ID NO: 7618142 - DNA, 22 bp, Homo sapiens
tttttgtagtcattagaagagg

SEQ ID NO: 7618143 - DNA, 22 bp, Homo sapiens
tttttgtagtcattagaagagg

SEQ ID NO: 7618144 - DNA, 17 bp, Homo sapiens
ttttgttcatcttcaaa

SEQ ID NO: 7618145 - DNA, 17 bp, Homo sapiens
ttttgttcatcttcaaa

SEQ ID NO: 7618146 - DNA, 17 bp, Homo sapiens
ttttgttcatcttcaaa

SEQ ID NO: 7618147 - DNA, 22 bp, Homo sapiens
ttttgtgttgtaatgtcagcta

SEQ ID NO: 7618148 - DNA, 22 bp, Homo sapiens
ttttgtgttgtaatgtcagcta

SEQ ID NO: 7618149 - DNA, 22 bp, Homo sapiens
tttttgtagtcattagaagagg

SEQ ID NO: 7618150 - DNA, 22 bp, Homo sapiens
ttttgttgacctctcccacctt

SEQ ID NO: 7618151 - DNA, 22 bp, Homo sapiens
ttttttagttaggtcagaatgt

SEQ ID NO: 7618152 - DNA, 22 bp, Homo sapiens
ttttttagttaggtcagaatgt

SEQ ID NO: 7618153 - DNA, 22 bp, Homo sapiens
ttttttagttaggtcagaatgt

SEQ ID NO: 7618154 - DNA, 22 bp, Homo sapiens
ttttttatagcaatgaacccac

SEQ ID NO: 7618155 - DNA, 22 bp, Homo sapiens
ttttttatagcaatgaacccac

SEQ ID NO: 7618156 - DNA, 22 bp, Homo sapiens
ttttttatagcaatgaacccac

SEQ ID NO: 7618157 - DNA, 22 bp, Homo sapiens
ttttttatagcaatgaacccac

SEQ ID NO: 7618158 - DNA, 22 bp, Homo sapiens
ttttttatatcaactgaagtct

SEQ ID NO: 7618159 - DNA, 22 bp, Homo sapiens
ttttttatatcaactgaagtct

SEQ ID NO: 7618160 - DNA, 22 bp, Homo sapiens
ttttttatatcaactgaagtct

SEQ ID NO: 7618161 - DNA, 22 bp, Homo sapiens
ttttttatatcaactgaagtct

SEQ ID NO: 7618162 - DNA, 22 bp, Homo sapiens
ttttttatatcaactgaagtct

SEQ ID NO: 7618163 - DNA, 22 bp, Homo sapiens
ttttttatatcaactgaagtct

SEQ ID NO: 7618164 - DNA, 22 bp, Homo sapiens
ttttttatatcaactgaagtct

SEQ ID NO: 7618165 - DNA, 22 bp, Homo sapiens
ttttttatatcaactgaagtct

SEQ ID NO: 7618166 - DNA, 22 bp, Homo sapiens
ttttttatctatggtagtacca

SEQ ID NO: 7618167 - DNA, 22 bp, Homo sapiens
ttttttatctatggtagtacca

SEQ ID NO: 7618168 - DNA, 22 bp, Homo sapiens
ttttttatctatggtagtacca

SEQ ID NO: 7618169 - DNA, 22 bp, Homo sapiens
ttttttatctatggtagtacca

SEQ ID NO: 7618170 - DNA, 22 bp, Homo sapiens
ttttttatctatggtagtacca

SEQ ID NO: 7618171 - DNA, 22 bp, Homo sapiens
ttttttatctatggtagtacca

SEQ ID NO: 7618172 - DNA, 22 bp, Homo sapiens
ttttttatctatggtagtacca

SEQ ID NO: 7618173 - DNA, 22 bp, Homo sapiens
ttttttatctatggtagtacca

SEQ ID NO: 7618174 - DNA, 22 bp, Homo sapiens
ttttttccagcttctagaggcc

SEQ ID NO: 7618175 - DNA, 22 bp, Homo sapiens
ttttttccaacttaagacttca

SEQ ID NO: 7618176 - DNA, 22 bp, Homo sapiens
ttttttccagcttctagaggcc

SEQ ID NO: 7618177 - DNA, 22 bp, Homo sapiens
ttttttccaacttaagacttca

SEQ ID NO: 7618178 - DNA, 22 bp, Homo sapiens
ttttttccaacttaagacttca

SEQ ID NO: 7618179 - DNA, 22 bp, Homo sapiens
ttttttccaacttaagacttca

SEQ ID NO: 7618180 - DNA, 22 bp, Homo sapiens
ttttttccaacttaagacttca

SEQ ID NO: 7618181 - DNA, 22 bp, Homo sapiens
ttttttcagcctgtctgtgcca

SEQ ID NO: 7618182 - DNA, 22 bp, Homo sapiens
ttttttcagcctgtctgtgcca

SEQ ID NO: 7618183 - DNA, 22 bp, Homo sapiens
ttttttcagcctgtctgtgcca

SEQ ID NO: 7618184 - DNA, 22 bp, Homo sapiens
ttttttcagcctgtctgtgcca

SEQ ID NO: 7618185 - DNA, 22 bp, Homo sapiens
ttttttcagcctgtctgtgcca

SEQ ID NO: 7618186 - DNA, 22 bp, Homo sapiens
ttttttcagcctgtctgtgcca

SEQ ID NO: 7618187 - DNA, 22 bp, Homo sapiens
tttttgttctgattatactggt

SEQ ID NO: 7618188 - DNA, 22 bp, Homo sapiens
tttttgttctgattatactggt

SEQ ID NO: 7618189 - DNA, 22 bp, Homo sapiens
tttttgttcccagagaatttgt

SEQ ID NO: 7618190 - DNA, 22 bp, Homo sapiens
tttttgttcccagagaatttgt

SEQ ID NO: 7618191 - DNA, 22 bp, Homo sapiens
tttttgtgtgagcagggtgtta

SEQ ID NO: 7618192 - DNA, 22 bp, Homo sapiens
tttttgtgtgagcagggtgtta

SEQ ID NO: 7618193 - DNA, 22 bp, Homo sapiens
tttttgttcccagagaatttgt

SEQ ID NO: 7618194 - DNA, 22 bp, Homo sapiens
tttttgttcccagagaatttgt

SEQ ID NO: 7618195 - DNA, 22 bp, Homo sapiens
tttttgttcccagagaatttgt

SEQ ID NO: 7618196 - DNA, 22 bp, Homo sapiens
tttttgttcccagagaatttgt

SEQ ID NO: 7618197 - DNA, 22 bp, Homo sapiens
tttttgttcccagagaatttgt

SEQ ID NO: 7618198 - DNA, 22 bp, Homo sapiens
tttttgttcccagagaatttgt

SEQ ID NO: 7618199 - DNA, 22 bp, Homo sapiens
tttttgttctgattatactggt

SEQ ID NO: 7618200 - DNA, 22 bp, Homo sapiens
tttttgttctgattatactggt

SEQ ID NO: 7618201 - DNA, 22 bp, Homo sapiens
tttttgttctgattatactggt

SEQ ID NO: 7618202 - DNA, 22 bp, Homo sapiens
tttttgttctgattatactggt

SEQ ID NO: 7618203 - DNA, 22 bp, Homo sapiens
tttttgttgcagagaggccact

SEQ ID NO: 7618204 - DNA, 22 bp, Homo sapiens
tttttgttgcagagaggccact

SEQ ID NO: 7618205 - DNA, 22 bp, Homo sapiens
ttttttacagaatcattaatca

SEQ ID NO: 7618206 - DNA, 22 bp, Homo sapiens
ttttttacagaatcattaatca

SEQ ID NO: 7618207 - DNA, 22 bp, Homo sapiens
ttttttacagaatcattaatca

SEQ ID NO: 7618208 - DNA, 22 bp, Homo sapiens
tttttgtctattcactgattca

SEQ ID NO: 7618209 - DNA, 22 bp, Homo sapiens
tttttgtctattcactgattca

SEQ ID NO: 7618210 - DNA, 22 bp, Homo sapiens
tttttgtgaaatctccagacat

SEQ ID NO: 7618211 - DNA, 22 bp, Homo sapiens
tttttgtctagcgtctctagtt

SEQ ID NO: 7618212 - DNA, 22 bp, Homo sapiens
tttttgtctagcgtctctagtt

SEQ ID NO: 7618213 - DNA, 22 bp, Homo sapiens
tttttgtctagcgtctctagtt

SEQ ID NO: 7618214 - DNA, 22 bp, Homo sapiens
tttttgtctagcgtctctagtt

SEQ ID NO: 7618215 - DNA, 22 bp, Homo sapiens
tttttgtcatctatttctggtg

SEQ ID NO: 7618216 - DNA, 22 bp, Homo sapiens
tttttgtcatctatttctggtg

SEQ ID NO: 7618217 - DNA, 22 bp, Homo sapiens
tttttgtcatctatttctggtg

SEQ ID NO: 7618218 - DNA, 22 bp, Homo sapiens
tttttgtatagaaatgaactaa

SEQ ID NO: 7618219 - DNA, 22 bp, Homo sapiens
tttttgtggtatattgcaacaa

SEQ ID NO: 7618220 - DNA, 22 bp, Homo sapiens
tttttgtggtgcagactaaagc

SEQ ID NO: 7618221 - DNA, 22 bp, Homo sapiens
tttttgtggtgcagactaaagc

SEQ ID NO: 7618222 - DNA, 22 bp, Homo sapiens
tttttgtggtgcagactaaagc

SEQ ID NO: 7618223 - DNA, 22 bp, Homo sapiens
tttttgtgatatgacactgtat

SEQ ID NO: 7618224 - DNA, 22 bp, Homo sapiens
tttttgtggtatattgcaacaa

SEQ ID NO: 7618225 - DNA, 22 bp, Homo sapiens
tttttgtgaaatctccagacat

SEQ ID NO: 7618226 - DNA, 22 bp, Homo sapiens
tttttgtgatatgacactgtat

SEQ ID NO: 7618227 - DNA, 22 bp, Homo sapiens
tttttgtgtatcctgctccatg

SEQ ID NO: 7618228 - DNA, 22 bp, Homo sapiens
tttttgtgtatcctgctccatg

SEQ ID NO: 7618229 - DNA, 22 bp, Homo sapiens
tttttgtgtatcctgctccatg

SEQ ID NO: 7618230 - DNA, 22 bp, Homo sapiens
tttttgtggtgcagactaaagc

SEQ ID NO: 7618231 - DNA, 22 bp, Homo sapiens
tttttgtggtgtgagtggacat

SEQ ID NO: 7618232 - DNA, 22 bp, Homo sapiens
tttttgtggtgtgagtggacat

SEQ ID NO: 7618233 - DNA, 22 bp, Homo sapiens
ttttattgggagtcctctactg

SEQ ID NO: 7618234 - DNA, 22 bp, Homo sapiens
ttttattgggagtcctctactg

SEQ ID NO: 7618235 - DNA, 22 bp, Homo sapiens
ttttattgggagtcctctactg

SEQ ID NO: 7618236 - DNA, 22 bp, Homo sapiens
ttttattgggagtcctctactg

SEQ ID NO: 7618237 - DNA, 22 bp, Homo sapiens
ttttattgggagtcctctactg

SEQ ID NO: 7618238 - DNA, 22 bp, Homo sapiens
ttttattgggagtcctctactg

SEQ ID NO: 7618239 - DNA, 22 bp, Homo sapiens
ttttattgggagtcctctactg

SEQ ID NO: 7618240 - DNA, 22 bp, Homo sapiens
ttttattgggagtcctctactg

SEQ ID NO: 7618241 - DNA, 22 bp, Homo sapiens
ttttattgggagtcctctactg

SEQ ID NO: 7618242 - DNA, 22 bp, Homo sapiens
ttttattgggagtcctctactg

SEQ ID NO: 7618243 - DNA, 22 bp, Homo sapiens
ttttagaagtgcctatcctatg

SEQ ID NO: 7618244 - DNA, 22 bp, Homo sapiens
ttttagaagtgcctatcctatg

SEQ ID NO: 7618245 - DNA, 22 bp, Homo sapiens
ttttagaagtgcctatcctatg

SEQ ID NO: 7618246 - DNA, 22 bp, Homo sapiens
ttttagaagtgcctatcctatg

SEQ ID NO: 7618247 - DNA, 22 bp, Homo sapiens
ttttagaagtgcctatcctatg

SEQ ID NO: 7618248 - DNA, 22 bp, Homo sapiens
ttttagaagtgcctatcctatg

SEQ ID NO: 7618249 - DNA, 22 bp, Homo sapiens
ttttagaagtgcctatcctatg

SEQ ID NO: 7618250 - DNA, 22 bp, Homo sapiens
ttttagaagtgcctatcctatg

SEQ ID NO: 7618251 - DNA, 22 bp, Homo sapiens
ttttagaagtgcctatcctatg

SEQ ID NO: 7618252 - DNA, 22 bp, Homo sapiens
ttttattggtaatgataaaagt

SEQ ID NO: 7618253 - DNA, 22 bp, Homo sapiens
ttttattggtaatgataaaagt

SEQ ID NO: 7618254 - DNA, 22 bp, Homo sapiens
ttttattggtaatgataaaagt

SEQ ID NO: 7618255 - DNA, 22 bp, Homo sapiens
ttttattggtaatgataaaagt

SEQ ID NO: 7618256 - DNA, 22 bp, Homo sapiens
ttttattggtaatgataaaagt

SEQ ID NO: 7618257 - DNA, 22 bp, Homo sapiens
ttttattggtaatgataaaagt

SEQ ID NO: 7618258 - DNA, 22 bp, Homo sapiens
ttttattggtaatgataaaagt

SEQ ID NO: 7618259 - DNA, 22 bp, Homo sapiens
ttttattggtaatgataaaagt

SEQ ID NO: 7618260 - DNA, 22 bp, Homo sapiens
ttttattggtaatgataaaagt

SEQ ID NO: 7618261 - DNA, 22 bp, Homo sapiens
ttttattggtaatgataaaagt

SEQ ID NO: 7618262 - DNA, 22 bp, Homo sapiens
ttttattggtaatgataaaagt

SEQ ID NO: 7618263 - DNA, 22 bp, Homo sapiens
ttttattggtaatgataaaagt

SEQ ID NO: 7618264 - DNA, 22 bp, Homo sapiens
ttttattggtaatgataaaagt

SEQ ID NO: 7618265 - DNA, 22 bp, Homo sapiens
ttttattggtaatgataaaagt

SEQ ID NO: 7618266 - DNA, 22 bp, Homo sapiens
ttttattggtaatgataaaagt

SEQ ID NO: 7618267 - DNA, 22 bp, Homo sapiens
ttttattggtaatgataaaagt

SEQ ID NO: 7618268 - DNA, 22 bp, Homo sapiens
ttttattggtaatgataaaagt

SEQ ID NO: 7618269 - DNA, 22 bp, Homo sapiens
ttttactttggatacagtactt

SEQ ID NO: 7618270 - DNA, 22 bp, Homo sapiens
ttttactttggatacagtactt

SEQ ID NO: 7618271 - DNA, 22 bp, Homo sapiens
ttttactttggatacagtactt

SEQ ID NO: 7618272 - DNA, 22 bp, Homo sapiens
ttttacttcattcctgacttca

SEQ ID NO: 7618273 - DNA, 22 bp, Homo sapiens
ttttacttcattcctgacttca

SEQ ID NO: 7618274 - DNA, 22 bp, Homo sapiens
ttttacttcattcctgacttca

SEQ ID NO: 7618275 - DNA, 22 bp, Homo sapiens
ttttacttcattcctgacttca

SEQ ID NO: 7618276 - DNA, 22 bp, Homo sapiens
ttttacttaattcttggtcatg

SEQ ID NO: 7618277 - DNA, 22 bp, Homo sapiens
ttttacattgggaaatgcctct

SEQ ID NO: 7618278 - DNA, 22 bp, Homo sapiens
ttttaccactgggtgacatgga

SEQ ID NO: 7618279 - DNA, 22 bp, Homo sapiens
ttttaccactgggtgacatgga

SEQ ID NO: 7618280 - DNA, 22 bp, Homo sapiens
ttttacattgggaaatgcctct

SEQ ID NO: 7618281 - DNA, 22 bp, Homo sapiens
ttttacattgggaaatgcctct

SEQ ID NO: 7618282 - DNA, 22 bp, Homo sapiens
ttttacttaattcttggtcatg

SEQ ID NO: 7618283 - DNA, 22 bp, Homo sapiens
ttttacttaattcttggtcatg

SEQ ID NO: 7618284 - DNA, 22 bp, Homo sapiens
ttttaccactgggtgacatgga

SEQ ID NO: 7618285 - DNA, 22 bp, Homo sapiens
ttttaccactgggtgacatgga

SEQ ID NO: 7618286 - DNA, 22 bp, Homo sapiens
ttttagaaggaatgctatggtg

SEQ ID NO: 7618287 - DNA, 22 bp, Homo sapiens
ttttagaaggaatgctatggtg

SEQ ID NO: 7618288 - DNA, 22 bp, Homo sapiens
ttttagaaggaatgctatggtg

SEQ ID NO: 7618289 - DNA, 22 bp, Homo sapiens
ttttagaaggaatgctatggtg

SEQ ID NO: 7618290 - DNA, 22 bp, Homo sapiens
ttttagaaatactgatttagtg

SEQ ID NO: 7618291 - DNA, 22 bp, Homo sapiens
ttttagaaatactgatttagtg

SEQ ID NO: 7618292 - DNA, 22 bp, Homo sapiens
ttttagaaatactgatttagtg

SEQ ID NO: 7618293 - DNA, 22 bp, Homo sapiens
ttttagaaatactgatttagtg

SEQ ID NO: 7618294 - DNA, 22 bp, Homo sapiens
ttttagaaatactgatttagtg

SEQ ID NO: 7618295 - DNA, 22 bp, Homo sapiens
ttttagaaatactgatttagtg

SEQ ID NO: 7618296 - DNA, 22 bp, Homo sapiens
ttttagaaagatccctggcagg

SEQ ID NO: 7618297 - DNA, 22 bp, Homo sapiens
ttttagaaagatccctggcagg

SEQ ID NO: 7618298 - DNA, 22 bp, Homo sapiens
ttttactttggatacagtactt

SEQ ID NO: 7618299 - DNA, 22 bp, Homo sapiens
ttttagaaatactgatttagtg

SEQ ID NO: 7618300 - DNA, 22 bp, Homo sapiens
ttttagaaatactgatttagtg

SEQ ID NO: 7618301 - DNA, 22 bp, Homo sapiens
ttttagaaatactgatttagtg

SEQ ID NO: 7618302 - DNA, 22 bp, Homo sapiens
ttttagaaagatccctggcagg

SEQ ID NO: 7618303 - DNA, 22 bp, Homo sapiens
ttttagaaagatccctggcagg

SEQ ID NO: 7618304 - DNA, 16 bp, Homo sapiens
ttttattgtgacagcc

SEQ ID NO: 7618305 - DNA, 16 bp, Homo sapiens
ttttattgtgacagcc

SEQ ID NO: 7618306 - DNA, 16 bp, Homo sapiens
ttttattgtgacagcc

SEQ ID NO: 7618307 - DNA, 16 bp, Homo sapiens
ttttattgtgacagcc

SEQ ID NO: 7618308 - DNA, 22 bp, Homo sapiens
ttttcaaagactggaggctgat

SEQ ID NO: 7618309 - DNA, 22 bp, Homo sapiens
ttttcaaagactggaggctgat

SEQ ID NO: 7618310 - DNA, 22 bp, Homo sapiens
ttttcaaagactggaggctgat

SEQ ID NO: 7618311 - DNA, 22 bp, Homo sapiens
ttttattgtctgtattgcctat

SEQ ID NO: 7618312 - DNA, 22 bp, Homo sapiens
ttttattgtctgtattgcctat

SEQ ID NO: 7618313 - DNA, 22 bp, Homo sapiens
ttttattgtctgtattgcctat

SEQ ID NO: 7618314 - DNA, 16 bp, Homo sapiens
ttttattgtgacagcc

SEQ ID NO: 7618315 - DNA, 16 bp, Homo sapiens
ttttattgtgacagcc

SEQ ID NO: 7618316 - DNA, 16 bp, Homo sapiens
ttttattgtgacagcc

SEQ ID NO: 7618317 - DNA, 16 bp, Homo sapiens
ttttattgtgacagcc

SEQ ID NO: 7618318 - DNA, 16 bp, Homo sapiens
ttttattgtgacagcc

SEQ ID NO: 7618319 - DNA, 16 bp, Homo sapiens
ttttattgtgacagcc

SEQ ID NO: 7618320 - DNA, 22 bp, Homo sapiens
ttttcaattttgaggcagtggt

SEQ ID NO: 7618321 - DNA, 22 bp, Homo sapiens
ttttcaattttgaggcagtggt

SEQ ID NO: 7618322 - DNA, 22 bp, Homo sapiens
ttttcaattttgaggcagtggt

SEQ ID NO: 7618323 - DNA, 22 bp, Homo sapiens
ttttcaagggcagggaaatcat

SEQ ID NO: 7618324 - DNA, 22 bp, Homo sapiens
ttttcaagggcagggaaatcat

SEQ ID NO: 7618325 - DNA, 22 bp, Homo sapiens
ttttcaagagagtgttctatgt

SEQ ID NO: 7618326 - DNA, 22 bp, Homo sapiens
ttttcaagagagtgttctatgt

SEQ ID NO: 7618327 - DNA, 22 bp, Homo sapiens
ttttcaagagagtgttctatgt

SEQ ID NO: 7618328 - DNA, 22 bp, Homo sapiens
ttttcaagagagtgttctatgt

SEQ ID NO: 7618329 - DNA, 16 bp, Homo sapiens
ttttcaagagcggaga

SEQ ID NO: 7618330 - DNA, 22 bp, Homo sapiens
ttttcaagggcagggaaatcat

SEQ ID NO: 7618331 - DNA, 22 bp, Homo sapiens
ttttcacaagggtccaactagt

SEQ ID NO: 7618332 - DNA, 22 bp, Homo sapiens
ttttcacacaaggtgataagtt

SEQ ID NO: 7618333 - DNA, 22 bp, Homo sapiens
ttttcacacaaggtgataagtt

SEQ ID NO: 7618334 - DNA, 22 bp, Homo sapiens
ttttcacacaaggtgataagtt

SEQ ID NO: 7618335 - DNA, 20 bp, Homo sapiens
ttttccactcctcaaaacag

SEQ ID NO: 7618336 - DNA, 20 bp, Homo sapiens
ttttccagaaagtatcattg

SEQ ID NO: 7618337 - DNA, 20 bp, Homo sapiens
ttttccagaaagtatcattg

SEQ ID NO: 7618338 - DNA, 22 bp, Homo sapiens
ttttccactttagtgcaataac

SEQ ID NO: 7618339 - DNA, 22 bp, Homo sapiens
ttttcacacaaggtgataagtt

SEQ ID NO: 7618340 - DNA, 22 bp, Homo sapiens
ttttattgtctgtattgcctat

SEQ ID NO: 7618341 - DNA, 22 bp, Homo sapiens
ttttattgtctgtattgcctat

SEQ ID NO: 7618342 - DNA, 22 bp, Homo sapiens
ttttattgtctgtattgcctat

SEQ ID NO: 7618343 - DNA, 22 bp, Homo sapiens
ttttattgtctgtattgcctat

SEQ ID NO: 7618344 - DNA, 22 bp, Homo sapiens
ttttattgtctgtattgcctat

SEQ ID NO: 7618345 - DNA, 22 bp, Homo sapiens
ttttattgtctgtattgcctat

SEQ ID NO: 7618346 - DNA, 22 bp, Homo sapiens
ttttattgtctgtattgcctat

SEQ ID NO: 7618347 - DNA, 22 bp, Homo sapiens
ttttattgtctgtattgcctat

SEQ ID NO: 7618348 - DNA, 22 bp, Homo sapiens
ttttattgtctgtattgcctat

SEQ ID NO: 7618349 - DNA, 22 bp, Homo sapiens
ttttattgtctgtattgcctat

SEQ ID NO: 7618350 - DNA, 22 bp, Homo sapiens
ttttattgtctcccagttctgg

SEQ ID NO: 7618351 - DNA, 22 bp, Homo sapiens
ttttattgtctcccagttctgg

SEQ ID NO: 7618352 - DNA, 22 bp, Homo sapiens
ttttattgtctcccagttctgg

SEQ ID NO: 7618353 - DNA, 22 bp, Homo sapiens
ttttattgtctcccagttctgg

SEQ ID NO: 7618354 - DNA, 22 bp, Homo sapiens
ttttattgtctcccagttctgg

SEQ ID NO: 7618355 - DNA, 22 bp, Homo sapiens
ttttattgtctcccagttctgg

SEQ ID NO: 7618356 - DNA, 22 bp, Homo sapiens
ttttattgtctcccagttctgg

SEQ ID NO: 7618357 - DNA, 22 bp, Homo sapiens
ttttattgtctcccagttctgg

SEQ ID NO: 7618358 - DNA, 22 bp, Homo sapiens
ttttattgtcaatgaagacaga

SEQ ID NO: 7618359 - DNA, 22 bp, Homo sapiens
ttttattgtcaatgaagacaga

SEQ ID NO: 7618360 - DNA, 22 bp, Homo sapiens
ttttattgtcaatgaagacaga

SEQ ID NO: 7618361 - DNA, 22 bp, Homo sapiens
ttttattgtcaatgaagacaga

SEQ ID NO: 7618362 - DNA, 22 bp, Homo sapiens
ttttattgtctcccagttctgg

SEQ ID NO: 7618363 - DNA, 22 bp, Homo sapiens
ttttattgtctcccagttctgg

SEQ ID NO: 7618364 - DNA, 22 bp, Homo sapiens
ttttattgtctcccagttctgg

SEQ ID NO: 7618365 - DNA, 22 bp, Homo sapiens
ttttattgtcaatgaagacaga

SEQ ID NO: 7618366 - DNA, 22 bp, Homo sapiens
ttttattgtcaatgaagacaga

SEQ ID NO: 7618367 - DNA, 22 bp, Homo sapiens
ttttattgtcaatgaagacaga

SEQ ID NO: 7618368 - DNA, 22 bp, Homo sapiens
ttttattgtcaatgaagacaga

SEQ ID NO: 7618369 - DNA, 22 bp, Homo sapiens
ttttattgtcaatgaagacaga

SEQ ID NO: 7618370 - DNA, 22 bp, Homo sapiens
ttttattgtcaatgaagacaga

SEQ ID NO: 7618371 - DNA, 22 bp, Homo sapiens
ttttattgtcaatgaagacaga

SEQ ID NO: 7618372 - DNA, 22 bp, Homo sapiens
ttttattgtcaatgaagacaga

SEQ ID NO: 7618373 - DNA, 22 bp, Homo sapiens
ttttattgtcaatgaagacaga

SEQ ID NO: 7618374 - DNA, 22 bp, Homo sapiens
tttgtgtatgcttcacctagcc

SEQ ID NO: 7618375 - DNA, 22 bp, Homo sapiens
tttgtgtagtctgttcccactg

SEQ ID NO: 7618376 - DNA, 22 bp, Homo sapiens
tttgtgtatgtatgcttgtaca

SEQ ID NO: 7618377 - DNA, 22 bp, Homo sapiens
tttgtgtatgtatgcttgtaca

SEQ ID NO: 7618378 - DNA, 19 bp, Homo sapiens
tttgtgtatgtgcgtacca

SEQ ID NO: 7618379 - DNA, 22 bp, Homo sapiens
tttgtgtcgtcactgtcttctc

SEQ ID NO: 7618380 - DNA, 22 bp, Homo sapiens
tttgtgtaccttgtacatttgt

SEQ ID NO: 7618381 - DNA, 22 bp, Homo sapiens
tttgtgtaccttgtacatttgt

SEQ ID NO: 7618382 - DNA, 22 bp, Homo sapiens
tttgtggcaggagcggagaccg

SEQ ID NO: 7618383 - DNA, 23 bp, Homo sapiens
ttttaatttggacataagaagat

SEQ ID NO: 7618384 - DNA, 23 bp, Homo sapiens
ttttaatttggacataagaagat

SEQ ID NO: 7618385 - DNA, 23 bp, Homo sapiens
ttttaatttggacataagaagat

SEQ ID NO: 7618386 - DNA, 23 bp, Homo sapiens
ttttaatttggacataagaagat

SEQ ID NO: 7618387 - DNA, 23 bp, Homo sapiens
ttttaatttggacataagaagat

SEQ ID NO: 7618388 - DNA, 23 bp, Homo sapiens
ttttaatttggacataagaagat

SEQ ID NO: 7618389 - DNA, 23 bp, Homo sapiens
ttttaatttggacataagaagat

SEQ ID NO: 7618390 - DNA, 22 bp, Homo sapiens
ttttaattttgcaaatctggtg

SEQ ID NO: 7618391 - DNA, 22 bp, Homo sapiens
ttttaattttgcaaatctggtg

SEQ ID NO: 7618392 - DNA, 22 bp, Homo sapiens
ttttaattttgcaaatctggtg

SEQ ID NO: 7618393 - DNA, 22 bp, Homo sapiens
ttttaattttagcccttctggt

SEQ ID NO: 7618394 - DNA, 22 bp, Homo sapiens
ttttaattttagcccttctggt

SEQ ID NO: 7618395 - DNA, 22 bp, Homo sapiens
ttttaattttagcccttctggt

SEQ ID NO: 7618396 - DNA, 22 bp, Homo sapiens
ttttaattttagcccttctggt

SEQ ID NO: 7618397 - DNA, 22 bp, Homo sapiens
ttttaattttagcccttctggt

SEQ ID NO: 7618398 - DNA, 22 bp, Homo sapiens
ttttaattttagcccttctggt

SEQ ID NO: 7618399 - DNA, 22 bp, Homo sapiens
ttttacaagctgagtcgttaaa

SEQ ID NO: 7618400 - DNA, 22 bp, Homo sapiens
ttttacaagctgagtcgttaaa

SEQ ID NO: 7618401 - DNA, 22 bp, Homo sapiens
ttttacaagctgagtcgttaaa

SEQ ID NO: 7618402 - DNA, 22 bp, Homo sapiens
ttttacaaatgaggagctggag

SEQ ID NO: 7618403 - DNA, 22 bp, Homo sapiens
ttttacaaatgaggagctggag

SEQ ID NO: 7618404 - DNA, 22 bp, Homo sapiens
ttttacaaatgaggagctggag

SEQ ID NO: 7618405 - DNA, 22 bp, Homo sapiens
ttttacaaatgaggagctggag

SEQ ID NO: 7618406 - DNA, 22 bp, Homo sapiens
ttttacaaatgaggagctggag

SEQ ID NO: 7618407 - DNA, 22 bp, Homo sapiens
ttttacaaatgaggagctggag

SEQ ID NO: 7618408 - DNA, 22 bp, Homo sapiens
ttttacaaatgaggagctggag

SEQ ID NO: 7618409 - DNA, 22 bp, Homo sapiens
ttttacaagctgagtcgttaaa

SEQ ID NO: 7618410 - DNA, 22 bp, Homo sapiens
ttttacaagctgagtcgttaaa

SEQ ID NO: 7618411 - DNA, 22 bp, Homo sapiens
ttttacaagctgagtcgttaaa

SEQ ID NO: 7618412 - DNA, 22 bp, Homo sapiens
ttttacaagctgagtcgttaaa

SEQ ID NO: 7618413 - DNA, 22 bp, Homo sapiens
ttttacaagctgagtcgttaaa

SEQ ID NO: 7618414 - DNA, 22 bp, Homo sapiens
ttttacaggtcataggtatagt

SEQ ID NO: 7618415 - DNA, 22 bp, Homo sapiens
ttttacaggtcataggtatagt

SEQ ID NO: 7618416 - DNA, 22 bp, Homo sapiens
ttttacaggtgaaaaatgaaga

SEQ ID NO: 7618417 - DNA, 22 bp, Homo sapiens
ttttacaggtgaaaaatgaaga

SEQ ID NO: 7618418 - DNA, 22 bp, Homo sapiens
ttttacaggtgaaaaatgaaga

SEQ ID NO: 7618419 - DNA, 22 bp, Homo sapiens
ttttacagtcagtcaaactcag

SEQ ID NO: 7618420 - DNA, 22 bp, Homo sapiens
ttttacagttccatgcaaagcg

SEQ ID NO: 7618421 - DNA, 22 bp, Homo sapiens
ttttacagttccatgcaaagcg

SEQ ID NO: 7618422 - DNA, 22 bp, Homo sapiens
ttttacagttccatgcaaagcg

SEQ ID NO: 7618423 - DNA, 22 bp, Homo sapiens
ttttacaagctgagtcgttaaa

SEQ ID NO: 7618424 - DNA, 22 bp, Homo sapiens
ttttacacctcagatgagcaga

SEQ ID NO: 7618425 - DNA, 22 bp, Homo sapiens
ttttacacctcagatgagcaga

SEQ ID NO: 7618426 - DNA, 22 bp, Homo sapiens
ttttacacctcagatgagcaga

SEQ ID NO: 7618427 - DNA, 22 bp, Homo sapiens
ttttacaggtcataggtatagt

SEQ ID NO: 7618428 - DNA, 22 bp, Homo sapiens
ttttacaggtcataggtatagt

SEQ ID NO: 7618429 - DNA, 22 bp, Homo sapiens
ttttacacctgttaactctaag

SEQ ID NO: 7618430 - DNA, 22 bp, Homo sapiens
ttttacacctgttaactctaag

SEQ ID NO: 7618431 - DNA, 22 bp, Homo sapiens
ttttacacttcggttgtgtgca

SEQ ID NO: 7618432 - DNA, 22 bp, Homo sapiens
tttgtccttgaatcaattcaca

SEQ ID NO: 7618433 - DNA, 18 bp, Homo sapiens
tttgtcctgtggcagctg

SEQ ID NO: 7618434 - DNA, 22 bp, Homo sapiens
tttgtcattctgtgtatttaaa

SEQ ID NO: 7618435 - DNA, 22 bp, Homo sapiens
tttgtcctgtagttacagtgga

SEQ ID NO: 7618436 - DNA, 22 bp, Homo sapiens
tttgtcctgcttgggcttaaaa

SEQ ID NO: 7618437 - DNA, 22 bp, Homo sapiens
tttgtcctgtagttacagtgga

SEQ ID NO: 7618438 - DNA, 22 bp, Homo sapiens
tttgtcctgtagttacagtgga

SEQ ID NO: 7618439 - DNA, 22 bp, Homo sapiens
tttgtctaattgcaaggcaagt

SEQ ID NO: 7618440 - DNA, 22 bp, Homo sapiens
tttgtccttgaatcaattcaca

SEQ ID NO: 7618441 - DNA, 22 bp, Homo sapiens
tttgtccttgtcctacatcggt

SEQ ID NO: 7618442 - DNA, 22 bp, Homo sapiens
tttgtctacaaaaagtgtacag

SEQ ID NO: 7618443 - DNA, 22 bp, Homo sapiens
tttgtctataaattactactgc

SEQ ID NO: 7618444 - DNA, 22 bp, Homo sapiens
tttgtcttaaatcttgttactg

SEQ ID NO: 7618445 - DNA, 22 bp, Homo sapiens
tttgtcttaaatcttgttactg

SEQ ID NO: 7618446 - DNA, 22 bp, Homo sapiens
tttgtcttaaatcttgttactg

SEQ ID NO: 7618447 - DNA, 22 bp, Homo sapiens
tttgtcttaaatcttgttactg

SEQ ID NO: 7618448 - DNA, 20 bp, Homo sapiens
tttgtctgttaagtgtttct

SEQ ID NO: 7618449 - DNA, 22 bp, Homo sapiens
tttgtctgttattgttctcatg

SEQ ID NO: 7618450 - DNA, 20 bp, Homo sapiens
tttgtctgttaagtgtttct

SEQ ID NO: 7618451 - DNA, 20 bp, Homo sapiens
tttgtctgttaagtgtttct

SEQ ID NO: 7618452 - DNA, 22 bp, Homo sapiens
tttgtctgccttgctggactgt

SEQ ID NO: 7618453 - DNA, 19 bp, Homo sapiens
tttgtctctgaataatatt

SEQ ID NO: 7618454 - DNA, 22 bp, Homo sapiens
tttgtcttatccaatctctcag

SEQ ID NO: 7618455 - DNA, 22 bp, Homo sapiens
tttgtcttatccaatctctcag

SEQ ID NO: 7618456 - DNA, 22 bp, Homo sapiens
tttgtcttatccaatctctcag

SEQ ID NO: 7618457 - DNA, 22 bp, Homo sapiens
tttgtcttatccaatctctcag

SEQ ID NO: 7618458 - DNA, 22 bp, Homo sapiens
tttgtcttatccaatctctcag

SEQ ID NO: 7618459 - DNA, 22 bp, Homo sapiens
tttgtcttatccaatctctcag

SEQ ID NO: 7618460 - DNA, 22 bp, Homo sapiens
tttgtcttatccaatctctcag

SEQ ID NO: 7618461 - DNA, 22 bp, Homo sapiens
tttgtcttaaatcttgttactg

SEQ ID NO: 7618462 - DNA, 22 bp, Homo sapiens
tttgtcttaaatcttgttactg

SEQ ID NO: 7618463 - DNA, 22 bp, Homo sapiens
tttgtcttaaatcttgttactg

SEQ ID NO: 7618464 - DNA, 22 bp, Homo sapiens
tttgtcttaaatcttgttactg

SEQ ID NO: 7618465 - DNA, 22 bp, Homo sapiens
tttgtcttaaatcttgttactg

SEQ ID NO: 7618466 - DNA, 22 bp, Homo sapiens
tttgtcttaaatcttgttactg

SEQ ID NO: 7618467 - DNA, 22 bp, Homo sapiens
tttgtcttgaggctggggaagt

SEQ ID NO: 7618468 - DNA, 22 bp, Homo sapiens
tttgtcttgaggctggggaagt

SEQ ID NO: 7618469 - DNA, 22 bp, Homo sapiens
tttgtcttgaggctggggaagt

SEQ ID NO: 7618470 - DNA, 22 bp, Homo sapiens
tttgtcttccccctttaatcag

SEQ ID NO: 7618471 - DNA, 22 bp, Homo sapiens
tttgtcttccccctttaatcag

SEQ ID NO: 7618472 - DNA, 22 bp, Homo sapiens
tttgtcttccccctttaatcag

SEQ ID NO: 7618473 - DNA, 22 bp, Homo sapiens
tttgtcttccccctttaatcag

SEQ ID NO: 7618474 - DNA, 22 bp, Homo sapiens
tttgtcttccccctttaatcag

SEQ ID NO: 7618475 - DNA, 22 bp, Homo sapiens
tttgtcttccccctttaatcag

SEQ ID NO: 7618476 - DNA, 22 bp, Homo sapiens
tttgtcttcatccttcgagctg

SEQ ID NO: 7618477 - DNA, 22 bp, Homo sapiens
tttgtcttcatccttcgagctg

SEQ ID NO: 7618478 - DNA, 22 bp, Homo sapiens
tttgtcttatccaatctctcag

SEQ ID NO: 7618479 - DNA, 22 bp, Homo sapiens
tttgtggcaggagcggagaccg

SEQ ID NO: 7618480 - DNA, 22 bp, Homo sapiens
tttgtggcaggagcggagaccg

SEQ ID NO: 7618481 - DNA, 22 bp, Homo sapiens
tttgtggcaggagcggagaccg

SEQ ID NO: 7618482 - DNA, 22 bp, Homo sapiens
tttgtggatggaaaatagcagg

SEQ ID NO: 7618483 - DNA, 22 bp, Homo sapiens
tttgtggaactctcttcttgca

SEQ ID NO: 7618484 - DNA, 22 bp, Homo sapiens
tttgtggaactctcttcttgca

SEQ ID NO: 7618485 - DNA, 21 bp, Homo sapiens
tttgtggaattctcactcttc

SEQ ID NO: 7618486 - DNA, 21 bp, Homo sapiens
tttgtggaattctcactcttc

SEQ ID NO: 7618487 - DNA, 22 bp, Homo sapiens
tttgtgctaatgctagattact

SEQ ID NO: 7618488 - DNA, 22 bp, Homo sapiens
tttgtgctaatgctagattact

SEQ ID NO: 7618489 - DNA, 22 bp, Homo sapiens
tttgtgctaatgctagattact

SEQ ID NO: 7618490 - DNA, 22 bp, Homo sapiens
tttgtgctgaagatccagagca

SEQ ID NO: 7618491 - DNA, 22 bp, Homo sapiens
tttgtggaactctcttcttgca

SEQ ID NO: 7618492 - DNA, 22 bp, Homo sapiens
tttgtgcaggtgtgtcagatcg

SEQ ID NO: 7618493 - DNA, 22 bp, Homo sapiens
tttgtgcaggtataggcggaga

SEQ ID NO: 7618494 - DNA, 23 bp, Homo sapiens
tttgtgcagaagacaaagtggcc

SEQ ID NO: 7618495 - DNA, 22 bp, Homo sapiens
tttgtgcagataggagacaatc

SEQ ID NO: 7618496 - DNA, 19 bp, Homo sapiens
tttgtgcagcaacattaat

SEQ ID NO: 7618497 - DNA, 22 bp, Homo sapiens
tttgtgatctcctccctctaga

SEQ ID NO: 7618498 - DNA, 22 bp, Homo sapiens
tttgtgattaattttcaacctc

SEQ ID NO: 7618499 - DNA, 22 bp, Homo sapiens
tttgtgcaatttatgtactata

SEQ ID NO: 7618500 - DNA, 22 bp, Homo sapiens
tttgaaattggctcattggttt

SEQ ID NO: 7618501 - DNA, 22 bp, Homo sapiens
tttgaacaagagcttcacatta

SEQ ID NO: 7618502 - DNA, 22 bp, Homo sapiens
tttgaacaagagcttcacatta

SEQ ID NO: 7618503 - DNA, 22 bp, Homo sapiens
tttgaacagacactttctacag

SEQ ID NO: 7618504 - DNA, 22 bp, Homo sapiens
tttgaacagggaatgttccaca

SEQ ID NO: 7618505 - DNA, 22 bp, Homo sapiens
tttgaacagggaatgttccaca

SEQ ID NO: 7618506 - DNA, 22 bp, Homo sapiens
tttgaacaggagtatctatagt

SEQ ID NO: 7618507 - DNA, 22 bp, Homo sapiens
tttgaacaggagtatctatagt

SEQ ID NO: 7618508 - DNA, 22 bp, Homo sapiens
tttgaacaggagtatctatagt

SEQ ID NO: 7618509 - DNA, 22 bp, Homo sapiens
tttgaacaggagtatctatagt

SEQ ID NO: 7618510 - DNA, 22 bp, Homo sapiens
tttgaacaggagtatctatagt

SEQ ID NO: 7618511 - DNA, 22 bp, Homo sapiens
tttgaacatgctgcatgataat

SEQ ID NO: 7618512 - DNA, 22 bp, Homo sapiens
tttgaacatgctgcatgataat

SEQ ID NO: 7618513 - DNA, 22 bp, Homo sapiens
tttgaacatgctgcatgataat

SEQ ID NO: 7618514 - DNA, 22 bp, Homo sapiens
tttgaacatgctgcatgataat

SEQ ID NO: 7618515 - DNA, 22 bp, Homo sapiens
tttgaacatgctgcatgataat

SEQ ID NO: 7618516 - DNA, 22 bp, Homo sapiens
tttgaacatgctgcatgataat

SEQ ID NO: 7618517 - DNA, 22 bp, Homo sapiens
tttgaactcagcttcagacaac

SEQ ID NO: 7618518 - DNA, 22 bp, Homo sapiens
tttgaactcagcttcagacaac

SEQ ID NO: 7618519 - DNA, 23 bp, Homo sapiens
tttgaacatttctagattacata

SEQ ID NO: 7618520 - DNA, 23 bp, Homo sapiens
tttgaacatttctagattacata

SEQ ID NO: 7618521 - DNA, 22 bp, Homo sapiens
tttgaacattcaacagacccag

SEQ ID NO: 7618522 - DNA, 22 bp, Homo sapiens
tttgaaccccgaccaaacactg

SEQ ID NO: 7618523 - DNA, 22 bp, Homo sapiens
tttgaaccccgaccaaacactg

SEQ ID NO: 7618524 - DNA, 23 bp, Homo sapiens
tttgaacatttctagattacata

SEQ ID NO: 7618525 - DNA, 22 bp, Homo sapiens
tttgaagacagatcaatataag

SEQ ID NO: 7618526 - DNA, 22 bp, Homo sapiens
tttgaagacagatcaatataag

SEQ ID NO: 7618527 - DNA, 23 bp, Homo sapiens
tttgaagaagtgaatatcatata

SEQ ID NO: 7618528 - DNA, 23 bp, Homo sapiens
tttgaagaagtgaatatcatata

SEQ ID NO: 7618529 - DNA, 23 bp, Homo sapiens
tttgaagaagtgaatatcatata

SEQ ID NO: 7618530 - DNA, 22 bp, Homo sapiens
tttgaagaagctgacctatttt

SEQ ID NO: 7618531 - DNA, 22 bp, Homo sapiens
tttgaagaagctgacctatttt

SEQ ID NO: 7618532 - DNA, 22 bp, Homo sapiens
tttgaagacatattgttacata

SEQ ID NO: 7618533 - DNA, 22 bp, Homo sapiens
tttgaagacatattgttacata

SEQ ID NO: 7618534 - DNA, 22 bp, Homo sapiens
tttgaagacagatcaatataag

SEQ ID NO: 7618535 - DNA, 22 bp, Homo sapiens
tttgaagacatattgttacata

SEQ ID NO: 7618536 - DNA, 22 bp, Homo sapiens
tttgaagacatattgttacata

SEQ ID NO: 7618537 - DNA, 23 bp, Homo sapiens
tttgacagcgtggtttctgtggg

SEQ ID NO: 7618538 - DNA, 23 bp, Homo sapiens
tttgacagcgtggtttctgtggg

SEQ ID NO: 7618539 - DNA, 22 bp, Homo sapiens
tttgacagcatatcctcatatt

SEQ ID NO: 7618540 - DNA, 21 bp, Homo sapiens
tttgacagctcagagggcatt

SEQ ID NO: 7618541 - DNA, 22 bp, Homo sapiens
tttgacagcataatcctacacc

SEQ ID NO: 7618542 - DNA, 22 bp, Homo sapiens
tttgaagactactgggagtgaa

SEQ ID NO: 7618543 - DNA, 22 bp, Homo sapiens
tttgaagactactgggagtgaa

SEQ ID NO: 7618544 - DNA, 22 bp, Homo sapiens
tttgaagactactgggagtgaa

SEQ ID NO: 7618545 - DNA, 22 bp, Homo sapiens
tttgaagactactgggagtgaa

SEQ ID NO: 7618546 - DNA, 22 bp, Homo sapiens
tttgaagactactgggagtgaa

SEQ ID NO: 7618547 - DNA, 22 bp, Homo sapiens
tttgaagactactgggagtgaa

SEQ ID NO: 7618548 - DNA, 22 bp, Homo sapiens
tttgaagactactgggagtgaa

SEQ ID NO: 7618549 - DNA, 22 bp, Homo sapiens
tttgaagactactgggagtgaa

SEQ ID NO: 7618550 - DNA, 22 bp, Homo sapiens
tttgaagaccttatctctaaat

SEQ ID NO: 7618551 - DNA, 22 bp, Homo sapiens
tttgaagaccttatctctaaat

SEQ ID NO: 7618552 - DNA, 22 bp, Homo sapiens
tttgaagaccttatctctaaat

SEQ ID NO: 7618553 - DNA, 22 bp, Homo sapiens
tttgacatcactgacctgtttt

SEQ ID NO: 7618554 - DNA, 22 bp, Homo sapiens
tttgacagtgttggggcaggct

SEQ ID NO: 7618555 - DNA, 22 bp, Homo sapiens
tttgacagtgttggggcaggct

SEQ ID NO: 7618556 - DNA, 22 bp, Homo sapiens
tttgacagtgctgctaaaatgc

SEQ ID NO: 7618557 - DNA, 22 bp, Homo sapiens
tttgacagtgctgctaaaatgc

SEQ ID NO: 7618558 - DNA, 22 bp, Homo sapiens
tttgacagtgatgatatataca

SEQ ID NO: 7618559 - DNA, 22 bp, Homo sapiens
tttgacagtcccctgatgtttg

SEQ ID NO: 7618560 - DNA, 22 bp, Homo sapiens
tttgacagtgacgcctgtatga

SEQ ID NO: 7618561 - DNA, 22 bp, Homo sapiens
tttgacagtgacgcctgtatga

SEQ ID NO: 7618562 - DNA, 22 bp, Homo sapiens
tttgacagtgatgatatataca

SEQ ID NO: 7618563 - DNA, 22 bp, Homo sapiens
tttgacagtgatgatatataca

SEQ ID NO: 7618564 - DNA, 22 bp, Homo sapiens
tttgacagtcccctgatgtttg

SEQ ID NO: 7618565 - DNA, 22 bp, Homo sapiens
tttgacagtcccctgatgtttg

SEQ ID NO: 7618566 - DNA, 22 bp, Homo sapiens
tttgacagtactctgtaggatc

SEQ ID NO: 7618567 - DNA, 22 bp, Homo sapiens
tttgacagtactctgtaggatc

SEQ ID NO: 7618568 - DNA, 22 bp, Homo sapiens
tttgacagtaataaagcacaag

SEQ ID NO: 7618569 - DNA, 22 bp, Homo sapiens
tttgacagggtgatgaggtggt

SEQ ID NO: 7618570 - DNA, 22 bp, Homo sapiens
tttgacaggaggtggctactca

SEQ ID NO: 7618571 - DNA, 22 bp, Homo sapiens
tttgacaggaattctctctagg

SEQ ID NO: 7618572 - DNA, 22 bp, Homo sapiens
tttgacagcttgttacaaagtt

SEQ ID NO: 7618573 - DNA, 22 bp, Homo sapiens
tttgacaggactaacatatggc

SEQ ID NO: 7618574 - DNA, 22 bp, Homo sapiens
tttgacaggactaacatatggc

SEQ ID NO: 7618575 - DNA, 22 bp, Homo sapiens
tttgacaggactaacatatggc

SEQ ID NO: 7618576 - DNA, 22 bp, Homo sapiens
tttgacagcttgcagtgagacc

SEQ ID NO: 7618577 - DNA, 22 bp, Homo sapiens
tttgacagcttgcagtgagacc

SEQ ID NO: 7618578 - DNA, 22 bp, Homo sapiens
tttgacagcttgttacaaagtt

SEQ ID NO: 7618579 - DNA, 22 bp, Homo sapiens
tttgacagcttgcagtgagacc

SEQ ID NO: 7618580 - DNA, 22 bp, Homo sapiens
tttgacatgaagtagcttataa

SEQ ID NO: 7618581 - DNA, 22 bp, Homo sapiens
tttgacatgaagtagcttataa

SEQ ID NO: 7618582 - DNA, 22 bp, Homo sapiens
tttgacatgcaaagcactttag

SEQ ID NO: 7618583 - DNA, 22 bp, Homo sapiens
tttgacatgtgcttataacttt

SEQ ID NO: 7618584 - DNA, 22 bp, Homo sapiens
tttgacatgtgcttataacttt

SEQ ID NO: 7618585 - DNA, 22 bp, Homo sapiens
tttgacatgcaaagcactttag

SEQ ID NO: 7618586 - DNA, 22 bp, Homo sapiens
tttgacatggaataactcattt

SEQ ID NO: 7618587 - DNA, 22 bp, Homo sapiens
tttgacatggaataactcattt

SEQ ID NO: 7618588 - DNA, 22 bp, Homo sapiens
tttgacattaaggaacatatat

SEQ ID NO: 7618589 - DNA, 22 bp, Homo sapiens
tttgacattaaggaacatatat

SEQ ID NO: 7618590 - DNA, 22 bp, Homo sapiens
tttgacatgtgcttataacttt

SEQ ID NO: 7618591 - DNA, 22 bp, Homo sapiens
tttgacattaaggaacatatat

SEQ ID NO: 7618592 - DNA, 22 bp, Homo sapiens
tttgacattaaggaacatatat

SEQ ID NO: 7618593 - DNA, 22 bp, Homo sapiens
tttgacattaaggaacatatat

SEQ ID NO: 7618594 - DNA, 22 bp, Homo sapiens
tttgacattatcctgttactgg

SEQ ID NO: 7618595 - DNA, 22 bp, Homo sapiens
tttgacattatcctgttactgg

SEQ ID NO: 7618596 - DNA, 22 bp, Homo sapiens
tttgacattaaggaacatatat

SEQ ID NO: 7618597 - DNA, 22 bp, Homo sapiens
tttgacattatcctgttactgg

SEQ ID NO: 7618598 - DNA, 22 bp, Homo sapiens
tttgacattggcttattctgtt

SEQ ID NO: 7618599 - DNA, 22 bp, Homo sapiens
tttgacattgaaagcagaatcg

SEQ ID NO: 7618600 - DNA, 22 bp, Homo sapiens
tttgacattgccaatttgctca

SEQ ID NO: 7618601 - DNA, 22 bp, Homo sapiens
tttgacattgccaatttgctca

SEQ ID NO: 7618602 - DNA, 22 bp, Homo sapiens
tttgacattgaaagcagaatcg

SEQ ID NO: 7618603 - DNA, 22 bp, Homo sapiens
tttgacattgaaagcagaatcg

SEQ ID NO: 7618604 - DNA, 22 bp, Homo sapiens
tttgagaaggtgacaaattcta

SEQ ID NO: 7618605 - DNA, 22 bp, Homo sapiens
tttgagaaggtgacaaattcta

SEQ ID NO: 7618606 - DNA, 22 bp, Homo sapiens
tttgagaaggtgacaaattcta

SEQ ID NO: 7618607 - DNA, 22 bp, Homo sapiens
tttgagaagctgtcttgggctc

SEQ ID NO: 7618608 - DNA, 19 bp, Homo sapiens
tttgagaagttattatcta

SEQ ID NO: 7618609 - DNA, 19 bp, Homo sapiens
tttgagaagttattatcta

SEQ ID NO: 7618610 - DNA, 19 bp, Homo sapiens
tttgagaagttattatcta

SEQ ID NO: 7618611 - DNA, 19 bp, Homo sapiens
tttgagaagttattatcta

SEQ ID NO: 7618612 - DNA, 19 bp, Homo sapiens
tttgagaagttattatcta

SEQ ID NO: 7618613 - DNA, 22 bp, Homo sapiens
tttgagaagtaattcaagacat

SEQ ID NO: 7618614 - DNA, 22 bp, Homo sapiens
tttctagtcctcatgcatcatt

SEQ ID NO: 7618615 - DNA, 22 bp, Homo sapiens
tttctagtcagccatatctagt

SEQ ID NO: 7618616 - DNA, 22 bp, Homo sapiens
tttctagtcctcatgcatcatt

SEQ ID NO: 7618617 - DNA, 22 bp, Homo sapiens
tttctagtcagccatatctagt

SEQ ID NO: 7618618 - DNA, 22 bp, Homo sapiens
tttctagtcagccatatctagt

SEQ ID NO: 7618619 - DNA, 22 bp, Homo sapiens
tttctagtcagccatatctagt

SEQ ID NO: 7618620 - DNA, 22 bp, Homo sapiens
tttctagtcagccatatctagt

SEQ ID NO: 7618621 - DNA, 22 bp, Homo sapiens
tttctagtctcgatctcttaat

SEQ ID NO: 7618622 - DNA, 22 bp, Homo sapiens
tttctagtctcgatctcttaat

SEQ ID NO: 7618623 - DNA, 22 bp, Homo sapiens
tttctagtctcgatctcttaat

SEQ ID NO: 7618624 - DNA, 22 bp, Homo sapiens
tttctagtaatcaatataaagt

SEQ ID NO: 7618625 - DNA, 22 bp, Homo sapiens
tttctagtatataactagatct

SEQ ID NO: 7618626 - DNA, 22 bp, Homo sapiens
tttctagtatataactagatct

SEQ ID NO: 7618627 - DNA, 22 bp, Homo sapiens
tttctagtaaaagctaattacc

SEQ ID NO: 7618628 - DNA, 22 bp, Homo sapiens
tttctaggtttacaatactgca

SEQ ID NO: 7618629 - DNA, 22 bp, Homo sapiens
tttctaggtgttcacagagcat

SEQ ID NO: 7618630 - DNA, 22 bp, Homo sapiens
tttctaggtgttcacagagcat

SEQ ID NO: 7618631 - DNA, 22 bp, Homo sapiens
tttctaggtttacaatactgca

SEQ ID NO: 7618632 - DNA, 22 bp, Homo sapiens
tttctagtctcgatctcttaat

SEQ ID NO: 7618633 - DNA, 22 bp, Homo sapiens
tttctagtggttaagatttaca

SEQ ID NO: 7618634 - DNA, 22 bp, Homo sapiens
tttctagtcttccctacctccc

SEQ ID NO: 7618635 - DNA, 22 bp, Homo sapiens
tttctagtgggtattccctgtt

SEQ ID NO: 7618636 - DNA, 22 bp, Homo sapiens
tttctagtggttaagatttaca

SEQ ID NO: 7618637 - DNA, 19 bp, Homo sapiens
tttctagtttcagcttgtc

SEQ ID NO: 7618638 - DNA, 22 bp, Homo sapiens
tttctataaaaagtgctaggat

SEQ ID NO: 7618639 - DNA, 22 bp, Homo sapiens
tttctatatcttacctattgta

SEQ ID NO: 7618640 - DNA, 22 bp, Homo sapiens
tttctatatcttacctattgta

SEQ ID NO: 7618641 - DNA, 22 bp, Homo sapiens
tttctatagctttcttgggagt

SEQ ID NO: 7618642 - DNA, 22 bp, Homo sapiens
tttctatagctttcttgggagt

SEQ ID NO: 7618643 - DNA, 22 bp, Homo sapiens
tttctataatctaccatgccag

SEQ ID NO: 7618644 - DNA, 22 bp, Homo sapiens
tttctatagctttcttgggagt

SEQ ID NO: 7618645 - DNA, 22 bp, Homo sapiens
tttctataactggactggattg

SEQ ID NO: 7618646 - DNA, 22 bp, Homo sapiens
tttctataaaaagtgctaggat

SEQ ID NO: 7618647 - DNA, 22 bp, Homo sapiens
tttctataaaaagtgctaggat

SEQ ID NO: 7618648 - DNA, 22 bp, Homo sapiens
tttctataactggactggattg

SEQ ID NO: 7618649 - DNA, 22 bp, Homo sapiens
tttctataactggactggattg

SEQ ID NO: 7618650 - DNA, 22 bp, Homo sapiens
tttctagagtgggcatgtctta

SEQ ID NO: 7618651 - DNA, 22 bp, Homo sapiens
tttctagagttcatcatggtaa

SEQ ID NO: 7618652 - DNA, 22 bp, Homo sapiens
tttctagatgagttttgaagat

SEQ ID NO: 7618653 - DNA, 22 bp, Homo sapiens
tttctagatcaaacttttatat

SEQ ID NO: 7618654 - DNA, 22 bp, Homo sapiens
tttctagatattcgcagataga

SEQ ID NO: 7618655 - DNA, 22 bp, Homo sapiens
tttctagatcaaacttttatat

SEQ ID NO: 7618656 - DNA, 22 bp, Homo sapiens
tttctagacatttctatgtaca

SEQ ID NO: 7618657 - DNA, 22 bp, Homo sapiens
tttctagagtgggcatgtctta

SEQ ID NO: 7618658 - DNA, 22 bp, Homo sapiens
tttctagagtgggcatgtctta

SEQ ID NO: 7618659 - DNA, 22 bp, Homo sapiens
tttctagagtgggcatgtctta

SEQ ID NO: 7618660 - DNA, 22 bp, Homo sapiens
tttctagagtgggcatgtctta

SEQ ID NO: 7618661 - DNA, 17 bp, Homo sapiens
tttctagattatcctct

SEQ ID NO: 7618662 - DNA, 22 bp, Homo sapiens
tttctagctgtaggaagctgag

SEQ ID NO: 7618663 - DNA, 17 bp, Homo sapiens
tttctagattatcctct

SEQ ID NO: 7618664 - DNA, 22 bp, Homo sapiens
tttctagatgcggggcttgtgc

SEQ ID NO: 7618665 - DNA, 22 bp, Homo sapiens
tttctaggtcttccatactgcc

SEQ ID NO: 7618666 - DNA, 22 bp, Homo sapiens
tttctaggtcttccatactgcc

SEQ ID NO: 7618667 - DNA, 22 bp, Homo sapiens
tttctagggctcttgtcttctg

SEQ ID NO: 7618668 - DNA, 22 bp, Homo sapiens
tttctaggtcttccatactgcc

SEQ ID NO: 7618669 - DNA, 22 bp, Homo sapiens
tttctaggcacagtgtcttccc

SEQ ID NO: 7618670 - DNA, 22 bp, Homo sapiens
tttctaggaaaagatagaagga

SEQ ID NO: 7618671 - DNA, 22 bp, Homo sapiens
tttctaggacatgataggatat

SEQ ID NO: 7618672 - DNA, 22 bp, Homo sapiens
tttctaggacatgataggatat

SEQ ID NO: 7618673 - DNA, 22 bp, Homo sapiens
tttctaggacatgataggatat

SEQ ID NO: 7618674 - DNA, 22 bp, Homo sapiens
tttctaggacatgataggatat

SEQ ID NO: 7618675 - DNA, 22 bp, Homo sapiens
tttctaggatactctaaatgta

SEQ ID NO: 7618676 - DNA, 22 bp, Homo sapiens
tttgaaatgtatcagtataggt

SEQ ID NO: 7618677 - DNA, 22 bp, Homo sapiens
tttgaaatgtatcagtataggt

SEQ ID NO: 7618678 - DNA, 22 bp, Homo sapiens
tttgaaatctaatcaaggaaca

SEQ ID NO: 7618679 - DNA, 22 bp, Homo sapiens
tttgaaatctaatcaaggaaca

SEQ ID NO: 7618680 - DNA, 22 bp, Homo sapiens
tttgaaatctaatcaaggaaca

SEQ ID NO: 7618681 - DNA, 22 bp, Homo sapiens
tttgaaatctaatcaaggaaca

SEQ ID NO: 7618682 - DNA, 22 bp, Homo sapiens
tttgaaatgtatcagtataggt

SEQ ID NO: 7618683 - DNA, 22 bp, Homo sapiens
tttgaaatgtatcagtataggt

SEQ ID NO: 7618684 - DNA, 22 bp, Homo sapiens
tttgaaattaagatattgtcca

SEQ ID NO: 7618685 - DNA, 22 bp, Homo sapiens
tttgaaatgtatcagtataggt

SEQ ID NO: 7618686 - DNA, 22 bp, Homo sapiens
tttgaaatgtatcagtataggt

SEQ ID NO: 7618687 - DNA, 22 bp, Homo sapiens
tttgaaattggctcattggttt

SEQ ID NO: 7618688 - DNA, 22 bp, Homo sapiens
tttgaaattaagatattgtcca

SEQ ID NO: 7618689 - DNA, 22 bp, Homo sapiens
tttgaaatatgtgatgagagag

SEQ ID NO: 7618690 - DNA, 22 bp, Homo sapiens
tttgaaatatgtgatgagagag

SEQ ID NO: 7618691 - DNA, 22 bp, Homo sapiens
tttgaaatatgtgtcttttgaa

SEQ ID NO: 7618692 - DNA, 22 bp, Homo sapiens
tttgaaatatgtgtcttttgaa

SEQ ID NO: 7618693 - DNA, 22 bp, Homo sapiens
tttgaaatatgtgatgagagag

SEQ ID NO: 7618694 - DNA, 22 bp, Homo sapiens
tttgaaatatgtgatgagagag

SEQ ID NO: 7618695 - DNA, 22 bp, Homo sapiens
tttgaaatatgtgatgagagag

SEQ ID NO: 7618696 - DNA, 22 bp, Homo sapiens
tttgaaatatgaggcattatga

SEQ ID NO: 7618697 - DNA, 22 bp, Homo sapiens
tttgaaatatgaggcattatga

SEQ ID NO: 7618698 - DNA, 22 bp, Homo sapiens
tttgaaagttcttctgacacta

SEQ ID NO: 7618699 - DNA, 22 bp, Homo sapiens
tttgaaagttcttctgacacta

SEQ ID NO: 7618700 - DNA, 22 bp, Homo sapiens
tttgaaagtgtttacttgggaa

SEQ ID NO: 7618701 - DNA, 22 bp, Homo sapiens
tttctattggcgtcactgttgt

SEQ ID NO: 7618702 - DNA, 21 bp, Homo sapiens
tttgaaagtgggtgattcttt

SEQ ID NO: 7618703 - DNA, 21 bp, Homo sapiens
tttgaaagtgggtgattcttt

SEQ ID NO: 7618704 - DNA, 22 bp, Homo sapiens
tttctattggcgtcactgttgt

SEQ ID NO: 7618705 - DNA, 22 bp, Homo sapiens
tttctattgatctaataaacat

SEQ ID NO: 7618706 - DNA, 22 bp, Homo sapiens
tttctattgatctaataaacat

SEQ ID NO: 7618707 - DNA, 22 bp, Homo sapiens
tttctattggcgtcactgttgt

SEQ ID NO: 7618708 - DNA, 22 bp, Homo sapiens
tttctattggcgtcactgttgt

SEQ ID NO: 7618709 - DNA, 22 bp, Homo sapiens
tttctattggcgtcactgttgt

SEQ ID NO: 7618710 - DNA, 22 bp, Homo sapiens
tttctattggcgtcactgttgt

SEQ ID NO: 7618711 - DNA, 22 bp, Homo sapiens
tttctattgatctaataaacat

SEQ ID NO: 7618712 - DNA, 22 bp, Homo sapiens
tttctattgatctaataaacat

SEQ ID NO: 7618713 - DNA, 22 bp, Homo sapiens
tttctattgatctaataaacat

SEQ ID NO: 7618714 - DNA, 22 bp, Homo sapiens
tttctattgatctaataaacat

SEQ ID NO: 7618715 - DNA, 22 bp, Homo sapiens
tttctattgatctaataaacat

SEQ ID NO: 7618716 - DNA, 22 bp, Homo sapiens
tttctattgatctaataaacat

SEQ ID NO: 7618717 - DNA, 22 bp, Homo sapiens
tttctattgatctaataaacat

SEQ ID NO: 7618718 - DNA, 22 bp, Homo sapiens
tttctattctggatctgtggca

SEQ ID NO: 7618719 - DNA, 22 bp, Homo sapiens
tttctattgatctaataaacat

SEQ ID NO: 7618720 - DNA, 22 bp, Homo sapiens
tttctattctggatctgtggca

SEQ ID NO: 7618721 - DNA, 22 bp, Homo sapiens
tttctatatgaggagctaaagt

SEQ ID NO: 7618722 - DNA, 22 bp, Homo sapiens
tttctatatgaggagctaaagt

SEQ ID NO: 7618723 - DNA, 22 bp, Homo sapiens
tttctatatgaggagctaaagt

SEQ ID NO: 7618724 - DNA, 22 bp, Homo sapiens
tttctatatgaggagctaaagt

SEQ ID NO: 7618725 - DNA, 22 bp, Homo sapiens
tttctatatgaggagctaaagt

SEQ ID NO: 7618726 - DNA, 22 bp, Homo sapiens
tttctatatgaggagctaaagt

SEQ ID NO: 7618727 - DNA, 22 bp, Homo sapiens
tttctattctggatctgtggca

SEQ ID NO: 7618728 - DNA, 20 bp, Homo sapiens
tttctatggggccagcacat

SEQ ID NO: 7618729 - DNA, 22 bp, Homo sapiens
tttctatctagggttagagtga

SEQ ID NO: 7618730 - DNA, 22 bp, Homo sapiens
tttctatctgagaagatatcta

SEQ ID NO: 7618731 - DNA, 22 bp, Homo sapiens
tttctatctgagaagatatcta

SEQ ID NO: 7618732 - DNA, 20 bp, Homo sapiens
tttctatggggccagcacat

SEQ ID NO: 7618733 - DNA, 22 bp, Homo sapiens
tttgggcatatagctgttccct

SEQ ID NO: 7618734 - DNA, 22 bp, Homo sapiens
tttgggcagtgggcttagcggc

SEQ ID NO: 7618735 - DNA, 22 bp, Homo sapiens
tttgggcagtcctggaatttgt

SEQ ID NO: 7618736 - DNA, 22 bp, Homo sapiens
tttgggcagtagatgtatcact

SEQ ID NO: 7618737 - DNA, 22 bp, Homo sapiens
tttgggcagtagatgtatcact

SEQ ID NO: 7618738 - DNA, 22 bp, Homo sapiens
tttgggaaagtgtcttttgtat

SEQ ID NO: 7618739 - DNA, 22 bp, Homo sapiens
tttgggcaggcttttccctaga

SEQ ID NO: 7618740 - DNA, 22 bp, Homo sapiens
tttgggcattagtaagttaagc

SEQ ID NO: 7618741 - DNA, 22 bp, Homo sapiens
tttgggctcccacaggcttgtg

SEQ ID NO: 7618742 - DNA, 22 bp, Homo sapiens
tttgggcattagaatattcttt

SEQ ID NO: 7618743 - DNA, 22 bp, Homo sapiens
tttgggaaagtgtcttttgtat

SEQ ID NO: 7618744 - DNA, 22 bp, Homo sapiens
tttgggcatgttgtggccagct

SEQ ID NO: 7618745 - DNA, 22 bp, Homo sapiens
tttgggcatgttgtggccagct

SEQ ID NO: 7618746 - DNA, 22 bp, Homo sapiens
tttgggcatatagctgttccct

SEQ ID NO: 7618747 - DNA, 22 bp, Homo sapiens
tttggggctcagcaggctgttt

SEQ ID NO: 7618748 - DNA, 22 bp, Homo sapiens
tttgggtagataacaaagatct

SEQ ID NO: 7618749 - DNA, 22 bp, Homo sapiens
tttggggctcagcaggctgttt

SEQ ID NO: 7618750 - DNA, 22 bp, Homo sapiens
tttgggttcagacatgattaca

SEQ ID NO: 7618751 - DNA, 22 bp, Homo sapiens
tttggggatgacaggttaggaa

SEQ ID NO: 7618752 - DNA, 22 bp, Homo sapiens
tttggggatgtctgagttgttg

SEQ ID NO: 7618753 - DNA, 22 bp, Homo sapiens
tttggggatgtctgagttgttg

SEQ ID NO: 7618754 - DNA, 22 bp, Homo sapiens
tttggggccagccccatgtctg

SEQ ID NO: 7618755 - DNA, 22 bp, Homo sapiens
tttggggaggttatcggtgtgc

SEQ ID NO: 7618756 - DNA, 22 bp, Homo sapiens
tttggggagacatggccagctg

SEQ ID NO: 7618757 - DNA, 22 bp, Homo sapiens
tttggggaaccactgaggtagg

SEQ ID NO: 7618758 - DNA, 22 bp, Homo sapiens
tttgggctggaattttagtacc

SEQ ID NO: 7618759 - DNA, 18 bp, Homo sapiens
tttgggctgatgttgggc

SEQ ID NO: 7618760 - DNA, 21 bp, Homo sapiens
tttgtccacctgtgttcacca

SEQ ID NO: 7618761 - DNA, 22 bp, Homo sapiens
tttgtcatttccctgattaaag

SEQ ID NO: 7618762 - DNA, 22 bp, Homo sapiens
tttgtcatttccctgattaaag

SEQ ID NO: 7618763 - DNA, 22 bp, Homo sapiens
tttgtcatttccctgattaaag

SEQ ID NO: 7618764 - DNA, 22 bp, Homo sapiens
tttgtcatttccctgattaaag

SEQ ID NO: 7618765 - DNA, 22 bp, Homo sapiens
tttgtcatgttttgtaatgtct

SEQ ID NO: 7618766 - DNA, 22 bp, Homo sapiens
tttgtcattctgtgtatttaaa

SEQ ID NO: 7618767 - DNA, 22 bp, Homo sapiens
tttgtcattctgtgtatttaaa

SEQ ID NO: 7618768 - DNA, 19 bp, Homo sapiens
tttgtcatggtgagttgtt

SEQ ID NO: 7618769 - DNA, 22 bp, Homo sapiens
tttgtcatgtccttaactgtct

SEQ ID NO: 7618770 - DNA, 20 bp, Homo sapiens
tttgtccagcgtctactctg

SEQ ID NO: 7618771 - DNA, 22 bp, Homo sapiens
tttgtccagtgcaccagcctca

SEQ ID NO: 7618772 - DNA, 20 bp, Homo sapiens
tttgtccagcgtctactctg

SEQ ID NO: 7618773 - DNA, 22 bp, Homo sapiens
tttgtccagatgcacagataat

SEQ ID NO: 7618774 - DNA, 22 bp, Homo sapiens
tttgtcctataatcctcttaca

SEQ ID NO: 7618775 - DNA, 22 bp, Homo sapiens
tttgtcctaacagtggtaaagg

SEQ ID NO: 7618776 - DNA, 22 bp, Homo sapiens
tttgtcctataatcctcttaca

SEQ ID NO: 7618777 - DNA, 22 bp, Homo sapiens
tttgtcctataatcctcttaca

SEQ ID NO: 7618778 - DNA, 22 bp, Homo sapiens
tttgtcctctccatgtacaata

SEQ ID NO: 7618779 - DNA, 22 bp, Homo sapiens
tttgtcctctccatgtacaata

SEQ ID NO: 7618780 - DNA, 22 bp, Homo sapiens
tttgtcctctccatgtacaata

SEQ ID NO: 7618781 - DNA, 22 bp, Homo sapiens
tttggtaaatgcaggttcttct

SEQ ID NO: 7618782 - DNA, 22 bp, Homo sapiens
tttggtaaccttgcattcttta

SEQ ID NO: 7618783 - DNA, 22 bp, Homo sapiens
tttggtaaccttgcattcttta

SEQ ID NO: 7618784 - DNA, 22 bp, Homo sapiens
tttggtaaccttgcattcttta

SEQ ID NO: 7618785 - DNA, 22 bp, Homo sapiens
tttgtcataactctgctgcaag

SEQ ID NO: 7618786 - DNA, 22 bp, Homo sapiens
tttgtcatatagactattgtga

SEQ ID NO: 7618787 - DNA, 22 bp, Homo sapiens
tttgtcatatagactattgtga

SEQ ID NO: 7618788 - DNA, 22 bp, Homo sapiens
tttgtcatatcacacaattttg

SEQ ID NO: 7618789 - DNA, 22 bp, Homo sapiens
tttgtcataactctgctgcaag

SEQ ID NO: 7618790 - DNA, 22 bp, Homo sapiens
tttgtcatatagactattgtga

SEQ ID NO: 7618791 - DNA, 22 bp, Homo sapiens
tttgtcatatcacacaattttg

SEQ ID NO: 7618792 - DNA, 22 bp, Homo sapiens
tttgtcatatcacacaattttg

SEQ ID NO: 7618793 - DNA, 22 bp, Homo sapiens
tttgtcatattgaaggtgctta

SEQ ID NO: 7618794 - DNA, 22 bp, Homo sapiens
tttgtcatgtccttaactgtct

SEQ ID NO: 7618795 - DNA, 19 bp, Homo sapiens
tttgtcatggtgagttgtt

SEQ ID NO: 7618796 - DNA, 22 bp, Homo sapiens
tttgtcatgctttccttatgga

SEQ ID NO: 7618797 - DNA, 22 bp, Homo sapiens
tttgtcatcccttttgaaactg

SEQ ID NO: 7618798 - DNA, 22 bp, Homo sapiens
tttgtcatcagttattaatatg

SEQ ID NO: 7618799 - DNA, 22 bp, Homo sapiens
tttgtcatatcacacaattttg

SEQ ID NO: 7618800 - DNA, 22 bp, Homo sapiens
tttgtcatcagttattaatatg

SEQ ID NO: 7618801 - DNA, 22 bp, Homo sapiens
tttgtcatattgaaggtgctta

SEQ ID NO: 7618802 - DNA, 22 bp, Homo sapiens
tttgtcatcccttttgaaactg

SEQ ID NO: 7618803 - DNA, 22 bp, Homo sapiens
tttgtcatcccttttgaaactg

SEQ ID NO: 7618804 - DNA, 22 bp, Homo sapiens
tttgtcatcagttattaatatg

SEQ ID NO: 7618805 - DNA, 22 bp, Homo sapiens
tttggctagccaagaaacaaaa

SEQ ID NO: 7618806 - DNA, 22 bp, Homo sapiens
tttggctcagctcacagatccc

SEQ ID NO: 7618807 - DNA, 23 bp, Homo sapiens
tttggctccatgggtggctcatt

SEQ ID NO: 7618808 - DNA, 22 bp, Homo sapiens
tttggctcggctgctgatggtg

SEQ ID NO: 7618809 - DNA, 22 bp, Homo sapiens
tttggctcggctgctgatggtg

SEQ ID NO: 7618810 - DNA, 22 bp, Homo sapiens
tttggctctgcgtcttcaccca

SEQ ID NO: 7618811 - DNA, 22 bp, Homo sapiens
tttggctctagtaaatataacc

SEQ ID NO: 7618812 - DNA, 22 bp, Homo sapiens
tttggctctcacttgcactcag

SEQ ID NO: 7618813 - DNA, 22 bp, Homo sapiens
tttggctctgcgtcttcaccca

SEQ ID NO: 7618814 - DNA, 19 bp, Homo sapiens
tttggctctggtcagagag

SEQ ID NO: 7618815 - DNA, 22 bp, Homo sapiens
tttggctctgtgtcttcaccca

SEQ ID NO: 7618816 - DNA, 22 bp, Homo sapiens
tttggctctgtgtcttcaccca

SEQ ID NO: 7618817 - DNA, 22 bp, Homo sapiens
tttggctctgtgtctccaccca

SEQ ID NO: 7618818 - DNA, 22 bp, Homo sapiens
tttggctctgtgtctccaccca

SEQ ID NO: 7618819 - DNA, 22 bp, Homo sapiens
tttggctctggttctggctcca

SEQ ID NO: 7618820 - DNA, 22 bp, Homo sapiens
tttggcttaacttacatgatat

SEQ ID NO: 7618821 - DNA, 22 bp, Homo sapiens
tttggcttaacttacatgatat

SEQ ID NO: 7618822 - DNA, 22 bp, Homo sapiens
tttggctgtgtgctcccttttc

SEQ ID NO: 7618823 - DNA, 22 bp, Homo sapiens
tttggctgtgtgctcccttttc

SEQ ID NO: 7618824 - DNA, 23 bp, Homo sapiens
tttggctgggctgtgggcacacc

SEQ ID NO: 7618825 - DNA, 22 bp, Homo sapiens
tttggctgtcatttgaaaatgt

SEQ ID NO: 7618826 - DNA, 22 bp, Homo sapiens
tttggctgagaagttgtgcttt

SEQ ID NO: 7618827 - DNA, 22 bp, Homo sapiens
tttggctggatgatagaactaa

SEQ ID NO: 7618828 - DNA, 23 bp, Homo sapiens
tttggctgggctgtgggcacacc

SEQ ID NO: 7618829 - DNA, 22 bp, Homo sapiens
tttggctcttcccgtaccataa

SEQ ID NO: 7618830 - DNA, 22 bp, Homo sapiens
tttggctgaagaccagattaaa

SEQ ID NO: 7618831 - DNA, 22 bp, Homo sapiens
tttggctttagtgccttctgat

SEQ ID NO: 7618832 - DNA, 22 bp, Homo sapiens
tttggcttgcactggcaccaac

SEQ ID NO: 7618833 - DNA, 22 bp, Homo sapiens
tttggcttgcactggcaccaac

SEQ ID NO: 7618834 - DNA, 20 bp, Homo sapiens
tttggcttcaagtgcattgc

SEQ ID NO: 7618835 - DNA, 22 bp, Homo sapiens
tttggcttaacttacatgatat

SEQ ID NO: 7618836 - DNA, 22 bp, Homo sapiens
tttggcttaacttacatgatat

SEQ ID NO: 7618837 - DNA, 21 bp, Homo sapiens
tttggcttctctgctgcagcc

SEQ ID NO: 7618838 - DNA, 22 bp, Homo sapiens
tttggcttctcctaccacctct

SEQ ID NO: 7618839 - DNA, 22 bp, Homo sapiens
tttggctactgtacagaaagcc

SEQ ID NO: 7618840 - DNA, 22 bp, Homo sapiens
tttggcgtctctcaggagctca

SEQ ID NO: 7618841 - DNA, 22 bp, Homo sapiens
tttggcctgggccagcatatat

SEQ ID NO: 7618842 - DNA, 22 bp, Homo sapiens
tttggccatatctatactcagc

SEQ ID NO: 7618843 - DNA, 22 bp, Homo sapiens
tttggccatatctatactcagc

SEQ ID NO: 7618844 - DNA, 22 bp, Homo sapiens
tttggccatatctatactcagc

SEQ ID NO: 7618845 - DNA, 18 bp, Homo sapiens
tttggccatgacctggct

SEQ ID NO: 7618846 - DNA, 18 bp, Homo sapiens
tttggccatgacctggct

SEQ ID NO: 7618847 - DNA, 18 bp, Homo sapiens
tttggccatgacctggct

SEQ ID NO: 7618848 - DNA, 22 bp, Homo sapiens
tttggccatgctcaagggtata

SEQ ID NO: 7618849 - DNA, 22 bp, Homo sapiens
tttggccatgctcaagggtata

SEQ ID NO: 7618850 - DNA, 22 bp, Homo sapiens
tttggccatgctcaagggtata

SEQ ID NO: 7618851 - DNA, 21 bp, Homo sapiens
tttggcctagaggcttctctg

SEQ ID NO: 7618852 - DNA, 22 bp, Homo sapiens
tttggcctcatgaatttcttgc

SEQ ID NO: 7618853 - DNA, 22 bp, Homo sapiens
tttggcctcatgaatttcttgc

SEQ ID NO: 7618854 - DNA, 21 bp, Homo sapiens
tttggcctctgcctgagctcc

SEQ ID NO: 7618855 - DNA, 22 bp, Homo sapiens
tttggcctctgggagaatattc

SEQ ID NO: 7618856 - DNA, 22 bp, Homo sapiens
tttggccttagtccagaagaag

SEQ ID NO: 7618857 - DNA, 22 bp, Homo sapiens
tttggccaacaacatggaagct

SEQ ID NO: 7618858 - DNA, 22 bp, Homo sapiens
tttggccaagaaagttctgtgg

SEQ ID NO: 7618859 - DNA, 21 bp, Homo sapiens
tttggcattatgtcaccagag

SEQ ID NO: 7618860 - DNA, 23 bp, Homo sapiens
tttggcatgttaacttcacttac

SEQ ID NO: 7618861 - DNA, 22 bp, Homo sapiens
tttggcatttaataggtgatca

SEQ ID NO: 7618862 - DNA, 22 bp, Homo sapiens
tttggccacagatccttggggg

SEQ ID NO: 7618863 - DNA, 22 bp, Homo sapiens
tttggccacttcatagatcatt

SEQ ID NO: 7618864 - DNA, 22 bp, Homo sapiens
tttggccacttcatagatcatt

SEQ ID NO: 7618865 - DNA, 22 bp, Homo sapiens
tttggccacttcatagatcatt

SEQ ID NO: 7618866 - DNA, 22 bp, Homo sapiens
tttggccacttgggagtccagg

SEQ ID NO: 7618867 - DNA, 22 bp, Homo sapiens
tttggccacttgggagtccagg

SEQ ID NO: 7618868 - DNA, 22 bp, Homo sapiens
tttggccaggtctggaaacagt

SEQ ID NO: 7618869 - DNA, 22 bp, Homo sapiens
tttggccaggtctggaaacagt

SEQ ID NO: 7618870 - DNA, 22 bp, Homo sapiens
tttgcttgttcaagatttctgt

SEQ ID NO: 7618871 - DNA, 17 bp, Homo sapiens
tttggcagtcttttaca

SEQ ID NO: 7618872 - DNA, 22 bp, Homo sapiens
tttggcaggtggcagctctggg

SEQ ID NO: 7618873 - DNA, 17 bp, Homo sapiens
tttggcagtcttttaca

SEQ ID NO: 7618874 - DNA, 22 bp, Homo sapiens
tttggcagtgaagccctctcat

SEQ ID NO: 7618875 - DNA, 22 bp, Homo sapiens
tttggcagtgaagccctctcat

SEQ ID NO: 7618876 - DNA, 21 bp, Homo sapiens
tttggcagtttcccaggaaat

SEQ ID NO: 7618877 - DNA, 21 bp, Homo sapiens
tttggcagtttcccaggaaat

SEQ ID NO: 7618878 - DNA, 22 bp, Homo sapiens
tttggcatagctctttgttcct

SEQ ID NO: 7618879 - DNA, 22 bp, Homo sapiens
tttggcatagctctttgttcct

SEQ ID NO: 7618880 - DNA, 22 bp, Homo sapiens
tttggcatagctctttgttcct

SEQ ID NO: 7618881 - DNA, 20 bp, Homo sapiens
tttggcatcattttgggagc

SEQ ID NO: 7618882 - DNA, 22 bp, Homo sapiens
tttggcatgggctatttgcttt

SEQ ID NO: 7618883 - DNA, 23 bp, Homo sapiens
tttggcatgttaacttcacttac

SEQ ID NO: 7618884 - DNA, 20 bp, Homo sapiens
tttgagaccagtctgcccaa

SEQ ID NO: 7618885 - DNA, 20 bp, Homo sapiens
tttgagaccagtctgcccaa

SEQ ID NO: 7618886 - DNA, 21 bp, Homo sapiens
tttgagaattggtcagagtgc

SEQ ID NO: 7618887 - DNA, 20 bp, Homo sapiens
tttgagaccagtctgcccaa

SEQ ID NO: 7618888 - DNA, 20 bp, Homo sapiens
tttgagaccagtctgcccaa

SEQ ID NO: 7618889 - DNA, 20 bp, Homo sapiens
tttgagaccagtctgcccaa

SEQ ID NO: 7618890 - DNA, 20 bp, Homo sapiens
tttgagaccagtctgcccaa

SEQ ID NO: 7618891 - DNA, 21 bp, Homo sapiens
tttgagaattggtcagagtgc

SEQ ID NO: 7618892 - DNA, 22 bp, Homo sapiens
tttgagaatggtaagtggatcg

SEQ ID NO: 7618893 - DNA, 22 bp, Homo sapiens
tttgagaatggtaagtggatcg

SEQ ID NO: 7618894 - DNA, 22 bp, Homo sapiens
tttgagaatggtaagtggatcg

SEQ ID NO: 7618895 - DNA, 22 bp, Homo sapiens
tttgagaatggtaagtggatcg

SEQ ID NO: 7618896 - DNA, 18 bp, Homo sapiens
tttgagaatgcatgactg

SEQ ID NO: 7618897 - DNA, 19 bp, Homo sapiens
tttgagaagttattatcta

SEQ ID NO: 7618898 - DNA, 22 bp, Homo sapiens
tttgagcagaagggtgacatgc

SEQ ID NO: 7618899 - DNA, 22 bp, Homo sapiens
tttgagcagaagggtgacatgc

SEQ ID NO: 7618900 - DNA, 22 bp, Homo sapiens
tttgagcaagttccattaagct

SEQ ID NO: 7618901 - DNA, 22 bp, Homo sapiens
tttgagcagagaaaggacatga

SEQ ID NO: 7618902 - DNA, 22 bp, Homo sapiens
tttgagattccttagctcagag

SEQ ID NO: 7618903 - DNA, 22 bp, Homo sapiens
tttgagatagtctagagtaact

SEQ ID NO: 7618904 - DNA, 22 bp, Homo sapiens
tttgagatggagtcttgctctg

SEQ ID NO: 7618905 - DNA, 22 bp, Homo sapiens
tttgagatggagtcttgctctg

SEQ ID NO: 7618906 - DNA, 22 bp, Homo sapiens
tttgcagtgttcatcagtattt

SEQ ID NO: 7618907 - DNA, 22 bp, Homo sapiens
tttgagcttgtagcattgctat

SEQ ID NO: 7618908 - DNA, 19 bp, Homo sapiens
tttgcagtggttcctttgt

SEQ ID NO: 7618909 - DNA, 22 bp, Homo sapiens
tttgagctatgggcttggattt

SEQ ID NO: 7618910 - DNA, 22 bp, Homo sapiens
tttgagcagcagatgcacttag

SEQ ID NO: 7618911 - DNA, 22 bp, Homo sapiens
tttgcatattaatatctgcgct

SEQ ID NO: 7618912 - DNA, 22 bp, Homo sapiens
tttgcatggagtgaatggcgtg

SEQ ID NO: 7618913 - DNA, 22 bp, Homo sapiens
tttgcatcctgtgtgtgaaagt

SEQ ID NO: 7618914 - DNA, 18 bp, Homo sapiens
tttgcatggtaacattga

SEQ ID NO: 7618915 - DNA, 22 bp, Homo sapiens
tttgcatgggaggtagtaatca

SEQ ID NO: 7618916 - DNA, 22 bp, Homo sapiens
tttgcatgggaggtagtaatca

SEQ ID NO: 7618917 - DNA, 22 bp, Homo sapiens
tttgcattacttgactttagtt

SEQ ID NO: 7618918 - DNA, 22 bp, Homo sapiens
tttgcattacttgactttagtt

SEQ ID NO: 7618919 - DNA, 22 bp, Homo sapiens
tttgcattagtttagatttcaa

SEQ ID NO: 7618920 - DNA, 22 bp, Homo sapiens
tttgcattagtttagatttcaa

SEQ ID NO: 7618921 - DNA, 22 bp, Homo sapiens
tttgcattatatttatagaaga

SEQ ID NO: 7618922 - DNA, 22 bp, Homo sapiens
tttgcattatatttatagaaga

SEQ ID NO: 7618923 - DNA, 22 bp, Homo sapiens
tttgcattatctcacttatata

SEQ ID NO: 7618924 - DNA, 22 bp, Homo sapiens
tttgcattcctgcctgcattca

SEQ ID NO: 7618925 - DNA, 22 bp, Homo sapiens
tttgcattatctcacttatata

SEQ ID NO: 7618926 - DNA, 22 bp, Homo sapiens
tttgcagtttcattgctgaaat

SEQ ID NO: 7618927 - DNA, 22 bp, Homo sapiens
tttgcagtttcattgctgaaat

SEQ ID NO: 7618928 - DNA, 22 bp, Homo sapiens
tttgcagtttcattgctgaaat

SEQ ID NO: 7618929 - DNA, 22 bp, Homo sapiens
tttgcagtttgttcagctcttt

SEQ ID NO: 7618930 - DNA, 22 bp, Homo sapiens
tttgcagttcatctgagaaaaa

SEQ ID NO: 7618931 - DNA, 22 bp, Homo sapiens
tttgcagttcatctgagaaaaa

SEQ ID NO: 7618932 - DNA, 22 bp, Homo sapiens
tttgcagttcatgttggaaaat

SEQ ID NO: 7618933 - DNA, 22 bp, Homo sapiens
tttgcataaaggagcatttctc

SEQ ID NO: 7618934 - DNA, 22 bp, Homo sapiens
tttgcataaaggagcatttctc

SEQ ID NO: 7618935 - DNA, 22 bp, Homo sapiens
tttgcataaaggagcatttctc

SEQ ID NO: 7618936 - DNA, 22 bp, Homo sapiens
tttgcataagtcatgtccagtg

SEQ ID NO: 7618937 - DNA, 22 bp, Homo sapiens
tttgcataagtcatgtccagtg

SEQ ID NO: 7618938 - DNA, 22 bp, Homo sapiens
tttgcataggatggacatttta

SEQ ID NO: 7618939 - DNA, 22 bp, Homo sapiens
tttgcataggatggacatttta

SEQ ID NO: 7618940 - DNA, 22 bp, Homo sapiens
tttgcatacatgagaatgtctt

SEQ ID NO: 7618941 - DNA, 22 bp, Homo sapiens
tttgcatacatgagaatgtctt

SEQ ID NO: 7618942 - DNA, 22 bp, Homo sapiens
tttgcataggatggacatttta

SEQ ID NO: 7618943 - DNA, 22 bp, Homo sapiens
tttgcataggatggacatttta

SEQ ID NO: 7618944 - DNA, 22 bp, Homo sapiens
tttgcataccctccctgtgctg

SEQ ID NO: 7618945 - DNA, 22 bp, Homo sapiens
tttgcataccctccctgtgctg

SEQ ID NO: 7618946 - DNA, 22 bp, Homo sapiens
tttgcatttgttcaagtattga

SEQ ID NO: 7618947 - DNA, 21 bp, Homo sapiens
tttgcattttacatgtgggga

SEQ ID NO: 7618948 - DNA, 22 bp, Homo sapiens
tttgcatttgtttagaacctga

SEQ ID NO: 7618949 - DNA, 22 bp, Homo sapiens
tttgcatttgtttagaacctga

SEQ ID NO: 7618950 - DNA, 22 bp, Homo sapiens
tttgcatttgttcaagtattga

SEQ ID NO: 7618951 - DNA, 22 bp, Homo sapiens
tttgcatttgttcaagtattga

SEQ ID NO: 7618952 - DNA, 22 bp, Homo sapiens
tttgcatttctcgtaaggaaac

SEQ ID NO: 7618953 - DNA, 22 bp, Homo sapiens
tttgcatttctaatgagctccg

SEQ ID NO: 7618954 - DNA, 22 bp, Homo sapiens
tttgcatttctaatgagctccg

SEQ ID NO: 7618955 - DNA, 22 bp, Homo sapiens
tttgcatttataagttggtgga

SEQ ID NO: 7618956 - DNA, 22 bp, Homo sapiens
tttgcatttataagttggtgga

SEQ ID NO: 7618957 - DNA, 22 bp, Homo sapiens
tttgcatttccagagtagcaga

SEQ ID NO: 7618958 - DNA, 22 bp, Homo sapiens
tttgcattgcattaagtattct

SEQ ID NO: 7618959 - DNA, 22 bp, Homo sapiens
tttgcattgcattaagtattct

SEQ ID NO: 7618960 - DNA, 22 bp, Homo sapiens
tttgcattgcatacaaggaact

SEQ ID NO: 7618961 - DNA, 22 bp, Homo sapiens
tttgcattgcattaagtattct

SEQ ID NO: 7618962 - DNA, 22 bp, Homo sapiens
tttgcattgcagtggtttacag

SEQ ID NO: 7618963 - DNA, 22 bp, Homo sapiens
tttgcattctagaaaaatttct

SEQ ID NO: 7618964 - DNA, 22 bp, Homo sapiens
tttgcattgcctctgacttatg

SEQ ID NO: 7618965 - DNA, 22 bp, Homo sapiens
tttgcattgtaatatttagttc

SEQ ID NO: 7618966 - DNA, 22 bp, Homo sapiens
tttgcattgcctctgacttatg

SEQ ID NO: 7618967 - DNA, 22 bp, Homo sapiens
tttgcattgtttcaaaagtgaa

SEQ ID NO: 7618968 - DNA, 22 bp, Homo sapiens
tttgcattgtaatatttagttc

SEQ ID NO: 7618969 - DNA, 22 bp, Homo sapiens
tttgcattgtaatatttagttc

SEQ ID NO: 7618970 - DNA, 22 bp, Homo sapiens
tttgcttgacccttgtgctgaa

SEQ ID NO: 7618971 - DNA, 22 bp, Homo sapiens
tttgcttcacaagtatggttct

SEQ ID NO: 7618972 - DNA, 21 bp, Homo sapiens
tttgcttcaattccagaagct

SEQ ID NO: 7618973 - DNA, 21 bp, Homo sapiens
tttgcttcaattccagaagct

SEQ ID NO: 7618974 - DNA, 22 bp, Homo sapiens
tttgcttcacaagtatggttct

SEQ ID NO: 7618975 - DNA, 21 bp, Homo sapiens
tttgcttcaattccagaagct

SEQ ID NO: 7618976 - DNA, 22 bp, Homo sapiens
tttgcttaactggtagaatgcg

SEQ ID NO: 7618977 - DNA, 22 bp, Homo sapiens
tttgcttaactggtagaatgcg

SEQ ID NO: 7618978 - DNA, 22 bp, Homo sapiens
tttgcttaaagttctttctggt

SEQ ID NO: 7618979 - DNA, 22 bp, Homo sapiens
tttgcttaaaagcggagcaaga

SEQ ID NO: 7618980 - DNA, 22 bp, Homo sapiens
tttgcttaaagttctttctggt

SEQ ID NO: 7618981 - DNA, 22 bp, Homo sapiens
tttgcttaaagttctttctggt

SEQ ID NO: 7618982 - DNA, 22 bp, Homo sapiens
tttgctgtgggatatccatgtg

SEQ ID NO: 7618983 - DNA, 22 bp, Homo sapiens
tttgctgtgggatatccatgtg

SEQ ID NO: 7618984 - DNA, 20 bp, Homo sapiens
tttgctgtgggtgtaagaat

SEQ ID NO: 7618985 - DNA, 20 bp, Homo sapiens
tttgctgtgggtgtaagaat

SEQ ID NO: 7618986 - DNA, 20 bp, Homo sapiens
tttgctgtgggtgtaagaat

SEQ ID NO: 7618987 - DNA, 22 bp, Homo sapiens
tttgctgtcagccgctattttc

SEQ ID NO: 7618988 - DNA, 22 bp, Homo sapiens
tttgctgtcagccgctattttc

SEQ ID NO: 7618989 - DNA, 22 bp, Homo sapiens
tttgctgtcagccgctattttc

SEQ ID NO: 7618990 - DNA, 22 bp, Homo sapiens
tttgctgtcagccgctattttc

SEQ ID NO: 7618991 - DNA, 22 bp, Homo sapiens
tttgctgtgcttacatatgtat

SEQ ID NO: 7618992 - DNA, 22 bp, Homo sapiens
tttgctgtgcttacatatgtat

SEQ ID NO: 7618993 - DNA, 22 bp, Homo sapiens
tttgctgtgaatccattactgt

SEQ ID NO: 7618994 - DNA, 22 bp, Homo sapiens
tttgctgaccccattctgagtc

SEQ ID NO: 7618995 - DNA, 22 bp, Homo sapiens
tttgctgactggatgcagttgg

SEQ ID NO: 7618996 - DNA, 22 bp, Homo sapiens
tttgctgaccccattctgagtc

SEQ ID NO: 7618997 - DNA, 22 bp, Homo sapiens
tttgctgaatagattgtaaact

SEQ ID NO: 7618998 - DNA, 21 bp, Homo sapiens
tttgctgaatgattccagggc

SEQ ID NO: 7618999 - DNA, 22 bp, Homo sapiens
tttgctgaatagattgtaaact

SEQ ID NO: 7619000 - DNA, 22 bp, Homo sapiens
tttgctgaataaatgtgtgact

SEQ ID NO: 7619001 - DNA, 22 bp, Homo sapiens
tttgctgaatagattgtaaact

SEQ ID NO: 7619002 - DNA, 22 bp, Homo sapiens
tttgctgaactaaaattctgaa

SEQ ID NO: 7619003 - DNA, 21 bp, Homo sapiens
tttgctgaagattttaggctg

SEQ ID NO: 7619004 - DNA, 22 bp, Homo sapiens
tttgctgaataaatgtgtgact

SEQ ID NO: 7619005 - DNA, 22 bp, Homo sapiens
tttgctgagttgaagtttgagg

SEQ ID NO: 7619006 - DNA, 22 bp, Homo sapiens
tttgctgaggtgaggtgaaggt

SEQ ID NO: 7619007 - DNA, 22 bp, Homo sapiens
tttgctgaggtgaggtgaaggt

SEQ ID NO: 7619008 - DNA, 22 bp, Homo sapiens
tttgctgaggtgaggtgaaggt

SEQ ID NO: 7619009 - DNA, 22 bp, Homo sapiens
tttgctgagttttctcctaaga

SEQ ID NO: 7619010 - DNA, 22 bp, Homo sapiens
tttgctgagttgaagtttgagg

SEQ ID NO: 7619011 - DNA, 22 bp, Homo sapiens
tttgctgagttttctcctaaga

SEQ ID NO: 7619012 - DNA, 19 bp, Homo sapiens
tttgctggttcaggaaaga

SEQ ID NO: 7619013 - DNA, 19 bp, Homo sapiens
tttgctggttcaggaaaga

SEQ ID NO: 7619014 - DNA, 22 bp, Homo sapiens
tttgctgggctctgtgccagac

SEQ ID NO: 7619015 - DNA, 22 bp, Homo sapiens
tttgctgggctctgtgccagac

SEQ ID NO: 7619016 - DNA, 22 bp, Homo sapiens
tttgctgatattttgctgatac

SEQ ID NO: 7619017 - DNA, 22 bp, Homo sapiens
tttgctgatattttgctgatac

SEQ ID NO: 7619018 - DNA, 21 bp, Homo sapiens
ttttttcttgcgtgaggcctg

SEQ ID NO: 7619019 - DNA, 21 bp, Homo sapiens
ttttttcttgcgtgaggcctg

SEQ ID NO: 7619020 - DNA, 21 bp, Homo sapiens
ttttttcttgcgtgaggcctg

SEQ ID NO: 7619021 - DNA, 21 bp, Homo sapiens
ttttttcttgcgtgaggcctg

SEQ ID NO: 7619022 - DNA, 21 bp, Homo sapiens
ttttttcttgcgtgaggcctg

SEQ ID NO: 7619023 - DNA, 21 bp, Homo sapiens
ttttttcttgcgtgaggcctg

SEQ ID NO: 7619024 - DNA, 22 bp, Homo sapiens
ttttttggataataaacgatct

SEQ ID NO: 7619025 - DNA, 22 bp, Homo sapiens
ttttttgcacactctgctaaat

SEQ ID NO: 7619026 - DNA, 22 bp, Homo sapiens
ttttttgcacactctgctaaat

SEQ ID NO: 7619027 - DNA, 22 bp, Homo sapiens
ttttttgcacactctgctaaat

SEQ ID NO: 7619028 - DNA, 21 bp, Homo sapiens
ttttttcttgcgtgaggcctg

SEQ ID NO: 7619029 - DNA, 21 bp, Homo sapiens
ttttttcttgcgtgaggcctg

SEQ ID NO: 7619030 - DNA, 22 bp, Homo sapiens
ttttttggtgctcctaggaagg

SEQ ID NO: 7619031 - DNA, 22 bp, Homo sapiens
ttttttggataataaacgatct

SEQ ID NO: 7619032 - DNA, 22 bp, Homo sapiens
ttttttgcacactctgctaaat

SEQ ID NO: 7619033 - DNA, 22 bp, Homo sapiens
ttttttgtagcaagcgcagata

SEQ ID NO: 7619034 - DNA, 22 bp, Homo sapiens
ttttttgtagcaagcgcagata

SEQ ID NO: 7619035 - DNA, 22 bp, Homo sapiens
ttttttgtagcaagcgcagata

SEQ ID NO: 7619036 - DNA, 22 bp, Homo sapiens
ttttttgtagcaagcgcagata

SEQ ID NO: 7619037 - DNA, 22 bp, Homo sapiens
ttttttccttcatgacttaaga

SEQ ID NO: 7619038 - DNA, 22 bp, Homo sapiens
ttttttccttcatgacttaaga

SEQ ID NO: 7619039 - DNA, 22 bp, Homo sapiens
ttttttccttcatgacttaaga

SEQ ID NO: 7619040 - DNA, 22 bp, Homo sapiens
ttttttccttcatgacttaaga

SEQ ID NO: 7619041 - DNA, 22 bp, Homo sapiens
ttttttccttcatgacttaaga

SEQ ID NO: 7619042 - DNA, 22 bp, Homo sapiens
ttttttcctgagccttgtggtc

SEQ ID NO: 7619043 - DNA, 22 bp, Homo sapiens
ttttttcctctgtgatggcaaa

SEQ ID NO: 7619044 - DNA, 22 bp, Homo sapiens
ttttttcctctgtgatggcaaa

SEQ ID NO: 7619045 - DNA, 22 bp, Homo sapiens
ttttttcctctgtgatggcaaa

SEQ ID NO: 7619046 - DNA, 22 bp, Homo sapiens
ttttttcctgagccttgtggtc

SEQ ID NO: 7619047 - DNA, 22 bp, Homo sapiens
ttttttcctgagccttgtggtc

SEQ ID NO: 7619048 - DNA, 22 bp, Homo sapiens
ttttttcctgagccttgtggtc

SEQ ID NO: 7619049 - DNA, 22 bp, Homo sapiens
ttttttcctgagccttgtggtc

SEQ ID NO: 7619050 - DNA, 22 bp, Homo sapiens
ttttttccaggaagccactgga

SEQ ID NO: 7619051 - DNA, 22 bp, Homo sapiens
ttttttccaggaagccactgga

SEQ ID NO: 7619052 - DNA, 22 bp, Homo sapiens
ttttttccagcttctagaggcc

SEQ ID NO: 7619053 - DNA, 22 bp, Homo sapiens
ttttttccagcttctagaggcc

SEQ ID NO: 7619054 - DNA, 22 bp, Homo sapiens
ttttttccagcttctagaggcc

SEQ ID NO: 7619055 - DNA, 22 bp, Homo sapiens
ttttttccagcttctagaggcc

SEQ ID NO: 7619056 - DNA, 22 bp, Homo sapiens
ttttttccagcttctagaggcc

SEQ ID NO: 7619057 - DNA, 22 bp, Homo sapiens
ttttttccagcttctagaggcc

SEQ ID NO: 7619058 - DNA, 22 bp, Homo sapiens
ttttttccagcttctagaggcc

SEQ ID NO: 7619059 - DNA, 22 bp, Homo sapiens
ttttttccaggaagccactgga

SEQ ID NO: 7619060 - DNA, 22 bp, Homo sapiens
ttttttccaggaagccactgga

SEQ ID NO: 7619061 - DNA, 22 bp, Homo sapiens
ttttttccaggaagccactgga

SEQ ID NO: 7619062 - DNA, 22 bp, Homo sapiens
ttttttcctctgtgatggcaaa

SEQ ID NO: 7619063 - DNA, 22 bp, Homo sapiens
ttttttcctctgtgatggcaaa

SEQ ID NO: 7619064 - DNA, 22 bp, Homo sapiens
ttttttcctctgtgatggcaaa

SEQ ID NO: 7619065 - DNA, 22 bp, Homo sapiens
tttattgctggccacctgtagc

SEQ ID NO: 7619066 - DNA, 22 bp, Homo sapiens
tttattgctcagcagttagttg

SEQ ID NO: 7619067 - DNA, 22 bp, Homo sapiens
tttattgctcagcagttagttg

SEQ ID NO: 7619068 - DNA, 22 bp, Homo sapiens
tttattgctggccacctgtagc

SEQ ID NO: 7619069 - DNA, 22 bp, Homo sapiens
tttattgctggccacctgtagc

SEQ ID NO: 7619070 - DNA, 22 bp, Homo sapiens
tttattgctgagaaggattcca

SEQ ID NO: 7619071 - DNA, 22 bp, Homo sapiens
tttattgctgagaaggattcca

SEQ ID NO: 7619072 - DNA, 22 bp, Homo sapiens
tttattgctagcccttggtcca

SEQ ID NO: 7619073 - DNA, 22 bp, Homo sapiens
tttattgctagcccttggtcca

SEQ ID NO: 7619074 - DNA, 22 bp, Homo sapiens
tttattgctagcccttggtcca

SEQ ID NO: 7619075 - DNA, 22 bp, Homo sapiens
tttattgctcagcagttagttg

SEQ ID NO: 7619076 - DNA, 22 bp, Homo sapiens
tttattggaacacagccatgac

SEQ ID NO: 7619077 - DNA, 22 bp, Homo sapiens
tttattggaacacagccatgac

SEQ ID NO: 7619078 - DNA, 22 bp, Homo sapiens
tttattggaacacagccatgac

SEQ ID NO: 7619079 - DNA, 22 bp, Homo sapiens
tttattggaacacagccatgac

SEQ ID NO: 7619080 - DNA, 22 bp, Homo sapiens
tttattggaacacagccatgac

SEQ ID NO: 7619081 - DNA, 22 bp, Homo sapiens
tttattgctgtgttagggacag

SEQ ID NO: 7619082 - DNA, 22 bp, Homo sapiens
tttattgctgtgttagggacag

SEQ ID NO: 7619083 - DNA, 22 bp, Homo sapiens
tttattgctgtgttagggacag

SEQ ID NO: 7619084 - DNA, 22 bp, Homo sapiens
tttattggaacacagccatgac

SEQ ID NO: 7619085 - DNA, 22 bp, Homo sapiens
tttattggaacacagccatgac

SEQ ID NO: 7619086 - DNA, 22 bp, Homo sapiens
tttattggaacacagccatgac

SEQ ID NO: 7619087 - DNA, 22 bp, Homo sapiens
tttattggatgggtcagctcta

SEQ ID NO: 7619088 - DNA, 22 bp, Homo sapiens
tttattggatgggtcagctcta

SEQ ID NO: 7619089 - DNA, 22 bp, Homo sapiens
tttattggatgggtcagctcta

SEQ ID NO: 7619090 - DNA, 22 bp, Homo sapiens
tttattggatgggtcagctcta

SEQ ID NO: 7619091 - DNA, 22 bp, Homo sapiens
tttattggatggatggatggat

SEQ ID NO: 7619092 - DNA, 22 bp, Homo sapiens
tttattggatggatggatggat

SEQ ID NO: 7619093 - DNA, 22 bp, Homo sapiens
tttattggatggatggatggat

SEQ ID NO: 7619094 - DNA, 22 bp, Homo sapiens
tttattggatgggtcagctcta

SEQ ID NO: 7619095 - DNA, 22 bp, Homo sapiens
tttattggatgggtcagctcta

SEQ ID NO: 7619096 - DNA, 20 bp, Homo sapiens
tttattggcctttcaggaac

SEQ ID NO: 7619097 - DNA, 20 bp, Homo sapiens
tttattggcctttcaggaac

SEQ ID NO: 7619098 - DNA, 20 bp, Homo sapiens
tttattggcctttcaggaac

SEQ ID NO: 7619099 - DNA, 20 bp, Homo sapiens
tttattggcctttcaggaac

SEQ ID NO: 7619100 - DNA, 22 bp, Homo sapiens
tttattggatatttacaagata

SEQ ID NO: 7619101 - DNA, 22 bp, Homo sapiens
tttattggatggatggatggat

SEQ ID NO: 7619102 - DNA, 22 bp, Homo sapiens
tttattggatggatggatggat

SEQ ID NO: 7619103 - DNA, 22 bp, Homo sapiens
tttattggatggatggatggat

SEQ ID NO: 7619104 - DNA, 22 bp, Homo sapiens
tttattggatggatggatggat

SEQ ID NO: 7619105 - DNA, 22 bp, Homo sapiens
tttattggatatttacaagata

SEQ ID NO: 7619106 - DNA, 22 bp, Homo sapiens
tttattggatatttacaagata

SEQ ID NO: 7619107 - DNA, 22 bp, Homo sapiens
tttattggatatttacaagata

SEQ ID NO: 7619108 - DNA, 22 bp, Homo sapiens
tttattggatatttacaagata

SEQ ID NO: 7619109 - DNA, 22 bp, Homo sapiens
tttattggatatttacaagata

SEQ ID NO: 7619110 - DNA, 22 bp, Homo sapiens
tttattgggcctggaggatcta

SEQ ID NO: 7619111 - DNA, 22 bp, Homo sapiens
tttattgggcctggaggatcta

SEQ ID NO: 7619112 - DNA, 22 bp, Homo sapiens
tttattgggtgcagtgcccaca

SEQ ID NO: 7619113 - DNA, 22 bp, Homo sapiens
tttattgggtgcagtgcccaca

SEQ ID NO: 7619114 - DNA, 22 bp, Homo sapiens
tttattgggtgcagtgcccaca

SEQ ID NO: 7619115 - DNA, 22 bp, Homo sapiens
tttattgggtgcagtgcccaca

SEQ ID NO: 7619116 - DNA, 20 bp, Homo sapiens
tttattggcctttcaggaac

SEQ ID NO: 7619117 - DNA, 20 bp, Homo sapiens
tttattggcctttcaggaac

SEQ ID NO: 7619118 - DNA, 22 bp, Homo sapiens
tttattgggcctggaggatcta

SEQ ID NO: 7619119 - DNA, 22 bp, Homo sapiens
tttattgggcctggaggatcta

SEQ ID NO: 7619120 - DNA, 22 bp, Homo sapiens
tttattgggcctggaggatcta

SEQ ID NO: 7619121 - DNA, 22 bp, Homo sapiens
tttattgggcctggaggatcta

SEQ ID NO: 7619122 - DNA, 22 bp, Homo sapiens
tttattgggtgcagtgcccaca

SEQ ID NO: 7619123 - DNA, 22 bp, Homo sapiens
tttattgggtgcagtgcccaca

SEQ ID NO: 7619124 - DNA, 22 bp, Homo sapiens
tttattgtcaatctattcccag

SEQ ID NO: 7619125 - DNA, 22 bp, Homo sapiens
tttattgtcaatctattcccag

SEQ ID NO: 7619126 - DNA, 22 bp, Homo sapiens
tttattgtcaatctattcccag

SEQ ID NO: 7619127 - DNA, 22 bp, Homo sapiens
tttattgtcaatctattcccag

SEQ ID NO: 7619128 - DNA, 22 bp, Homo sapiens
tttattgtcaatctattcccag

SEQ ID NO: 7619129 - DNA, 22 bp, Homo sapiens
tttattgtctatgaactgcttg

SEQ ID NO: 7619130 - DNA, 22 bp, Homo sapiens
tttattgtctatgaactgcttg

SEQ ID NO: 7619131 - DNA, 22 bp, Homo sapiens
tttattgtctatgaactgcttg

SEQ ID NO: 7619132 - DNA, 22 bp, Homo sapiens
tttattgtctatgaactgcttg

SEQ ID NO: 7619133 - DNA, 22 bp, Homo sapiens
tttattgtctatgaactgcttg

SEQ ID NO: 7619134 - DNA, 22 bp, Homo sapiens
tttatttataagccacttgctg

SEQ ID NO: 7619135 - DNA, 22 bp, Homo sapiens
tttatttataagccacttgctg

SEQ ID NO: 7619136 - DNA, 22 bp, Homo sapiens
tttatttataagccacttgctg

SEQ ID NO: 7619137 - DNA, 22 bp, Homo sapiens
tttatttataagccacttgctg

SEQ ID NO: 7619138 - DNA, 22 bp, Homo sapiens
tttatttataagccacttgctg

SEQ ID NO: 7619139 - DNA, 22 bp, Homo sapiens
tttatttataagccacttgctg

SEQ ID NO: 7619140 - DNA, 22 bp, Homo sapiens
tttatttataagccacttgctg

SEQ ID NO: 7619141 - DNA, 16 bp, Homo sapiens
tttatttactagtgtt

SEQ ID NO: 7619142 - DNA, 22 bp, Homo sapiens
tttattgtgttgaaactgaatt

SEQ ID NO: 7619143 - DNA, 16 bp, Homo sapiens
tttatttactagtgtt

SEQ ID NO: 7619144 - DNA, 22 bp, Homo sapiens
tttattgtcttcgtggtgccta

SEQ ID NO: 7619145 - DNA, 22 bp, Homo sapiens
tttattgtcttcgtggtgccta

SEQ ID NO: 7619146 - DNA, 22 bp, Homo sapiens
tttattgtcttcgtggtgccta

SEQ ID NO: 7619147 - DNA, 22 bp, Homo sapiens
tttattgtcttcgtggtgccta

SEQ ID NO: 7619148 - DNA, 22 bp, Homo sapiens
tttattgtcttcgtggtgccta

SEQ ID NO: 7619149 - DNA, 22 bp, Homo sapiens
tttattgtcttcgtggtgccta

SEQ ID NO: 7619150 - DNA, 22 bp, Homo sapiens
tttattgtgttgaaactgaatt

SEQ ID NO: 7619151 - DNA, 22 bp, Homo sapiens
tttattgtgttgaaactgaatt

SEQ ID NO: 7619152 - DNA, 22 bp, Homo sapiens
tttattgtgttgaaactgaatt

SEQ ID NO: 7619153 - DNA, 22 bp, Homo sapiens
tttattgtgttgaaactgaatt

SEQ ID NO: 7619154 - DNA, 22 bp, Homo sapiens
tttattgtcttcgtggtgccta

SEQ ID NO: 7619155 - DNA, 22 bp, Homo sapiens
tttattgtgttgaaactgaatt

SEQ ID NO: 7619156 - DNA, 22 bp, Homo sapiens
tttattgtgttgaaactgaatt

SEQ ID NO: 7619157 - DNA, 22 bp, Homo sapiens
tttatgacaagcattactgatt

SEQ ID NO: 7619158 - DNA, 22 bp, Homo sapiens
tttatgaactacagatataact

SEQ ID NO: 7619159 - DNA, 22 bp, Homo sapiens
tttatgacaagcattactgatt

SEQ ID NO: 7619160 - DNA, 22 bp, Homo sapiens
tttatgacattacaatatcaag

SEQ ID NO: 7619161 - DNA, 22 bp, Homo sapiens
tttatgaactacagatataact

SEQ ID NO: 7619162 - DNA, 22 bp, Homo sapiens
tttatgaactacagatataact

SEQ ID NO: 7619163 - DNA, 22 bp, Homo sapiens
tttatgaactacagatataact

SEQ ID NO: 7619164 - DNA, 22 bp, Homo sapiens
tttatctttggatcttcagaaa

SEQ ID NO: 7619165 - DNA, 22 bp, Homo sapiens
tttatgaaccactctacacctt

SEQ ID NO: 7619166 - DNA, 22 bp, Homo sapiens
tttatgaaccactctacacctt

SEQ ID NO: 7619167 - DNA, 22 bp, Homo sapiens
tttatgaaccactctacacctt

SEQ ID NO: 7619168 - DNA, 22 bp, Homo sapiens
tttatctttggatcttcagaaa

SEQ ID NO: 7619169 - DNA, 22 bp, Homo sapiens
tttatctttggatcttcagaaa

SEQ ID NO: 7619170 - DNA, 22 bp, Homo sapiens
tttatctttggatcttcagaaa

SEQ ID NO: 7619171 - DNA, 22 bp, Homo sapiens
tttatctttggatcttcagaaa

SEQ ID NO: 7619172 - DNA, 22 bp, Homo sapiens
tttatctttggatcttcagaaa

SEQ ID NO: 7619173 - DNA, 22 bp, Homo sapiens
tttatctttggatcttcagaaa

SEQ ID NO: 7619174 - DNA, 22 bp, Homo sapiens
tttatctttggatcttcagaaa

SEQ ID NO: 7619175 - DNA, 22 bp, Homo sapiens
tttatgacttctaatctgaagc

SEQ ID NO: 7619176 - DNA, 22 bp, Homo sapiens
tttatgacccaagaagatacca

SEQ ID NO: 7619177 - DNA, 22 bp, Homo sapiens
tttatgacattacaatatcaag

SEQ ID NO: 7619178 - DNA, 22 bp, Homo sapiens
tttatgacttctaatctgaagc

SEQ ID NO: 7619179 - DNA, 22 bp, Homo sapiens
tttatgacattacaatatcaag

SEQ ID NO: 7619180 - DNA, 22 bp, Homo sapiens
tttatgacccaagaagatacca

SEQ ID NO: 7619181 - DNA, 22 bp, Homo sapiens
tttatgagcaccttggcccaga

SEQ ID NO: 7619182 - DNA, 22 bp, Homo sapiens
tttatgagcctcaaatctgagt

SEQ ID NO: 7619183 - DNA, 22 bp, Homo sapiens
tttatgtaatttcataggtgtg

SEQ ID NO: 7619184 - DNA, 21 bp, Homo sapiens
tttatgtacttcatagagtag

SEQ ID NO: 7619185 - DNA, 21 bp, Homo sapiens
tttatgtacttcatagagtag

SEQ ID NO: 7619186 - DNA, 21 bp, Homo sapiens
tttatgtacttcatagagtag

SEQ ID NO: 7619187 - DNA, 22 bp, Homo sapiens
tttatgtacatatccacaagga

SEQ ID NO: 7619188 - DNA, 21 bp, Homo sapiens
tttatgtacttcatagagtag

SEQ ID NO: 7619189 - DNA, 22 bp, Homo sapiens
tttatgtaatttcataggtgtg

SEQ ID NO: 7619190 - DNA, 22 bp, Homo sapiens
tttatgtaatttcataggtgtg

SEQ ID NO: 7619191 - DNA, 22 bp, Homo sapiens
tttatgtacatatccacaagga

SEQ ID NO: 7619192 - DNA, 22 bp, Homo sapiens
tttatgtacatatccacaagga

SEQ ID NO: 7619193 - DNA, 22 bp, Homo sapiens
tttattgccctgtagtacagga

SEQ ID NO: 7619194 - DNA, 22 bp, Homo sapiens
tttattgccctgtagtacagga

SEQ ID NO: 7619195 - DNA, 22 bp, Homo sapiens
tttattgccctgtagtacagga

SEQ ID NO: 7619196 - DNA, 22 bp, Homo sapiens
tttattgccctgtagtacagga

SEQ ID NO: 7619197 - DNA, 22 bp, Homo sapiens
tttattgccctgtagtacagga

SEQ ID NO: 7619198 - DNA, 22 bp, Homo sapiens
tttattgccctgtagtacagga

SEQ ID NO: 7619199 - DNA, 22 bp, Homo sapiens
tttatgtttgcattttcaaaga

SEQ ID NO: 7619200 - DNA, 22 bp, Homo sapiens
tttatgtttgcattttcaaaga

SEQ ID NO: 7619201 - DNA, 22 bp, Homo sapiens
tttatgtttgcattttcaaaga

SEQ ID NO: 7619202 - DNA, 22 bp, Homo sapiens
tttatgtttgcattttcaaaga

SEQ ID NO: 7619203 - DNA, 22 bp, Homo sapiens
tttattgcatacacaaatgtca

SEQ ID NO: 7619204 - DNA, 22 bp, Homo sapiens
tttatgttgaagagactgtgtt

SEQ ID NO: 7619205 - DNA, 22 bp, Homo sapiens
tttatgttcctcttgagctttc

SEQ ID NO: 7619206 - DNA, 22 bp, Homo sapiens
tttatgtttgacaatgatctgg

SEQ ID NO: 7619207 - DNA, 22 bp, Homo sapiens
tttatgtttgacaatgatctgg

SEQ ID NO: 7619208 - DNA, 22 bp, Homo sapiens
tttatgtttgcattttcaaaga

SEQ ID NO: 7619209 - DNA, 22 bp, Homo sapiens
tttatgtttgacaatgatctgg

SEQ ID NO: 7619210 - DNA, 22 bp, Homo sapiens
tttatgtttgacaatgatctgg

SEQ ID NO: 7619211 - DNA, 22 bp, Homo sapiens
tttatgtttgacaatgatctgg

SEQ ID NO: 7619212 - DNA, 22 bp, Homo sapiens
tttatgtttgacaatgatctgg

SEQ ID NO: 7619213 - DNA, 22 bp, Homo sapiens
tttatgtgatgcatcccagaaa

SEQ ID NO: 7619214 - DNA, 22 bp, Homo sapiens
tttatgttatgggtaggatcaa

SEQ ID NO: 7619215 - DNA, 22 bp, Homo sapiens
tttatgttatgggtaggatcaa

SEQ ID NO: 7619216 - DNA, 22 bp, Homo sapiens
tttatgttcctcttgagctttc

SEQ ID NO: 7619217 - DNA, 22 bp, Homo sapiens
tttatgttcctcttgagctttc

SEQ ID NO: 7619218 - DNA, 22 bp, Homo sapiens
tttatgttcctcttgagctttc

SEQ ID NO: 7619219 - DNA, 22 bp, Homo sapiens
tttatgtcccttcaaatgttta

SEQ ID NO: 7619220 - DNA, 19 bp, Homo sapiens
tttatgtcattgaggtcat

SEQ ID NO: 7619221 - DNA, 22 bp, Homo sapiens
tttatgtagttacggactatca

SEQ ID NO: 7619222 - DNA, 22 bp, Homo sapiens
tttatgtagttacggactatca

SEQ ID NO: 7619223 - DNA, 22 bp, Homo sapiens
tttatgtagttacggactatca

SEQ ID NO: 7619224 - DNA, 22 bp, Homo sapiens
tttatgtagttacggactatca

SEQ ID NO: 7619225 - DNA, 22 bp, Homo sapiens
tttatgtagttacggactatca

SEQ ID NO: 7619226 - DNA, 22 bp, Homo sapiens
tttatgtcaaaactacagttgg

SEQ ID NO: 7619227 - DNA, 22 bp, Homo sapiens
tttatgtcaaaactacagttgg

SEQ ID NO: 7619228 - DNA, 21 bp, Homo sapiens
tttatgtacttcatagagtag

SEQ ID NO: 7619229 - DNA, 21 bp, Homo sapiens
tttatgtacttcatagagtag

SEQ ID NO: 7619230 - DNA, 21 bp, Homo sapiens
tttatgtacttcatagagtag

SEQ ID NO: 7619231 - DNA, 21 bp, Homo sapiens
tttatgtacttcatagagtag

SEQ ID NO: 7619232 - DNA, 22 bp, Homo sapiens
tttagctaagacatagattctt

SEQ ID NO: 7619233 - DNA, 22 bp, Homo sapiens
tttagctaagacatagattctt

SEQ ID NO: 7619234 - DNA, 22 bp, Homo sapiens
tttagcgtagctgacagctaat

SEQ ID NO: 7619235 - DNA, 22 bp, Homo sapiens
tttagctggcagttacagatgt

SEQ ID NO: 7619236 - DNA, 22 bp, Homo sapiens
tttagcttaaatggagaaagag

SEQ ID NO: 7619237 - DNA, 22 bp, Homo sapiens
tttagcttaaatggagaaagag

SEQ ID NO: 7619238 - DNA, 19 bp, Homo sapiens
tttagcttacgtttcattg

SEQ ID NO: 7619239 - DNA, 23 bp, Homo sapiens
tttagcttccctttagttagggg

SEQ ID NO: 7619240 - DNA, 22 bp, Homo sapiens
tttagcttgaaagttttggagg

SEQ ID NO: 7619241 - DNA, 22 bp, Homo sapiens
tttagcttgaatcttgtttaaa

SEQ ID NO: 7619242 - DNA, 22 bp, Homo sapiens
tttagcttgaatcttgtttaaa

SEQ ID NO: 7619243 - DNA, 22 bp, Homo sapiens
tttagcttgaaagttttggagg

SEQ ID NO: 7619244 - DNA, 22 bp, Homo sapiens
tttagcttcttcagcttgttca

SEQ ID NO: 7619245 - DNA, 22 bp, Homo sapiens
tttagcttcttcagcttgttca

SEQ ID NO: 7619246 - DNA, 19 bp, Homo sapiens
tttagcttacgtttcattg

SEQ ID NO: 7619247 - DNA, 23 bp, Homo sapiens
tttagcttataaatgcttttgaa

SEQ ID NO: 7619248 - DNA, 22 bp, Homo sapiens
tttagcttcagttctagcttct

SEQ ID NO: 7619249 - DNA, 22 bp, Homo sapiens
tttagcttcagttctagcttct

SEQ ID NO: 7619250 - DNA, 22 bp, Homo sapiens
tttagcttcagttctagcttct

SEQ ID NO: 7619251 - DNA, 22 bp, Homo sapiens
tttagcttcagttctagcttct

SEQ ID NO: 7619252 - DNA, 23 bp, Homo sapiens
tttagcttataaatgcttttgaa

SEQ ID NO: 7619253 - DNA, 23 bp, Homo sapiens
tttagcttataaatgcttttgaa

SEQ ID NO: 7619254 - DNA, 22 bp, Homo sapiens
tttagcttcatcttcaagctgg

SEQ ID NO: 7619255 - DNA, 22 bp, Homo sapiens
tttagcttcatcttcaagctgg

SEQ ID NO: 7619256 - DNA, 22 bp, Homo sapiens
tttagcttcatcttcaagctgg

SEQ ID NO: 7619257 - DNA, 22 bp, Homo sapiens
tttagcattggagtctgggcta

SEQ ID NO: 7619258 - DNA, 21 bp, Homo sapiens
tttagcatttacatatttcca

SEQ ID NO: 7619259 - DNA, 22 bp, Homo sapiens
tttagccaactatatgactagt

SEQ ID NO: 7619260 - DNA, 22 bp, Homo sapiens
tttagcattactaaaatgaaaa

SEQ ID NO: 7619261 - DNA, 22 bp, Homo sapiens
tttagcattactaaaatgaaaa

SEQ ID NO: 7619262 - DNA, 22 bp, Homo sapiens
tttagcattaagcttttcaaat

SEQ ID NO: 7619263 - DNA, 22 bp, Homo sapiens
tttagcattaagcttttcaaat

SEQ ID NO: 7619264 - DNA, 22 bp, Homo sapiens
tttagcattaagcttttcaaat

SEQ ID NO: 7619265 - DNA, 22 bp, Homo sapiens
tttagcattaagcttttcaaat

SEQ ID NO: 7619266 - DNA, 22 bp, Homo sapiens
tttagcatgttcctttcataga

SEQ ID NO: 7619267 - DNA, 22 bp, Homo sapiens
tttagcatgttcctttcataga

SEQ ID NO: 7619268 - DNA, 22 bp, Homo sapiens
tttacagctgctggcaagcttg

SEQ ID NO: 7619269 - DNA, 22 bp, Homo sapiens
tttacagcttctatactatgtg

SEQ ID NO: 7619270 - DNA, 22 bp, Homo sapiens
tttagcttttgtgtcagataag

SEQ ID NO: 7619271 - DNA, 22 bp, Homo sapiens
tttagcttttgtgtcagataag

SEQ ID NO: 7619272 - DNA, 22 bp, Homo sapiens
tttaggaaatactgtcctatga

SEQ ID NO: 7619273 - DNA, 22 bp, Homo sapiens
tttagctttacctcatagattt

SEQ ID NO: 7619274 - DNA, 22 bp, Homo sapiens
tttagctttgaaggatatggtt

SEQ ID NO: 7619275 - DNA, 22 bp, Homo sapiens
tttagctttacctcatagattt

SEQ ID NO: 7619276 - DNA, 22 bp, Homo sapiens
tttagcttgttggaacaattga

SEQ ID NO: 7619277 - DNA, 22 bp, Homo sapiens
tttagcttgttggaacaattga

SEQ ID NO: 7619278 - DNA, 22 bp, Homo sapiens
tttagcttgatggcccggaata

SEQ ID NO: 7619279 - DNA, 20 bp, Homo sapiens
tttagcttgcctggaaggga

SEQ ID NO: 7619280 - DNA, 22 bp, Homo sapiens
tttagcttggagtcctctggga

SEQ ID NO: 7619281 - DNA, 22 bp, Homo sapiens
tttagcttggagtcctctggga

SEQ ID NO: 7619282 - DNA, 22 bp, Homo sapiens
tttaggaagatctgaaggaaga

SEQ ID NO: 7619283 - DNA, 22 bp, Homo sapiens
tttaggaagagttgagtaaatt

SEQ ID NO: 7619284 - DNA, 22 bp, Homo sapiens
tttaggaagagttgagtaaatt

SEQ ID NO: 7619285 - DNA, 22 bp, Homo sapiens
tttaggaacttaggtttatgga

SEQ ID NO: 7619286 - DNA, 18 bp, Homo sapiens
tttaggaaatatgtgcct

SEQ ID NO: 7619287 - DNA, 22 bp, Homo sapiens
tttaggaacttaggtttatgga

SEQ ID NO: 7619288 - DNA, 22 bp, Homo sapiens
tttaggaagacttgaatgagta

SEQ ID NO: 7619289 - DNA, 22 bp, Homo sapiens
tttaggaagacttgaatgagta

SEQ ID NO: 7619290 - DNA, 22 bp, Homo sapiens
tttaggaagatctgaaggaaga

SEQ ID NO: 7619291 - DNA, 22 bp, Homo sapiens
tttaggaagagttgagtaaatt

SEQ ID NO: 7619292 - DNA, 21 bp, Homo sapiens
tttaggaagtttaaggcaggt

SEQ ID NO: 7619293 - DNA, 22 bp, Homo sapiens
tttaggaagtttcagataggaa

SEQ ID NO: 7619294 - DNA, 22 bp, Homo sapiens
tttaggaagtttcagataggaa

SEQ ID NO: 7619295 - DNA, 22 bp, Homo sapiens
tttaggaatagctgacaatctt

SEQ ID NO: 7619296 - DNA, 22 bp, Homo sapiens
tttaggaatagctgacaatctt

SEQ ID NO: 7619297 - DNA, 22 bp, Homo sapiens
tttaggaatagctgacaatctt

SEQ ID NO: 7619298 - DNA, 22 bp, Homo sapiens
tttaggaatagctgacaatctt

SEQ ID NO: 7619299 - DNA, 18 bp, Homo sapiens
tttaggaattccaagaga

SEQ ID NO: 7619300 - DNA, 22 bp, Homo sapiens
tttaggaatattttctttcagg

SEQ ID NO: 7619301 - DNA, 19 bp, Homo sapiens
tttaggataaagtctggac

SEQ ID NO: 7619302 - DNA, 22 bp, Homo sapiens
tttaggagtcaaatgttttagg

SEQ ID NO: 7619303 - DNA, 18 bp, Homo sapiens
tttaggaattccaagaga

SEQ ID NO: 7619304 - DNA, 22 bp, Homo sapiens
tttaggataactccagttttcc

SEQ ID NO: 7619305 - DNA, 18 bp, Homo sapiens
tttaggaattccaagaga

SEQ ID NO: 7619306 - DNA, 22 bp, Homo sapiens
tttaggatgctctattctgact

SEQ ID NO: 7619307 - DNA, 22 bp, Homo sapiens
tttaggatattaatgttcagag

SEQ ID NO: 7619308 - DNA, 22 bp, Homo sapiens
tttaggatattaatgttcagag

SEQ ID NO: 7619309 - DNA, 22 bp, Homo sapiens
tttaggcacagagttgagggac

SEQ ID NO: 7619310 - DNA, 22 bp, Homo sapiens
tttaggcaagggcaagattatc

SEQ ID NO: 7619311 - DNA, 22 bp, Homo sapiens
tttaggcaagaactcactgaga

SEQ ID NO: 7619312 - DNA, 22 bp, Homo sapiens
tttaggcaaactcattgtcaga

SEQ ID NO: 7619313 - DNA, 22 bp, Homo sapiens
tttaggatgctctattctgact

SEQ ID NO: 7619314 - DNA, 22 bp, Homo sapiens
tttatctgctatctgctgtgct

SEQ ID NO: 7619315 - DNA, 22 bp, Homo sapiens
tttatctgcattctgaccatct

SEQ ID NO: 7619316 - DNA, 22 bp, Homo sapiens
tttatctggactgtgatataaa

SEQ ID NO: 7619317 - DNA, 22 bp, Homo sapiens
tttatctggactgtgatataaa

SEQ ID NO: 7619318 - DNA, 22 bp, Homo sapiens
tttatctggactgtgatataaa

SEQ ID NO: 7619319 - DNA, 22 bp, Homo sapiens
tttatctgtatatctcaagtgt

SEQ ID NO: 7619320 - DNA, 22 bp, Homo sapiens
tttatctgtatatctcaagtgt

SEQ ID NO: 7619321 - DNA, 22 bp, Homo sapiens
tttatctgtatatctcaagtgt

SEQ ID NO: 7619322 - DNA, 22 bp, Homo sapiens
tttatctgtagagcttcaccta

SEQ ID NO: 7619323 - DNA, 22 bp, Homo sapiens
tttatctgtggtaaataacatt

SEQ ID NO: 7619324 - DNA, 22 bp, Homo sapiens
tttatctgtggtaaataacatt

SEQ ID NO: 7619325 - DNA, 22 bp, Homo sapiens
tttatctgtcatttcccatatc

SEQ ID NO: 7619326 - DNA, 22 bp, Homo sapiens
tttatctgtgggagttgtttgg

SEQ ID NO: 7619327 - DNA, 22 bp, Homo sapiens
tttatctgttgtacctgcattg

SEQ ID NO: 7619328 - DNA, 22 bp, Homo sapiens
tttatcttctgcagttctggct

SEQ ID NO: 7619329 - DNA, 22 bp, Homo sapiens
tttatctgttgtacatttatgc

SEQ ID NO: 7619330 - DNA, 22 bp, Homo sapiens
tttatctgttgtacatttatgc

SEQ ID NO: 7619331 - DNA, 22 bp, Homo sapiens
tttatctgttgtacctgcattg

SEQ ID NO: 7619332 - DNA, 22 bp, Homo sapiens
tttatctgttgtacatttatgc

SEQ ID NO: 7619333 - DNA, 22 bp, Homo sapiens
tttatctttaggactttgcaga

SEQ ID NO: 7619334 - DNA, 22 bp, Homo sapiens
tttatctttaggactttgcaga

SEQ ID NO: 7619335 - DNA, 22 bp, Homo sapiens
tttatctttaggactttgcaga

SEQ ID NO: 7619336 - DNA, 22 bp, Homo sapiens
tttatcttctgcagttctggct

SEQ ID NO: 7619337 - DNA, 22 bp, Homo sapiens
tttatctttaggactttgcaga

SEQ ID NO: 7619338 - DNA, 22 bp, Homo sapiens
tttatctttaggactttgcaga

SEQ ID NO: 7619339 - DNA, 22 bp, Homo sapiens
tttagtgtaagcataaagaaca

SEQ ID NO: 7619340 - DNA, 18 bp, Homo sapiens
tttagtggtgcatttgac

SEQ ID NO: 7619341 - DNA, 22 bp, Homo sapiens
tttagtgtaagcataaagaaca

SEQ ID NO: 7619342 - DNA, 22 bp, Homo sapiens
tttaggcagctacatactaact

SEQ ID NO: 7619343 - DNA, 22 bp, Homo sapiens
tttagtgctttgctattcatgg

SEQ ID NO: 7619344 - DNA, 22 bp, Homo sapiens
tttaggcagcagtgaggatgaa

SEQ ID NO: 7619345 - DNA, 22 bp, Homo sapiens
tttaggcagaacatggactttg

SEQ ID NO: 7619346 - DNA, 22 bp, Homo sapiens
tttagtgtaattctgccttttg

SEQ ID NO: 7619347 - DNA, 22 bp, Homo sapiens
tttagtgtaagcataaagaaca

SEQ ID NO: 7619348 - DNA, 22 bp, Homo sapiens
tttagtgtaagcataaagaaca

SEQ ID NO: 7619349 - DNA, 22 bp, Homo sapiens
tttagtgtaagcataaagaaca

SEQ ID NO: 7619350 - DNA, 22 bp, Homo sapiens
tttagtgtagcattcagagtca

SEQ ID NO: 7619351 - DNA, 22 bp, Homo sapiens
tttagtgtaattctgccttttg

SEQ ID NO: 7619352 - DNA, 22 bp, Homo sapiens
tttagtgtagcattcagagtca

SEQ ID NO: 7619353 - DNA, 22 bp, Homo sapiens
tttatctgcattctgaccatct

SEQ ID NO: 7619354 - DNA, 22 bp, Homo sapiens
tttagttattgcacagaattag

SEQ ID NO: 7619355 - DNA, 22 bp, Homo sapiens
tttagttattgcacagaattag

SEQ ID NO: 7619356 - DNA, 22 bp, Homo sapiens
tttagttattgcacagaattag

SEQ ID NO: 7619357 - DNA, 22 bp, Homo sapiens
tttagttattgcacagaattag

SEQ ID NO: 7619358 - DNA, 22 bp, Homo sapiens
tttagtgtttgcgtgtactcct

SEQ ID NO: 7619359 - DNA, 22 bp, Homo sapiens
tttagtgtggcactgatgttca

SEQ ID NO: 7619360 - DNA, 22 bp, Homo sapiens
tttagtgtttgcgtgtactcct

SEQ ID NO: 7619361 - DNA, 22 bp, Homo sapiens
tttagtgtggcactgatgttca

SEQ ID NO: 7619362 - DNA, 22 bp, Homo sapiens
tttagtgtggcactgatgttca

SEQ ID NO: 7619363 - DNA, 22 bp, Homo sapiens
tttagtgtgacagtccccagta

SEQ ID NO: 7619364 - DNA, 22 bp, Homo sapiens
tttagtgtggcactgatgttca

SEQ ID NO: 7619365 - DNA, 22 bp, Homo sapiens
tttagtgtagcctaagcagaat

SEQ ID NO: 7619366 - DNA, 22 bp, Homo sapiens
tttagtgtagcctaagcagaat

SEQ ID NO: 7619367 - DNA, 22 bp, Homo sapiens
tttagtgtgacagtccccagta

SEQ ID NO: 7619368 - DNA, 22 bp, Homo sapiens
tttagtgtagcctaagcagaat

SEQ ID NO: 7619369 - DNA, 22 bp, Homo sapiens
tttagtgtagcctaagcagaat

SEQ ID NO: 7619370 - DNA, 22 bp, Homo sapiens
tttagtgtagcattcagagtca

SEQ ID NO: 7619371 - DNA, 22 bp, Homo sapiens
tttagtgtagcattcagagtca

SEQ ID NO: 7619372 - DNA, 22 bp, Homo sapiens
tttagtgtagcctaagcagaat

SEQ ID NO: 7619373 - DNA, 23 bp, Homo sapiens
tttaacatttgaacatgtggcca

SEQ ID NO: 7619374 - DNA, 23 bp, Homo sapiens
tttaacatttgaacatgtggcca

SEQ ID NO: 7619375 - DNA, 22 bp, Homo sapiens
tttaacatgttcaagaaacata

SEQ ID NO: 7619376 - DNA, 22 bp, Homo sapiens
tttaacatgttcaagaaacata

SEQ ID NO: 7619377 - DNA, 22 bp, Homo sapiens
tttaacatgttcaagaaacata

SEQ ID NO: 7619378 - DNA, 22 bp, Homo sapiens
tttaacatgttcaagaaacata

SEQ ID NO: 7619379 - DNA, 22 bp, Homo sapiens
tttaacatgttcaagaaacata

SEQ ID NO: 7619380 - DNA, 23 bp, Homo sapiens
tttaaccttggtcaagaatttcc

SEQ ID NO: 7619381 - DNA, 22 bp, Homo sapiens
tttaaccagaaaggtactcatc

SEQ ID NO: 7619382 - DNA, 22 bp, Homo sapiens
tttaaccagtttacaaagaatt

SEQ ID NO: 7619383 - DNA, 22 bp, Homo sapiens
tttaaccagtttacaaagaatt

SEQ ID NO: 7619384 - DNA, 22 bp, Homo sapiens
tttaaccagaaaggtactcatc

SEQ ID NO: 7619385 - DNA, 22 bp, Homo sapiens
tttaaccagtttacaaagaatt

SEQ ID NO: 7619386 - DNA, 22 bp, Homo sapiens
tttaaccagtttacaaagaatt

SEQ ID NO: 7619387 - DNA, 22 bp, Homo sapiens
tttaacttgatcagtagagcat

SEQ ID NO: 7619388 - DNA, 22 bp, Homo sapiens
tttaacttagaagagatatcct

SEQ ID NO: 7619389 - DNA, 22 bp, Homo sapiens
tttaacttagaagagatatcct

SEQ ID NO: 7619390 - DNA, 22 bp, Homo sapiens
tttaacttagaagagatatcct

SEQ ID NO: 7619391 - DNA, 22 bp, Homo sapiens
tttaacttagaagagatatcct

SEQ ID NO: 7619392 - DNA, 22 bp, Homo sapiens
tttaactctgtcattctcttta

SEQ ID NO: 7619393 - DNA, 22 bp, Homo sapiens
tttaactctgagagtaactgag

SEQ ID NO: 7619394 - DNA, 22 bp, Homo sapiens
tttaactggtctcctgctgctt

SEQ ID NO: 7619395 - DNA, 22 bp, Homo sapiens
tttaagaagttatgttataaat

SEQ ID NO: 7619396 - DNA, 22 bp, Homo sapiens
tttaagaagttatgttataaat

SEQ ID NO: 7619397 - DNA, 22 bp, Homo sapiens
tttaagaagttatgttataaat

SEQ ID NO: 7619398 - DNA, 22 bp, Homo sapiens
tttaagaagttatgttataaat

SEQ ID NO: 7619399 - DNA, 22 bp, Homo sapiens
tttaagaagttatgttataaat

SEQ ID NO: 7619400 - DNA, 22 bp, Homo sapiens
tttaacttgatcagtagagcat

SEQ ID NO: 7619401 - DNA, 23 bp, Homo sapiens
tttaactttccaataattcattg

SEQ ID NO: 7619402 - DNA, 23 bp, Homo sapiens
tttaactttccaataattcattg

SEQ ID NO: 7619403 - DNA, 23 bp, Homo sapiens
tttaactttccaataattcattg

SEQ ID NO: 7619404 - DNA, 22 bp, Homo sapiens
tttaacatgttcaagaaacata

SEQ ID NO: 7619405 - DNA, 22 bp, Homo sapiens
tttaacatgttcaagaaacata

SEQ ID NO: 7619406 - DNA, 22 bp, Homo sapiens
tttaacatgttcaagaaacata

SEQ ID NO: 7619407 - DNA, 22 bp, Homo sapiens
tttaacatgttcaagaaacata

SEQ ID NO: 7619408 - DNA, 22 bp, Homo sapiens
tttaacatgtgaattttggaag

SEQ ID NO: 7619409 - DNA, 22 bp, Homo sapiens
tttaacatgttcaagaaacata

SEQ ID NO: 7619410 - DNA, 22 bp, Homo sapiens
tttaacatgttcaagaaacata

SEQ ID NO: 7619411 - DNA, 22 bp, Homo sapiens
tttaacatgttcaagaaacata

SEQ ID NO: 7619412 - DNA, 22 bp, Homo sapiens
tttaacatgttcaagaaacata

SEQ ID NO: 7619413 - DNA, 22 bp, Homo sapiens
tttaacatgttcaagaaacata

SEQ ID NO: 7619414 - DNA, 22 bp, Homo sapiens
tttaacatgtgaattttggaag

SEQ ID NO: 7619415 - DNA, 22 bp, Homo sapiens
tttaacatgtgaattttggaag

SEQ ID NO: 7619416 - DNA, 22 bp, Homo sapiens
tttaacatgtaattgctgcttt

SEQ ID NO: 7619417 - DNA, 22 bp, Homo sapiens
tttaacatgtaattgctgcttt

SEQ ID NO: 7619418 - DNA, 22 bp, Homo sapiens
tttaacaggtaaagtaaatgtg

SEQ ID NO: 7619419 - DNA, 22 bp, Homo sapiens
tttaacatgtaattgctgcttt

SEQ ID NO: 7619420 - DNA, 22 bp, Homo sapiens
tttaacaggtaaagtaaatgtg

SEQ ID NO: 7619421 - DNA, 22 bp, Homo sapiens
tttaacaggtaaagtaaatgtg

SEQ ID NO: 7619422 - DNA, 22 bp, Homo sapiens
tttaacaggtaaagtaaatgtg

SEQ ID NO: 7619423 - DNA, 22 bp, Homo sapiens
tttaaattatagttaatgtctg

SEQ ID NO: 7619424 - DNA, 22 bp, Homo sapiens
tttaaattatagttaatgtctg

SEQ ID NO: 7619425 - DNA, 22 bp, Homo sapiens
tttaaattatagttaatgtctg

SEQ ID NO: 7619426 - DNA, 22 bp, Homo sapiens
tttaaattatagttaatgtctg

SEQ ID NO: 7619427 - DNA, 22 bp, Homo sapiens
tttaaattatagttaatgtctg

SEQ ID NO: 7619428 - DNA, 22 bp, Homo sapiens
ttgtttaaaatgtagcaagaaa

SEQ ID NO: 7619429 - DNA, 22 bp, Homo sapiens
ttgtttaaaatgtagcaagaaa

SEQ ID NO: 7619430 - DNA, 22 bp, Homo sapiens
ttgtttaaaatgtagcaagaaa

SEQ ID NO: 7619431 - DNA, 22 bp, Homo sapiens
ttgtttaaaatgtagcaagaaa

SEQ ID NO: 7619432 - DNA, 22 bp, Homo sapiens
ttgtttaaaatgtagcaagaaa

SEQ ID NO: 7619433 - DNA, 22 bp, Homo sapiens
ttgtttaaaatgtagcaagaaa

SEQ ID NO: 7619434 - DNA, 22 bp, Homo sapiens
ttgtttaaaatgtagcaagaaa

SEQ ID NO: 7619435 - DNA, 22 bp, Homo sapiens
tttaaatgtttatagagagtac

SEQ ID NO: 7619436 - DNA, 22 bp, Homo sapiens
tttaaattatagttaatgtctg

SEQ ID NO: 7619437 - DNA, 22 bp, Homo sapiens
tttaaattatagttaatgtctg

SEQ ID NO: 7619438 - DNA, 22 bp, Homo sapiens
tttaaattatagttaatgtctg

SEQ ID NO: 7619439 - DNA, 22 bp, Homo sapiens
tttaaattatagttaatgtctg

SEQ ID NO: 7619440 - DNA, 22 bp, Homo sapiens
tttaaattatagttaatgtctg

SEQ ID NO: 7619441 - DNA, 22 bp, Homo sapiens
tttaaattatagttaatgtctg

SEQ ID NO: 7619442 - DNA, 22 bp, Homo sapiens
tttaaattatagttaatgtctg

SEQ ID NO: 7619443 - DNA, 22 bp, Homo sapiens
tttaaattatagttaatgtctg

SEQ ID NO: 7619444 - DNA, 22 bp, Homo sapiens
tttaaattatagttaatgtctg

SEQ ID NO: 7619445 - DNA, 22 bp, Homo sapiens
tttaaattatagttaatgtctg

SEQ ID NO: 7619446 - DNA, 22 bp, Homo sapiens
tttaacagatgtgaaattttca

SEQ ID NO: 7619447 - DNA, 22 bp, Homo sapiens
tttaacagatgtgaaattttca

SEQ ID NO: 7619448 - DNA, 22 bp, Homo sapiens
ttgttgtcattgtagaggattt

SEQ ID NO: 7619449 - DNA, 22 bp, Homo sapiens
ttgttgttataggtggtacaag

SEQ ID NO: 7619450 - DNA, 22 bp, Homo sapiens
ttgttgttggagccaatatgca

SEQ ID NO: 7619451 - DNA, 22 bp, Homo sapiens
ttgtttaaaagaaatcatagaa

SEQ ID NO: 7619452 - DNA, 22 bp, Homo sapiens
ttgtttaaaagaaatcatagaa

SEQ ID NO: 7619453 - DNA, 22 bp, Homo sapiens
ttgtttaaaagaaatcatagaa

SEQ ID NO: 7619454 - DNA, 22 bp, Homo sapiens
ttgtttaaaagaaatcatagaa

SEQ ID NO: 7619455 - DNA, 22 bp, Homo sapiens
ttgtttaaaagaaatcatagaa

SEQ ID NO: 7619456 - DNA, 22 bp, Homo sapiens
ttgtttaaaagaaatcatagaa

SEQ ID NO: 7619457 - DNA, 22 bp, Homo sapiens
ttgtttaaaagaaatcatagaa

SEQ ID NO: 7619458 - DNA, 22 bp, Homo sapiens
ttgtttaaaagaaatcatagaa

SEQ ID NO: 7619459 - DNA, 22 bp, Homo sapiens
ttgtttaaaagaaatcatagaa

SEQ ID NO: 7619460 - DNA, 22 bp, Homo sapiens
ttgttgggcatgcagtggctgt

SEQ ID NO: 7619461 - DNA, 22 bp, Homo sapiens
ttgttgctgctcaacctctata

SEQ ID NO: 7619462 - DNA, 22 bp, Homo sapiens
ttgttgggcatgcagtggctgt

SEQ ID NO: 7619463 - DNA, 22 bp, Homo sapiens
ttgttgctcttgttgccacatg

SEQ ID NO: 7619464 - DNA, 22 bp, Homo sapiens
ttgttgggcatgcagtggctgt

SEQ ID NO: 7619465 - DNA, 22 bp, Homo sapiens
ttgttgggcatgcagtggctgt

SEQ ID NO: 7619466 - DNA, 22 bp, Homo sapiens
ttgttgcataaagtaggaaata

SEQ ID NO: 7619467 - DNA, 22 bp, Homo sapiens
ttgttgcatttcaagtatgaga

SEQ ID NO: 7619468 - DNA, 22 bp, Homo sapiens
ttgttgccggaaagatctcgac

SEQ ID NO: 7619469 - DNA, 22 bp, Homo sapiens
ttgttgctcttgttgccacatg

SEQ ID NO: 7619470 - DNA, 22 bp, Homo sapiens
ttgttgtcattgtagaggattt

SEQ ID NO: 7619471 - DNA, 22 bp, Homo sapiens
ttgttgtcattgtagaggattt

SEQ ID NO: 7619472 - DNA, 22 bp, Homo sapiens
ttgttgtcattgtagaggattt

SEQ ID NO: 7619473 - DNA, 22 bp, Homo sapiens
ttgttgtcattgtagaggattt

SEQ ID NO: 7619474 - DNA, 22 bp, Homo sapiens
ttgttgtcattgtagaggattt

SEQ ID NO: 7619475 - DNA, 22 bp, Homo sapiens
ttgttggtggaattgatgctag

SEQ ID NO: 7619476 - DNA, 22 bp, Homo sapiens
ttgttggtgaatagggtggaat

SEQ ID NO: 7619477 - DNA, 22 bp, Homo sapiens
ttgttcttagtatgcattgttt

SEQ ID NO: 7619478 - DNA, 22 bp, Homo sapiens
ttgttcttacttaagagtgaat

SEQ ID NO: 7619479 - DNA, 22 bp, Homo sapiens
ttgttcttacttaagagtgaat

SEQ ID NO: 7619480 - DNA, 22 bp, Homo sapiens
ttgttcttagtatgcattgttt

SEQ ID NO: 7619481 - DNA, 21 bp, Homo sapiens
ttgttcttccagaagcaaagt

SEQ ID NO: 7619482 - DNA, 22 bp, Homo sapiens
ttgttcttagtatgcattgttt

SEQ ID NO: 7619483 - DNA, 21 bp, Homo sapiens
ttgttcttccagaagcaaagt

SEQ ID NO: 7619484 - DNA, 22 bp, Homo sapiens
ttgttcttctctagagaagtgg

SEQ ID NO: 7619485 - DNA, 22 bp, Homo sapiens
ttgttcttccatcatccctcag

SEQ ID NO: 7619486 - DNA, 22 bp, Homo sapiens
ttgttcttgccaagacatgaag

SEQ ID NO: 7619487 - DNA, 22 bp, Homo sapiens
ttgttcttctctagagaagtgg

SEQ ID NO: 7619488 - DNA, 22 bp, Homo sapiens
ttgttcttgccaagacatgaag

SEQ ID NO: 7619489 - DNA, 22 bp, Homo sapiens
ttgttcttgccaagacatgaag

SEQ ID NO: 7619490 - DNA, 22 bp, Homo sapiens
ttgttcttggagcaggcagaga

SEQ ID NO: 7619491 - DNA, 22 bp, Homo sapiens
ttgttcttggagcaggcagaga

SEQ ID NO: 7619492 - DNA, 22 bp, Homo sapiens
ttgttcttggagcaggcagaga

SEQ ID NO: 7619493 - DNA, 23 bp, Homo sapiens
ttgttcttggatcttcctgaagc

SEQ ID NO: 7619494 - DNA, 23 bp, Homo sapiens
ttgttcttggatcttcctgaagc

SEQ ID NO: 7619495 - DNA, 22 bp, Homo sapiens
ttgttcttggagcaggcagaga

SEQ ID NO: 7619496 - DNA, 23 bp, Homo sapiens
ttgttcttggatcttcctgaagc

SEQ ID NO: 7619497 - DNA, 23 bp, Homo sapiens
ttgttcttggatcttcctgaagc

SEQ ID NO: 7619498 - DNA, 22 bp, Homo sapiens
ttgttcttggagcaggcagaga

SEQ ID NO: 7619499 - DNA, 22 bp, Homo sapiens
ttgttcttggagcaggcagaga

SEQ ID NO: 7619500 - DNA, 22 bp, Homo sapiens
ttgttcttttgcttagacagat

SEQ ID NO: 7619501 - DNA, 22 bp, Homo sapiens
ttgttcttttgcttagacagat

SEQ ID NO: 7619502 - DNA, 22 bp, Homo sapiens
ttgttctttatcctggaagcct

SEQ ID NO: 7619503 - DNA, 22 bp, Homo sapiens
ttgttcttttgcttagacagat

SEQ ID NO: 7619504 - DNA, 22 bp, Homo sapiens
ttgttcttttgcttagacagat

SEQ ID NO: 7619505 - DNA, 22 bp, Homo sapiens
ttgttctttttctccatgagat

SEQ ID NO: 7619506 - DNA, 22 bp, Homo sapiens
ttgttcttttgcttagacagat

SEQ ID NO: 7619507 - DNA, 22 bp, Homo sapiens
ttgttcttgtctttgccttcac

SEQ ID NO: 7619508 - DNA, 22 bp, Homo sapiens
ttgttcttgtctttgccttcac

SEQ ID NO: 7619509 - DNA, 22 bp, Homo sapiens
ttgttcttgtctttgccttcac

SEQ ID NO: 7619510 - DNA, 22 bp, Homo sapiens
ttgttctttatcctggaagcct

SEQ ID NO: 7619511 - DNA, 22 bp, Homo sapiens
ttgttctttatcctggaagcct

SEQ ID NO: 7619512 - DNA, 22 bp, Homo sapiens
ttgttgcaacagacaccatatg

SEQ ID NO: 7619513 - DNA, 22 bp, Homo sapiens
ttgttgatgtggacgtctggaa

SEQ ID NO: 7619514 - DNA, 22 bp, Homo sapiens
ttgttgcaagcctggaatctgg

SEQ ID NO: 7619515 - DNA, 22 bp, Homo sapiens
ttgttgcagagatgaatgacat

SEQ ID NO: 7619516 - DNA, 22 bp, Homo sapiens
ttgttgcaagggttaaatgaga

SEQ ID NO: 7619517 - DNA, 22 bp, Homo sapiens
ttgttgcagagatgaatgacat

SEQ ID NO: 7619518 - DNA, 22 bp, Homo sapiens
ttgttgaattagttgactgtgt

SEQ ID NO: 7619519 - DNA, 22 bp, Homo sapiens
ttgttctttttctccatgagat

SEQ ID NO: 7619520 - DNA, 22 bp, Homo sapiens
ttgttgaatggataaataaatt

SEQ ID NO: 7619521 - DNA, 22 bp, Homo sapiens
tttaagaagttatgttataaat

SEQ ID NO: 7619522 - DNA, 22 bp, Homo sapiens
tttaagaagttatgttataaat

SEQ ID NO: 7619523 - DNA, 22 bp, Homo sapiens
tttaagaagttatgttataaat

SEQ ID NO: 7619524 - DNA, 20 bp, Homo sapiens
tttaagaagtttctgaggaa

SEQ ID NO: 7619525 - DNA, 22 bp, Homo sapiens
tttaagacagtgcaagctgaat

SEQ ID NO: 7619526 - DNA, 22 bp, Homo sapiens
tttaagacagtgcaagctgaat

SEQ ID NO: 7619527 - DNA, 22 bp, Homo sapiens
tttaagacccacagggaagttg

SEQ ID NO: 7619528 - DNA, 22 bp, Homo sapiens
tttaagacagtgcaagctgaat

SEQ ID NO: 7619529 - DNA, 20 bp, Homo sapiens
tttaagaagtttctgaggaa

SEQ ID NO: 7619530 - DNA, 22 bp, Homo sapiens
tttaagagcctgtacaaatatt

SEQ ID NO: 7619531 - DNA, 22 bp, Homo sapiens
tttaagagcctgtacaaatatt

SEQ ID NO: 7619532 - DNA, 22 bp, Homo sapiens
tttaagagcatttgcaatttat

SEQ ID NO: 7619533 - DNA, 22 bp, Homo sapiens
tttaagacttaggaaagaggat

SEQ ID NO: 7619534 - DNA, 22 bp, Homo sapiens
tttaagagcatttgcaatttat

SEQ ID NO: 7619535 - DNA, 22 bp, Homo sapiens
tttaagactcttgtagtacaca

SEQ ID NO: 7619536 - DNA, 22 bp, Homo sapiens
tttaagactcttgtagtacaca

SEQ ID NO: 7619537 - DNA, 22 bp, Homo sapiens
tttaagactcttgtagtacaca

SEQ ID NO: 7619538 - DNA, 22 bp, Homo sapiens
tttaagacttagatttattggg

SEQ ID NO: 7619539 - DNA, 22 bp, Homo sapiens
tttaagacttagatttattggg

SEQ ID NO: 7619540 - DNA, 22 bp, Homo sapiens
tttaagatcatttgtattatcc

SEQ ID NO: 7619541 - DNA, 22 bp, Homo sapiens
tttaagatcatttgtattatcc

SEQ ID NO: 7619542 - DNA, 22 bp, Homo sapiens
tttaagatcatttgtattatcc

SEQ ID NO: 7619543 - DNA, 22 bp, Homo sapiens
tttaagatcatttgtattatcc

SEQ ID NO: 7619544 - DNA, 22 bp, Homo sapiens
tttaagatcatttgtattatcc

SEQ ID NO: 7619545 - DNA, 22 bp, Homo sapiens
tttaagatcatttgtattatcc

SEQ ID NO: 7619546 - DNA, 22 bp, Homo sapiens
tttaagatctatcccattttgt

SEQ ID NO: 7619547 - DNA, 22 bp, Homo sapiens
tttaagatctatcccattttgt

SEQ ID NO: 7619548 - DNA, 22 bp, Homo sapiens
tttaagatctatcccattttgt

SEQ ID NO: 7619549 - DNA, 22 bp, Homo sapiens
tttacaagtcagggactgttct

SEQ ID NO: 7619550 - DNA, 22 bp, Homo sapiens
tttacaagtcagggactgttct

SEQ ID NO: 7619551 - DNA, 22 bp, Homo sapiens
tttacaagtcagggactgttct

SEQ ID NO: 7619552 - DNA, 22 bp, Homo sapiens
tttaagagctagtatgtcattt

SEQ ID NO: 7619553 - DNA, 22 bp, Homo sapiens
tttaagagttaaactttgacct

SEQ ID NO: 7619554 - DNA, 22 bp, Homo sapiens
tttaagagctagtatgtcattt

SEQ ID NO: 7619555 - DNA, 22 bp, Homo sapiens
tttaagactcttgtagtacaca

SEQ ID NO: 7619556 - DNA, 22 bp, Homo sapiens
tttaagagcctgtacaaatatt

SEQ ID NO: 7619557 - DNA, 22 bp, Homo sapiens
tttaagagctagtatgtcattt

SEQ ID NO: 7619558 - DNA, 22 bp, Homo sapiens
tttaagagctagtatgtcattt

SEQ ID NO: 7619559 - DNA, 22 bp, Homo sapiens
tttaagagctagtatgtcattt

SEQ ID NO: 7619560 - DNA, 22 bp, Homo sapiens
tttacaagtttacagaatgatg

SEQ ID NO: 7619561 - DNA, 22 bp, Homo sapiens
tttacaagtttacagaatgatg

SEQ ID NO: 7619562 - DNA, 22 bp, Homo sapiens
tttacaagtttacagaatgatg

SEQ ID NO: 7619563 - DNA, 22 bp, Homo sapiens
tttacaagtttacagaatgatg

SEQ ID NO: 7619564 - DNA, 22 bp, Homo sapiens
tttacaagtttacagaatgatg

SEQ ID NO: 7619565 - DNA, 22 bp, Homo sapiens
tttacacatacctctttaaagt

SEQ ID NO: 7619566 - DNA, 22 bp, Homo sapiens
tttacacattattttcagtgtg

SEQ ID NO: 7619567 - DNA, 22 bp, Homo sapiens
tttacacattattttcagtgtg

SEQ ID NO: 7619568 - DNA, 22 bp, Homo sapiens
tttacacattattttcagtgtg

SEQ ID NO: 7619569 - DNA, 22 bp, Homo sapiens
tttacacattattttcagtgtg

SEQ ID NO: 7619570 - DNA, 19 bp, Homo sapiens
tttacaagttctttgtatg

SEQ ID NO: 7619571 - DNA, 22 bp, Homo sapiens
tttacaagtcagggactgttct

SEQ ID NO: 7619572 - DNA, 22 bp, Homo sapiens
tttacaagtctgttgatcccaa

SEQ ID NO: 7619573 - DNA, 19 bp, Homo sapiens
tttacaagttctttgtatg

SEQ ID NO: 7619574 - DNA, 22 bp, Homo sapiens
tttacaagtttacagaatgatg

SEQ ID NO: 7619575 - DNA, 22 bp, Homo sapiens
tttacaagtttacagaatgatg

SEQ ID NO: 7619576 - DNA, 22 bp, Homo sapiens
tttacaagtttacagaatgatg

SEQ ID NO: 7619577 - DNA, 19 bp, Homo sapiens
tttacaagttctttgtatg

SEQ ID NO: 7619578 - DNA, 19 bp, Homo sapiens
tttacaagttctttgtatg

SEQ ID NO: 7619579 - DNA, 22 bp, Homo sapiens
tttacactcctggaaatgatat

SEQ ID NO: 7619580 - DNA, 22 bp, Homo sapiens
tttacactcctggaaatgatat

SEQ ID NO: 7619581 - DNA, 22 bp, Homo sapiens
tttacactcctggaaatgatat

SEQ ID NO: 7619582 - DNA, 22 bp, Homo sapiens
tttacactcctggaaatgatat

SEQ ID NO: 7619583 - DNA, 22 bp, Homo sapiens
tttacacattattttcagtgtg

SEQ ID NO: 7619584 - DNA, 22 bp, Homo sapiens
tttacacattattttcagtgtg

SEQ ID NO: 7619585 - DNA, 22 bp, Homo sapiens
tttacactgtgaaacaggtatc

SEQ ID NO: 7619586 - DNA, 22 bp, Homo sapiens
tttacactgcttgaacaatctc

SEQ ID NO: 7619587 - DNA, 22 bp, Homo sapiens
tttacactgacagcacataagg

SEQ ID NO: 7619588 - DNA, 22 bp, Homo sapiens
tttacactgacagcacataagg

SEQ ID NO: 7619589 - DNA, 22 bp, Homo sapiens
tttacactgacagcacataagg

SEQ ID NO: 7619590 - DNA, 22 bp, Homo sapiens
tttacactgacagcacataagg

SEQ ID NO: 7619591 - DNA, 22 bp, Homo sapiens
tttacactgacagcacataagg

SEQ ID NO: 7619592 - DNA, 22 bp, Homo sapiens
tttacactgcttgaacaatctc

SEQ ID NO: 7619593 - DNA, 22 bp, Homo sapiens
tttacactgccattctgaatac

SEQ ID NO: 7619594 - DNA, 22 bp, Homo sapiens
tttacagaatgtcaatttctat

SEQ ID NO: 7619595 - DNA, 22 bp, Homo sapiens
tttacagaatgtcaatttctat

SEQ ID NO: 7619596 - DNA, 22 bp, Homo sapiens
tttacagaagagaaggatgctt

SEQ ID NO: 7619597 - DNA, 22 bp, Homo sapiens
tttacagaagagaaggatgctt

SEQ ID NO: 7619598 - DNA, 22 bp, Homo sapiens
tttacagaagagaaggatgctt

SEQ ID NO: 7619599 - DNA, 22 bp, Homo sapiens
tttacagaatgtcaatttctat

SEQ ID NO: 7619600 - DNA, 22 bp, Homo sapiens
tttacagaatgtcaatttctat

SEQ ID NO: 7619601 - DNA, 22 bp, Homo sapiens
tttacagaatgtcaatttctat

SEQ ID NO: 7619602 - DNA, 22 bp, Homo sapiens
tttacagaatgttgaatttggg

SEQ ID NO: 7619603 - DNA, 22 bp, Homo sapiens
tttacagaatgttgaatttggg

SEQ ID NO: 7619604 - DNA, 22 bp, Homo sapiens
tttacagaatgtcaatttctat

SEQ ID NO: 7619605 - DNA, 22 bp, Homo sapiens
tttacagaatgttgaatttggg

SEQ ID NO: 7619606 - DNA, 22 bp, Homo sapiens
tttacagaatgttgaatttggg

SEQ ID NO: 7619607 - DNA, 22 bp, Homo sapiens
tttacacttgaggaaactgagg

SEQ ID NO: 7619608 - DNA, 22 bp, Homo sapiens
tttacacttgaggaaactgagg

SEQ ID NO: 7619609 - DNA, 22 bp, Homo sapiens
tttacacttattatgaagcttt

SEQ ID NO: 7619610 - DNA, 22 bp, Homo sapiens
tttacacttgaggaaactgagg

SEQ ID NO: 7619611 - DNA, 22 bp, Homo sapiens
tttacacttgaggaaactgagg

SEQ ID NO: 7619612 - DNA, 22 bp, Homo sapiens
tttacacttgaggaaactgagg

SEQ ID NO: 7619613 - DNA, 22 bp, Homo sapiens
tttacagaagagaaggatgctt

SEQ ID NO: 7619614 - DNA, 22 bp, Homo sapiens
tttacagaagagaaggatgctt

SEQ ID NO: 7619615 - DNA, 22 bp, Homo sapiens
tttacactttcctgggaacatc

SEQ ID NO: 7619616 - DNA, 22 bp, Homo sapiens
tttacagagaatgtacataaag

SEQ ID NO: 7619617 - DNA, 22 bp, Homo sapiens
tttacagagaatgtacataaag

SEQ ID NO: 7619618 - DNA, 22 bp, Homo sapiens
tttacagagaatgtacataaag

SEQ ID NO: 7619619 - DNA, 22 bp, Homo sapiens
tttacagacaacttaatagggg

SEQ ID NO: 7619620 - DNA, 22 bp, Homo sapiens
tttacagagaatgtacataaag

SEQ ID NO: 7619621 - DNA, 22 bp, Homo sapiens
tttacagagaatgtacataaag

SEQ ID NO: 7619622 - DNA, 22 bp, Homo sapiens
tttacagagaatgtacataaag

SEQ ID NO: 7619623 - DNA, 22 bp, Homo sapiens
tttacagagaatgtacataaag

SEQ ID NO: 7619624 - DNA, 22 bp, Homo sapiens
tttacagacaacttaatagggg

SEQ ID NO: 7619625 - DNA, 22 bp, Homo sapiens
tttacagacaacttaatagggg

SEQ ID NO: 7619626 - DNA, 22 bp, Homo sapiens
tttacagacaacttaatagggg

SEQ ID NO: 7619627 - DNA, 22 bp, Homo sapiens
tttacagacaacttaatagggg

SEQ ID NO: 7619628 - DNA, 22 bp, Homo sapiens
tttacagagagagaactggact

SEQ ID NO: 7619629 - DNA, 22 bp, Homo sapiens
tttacagagagagaactggact

SEQ ID NO: 7619630 - DNA, 22 bp, Homo sapiens
tttacagagagagaactggact

SEQ ID NO: 7619631 - DNA, 22 bp, Homo sapiens
tttacagagagagaactggact

SEQ ID NO: 7619632 - DNA, 22 bp, Homo sapiens
tttacagaggtgtcctgcattg

SEQ ID NO: 7619633 - DNA, 22 bp, Homo sapiens
tttacagatctgttgatttgtt

SEQ ID NO: 7619634 - DNA, 22 bp, Homo sapiens
tttacagatctgttgatttgtt

SEQ ID NO: 7619635 - DNA, 22 bp, Homo sapiens
tttacagagagagaactggact

SEQ ID NO: 7619636 - DNA, 22 bp, Homo sapiens
tttacagagaatgtacataaag

SEQ ID NO: 7619637 - DNA, 22 bp, Homo sapiens
tttacagagaatgtacataaag

SEQ ID NO: 7619638 - DNA, 22 bp, Homo sapiens
tttacagatctgttgatttgtt

SEQ ID NO: 7619639 - DNA, 22 bp, Homo sapiens
tttacagatgaggaaactgaga

SEQ ID NO: 7619640 - DNA, 22 bp, Homo sapiens
tttacagatgaggaaactgaga

SEQ ID NO: 7619641 - DNA, 22 bp, Homo sapiens
tttacagatgaggaaactgaga

SEQ ID NO: 7619642 - DNA, 22 bp, Homo sapiens
tttacagatgaggaaactgaga

SEQ ID NO: 7619643 - DNA, 22 bp, Homo sapiens
tttacagatgaggaaactgaga

SEQ ID NO: 7619644 - DNA, 22 bp, Homo sapiens
tttacagatgaggaaactgaga

SEQ ID NO: 7619645 - DNA, 22 bp, Homo sapiens
tttacagatgaggaaactgaga

SEQ ID NO: 7619646 - DNA, 22 bp, Homo sapiens
tttacagatgaggaaactgaga

SEQ ID NO: 7619647 - DNA, 22 bp, Homo sapiens
tttacagatgaggaaactgaga

SEQ ID NO: 7619648 - DNA, 22 bp, Homo sapiens
tttacagatgaggaaactgaga

SEQ ID NO: 7619649 - DNA, 22 bp, Homo sapiens
tttacagatgaggatactgagg

SEQ ID NO: 7619650 - DNA, 22 bp, Homo sapiens
tttacagatgaggatactgagg

SEQ ID NO: 7619651 - DNA, 22 bp, Homo sapiens
tttacagatgaggatactgagg

SEQ ID NO: 7619652 - DNA, 22 bp, Homo sapiens
tttacagatgaggatactgagg

SEQ ID NO: 7619653 - DNA, 22 bp, Homo sapiens
tttacagatgaggatactgagg

SEQ ID NO: 7619654 - DNA, 22 bp, Homo sapiens
tttacagatgaggatactgagg

SEQ ID NO: 7619655 - DNA, 22 bp, Homo sapiens
tttacagatgaggatactgagg

SEQ ID NO: 7619656 - DNA, 22 bp, Homo sapiens
tttacagatgaggaaactgaga

SEQ ID NO: 7619657 - DNA, 22 bp, Homo sapiens
tttacagatgaggatactgagg

SEQ ID NO: 7619658 - DNA, 22 bp, Homo sapiens
tttacagatgaggatactgagg

SEQ ID NO: 7619659 - DNA, 22 bp, Homo sapiens
tttacagatgaggatactgagg

SEQ ID NO: 7619660 - DNA, 22 bp, Homo sapiens
tttacagatgaggatactgagg

SEQ ID NO: 7619661 - DNA, 22 bp, Homo sapiens
tttacagattctgggtattagg

SEQ ID NO: 7619662 - DNA, 22 bp, Homo sapiens
tttacagatgtggaaagtgagc

SEQ ID NO: 7619663 - DNA, 22 bp, Homo sapiens
tttacagatgtggaaagtgagc

SEQ ID NO: 7619664 - DNA, 22 bp, Homo sapiens
tttacagatgtggaaagtgagc

SEQ ID NO: 7619665 - DNA, 22 bp, Homo sapiens
tttacagatgaggatactgagg

SEQ ID NO: 7619666 - DNA, 22 bp, Homo sapiens
tttacagatgtggaaagtgagc

SEQ ID NO: 7619667 - DNA, 22 bp, Homo sapiens
tttacagatgtggaaagtgagc

SEQ ID NO: 7619668 - DNA, 22 bp, Homo sapiens
tttacagatgtggaaagtgagc

SEQ ID NO: 7619669 - DNA, 22 bp, Homo sapiens
tttacagatgtggaaagtgagc

SEQ ID NO: 7619670 - DNA, 22 bp, Homo sapiens
tttacagatgtggaaagtgagc

SEQ ID NO: 7619671 - DNA, 22 bp, Homo sapiens
tttacagatgtggaaagtgagc

SEQ ID NO: 7619672 - DNA, 22 bp, Homo sapiens
tttacagatgtggaaagtgagc

SEQ ID NO: 7619673 - DNA, 22 bp, Homo sapiens
tttacagcaacagtgcagaggt

SEQ ID NO: 7619674 - DNA, 22 bp, Homo sapiens
tttacagcagcatgatttataa

SEQ ID NO: 7619675 - DNA, 22 bp, Homo sapiens
tttacagattctgggtattagg

SEQ ID NO: 7619676 - DNA, 22 bp, Homo sapiens
tttacagattctgggtattagg

SEQ ID NO: 7619677 - DNA, 22 bp, Homo sapiens
tttacagcaacagtgcagaggt

SEQ ID NO: 7619678 - DNA, 22 bp, Homo sapiens
tttacagctagacatacctgag

SEQ ID NO: 7619679 - DNA, 22 bp, Homo sapiens
tttacagctagacatacctgag

SEQ ID NO: 7619680 - DNA, 22 bp, Homo sapiens
tttacagcattgctgaaagttc

SEQ ID NO: 7619681 - DNA, 22 bp, Homo sapiens
tttacagctactgtcctatttc

SEQ ID NO: 7619682 - DNA, 22 bp, Homo sapiens
tttcaagtgactatggtttttg

SEQ ID NO: 7619683 - DNA, 22 bp, Homo sapiens
tttcaagtgactatggtttttg

SEQ ID NO: 7619684 - DNA, 22 bp, Homo sapiens
tttcaagtgactatggtttttg

SEQ ID NO: 7619685 - DNA, 22 bp, Homo sapiens
tttcaagtggcgagataaggaa

SEQ ID NO: 7619686 - DNA, 22 bp, Homo sapiens
tttcaagtggcgagataaggaa

SEQ ID NO: 7619687 - DNA, 22 bp, Homo sapiens
tttcaagtggggacatttgaga

SEQ ID NO: 7619688 - DNA, 22 bp, Homo sapiens
tttcaagtgtcctgattaatgg

SEQ ID NO: 7619689 - DNA, 22 bp, Homo sapiens
tttcaagtgtcctgattaatgg

SEQ ID NO: 7619690 - DNA, 22 bp, Homo sapiens
tttcaagttaaatggggtcttt

SEQ ID NO: 7619691 - DNA, 22 bp, Homo sapiens
tttcaagttaaatggggtcttt

SEQ ID NO: 7619692 - DNA, 22 bp, Homo sapiens
tttcaagttaaatggggtcttt

SEQ ID NO: 7619693 - DNA, 22 bp, Homo sapiens
tttcaagttcccagttttgtgg

SEQ ID NO: 7619694 - DNA, 22 bp, Homo sapiens
tttcaagttcccagttttgtgg

SEQ ID NO: 7619695 - DNA, 22 bp, Homo sapiens
tttcaagttctgttcctaaact

SEQ ID NO: 7619696 - DNA, 22 bp, Homo sapiens
tttcaagttctgttctagggta

SEQ ID NO: 7619697 - DNA, 22 bp, Homo sapiens
tttcaagttctgttcctaaact

SEQ ID NO: 7619698 - DNA, 22 bp, Homo sapiens
tttcaagttctgttctagggta

SEQ ID NO: 7619699 - DNA, 22 bp, Homo sapiens
tttcaagttctgttctagggta

SEQ ID NO: 7619700 - DNA, 22 bp, Homo sapiens
tttcaagttctgttcctaaact

SEQ ID NO: 7619701 - DNA, 20 bp, Homo sapiens
tttcaagttgtaaggtatca

SEQ ID NO: 7619702 - DNA, 20 bp, Homo sapiens
tttcaagttgtaaggtatca

SEQ ID NO: 7619703 - DNA, 20 bp, Homo sapiens
tttcaagttgtaaggtatca

SEQ ID NO: 7619704 - DNA, 22 bp, Homo sapiens
tttcaagttgttgcattaaatg

SEQ ID NO: 7619705 - DNA, 22 bp, Homo sapiens
tttcaagttgttgcattaaatg

SEQ ID NO: 7619706 - DNA, 22 bp, Homo sapiens
tttcaagttgttgcattaaatg

SEQ ID NO: 7619707 - DNA, 22 bp, Homo sapiens
tttcaagttgtttatatccaga

SEQ ID NO: 7619708 - DNA, 22 bp, Homo sapiens
tttcaagtttagtgtgttcaaa

SEQ ID NO: 7619709 - DNA, 22 bp, Homo sapiens
tttcaagtttagtgtgttcaaa

SEQ ID NO: 7619710 - DNA, 22 bp, Homo sapiens
tttcaagtttagtgtgttcaaa

SEQ ID NO: 7619711 - DNA, 22 bp, Homo sapiens
tttcaagtttagtgtgttcaaa

SEQ ID NO: 7619712 - DNA, 22 bp, Homo sapiens
tttcaataacaaagctcatttt

SEQ ID NO: 7619713 - DNA, 22 bp, Homo sapiens
tttcaataacaaagctcatttt

SEQ ID NO: 7619714 - DNA, 22 bp, Homo sapiens
tttcaatgacacaaaagagaaa

SEQ ID NO: 7619715 - DNA, 22 bp, Homo sapiens
tttcaatgacacaaaagagaaa

SEQ ID NO: 7619716 - DNA, 22 bp, Homo sapiens
tttcaatgacacaaaagagaaa

SEQ ID NO: 7619717 - DNA, 22 bp, Homo sapiens
tttcaatgacacaaaagagaaa

SEQ ID NO: 7619718 - DNA, 22 bp, Homo sapiens
tttcaataacaaagctcatttt

SEQ ID NO: 7619719 - DNA, 22 bp, Homo sapiens
tttcacaagacagctactgttg

SEQ ID NO: 7619720 - DNA, 22 bp, Homo sapiens
tttcacaagacagctactgttg

SEQ ID NO: 7619721 - DNA, 22 bp, Homo sapiens
tttcacaagacagctactgttg

SEQ ID NO: 7619722 - DNA, 22 bp, Homo sapiens
tttcacaagtaaagtcctaagt

SEQ ID NO: 7619723 - DNA, 22 bp, Homo sapiens
tttcacaagtttcaggattctg

SEQ ID NO: 7619724 - DNA, 22 bp, Homo sapiens
tttcacaagtttcaggattctg

SEQ ID NO: 7619725 - DNA, 22 bp, Homo sapiens
tttcacaagtttcaggattctg

SEQ ID NO: 7619726 - DNA, 22 bp, Homo sapiens
tttcacaatcaaatggtgaaat

SEQ ID NO: 7619727 - DNA, 22 bp, Homo sapiens
tttcacaagtttcaggattctg

SEQ ID NO: 7619728 - DNA, 19 bp, Homo sapiens
tttcaatggcttagagaaa

SEQ ID NO: 7619729 - DNA, 19 bp, Homo sapiens
tttcaatggcttagagaaa

SEQ ID NO: 7619730 - DNA, 22 bp, Homo sapiens
tttcaatgacacaaaagagaaa

SEQ ID NO: 7619731 - DNA, 22 bp, Homo sapiens
tttcaatgacacaaaagagaaa

SEQ ID NO: 7619732 - DNA, 18 bp, Homo sapiens
tttcacaacctccagagg

SEQ ID NO: 7619733 - DNA, 19 bp, Homo sapiens
tttcaatggcttagagaaa

SEQ ID NO: 7619734 - DNA, 18 bp, Homo sapiens
tttcacaacctccagagg

SEQ ID NO: 7619735 - DNA, 18 bp, Homo sapiens
tttcacaacctccagagg

SEQ ID NO: 7619736 - DNA, 22 bp, Homo sapiens
tttcacaacgttgtggtgagag

SEQ ID NO: 7619737 - DNA, 22 bp, Homo sapiens
tttcacaacgttgtggtgagag

SEQ ID NO: 7619738 - DNA, 22 bp, Homo sapiens
tttcacaactgcttatttgaga

SEQ ID NO: 7619739 - DNA, 22 bp, Homo sapiens
tttcacaactgcttatttgaga

SEQ ID NO: 7619740 - DNA, 22 bp, Homo sapiens
tttcacaactgcttatttgaga

SEQ ID NO: 7619741 - DNA, 22 bp, Homo sapiens
tttcacaactgcttatttgaga

SEQ ID NO: 7619742 - DNA, 22 bp, Homo sapiens
tttcacaactgcttatttgaga

SEQ ID NO: 7619743 - DNA, 22 bp, Homo sapiens
tttcacaacgttgtggtgagag

SEQ ID NO: 7619744 - DNA, 22 bp, Homo sapiens
tttcacaacgttgtggtgagag

SEQ ID NO: 7619745 - DNA, 22 bp, Homo sapiens
tttcacaacgttgtggtgagag

SEQ ID NO: 7619746 - DNA, 20 bp, Homo sapiens
tttcaagtcagcaattctca

SEQ ID NO: 7619747 - DNA, 20 bp, Homo sapiens
tttcaagtcagcaattctca

SEQ ID NO: 7619748 - DNA, 20 bp, Homo sapiens
tttcaagtcagcaattctca

SEQ ID NO: 7619749 - DNA, 22 bp, Homo sapiens
tttcaagtactgtaaacatgct

SEQ ID NO: 7619750 - DNA, 22 bp, Homo sapiens
tttcaagtagagggatcgctag

SEQ ID NO: 7619751 - DNA, 22 bp, Homo sapiens
tttcaagtactgtaaacatgct

SEQ ID NO: 7619752 - DNA, 22 bp, Homo sapiens
tttcaagtactgtaaacatgct

SEQ ID NO: 7619753 - DNA, 22 bp, Homo sapiens
tttcaagtactgtaaacatgct

SEQ ID NO: 7619754 - DNA, 22 bp, Homo sapiens
tttcaagtactgtaaacatgct

SEQ ID NO: 7619755 - DNA, 22 bp, Homo sapiens
tttcaagtactgtaaacatgct

SEQ ID NO: 7619756 - DNA, 20 bp, Homo sapiens
tttcaagtcagcaattctca

SEQ ID NO: 7619757 - DNA, 22 bp, Homo sapiens
tttcaagtcagtagctaatcat

SEQ ID NO: 7619758 - DNA, 22 bp, Homo sapiens
tttcaagtcattctataatatc

SEQ ID NO: 7619759 - DNA, 22 bp, Homo sapiens
tttcaagtcattctataatatc

SEQ ID NO: 7619760 - DNA, 22 bp, Homo sapiens
tttcaagtcattctataatatc

SEQ ID NO: 7619761 - DNA, 20 bp, Homo sapiens
tttcaagtcggtagagtcta

SEQ ID NO: 7619762 - DNA, 22 bp, Homo sapiens
tttcaagcatgtcaagttagtc

SEQ ID NO: 7619763 - DNA, 22 bp, Homo sapiens
tttcaaggatgttatataaatg

SEQ ID NO: 7619764 - DNA, 22 bp, Homo sapiens
tttcaaggccttctggttcagt

SEQ ID NO: 7619765 - DNA, 22 bp, Homo sapiens
tttcaaggctaatccacagtat

SEQ ID NO: 7619766 - DNA, 22 bp, Homo sapiens
tttcaaggccttctggttcagt

SEQ ID NO: 7619767 - DNA, 22 bp, Homo sapiens
tttcaaggatgttatataaatg

SEQ ID NO: 7619768 - DNA, 22 bp, Homo sapiens
tttcaaggatgttatataaatg

SEQ ID NO: 7619769 - DNA, 22 bp, Homo sapiens
tttcaagtaagatacatttcag

SEQ ID NO: 7619770 - DNA, 22 bp, Homo sapiens
tttcaagtaagatacatttcag

SEQ ID NO: 7619771 - DNA, 22 bp, Homo sapiens
tttcaagtaagatacatttcag

SEQ ID NO: 7619772 - DNA, 17 bp, Homo sapiens
tttcaaggttacgttcc

SEQ ID NO: 7619773 - DNA, 23 bp, Homo sapiens
tttcaaggtgtctgtaccactga

SEQ ID NO: 7619774 - DNA, 23 bp, Homo sapiens
tttcaaggtgtctgtaccactga

SEQ ID NO: 7619775 - DNA, 17 bp, Homo sapiens
tttcaaggttacgttcc

SEQ ID NO: 7619776 - DNA, 22 bp, Homo sapiens
tttcaagggaatatgaaattca

SEQ ID NO: 7619777 - DNA, 22 bp, Homo sapiens
tttcaaggtgcaggagggtttt

SEQ ID NO: 7619778 - DNA, 22 bp, Homo sapiens
tttcaaggctagttttaattag

SEQ ID NO: 7619779 - DNA, 22 bp, Homo sapiens
tttcaaggctagttttaattag

SEQ ID NO: 7619780 - DNA, 22 bp, Homo sapiens
tttcaaggctagttttaattag

SEQ ID NO: 7619781 - DNA, 22 bp, Homo sapiens
tttatttataagccacttgctg

SEQ ID NO: 7619782 - DNA, 22 bp, Homo sapiens
tttatttataagccacttgctg

SEQ ID NO: 7619783 - DNA, 22 bp, Homo sapiens
tttatttataagccacttgctg

SEQ ID NO: 7619784 - DNA, 22 bp, Homo sapiens
tttatttataagccacttgctg

SEQ ID NO: 7619785 - DNA, 22 bp, Homo sapiens
tttatttataagccacttgctg

SEQ ID NO: 7619786 - DNA, 22 bp, Homo sapiens
tttatttataagccacttgctg

SEQ ID NO: 7619787 - DNA, 22 bp, Homo sapiens
tttatttataagccacttgctg

SEQ ID NO: 7619788 - DNA, 22 bp, Homo sapiens
tttatttataagccacttgctg

SEQ ID NO: 7619789 - DNA, 22 bp, Homo sapiens
tttatttataagccacttgctg

SEQ ID NO: 7619790 - DNA, 21 bp, Homo sapiens
tttatttatataggacacatg

SEQ ID NO: 7619791 - DNA, 21 bp, Homo sapiens
tttatttatataggacacatg

SEQ ID NO: 7619792 - DNA, 21 bp, Homo sapiens
tttatttatataggacacatg

SEQ ID NO: 7619793 - DNA, 21 bp, Homo sapiens
tttatttatataggacacatg

SEQ ID NO: 7619794 - DNA, 21 bp, Homo sapiens
tttatttatataggacacatg

SEQ ID NO: 7619795 - DNA, 21 bp, Homo sapiens
tttatttatataggacacatg

SEQ ID NO: 7619796 - DNA, 21 bp, Homo sapiens
tttatttatataggacacatg

SEQ ID NO: 7619797 - DNA, 21 bp, Homo sapiens
tttatttatataggacacatg

SEQ ID NO: 7619798 - DNA, 21 bp, Homo sapiens
tttatttatataggacacatg

SEQ ID NO: 7619799 - DNA, 22 bp, Homo sapiens
tttatttatccttctggattgc

SEQ ID NO: 7619800 - DNA, 22 bp, Homo sapiens
tttatttatccttctggattgc

SEQ ID NO: 7619801 - DNA, 22 bp, Homo sapiens
tttatttatccttctggattgc

SEQ ID NO: 7619802 - DNA, 21 bp, Homo sapiens
tttatttatataggacacatg

SEQ ID NO: 7619803 - DNA, 21 bp, Homo sapiens
tttatttatataggacacatg

SEQ ID NO: 7619804 - DNA, 22 bp, Homo sapiens
tttatttatccttctggattgc

SEQ ID NO: 7619805 - DNA, 22 bp, Homo sapiens
tttatttatccttctggattgc

SEQ ID NO: 7619806 - DNA, 22 bp, Homo sapiens
tttatttatccttctggattgc

SEQ ID NO: 7619807 - DNA, 22 bp, Homo sapiens
tttatttatccttctggattgc

SEQ ID NO: 7619808 - DNA, 22 bp, Homo sapiens
tttatttatccttctggattgc

SEQ ID NO: 7619809 - DNA, 22 bp, Homo sapiens
tttatttatccttctggattgc

SEQ ID NO: 7619810 - DNA, 22 bp, Homo sapiens
tttatttatccttctggattgc

SEQ ID NO: 7619811 - DNA, 23 bp, Homo sapiens
tttatttatttaggctgagggat

SEQ ID NO: 7619812 - DNA, 23 bp, Homo sapiens
tttatttatttaggctgagggat

SEQ ID NO: 7619813 - DNA, 23 bp, Homo sapiens
tttatttatttaggctgagggat

SEQ ID NO: 7619814 - DNA, 23 bp, Homo sapiens
tttatttatttaggctgagggat

SEQ ID NO: 7619815 - DNA, 23 bp, Homo sapiens
tttatttatttaggctgagggat

SEQ ID NO: 7619816 - DNA, 23 bp, Homo sapiens
tttatttatttaggctgagggat

SEQ ID NO: 7619817 - DNA, 23 bp, Homo sapiens
tttatttatttaggctgagggat

SEQ ID NO: 7619818 - DNA, 22 bp, Homo sapiens
tttatttatccttctggattgc

SEQ ID NO: 7619819 - DNA, 22 bp, Homo sapiens
tttatttatccttctggattgc

SEQ ID NO: 7619820 - DNA, 22 bp, Homo sapiens
tttcacatggactttttgttct

SEQ ID NO: 7619821 - DNA, 22 bp, Homo sapiens
tttcacatggaagctctcgaga

SEQ ID NO: 7619822 - DNA, 22 bp, Homo sapiens
tttcacatggactttttgttct

SEQ ID NO: 7619823 - DNA, 22 bp, Homo sapiens
tttcacatggactttttgttct

SEQ ID NO: 7619824 - DNA, 22 bp, Homo sapiens
tttcacatgcagcagggaagtg

SEQ ID NO: 7619825 - DNA, 22 bp, Homo sapiens
tttcacatgcagcagggaagtg

SEQ ID NO: 7619826 - DNA, 22 bp, Homo sapiens
tttcacatggaagctctcgaga

SEQ ID NO: 7619827 - DNA, 22 bp, Homo sapiens
tttcacatggaagctctcgaga

SEQ ID NO: 7619828 - DNA, 20 bp, Homo sapiens
tttcacatctgtccctttaa

SEQ ID NO: 7619829 - DNA, 20 bp, Homo sapiens
tttcacatctgtccctttaa

SEQ ID NO: 7619830 - DNA, 20 bp, Homo sapiens
tttcacatctgtccctttaa

SEQ ID NO: 7619831 - DNA, 22 bp, Homo sapiens
tttcacatcctgaagccccact

SEQ ID NO: 7619832 - DNA, 22 bp, Homo sapiens
tttcacatcctgaagccccact

SEQ ID NO: 7619833 - DNA, 22 bp, Homo sapiens
tttcacatcccgcgcgccctta

SEQ ID NO: 7619834 - DNA, 22 bp, Homo sapiens
tttcacatcatgggatggaagc

SEQ ID NO: 7619835 - DNA, 22 bp, Homo sapiens
tttcacatcatgggatggaagc

SEQ ID NO: 7619836 - DNA, 22 bp, Homo sapiens
tttcacatgtatataggcatta

SEQ ID NO: 7619837 - DNA, 22 bp, Homo sapiens
tttcacatgtatataggcatta

SEQ ID NO: 7619838 - DNA, 22 bp, Homo sapiens
tttcacatgtatataggcatta

SEQ ID NO: 7619839 - DNA, 22 bp, Homo sapiens
tttcacatgtatataggcatta

SEQ ID NO: 7619840 - DNA, 22 bp, Homo sapiens
tttcacatgtatataggcatta

SEQ ID NO: 7619841 - DNA, 22 bp, Homo sapiens
tttcacatggtactgcctgttt

SEQ ID NO: 7619842 - DNA, 22 bp, Homo sapiens
tttcacatggtactgcctgttt

SEQ ID NO: 7619843 - DNA, 22 bp, Homo sapiens
tttcacatggtactgcctgttt

SEQ ID NO: 7619844 - DNA, 22 bp, Homo sapiens
tttcacatggtactgcctgttt

SEQ ID NO: 7619845 - DNA, 22 bp, Homo sapiens
tttcacatggtactgcctgttt

SEQ ID NO: 7619846 - DNA, 22 bp, Homo sapiens
tttcacatgtgctgttgtcaat

SEQ ID NO: 7619847 - DNA, 22 bp, Homo sapiens
tttcacatgtgctgttgtcaat

SEQ ID NO: 7619848 - DNA, 22 bp, Homo sapiens
tttcacatgtgctgttgtcaat

SEQ ID NO: 7619849 - DNA, 22 bp, Homo sapiens
tttcacatgtgctgttgtcaat

SEQ ID NO: 7619850 - DNA, 22 bp, Homo sapiens
tttcacatgtatataggcatta

SEQ ID NO: 7619851 - DNA, 22 bp, Homo sapiens
tttcacatgtggaatgccaggt

SEQ ID NO: 7619852 - DNA, 22 bp, Homo sapiens
tttcacatgtggaatgccaggt

SEQ ID NO: 7619853 - DNA, 22 bp, Homo sapiens
tttcacatgtggaatgccaggt

SEQ ID NO: 7619854 - DNA, 22 bp, Homo sapiens
tttcacatatggttgttgattg

SEQ ID NO: 7619855 - DNA, 22 bp, Homo sapiens
tttcacatatggttgttgattg

SEQ ID NO: 7619856 - DNA, 22 bp, Homo sapiens
tttcacatcagaggtagattag

SEQ ID NO: 7619857 - DNA, 22 bp, Homo sapiens
tttcacatcagaggtagattag

SEQ ID NO: 7619858 - DNA, 22 bp, Homo sapiens
tttcacatatggttgttgattg

SEQ ID NO: 7619859 - DNA, 22 bp, Homo sapiens
tttcacatcagaggtagattag

SEQ ID NO: 7619860 - DNA, 22 bp, Homo sapiens
tttcacatcagaggtagattag

SEQ ID NO: 7619861 - DNA, 22 bp, Homo sapiens
tttcacatatggttgttgattg

SEQ ID NO: 7619862 - DNA, 22 bp, Homo sapiens
tttcacatatcaactctatcct

SEQ ID NO: 7619863 - DNA, 22 bp, Homo sapiens
tttcacaggccttttgtagccc

SEQ ID NO: 7619864 - DNA, 22 bp, Homo sapiens
tttcacaggatgctgttttata

SEQ ID NO: 7619865 - DNA, 22 bp, Homo sapiens
tttcacaggattctgatgtagt

SEQ ID NO: 7619866 - DNA, 22 bp, Homo sapiens
tttcacaggccttttgtagccc

SEQ ID NO: 7619867 - DNA, 22 bp, Homo sapiens
tttcacaggccttttgtagccc

SEQ ID NO: 7619868 - DNA, 22 bp, Homo sapiens
tttcacaggggcaacctccatg

SEQ ID NO: 7619869 - DNA, 22 bp, Homo sapiens
tttcacaggggcaacctccatg

SEQ ID NO: 7619870 - DNA, 20 bp, Homo sapiens
tttcacaatgaacatgtctc

SEQ ID NO: 7619871 - DNA, 20 bp, Homo sapiens
tttcacaatgaacatgtctc

SEQ ID NO: 7619872 - DNA, 20 bp, Homo sapiens
tttcacaatgaacatgtctc

SEQ ID NO: 7619873 - DNA, 20 bp, Homo sapiens
tttcacaatgaacatgtctc

SEQ ID NO: 7619874 - DNA, 23 bp, Homo sapiens
tttcacagcttttattctgcatc

SEQ ID NO: 7619875 - DNA, 20 bp, Homo sapiens
tttcacaatgaacatgtctc

SEQ ID NO: 7619876 - DNA, 22 bp, Homo sapiens
tttcacaatcaaatggtgaaat

SEQ ID NO: 7619877 - DNA, 22 bp, Homo sapiens
tttcacaggatgctgttttata

SEQ ID NO: 7619878 - DNA, 22 bp, Homo sapiens
tttcacaggatgctgttttata

SEQ ID NO: 7619879 - DNA, 22 bp, Homo sapiens
tttcacaggagtcctttctata

SEQ ID NO: 7619880 - DNA, 22 bp, Homo sapiens
tttcacaggagttgtaccattt

SEQ ID NO: 7619881 - DNA, 22 bp, Homo sapiens
tttcacaggagttgtaccattt

SEQ ID NO: 7619882 - DNA, 22 bp, Homo sapiens
tttcacaggagtcctttctata

SEQ ID NO: 7619883 - DNA, 22 bp, Homo sapiens
tttcacaggaatacccggcttt

SEQ ID NO: 7619884 - DNA, 22 bp, Homo sapiens
tttcacaggaatacccggcttt

SEQ ID NO: 7619885 - DNA, 22 bp, Homo sapiens
tttcataaacagtagaagacta

SEQ ID NO: 7619886 - DNA, 22 bp, Homo sapiens
tttcataaacagtagaagacta

SEQ ID NO: 7619887 - DNA, 22 bp, Homo sapiens
tttcataaacagtagaagacta

SEQ ID NO: 7619888 - DNA, 22 bp, Homo sapiens
tttcataaacagtagaagacta

SEQ ID NO: 7619889 - DNA, 22 bp, Homo sapiens
tttcataaacagtagaagacta

SEQ ID NO: 7619890 - DNA, 22 bp, Homo sapiens
tttcagttttataactttggcc

SEQ ID NO: 7619891 - DNA, 22 bp, Homo sapiens
tttcagtttttgctcgatgtat

SEQ ID NO: 7619892 - DNA, 22 bp, Homo sapiens
tttcagtttttgctcgatgtat

SEQ ID NO: 7619893 - DNA, 22 bp, Homo sapiens
tttcagttttataactttggcc

SEQ ID NO: 7619894 - DNA, 22 bp, Homo sapiens
tttcagtttgtcggccttggac

SEQ ID NO: 7619895 - DNA, 23 bp, Homo sapiens
tttcagtttggaccagccccgac

SEQ ID NO: 7619896 - DNA, 22 bp, Homo sapiens
tttcagtgtcagtaatgcagca

SEQ ID NO: 7619897 - DNA, 21 bp, Homo sapiens
tttcagtgtatgacagtgaaa

SEQ ID NO: 7619898 - DNA, 22 bp, Homo sapiens
tttcagtgtcagtaatgcagca

SEQ ID NO: 7619899 - DNA, 22 bp, Homo sapiens
tttcagtgtgagtgtcttattt

SEQ ID NO: 7619900 - DNA, 22 bp, Homo sapiens
tttcagtgtatcttccaaaagc

SEQ ID NO: 7619901 - DNA, 21 bp, Homo sapiens
tttcagtgtatgacagtgaaa

SEQ ID NO: 7619902 - DNA, 21 bp, Homo sapiens
tttcagtgtatgacagtgaaa

SEQ ID NO: 7619903 - DNA, 22 bp, Homo sapiens
tttcagtttgaaggaaaggcca

SEQ ID NO: 7619904 - DNA, 22 bp, Homo sapiens
tttcagtttgaaggaaaggcca

SEQ ID NO: 7619905 - DNA, 22 bp, Homo sapiens
tttcagtttccagctttgtcat

SEQ ID NO: 7619906 - DNA, 22 bp, Homo sapiens
tttcagtttgaaggaaaggcca

SEQ ID NO: 7619907 - DNA, 22 bp, Homo sapiens
tttcagtttgaaggaaaggcca

SEQ ID NO: 7619908 - DNA, 22 bp, Homo sapiens
tttcagtgggtttatttcatgt

SEQ ID NO: 7619909 - DNA, 22 bp, Homo sapiens
tttcagtgggtttatttcatgt

SEQ ID NO: 7619910 - DNA, 20 bp, Homo sapiens
tttcagtggtttgtgcctag

SEQ ID NO: 7619911 - DNA, 22 bp, Homo sapiens
tttcagtggcatcgattaccct

SEQ ID NO: 7619912 - DNA, 22 bp, Homo sapiens
tttcacatttgttttaagaagt

SEQ ID NO: 7619913 - DNA, 22 bp, Homo sapiens
tttcagtgtatcttccaaaagc

SEQ ID NO: 7619914 - DNA, 22 bp, Homo sapiens
tttcagtgtatcttccaaaagc

SEQ ID NO: 7619915 - DNA, 22 bp, Homo sapiens
tttcagtgtaaggtttccagga

SEQ ID NO: 7619916 - DNA, 22 bp, Homo sapiens
tttcagtgtatcttccaaaagc

SEQ ID NO: 7619917 - DNA, 22 bp, Homo sapiens
tttcagtgtaaggtttccagga

SEQ ID NO: 7619918 - DNA, 22 bp, Homo sapiens
tttcagtgtaaggtttccagga

SEQ ID NO: 7619919 - DNA, 22 bp, Homo sapiens
tttcacatttgttttaagaagt

SEQ ID NO: 7619920 - DNA, 22 bp, Homo sapiens
tttcacatttgttttaagaagt

SEQ ID NO: 7619921 - DNA, 22 bp, Homo sapiens
tttcacatttgttttaagaagt

SEQ ID NO: 7619922 - DNA, 23 bp, Homo sapiens
tttcacatttactgttagatggc

SEQ ID NO: 7619923 - DNA, 22 bp, Homo sapiens
tttcacatttaggcgtgaattg

SEQ ID NO: 7619924 - DNA, 22 bp, Homo sapiens
tttcacatttaggcgtgaattg

SEQ ID NO: 7619925 - DNA, 23 bp, Homo sapiens
tttcacatttactgttagatggc

SEQ ID NO: 7619926 - DNA, 22 bp, Homo sapiens
tttcacattggcttctatttct

SEQ ID NO: 7619927 - DNA, 22 bp, Homo sapiens
tttcacattggcttctatttct

SEQ ID NO: 7619928 - DNA, 22 bp, Homo sapiens
tttcacattggcttctatttct

SEQ ID NO: 7619929 - DNA, 22 bp, Homo sapiens
tttcacattggcttctatttct

SEQ ID NO: 7619930 - DNA, 22 bp, Homo sapiens
tttcacattggcttctatttct

SEQ ID NO: 7619931 - DNA, 22 bp, Homo sapiens
tttcacattggcttctatttct

SEQ ID NO: 7619932 - DNA, 22 bp, Homo sapiens
tttcacattggcttctatttct

SEQ ID NO: 7619933 - DNA, 22 bp, Homo sapiens
tttcacattcttctgaatctac

SEQ ID NO: 7619934 - DNA, 22 bp, Homo sapiens
tttcacattcttctgaatctac

SEQ ID NO: 7619935 - DNA, 22 bp, Homo sapiens
tttcacattcttctgaatctac

SEQ ID NO: 7619936 - DNA, 22 bp, Homo sapiens
tttcacattcttctgaatctac

SEQ ID NO: 7619937 - DNA, 22 bp, Homo sapiens
tttcacattctctggttatcga

SEQ ID NO: 7619938 - DNA, 22 bp, Homo sapiens
tttcacattcagatatagactt

SEQ ID NO: 7619939 - DNA, 22 bp, Homo sapiens
tttcacattcttctgaatctac

SEQ ID NO: 7619940 - DNA, 23 bp, Homo sapiens
tttcacattaatgtttagcagga

SEQ ID NO: 7619941 - DNA, 23 bp, Homo sapiens
tttcacattaatgtttagcagga

SEQ ID NO: 7619942 - DNA, 23 bp, Homo sapiens
tttcacattaatgtttagcagga

SEQ ID NO: 7619943 - DNA, 22 bp, Homo sapiens
tttcacatgtggaatgccaggt

SEQ ID NO: 7619944 - DNA, 23 bp, Homo sapiens
tttcacattaatgtttagcagga

SEQ ID NO: 7619945 - DNA, 23 bp, Homo sapiens
tttcacattaatgtttagcagga

SEQ ID NO: 7619946 - DNA, 22 bp, Homo sapiens
tttcacattagatatgtcattt

SEQ ID NO: 7619947 - DNA, 22 bp, Homo sapiens
tttcacattagatatgtcattt

SEQ ID NO: 7619948 - DNA, 22 bp, Homo sapiens
tttcacattagatatgtcattt

SEQ ID NO: 7619949 - DNA, 22 bp, Homo sapiens
tttcacattagatatgtcattt

SEQ ID NO: 7619950 - DNA, 22 bp, Homo sapiens
tttcacattcagatatagactt

SEQ ID NO: 7619951 - DNA, 22 bp, Homo sapiens
tttcacattcagatatagactt

SEQ ID NO: 7619952 - DNA, 22 bp, Homo sapiens
tttcacattcagatatagactt

SEQ ID NO: 7619953 - DNA, 22 bp, Homo sapiens
tttcccacacagtccactgcag

SEQ ID NO: 7619954 - DNA, 22 bp, Homo sapiens
tttcccaagtgtaaacatggca

SEQ ID NO: 7619955 - DNA, 22 bp, Homo sapiens
tttcccacacagtccactgcag

SEQ ID NO: 7619956 - DNA, 22 bp, Homo sapiens
tttcccacacagtccactgcag

SEQ ID NO: 7619957 - DNA, 22 bp, Homo sapiens
tttcccaacagtctctctcaaa

SEQ ID NO: 7619958 - DNA, 22 bp, Homo sapiens
tttcccaacagtctctctcaaa

SEQ ID NO: 7619959 - DNA, 22 bp, Homo sapiens
tttccagttgttctagaaagct

SEQ ID NO: 7619960 - DNA, 22 bp, Homo sapiens
tttccagttgttctagaaagct

SEQ ID NO: 7619961 - DNA, 22 bp, Homo sapiens
tttccagttgttctagaaagct

SEQ ID NO: 7619962 - DNA, 22 bp, Homo sapiens
tttccagtgggccccttgaaat

SEQ ID NO: 7619963 - DNA, 22 bp, Homo sapiens
tttccagtgggccccttgaaat

SEQ ID NO: 7619964 - DNA, 22 bp, Homo sapiens
tttccagttgtcctatcacctg

SEQ ID NO: 7619965 - DNA, 22 bp, Homo sapiens
tttccagtgggccccttgaaat

SEQ ID NO: 7619966 - DNA, 22 bp, Homo sapiens
tttccatatttaatcaaaataa

SEQ ID NO: 7619967 - DNA, 22 bp, Homo sapiens
tttccatatttaatcaaaataa

SEQ ID NO: 7619968 - DNA, 22 bp, Homo sapiens
tttccatgttatcttgcagact

SEQ ID NO: 7619969 - DNA, 22 bp, Homo sapiens
tttccatgttatcttgcagact

SEQ ID NO: 7619970 - DNA, 22 bp, Homo sapiens
tttcctttgtgcaggccttggg

SEQ ID NO: 7619971 - DNA, 22 bp, Homo sapiens
tttcctttgggcacccgagctc

SEQ ID NO: 7619972 - DNA, 22 bp, Homo sapiens
tttcctttgggagcatgaattt

SEQ ID NO: 7619973 - DNA, 22 bp, Homo sapiens
tttcctttgggagcatgaattt

SEQ ID NO: 7619974 - DNA, 22 bp, Homo sapiens
tttcctttgggagcatgaattt

SEQ ID NO: 7619975 - DNA, 22 bp, Homo sapiens
tttcctttgggagcatgaattt

SEQ ID NO: 7619976 - DNA, 22 bp, Homo sapiens
tttcctttgggagcatgaattt

SEQ ID NO: 7619977 - DNA, 22 bp, Homo sapiens
tttcctttgggagcatgaattt

SEQ ID NO: 7619978 - DNA, 22 bp, Homo sapiens
tttcctttgggagcatgaattt

SEQ ID NO: 7619979 - DNA, 22 bp, Homo sapiens
tttcctttgggagcatgaattt

SEQ ID NO: 7619980 - DNA, 22 bp, Homo sapiens
tttcctttgagggtcctacact

SEQ ID NO: 7619981 - DNA, 22 bp, Homo sapiens
tttcctttgagggtcctacact

SEQ ID NO: 7619982 - DNA, 22 bp, Homo sapiens
tttcctttgagggtcctacact

SEQ ID NO: 7619983 - DNA, 22 bp, Homo sapiens
tttcctttgcccaatacatgtc

SEQ ID NO: 7619984 - DNA, 22 bp, Homo sapiens
tttcctttgcccaatacatgtc

SEQ ID NO: 7619985 - DNA, 22 bp, Homo sapiens
tttcctttgcccaatacatgtc

SEQ ID NO: 7619986 - DNA, 22 bp, Homo sapiens
tttcctttgcccaatacatgtc

SEQ ID NO: 7619987 - DNA, 22 bp, Homo sapiens
tttcctttgcccaatacatgtc

SEQ ID NO: 7619988 - DNA, 22 bp, Homo sapiens
tttcctttgcccaatacatgtc

SEQ ID NO: 7619989 - DNA, 22 bp, Homo sapiens
tttcctttgagggtcctacact

SEQ ID NO: 7619990 - DNA, 22 bp, Homo sapiens
tttcctttctggtttggtcata

SEQ ID NO: 7619991 - DNA, 22 bp, Homo sapiens
tttcctttgagggtcctacact

SEQ ID NO: 7619992 - DNA, 22 bp, Homo sapiens
tttccttgcacattggtttcca

SEQ ID NO: 7619993 - DNA, 22 bp, Homo sapiens
tttccttgcacattggtttcca

SEQ ID NO: 7619994 - DNA, 22 bp, Homo sapiens
tttccttgcacattggtttcca

SEQ ID NO: 7619995 - DNA, 22 bp, Homo sapiens
tttccttgcacattggtttcca

SEQ ID NO: 7619996 - DNA, 22 bp, Homo sapiens
tttccttgcacattggtttcca

SEQ ID NO: 7619997 - DNA, 21 bp, Homo sapiens
tttcccagcagagatagctgg

SEQ ID NO: 7619998 - DNA, 22 bp, Homo sapiens
tttccttcttagcggtgttctt

SEQ ID NO: 7619999 - DNA, 22 bp, Homo sapiens
tttcccagaggtatgaataagt

SEQ ID NO: 7620000 - DNA, 22 bp, Homo sapiens
tttcccagaggtatgaataagt

SEQ ID NO: 7620001 - DNA, 22 bp, Homo sapiens
tttcccagaggtatgaataagt

SEQ ID NO: 7620002 - DNA, 22 bp, Homo sapiens
tttcccagaggtatgaataagt

SEQ ID NO: 7620003 - DNA, 22 bp, Homo sapiens
tttcccaattgagaggttctgt

SEQ ID NO: 7620004 - DNA, 22 bp, Homo sapiens
tttcccacacagtccactgcag

SEQ ID NO: 7620005 - DNA, 23 bp, Homo sapiens
tttcccaccctctctcattgctg

SEQ ID NO: 7620006 - DNA, 23 bp, Homo sapiens
tttcccaccctctctcattgctg

SEQ ID NO: 7620007 - DNA, 22 bp, Homo sapiens
tttctaaggccagagactgctg

SEQ ID NO: 7620008 - DNA, 22 bp, Homo sapiens
tttctaaggccagagactgctg

SEQ ID NO: 7620009 - DNA, 21 bp, Homo sapiens
tttctaaggaggaagaaaaga

SEQ ID NO: 7620010 - DNA, 21 bp, Homo sapiens
tttctaaggaggaagaaaaga

SEQ ID NO: 7620011 - DNA, 21 bp, Homo sapiens
tttctaaggaggaagaaaaga

SEQ ID NO: 7620012 - DNA, 22 bp, Homo sapiens
tttctaaggtgaggtagaaaat

SEQ ID NO: 7620013 - DNA, 22 bp, Homo sapiens
tttctaaggtgaggtagaaaat

SEQ ID NO: 7620014 - DNA, 22 bp, Homo sapiens
tttctaaggtgaggtagaaaat

SEQ ID NO: 7620015 - DNA, 22 bp, Homo sapiens
tttctaaggtgaggtagaaaat

SEQ ID NO: 7620016 - DNA, 22 bp, Homo sapiens
tttctaaggctaggtcttaagg

SEQ ID NO: 7620017 - DNA, 22 bp, Homo sapiens
tttctaaggctaggtcttaagg

SEQ ID NO: 7620018 - DNA, 19 bp, Homo sapiens
tttctaagctaaatgcttc

SEQ ID NO: 7620019 - DNA, 22 bp, Homo sapiens
tttctaagcttagtatgaggca

SEQ ID NO: 7620020 - DNA, 22 bp, Homo sapiens
tttctaagcttagtatgaggca

SEQ ID NO: 7620021 - DNA, 19 bp, Homo sapiens
tttctaagctaaatgcttc

SEQ ID NO: 7620022 - DNA, 19 bp, Homo sapiens
tttctaagctaaatgcttc

SEQ ID NO: 7620023 - DNA, 19 bp, Homo sapiens
tttctaagctaaatgcttc

SEQ ID NO: 7620024 - DNA, 19 bp, Homo sapiens
tttctaagctaaatgcttc

SEQ ID NO: 7620025 - DNA, 22 bp, Homo sapiens
tttctaagatgtggtttcaagg

SEQ ID NO: 7620026 - DNA, 22 bp, Homo sapiens
tttctaagatgtggtttcaagg

SEQ ID NO: 7620027 - DNA, 22 bp, Homo sapiens
tttctaaatggtggctgcattg

SEQ ID NO: 7620028 - DNA, 22 bp, Homo sapiens
tttctaaatggtggctgcattg

SEQ ID NO: 7620029 - DNA, 22 bp, Homo sapiens
tttctaacagcaaatgtttatc

SEQ ID NO: 7620030 - DNA, 22 bp, Homo sapiens
tttctaaatggtggctgcattg

SEQ ID NO: 7620031 - DNA, 22 bp, Homo sapiens
tttctaacgtagacagggaggt

SEQ ID NO: 7620032 - DNA, 22 bp, Homo sapiens
tttctaacagcaaatgtttatc

SEQ ID NO: 7620033 - DNA, 22 bp, Homo sapiens
tttctaagacatttgtcatctt

SEQ ID NO: 7620034 - DNA, 22 bp, Homo sapiens
tttctaagaatattgctcttaa

SEQ ID NO: 7620035 - DNA, 22 bp, Homo sapiens
tttctaagaatattgctcttaa

SEQ ID NO: 7620036 - DNA, 22 bp, Homo sapiens
tttctaagaatattgctcttaa

SEQ ID NO: 7620037 - DNA, 22 bp, Homo sapiens
tttctaagacatttgtcatctt

SEQ ID NO: 7620038 - DNA, 22 bp, Homo sapiens
tttctaacgtagacagggaggt

SEQ ID NO: 7620039 - DNA, 22 bp, Homo sapiens
tttctaagaaagtaatggttat

SEQ ID NO: 7620040 - DNA, 22 bp, Homo sapiens
tttctaacagcaaatgtttatc

SEQ ID NO: 7620041 - DNA, 22 bp, Homo sapiens
tttctaacgtagacagggaggt

SEQ ID NO: 7620042 - DNA, 22 bp, Homo sapiens
tttctaagaaagtaatggttat

SEQ ID NO: 7620043 - DNA, 22 bp, Homo sapiens
tttccttttataaggcttgagg

SEQ ID NO: 7620044 - DNA, 22 bp, Homo sapiens
tttccttttataaggcttgagg

SEQ ID NO: 7620045 - DNA, 22 bp, Homo sapiens
tttccttttaagcagtcggcct

SEQ ID NO: 7620046 - DNA, 22 bp, Homo sapiens
tttcctttgtgcaggccttggg

SEQ ID NO: 7620047 - DNA, 22 bp, Homo sapiens
tttcctttgtgcaggccttggg

SEQ ID NO: 7620048 - DNA, 22 bp, Homo sapiens
tttcctttgtgcaggccttggg

SEQ ID NO: 7620049 - DNA, 22 bp, Homo sapiens
tttccttttataaggcttgagg

SEQ ID NO: 7620050 - DNA, 22 bp, Homo sapiens
tttccttttggctaggtgtgaa

SEQ ID NO: 7620051 - DNA, 22 bp, Homo sapiens
tttccttttggctaggtgtgaa

SEQ ID NO: 7620052 - DNA, 22 bp, Homo sapiens
tttcgaatgatgtttggaatat

SEQ ID NO: 7620053 - DNA, 22 bp, Homo sapiens
tttccttttggctaggtgtgaa

SEQ ID NO: 7620054 - DNA, 21 bp, Homo sapiens
tttcgcatgtgttaactgtga

SEQ ID NO: 7620055 - DNA, 22 bp, Homo sapiens
tttcgagggccttaagtattcc

SEQ ID NO: 7620056 - DNA, 22 bp, Homo sapiens
tttcgggaaaaactggtaagac

SEQ ID NO: 7620057 - DNA, 22 bp, Homo sapiens
tttcggaaatgcagaaacttca

SEQ ID NO: 7620058 - DNA, 22 bp, Homo sapiens
tttctaaacaaagggagtttgg

SEQ ID NO: 7620059 - DNA, 22 bp, Homo sapiens
tttctaaacaaagggagtttgg

SEQ ID NO: 7620060 - DNA, 22 bp, Homo sapiens
tttctaaactggattcagcctg

SEQ ID NO: 7620061 - DNA, 22 bp, Homo sapiens
tttctaaactggattcagcctg

SEQ ID NO: 7620062 - DNA, 22 bp, Homo sapiens
tttctaaactggattcagcctg

SEQ ID NO: 7620063 - DNA, 22 bp, Homo sapiens
tttcgtcaattgtaacaaatgt

SEQ ID NO: 7620064 - DNA, 22 bp, Homo sapiens
tttctaaaatagattttatggt

SEQ ID NO: 7620065 - DNA, 22 bp, Homo sapiens
tttctaaaatagattttatggt

SEQ ID NO: 7620066 - DNA, 22 bp, Homo sapiens
tttctaaaatagattttatggt

SEQ ID NO: 7620067 - DNA, 22 bp, Homo sapiens
tttctaaaatagattttatggt

SEQ ID NO: 7620068 - DNA, 22 bp, Homo sapiens
tttctaaaatagattttatggt

SEQ ID NO: 7620069 - DNA, 22 bp, Homo sapiens
tttctaaaatagattttatggt

SEQ ID NO: 7620070 - DNA, 22 bp, Homo sapiens
tttctaaaatagattttatggt

SEQ ID NO: 7620071 - DNA, 22 bp, Homo sapiens
tttctaaaatagattttatggt

SEQ ID NO: 7620072 - DNA, 22 bp, Homo sapiens
tttctaaaatagattttatggt

SEQ ID NO: 7620073 - DNA, 22 bp, Homo sapiens
tttctaaaatagattttatggt

SEQ ID NO: 7620074 - DNA, 22 bp, Homo sapiens
tttccaaataaggtcacattct

SEQ ID NO: 7620075 - DNA, 22 bp, Homo sapiens
tttccaaataaggtcacattct

SEQ ID NO: 7620076 - DNA, 22 bp, Homo sapiens
tttccagagctgagaaggcttg

SEQ ID NO: 7620077 - DNA, 22 bp, Homo sapiens
tttccagagggtgctcagggcg

SEQ ID NO: 7620078 - DNA, 22 bp, Homo sapiens
tttccagagggtgctcagggcg

SEQ ID NO: 7620079 - DNA, 22 bp, Homo sapiens
tttccagagctgagaaggcttg

SEQ ID NO: 7620080 - DNA, 22 bp, Homo sapiens
tttccagagctgagaaggcttg

SEQ ID NO: 7620081 - DNA, 22 bp, Homo sapiens
tttccagagctgagaaggcttg

SEQ ID NO: 7620082 - DNA, 22 bp, Homo sapiens
tttccagagctgagaaggcttg

SEQ ID NO: 7620083 - DNA, 22 bp, Homo sapiens
tttccagattaagataccactt

SEQ ID NO: 7620084 - DNA, 22 bp, Homo sapiens
tttccagattaagataccactt

SEQ ID NO: 7620085 - DNA, 22 bp, Homo sapiens
tttccagatgctaggttgaaag

SEQ ID NO: 7620086 - DNA, 22 bp, Homo sapiens
tttccagattaagataccactt

SEQ ID NO: 7620087 - DNA, 22 bp, Homo sapiens
tttccaggaagtaaggataatc

SEQ ID NO: 7620088 - DNA, 22 bp, Homo sapiens
tttccaggaagtaaggataatc

SEQ ID NO: 7620089 - DNA, 22 bp, Homo sapiens
tttccaggagaaagagagcctt

SEQ ID NO: 7620090 - DNA, 22 bp, Homo sapiens
tttccagatgctaggttgaaag

SEQ ID NO: 7620091 - DNA, 22 bp, Homo sapiens
tttccaggagaaagagagcctt

SEQ ID NO: 7620092 - DNA, 22 bp, Homo sapiens
tttccaggcagaggagttgtga

SEQ ID NO: 7620093 - DNA, 22 bp, Homo sapiens
tttcatcttatttgtctacatc

SEQ ID NO: 7620094 - DNA, 22 bp, Homo sapiens
tttcatcttatttgtctacatc

SEQ ID NO: 7620095 - DNA, 22 bp, Homo sapiens
tttcatcttatttgtctacatc

SEQ ID NO: 7620096 - DNA, 22 bp, Homo sapiens
tttcatctgtgctgccaagact

SEQ ID NO: 7620097 - DNA, 22 bp, Homo sapiens
tttcatctgtgctgccaagact

SEQ ID NO: 7620098 - DNA, 22 bp, Homo sapiens
tttcatctgagtagcgtcggat

SEQ ID NO: 7620099 - DNA, 22 bp, Homo sapiens
tttcatctgtgctgccaagact

SEQ ID NO: 7620100 - DNA, 22 bp, Homo sapiens
tttccaaataaggtcacactca

SEQ ID NO: 7620101 - DNA, 22 bp, Homo sapiens
tttcatcttccttggcataggt

SEQ ID NO: 7620102 - DNA, 22 bp, Homo sapiens
tttcatcttccttggcataggt

SEQ ID NO: 7620103 - DNA, 22 bp, Homo sapiens
tttccaaataaggtcacattct

SEQ ID NO: 7620104 - DNA, 22 bp, Homo sapiens
tttccaaataaggtcacattct

SEQ ID NO: 7620105 - DNA, 22 bp, Homo sapiens
tttccaaataaggtcacattct

SEQ ID NO: 7620106 - DNA, 22 bp, Homo sapiens
tttccaaataaggtcacattct

SEQ ID NO: 7620107 - DNA, 22 bp, Homo sapiens
tttccaaataaggtcacattct

SEQ ID NO: 7620108 - DNA, 22 bp, Homo sapiens
tttccagggctctgtagaagaa

SEQ ID NO: 7620109 - DNA, 18 bp, Homo sapiens
tttccagggattaggtgg

SEQ ID NO: 7620110 - DNA, 22 bp, Homo sapiens
tttccagggctctgtagaagaa

SEQ ID NO: 7620111 - DNA, 22 bp, Homo sapiens
tttccaggtatcaagcttcagg

SEQ ID NO: 7620112 - DNA, 22 bp, Homo sapiens
tttccaggtatcaagcttcagg

SEQ ID NO: 7620113 - DNA, 22 bp, Homo sapiens
tttccaggtatcaagcttcagg

SEQ ID NO: 7620114 - DNA, 22 bp, Homo sapiens
tttccagggaggaatgtggggt

SEQ ID NO: 7620115 - DNA, 22 bp, Homo sapiens
tttccaggccagacctttcaat

SEQ ID NO: 7620116 - DNA, 18 bp, Homo sapiens
tttccagggattaggtgg

SEQ ID NO: 7620117 - DNA, 22 bp, Homo sapiens
tttccagggaggaatgtggggt

SEQ ID NO: 7620118 - DNA, 22 bp, Homo sapiens
tttccaggtatcaagcttcagg

SEQ ID NO: 7620119 - DNA, 22 bp, Homo sapiens
tttccaggtattaatactgtat

SEQ ID NO: 7620120 - DNA, 22 bp, Homo sapiens
tttccaggtattaatactgtat

SEQ ID NO: 7620121 - DNA, 22 bp, Homo sapiens
tttccaggtattaatactgtat

SEQ ID NO: 7620122 - DNA, 22 bp, Homo sapiens
tttccaggtattaatactgtat

SEQ ID NO: 7620123 - DNA, 23 bp, Homo sapiens
tttccaggtgaccgtcagaatta

SEQ ID NO: 7620124 - DNA, 23 bp, Homo sapiens
tttccaggtgaccgtcagaatta

SEQ ID NO: 7620125 - DNA, 22 bp, Homo sapiens
tttccagggaggaatgtggggt

SEQ ID NO: 7620126 - DNA, 23 bp, Homo sapiens
tttccaggtgaccgtcagaatta

SEQ ID NO: 7620127 - DNA, 22 bp, Homo sapiens
tttccaggtgcatagaaaacag

SEQ ID NO: 7620128 - DNA, 22 bp, Homo sapiens
tttccaggtgcatagaaaacag

SEQ ID NO: 7620129 - DNA, 22 bp, Homo sapiens
tttccaggtgcatagaaaacag

SEQ ID NO: 7620130 - DNA, 22 bp, Homo sapiens
tttccagtaagtggcaaggagc

SEQ ID NO: 7620131 - DNA, 22 bp, Homo sapiens
tttccagtgaaattttgaatgt

SEQ ID NO: 7620132 - DNA, 22 bp, Homo sapiens
tttccagtgaaattttgaatgt

SEQ ID NO: 7620133 - DNA, 22 bp, Homo sapiens
tttccagtccctggatttaacc

SEQ ID NO: 7620134 - DNA, 22 bp, Homo sapiens
tttccagtccctggatttaacc

SEQ ID NO: 7620135 - DNA, 22 bp, Homo sapiens
tttccagtgaattagtctgttt

SEQ ID NO: 7620136 - DNA, 22 bp, Homo sapiens
tttccagtgaattagtctgttt

SEQ ID NO: 7620137 - DNA, 22 bp, Homo sapiens
tttccagtgagcaaatgtagaa

SEQ ID NO: 7620138 - DNA, 22 bp, Homo sapiens
tttccagtgattgctgctctca

SEQ ID NO: 7620139 - DNA, 22 bp, Homo sapiens
tttccagtgagcaaatgtagaa

SEQ ID NO: 7620140 - DNA, 22 bp, Homo sapiens
tttccagtgattgctgctctca

SEQ ID NO: 7620141 - DNA, 22 bp, Homo sapiens
tttccagtgagcaaatgtagaa

SEQ ID NO: 7620142 - DNA, 22 bp, Homo sapiens
tttcatagctgaaaatgttgaa

SEQ ID NO: 7620143 - DNA, 22 bp, Homo sapiens
tttcatagctgaaaatgttgaa

SEQ ID NO: 7620144 - DNA, 22 bp, Homo sapiens
tttcatatgggcattggcaata

SEQ ID NO: 7620145 - DNA, 22 bp, Homo sapiens
tttcatagtcaagtgtgtatga

SEQ ID NO: 7620146 - DNA, 22 bp, Homo sapiens
tttcatagctgaaaatgttgaa

SEQ ID NO: 7620147 - DNA, 22 bp, Homo sapiens
tttcatagccttctaatgagtt

SEQ ID NO: 7620148 - DNA, 22 bp, Homo sapiens
tttcataatgtcacagtcaaaa

SEQ ID NO: 7620149 - DNA, 22 bp, Homo sapiens
tttcataccatatccacacatc

SEQ ID NO: 7620150 - DNA, 22 bp, Homo sapiens
tttcatattattccttgagtct

SEQ ID NO: 7620151 - DNA, 22 bp, Homo sapiens
tttcatattattccttgagtct

SEQ ID NO: 7620152 - DNA, 22 bp, Homo sapiens
tttcatattgtccagtcagcgc

SEQ ID NO: 7620153 - DNA, 22 bp, Homo sapiens
tttcatattgtccagtcagcgc

SEQ ID NO: 7620154 - DNA, 23 bp, Homo sapiens
tttcatatggtgtggatgaagaa

SEQ ID NO: 7620155 - DNA, 23 bp, Homo sapiens
tttcatatggtgtggatgaagaa

SEQ ID NO: 7620156 - DNA, 22 bp, Homo sapiens
tttcatatgggcattggcaata

SEQ ID NO: 7620157 - DNA, 22 bp, Homo sapiens
tttcatatgggcattggcaata

SEQ ID NO: 7620158 - DNA, 22 bp, Homo sapiens
tttcatatgggcattggcaata

SEQ ID NO: 7620159 - DNA, 22 bp, Homo sapiens
tttcatatgggcattggcaata

SEQ ID NO: 7620160 - DNA, 22 bp, Homo sapiens
tttcatctctctaaaagacagt

SEQ ID NO: 7620161 - DNA, 22 bp, Homo sapiens
tttcatctctctaaaagacagt

SEQ ID NO: 7620162 - DNA, 22 bp, Homo sapiens
tttcatctctctaaaagacagt

SEQ ID NO: 7620163 - DNA, 22 bp, Homo sapiens
tttcatctatttgctttgtgaa

SEQ ID NO: 7620164 - DNA, 22 bp, Homo sapiens
tttcatctaacactacataggg

SEQ ID NO: 7620165 - DNA, 22 bp, Homo sapiens
tttcatctaacactacataggg

SEQ ID NO: 7620166 - DNA, 22 bp, Homo sapiens
tttcatcaccccaaatctatgg

SEQ ID NO: 7620167 - DNA, 22 bp, Homo sapiens
tttcatcaccccaaatctatgg

SEQ ID NO: 7620168 - DNA, 23 bp, Homo sapiens
tttcatcagttgatctggacagc

SEQ ID NO: 7620169 - DNA, 22 bp, Homo sapiens
tttcatcatcaaaatagtgagg

SEQ ID NO: 7620170 - DNA, 22 bp, Homo sapiens
tttcatcatgttggcagattgg

SEQ ID NO: 7620171 - DNA, 22 bp, Homo sapiens
tttcatcatgttggcagattgg

SEQ ID NO: 7620172 - DNA, 22 bp, Homo sapiens
tttcatcatgttggcagattgg

SEQ ID NO: 7620173 - DNA, 22 bp, Homo sapiens
tttcataagggtttctagactt

SEQ ID NO: 7620174 - DNA, 22 bp, Homo sapiens
tttcataagggtttctagactt

SEQ ID NO: 7620175 - DNA, 22 bp, Homo sapiens
tttcataagggtttctagactt

SEQ ID NO: 7620176 - DNA, 22 bp, Homo sapiens
tttcataagggtttctagactt

SEQ ID NO: 7620177 - DNA, 22 bp, Homo sapiens
tttcataacctcaagctacagt

SEQ ID NO: 7620178 - DNA, 22 bp, Homo sapiens
tttcataacctcaagctacagt

SEQ ID NO: 7620179 - DNA, 22 bp, Homo sapiens
tttcataacctcaagctacagt

SEQ ID NO: 7620180 - DNA, 22 bp, Homo sapiens
tttcataacctcaagctacagt

SEQ ID NO: 7620181 - DNA, 22 bp, Homo sapiens
tttcataacctcaagctacagt

SEQ ID NO: 7620182 - DNA, 22 bp, Homo sapiens
tttcataacctcaagctacagt

SEQ ID NO: 7620183 - DNA, 22 bp, Homo sapiens
tttcataaacagtagaagacta

SEQ ID NO: 7620184 - DNA, 22 bp, Homo sapiens
tttcataatactgtacatgaaa

SEQ ID NO: 7620185 - DNA, 22 bp, Homo sapiens
tttcataatactgtacatgaaa

SEQ ID NO: 7620186 - DNA, 22 bp, Homo sapiens
tttcataatactgtacatgaaa

SEQ ID NO: 7620187 - DNA, 22 bp, Homo sapiens
tttcataatactgtacatgaaa

SEQ ID NO: 7620188 - DNA, 22 bp, Homo sapiens
tttcataatactgtacatgaaa

SEQ ID NO: 7620189 - DNA, 22 bp, Homo sapiens
tttcataagggtttctagactt

SEQ ID NO: 7620190 - DNA, 22 bp, Homo sapiens
tttcataatactgtacatgaaa

SEQ ID NO: 7620191 - DNA, 22 bp, Homo sapiens
tttcataatatccagagatttt

SEQ ID NO: 7620192 - DNA, 22 bp, Homo sapiens
tttcataatatccagagatttt

SEQ ID NO: 7620193 - DNA, 22 bp, Homo sapiens
tttcataatatccagagatttt

SEQ ID NO: 7620194 - DNA, 22 bp, Homo sapiens
tttcataatatccagagatttt

SEQ ID NO: 7620195 - DNA, 22 bp, Homo sapiens
tttcataatagtgcagtttgtt

SEQ ID NO: 7620196 - DNA, 22 bp, Homo sapiens
tttcataatagtgcagtttgtt

SEQ ID NO: 7620197 - DNA, 22 bp, Homo sapiens
tttcataatagtgcagtttgtt

SEQ ID NO: 7620198 - DNA, 22 bp, Homo sapiens
tttcataatagtgcagtttgtt

SEQ ID NO: 7620199 - DNA, 22 bp, Homo sapiens
tttcataatactgtacatgaaa

SEQ ID NO: 7620200 - DNA, 22 bp, Homo sapiens
tttcataatgtcacagtcaaaa

SEQ ID NO: 7620201 - DNA, 22 bp, Homo sapiens
tttcataatgtcacagtcaaaa

SEQ ID NO: 7620202 - DNA, 22 bp, Homo sapiens
tttcataatgtcacagtcaaaa

SEQ ID NO: 7620203 - DNA, 22 bp, Homo sapiens
tttcataatgtcacagtcaaaa

SEQ ID NO: 7620204 - DNA, 22 bp, Homo sapiens
tttcataatgtcacagtcaaaa

SEQ ID NO: 7620205 - DNA, 22 bp, Homo sapiens
tttcataatgtcacagtcaaaa

SEQ ID NO: 7620206 - DNA, 22 bp, Homo sapiens
tttcataatctgtcaagtgggg

SEQ ID NO: 7620207 - DNA, 22 bp, Homo sapiens
tttcataatctgtcaagtgggg

SEQ ID NO: 7620208 - DNA, 22 bp, Homo sapiens
tttcataatatccagagatttt

SEQ ID NO: 7620209 - DNA, 22 bp, Homo sapiens
tttcataatatccagagatttt

SEQ ID NO: 7620210 - DNA, 22 bp, Homo sapiens
ttgaggtattgatattttatga

SEQ ID NO: 7620211 - DNA, 22 bp, Homo sapiens
ttgaggtattgatattttatga

SEQ ID NO: 7620212 - DNA, 22 bp, Homo sapiens
ttgaggtattgatattttatga

SEQ ID NO: 7620213 - DNA, 22 bp, Homo sapiens
ttgaggtcaaagaagtgagtgg

SEQ ID NO: 7620214 - DNA, 22 bp, Homo sapiens
ttgaggtcaaagaagtgagtgg

SEQ ID NO: 7620215 - DNA, 20 bp, Homo sapiens
ttgaggtcaaggactaggcc

SEQ ID NO: 7620216 - DNA, 22 bp, Homo sapiens
ttgaggtcaagtaaccactgga

SEQ ID NO: 7620217 - DNA, 22 bp, Homo sapiens
ttgaggtcaattctgtttcctg

SEQ ID NO: 7620218 - DNA, 22 bp, Homo sapiens
ttgaggtcatatatatttggca

SEQ ID NO: 7620219 - DNA, 22 bp, Homo sapiens
ttgaggtcaagtaaccactgga

SEQ ID NO: 7620220 - DNA, 22 bp, Homo sapiens
ttgaggtcaagtaaccactgga

SEQ ID NO: 7620221 - DNA, 22 bp, Homo sapiens
ttgaggtcatctgaagtactag

SEQ ID NO: 7620222 - DNA, 22 bp, Homo sapiens
ttgaggtccaggtgtgggcagg

SEQ ID NO: 7620223 - DNA, 22 bp, Homo sapiens
ttgaggtccagtctccacccac

SEQ ID NO: 7620224 - DNA, 22 bp, Homo sapiens
ttgaggtcccaaacccactgag

SEQ ID NO: 7620225 - DNA, 22 bp, Homo sapiens
ttgaggtctggcagtagcgttg

SEQ ID NO: 7620226 - DNA, 22 bp, Homo sapiens
ttgaggtctgtgataaaagtca

SEQ ID NO: 7620227 - DNA, 22 bp, Homo sapiens
ttgaggtctgtgtaggcagcaa

SEQ ID NO: 7620228 - DNA, 22 bp, Homo sapiens
ttgaggtcttcagctgacacct

SEQ ID NO: 7620229 - DNA, 22 bp, Homo sapiens
ttgaggtcttcaggatcaggct

SEQ ID NO: 7620230 - DNA, 22 bp, Homo sapiens
ttgaggtcttcattcttgggca

SEQ ID NO: 7620231 - DNA, 22 bp, Homo sapiens
ttgaggtcttgagtactgggga

SEQ ID NO: 7620232 - DNA, 22 bp, Homo sapiens
ttgaggtccccagtacccactg

SEQ ID NO: 7620233 - DNA, 22 bp, Homo sapiens
ttgaggtcccaaacccactgag

SEQ ID NO: 7620234 - DNA, 22 bp, Homo sapiens
ttgaggtccctgccttgccttc

SEQ ID NO: 7620235 - DNA, 23 bp, Homo sapiens
ttgaggtcggctctctgagcctg

SEQ ID NO: 7620236 - DNA, 22 bp, Homo sapiens
ttgaggtctctacagaagagtg

SEQ ID NO: 7620237 - DNA, 22 bp, Homo sapiens
ttgaggtctctacagaagagtg

SEQ ID NO: 7620238 - DNA, 22 bp, Homo sapiens
ttgaggtctgagactgtgcagg

SEQ ID NO: 7620239 - DNA, 22 bp, Homo sapiens
ttgaggtccccagtacccactg

SEQ ID NO: 7620240 - DNA, 22 bp, Homo sapiens
ttgaggtctgagactgtgcagg

SEQ ID NO: 7620241 - DNA, 19 bp, Homo sapiens
ttgcatttcatgtttgatt

SEQ ID NO: 7620242 - DNA, 22 bp, Homo sapiens
ttgcatttcactttcagtaggc

SEQ ID NO: 7620243 - DNA, 22 bp, Homo sapiens
ttgcatttcactttcagtaggc

SEQ ID NO: 7620244 - DNA, 22 bp, Homo sapiens
ttgcatttcactttcagtaggc

SEQ ID NO: 7620245 - DNA, 22 bp, Homo sapiens
ttgcatttcactttcagtaggc

SEQ ID NO: 7620246 - DNA, 22 bp, Homo sapiens
ttgcatttcccattgagtaatg

SEQ ID NO: 7620247 - DNA, 22 bp, Homo sapiens
ttgcatttcccattgagtaatg

SEQ ID NO: 7620248 - DNA, 19 bp, Homo sapiens
ttgcatttcatgtttgatt

SEQ ID NO: 7620249 - DNA, 22 bp, Homo sapiens
ttgcatttcccattgagtaatg

SEQ ID NO: 7620250 - DNA, 22 bp, Homo sapiens
ttgagtaccttggattacaggt

SEQ ID NO: 7620251 - DNA, 22 bp, Homo sapiens
ttgagtaccttggattacaggt

SEQ ID NO: 7620252 - DNA, 22 bp, Homo sapiens
ttgaggtctttgagcaaacgca

SEQ ID NO: 7620253 - DNA, 22 bp, Homo sapiens
ttgagtcagtaattccatttct

SEQ ID NO: 7620254 - DNA, 18 bp, Homo sapiens
ttgagtctagccatggaa

SEQ ID NO: 7620255 - DNA, 22 bp, Homo sapiens
ttgcatttgagaaagttctcct

SEQ ID NO: 7620256 - DNA, 22 bp, Homo sapiens
ttgcatttgagaaagttctcct

SEQ ID NO: 7620257 - DNA, 22 bp, Homo sapiens
ttgcatttgagaaagttctcct

SEQ ID NO: 7620258 - DNA, 22 bp, Homo sapiens
ttgcatttgagaaagttctcct

SEQ ID NO: 7620259 - DNA, 22 bp, Homo sapiens
ttgcatttgagaaagttctcct

SEQ ID NO: 7620260 - DNA, 22 bp, Homo sapiens
ttgcatttgatcttgggttctc

SEQ ID NO: 7620261 - DNA, 22 bp, Homo sapiens
ttgcatttgctcatttgatatg

SEQ ID NO: 7620262 - DNA, 22 bp, Homo sapiens
ttgcatttgacaaattatttaa

SEQ ID NO: 7620263 - DNA, 22 bp, Homo sapiens
ttgcatttgacaaattatttaa

SEQ ID NO: 7620264 - DNA, 22 bp, Homo sapiens
ttgcatttgacaaattatttaa

SEQ ID NO: 7620265 - DNA, 22 bp, Homo sapiens
ttgcatttgacaaattatttaa

SEQ ID NO: 7620266 - DNA, 22 bp, Homo sapiens
ttgcatttcctgtactgtttga

SEQ ID NO: 7620267 - DNA, 22 bp, Homo sapiens
ttgcatttcctgtactgtttga

SEQ ID NO: 7620268 - DNA, 22 bp, Homo sapiens
ttgcatttcctgtactgtttga

SEQ ID NO: 7620269 - DNA, 22 bp, Homo sapiens
ttgccaggagagccacttgcag

SEQ ID NO: 7620270 - DNA, 22 bp, Homo sapiens
ttgccaggagagccacttgcag

SEQ ID NO: 7620271 - DNA, 22 bp, Homo sapiens
ttgccaggagagccacttgcag

SEQ ID NO: 7620272 - DNA, 22 bp, Homo sapiens
ttgccaggagacatctggagcc

SEQ ID NO: 7620273 - DNA, 22 bp, Homo sapiens
ttgccagatcttccacatggct

SEQ ID NO: 7620274 - DNA, 22 bp, Homo sapiens
ttgccagatggcgctgttgctc

SEQ ID NO: 7620275 - DNA, 21 bp, Homo sapiens
ttgccagatcacagtggctct

SEQ ID NO: 7620276 - DNA, 22 bp, Homo sapiens
ttgccagcttgttttaaaacat

SEQ ID NO: 7620277 - DNA, 22 bp, Homo sapiens
ttgccaggagacaaagtgggcc

SEQ ID NO: 7620278 - DNA, 22 bp, Homo sapiens
ttgccaggcttgtttctaggct

SEQ ID NO: 7620279 - DNA, 22 bp, Homo sapiens
ttgccaggcttgtttctaggct

SEQ ID NO: 7620280 - DNA, 22 bp, Homo sapiens
ttgccaggcttgtttctaggct

SEQ ID NO: 7620281 - DNA, 22 bp, Homo sapiens
ttgccagggaacagggagaggc

SEQ ID NO: 7620282 - DNA, 22 bp, Homo sapiens
ttgccagggaacagggagaggc

SEQ ID NO: 7620283 - DNA, 22 bp, Homo sapiens
ttgccaggctctggttccagcc

SEQ ID NO: 7620284 - DNA, 22 bp, Homo sapiens
ttgccaggagctcatctgaggg

SEQ ID NO: 7620285 - DNA, 22 bp, Homo sapiens
ttgccaggctctggttccagcc

SEQ ID NO: 7620286 - DNA, 22 bp, Homo sapiens
ttgccaggctggagtgcagtgg

SEQ ID NO: 7620287 - DNA, 22 bp, Homo sapiens
ttgccagtttccctggatgtgt

SEQ ID NO: 7620288 - DNA, 22 bp, Homo sapiens
ttgccatcccttacctcagtca

SEQ ID NO: 7620289 - DNA, 22 bp, Homo sapiens
ttgccagtgccagcccaggcag

SEQ ID NO: 7620290 - DNA, 22 bp, Homo sapiens
ttgccagtattaatagcacttt

SEQ ID NO: 7620291 - DNA, 22 bp, Homo sapiens
ttgccaggggacatctggagcc

SEQ ID NO: 7620292 - DNA, 22 bp, Homo sapiens
ttgccagggtcaggatgagatc

SEQ ID NO: 7620293 - DNA, 22 bp, Homo sapiens
ttgccagggctttggtggcatc

SEQ ID NO: 7620294 - DNA, 22 bp, Homo sapiens
ttgccagggctttggtggcatc

SEQ ID NO: 7620295 - DNA, 22 bp, Homo sapiens
ttgccagggctttggtggcatc

SEQ ID NO: 7620296 - DNA, 22 bp, Homo sapiens
ttgccagggccagtgggggtgt

SEQ ID NO: 7620297 - DNA, 22 bp, Homo sapiens
ttgccagggaacagggagaggc

SEQ ID NO: 7620298 - DNA, 22 bp, Homo sapiens
ttgccagggccagtgggggtgt

SEQ ID NO: 7620299 - DNA, 22 bp, Homo sapiens
ttgccagggaacagggagaggc

SEQ ID NO: 7620300 - DNA, 22 bp, Homo sapiens
ttgcattttggttgtaaatatg

SEQ ID NO: 7620301 - DNA, 22 bp, Homo sapiens
ttgcattttggttgtaaatatg

SEQ ID NO: 7620302 - DNA, 22 bp, Homo sapiens
ttgcattttggttgtaaatatg

SEQ ID NO: 7620303 - DNA, 21 bp, Homo sapiens
ttgcattttaagtttactgct

SEQ ID NO: 7620304 - DNA, 22 bp, Homo sapiens
ttgcatttgtttgagtagaatg

SEQ ID NO: 7620305 - DNA, 22 bp, Homo sapiens
ttgcatttgtttgagtagaatg

SEQ ID NO: 7620306 - DNA, 22 bp, Homo sapiens
ttgcatttgtttgagtagaatg

SEQ ID NO: 7620307 - DNA, 22 bp, Homo sapiens
ttgcatttgtggcatgggtgtt

SEQ ID NO: 7620308 - DNA, 22 bp, Homo sapiens
ttgcatttgtttgagtagaatg

SEQ ID NO: 7620309 - DNA, 22 bp, Homo sapiens
ttgcatttgtggcatgggtgtt

SEQ ID NO: 7620310 - DNA, 22 bp, Homo sapiens
ttgcatttggttctgcctggta

SEQ ID NO: 7620311 - DNA, 22 bp, Homo sapiens
ttgcatttggttctgcctggta

SEQ ID NO: 7620312 - DNA, 22 bp, Homo sapiens
ttgcatttttacaagtagccag

SEQ ID NO: 7620313 - DNA, 22 bp, Homo sapiens
ttgcatttttacaagtagccag

SEQ ID NO: 7620314 - DNA, 22 bp, Homo sapiens
ttgcatttttacaagtagccag

SEQ ID NO: 7620315 - DNA, 22 bp, Homo sapiens
ttgcatttttacaagtagccag

SEQ ID NO: 7620316 - DNA, 22 bp, Homo sapiens
ttgcatttttagatgcttctgt

SEQ ID NO: 7620317 - DNA, 22 bp, Homo sapiens
ttgcatttttagatgcttctgt

SEQ ID NO: 7620318 - DNA, 22 bp, Homo sapiens
ttgcatttttagatgcttctgt

SEQ ID NO: 7620319 - DNA, 22 bp, Homo sapiens
ttgcatttttagatgcttctgt

SEQ ID NO: 7620320 - DNA, 22 bp, Homo sapiens
ttgcatttttagatgcttctgt

SEQ ID NO: 7620321 - DNA, 22 bp, Homo sapiens
ttgccaagtttaatgaatgact

SEQ ID NO: 7620322 - DNA, 22 bp, Homo sapiens
ttgccaagtttaatgaatgact

SEQ ID NO: 7620323 - DNA, 22 bp, Homo sapiens
ttgccacacaagtaaagaaaca

SEQ ID NO: 7620324 - DNA, 22 bp, Homo sapiens
ttgccactaactagctgtgaga

SEQ ID NO: 7620325 - DNA, 22 bp, Homo sapiens
ttgcatttttgagcacgaagtt

SEQ ID NO: 7620326 - DNA, 22 bp, Homo sapiens
ttgcatttttgagcacgaagtt

SEQ ID NO: 7620327 - DNA, 22 bp, Homo sapiens
ttgcatttttgagcacgaagtt

SEQ ID NO: 7620328 - DNA, 22 bp, Homo sapiens
ttgcctcaagattttttattga

SEQ ID NO: 7620329 - DNA, 22 bp, Homo sapiens
ttgcctccttttaaggaaatca

SEQ ID NO: 7620330 - DNA, 22 bp, Homo sapiens
ttgcctcccagcatgggcagct

SEQ ID NO: 7620331 - DNA, 22 bp, Homo sapiens
ttgcctcccagcatgggcagct

SEQ ID NO: 7620332 - DNA, 22 bp, Homo sapiens
ttgcctcccagcatgggcagct

SEQ ID NO: 7620333 - DNA, 22 bp, Homo sapiens
ttgcctcccagcatgggcagct

SEQ ID NO: 7620334 - DNA, 22 bp, Homo sapiens
ttgcctccttttaaggaaatca

SEQ ID NO: 7620335 - DNA, 22 bp, Homo sapiens
ttgcctgattagtctcagattg

SEQ ID NO: 7620336 - DNA, 22 bp, Homo sapiens
ttgcctgctacggtcttcactg

SEQ ID NO: 7620337 - DNA, 22 bp, Homo sapiens
ttgcccagagtcacccagctca

SEQ ID NO: 7620338 - DNA, 22 bp, Homo sapiens
ttgcccagagtcacccagctca

SEQ ID NO: 7620339 - DNA, 22 bp, Homo sapiens
ttgcccagagctgcctgttaca

SEQ ID NO: 7620340 - DNA, 22 bp, Homo sapiens
ttgcctattgttcttacatgtt

SEQ ID NO: 7620341 - DNA, 22 bp, Homo sapiens
ttgcccagagctgcctgttaca

SEQ ID NO: 7620342 - DNA, 22 bp, Homo sapiens
ttgcccagagtcacccagctca

SEQ ID NO: 7620343 - DNA, 22 bp, Homo sapiens
ttgcccagagctgcctgttaca

SEQ ID NO: 7620344 - DNA, 22 bp, Homo sapiens
ttgcccagagctgcctgttaca

SEQ ID NO: 7620345 - DNA, 22 bp, Homo sapiens
ttgcccactctgtttcccaaga

SEQ ID NO: 7620346 - DNA, 22 bp, Homo sapiens
ttgcccactcatgcttttgata

SEQ ID NO: 7620347 - DNA, 22 bp, Homo sapiens
ttgccattgctcagtgaacaga

SEQ ID NO: 7620348 - DNA, 22 bp, Homo sapiens
ttgccattccagggtattaggg

SEQ ID NO: 7620349 - DNA, 23 bp, Homo sapiens
ttgccattccaaataatttccta

SEQ ID NO: 7620350 - DNA, 23 bp, Homo sapiens
ttgccattccaaataatttccta

SEQ ID NO: 7620351 - DNA, 22 bp, Homo sapiens
ttgccattaaaacatgttatct

SEQ ID NO: 7620352 - DNA, 22 bp, Homo sapiens
ttgccattatcatttatgatac

SEQ ID NO: 7620353 - DNA, 22 bp, Homo sapiens
ttgccattaaaacatgttatct

SEQ ID NO: 7620354 - DNA, 22 bp, Homo sapiens
ttgccatcccttacctcagtca

SEQ ID NO: 7620355 - DNA, 22 bp, Homo sapiens
ttgcccaccatccaataaaatg

SEQ ID NO: 7620356 - DNA, 22 bp, Homo sapiens
ttgccatttcgtaagccgggag

SEQ ID NO: 7620357 - DNA, 22 bp, Homo sapiens
ttgcccactcagccctgtggag

SEQ ID NO: 7620358 - DNA, 22 bp, Homo sapiens
ttgcccaccttcttttcgtgcc

SEQ ID NO: 7620359 - DNA, 22 bp, Homo sapiens
ttgcccaccttagtcttcagac

SEQ ID NO: 7620360 - DNA, 22 bp, Homo sapiens
ttgcctttcccatgtctaggag

SEQ ID NO: 7620361 - DNA, 17 bp, Homo sapiens
ttgcctttatggtcact

SEQ ID NO: 7620362 - DNA, 22 bp, Homo sapiens
ttgcctttcccctctggaagca

SEQ ID NO: 7620363 - DNA, 22 bp, Homo sapiens
ttgcctttcccctctggaagca

SEQ ID NO: 7620364 - DNA, 22 bp, Homo sapiens
ttgcctttcccatgtctaggag

SEQ ID NO: 7620365 - DNA, 22 bp, Homo sapiens
ttgcctttaagtataactgctg

SEQ ID NO: 7620366 - DNA, 17 bp, Homo sapiens
ttgcctttatggtcact

SEQ ID NO: 7620367 - DNA, 22 bp, Homo sapiens
ttgccttttgctctgggggcag

SEQ ID NO: 7620368 - DNA, 22 bp, Homo sapiens
ttgccttttgctctgggggcag

SEQ ID NO: 7620369 - DNA, 22 bp, Homo sapiens
ttgcgcctccctgtgccaggca

SEQ ID NO: 7620370 - DNA, 22 bp, Homo sapiens
ttgcctttgacggtgcagcagt

SEQ ID NO: 7620371 - DNA, 22 bp, Homo sapiens
ttgcctttgacggtgcagcagt

SEQ ID NO: 7620372 - DNA, 22 bp, Homo sapiens
ttgcctttaacccctgaaaggc

SEQ ID NO: 7620373 - DNA, 22 bp, Homo sapiens
ttgcctttaagtataactgctg

SEQ ID NO: 7620374 - DNA, 22 bp, Homo sapiens
ttgcctttaacccctgaaaggc

SEQ ID NO: 7620375 - DNA, 22 bp, Homo sapiens
ttgccttgttattctctcagaa

SEQ ID NO: 7620376 - DNA, 22 bp, Homo sapiens
ttgccttgttattctctcagaa

SEQ ID NO: 7620377 - DNA, 17 bp, Homo sapiens
ttgccttaagtatgtgc

SEQ ID NO: 7620378 - DNA, 17 bp, Homo sapiens
ttgccttaagtatgtgc

SEQ ID NO: 7620379 - DNA, 22 bp, Homo sapiens
ttgccttactgcattcagtaaa

SEQ ID NO: 7620380 - DNA, 22 bp, Homo sapiens
ttgccttatagtgctctgcatt

SEQ ID NO: 7620381 - DNA, 22 bp, Homo sapiens
ttgcctgggcaacatagaactc

SEQ ID NO: 7620382 - DNA, 22 bp, Homo sapiens
ttgcctgggcaacatagaactc

SEQ ID NO: 7620383 - DNA, 22 bp, Homo sapiens
ttgcctgggcaacatagaactc

SEQ ID NO: 7620384 - DNA, 22 bp, Homo sapiens
ttgcctgggctagtaagccaga

SEQ ID NO: 7620385 - DNA, 22 bp, Homo sapiens
ttgcctgggctagtaagccaga

SEQ ID NO: 7620386 - DNA, 22 bp, Homo sapiens
ttgcctggtcctgtgggtgctg

SEQ ID NO: 7620387 - DNA, 22 bp, Homo sapiens
ttgcctggtcctgtgggtgctg

SEQ ID NO: 7620388 - DNA, 22 bp, Homo sapiens
ttgcctggtcctgtgggtgctg

SEQ ID NO: 7620389 - DNA, 22 bp, Homo sapiens
ttgcctgtgaggattctggttg

SEQ ID NO: 7620390 - DNA, 22 bp, Homo sapiens
ttgcctggagggacatggagac

SEQ ID NO: 7620391 - DNA, 22 bp, Homo sapiens
ttgcctggagggacatggagac

SEQ ID NO: 7620392 - DNA, 22 bp, Homo sapiens
ttgcctggagggacatggagac

SEQ ID NO: 7620393 - DNA, 22 bp, Homo sapiens
ttgcctggagggacatggagac

SEQ ID NO: 7620394 - DNA, 22 bp, Homo sapiens
ttgcctggactctgctggtatt

SEQ ID NO: 7620395 - DNA, 22 bp, Homo sapiens
ttgcctggactctgctggtatt

SEQ ID NO: 7620396 - DNA, 22 bp, Homo sapiens
ttgcctggactctgctggtatt

SEQ ID NO: 7620397 - DNA, 22 bp, Homo sapiens
ttgcctggcttgtagatggggg

SEQ ID NO: 7620398 - DNA, 22 bp, Homo sapiens
ttgcctggcttgtagatggggg

SEQ ID NO: 7620399 - DNA, 22 bp, Homo sapiens
ttgcctggcttgtagatggggg

SEQ ID NO: 7620400 - DNA, 22 bp, Homo sapiens
ttgcctggattctaccacagaa

SEQ ID NO: 7620401 - DNA, 22 bp, Homo sapiens
ttgcctggattctaccacagaa

SEQ ID NO: 7620402 - DNA, 22 bp, Homo sapiens
ttgcctggatggtccccagaga

SEQ ID NO: 7620403 - DNA, 22 bp, Homo sapiens
ttgcctggatggtccccagaga

SEQ ID NO: 7620404 - DNA, 22 bp, Homo sapiens
ttgctaaatccctataatattc

SEQ ID NO: 7620405 - DNA, 22 bp, Homo sapiens
ttgctaaatgtgttatatctgt

SEQ ID NO: 7620406 - DNA, 22 bp, Homo sapiens
ttgctaaatgtgttatatctgt

SEQ ID NO: 7620407 - DNA, 22 bp, Homo sapiens
ttgctaagttatagagtatctt

SEQ ID NO: 7620408 - DNA, 22 bp, Homo sapiens
ttgctaatagaagatttgggaa

SEQ ID NO: 7620409 - DNA, 22 bp, Homo sapiens
ttgctaataaagtttttatgtg

SEQ ID NO: 7620410 - DNA, 22 bp, Homo sapiens
ttgctaaaaatggaattatagg

SEQ ID NO: 7620411 - DNA, 22 bp, Homo sapiens
ttgctaaaggattttgtattta

SEQ ID NO: 7620412 - DNA, 22 bp, Homo sapiens
ttgctaaatccctataatattc

SEQ ID NO: 7620413 - DNA, 22 bp, Homo sapiens
ttgctaaaaatggaattatagg

SEQ ID NO: 7620414 - DNA, 22 bp, Homo sapiens
ttgctaaaaatggaattatagg

SEQ ID NO: 7620415 - DNA, 22 bp, Homo sapiens
ttgctaccattgataccagcac

SEQ ID NO: 7620416 - DNA, 22 bp, Homo sapiens
ttgctaatttaactaccttgtt

SEQ ID NO: 7620417 - DNA, 22 bp, Homo sapiens
ttgctacatggtttcaaagctg

SEQ ID NO: 7620418 - DNA, 22 bp, Homo sapiens
ttgctacatggtttcaaagctg

SEQ ID NO: 7620419 - DNA, 22 bp, Homo sapiens
ttgctaatcatatttcatcact

SEQ ID NO: 7620420 - DNA, 22 bp, Homo sapiens
ttgctaatgccctagaagtatt

SEQ ID NO: 7620421 - DNA, 22 bp, Homo sapiens
ttgctaatgccctagaagtatt

SEQ ID NO: 7620422 - DNA, 22 bp, Homo sapiens
ttgctaatttaactaccttgtt

SEQ ID NO: 7620423 - DNA, 22 bp, Homo sapiens
ttgctaggattcattctatact

SEQ ID NO: 7620424 - DNA, 22 bp, Homo sapiens
ttgctatttcctgaaataagca

SEQ ID NO: 7620425 - DNA, 22 bp, Homo sapiens
ttgctatactcattagttattt

SEQ ID NO: 7620426 - DNA, 22 bp, Homo sapiens
ttgcttcctcctagccacttgc

SEQ ID NO: 7620427 - DNA, 22 bp, Homo sapiens
ttgcttcctctagtttcttgaa

SEQ ID NO: 7620428 - DNA, 22 bp, Homo sapiens
ttgcttcctctgtgcaatcctc

SEQ ID NO: 7620429 - DNA, 22 bp, Homo sapiens
ttgcttccagtccaagtctgtt

SEQ ID NO: 7620430 - DNA, 22 bp, Homo sapiens
ttgcttcattttcccagtacgg

SEQ ID NO: 7620431 - DNA, 22 bp, Homo sapiens
ttgcttcattttaaataaagac

SEQ ID NO: 7620432 - DNA, 22 bp, Homo sapiens
ttgcttcattttgggactctag

SEQ ID NO: 7620433 - DNA, 23 bp, Homo sapiens
ttgcttccactgtaagtggagaa

SEQ ID NO: 7620434 - DNA, 22 bp, Homo sapiens
ttgcttcatggagatggacgaa

SEQ ID NO: 7620435 - DNA, 22 bp, Homo sapiens
ttgcttcatcagagtaaacaag

SEQ ID NO: 7620436 - DNA, 22 bp, Homo sapiens
ttgcttcattaagttctcacag

SEQ ID NO: 7620437 - DNA, 22 bp, Homo sapiens
ttgcttcattttaaataaagac

SEQ ID NO: 7620438 - DNA, 22 bp, Homo sapiens
ttgcttcatcagagtaaacaag

SEQ ID NO: 7620439 - DNA, 22 bp, Homo sapiens
ttgctatttcctgaaataagca

SEQ ID NO: 7620440 - DNA, 22 bp, Homo sapiens
ttgctattttgagagtcatagt

SEQ ID NO: 7620441 - DNA, 22 bp, Homo sapiens
ttgctcagcactggagccagct

SEQ ID NO: 7620442 - DNA, 22 bp, Homo sapiens
ttgctattttgagagtcatagt

SEQ ID NO: 7620443 - DNA, 22 bp, Homo sapiens
ttgctattttgagagtcatagt

SEQ ID NO: 7620444 - DNA, 22 bp, Homo sapiens
ttgctcagcactggagccagct

SEQ ID NO: 7620445 - DNA, 22 bp, Homo sapiens
ttgctcaggctggtgtgcagtg

SEQ ID NO: 7620446 - DNA, 22 bp, Homo sapiens
ttgctcaggcttagagctacta

SEQ ID NO: 7620447 - DNA, 19 bp, Homo sapiens
ttgcttcaggctgtgtgct

SEQ ID NO: 7620448 - DNA, 22 bp, Homo sapiens
ttgctcagtggcagggctggta

SEQ ID NO: 7620449 - DNA, 22 bp, Homo sapiens
ttgctcaggcttagagctacta

SEQ ID NO: 7620450 - DNA, 22 bp, Homo sapiens
ttgcttgcttctattttataca

SEQ ID NO: 7620451 - DNA, 22 bp, Homo sapiens
ttgcttgcttcttgggagtggt

SEQ ID NO: 7620452 - DNA, 22 bp, Homo sapiens
ttgcttggcccattgcttcagt

SEQ ID NO: 7620453 - DNA, 22 bp, Homo sapiens
ttgcttgtcttccctttacctc

SEQ ID NO: 7620454 - DNA, 22 bp, Homo sapiens
ttgctttaaaatggctaagtct

SEQ ID NO: 7620455 - DNA, 22 bp, Homo sapiens
ttgctttaaaatggctaagtct

SEQ ID NO: 7620456 - DNA, 22 bp, Homo sapiens
ttgctttaactagtaaatgggg

SEQ ID NO: 7620457 - DNA, 22 bp, Homo sapiens
ttgctttaactagtaaatgggg

SEQ ID NO: 7620458 - DNA, 22 bp, Homo sapiens
ttgctttaaaatggctaagtct

SEQ ID NO: 7620459 - DNA, 22 bp, Homo sapiens
ttgctttaactagtaaatgggg

SEQ ID NO: 7620460 - DNA, 22 bp, Homo sapiens
ttgctttaactagtaaatgggg

SEQ ID NO: 7620461 - DNA, 15 bp, Homo sapiens
ttgctttaagacatg

SEQ ID NO: 7620462 - DNA, 22 bp, Homo sapiens
ttgctttacaaaaattgatggt

SEQ ID NO: 7620463 - DNA, 22 bp, Homo sapiens
ttgctttacaaaaattgatggt

SEQ ID NO: 7620464 - DNA, 22 bp, Homo sapiens
ttgctttaatgagattttgcca

SEQ ID NO: 7620465 - DNA, 22 bp, Homo sapiens
ttgctttaatgagattttgcca

SEQ ID NO: 7620466 - DNA, 22 bp, Homo sapiens
ttgctttaatgagattttgcca

SEQ ID NO: 7620467 - DNA, 22 bp, Homo sapiens
ttgctttaaggtatctggagaa

SEQ ID NO: 7620468 - DNA, 22 bp, Homo sapiens
ttgctttaaggtatctggagaa

SEQ ID NO: 7620469 - DNA, 22 bp, Homo sapiens
ttgctttaaggtatctggagaa

SEQ ID NO: 7620470 - DNA, 22 bp, Homo sapiens
ttgctttaaggtatctggagaa

SEQ ID NO: 7620471 - DNA, 22 bp, Homo sapiens
ttgctttaaggtatctggagaa

SEQ ID NO: 7620472 - DNA, 22 bp, Homo sapiens
ttgctttaaggtatctggagaa

SEQ ID NO: 7620473 - DNA, 22 bp, Homo sapiens
ttgctttagaatctgcttctgg

SEQ ID NO: 7620474 - DNA, 22 bp, Homo sapiens
ttgctttagaatctgcttctgg

SEQ ID NO: 7620475 - DNA, 22 bp, Homo sapiens
ttgctttagaatctgcttctgg

SEQ ID NO: 7620476 - DNA, 22 bp, Homo sapiens
ttgctttaggatttaagtggca

SEQ ID NO: 7620477 - DNA, 22 bp, Homo sapiens
ttgctttaggatttaagtggca

SEQ ID NO: 7620478 - DNA, 22 bp, Homo sapiens
ttgctttaggatttaagtggca

SEQ ID NO: 7620479 - DNA, 22 bp, Homo sapiens
ttgctttactttgccattcgtt

SEQ ID NO: 7620480 - DNA, 22 bp, Homo sapiens
ttgctttacggcaaggccccag

SEQ ID NO: 7620481 - DNA, 22 bp, Homo sapiens
ttgctttactttgccattcgtt

SEQ ID NO: 7620482 - DNA, 22 bp, Homo sapiens
ttgctttacaaaaattgatggt

SEQ ID NO: 7620483 - DNA, 22 bp, Homo sapiens
ttgctttacaaaaattgatggt

SEQ ID NO: 7620484 - DNA, 22 bp, Homo sapiens
ttgctttacaaaaattgatggt

SEQ ID NO: 7620485 - DNA, 22 bp, Homo sapiens
ttgctttacatgttctggtaaa

SEQ ID NO: 7620486 - DNA, 22 bp, Homo sapiens
ttgctttacatgttctggtaaa

SEQ ID NO: 7620487 - DNA, 22 bp, Homo sapiens
ttgctttacatgttctggtaaa

SEQ ID NO: 7620488 - DNA, 22 bp, Homo sapiens
ttgctttaccatttgatctcta

SEQ ID NO: 7620489 - DNA, 22 bp, Homo sapiens
ttgctttaccatttgatctcta

SEQ ID NO: 7620490 - DNA, 22 bp, Homo sapiens
ttgctttaccatttgatctcta

SEQ ID NO: 7620491 - DNA, 22 bp, Homo sapiens
ttgctttacctgtggtatattt

SEQ ID NO: 7620492 - DNA, 22 bp, Homo sapiens
ttgcttgctcaactctgttgtt

SEQ ID NO: 7620493 - DNA, 22 bp, Homo sapiens
ttgcttgccctgcagcatactt

SEQ ID NO: 7620494 - DNA, 22 bp, Homo sapiens
ttgcttgcccaagtgtcaattt

SEQ ID NO: 7620495 - DNA, 22 bp, Homo sapiens
ttgcttgcctgttaggagaaac

SEQ ID NO: 7620496 - DNA, 22 bp, Homo sapiens
ttgcttgcataatgctggcatg

SEQ ID NO: 7620497 - DNA, 22 bp, Homo sapiens
ttgcttgcattgtccctggtga

SEQ ID NO: 7620498 - DNA, 22 bp, Homo sapiens
ttgcttgattctgcaaaagcat

SEQ ID NO: 7620499 - DNA, 22 bp, Homo sapiens
ttgcttgattctgcaaaagcat

SEQ ID NO: 7620500 - DNA, 22 bp, Homo sapiens
ttgcttgactttgtgtacctgt

SEQ ID NO: 7620501 - DNA, 22 bp, Homo sapiens
ttgcttgatgcttatatacttg

SEQ ID NO: 7620502 - DNA, 22 bp, Homo sapiens
ttgcttcttagatattcctctc

SEQ ID NO: 7620503 - DNA, 22 bp, Homo sapiens
ttgcttcttagatattcctctc

SEQ ID NO: 7620504 - DNA, 22 bp, Homo sapiens
ttgcttcttagatattcctctc

SEQ ID NO: 7620505 - DNA, 22 bp, Homo sapiens
ttgcttcttagatattcctctc

SEQ ID NO: 7620506 - DNA, 22 bp, Homo sapiens
ttgcttgactttgtgtacctgt

SEQ ID NO: 7620507 - DNA, 21 bp, Homo sapiens
ttgcttgaaccaaaaggcata

SEQ ID NO: 7620508 - DNA, 18 bp, Homo sapiens
ttgcttcttttctctagg

SEQ ID NO: 7620509 - DNA, 18 bp, Homo sapiens
ttgcttcttttctctagg

SEQ ID NO: 7620510 - DNA, 22 bp, Homo sapiens
ttgcttccttgagctggtctga

SEQ ID NO: 7620511 - DNA, 22 bp, Homo sapiens
ttgcttcctttacagatgggca

SEQ ID NO: 7620512 - DNA, 22 bp, Homo sapiens
ttgcttccttgagctggtctga

SEQ ID NO: 7620513 - DNA, 22 bp, Homo sapiens
ttgcttcctggatgtgactttg

SEQ ID NO: 7620514 - DNA, 22 bp, Homo sapiens
ttgcttctaagtataaatatga

SEQ ID NO: 7620515 - DNA, 22 bp, Homo sapiens
ttgcttctaagtataaatatga

SEQ ID NO: 7620516 - DNA, 22 bp, Homo sapiens
ttgcttctaagtataaatatga

SEQ ID NO: 7620517 - DNA, 22 bp, Homo sapiens
ttgcttctaagtataaatatga

SEQ ID NO: 7620518 - DNA, 22 bp, Homo sapiens
ttgcttctcagggcctgatgca

SEQ ID NO: 7620519 - DNA, 22 bp, Homo sapiens
ttgcttctggaactttctgttc

SEQ ID NO: 7620520 - DNA, 22 bp, Homo sapiens
ttgcttctggaactttctgttc

SEQ ID NO: 7620521 - DNA, 22 bp, Homo sapiens
ttgcttctggaactttctgttc

SEQ ID NO: 7620522 - DNA, 23 bp, Homo sapiens
ttgcttctgtgcaattcagtact

SEQ ID NO: 7620523 - DNA, 22 bp, Homo sapiens
ttgcttctggaactttctgttc

SEQ ID NO: 7620524 - DNA, 23 bp, Homo sapiens
ttgcttctgtgcaattcagtact

SEQ ID NO: 7620525 - DNA, 23 bp, Homo sapiens
ttgcttctgtgcaattcagtact

SEQ ID NO: 7620526 - DNA, 23 bp, Homo sapiens
ttgcttctgtgcaattcagtact

SEQ ID NO: 7620527 - DNA, 23 bp, Homo sapiens
ttgcttctgtgcaattcagtact

SEQ ID NO: 7620528 - DNA, 23 bp, Homo sapiens
ttgcttctgtgcaattcagtact

SEQ ID NO: 7620529 - DNA, 23 bp, Homo sapiens
ttgcttctgtgcaattcagtact

SEQ ID NO: 7620530 - DNA, 22 bp, Homo sapiens
ttggaacatgccggggtccagg

SEQ ID NO: 7620531 - DNA, 22 bp, Homo sapiens
ttggaacatccaggacagatat

SEQ ID NO: 7620532 - DNA, 22 bp, Homo sapiens
ttggaacatgccggggtccagg

SEQ ID NO: 7620533 - DNA, 22 bp, Homo sapiens
ttggaacatgccggggtccagg

SEQ ID NO: 7620534 - DNA, 22 bp, Homo sapiens
ttggaacagtgtgaaaaggtta

SEQ ID NO: 7620535 - DNA, 22 bp, Homo sapiens
ttggaacagaaacagacaaata

SEQ ID NO: 7620536 - DNA, 22 bp, Homo sapiens
ttggaacagaaacagacaaata

SEQ ID NO: 7620537 - DNA, 22 bp, Homo sapiens
ttggaacagaaacagacaaata

SEQ ID NO: 7620538 - DNA, 22 bp, Homo sapiens
ttggaacagaaacagacaaata

SEQ ID NO: 7620539 - DNA, 20 bp, Homo sapiens
ttggaacagtggatcagcag

SEQ ID NO: 7620540 - DNA, 22 bp, Homo sapiens
ttggaacaggattcaattaaag

SEQ ID NO: 7620541 - DNA, 22 bp, Homo sapiens
ttggaacaggattcaattaaag

SEQ ID NO: 7620542 - DNA, 22 bp, Homo sapiens
ttggaagaaatatcaatagtgt

SEQ ID NO: 7620543 - DNA, 22 bp, Homo sapiens
ttggaagaaatatcaatagtgt

SEQ ID NO: 7620544 - DNA, 22 bp, Homo sapiens
ttggaactggaggaacatgcta

SEQ ID NO: 7620545 - DNA, 22 bp, Homo sapiens
ttggaacatgccggggtccagg

SEQ ID NO: 7620546 - DNA, 22 bp, Homo sapiens
ttggaagacagccgtctttatt

SEQ ID NO: 7620547 - DNA, 22 bp, Homo sapiens
ttggaagacagccgtctttatt

SEQ ID NO: 7620548 - DNA, 22 bp, Homo sapiens
ttggaagacagtgaaacagcac

SEQ ID NO: 7620549 - DNA, 22 bp, Homo sapiens
ttggaagacagtgaaacagcac

SEQ ID NO: 7620550 - DNA, 22 bp, Homo sapiens
ttggaagacaatgctgattctc

SEQ ID NO: 7620551 - DNA, 22 bp, Homo sapiens
ttggaagaaatatcaatagtgt

SEQ ID NO: 7620552 - DNA, 22 bp, Homo sapiens
ttggaagaaatatcaatagtgt

SEQ ID NO: 7620553 - DNA, 22 bp, Homo sapiens
ttggaagacaatgctgattctc

SEQ ID NO: 7620554 - DNA, 22 bp, Homo sapiens
ttggaagacaatgctgattctc

SEQ ID NO: 7620555 - DNA, 22 bp, Homo sapiens
ttggaagacaatgctgattctc

SEQ ID NO: 7620556 - DNA, 22 bp, Homo sapiens
ttgctttatgtgtatgacttga

SEQ ID NO: 7620557 - DNA, 22 bp, Homo sapiens
ttgctttatgtgtatgacttga

SEQ ID NO: 7620558 - DNA, 22 bp, Homo sapiens
ttgctttatgtgtatgacttga

SEQ ID NO: 7620559 - DNA, 22 bp, Homo sapiens
ttgctttatgtgtatgacttga

SEQ ID NO: 7620560 - DNA, 22 bp, Homo sapiens
ttgctttatgtgtatgacttga

SEQ ID NO: 7620561 - DNA, 22 bp, Homo sapiens
ttgctttatctcttatgcctca

SEQ ID NO: 7620562 - DNA, 22 bp, Homo sapiens
ttgctttatgtgtatgacttga

SEQ ID NO: 7620563 - DNA, 22 bp, Homo sapiens
ttgctttatgtgtatgacttga

SEQ ID NO: 7620564 - DNA, 22 bp, Homo sapiens
ttgctttattcacatctatatt

SEQ ID NO: 7620565 - DNA, 22 bp, Homo sapiens
ttgctttattcacatctatatt

SEQ ID NO: 7620566 - DNA, 22 bp, Homo sapiens
ttgctttattcacatctatatt

SEQ ID NO: 7620567 - DNA, 22 bp, Homo sapiens
ttgctttattcacatctatatt

SEQ ID NO: 7620568 - DNA, 22 bp, Homo sapiens
ttgctttattcacatctatatt

SEQ ID NO: 7620569 - DNA, 22 bp, Homo sapiens
ttggaacactagaatctgtact

SEQ ID NO: 7620570 - DNA, 22 bp, Homo sapiens
ttggaacagaaacagacaaata

SEQ ID NO: 7620571 - DNA, 22 bp, Homo sapiens
ttggaacactagaatctgtact

SEQ ID NO: 7620572 - DNA, 23 bp, Homo sapiens
ttggaacacagtaaatgcacaat

SEQ ID NO: 7620573 - DNA, 23 bp, Homo sapiens
ttggaacacagtaaatgcacaat

SEQ ID NO: 7620574 - DNA, 23 bp, Homo sapiens
ttggaacacagtaaatgcacaat

SEQ ID NO: 7620575 - DNA, 23 bp, Homo sapiens
ttggaacacagtaaatgcacaat

SEQ ID NO: 7620576 - DNA, 23 bp, Homo sapiens
ttggaacacagtaaatgcacaat

SEQ ID NO: 7620577 - DNA, 22 bp, Homo sapiens
ttgctttattcacatctatatt

SEQ ID NO: 7620578 - DNA, 22 bp, Homo sapiens
ttgctttattcctagcccttgt

SEQ ID NO: 7620579 - DNA, 22 bp, Homo sapiens
ttgctttagggcaaatatttca

SEQ ID NO: 7620580 - DNA, 22 bp, Homo sapiens
ttgctttagggcaaatatttca

SEQ ID NO: 7620581 - DNA, 22 bp, Homo sapiens
ttgctttagggcaaatatttca

SEQ ID NO: 7620582 - DNA, 22 bp, Homo sapiens
ttgctttagggcaaatatttca

SEQ ID NO: 7620583 - DNA, 22 bp, Homo sapiens
ttgctttaggtatagaatccat

SEQ ID NO: 7620584 - DNA, 22 bp, Homo sapiens
ttgctttaggtatagaatccat

SEQ ID NO: 7620585 - DNA, 22 bp, Homo sapiens
ttgctttatattcaagagagga

SEQ ID NO: 7620586 - DNA, 22 bp, Homo sapiens
ttgctttatattcaagagagga

SEQ ID NO: 7620587 - DNA, 22 bp, Homo sapiens
ttgctttatattcaagagagga

SEQ ID NO: 7620588 - DNA, 22 bp, Homo sapiens
ttgctttatattcaagagagga

SEQ ID NO: 7620589 - DNA, 22 bp, Homo sapiens
ttgctttatattcaagagagga

SEQ ID NO: 7620590 - DNA, 20 bp, Homo sapiens
ttgctttatcagacatgata

SEQ ID NO: 7620591 - DNA, 20 bp, Homo sapiens
ttgctttatcagacatgata

SEQ ID NO: 7620592 - DNA, 20 bp, Homo sapiens
ttgctttatcagacatgata

SEQ ID NO: 7620593 - DNA, 20 bp, Homo sapiens
ttgctttatcagacatgata

SEQ ID NO: 7620594 - DNA, 22 bp, Homo sapiens
ttgctttatctaagcatggcca

SEQ ID NO: 7620595 - DNA, 22 bp, Homo sapiens
ttgctttatctaagcatggcca

SEQ ID NO: 7620596 - DNA, 22 bp, Homo sapiens
ttgctttatctcttatgcctca

SEQ ID NO: 7620597 - DNA, 22 bp, Homo sapiens
ttgctttatctcttatgcctca

SEQ ID NO: 7620598 - DNA, 22 bp, Homo sapiens
ttggcactctccctgcactggt

SEQ ID NO: 7620599 - DNA, 22 bp, Homo sapiens
ttggcactcatcctggttgttt

SEQ ID NO: 7620600 - DNA, 22 bp, Homo sapiens
ttggcactctccctgcactggt

SEQ ID NO: 7620601 - DNA, 22 bp, Homo sapiens
ttggcactcatcctggttgttt

SEQ ID NO: 7620602 - DNA, 22 bp, Homo sapiens
ttggcactcagcaagtgttaat

SEQ ID NO: 7620603 - DNA, 22 bp, Homo sapiens
ttggcactctccctgcactggt

SEQ ID NO: 7620604 - DNA, 22 bp, Homo sapiens
ttggcactgaccaaagaagtcc

SEQ ID NO: 7620605 - DNA, 22 bp, Homo sapiens
ttggcactgcagatgaattgca

SEQ ID NO: 7620606 - DNA, 22 bp, Homo sapiens
ttggcactattcactccatggg

SEQ ID NO: 7620607 - DNA, 22 bp, Homo sapiens
ttggcactattgacattttggg

SEQ ID NO: 7620608 - DNA, 22 bp, Homo sapiens
ttggcacagtaatctctcttca

SEQ ID NO: 7620609 - DNA, 22 bp, Homo sapiens
ttggcactcaaaatagatggtt

SEQ ID NO: 7620610 - DNA, 22 bp, Homo sapiens
ttggcactcaaaattttatcgg

SEQ ID NO: 7620611 - DNA, 22 bp, Homo sapiens
ttggcactcaactgtcgttgtt

SEQ ID NO: 7620612 - DNA, 22 bp, Homo sapiens
ttggcactcaaaattttatcgg

SEQ ID NO: 7620613 - DNA, 22 bp, Homo sapiens
ttggcactcaaagccctctgca

SEQ ID NO: 7620614 - DNA, 22 bp, Homo sapiens
ttggcactcaaagccctctgca

SEQ ID NO: 7620615 - DNA, 22 bp, Homo sapiens
ttggcagaattaaccactgaag

SEQ ID NO: 7620616 - DNA, 22 bp, Homo sapiens
ttggcagactgacaatctgttt

SEQ ID NO: 7620617 - DNA, 22 bp, Homo sapiens
ttggcagactgacaatctgttt

SEQ ID NO: 7620618 - DNA, 22 bp, Homo sapiens
ttggcagactgggtcctgggga

SEQ ID NO: 7620619 - DNA, 22 bp, Homo sapiens
ttggcagaaaatgcttcctcag

SEQ ID NO: 7620620 - DNA, 22 bp, Homo sapiens
ttggcagaatgggcagcttgag

SEQ ID NO: 7620621 - DNA, 22 bp, Homo sapiens
ttggcagaattaaccactgaag

SEQ ID NO: 7620622 - DNA, 22 bp, Homo sapiens
ttggcagaaatgtggctgggag

SEQ ID NO: 7620623 - DNA, 22 bp, Homo sapiens
ttggcagaatgggcagcttgag

SEQ ID NO: 7620624 - DNA, 22 bp, Homo sapiens
ttggcagaaatgtggctgggag

SEQ ID NO: 7620625 - DNA, 22 bp, Homo sapiens
ttggcagaatgggcagcttgag

SEQ ID NO: 7620626 - DNA, 22 bp, Homo sapiens
ttggcactttctcagcagcctg

SEQ ID NO: 7620627 - DNA, 22 bp, Homo sapiens
ttggcactttctcagcagcctg

SEQ ID NO: 7620628 - DNA, 22 bp, Homo sapiens
ttggcactttgaatgagctcag

SEQ ID NO: 7620629 - DNA, 22 bp, Homo sapiens
ttggcactttgaatgagctcag

SEQ ID NO: 7620630 - DNA, 22 bp, Homo sapiens
ttggcacttttaggcagtaccg

SEQ ID NO: 7620631 - DNA, 22 bp, Homo sapiens
ttggcactgcattgaccacacc

SEQ ID NO: 7620632 - DNA, 22 bp, Homo sapiens
ttggcactgtgcctggcacatt

SEQ ID NO: 7620633 - DNA, 22 bp, Homo sapiens
ttggcacttcacgagacagcta

SEQ ID NO: 7620634 - DNA, 22 bp, Homo sapiens
ttggcacttcacgagacagcta

SEQ ID NO: 7620635 - DNA, 22 bp, Homo sapiens
ttggcaaaatttaaagaagtga

SEQ ID NO: 7620636 - DNA, 22 bp, Homo sapiens
ttggcaaaatttaaagaagtga

SEQ ID NO: 7620637 - DNA, 22 bp, Homo sapiens
ttggcaaaatttaaagaagtga

SEQ ID NO: 7620638 - DNA, 22 bp, Homo sapiens
ttggattctgttaggcaccttc

SEQ ID NO: 7620639 - DNA, 22 bp, Homo sapiens
ttggatgtttgaaatcacgtac

SEQ ID NO: 7620640 - DNA, 22 bp, Homo sapiens
ttggattacatgaaatgcagaa

SEQ ID NO: 7620641 - DNA, 22 bp, Homo sapiens
ttggattcactgttggtagagt

SEQ ID NO: 7620642 - DNA, 22 bp, Homo sapiens
ttggatgtttgaaatcacgtac

SEQ ID NO: 7620643 - DNA, 22 bp, Homo sapiens
ttggcaatgatctcaatcttct

SEQ ID NO: 7620644 - DNA, 22 bp, Homo sapiens
ttggcaatcaattctgacgtct

SEQ ID NO: 7620645 - DNA, 22 bp, Homo sapiens
ttggcaatgtctaaacacattt

SEQ ID NO: 7620646 - DNA, 22 bp, Homo sapiens
ttggcaattagttatatctgca

SEQ ID NO: 7620647 - DNA, 22 bp, Homo sapiens
ttggcaattcaccaaggctcgc

SEQ ID NO: 7620648 - DNA, 22 bp, Homo sapiens
ttggcaatcaattctgacgtct

SEQ ID NO: 7620649 - DNA, 22 bp, Homo sapiens
ttggcaatatttactgaagttg

SEQ ID NO: 7620650 - DNA, 22 bp, Homo sapiens
ttggcaatatttactgaagttg

SEQ ID NO: 7620651 - DNA, 22 bp, Homo sapiens
ttggcaaaggactcaaagcagg

SEQ ID NO: 7620652 - DNA, 22 bp, Homo sapiens
ttggcaaaggactcaaagcagg

SEQ ID NO: 7620653 - DNA, 22 bp, Homo sapiens
ttggcaacacatggaaaaattt

SEQ ID NO: 7620654 - DNA, 22 bp, Homo sapiens
ttggcacacagtaagccctaag

SEQ ID NO: 7620655 - DNA, 22 bp, Homo sapiens
ttggcacacagtaagccctaag

SEQ ID NO: 7620656 - DNA, 22 bp, Homo sapiens
ttggcacaagcagttgggccca

SEQ ID NO: 7620657 - DNA, 22 bp, Homo sapiens
ttggcacaaatttctgaaataa

SEQ ID NO: 7620658 - DNA, 22 bp, Homo sapiens
ttggcacaaatttctgaaataa

SEQ ID NO: 7620659 - DNA, 22 bp, Homo sapiens
ttggcacaaatttctgaaataa

SEQ ID NO: 7620660 - DNA, 22 bp, Homo sapiens
ttggcacaaatttctgaaataa

SEQ ID NO: 7620661 - DNA, 22 bp, Homo sapiens
ttggcacagccacttctgctgc

SEQ ID NO: 7620662 - DNA, 22 bp, Homo sapiens
ttggcacagagctgcagcctgg

SEQ ID NO: 7620663 - DNA, 22 bp, Homo sapiens
ttggcacagagctgcagcctgg

SEQ ID NO: 7620664 - DNA, 22 bp, Homo sapiens
ttggcacagagctgcagcctgg

SEQ ID NO: 7620665 - DNA, 22 bp, Homo sapiens
ttggcacagagctgcagcctgg

SEQ ID NO: 7620666 - DNA, 22 bp, Homo sapiens
ttggcacagaaaaactcactgt

SEQ ID NO: 7620667 - DNA, 22 bp, Homo sapiens
ttggcacagaaaaactcactgt

SEQ ID NO: 7620668 - DNA, 22 bp, Homo sapiens
ttggcacacagtaagccctaag

SEQ ID NO: 7620669 - DNA, 22 bp, Homo sapiens
ttggcactattcactccatggg

SEQ ID NO: 7620670 - DNA, 22 bp, Homo sapiens
ttggcactattcactccatggg

SEQ ID NO: 7620671 - DNA, 22 bp, Homo sapiens
ttggcactattcactccatggg

SEQ ID NO: 7620672 - DNA, 22 bp, Homo sapiens
ttggcacataatttgggaactc

SEQ ID NO: 7620673 - DNA, 22 bp, Homo sapiens
ttggcacctccctaggaagaag

SEQ ID NO: 7620674 - DNA, 22 bp, Homo sapiens
ttggcacagctccatggctttg

SEQ ID NO: 7620675 - DNA, 22 bp, Homo sapiens
ttggcacagtaatctctcttca

SEQ ID NO: 7620676 - DNA, 22 bp, Homo sapiens
ttggcacaggggacttatgtgt

SEQ ID NO: 7620677 - DNA, 22 bp, Homo sapiens
ttggcacagctccatggctttg

SEQ ID NO: 7620678 - DNA, 22 bp, Homo sapiens
ttggaggcaatgggaaggaggc

SEQ ID NO: 7620679 - DNA, 22 bp, Homo sapiens
ttggaggatgtcggcatattta

SEQ ID NO: 7620680 - DNA, 22 bp, Homo sapiens
ttggaggcaatgggaaggaggc

SEQ ID NO: 7620681 - DNA, 22 bp, Homo sapiens
ttggaggcaatgggaaggaggc

SEQ ID NO: 7620682 - DNA, 18 bp, Homo sapiens
ttggaggatgtccatgaa

SEQ ID NO: 7620683 - DNA, 22 bp, Homo sapiens
ttggaggatggagttagcatct

SEQ ID NO: 7620684 - DNA, 20 bp, Homo sapiens
ttggatgtgcatggccgtgc

SEQ ID NO: 7620685 - DNA, 20 bp, Homo sapiens
ttggatgtgcatggccgtgc

SEQ ID NO: 7620686 - DNA, 21 bp, Homo sapiens
ttggatgtatttatgttttag

SEQ ID NO: 7620687 - DNA, 20 bp, Homo sapiens
ttggatgtgcatggccgtgc

SEQ ID NO: 7620688 - DNA, 22 bp, Homo sapiens
ttggatgggcattaggaaagtc

SEQ ID NO: 7620689 - DNA, 19 bp, Homo sapiens
ttggatgctaccaggtacc

SEQ ID NO: 7620690 - DNA, 22 bp, Homo sapiens
ttggagggacagatggctaggc

SEQ ID NO: 7620691 - DNA, 22 bp, Homo sapiens
ttggagggacagatggctaggc

SEQ ID NO: 7620692 - DNA, 22 bp, Homo sapiens
ttggagggacagatggctaggc

SEQ ID NO: 7620693 - DNA, 22 bp, Homo sapiens
ttggagggacagatggctaggc

SEQ ID NO: 7620694 - DNA, 22 bp, Homo sapiens
ttggaggatgcaatgagggagt

SEQ ID NO: 7620695 - DNA, 22 bp, Homo sapiens
ttggaggatgcaatgagggagt

SEQ ID NO: 7620696 - DNA, 22 bp, Homo sapiens
ttggaattcagcttgcttataa

SEQ ID NO: 7620697 - DNA, 22 bp, Homo sapiens
ttggaattcaagttgtagctta

SEQ ID NO: 7620698 - DNA, 22 bp, Homo sapiens
ttggaattcagcttgcttataa

SEQ ID NO: 7620699 - DNA, 22 bp, Homo sapiens
ttggaattaatatttgtataca

SEQ ID NO: 7620700 - DNA, 22 bp, Homo sapiens
ttggaattaatatttgtataca

SEQ ID NO: 7620701 - DNA, 22 bp, Homo sapiens
ttggaattaaaaggagaacttc

SEQ ID NO: 7620702 - DNA, 22 bp, Homo sapiens
ttggaattaaaaggagaacttc

SEQ ID NO: 7620703 - DNA, 22 bp, Homo sapiens
ttggaatgttttaatataaatt

SEQ ID NO: 7620704 - DNA, 22 bp, Homo sapiens
ttggaatgttttaatataaatt

SEQ ID NO: 7620705 - DNA, 22 bp, Homo sapiens
ttggaatctgcaatttaacaaa

SEQ ID NO: 7620706 - DNA, 21 bp, Homo sapiens
ttggaatcttaggagtgtggg

SEQ ID NO: 7620707 - DNA, 21 bp, Homo sapiens
ttggaatcttaggagtgtggg

SEQ ID NO: 7620708 - DNA, 22 bp, Homo sapiens
ttggaatgcacactgagcctgc

SEQ ID NO: 7620709 - DNA, 22 bp, Homo sapiens
ttggaatgcacactgagcctgc

SEQ ID NO: 7620710 - DNA, 21 bp, Homo sapiens
ttggaagataatgcttatgat

SEQ ID NO: 7620711 - DNA, 22 bp, Homo sapiens
ttggaagagtagagttgaataa

SEQ ID NO: 7620712 - DNA, 21 bp, Homo sapiens
ttggaagataatgcttatgat

SEQ ID NO: 7620713 - DNA, 22 bp, Homo sapiens
ttggaagagtagagttgaataa

SEQ ID NO: 7620714 - DNA, 22 bp, Homo sapiens
ttggaagaggaaaatgagccta

SEQ ID NO: 7620715 - DNA, 22 bp, Homo sapiens
ttggaagaggaaaatgagccta

SEQ ID NO: 7620716 - DNA, 22 bp, Homo sapiens
ttggaataaaaacaactcacag

SEQ ID NO: 7620717 - DNA, 22 bp, Homo sapiens
ttggaagttaaataaggttcaa

SEQ ID NO: 7620718 - DNA, 22 bp, Homo sapiens
ttggaagtaatgaagaggtggg

SEQ ID NO: 7620719 - DNA, 22 bp, Homo sapiens
ttggaagagagccacagttaat

SEQ ID NO: 7620720 - DNA, 22 bp, Homo sapiens
ttggaagagagccacagttaat

SEQ ID NO: 7620721 - DNA, 22 bp, Homo sapiens
ttggaagagagccacagttaat

SEQ ID NO: 7620722 - DNA, 22 bp, Homo sapiens
ttggaagaccagaggccttgtc

SEQ ID NO: 7620723 - DNA, 22 bp, Homo sapiens
ttggaagacagtgaaacagcac

SEQ ID NO: 7620724 - DNA, 22 bp, Homo sapiens
ttggaagacagtgaaacagcac

SEQ ID NO: 7620725 - DNA, 22 bp, Homo sapiens
ttggaagacattaaagagagtg

SEQ ID NO: 7620726 - DNA, 22 bp, Homo sapiens
ttggaatcctgcctctgctact

SEQ ID NO: 7620727 - DNA, 22 bp, Homo sapiens
ttggaatcctgagatgagaatt

SEQ ID NO: 7620728 - DNA, 21 bp, Homo sapiens
ttggaatctcttcatctctgc

SEQ ID NO: 7620729 - DNA, 22 bp, Homo sapiens
ttggaatctgcaatttaacaaa

SEQ ID NO: 7620730 - DNA, 22 bp, Homo sapiens
ttggaatcattcttaaaggtct

SEQ ID NO: 7620731 - DNA, 22 bp, Homo sapiens
ttggaatcactcacataagtct

SEQ ID NO: 7620732 - DNA, 22 bp, Homo sapiens
ttggaatcctgagatgagaatt

SEQ ID NO: 7620733 - DNA, 22 bp, Homo sapiens
ttggaatcctgagatgagaatt

SEQ ID NO: 7620734 - DNA, 22 bp, Homo sapiens
ttggaatcattcttaaaggtct

SEQ ID NO: 7620735 - DNA, 22 bp, Homo sapiens
ttggaatcctgagatgagaatt

SEQ ID NO: 7620736 - DNA, 22 bp, Homo sapiens
ttggaatcaattcatgttgcaa

SEQ ID NO: 7620737 - DNA, 20 bp, Homo sapiens
ttggaatcacctggagaggt

SEQ ID NO: 7620738 - DNA, 20 bp, Homo sapiens
ttggaatcacctggagaggt

SEQ ID NO: 7620739 - DNA, 22 bp, Homo sapiens
ttggaatcactcacataagtct

SEQ ID NO: 7620740 - DNA, 22 bp, Homo sapiens
ttggaatcattcttaaaggtct

SEQ ID NO: 7620741 - DNA, 22 bp, Homo sapiens
ttggaatatcatgcagaataaa

SEQ ID NO: 7620742 - DNA, 22 bp, Homo sapiens
ttggaatagatttgttagaaaa

SEQ ID NO: 7620743 - DNA, 22 bp, Homo sapiens
ttggaataaaaacaactcacag

SEQ ID NO: 7620744 - DNA, 22 bp, Homo sapiens
ttggaatagggaatcaaagttt

SEQ ID NO: 7620745 - DNA, 22 bp, Homo sapiens
ttggaatagggaggctggcata

SEQ ID NO: 7620746 - DNA, 22 bp, Homo sapiens
ttggcccagcatgcgggtctgt

SEQ ID NO: 7620747 - DNA, 20 bp, Homo sapiens
ttggcagcagctcagccacc

SEQ ID NO: 7620748 - DNA, 22 bp, Homo sapiens
ttggcccagactcggggactga

SEQ ID NO: 7620749 - DNA, 22 bp, Homo sapiens
ttggcccagactcggggactga

SEQ ID NO: 7620750 - DNA, 22 bp, Homo sapiens
ttggcagcagggagttggccgc

SEQ ID NO: 7620751 - DNA, 22 bp, Homo sapiens
ttggcccagggtcagcggcgct

SEQ ID NO: 7620752 - DNA, 22 bp, Homo sapiens
ttggcccagcatgcgggtctgt

SEQ ID NO: 7620753 - DNA, 22 bp, Homo sapiens
ttggcccagggtcagcggcgct

SEQ ID NO: 7620754 - DNA, 22 bp, Homo sapiens
ttggccctagactctaagtccg

SEQ ID NO: 7620755 - DNA, 22 bp, Homo sapiens
ttggccctagactctaagtccg

SEQ ID NO: 7620756 - DNA, 22 bp, Homo sapiens
ttggccctagatgattaagttg

SEQ ID NO: 7620757 - DNA, 22 bp, Homo sapiens
ttggcagatggattcaacatta

SEQ ID NO: 7620758 - DNA, 22 bp, Homo sapiens
ttggcagattcatttaataaat

SEQ ID NO: 7620759 - DNA, 22 bp, Homo sapiens
ttggcagattctgaacaaagcc

SEQ ID NO: 7620760 - DNA, 22 bp, Homo sapiens
ttggcagatttgtcagtaagct

SEQ ID NO: 7620761 - DNA, 22 bp, Homo sapiens
ttggcagatggattcaacatta

SEQ ID NO: 7620762 - DNA, 22 bp, Homo sapiens
ttggcagatttgtcagtaagct

SEQ ID NO: 7620763 - DNA, 22 bp, Homo sapiens
ttggcagcaagaggctcttctg

SEQ ID NO: 7620764 - DNA, 22 bp, Homo sapiens
ttggcagcaagaggctcttctg

SEQ ID NO: 7620765 - DNA, 22 bp, Homo sapiens
ttggcagcacggggaacgtctg

SEQ ID NO: 7620766 - DNA, 22 bp, Homo sapiens
ttggcagcacggggaacgtctg

SEQ ID NO: 7620767 - DNA, 22 bp, Homo sapiens
ttggcagcagagtgtggtgctc

SEQ ID NO: 7620768 - DNA, 22 bp, Homo sapiens
ttggcagcagagtgtggtgctc

SEQ ID NO: 7620769 - DNA, 20 bp, Homo sapiens
ttggcagcagctcagccacc

SEQ ID NO: 7620770 - DNA, 20 bp, Homo sapiens
ttggcagcagctcagccacc

SEQ ID NO: 7620771 - DNA, 22 bp, Homo sapiens
ttggcagaggtctcgttgtggc

SEQ ID NO: 7620772 - DNA, 22 bp, Homo sapiens
ttggcagatgaacacaactgga

SEQ ID NO: 7620773 - DNA, 22 bp, Homo sapiens
ttggcagatgaacacaactgga

SEQ ID NO: 7620774 - DNA, 22 bp, Homo sapiens
ttggcagaggtctcgttgtggc

SEQ ID NO: 7620775 - DNA, 22 bp, Homo sapiens
ttggcagatgagaccaggggtt

SEQ ID NO: 7620776 - DNA, 22 bp, Homo sapiens
ttggcagagggaccagcctaca

SEQ ID NO: 7620777 - DNA, 22 bp, Homo sapiens
ttggcagaggggccacctgccc

SEQ ID NO: 7620778 - DNA, 22 bp, Homo sapiens
ttggcagaggggccacctgccc

SEQ ID NO: 7620779 - DNA, 22 bp, Homo sapiens
ttggcagaggggccacctgccc

SEQ ID NO: 7620780 - DNA, 22 bp, Homo sapiens
ttggcagaggggtttctggtgg

SEQ ID NO: 7620781 - DNA, 22 bp, Homo sapiens
ttggcagaggggtttctggtgg

SEQ ID NO: 7620782 - DNA, 22 bp, Homo sapiens
ttggcagagagtatgctgaaga

SEQ ID NO: 7620783 - DNA, 22 bp, Homo sapiens
ttggcagactgacaatctgttt

SEQ ID NO: 7620784 - DNA, 22 bp, Homo sapiens
ttggcagactgggtcctgggga

SEQ ID NO: 7620785 - DNA, 22 bp, Homo sapiens
ttggcagactgggtcctgggga

SEQ ID NO: 7620786 - DNA, 22 bp, Homo sapiens
ttggcagactgttttcaaaagt

SEQ ID NO: 7620787 - DNA, 22 bp, Homo sapiens
ttggcagagccccagccttgga

SEQ ID NO: 7620788 - DNA, 22 bp, Homo sapiens
ttggcagagagtatgctgaaga

SEQ ID NO: 7620789 - DNA, 22 bp, Homo sapiens
ttggcagagccccagccttgga

SEQ ID NO: 7620790 - DNA, 22 bp, Homo sapiens
ttggcagagggaccagcctaca

SEQ ID NO: 7620791 - DNA, 22 bp, Homo sapiens
ttggcagagccccagccttgga

SEQ ID NO: 7620792 - DNA, 22 bp, Homo sapiens
ttggcagaggccgaggtgaaga

SEQ ID NO: 7620793 - DNA, 22 bp, Homo sapiens
ttggcctacctgggaatgctgg

SEQ ID NO: 7620794 - DNA, 21 bp, Homo sapiens
ttggccgtgcagatgaacagc

SEQ ID NO: 7620795 - DNA, 22 bp, Homo sapiens
ttggccctttatgggatgggca

SEQ ID NO: 7620796 - DNA, 22 bp, Homo sapiens
ttggcctattccagcagctgtg

SEQ ID NO: 7620797 - DNA, 22 bp, Homo sapiens
ttggcctattccagcagctgtg

SEQ ID NO: 7620798 - DNA, 22 bp, Homo sapiens
ttggccctggcacacccccacg

SEQ ID NO: 7620799 - DNA, 22 bp, Homo sapiens
ttggcctctcccatactgtcca

SEQ ID NO: 7620800 - DNA, 17 bp, Homo sapiens
ttggcctcttgacattt

SEQ ID NO: 7620801 - DNA, 22 bp, Homo sapiens
ttggccctggggccagcttcga

SEQ ID NO: 7620802 - DNA, 22 bp, Homo sapiens
ttggccctggggccagcttcga

SEQ ID NO: 7620803 - DNA, 22 bp, Homo sapiens
ttggccctggggccagcttcga

SEQ ID NO: 7620804 - DNA, 22 bp, Homo sapiens
ttggccctggcacacccccacg

SEQ ID NO: 7620805 - DNA, 22 bp, Homo sapiens
ttggccctgaggttatcatcta

SEQ ID NO: 7620806 - DNA, 22 bp, Homo sapiens
ttggccctgaggaggcagctgc

SEQ ID NO: 7620807 - DNA, 22 bp, Homo sapiens
ttggccctccacctggctgtgc

SEQ ID NO: 7620808 - DNA, 22 bp, Homo sapiens
ttggccctccacctggctgtgc

SEQ ID NO: 7620809 - DNA, 22 bp, Homo sapiens
ttggccctagatgattaagttg

SEQ ID NO: 7620810 - DNA, 22 bp, Homo sapiens
ttggcctctcccatactgtcca

SEQ ID NO: 7620811 - DNA, 22 bp, Homo sapiens
ttggccttaacctctctgtgcc

SEQ ID NO: 7620812 - DNA, 22 bp, Homo sapiens
ttggcctggcgcggtggctcac

SEQ ID NO: 7620813 - DNA, 22 bp, Homo sapiens
ttggcctgctccagagaggcca

SEQ ID NO: 7620814 - DNA, 22 bp, Homo sapiens
ttggccttacgcatggtcggca

SEQ ID NO: 7620815 - DNA, 22 bp, Homo sapiens
ttggccttactctcctacactg

SEQ ID NO: 7620816 - DNA, 22 bp, Homo sapiens
ttggccttagcttcttcttaaa

SEQ ID NO: 7620817 - DNA, 22 bp, Homo sapiens
ttggccttagcttcttcttaaa

SEQ ID NO: 7620818 - DNA, 17 bp, Homo sapiens
ttggccttctagcctct

SEQ ID NO: 7620819 - DNA, 17 bp, Homo sapiens
ttggccttctagcctct

SEQ ID NO: 7620820 - DNA, 22 bp, Homo sapiens
ttggccttctcatttgcttatt

SEQ ID NO: 7620821 - DNA, 22 bp, Homo sapiens
ttggccttctcttcccggtcct

SEQ ID NO: 7620822 - DNA, 22 bp, Homo sapiens
ttggccttctctgacactgccc

SEQ ID NO: 7620823 - DNA, 22 bp, Homo sapiens
ttggccttctctgacactgccc

SEQ ID NO: 7620824 - DNA, 22 bp, Homo sapiens
ttggccttctggtgttcatttt

SEQ ID NO: 7620825 - DNA, 22 bp, Homo sapiens
ttggccttctggtgttcatttt

SEQ ID NO: 7620826 - DNA, 22 bp, Homo sapiens
ttggccttgtacatcatattaa

SEQ ID NO: 7620827 - DNA, 22 bp, Homo sapiens
ttggccttgaacatggtttagg

SEQ ID NO: 7620828 - DNA, 22 bp, Homo sapiens
ttggccttgtacatcatattaa

SEQ ID NO: 7620829 - DNA, 22 bp, Homo sapiens
ttggccttgtacatcatattaa

SEQ ID NO: 7620830 - DNA, 22 bp, Homo sapiens
ttggccttgtcacttcattact

SEQ ID NO: 7620831 - DNA, 22 bp, Homo sapiens
ttggccttgtcacttcattact

SEQ ID NO: 7620832 - DNA, 22 bp, Homo sapiens
ttggccttgtctggtcttctcc

SEQ ID NO: 7620833 - DNA, 22 bp, Homo sapiens
ttggccttgtctggtcttctcc

SEQ ID NO: 7620834 - DNA, 22 bp, Homo sapiens
ttggccttgtctggtcttctcc

SEQ ID NO: 7620835 - DNA, 19 bp, Homo sapiens
ttggccttgtttcatatct

SEQ ID NO: 7620836 - DNA, 22 bp, Homo sapiens
ttggctatgcttgtgttcagtt

SEQ ID NO: 7620837 - DNA, 22 bp, Homo sapiens
ttggctacatcgaggctccagc

SEQ ID NO: 7620838 - DNA, 22 bp, Homo sapiens
ttggctcacaaggacggttgct

SEQ ID NO: 7620839 - DNA, 22 bp, Homo sapiens
ttggctcacaaggacggttgct

SEQ ID NO: 7620840 - DNA, 22 bp, Homo sapiens
ttggctatgcttgtgttcagtt

SEQ ID NO: 7620841 - DNA, 22 bp, Homo sapiens
ttggctcaaaacttagattcca

SEQ ID NO: 7620842 - DNA, 22 bp, Homo sapiens
ttggctcaaaacttagattcca

SEQ ID NO: 7620843 - DNA, 22 bp, Homo sapiens
ttggcctttgtcatcaagatca

SEQ ID NO: 7620844 - DNA, 22 bp, Homo sapiens
ttggcgatttctgaaattataa

SEQ ID NO: 7620845 - DNA, 21 bp, Homo sapiens
ttggcctttgtctcagacact

SEQ ID NO: 7620846 - DNA, 22 bp, Homo sapiens
ttggcctttgctgggctgttga

SEQ ID NO: 7620847 - DNA, 21 bp, Homo sapiens
ttggcctttgtctcagacact

SEQ ID NO: 7620848 - DNA, 22 bp, Homo sapiens
ttggcctttgtcatcaagatca

SEQ ID NO: 7620849 - DNA, 22 bp, Homo sapiens
ttggcctttaaactggactttc

SEQ ID NO: 7620850 - DNA, 22 bp, Homo sapiens
ttggcctttaaactggactttc

SEQ ID NO: 7620851 - DNA, 19 bp, Homo sapiens
ttggccttgtttcatatct

SEQ ID NO: 7620852 - DNA, 19 bp, Homo sapiens
ttggccttgtttcatatct

SEQ ID NO: 7620853 - DNA, 22 bp, Homo sapiens
ttggcctttattctgtacttct

SEQ ID NO: 7620854 - DNA, 22 bp, Homo sapiens
ttggcctttattctgtacttct

SEQ ID NO: 7620855 - DNA, 22 bp, Homo sapiens
ttggcctttgctgggctgttga

SEQ ID NO: 7620856 - DNA, 22 bp, Homo sapiens
ttggcctttggactctgggact

SEQ ID NO: 7620857 - DNA, 22 bp, Homo sapiens
ttggctcacatgattatggagg

SEQ ID NO: 7620858 - DNA, 22 bp, Homo sapiens
ttggctcacatgattatggagg

SEQ ID NO: 7620859 - DNA, 22 bp, Homo sapiens
ttggctcacctggagcctgttg

SEQ ID NO: 7620860 - DNA, 22 bp, Homo sapiens
ttggctcacctggagcctgttg

SEQ ID NO: 7620861 - DNA, 22 bp, Homo sapiens
ttggctcacctggagcctgttg

SEQ ID NO: 7620862 - DNA, 20 bp, Homo sapiens
ttggctcagatttttatggg

SEQ ID NO: 7620863 - DNA, 20 bp, Homo sapiens
ttggctcagatttttatggg

SEQ ID NO: 7620864 - DNA, 22 bp, Homo sapiens
ttggctcacctgtctacccaga

SEQ ID NO: 7620865 - DNA, 22 bp, Homo sapiens
ttggctcacctgtctacccaga

SEQ ID NO: 7620866 - DNA, 22 bp, Homo sapiens
ttggctcacctgtctacccaga

SEQ ID NO: 7620867 - DNA, 22 bp, Homo sapiens
ttggctcagctgggactgttga

SEQ ID NO: 7620868 - DNA, 22 bp, Homo sapiens
ttggctcagctgggactgttga

SEQ ID NO: 7620869 - DNA, 22 bp, Homo sapiens
ttggctcagcatcttggtgcca

SEQ ID NO: 7620870 - DNA, 22 bp, Homo sapiens
ttggctcagcatcttggtgcca

SEQ ID NO: 7620871 - DNA, 22 bp, Homo sapiens
ttggctcaggctttcattgtaa

SEQ ID NO: 7620872 - DNA, 22 bp, Homo sapiens
ttggctcaggacccctgtgact

SEQ ID NO: 7620873 - DNA, 22 bp, Homo sapiens
ttggctcaggacccctgtgact

SEQ ID NO: 7620874 - DNA, 22 bp, Homo sapiens
ttggctcaggacccctgtgact

SEQ ID NO: 7620875 - DNA, 22 bp, Homo sapiens
ttggctcagtgtgagggagatg

SEQ ID NO: 7620876 - DNA, 22 bp, Homo sapiens
ttggctcagtgtgagggagatg

SEQ ID NO: 7620877 - DNA, 22 bp, Homo sapiens
ttggctcagtgtgagggagatg

SEQ ID NO: 7620878 - DNA, 22 bp, Homo sapiens
ttggctcaggctttcattgtaa

SEQ ID NO: 7620879 - DNA, 22 bp, Homo sapiens
ttggctcaggacccctgtgact

SEQ ID NO: 7620880 - DNA, 22 bp, Homo sapiens
ttggctcaggctttcattgtaa

SEQ ID NO: 7620881 - DNA, 22 bp, Homo sapiens
ttggctcattaaagatgataat

SEQ ID NO: 7620882 - DNA, 22 bp, Homo sapiens
ttggctcatgctgttttgtgca

SEQ ID NO: 7620883 - DNA, 20 bp, Homo sapiens
ttggctcatgcaacacctac

SEQ ID NO: 7620884 - DNA, 20 bp, Homo sapiens
ttggctcatgcaacacctac

SEQ ID NO: 7620885 - DNA, 22 bp, Homo sapiens
ttggctcctgttcctctgtctg

SEQ ID NO: 7620886 - DNA, 22 bp, Homo sapiens
ttggctcccactaactccagca

SEQ ID NO: 7620887 - DNA, 22 bp, Homo sapiens
ttggctcccactaactccagca

SEQ ID NO: 7620888 - DNA, 22 bp, Homo sapiens
ttggctcattaaagatgataat

SEQ ID NO: 7620889 - DNA, 22 bp, Homo sapiens
ttggctcatgctgttttgtgca

SEQ ID NO: 7620890 - DNA, 22 bp, Homo sapiens
ttggctcccactaactccagca

SEQ ID NO: 7620891 - DNA, 22 bp, Homo sapiens
ttggctcccactaactccagca

SEQ ID NO: 7620892 - DNA, 22 bp, Homo sapiens
ttggctctaggaaccaaagtga

SEQ ID NO: 7620893 - DNA, 22 bp, Homo sapiens
ttggctctaggaaccaaagtga

SEQ ID NO: 7620894 - DNA, 22 bp, Homo sapiens
ttggctctaggaaccaaagtga

SEQ ID NO: 7620895 - DNA, 22 bp, Homo sapiens
ttggctgctggtctttggatat

SEQ ID NO: 7620896 - DNA, 22 bp, Homo sapiens
ttggctgtgaaagcttctcaaa

SEQ ID NO: 7620897 - DNA, 22 bp, Homo sapiens
ttggctgtgaaagcttctcaaa

SEQ ID NO: 7620898 - DNA, 22 bp, Homo sapiens
ttggctgtatgtacatctgtta

SEQ ID NO: 7620899 - DNA, 22 bp, Homo sapiens
ttggctgtatgtacatctgtta

SEQ ID NO: 7620900 - DNA, 22 bp, Homo sapiens
ttggctggttttgagtatgtgc

SEQ ID NO: 7620901 - DNA, 22 bp, Homo sapiens
ttggctggtttcaagaaggcat

SEQ ID NO: 7620902 - DNA, 22 bp, Homo sapiens
ttggctggtaagccaaatgaaa

SEQ ID NO: 7620903 - DNA, 22 bp, Homo sapiens
ttggctggtttcaagaaggcat

SEQ ID NO: 7620904 - DNA, 22 bp, Homo sapiens
ttggctggtttcaagaaggcat

SEQ ID NO: 7620905 - DNA, 22 bp, Homo sapiens
ttggctggtttcaagaaggcat

SEQ ID NO: 7620906 - DNA, 22 bp, Homo sapiens
ttggctgggcacagtgtctcat

SEQ ID NO: 7620907 - DNA, 22 bp, Homo sapiens
ttggctgctttactctgacggg

SEQ ID NO: 7620908 - DNA, 22 bp, Homo sapiens
ttggctggctacctgggccgag

SEQ ID NO: 7620909 - DNA, 22 bp, Homo sapiens
ttggctggcttctcgacttgtt

SEQ ID NO: 7620910 - DNA, 22 bp, Homo sapiens
ttggctggtaagccaaatgaaa

SEQ ID NO: 7620911 - DNA, 22 bp, Homo sapiens
ttggctgggcacagtgtctcat

SEQ ID NO: 7620912 - DNA, 22 bp, Homo sapiens
ttggctggtttcaagaaggcat

SEQ ID NO: 7620913 - DNA, 22 bp, Homo sapiens
ttggctggtaagccaaatgaaa

SEQ ID NO: 7620914 - DNA, 22 bp, Homo sapiens
ttgggctgatctgtggaagaag

SEQ ID NO: 7620915 - DNA, 22 bp, Homo sapiens
ttgggctgatctgtggaagaag

SEQ ID NO: 7620916 - DNA, 22 bp, Homo sapiens
ttgggctgaggagggcgtggcc

SEQ ID NO: 7620917 - DNA, 22 bp, Homo sapiens
ttgggctgaggagggcgtggcc

SEQ ID NO: 7620918 - DNA, 22 bp, Homo sapiens
ttgggctgatctgtggaagaag

SEQ ID NO: 7620919 - DNA, 22 bp, Homo sapiens
ttgggctgcagcaattattagt

SEQ ID NO: 7620920 - DNA, 22 bp, Homo sapiens
ttgggctgcagcaattattagt

SEQ ID NO: 7620921 - DNA, 22 bp, Homo sapiens
ttgggctggagatgatctgctg

SEQ ID NO: 7620922 - DNA, 22 bp, Homo sapiens
ttgggctggagatgatctgctg

SEQ ID NO: 7620923 - DNA, 22 bp, Homo sapiens
ttgggctggataagtctttgtt

SEQ ID NO: 7620924 - DNA, 22 bp, Homo sapiens
ttgggctggataagtctttgtt

SEQ ID NO: 7620925 - DNA, 22 bp, Homo sapiens
ttgggctgaagtagagggcaga

SEQ ID NO: 7620926 - DNA, 22 bp, Homo sapiens
ttgggctgaagtagagggcaga

SEQ ID NO: 7620927 - DNA, 22 bp, Homo sapiens
ttgggctgaagtagagggcaga

SEQ ID NO: 7620928 - DNA, 22 bp, Homo sapiens
ttgggctgaggagggcgtggcc

SEQ ID NO: 7620929 - DNA, 22 bp, Homo sapiens
ttgggctgaggagggcgtggcc

SEQ ID NO: 7620930 - DNA, 22 bp, Homo sapiens
ttgggctgaggagggcgtggcc

SEQ ID NO: 7620931 - DNA, 22 bp, Homo sapiens
ttgggctgaaccctgcagctga

SEQ ID NO: 7620932 - DNA, 22 bp, Homo sapiens
ttgggctgaagtagagggcaga

SEQ ID NO: 7620933 - DNA, 22 bp, Homo sapiens
ttgggctgaaccctgcagctga

SEQ ID NO: 7620934 - DNA, 22 bp, Homo sapiens
ttgggctgaagtagagggcaga

SEQ ID NO: 7620935 - DNA, 22 bp, Homo sapiens
ttgggctcaggagtttgagacc

SEQ ID NO: 7620936 - DNA, 23 bp, Homo sapiens
ttgggctcagtggcaggaagagt

SEQ ID NO: 7620937 - DNA, 23 bp, Homo sapiens
ttgggctcagtggcaggaagagt

SEQ ID NO: 7620938 - DNA, 22 bp, Homo sapiens
ttgggctgaaccctgcagctga

SEQ ID NO: 7620939 - DNA, 22 bp, Homo sapiens
ttgggctcctgttgatcctgtc

SEQ ID NO: 7620940 - DNA, 22 bp, Homo sapiens
ttgggctcaggagtttgagacc

SEQ ID NO: 7620941 - DNA, 22 bp, Homo sapiens
ttgggctcaggagtttgagacc

SEQ ID NO: 7620942 - DNA, 22 bp, Homo sapiens
ttgggctcaggagtttgagacc

SEQ ID NO: 7620943 - DNA, 22 bp, Homo sapiens
ttgggctcaggagtttgagacc

SEQ ID NO: 7620944 - DNA, 21 bp, Homo sapiens
ttgggccttttctggtagctt

SEQ ID NO: 7620945 - DNA, 21 bp, Homo sapiens
ttgggccttttctggtagctt

SEQ ID NO: 7620946 - DNA, 21 bp, Homo sapiens
ttgggccttttctggtagctt

SEQ ID NO: 7620947 - DNA, 22 bp, Homo sapiens
ttgggctaataactgattttag

SEQ ID NO: 7620948 - DNA, 22 bp, Homo sapiens
ttgggctatgttatataatgtt

SEQ ID NO: 7620949 - DNA, 22 bp, Homo sapiens
ttgggctcaggagtttgagacc

SEQ ID NO: 7620950 - DNA, 22 bp, Homo sapiens
ttgggctcaggagtttgagacc

SEQ ID NO: 7620951 - DNA, 22 bp, Homo sapiens
ttggggaggttgccacattcca

SEQ ID NO: 7620952 - DNA, 22 bp, Homo sapiens
ttggggaggttgccacattcca

SEQ ID NO: 7620953 - DNA, 22 bp, Homo sapiens
ttggggagttaatgccaaagat

SEQ ID NO: 7620954 - DNA, 22 bp, Homo sapiens
ttggggaggttgccacattcca

SEQ ID NO: 7620955 - DNA, 22 bp, Homo sapiens
ttggggagttaatgccaaagat

SEQ ID NO: 7620956 - DNA, 22 bp, Homo sapiens
ttggggagaaatgaaatgaagt

SEQ ID NO: 7620957 - DNA, 22 bp, Homo sapiens
ttggggagaaatgaaatgaagt

SEQ ID NO: 7620958 - DNA, 22 bp, Homo sapiens
ttggggagaaatgaaatgaagt

SEQ ID NO: 7620959 - DNA, 22 bp, Homo sapiens
ttggggagaaatgaaatgaagt

SEQ ID NO: 7620960 - DNA, 22 bp, Homo sapiens
ttggggcagagaggatacggca

SEQ ID NO: 7620961 - DNA, 22 bp, Homo sapiens
ttggggcagagaggatacggca

SEQ ID NO: 7620962 - DNA, 22 bp, Homo sapiens
ttggggcacctccccagcattt

SEQ ID NO: 7620963 - DNA, 22 bp, Homo sapiens
ttggggcacctccccagcattt

SEQ ID NO: 7620964 - DNA, 22 bp, Homo sapiens
ttggggagttaatgccaaagat

SEQ ID NO: 7620965 - DNA, 22 bp, Homo sapiens
ttggggagttaatgccaaagat

SEQ ID NO: 7620966 - DNA, 17 bp, Homo sapiens
ttggggattgattactt

SEQ ID NO: 7620967 - DNA, 22 bp, Homo sapiens
ttggggcacctccccagcattt

SEQ ID NO: 7620968 - DNA, 22 bp, Homo sapiens
ttggggcacctccccagcattt

SEQ ID NO: 7620969 - DNA, 22 bp, Homo sapiens
ttggggagttaatgccaaagat

SEQ ID NO: 7620970 - DNA, 22 bp, Homo sapiens
ttggggagttaatgccaaagat

SEQ ID NO: 7620971 - DNA, 22 bp, Homo sapiens
ttggggagttaatgccaaagat

SEQ ID NO: 7620972 - DNA, 22 bp, Homo sapiens
ttgggctttaattccagagagg

SEQ ID NO: 7620973 - DNA, 22 bp, Homo sapiens
ttgggctggtctttgtttggtc

SEQ ID NO: 7620974 - DNA, 22 bp, Homo sapiens
ttggggaagagttgactttgga

SEQ ID NO: 7620975 - DNA, 22 bp, Homo sapiens
ttggggaagctttgaaatactt

SEQ ID NO: 7620976 - DNA, 22 bp, Homo sapiens
ttggggaaggcttccctgtacc

SEQ ID NO: 7620977 - DNA, 22 bp, Homo sapiens
ttggggaagctttgaaatactt

SEQ ID NO: 7620978 - DNA, 22 bp, Homo sapiens
ttggggaagctttgaaatactt

SEQ ID NO: 7620979 - DNA, 22 bp, Homo sapiens
ttgggctgggcaagaatcaatg

SEQ ID NO: 7620980 - DNA, 23 bp, Homo sapiens
ttgggctggctctcgatgcctct

SEQ ID NO: 7620981 - DNA, 22 bp, Homo sapiens
ttgggctggcccttgtctctgg

SEQ ID NO: 7620982 - DNA, 22 bp, Homo sapiens
ttgggctggcccttgtctctgg

SEQ ID NO: 7620983 - DNA, 22 bp, Homo sapiens
ttgggctggcagaggtggtctt

SEQ ID NO: 7620984 - DNA, 22 bp, Homo sapiens
ttgggctggcagaggtggtctt

SEQ ID NO: 7620985 - DNA, 22 bp, Homo sapiens
ttgggctggcagaggtggtctt

SEQ ID NO: 7620986 - DNA, 22 bp, Homo sapiens
ttgggctggcagaggtggtctt

SEQ ID NO: 7620987 - DNA, 22 bp, Homo sapiens
ttgggctggcagaggtggtctt

SEQ ID NO: 7620988 - DNA, 23 bp, Homo sapiens
ttgggaaatagttaagacatgag

SEQ ID NO: 7620989 - DNA, 22 bp, Homo sapiens
ttgggaaatatggattgttatt

SEQ ID NO: 7620990 - DNA, 22 bp, Homo sapiens
ttgggaaatatggattgttatt

SEQ ID NO: 7620991 - DNA, 22 bp, Homo sapiens
ttgggaaattactctgctagga

SEQ ID NO: 7620992 - DNA, 22 bp, Homo sapiens
ttgggaaattactctgctagga

SEQ ID NO: 7620993 - DNA, 22 bp, Homo sapiens
ttgggaaattactctgctagga

SEQ ID NO: 7620994 - DNA, 23 bp, Homo sapiens
ttgggaaatagttaagacatgag

SEQ ID NO: 7620995 - DNA, 22 bp, Homo sapiens
ttgggaaagggattatgagtag

SEQ ID NO: 7620996 - DNA, 22 bp, Homo sapiens
ttgggaaagccacaaattggag

SEQ ID NO: 7620997 - DNA, 22 bp, Homo sapiens
ttgggaaagaatgagaaggtga

SEQ ID NO: 7620998 - DNA, 22 bp, Homo sapiens
ttgggaaacagtatagctaaca

SEQ ID NO: 7620999 - DNA, 22 bp, Homo sapiens
ttgggaaagccacaaattggag

SEQ ID NO: 7621000 - DNA, 22 bp, Homo sapiens
ttgggaaagaatgagaaggtga

SEQ ID NO: 7621001 - DNA, 22 bp, Homo sapiens
ttggctttcaggctggaaatct

SEQ ID NO: 7621002 - DNA, 22 bp, Homo sapiens
ttggctttcagaatccctatct

SEQ ID NO: 7621003 - DNA, 22 bp, Homo sapiens
ttggctttcagaatccctatct

SEQ ID NO: 7621004 - DNA, 22 bp, Homo sapiens
ttggctttcaggctggaaatct

SEQ ID NO: 7621005 - DNA, 22 bp, Homo sapiens
ttggctttctctgtatctgaat

SEQ ID NO: 7621006 - DNA, 22 bp, Homo sapiens
ttggctttctctgtatctgaat

SEQ ID NO: 7621007 - DNA, 22 bp, Homo sapiens
ttggcttggagagttgaaatgt

SEQ ID NO: 7621008 - DNA, 22 bp, Homo sapiens
ttggctttagacctgagactgt

SEQ ID NO: 7621009 - DNA, 22 bp, Homo sapiens
ttggctttagacctgagactgt

SEQ ID NO: 7621010 - DNA, 22 bp, Homo sapiens
ttggctttagacctgagactgt

SEQ ID NO: 7621011 - DNA, 22 bp, Homo sapiens
ttggctttagacctgagactgt

SEQ ID NO: 7621012 - DNA, 22 bp, Homo sapiens
ttggctttagcccaaatgactg

SEQ ID NO: 7621013 - DNA, 22 bp, Homo sapiens
ttggctttagcccaaatgactg

SEQ ID NO: 7621014 - DNA, 18 bp, Homo sapiens
ttggctttgagaactggt

SEQ ID NO: 7621015 - DNA, 18 bp, Homo sapiens
ttggctttgagaactggt

SEQ ID NO: 7621016 - DNA, 18 bp, Homo sapiens
ttggctttgagaactggt

SEQ ID NO: 7621017 - DNA, 18 bp, Homo sapiens
ttggctttgagaactggt

SEQ ID NO: 7621018 - DNA, 22 bp, Homo sapiens
ttggcttttatgcagcttaggt

SEQ ID NO: 7621019 - DNA, 22 bp, Homo sapiens
ttgggaaacagtatagctaaca

SEQ ID NO: 7621020 - DNA, 22 bp, Homo sapiens
ttggctttggtctggatgccag

SEQ ID NO: 7621021 - DNA, 22 bp, Homo sapiens
ttggctttgtgagagggcttgg

SEQ ID NO: 7621022 - DNA, 22 bp, Homo sapiens
ttggctttgtgatggtagaact

SEQ ID NO: 7621023 - DNA, 22 bp, Homo sapiens
ttggctgttttatctcctggtg

SEQ ID NO: 7621024 - DNA, 22 bp, Homo sapiens
ttggcttcaatgtcagagacag

SEQ ID NO: 7621025 - DNA, 22 bp, Homo sapiens
ttggcttccaggatctcagcag

SEQ ID NO: 7621026 - DNA, 22 bp, Homo sapiens
ttggcttcaatgtcagagacag

SEQ ID NO: 7621027 - DNA, 22 bp, Homo sapiens
ttggcttcaatgtcagagacag

SEQ ID NO: 7621028 - DNA, 22 bp, Homo sapiens
ttggcttcattgatctcacttt

SEQ ID NO: 7621029 - DNA, 22 bp, Homo sapiens
ttggcttcaatgtcagagacag

SEQ ID NO: 7621030 - DNA, 22 bp, Homo sapiens
ttggcttccaggggcttttaca

SEQ ID NO: 7621031 - DNA, 22 bp, Homo sapiens
ttggcttccaggatctcagcag

SEQ ID NO: 7621032 - DNA, 22 bp, Homo sapiens
ttggcttcattgatctcacttt

SEQ ID NO: 7621033 - DNA, 22 bp, Homo sapiens
ttggcttccaggggcttttaca

SEQ ID NO: 7621034 - DNA, 22 bp, Homo sapiens
ttggcttccaggggcttttaca

SEQ ID NO: 7621035 - DNA, 22 bp, Homo sapiens
ttggcttctgatgtattcctga

SEQ ID NO: 7621036 - DNA, 22 bp, Homo sapiens
ttggcttctcttaaccctaaag

SEQ ID NO: 7621037 - DNA, 22 bp, Homo sapiens
ttggcttctgatgtattcctga

SEQ ID NO: 7621038 - DNA, 22 bp, Homo sapiens
ttggcttctcttaaccctaaag

SEQ ID NO: 7621039 - DNA, 22 bp, Homo sapiens
ttggcttcctgcacttgagttt

SEQ ID NO: 7621040 - DNA, 22 bp, Homo sapiens
ttggcttcctgcacttgagttt

SEQ ID NO: 7621041 - DNA, 22 bp, Homo sapiens
ttggcttctgttttggctctgt

SEQ ID NO: 7621042 - DNA, 22 bp, Homo sapiens
ttggcttctgatgtattcctga

SEQ ID NO: 7621043 - DNA, 22 bp, Homo sapiens
ttggcttctggcagtctggacg

SEQ ID NO: 7621044 - DNA, 22 bp, Homo sapiens
ttggcttcttataatgcaatag

SEQ ID NO: 7621045 - DNA, 22 bp, Homo sapiens
ttggcttctgttttggctctgt

SEQ ID NO: 7621046 - DNA, 22 bp, Homo sapiens
ttggcttctgttttggctctgt

SEQ ID NO: 7621047 - DNA, 22 bp, Homo sapiens
ttggcttcttataatgcaatag

SEQ ID NO: 7621048 - DNA, 22 bp, Homo sapiens
ttggcttcttataatgcaatag

SEQ ID NO: 7621049 - DNA, 22 bp, Homo sapiens
ttggcttcttcgcacagcagta

SEQ ID NO: 7621050 - DNA, 22 bp, Homo sapiens
ttggcttcttgtgaaatctgag

SEQ ID NO: 7621051 - DNA, 22 bp, Homo sapiens
ttggcttcttgtgaaatctgag

SEQ ID NO: 7621052 - DNA, 22 bp, Homo sapiens
ttggcttgatgactggcagtgt

SEQ ID NO: 7621053 - DNA, 22 bp, Homo sapiens
ttggcttgatgactggcagtgt

SEQ ID NO: 7621054 - DNA, 22 bp, Homo sapiens
ttggcttcttttctagacagaa

SEQ ID NO: 7621055 - DNA, 22 bp, Homo sapiens
ttggcttgatgactggcagtgt

SEQ ID NO: 7621056 - DNA, 22 bp, Homo sapiens
ttggcttgttaaaaatgcaatt

SEQ ID NO: 7621057 - DNA, 22 bp, Homo sapiens
ttggcttgttaaaaatgcaatt

SEQ ID NO: 7621058 - DNA, 22 bp, Homo sapiens
ttggctttacaagcagtggcac

SEQ ID NO: 7621059 - DNA, 22 bp, Homo sapiens
ttggcttcttttctagacagaa

SEQ ID NO: 7621060 - DNA, 22 bp, Homo sapiens
ttggcttctttagtcagtttgg

SEQ ID NO: 7621061 - DNA, 18 bp, Homo sapiens
ttggcttctttccttcct

SEQ ID NO: 7621062 - DNA, 22 bp, Homo sapiens
ttggcttctttagtcagtttgg

SEQ ID NO: 7621063 - DNA, 22 bp, Homo sapiens
ttggcttctttagtcagtttgg

SEQ ID NO: 7621064 - DNA, 22 bp, Homo sapiens
ttgtatttcctataacctttct

SEQ ID NO: 7621065 - DNA, 22 bp, Homo sapiens
ttgtatttcctataacctttct

SEQ ID NO: 7621066 - DNA, 22 bp, Homo sapiens
ttgtatttcctataacctttct

SEQ ID NO: 7621067 - DNA, 22 bp, Homo sapiens
ttgtatttcctataacctttct

SEQ ID NO: 7621068 - DNA, 22 bp, Homo sapiens
ttgtatttcctataacctttct

SEQ ID NO: 7621069 - DNA, 22 bp, Homo sapiens
ttgtatttatattgaatagctt

SEQ ID NO: 7621070 - DNA, 22 bp, Homo sapiens
ttgtatttatattgaatagctt

SEQ ID NO: 7621071 - DNA, 22 bp, Homo sapiens
ttgtatttatattgaatagctt

SEQ ID NO: 7621072 - DNA, 22 bp, Homo sapiens
ttgtatttatattgaatagctt

SEQ ID NO: 7621073 - DNA, 22 bp, Homo sapiens
ttgtatttatattgaatagctt

SEQ ID NO: 7621074 - DNA, 22 bp, Homo sapiens
ttgtatttatattgaatagctt

SEQ ID NO: 7621075 - DNA, 22 bp, Homo sapiens
ttgtattctttatgacttccct

SEQ ID NO: 7621076 - DNA, 22 bp, Homo sapiens
ttgtattcttccttagcagtac

SEQ ID NO: 7621077 - DNA, 22 bp, Homo sapiens
ttgtattcttccttagcagtac

SEQ ID NO: 7621078 - DNA, 22 bp, Homo sapiens
ttgtattcttccttagcagtac

SEQ ID NO: 7621079 - DNA, 22 bp, Homo sapiens
ttgtattcttccttagcagtac

SEQ ID NO: 7621080 - DNA, 22 bp, Homo sapiens
ttgtattccagccaccacaggc

SEQ ID NO: 7621081 - DNA, 20 bp, Homo sapiens
ttgtattccttgaatcaggt

SEQ ID NO: 7621082 - DNA, 20 bp, Homo sapiens
ttgtattccttgaatcaggt

SEQ ID NO: 7621083 - DNA, 22 bp, Homo sapiens
ttgtattcctgggtcaaggaga

SEQ ID NO: 7621084 - DNA, 20 bp, Homo sapiens
ttgtattccttgaatcaggt

SEQ ID NO: 7621085 - DNA, 22 bp, Homo sapiens
ttgtattctgttacagcaacat

SEQ ID NO: 7621086 - DNA, 20 bp, Homo sapiens
ttgtattccttgaatcaggt

SEQ ID NO: 7621087 - DNA, 22 bp, Homo sapiens
ttgtattctgttacagcaacat

SEQ ID NO: 7621088 - DNA, 22 bp, Homo sapiens
ttgtattagctgtaaattttct

SEQ ID NO: 7621089 - DNA, 22 bp, Homo sapiens
ttgtattaggccctagggagtt

SEQ ID NO: 7621090 - DNA, 22 bp, Homo sapiens
ttgtatgtttctgtgcacatga

SEQ ID NO: 7621091 - DNA, 22 bp, Homo sapiens
ttgtattagctgtaaattttct

SEQ ID NO: 7621092 - DNA, 22 bp, Homo sapiens
ttgtattagctgtaaattttct

SEQ ID NO: 7621093 - DNA, 22 bp, Homo sapiens
ttgtattagctgtaaattttct

SEQ ID NO: 7621094 - DNA, 22 bp, Homo sapiens
ttgtattagtaagtcagctgct

SEQ ID NO: 7621095 - DNA, 22 bp, Homo sapiens
ttgtattagtaagtcagctgct

SEQ ID NO: 7621096 - DNA, 22 bp, Homo sapiens
ttgtattcattgcttacccaat

SEQ ID NO: 7621097 - DNA, 22 bp, Homo sapiens
ttgtattcatttggccatactg

SEQ ID NO: 7621098 - DNA, 22 bp, Homo sapiens
ttgtattccagccaccacaggc

SEQ ID NO: 7621099 - DNA, 22 bp, Homo sapiens
ttgtattaattgaaatgaatgc

SEQ ID NO: 7621100 - DNA, 22 bp, Homo sapiens
ttgtattaattgaaatgaatgc

SEQ ID NO: 7621101 - DNA, 22 bp, Homo sapiens
ttgtattaattgaaatgaatgc

SEQ ID NO: 7621102 - DNA, 22 bp, Homo sapiens
ttgtattaattgaaatgaatgc

SEQ ID NO: 7621103 - DNA, 22 bp, Homo sapiens
ttgtatgtttctgtgcacatga

SEQ ID NO: 7621104 - DNA, 22 bp, Homo sapiens
ttgtattaattgaaatgaatgc

SEQ ID NO: 7621105 - DNA, 22 bp, Homo sapiens
ttgtattaaaatgtgtttctgt

SEQ ID NO: 7621106 - DNA, 22 bp, Homo sapiens
ttgtatgatcccatttagtgaa

SEQ ID NO: 7621107 - DNA, 21 bp, Homo sapiens
ttgtatgcatacatacacaca

SEQ ID NO: 7621108 - DNA, 22 bp, Homo sapiens
ttgtatgagtatggtgtatagg

SEQ ID NO: 7621109 - DNA, 22 bp, Homo sapiens
ttgtatgatcaaaagaaatgta

SEQ ID NO: 7621110 - DNA, 22 bp, Homo sapiens
ttgtatgtaccacaggtggtgg

SEQ ID NO: 7621111 - DNA, 22 bp, Homo sapiens
ttgtatggatttgtgggtgagt

SEQ ID NO: 7621112 - DNA, 22 bp, Homo sapiens
ttgtatgtaccacaggtggtgg

SEQ ID NO: 7621113 - DNA, 22 bp, Homo sapiens
ttgtatgtaccacaggtggtgg

SEQ ID NO: 7621114 - DNA, 22 bp, Homo sapiens
ttgtatgtttctgtgcacatga

SEQ ID NO: 7621115 - DNA, 22 bp, Homo sapiens
ttgtatgtggcaaatgggggag

SEQ ID NO: 7621116 - DNA, 22 bp, Homo sapiens
ttgtatgtggcaaatgggggag

SEQ ID NO: 7621117 - DNA, 22 bp, Homo sapiens
ttgtatgtctcaatatcctgtc

SEQ ID NO: 7621118 - DNA, 22 bp, Homo sapiens
ttgtatgtctcaatatcctgtc

SEQ ID NO: 7621119 - DNA, 22 bp, Homo sapiens
ttgtatgtctcaatatcctgtc

SEQ ID NO: 7621120 - DNA, 23 bp, Homo sapiens
ttgtatctctggaaattcttcaa

SEQ ID NO: 7621121 - DNA, 23 bp, Homo sapiens
ttgtatctctggaaattcttcaa

SEQ ID NO: 7621122 - DNA, 22 bp, Homo sapiens
ttgtatcagtgcctataaaatg

SEQ ID NO: 7621123 - DNA, 22 bp, Homo sapiens
ttgtatcatcattatcagtctg

SEQ ID NO: 7621124 - DNA, 22 bp, Homo sapiens
ttgtatcatcattatcagtctg

SEQ ID NO: 7621125 - DNA, 22 bp, Homo sapiens
ttgtatcagttagctattgctg

SEQ ID NO: 7621126 - DNA, 22 bp, Homo sapiens
ttgtatcaatgccaggagaaat

SEQ ID NO: 7621127 - DNA, 22 bp, Homo sapiens
ttgtatatattcttaaagatgt

SEQ ID NO: 7621128 - DNA, 22 bp, Homo sapiens
ttgtatcagtgcctataaaatg

SEQ ID NO: 7621129 - DNA, 22 bp, Homo sapiens
ttgtatcagtgcctataaaatg

SEQ ID NO: 7621130 - DNA, 22 bp, Homo sapiens
ttgtatatattcttaaagatgt

SEQ ID NO: 7621131 - DNA, 22 bp, Homo sapiens
ttgtatatattcttaaagatgt

SEQ ID NO: 7621132 - DNA, 22 bp, Homo sapiens
ttgtatatattcttaaagatgt

SEQ ID NO: 7621133 - DNA, 22 bp, Homo sapiens
ttgtatatattcttaaagatgt

SEQ ID NO: 7621134 - DNA, 22 bp, Homo sapiens
ttgtataagaagttggcagata

SEQ ID NO: 7621135 - DNA, 22 bp, Homo sapiens
ttgtataagaagttggcagata

SEQ ID NO: 7621136 - DNA, 22 bp, Homo sapiens
ttgtataagaagttggcagata

SEQ ID NO: 7621137 - DNA, 22 bp, Homo sapiens
ttgtagtggccaaagaactctt

SEQ ID NO: 7621138 - DNA, 22 bp, Homo sapiens
ttgtatagcccagagagtgaga

SEQ ID NO: 7621139 - DNA, 22 bp, Homo sapiens
ttgtatagcccagagagtgaga

SEQ ID NO: 7621140 - DNA, 22 bp, Homo sapiens
ttgtatagcccagagagtgaga

SEQ ID NO: 7621141 - DNA, 22 bp, Homo sapiens
ttgtatagcccagagagtgaga

SEQ ID NO: 7621142 - DNA, 22 bp, Homo sapiens
ttgtactgcacccctgggaatg

SEQ ID NO: 7621143 - DNA, 22 bp, Homo sapiens
ttgtactatgtctaagtcactg

SEQ ID NO: 7621144 - DNA, 22 bp, Homo sapiens
ttgtactgatatgaagaatcaa

SEQ ID NO: 7621145 - DNA, 22 bp, Homo sapiens
ttgtactatgtctaagtcactg

SEQ ID NO: 7621146 - DNA, 18 bp, Homo sapiens
ttggggtgaggccaggaa

SEQ ID NO: 7621147 - DNA, 18 bp, Homo sapiens
ttggggtgaggccaggaa

SEQ ID NO: 7621148 - DNA, 18 bp, Homo sapiens
ttggggtgaggccaggaa

SEQ ID NO: 7621149 - DNA, 18 bp, Homo sapiens
ttggggtgaggccaggaa

SEQ ID NO: 7621150 - DNA, 18 bp, Homo sapiens
ttggggtgaggccaggaa

SEQ ID NO: 7621151 - DNA, 19 bp, Homo sapiens
ttggggtgaatgccagaca

SEQ ID NO: 7621152 - DNA, 19 bp, Homo sapiens
ttggggtgaatgccagaca

SEQ ID NO: 7621153 - DNA, 22 bp, Homo sapiens
ttggggtcccacaggctgcctg

SEQ ID NO: 7621154 - DNA, 22 bp, Homo sapiens
ttggggtcccacaggctgcctg

SEQ ID NO: 7621155 - DNA, 22 bp, Homo sapiens
ttggggtatggagtttaaaagt

SEQ ID NO: 7621156 - DNA, 22 bp, Homo sapiens
ttggggtacgcaggtctgggag

SEQ ID NO: 7621157 - DNA, 22 bp, Homo sapiens
ttggggtacgcaggtctgggag

SEQ ID NO: 7621158 - DNA, 22 bp, Homo sapiens
ttggggtaaggaaatatggctt

SEQ ID NO: 7621159 - DNA, 22 bp, Homo sapiens
ttggggtacgcaggtctgggag

SEQ ID NO: 7621160 - DNA, 22 bp, Homo sapiens
ttggggggttgaggagtagata

SEQ ID NO: 7621161 - DNA, 22 bp, Homo sapiens
ttggggggttgaggagtagata

SEQ ID NO: 7621162 - DNA, 22 bp, Homo sapiens
ttggggggttgaggagtagata

SEQ ID NO: 7621163 - DNA, 22 bp, Homo sapiens
ttgggggcagagggagcatctg

SEQ ID NO: 7621164 - DNA, 22 bp, Homo sapiens
ttgggggcagagggagcatctg

SEQ ID NO: 7621165 - DNA, 22 bp, Homo sapiens
ttgggggcagagggagcatctg

SEQ ID NO: 7621166 - DNA, 22 bp, Homo sapiens
ttgggggaagaggatagacagt

SEQ ID NO: 7621167 - DNA, 22 bp, Homo sapiens
ttgggggcatattgagtagtgg

SEQ ID NO: 7621168 - DNA, 22 bp, Homo sapiens
ttgggggcatattgagtagtgg

SEQ ID NO: 7621169 - DNA, 22 bp, Homo sapiens
ttgggggcatattgagtagtgg

SEQ ID NO: 7621170 - DNA, 22 bp, Homo sapiens
ttgggggcatattgagtagtgg

SEQ ID NO: 7621171 - DNA, 22 bp, Homo sapiens
ttgggggcagagggagcatctg

SEQ ID NO: 7621172 - DNA, 20 bp, Homo sapiens
ttggggcatccaccgaatgg

SEQ ID NO: 7621173 - DNA, 20 bp, Homo sapiens
ttggggcatccaccgaatgg

SEQ ID NO: 7621174 - DNA, 22 bp, Homo sapiens
ttggggcagttattctgtgccc

SEQ ID NO: 7621175 - DNA, 22 bp, Homo sapiens
ttggggctcaggccgccgatgc

SEQ ID NO: 7621176 - DNA, 22 bp, Homo sapiens
ttggggcatgattagattatga

SEQ ID NO: 7621177 - DNA, 22 bp, Homo sapiens
ttggggcatgattagattatga

SEQ ID NO: 7621178 - DNA, 22 bp, Homo sapiens
ttggggctctgaaaaagatgta

SEQ ID NO: 7621179 - DNA, 22 bp, Homo sapiens
ttgggggaagaggatagacagt

SEQ ID NO: 7621180 - DNA, 22 bp, Homo sapiens
ttgggggaagaggatagacagt

SEQ ID NO: 7621181 - DNA, 22 bp, Homo sapiens
ttgtactgtggatctgtatttg

SEQ ID NO: 7621182 - DNA, 22 bp, Homo sapiens
ttgtactggttttgaaatgagc

SEQ ID NO: 7621183 - DNA, 22 bp, Homo sapiens
ttgtacttaaatatgcaaatag

SEQ ID NO: 7621184 - DNA, 22 bp, Homo sapiens
ttgtacttaaatatgcaaatag

SEQ ID NO: 7621185 - DNA, 22 bp, Homo sapiens
ttgtacttaaatatgcaaatag

SEQ ID NO: 7621186 - DNA, 22 bp, Homo sapiens
ttgtacttacattttaaagcta

SEQ ID NO: 7621187 - DNA, 22 bp, Homo sapiens
ttgtacttgccatagaacaaca

SEQ ID NO: 7621188 - DNA, 22 bp, Homo sapiens
ttgtacttccagacctagcagg

SEQ ID NO: 7621189 - DNA, 22 bp, Homo sapiens
ttgtactttggggaaatgttga

SEQ ID NO: 7621190 - DNA, 22 bp, Homo sapiens
ttgtactttggggaaatgttga

SEQ ID NO: 7621191 - DNA, 22 bp, Homo sapiens
ttgtactttggggaaatgttga

SEQ ID NO: 7621192 - DNA, 22 bp, Homo sapiens
ttgtacttttgtcaggtggaca

SEQ ID NO: 7621193 - DNA, 22 bp, Homo sapiens
ttgtacttttgtcaggtggaca

SEQ ID NO: 7621194 - DNA, 22 bp, Homo sapiens
ttgtagaaaattagatgcatgg

SEQ ID NO: 7621195 - DNA, 22 bp, Homo sapiens
ttgtagaaaattagatgcatgg

SEQ ID NO: 7621196 - DNA, 22 bp, Homo sapiens
ttgtagaacatgcagcacaatg

SEQ ID NO: 7621197 - DNA, 22 bp, Homo sapiens
ttgtagaaaattctcttggata

SEQ ID NO: 7621198 - DNA, 22 bp, Homo sapiens
ttgtagaacatgcagcacaatg

SEQ ID NO: 7621199 - DNA, 22 bp, Homo sapiens
ttgtagaatcattatttctagt

SEQ ID NO: 7621200 - DNA, 22 bp, Homo sapiens
ttgtagaacatgcagcacaatg

SEQ ID NO: 7621201 - DNA, 22 bp, Homo sapiens
ttgtagattggagagtgtgtga

SEQ ID NO: 7621202 - DNA, 18 bp, Homo sapiens
ttgtagcaaatggcagtg

SEQ ID NO: 7621203 - DNA, 22 bp, Homo sapiens
ttgtagcatcaatcagtacttt

SEQ ID NO: 7621204 - DNA, 22 bp, Homo sapiens
ttgtagcaagcttgtaagttca

SEQ ID NO: 7621205 - DNA, 22 bp, Homo sapiens
ttgtagctaggtttttgtagaa

SEQ ID NO: 7621206 - DNA, 22 bp, Homo sapiens
ttgtagctaggtttttgtagaa

SEQ ID NO: 7621207 - DNA, 22 bp, Homo sapiens
ttgtagctgaaagtaaagaagt

SEQ ID NO: 7621208 - DNA, 21 bp, Homo sapiens
ttgtagcttgttagaccatgt

SEQ ID NO: 7621209 - DNA, 22 bp, Homo sapiens
ttgtagaggaaagggaatggat

SEQ ID NO: 7621210 - DNA, 22 bp, Homo sapiens
ttgtagagggctactttgtgct

SEQ ID NO: 7621211 - DNA, 22 bp, Homo sapiens
ttgtagagtacacaacacttgg

SEQ ID NO: 7621212 - DNA, 22 bp, Homo sapiens
ttgtagacatctgtatcatttt

SEQ ID NO: 7621213 - DNA, 22 bp, Homo sapiens
ttgtagaggaaagggaatggat

SEQ ID NO: 7621214 - DNA, 22 bp, Homo sapiens
ttgtagaatttggatctcggca

SEQ ID NO: 7621215 - DNA, 22 bp, Homo sapiens
ttgtagaatcattatttctagt

SEQ ID NO: 7621216 - DNA, 22 bp, Homo sapiens
ttgtagaatcattatttctagt

SEQ ID NO: 7621217 - DNA, 19 bp, Homo sapiens
ttgtgcatatgcagtgcat

SEQ ID NO: 7621218 - DNA, 22 bp, Homo sapiens
ttgtgcatattaggtacatgct

SEQ ID NO: 7621219 - DNA, 22 bp, Homo sapiens
ttgtgcatctcatggtgggcca

SEQ ID NO: 7621220 - DNA, 22 bp, Homo sapiens
ttgtgcagagaaatctttcttg

SEQ ID NO: 7621221 - DNA, 22 bp, Homo sapiens
ttgtgcagagttgcctttattt

SEQ ID NO: 7621222 - DNA, 22 bp, Homo sapiens
ttgtgcagctataaagaaatgg

SEQ ID NO: 7621223 - DNA, 22 bp, Homo sapiens
ttgtgcagagttgcctttattt

SEQ ID NO: 7621224 - DNA, 22 bp, Homo sapiens
ttgtgcatttctctgagtgtgt

SEQ ID NO: 7621225 - DNA, 22 bp, Homo sapiens
ttgtgcattgcagcagtgcttt

SEQ ID NO: 7621226 - DNA, 22 bp, Homo sapiens
ttgtgcattagggaaaggaact

SEQ ID NO: 7621227 - DNA, 22 bp, Homo sapiens
ttgtgcatggagaaggcagggc

SEQ ID NO: 7621228 - DNA, 22 bp, Homo sapiens
ttgtgcatggagaaggcagggc

SEQ ID NO: 7621229 - DNA, 22 bp, Homo sapiens
ttgtgcatgcatacgtatgtgt

SEQ ID NO: 7621230 - DNA, 22 bp, Homo sapiens
ttgtgctaagtgctatgaaggc

SEQ ID NO: 7621231 - DNA, 22 bp, Homo sapiens
ttgtgctaagtgctatgaaggc

SEQ ID NO: 7621232 - DNA, 22 bp, Homo sapiens
ttgtgcctggcttgtattcaca

SEQ ID NO: 7621233 - DNA, 22 bp, Homo sapiens
ttgtgcccgggcccgggcctct

SEQ ID NO: 7621234 - DNA, 22 bp, Homo sapiens
ttgtgctcctatgagaatctaa

SEQ ID NO: 7621235 - DNA, 22 bp, Homo sapiens
ttgtgctccctcccgtctggcc

SEQ ID NO: 7621236 - DNA, 22 bp, Homo sapiens
ttgtgctcctatgagaatctaa

SEQ ID NO: 7621237 - DNA, 22 bp, Homo sapiens
ttgtgctcctatgagaatctaa

SEQ ID NO: 7621238 - DNA, 22 bp, Homo sapiens
ttgtgctagaaccagtacagaa

SEQ ID NO: 7621239 - DNA, 22 bp, Homo sapiens
ttgtgccattaataaggagttg

SEQ ID NO: 7621240 - DNA, 22 bp, Homo sapiens
ttgtgccatgaactgtatgaag

SEQ ID NO: 7621241 - DNA, 22 bp, Homo sapiens
ttgtgccataaccaccctgact

SEQ ID NO: 7621242 - DNA, 22 bp, Homo sapiens
ttgtgccagagaaagcacaaga

SEQ ID NO: 7621243 - DNA, 19 bp, Homo sapiens
ttgtgccaagggtcagaag

SEQ ID NO: 7621244 - DNA, 22 bp, Homo sapiens
ttgtgccaagaacatggaattt

SEQ ID NO: 7621245 - DNA, 22 bp, Homo sapiens
ttgtgcatttctctgagtgtgt

SEQ ID NO: 7621246 - DNA, 22 bp, Homo sapiens
ttgtgcaagaattggaaagcaa

SEQ ID NO: 7621247 - DNA, 22 bp, Homo sapiens
ttgtgcaaagggggttaatcat

SEQ ID NO: 7621248 - DNA, 22 bp, Homo sapiens
ttgtgagtagtgccgcaataaa

SEQ ID NO: 7621249 - DNA, 22 bp, Homo sapiens
ttgtgataaaacattagacatt

SEQ ID NO: 7621250 - DNA, 22 bp, Homo sapiens
ttgtgataacagaattcactct

SEQ ID NO: 7621251 - DNA, 22 bp, Homo sapiens
ttgtgatactgagcttggcatt

SEQ ID NO: 7621252 - DNA, 22 bp, Homo sapiens
ttgtgcaatagttttctcatga

SEQ ID NO: 7621253 - DNA, 22 bp, Homo sapiens
ttgtgcaatagttttctcatga

SEQ ID NO: 7621254 - DNA, 22 bp, Homo sapiens
ttgtgagagtttaccttgacca

SEQ ID NO: 7621255 - DNA, 22 bp, Homo sapiens
ttgtgagagccaaacatgtaag

SEQ ID NO: 7621256 - DNA, 22 bp, Homo sapiens
ttgtgagagccaaacatgtaag

SEQ ID NO: 7621257 - DNA, 22 bp, Homo sapiens
ttgtgagagaaaatgtgtatat

SEQ ID NO: 7621258 - DNA, 22 bp, Homo sapiens
ttgtgagactcgtaagagaagg

SEQ ID NO: 7621259 - DNA, 22 bp, Homo sapiens
ttgtgagactcgtaagagaagg

SEQ ID NO: 7621260 - DNA, 23 bp, Homo sapiens
ttgtgagaccttggaagaagtat

SEQ ID NO: 7621261 - DNA, 22 bp, Homo sapiens
ttgtgagacacaaatcaatgca

SEQ ID NO: 7621262 - DNA, 22 bp, Homo sapiens
ttgtatttcctataacctttct

SEQ ID NO: 7621263 - DNA, 22 bp, Homo sapiens
ttgtgagatgatttgaaagtgt

SEQ ID NO: 7621264 - DNA, 22 bp, Homo sapiens
ttgtgagatgtctactgaagaa

SEQ ID NO: 7621265 - DNA, 22 bp, Homo sapiens
ttgtgagatgtctactgaagaa

SEQ ID NO: 7621266 - DNA, 22 bp, Homo sapiens
ttgtgagatgatttgaaagtgt

SEQ ID NO: 7621267 - DNA, 22 bp, Homo sapiens
ttgtgagagtttaccttgacca

SEQ ID NO: 7621268 - DNA, 22 bp, Homo sapiens
ttgtgagatgatttgaaagtgt

SEQ ID NO: 7621269 - DNA, 22 bp, Homo sapiens
ttgtgagtagtgccgcaataaa

SEQ ID NO: 7621270 - DNA, 22 bp, Homo sapiens
ttgtgagtagtgccgcaataaa

SEQ ID NO: 7621271 - DNA, 22 bp, Homo sapiens
ttgtgagtagtgccgcaataaa

SEQ ID NO: 7621272 - DNA, 22 bp, Homo sapiens
ttgtgctcctgtgagaatctag

SEQ ID NO: 7621273 - DNA, 22 bp, Homo sapiens
ttgtgctcctatgagaatctaa

SEQ ID NO: 7621274 - DNA, 22 bp, Homo sapiens
ttgtgctcctatgagaatctaa

SEQ ID NO: 7621275 - DNA, 22 bp, Homo sapiens
ttgtgctcctatgagaatctaa

SEQ ID NO: 7621276 - DNA, 22 bp, Homo sapiens
ttgtgctcctgtgagaatctag

SEQ ID NO: 7621277 - DNA, 22 bp, Homo sapiens
ttgtgctcctgtgagaatctag

SEQ ID NO: 7621278 - DNA, 22 bp, Homo sapiens
ttgtgctcctgtgagaatctag

SEQ ID NO: 7621279 - DNA, 22 bp, Homo sapiens
ttgtgctcctgtgagaatctag

SEQ ID NO: 7621280 - DNA, 22 bp, Homo sapiens
ttgtgctcctgtgagaatctag

SEQ ID NO: 7621281 - DNA, 22 bp, Homo sapiens
ttgtgctgactgcgcccagctc

SEQ ID NO: 7621282 - DNA, 22 bp, Homo sapiens
ttgtgctctgtgttatttaagg

SEQ ID NO: 7621283 - DNA, 22 bp, Homo sapiens
ttgtgctgagcttctagctgtg

SEQ ID NO: 7621284 - DNA, 22 bp, Homo sapiens
ttgtgctgagcttctagctgtg

SEQ ID NO: 7621285 - DNA, 22 bp, Homo sapiens
ttgtgctgactgcgcccagctc

SEQ ID NO: 7621286 - DNA, 22 bp, Homo sapiens
ttgtgctctgtgttatttaagg

SEQ ID NO: 7621287 - DNA, 22 bp, Homo sapiens
ttgtgctctaaggtcagggcga

SEQ ID NO: 7621288 - DNA, 22 bp, Homo sapiens
ttgtgctctgtgttatttaagg

SEQ ID NO: 7621289 - DNA, 22 bp, Homo sapiens
ttgtgctctgtgttatttaagg

SEQ ID NO: 7621290 - DNA, 22 bp, Homo sapiens
ttgtgctctgtgttatttaagg

SEQ ID NO: 7621291 - DNA, 22 bp, Homo sapiens
ttgtgctctgtgttatttaagg

SEQ ID NO: 7621292 - DNA, 22 bp, Homo sapiens
ttgtgctgctgacttaagatat

SEQ ID NO: 7621293 - DNA, 22 bp, Homo sapiens
ttgtgctgcgtaggacgtggac

SEQ ID NO: 7621294 - DNA, 22 bp, Homo sapiens
ttgtgctgtatcatatttgtat

SEQ ID NO: 7621295 - DNA, 22 bp, Homo sapiens
ttgtgctgcgtaggacgtggac

SEQ ID NO: 7621296 - DNA, 22 bp, Homo sapiens
ttgtgctgtgagaatgctcatt

SEQ ID NO: 7621297 - DNA, 22 bp, Homo sapiens
ttgtgctgctgacttaagatat

SEQ ID NO: 7621298 - DNA, 22 bp, Homo sapiens
ttgtgctgtgagaatgctcatt

SEQ ID NO: 7621299 - DNA, 22 bp, Homo sapiens
ttgtgctgtatcatatttgtat

SEQ ID NO: 7621300 - DNA, 22 bp, Homo sapiens
ttgtgcttttgagctgagatga

SEQ ID NO: 7621301 - DNA, 22 bp, Homo sapiens
ttgtgcttttctagggatgagg

SEQ ID NO: 7621302 - DNA, 22 bp, Homo sapiens
ttgtgctttggaacagaatcct

SEQ ID NO: 7621303 - DNA, 22 bp, Homo sapiens
ttgtgcttgccctggaggtgcg

SEQ ID NO: 7621304 - DNA, 22 bp, Homo sapiens
ttgtgcttaagcaagctttctt

SEQ ID NO: 7621305 - DNA, 22 bp, Homo sapiens
ttgtggaagccctatgagagac

SEQ ID NO: 7621306 - DNA, 22 bp, Homo sapiens
ttgtggaagccctatgagagac

SEQ ID NO: 7621307 - DNA, 22 bp, Homo sapiens
ttgtggaaatacagactccaag

SEQ ID NO: 7621308 - DNA, 22 bp, Homo sapiens
ttgtgctttggaacagaatcct

SEQ ID NO: 7621309 - DNA, 23 bp, Homo sapiens
ttgtggaagggagatggcaacag

SEQ ID NO: 7621310 - DNA, 22 bp, Homo sapiens
ttgtggaagccctatgagagac

SEQ ID NO: 7621311 - DNA, 22 bp, Homo sapiens
ttgtggaagccctatgagagac

SEQ ID NO: 7621312 - DNA, 22 bp, Homo sapiens
ttgttcaggaggggaatgtgag

SEQ ID NO: 7621313 - DNA, 22 bp, Homo sapiens
ttgttcaggcctgggacagttt

SEQ ID NO: 7621314 - DNA, 22 bp, Homo sapiens
ttgttcataaagacagttcaga

SEQ ID NO: 7621315 - DNA, 22 bp, Homo sapiens
ttgttcagtagagagattatta

SEQ ID NO: 7621316 - DNA, 22 bp, Homo sapiens
ttgttcagtagagagattatta

SEQ ID NO: 7621317 - DNA, 22 bp, Homo sapiens
ttgttcagaagtttaaagaatt

SEQ ID NO: 7621318 - DNA, 22 bp, Homo sapiens
ttgttcagaagtttaaagaatt

SEQ ID NO: 7621319 - DNA, 22 bp, Homo sapiens
ttgttcagaaatttggactcct

SEQ ID NO: 7621320 - DNA, 22 bp, Homo sapiens
ttgttcatcaggtgacacatac

SEQ ID NO: 7621321 - DNA, 22 bp, Homo sapiens
ttgttcatcaggtgacacatac

SEQ ID NO: 7621322 - DNA, 22 bp, Homo sapiens
ttgttcataaagacagttcaga

SEQ ID NO: 7621323 - DNA, 22 bp, Homo sapiens
ttgttcatcaggtgacacatac

SEQ ID NO: 7621324 - DNA, 22 bp, Homo sapiens
ttgttcatcaggtgacacatac

SEQ ID NO: 7621325 - DNA, 23 bp, Homo sapiens
ttgtggagtggttgttttctagg

SEQ ID NO: 7621326 - DNA, 22 bp, Homo sapiens
ttgtggattctatttcccagaa

SEQ ID NO: 7621327 - DNA, 22 bp, Homo sapiens
ttgtggcagaccatgagtctaa

SEQ ID NO: 7621328 - DNA, 22 bp, Homo sapiens
ttgtggcagaccatgagtctaa

SEQ ID NO: 7621329 - DNA, 22 bp, Homo sapiens
ttgtggattgtgttaaattcct

SEQ ID NO: 7621330 - DNA, 22 bp, Homo sapiens
ttgttctatggtgaggcagcca

SEQ ID NO: 7621331 - DNA, 22 bp, Homo sapiens
ttgttctatggtgaggcagcca

SEQ ID NO: 7621332 - DNA, 22 bp, Homo sapiens
ttgttctatggtgaggcagcca

SEQ ID NO: 7621333 - DNA, 22 bp, Homo sapiens
ttgttcttacttaagagtgaat

SEQ ID NO: 7621334 - DNA, 22 bp, Homo sapiens
ttgttcttacttaagagtgaat

SEQ ID NO: 7621335 - DNA, 22 bp, Homo sapiens
ttgttccaacctaatagatgat

SEQ ID NO: 7621336 - DNA, 22 bp, Homo sapiens
ttgttcctttccatttctgagt

SEQ ID NO: 7621337 - DNA, 19 bp, Homo sapiens
ttgttcgttcctgacaggc

SEQ ID NO: 7621338 - DNA, 22 bp, Homo sapiens
ttgttcctttccatttctgagt

SEQ ID NO: 7621339 - DNA, 22 bp, Homo sapiens
ttgttctagcctcctgttttga

SEQ ID NO: 7621340 - DNA, 23 bp, Homo sapiens
ttgttctatcaacctagacttag

SEQ ID NO: 7621341 - DNA, 22 bp, Homo sapiens
ttgttctatggggtgaagtcta

SEQ ID NO: 7621342 - DNA, 22 bp, Homo sapiens
ttgttctatggggtgaagtcta

SEQ ID NO: 7621343 - DNA, 22 bp, Homo sapiens
ttgttcatctggaacccagagc

SEQ ID NO: 7621344 - DNA, 22 bp, Homo sapiens
ttgttcatctggaacccagagc

SEQ ID NO: 7621345 - DNA, 22 bp, Homo sapiens
ttgttcatcgtccttgctctgt

SEQ ID NO: 7621346 - DNA, 20 bp, Homo sapiens
ttgttcattgagctgttttc

SEQ ID NO: 7621347 - DNA, 20 bp, Homo sapiens
ttgttcattgagctgttttc

SEQ ID NO: 7621348 - DNA, 22 bp, Homo sapiens
ttgttcattagcgcttgggcac

SEQ ID NO: 7621349 - DNA, 21 bp, Homo sapiens
ttgttcctatctgcctcctgc

SEQ ID NO: 7621350 - DNA, 21 bp, Homo sapiens
ttgttcctatctgcctcctgc

SEQ ID NO: 7621351 - DNA, 22 bp, Homo sapiens
ttcatagatctcaattttgagg

SEQ ID NO: 7621352 - DNA, 22 bp, Homo sapiens
ttcatagagcagctcactgaat

SEQ ID NO: 7621353 - DNA, 22 bp, Homo sapiens
ttcatagacaggataacaggat

SEQ ID NO: 7621354 - DNA, 22 bp, Homo sapiens
ttcataggaaatagtgttcttt

SEQ ID NO: 7621355 - DNA, 22 bp, Homo sapiens
ttcataggaaaatgctggcccc

SEQ ID NO: 7621356 - DNA, 22 bp, Homo sapiens
ttcataggaaaaatgtgaggtg

SEQ ID NO: 7621357 - DNA, 22 bp, Homo sapiens
ttcataggcaccctgtctgagg

SEQ ID NO: 7621358 - DNA, 23 bp, Homo sapiens
ttcataggcacattgcgcacaga

SEQ ID NO: 7621359 - DNA, 22 bp, Homo sapiens
ttcataggatcaaaagctgttt

SEQ ID NO: 7621360 - DNA, 22 bp, Homo sapiens
ttcataggatagagtgagattt

SEQ ID NO: 7621361 - DNA, 22 bp, Homo sapiens
ttcataggagagaagaaagtgt

SEQ ID NO: 7621362 - DNA, 21 bp, Homo sapiens
ttcataggacgactgtctgtc

SEQ ID NO: 7621363 - DNA, 22 bp, Homo sapiens
ttcataggaatttaaagaggaa

SEQ ID NO: 7621364 - DNA, 22 bp, Homo sapiens
ttcatagtaacagtaactatgg

SEQ ID NO: 7621365 - DNA, 22 bp, Homo sapiens
ttcatagtaacagtaactatgg

SEQ ID NO: 7621366 - DNA, 22 bp, Homo sapiens
ttcataggtttgctgtgaacat

SEQ ID NO: 7621367 - DNA, 22 bp, Homo sapiens
ttcataggtggatgctgccagg

SEQ ID NO: 7621368 - DNA, 22 bp, Homo sapiens
ttcatagtgacatgcattctgg

SEQ ID NO: 7621369 - DNA, 22 bp, Homo sapiens
ttcatagtaacagtaactatgg

SEQ ID NO: 7621370 - DNA, 19 bp, Homo sapiens
ttcataggtgagcatacag

SEQ ID NO: 7621371 - DNA, 22 bp, Homo sapiens
ttcataggtcaaaaaacaagag

SEQ ID NO: 7621372 - DNA, 22 bp, Homo sapiens
ttcataggtacagggaatttct

SEQ ID NO: 7621373 - DNA, 22 bp, Homo sapiens
ttcatagggtatttccatagta

SEQ ID NO: 7621374 - DNA, 22 bp, Homo sapiens
ttcatagggctggggtgggagc

SEQ ID NO: 7621375 - DNA, 22 bp, Homo sapiens
ttcatagggagagtggtggaaa

SEQ ID NO: 7621376 - DNA, 22 bp, Homo sapiens
ttcataggcagcactggctcct

SEQ ID NO: 7621377 - DNA, 22 bp, Homo sapiens
ttcataggcagcactggctcct

SEQ ID NO: 7621378 - DNA, 22 bp, Homo sapiens
ttcatagtgacatgcattctgg

SEQ ID NO: 7621379 - DNA, 22 bp, Homo sapiens
ttcatagtgacatgcattctgg

SEQ ID NO: 7621380 - DNA, 22 bp, Homo sapiens
ttcatagtgattgttcagatag

SEQ ID NO: 7621381 - DNA, 22 bp, Homo sapiens
ttcatagtgattgttcagatag

SEQ ID NO: 7621382 - DNA, 22 bp, Homo sapiens
ttcatagtgcttaatttgataa

SEQ ID NO: 7621383 - DNA, 22 bp, Homo sapiens
ttcatagtgcttaatttgataa

SEQ ID NO: 7621384 - DNA, 22 bp, Homo sapiens
ttcatagtgcttaatttgataa

SEQ ID NO: 7621385 - DNA, 22 bp, Homo sapiens
ttcatagtgtttccttccagtg

SEQ ID NO: 7621386 - DNA, 22 bp, Homo sapiens
ttcatagtgtttccttccagtg

SEQ ID NO: 7621387 - DNA, 22 bp, Homo sapiens
ttcatagtgtttccttccagtg

SEQ ID NO: 7621388 - DNA, 22 bp, Homo sapiens
ttcatagtgtctttgctctctg

SEQ ID NO: 7621389 - DNA, 22 bp, Homo sapiens
ttcatagtgtctttgctctctg

SEQ ID NO: 7621390 - DNA, 22 bp, Homo sapiens
ttcatagtgtttccttccagtg

SEQ ID NO: 7621391 - DNA, 22 bp, Homo sapiens
ttcatagtgtttccttccagtg

SEQ ID NO: 7621392 - DNA, 22 bp, Homo sapiens
ttcatagtgtttccttccagtg

SEQ ID NO: 7621393 - DNA, 22 bp, Homo sapiens
ttcatagtgtttccttccagtg

SEQ ID NO: 7621394 - DNA, 22 bp, Homo sapiens
ttcatataaatggaatcagaat

SEQ ID NO: 7621395 - DNA, 22 bp, Homo sapiens
ttcatataaatggaatcagaat

SEQ ID NO: 7621396 - DNA, 22 bp, Homo sapiens
ttcatataaatggaatcagaat

SEQ ID NO: 7621397 - DNA, 22 bp, Homo sapiens
ttcatataaatggaatcagaat

SEQ ID NO: 7621398 - DNA, 22 bp, Homo sapiens
ttcatataaatggaatcagaat

SEQ ID NO: 7621399 - DNA, 22 bp, Homo sapiens
ttcatataaatggaatcagaat

SEQ ID NO: 7621400 - DNA, 22 bp, Homo sapiens
ttcatataaatggaatcagaat

SEQ ID NO: 7621401 - DNA, 22 bp, Homo sapiens
ttcatataccttgcgtttcaca

SEQ ID NO: 7621402 - DNA, 22 bp, Homo sapiens
ttcatatatatgcactacgtac

SEQ ID NO: 7621403 - DNA, 22 bp, Homo sapiens
ttcatattatgatttgaaatgc

SEQ ID NO: 7621404 - DNA, 22 bp, Homo sapiens
ttcatatgtgaactcagtgatg

SEQ ID NO: 7621405 - DNA, 22 bp, Homo sapiens
ttcatatatatgcactacgtac

SEQ ID NO: 7621406 - DNA, 22 bp, Homo sapiens
ttcatatgcagattaacaaata

SEQ ID NO: 7621407 - DNA, 22 bp, Homo sapiens
ttcatattatgatttgaaatgc

SEQ ID NO: 7621408 - DNA, 22 bp, Homo sapiens
ttcatattatgatttgaaatgc

SEQ ID NO: 7621409 - DNA, 22 bp, Homo sapiens
ttcatattatgatttgaaatgc

SEQ ID NO: 7621410 - DNA, 22 bp, Homo sapiens
ttcatattatgatttgaaatgc

SEQ ID NO: 7621411 - DNA, 22 bp, Homo sapiens
ttcatattatgatttgaaatgc

SEQ ID NO: 7621412 - DNA, 22 bp, Homo sapiens
ttcatattatgatttgaaatgc

SEQ ID NO: 7621413 - DNA, 22 bp, Homo sapiens
ttcatattcaaatactctgctt

SEQ ID NO: 7621414 - DNA, 22 bp, Homo sapiens
ttcatattcaaatactctgctt

SEQ ID NO: 7621415 - DNA, 22 bp, Homo sapiens
ttcatattatgatttgaaatgc

SEQ ID NO: 7621416 - DNA, 22 bp, Homo sapiens
ttcatattgcttccgtggagtg

SEQ ID NO: 7621417 - DNA, 22 bp, Homo sapiens
ttcatattcaaatactctgctt

SEQ ID NO: 7621418 - DNA, 22 bp, Homo sapiens
ttcatattgcttccgtggagtg

SEQ ID NO: 7621419 - DNA, 22 bp, Homo sapiens
ttcatattcaaatactctgctt

SEQ ID NO: 7621420 - DNA, 22 bp, Homo sapiens
ttcatatttgaaacagaagtta

SEQ ID NO: 7621421 - DNA, 22 bp, Homo sapiens
ttcatatttgaaacagaagtta

SEQ ID NO: 7621422 - DNA, 22 bp, Homo sapiens
ttcatatttctttaaggacttt

SEQ ID NO: 7621423 - DNA, 20 bp, Homo sapiens
ttcatcagcaaagcacagca

SEQ ID NO: 7621424 - DNA, 20 bp, Homo sapiens
ttcatcagcaaagcacagca

SEQ ID NO: 7621425 - DNA, 22 bp, Homo sapiens
ttcatcaccttggtagcactcc

SEQ ID NO: 7621426 - DNA, 22 bp, Homo sapiens
ttcatcaccttggtagcactcc

SEQ ID NO: 7621427 - DNA, 22 bp, Homo sapiens
ttcatcaatgtgtttaataatg

SEQ ID NO: 7621428 - DNA, 22 bp, Homo sapiens
ttcatcaatgtgtttaataatg

SEQ ID NO: 7621429 - DNA, 22 bp, Homo sapiens
ttcatattttctgcttgctcac

SEQ ID NO: 7621430 - DNA, 22 bp, Homo sapiens
ttcatcaaaaggctgaggggaa

SEQ ID NO: 7621431 - DNA, 22 bp, Homo sapiens
ttcatcaaaaggctgaggggaa

SEQ ID NO: 7621432 - DNA, 22 bp, Homo sapiens
ttcagaatgctatttctgaaat

SEQ ID NO: 7621433 - DNA, 22 bp, Homo sapiens
ttcagaatgctatttctgaaat

SEQ ID NO: 7621434 - DNA, 22 bp, Homo sapiens
ttcagaatgtactgatagaaca

SEQ ID NO: 7621435 - DNA, 22 bp, Homo sapiens
ttcagaatgtactgatagaaca

SEQ ID NO: 7621436 - DNA, 22 bp, Homo sapiens
ttcagaatgattacattctggt

SEQ ID NO: 7621437 - DNA, 22 bp, Homo sapiens
ttcagaatgattacattctggt

SEQ ID NO: 7621438 - DNA, 22 bp, Homo sapiens
ttcagaatgatttcagcgagca

SEQ ID NO: 7621439 - DNA, 22 bp, Homo sapiens
ttcagaatgatttcagcgagca

SEQ ID NO: 7621440 - DNA, 22 bp, Homo sapiens
ttcagaatgatttcagcgagca

SEQ ID NO: 7621441 - DNA, 22 bp, Homo sapiens
ttcagaatgctatttctgaaat

SEQ ID NO: 7621442 - DNA, 22 bp, Homo sapiens
ttcagaatgctatttctgaaat

SEQ ID NO: 7621443 - DNA, 22 bp, Homo sapiens
ttcagaatgagaatggatgggt

SEQ ID NO: 7621444 - DNA, 22 bp, Homo sapiens
ttcagaatgattacattctggt

SEQ ID NO: 7621445 - DNA, 22 bp, Homo sapiens
ttcagaatgattacattctggt

SEQ ID NO: 7621446 - DNA, 22 bp, Homo sapiens
ttcagaatgacttatgtaaggc

SEQ ID NO: 7621447 - DNA, 22 bp, Homo sapiens
ttcagaatgacttatgtaaggc

SEQ ID NO: 7621448 - DNA, 22 bp, Homo sapiens
ttcagaatgagaatggatgggt

SEQ ID NO: 7621449 - DNA, 22 bp, Homo sapiens
ttcagaatgacttatgtaaggc

SEQ ID NO: 7621450 - DNA, 22 bp, Homo sapiens
ttcagaatgacttatgtaaggc

SEQ ID NO: 7621451 - DNA, 22 bp, Homo sapiens
ttcagaatctatgtgccagctc

SEQ ID NO: 7621452 - DNA, 22 bp, Homo sapiens
ttcagaatctatgtgccagctc

SEQ ID NO: 7621453 - DNA, 22 bp, Homo sapiens
ttcagaatctatgtgccagctc

SEQ ID NO: 7621454 - DNA, 22 bp, Homo sapiens
ttcagaatctatgtgccagctc

SEQ ID NO: 7621455 - DNA, 19 bp, Homo sapiens
ttcagaattgggaggtgat

SEQ ID NO: 7621456 - DNA, 19 bp, Homo sapiens
ttcagaattgggaggtgat

SEQ ID NO: 7621457 - DNA, 16 bp, Homo sapiens
ttcagaatttgtagaa

SEQ ID NO: 7621458 - DNA, 16 bp, Homo sapiens
ttcagaatttgtagaa

SEQ ID NO: 7621459 - DNA, 22 bp, Homo sapiens
ttcagaatgtactgatagaaca

SEQ ID NO: 7621460 - DNA, 22 bp, Homo sapiens
ttcagaatgtgaccttatttgg

SEQ ID NO: 7621461 - DNA, 22 bp, Homo sapiens
ttcagaatgtgaccttatttgg

SEQ ID NO: 7621462 - DNA, 22 bp, Homo sapiens
ttcagaatgtgaccttatttgg

SEQ ID NO: 7621463 - DNA, 22 bp, Homo sapiens
ttcagacaggcagctgggctgg

SEQ ID NO: 7621464 - DNA, 22 bp, Homo sapiens
ttcagacacagcgctgggaaat

SEQ ID NO: 7621465 - DNA, 22 bp, Homo sapiens
ttcagacaaatttgaggaagct

SEQ ID NO: 7621466 - DNA, 22 bp, Homo sapiens
ttcagacagtaagaaagaggtt

SEQ ID NO: 7621467 - DNA, 22 bp, Homo sapiens
ttcagacagtaagaaagaggtt

SEQ ID NO: 7621468 - DNA, 22 bp, Homo sapiens
ttcagacagtaagaaagaggtt

SEQ ID NO: 7621469 - DNA, 22 bp, Homo sapiens
ttcagacaggcagctgggctgg

SEQ ID NO: 7621470 - DNA, 22 bp, Homo sapiens
ttcagacaggcagctgggctgg

SEQ ID NO: 7621471 - DNA, 22 bp, Homo sapiens
ttcatactgtttaagttctgtt

SEQ ID NO: 7621472 - DNA, 22 bp, Homo sapiens
ttcatactgtttaagttctgtt

SEQ ID NO: 7621473 - DNA, 22 bp, Homo sapiens
ttcatactgtgtttccaagttt

SEQ ID NO: 7621474 - DNA, 22 bp, Homo sapiens
ttcatactcttccctgggcaaa

SEQ ID NO: 7621475 - DNA, 22 bp, Homo sapiens
ttcatactcactccaataactg

SEQ ID NO: 7621476 - DNA, 22 bp, Homo sapiens
ttcatacatttttactaacagc

SEQ ID NO: 7621477 - DNA, 22 bp, Homo sapiens
ttcatacatttttactaacagc

SEQ ID NO: 7621478 - DNA, 22 bp, Homo sapiens
ttcatagaagcagaaagtaaac

SEQ ID NO: 7621479 - DNA, 22 bp, Homo sapiens
ttcatagaagcagaaagtaaac

SEQ ID NO: 7621480 - DNA, 22 bp, Homo sapiens
ttcatactgtttaagttctgtt

SEQ ID NO: 7621481 - DNA, 22 bp, Homo sapiens
ttcatagaagcagaaagtaaac

SEQ ID NO: 7621482 - DNA, 22 bp, Homo sapiens
ttcatagacccagaactcatta

SEQ ID NO: 7621483 - DNA, 22 bp, Homo sapiens
ttcatagagcagctcactgaat

SEQ ID NO: 7621484 - DNA, 22 bp, Homo sapiens
ttcatagacccatgtgaggaag

SEQ ID NO: 7621485 - DNA, 23 bp, Homo sapiens
ttcatagagagatggtgagaatt

SEQ ID NO: 7621486 - DNA, 23 bp, Homo sapiens
ttcatagagagatggtgagaatt

SEQ ID NO: 7621487 - DNA, 22 bp, Homo sapiens
ttcatagacccatgtgaggaag

SEQ ID NO: 7621488 - DNA, 22 bp, Homo sapiens
ttcatacatgtgtactgttcca

SEQ ID NO: 7621489 - DNA, 22 bp, Homo sapiens
ttcatacatgagactagatgca

SEQ ID NO: 7621490 - DNA, 22 bp, Homo sapiens
ttcatacatgagactagatgca

SEQ ID NO: 7621491 - DNA, 22 bp, Homo sapiens
ttcatacatgagactagatgca

SEQ ID NO: 7621492 - DNA, 22 bp, Homo sapiens
ttcatacacgaaaatgcatgca

SEQ ID NO: 7621493 - DNA, 22 bp, Homo sapiens
ttcatacatgtgtactgttcca

SEQ ID NO: 7621494 - DNA, 22 bp, Homo sapiens
ttcatacatgtgtactgttcca

SEQ ID NO: 7621495 - DNA, 22 bp, Homo sapiens
ttcatacatgtgtactgttcca

SEQ ID NO: 7621496 - DNA, 22 bp, Homo sapiens
ttcatacatttttactaacagc

SEQ ID NO: 7621497 - DNA, 22 bp, Homo sapiens
ttcatacatttttactaacagc

SEQ ID NO: 7621498 - DNA, 22 bp, Homo sapiens
ttcatacatttttactaacagc

SEQ ID NO: 7621499 - DNA, 22 bp, Homo sapiens
ttcatacatttttactaacagc

SEQ ID NO: 7621500 - DNA, 22 bp, Homo sapiens
ttcatacatttttactaacagc

SEQ ID NO: 7621501 - DNA, 22 bp, Homo sapiens
ttcatacatttttactaacagc

SEQ ID NO: 7621502 - DNA, 23 bp, Homo sapiens
ttcatacagaaacatcacttcat

SEQ ID NO: 7621503 - DNA, 22 bp, Homo sapiens
ttcatacacgaaaatgcatgca

SEQ ID NO: 7621504 - DNA, 22 bp, Homo sapiens
ttcatacacgaaaatgcatgca

SEQ ID NO: 7621505 - DNA, 23 bp, Homo sapiens
ttcatacagaaacatcacttcat

SEQ ID NO: 7621506 - DNA, 23 bp, Homo sapiens
ttcatacagaaacatcacttcat

SEQ ID NO: 7621507 - DNA, 23 bp, Homo sapiens
ttcatacagaaacatcacttcat

SEQ ID NO: 7621508 - DNA, 22 bp, Homo sapiens
ttcatacagtggctgcactcca

SEQ ID NO: 7621509 - DNA, 22 bp, Homo sapiens
ttcatacagtggctgcactcca

SEQ ID NO: 7621510 - DNA, 22 bp, Homo sapiens
ttcatacagtggctgcactcca

SEQ ID NO: 7621511 - DNA, 22 bp, Homo sapiens
ttcatacaatgggatattatga

SEQ ID NO: 7621512 - DNA, 22 bp, Homo sapiens
ttcagaaggatgacaccagttg

SEQ ID NO: 7621513 - DNA, 22 bp, Homo sapiens
ttcagaaggatgacaccagttg

SEQ ID NO: 7621514 - DNA, 22 bp, Homo sapiens
ttcagaaggattttaacacatg

SEQ ID NO: 7621515 - DNA, 17 bp, Homo sapiens
ttcagaagcattttggc

SEQ ID NO: 7621516 - DNA, 17 bp, Homo sapiens
ttcagaagcattttggc

SEQ ID NO: 7621517 - DNA, 22 bp, Homo sapiens
ttcagaactgtctgtccttttc

SEQ ID NO: 7621518 - DNA, 22 bp, Homo sapiens
ttcagaactgtctgtccttttc

SEQ ID NO: 7621519 - DNA, 22 bp, Homo sapiens
ttcagaactgtctgtccttttc

SEQ ID NO: 7621520 - DNA, 23 bp, Homo sapiens
ttcagaagaaatgagtacaggag

SEQ ID NO: 7621521 - DNA, 23 bp, Homo sapiens
ttcagaagaaatgagtacaggag

SEQ ID NO: 7621522 - DNA, 23 bp, Homo sapiens
ttcagaagaaatgagtacaggag

SEQ ID NO: 7621523 - DNA, 22 bp, Homo sapiens
ttcagaagtagctaagcagtca

SEQ ID NO: 7621524 - DNA, 22 bp, Homo sapiens
ttcagaaggtgcagcctgggcc

SEQ ID NO: 7621525 - DNA, 22 bp, Homo sapiens
ttcagaagtagctaagcagtca

SEQ ID NO: 7621526 - DNA, 22 bp, Homo sapiens
ttcagaagtagctaagcagtca

SEQ ID NO: 7621527 - DNA, 22 bp, Homo sapiens
ttcagaaggtgcagcctgggcc

SEQ ID NO: 7621528 - DNA, 22 bp, Homo sapiens
ttcagaaggtaggaatgtccct

SEQ ID NO: 7621529 - DNA, 22 bp, Homo sapiens
ttcagaaggattttaacacatg

SEQ ID NO: 7621530 - DNA, 22 bp, Homo sapiens
ttcagaaggattttaacacatg

SEQ ID NO: 7621531 - DNA, 21 bp, Homo sapiens
ttcagaagttgagggcaggtt

SEQ ID NO: 7621532 - DNA, 21 bp, Homo sapiens
ttcagaagttgagggcaggtt

SEQ ID NO: 7621533 - DNA, 22 bp, Homo sapiens
ttcagaagtgctttcacactct

SEQ ID NO: 7621534 - DNA, 22 bp, Homo sapiens
ttcagaagttttcaaaactaag

SEQ ID NO: 7621535 - DNA, 22 bp, Homo sapiens
ttcagaagttttcaaaactaag

SEQ ID NO: 7621536 - DNA, 22 bp, Homo sapiens
ttcagaataactttttattgaa

SEQ ID NO: 7621537 - DNA, 22 bp, Homo sapiens
ttcagaataactttttattgaa

SEQ ID NO: 7621538 - DNA, 22 bp, Homo sapiens
ttcagaataactttttattgaa

SEQ ID NO: 7621539 - DNA, 22 bp, Homo sapiens
ttcagaatatttgttttacatg

SEQ ID NO: 7621540 - DNA, 22 bp, Homo sapiens
ttcagaatattattttaaaggc

SEQ ID NO: 7621541 - DNA, 22 bp, Homo sapiens
ttcagaatatttgttttacatg

SEQ ID NO: 7621542 - DNA, 22 bp, Homo sapiens
ttcagaatatttgttttacatg

SEQ ID NO: 7621543 - DNA, 22 bp, Homo sapiens
ttcagaatatttgttttacatg

SEQ ID NO: 7621544 - DNA, 22 bp, Homo sapiens
ttcagaataatgtgttagagaa

SEQ ID NO: 7621545 - DNA, 22 bp, Homo sapiens
ttcagaataatgtgttagagaa

SEQ ID NO: 7621546 - DNA, 22 bp, Homo sapiens
ttcagaatatccgtttaagttt

SEQ ID NO: 7621547 - DNA, 22 bp, Homo sapiens
ttcagaatatccgtttaagttt

SEQ ID NO: 7621548 - DNA, 22 bp, Homo sapiens
ttcagaatattattttaaaggc

SEQ ID NO: 7621549 - DNA, 22 bp, Homo sapiens
ttcagaatattattttaaaggc

SEQ ID NO: 7621550 - DNA, 22 bp, Homo sapiens
ttcagaaatccctcttctaccc

SEQ ID NO: 7621551 - DNA, 20 bp, Homo sapiens
ttcagaaataaggaatgagg

SEQ ID NO: 7621552 - DNA, 20 bp, Homo sapiens
ttcagaaataaggaatgagg

SEQ ID NO: 7621553 - DNA, 20 bp, Homo sapiens
ttcagaaataaggaatgagg

SEQ ID NO: 7621554 - DNA, 22 bp, Homo sapiens
ttcagaaataaaatatcccaac

SEQ ID NO: 7621555 - DNA, 22 bp, Homo sapiens
ttcagaaataaaatatcccaac

SEQ ID NO: 7621556 - DNA, 22 bp, Homo sapiens
ttcactgttatgaagctctggg

SEQ ID NO: 7621557 - DNA, 22 bp, Homo sapiens
ttcactgttatgaagctctggg

SEQ ID NO: 7621558 - DNA, 22 bp, Homo sapiens
ttcactgtgatgtttaagagaa

SEQ ID NO: 7621559 - DNA, 22 bp, Homo sapiens
ttcactgtgaactcatattcag

SEQ ID NO: 7621560 - DNA, 22 bp, Homo sapiens
ttcactgtgaactcatattcag

SEQ ID NO: 7621561 - DNA, 22 bp, Homo sapiens
ttcactgtgaactcatattcag

SEQ ID NO: 7621562 - DNA, 22 bp, Homo sapiens
ttcactgtcctgcaactctaga

SEQ ID NO: 7621563 - DNA, 22 bp, Homo sapiens
ttcactgtgaactcatattcag

SEQ ID NO: 7621564 - DNA, 22 bp, Homo sapiens
ttcactgtgatggtgcagaggc

SEQ ID NO: 7621565 - DNA, 22 bp, Homo sapiens
ttcactgtgatgtttaagagaa

SEQ ID NO: 7621566 - DNA, 22 bp, Homo sapiens
ttcactgtgatgtttaagagaa

SEQ ID NO: 7621567 - DNA, 22 bp, Homo sapiens
ttcactgtgatggtgcagaggc

SEQ ID NO: 7621568 - DNA, 22 bp, Homo sapiens
ttcactgtgaactcatattcag

SEQ ID NO: 7621569 - DNA, 22 bp, Homo sapiens
ttcagaaatcgagtttcatgtc

SEQ ID NO: 7621570 - DNA, 22 bp, Homo sapiens
ttcagaaatcgagtttcatgtc

SEQ ID NO: 7621571 - DNA, 22 bp, Homo sapiens
ttcagaaatccctcttctaccc

SEQ ID NO: 7621572 - DNA, 22 bp, Homo sapiens
ttcagaaatccctcttctaccc

SEQ ID NO: 7621573 - DNA, 22 bp, Homo sapiens
ttcagaaatccctcttctaccc

SEQ ID NO: 7621574 - DNA, 22 bp, Homo sapiens
ttcagaaatccctcttctaccc

SEQ ID NO: 7621575 - DNA, 22 bp, Homo sapiens
ttcagaaatcgagtttcatgtc

SEQ ID NO: 7621576 - DNA, 22 bp, Homo sapiens
ttcagaaatcgagtttcatgtc

SEQ ID NO: 7621577 - DNA, 22 bp, Homo sapiens
ttcagaaattcatggagttcag

SEQ ID NO: 7621578 - DNA, 22 bp, Homo sapiens
ttcagaaatgtcagccatcaga

SEQ ID NO: 7621579 - DNA, 22 bp, Homo sapiens
ttcagaaatgtcagccatcaga

SEQ ID NO: 7621580 - DNA, 22 bp, Homo sapiens
ttcagaacaaccatggttagat

SEQ ID NO: 7621581 - DNA, 22 bp, Homo sapiens
ttcagaacaatatgaacagaac

SEQ ID NO: 7621582 - DNA, 22 bp, Homo sapiens
ttcagaaattcatggagttcag

SEQ ID NO: 7621583 - DNA, 22 bp, Homo sapiens
ttcagaacaaccatggttagat

SEQ ID NO: 7621584 - DNA, 22 bp, Homo sapiens
ttcagaaatgaatattggtatt

SEQ ID NO: 7621585 - DNA, 22 bp, Homo sapiens
ttcagaaatgaatattggtatt

SEQ ID NO: 7621586 - DNA, 22 bp, Homo sapiens
ttcagaaatgaatattggtatt

SEQ ID NO: 7621587 - DNA, 22 bp, Homo sapiens
ttcagaaatgaatattggtatt

SEQ ID NO: 7621588 - DNA, 22 bp, Homo sapiens
ttcagaaatgaatattggtatt

SEQ ID NO: 7621589 - DNA, 22 bp, Homo sapiens
ttcagaaatgaatattggtatt

SEQ ID NO: 7621590 - DNA, 22 bp, Homo sapiens
ttcagaaatgaatattggtatt

SEQ ID NO: 7621591 - DNA, 22 bp, Homo sapiens
ttcagaaatgtcagccatcaga

SEQ ID NO: 7621592 - DNA, 19 bp, Homo sapiens
ttcaagtaaactattatta

SEQ ID NO: 7621593 - DNA, 19 bp, Homo sapiens
ttcaagtaaactattatta

SEQ ID NO: 7621594 - DNA, 19 bp, Homo sapiens
ttcaagtaaactattatta

SEQ ID NO: 7621595 - DNA, 22 bp, Homo sapiens
ttcaaggttcagggagaaattg

SEQ ID NO: 7621596 - DNA, 22 bp, Homo sapiens
ttcaaggtaagtatgagaaagc

SEQ ID NO: 7621597 - DNA, 23 bp, Homo sapiens
ttcaagggttatttgttagcact

SEQ ID NO: 7621598 - DNA, 22 bp, Homo sapiens
ttcaagtaaatcactttttgtc

SEQ ID NO: 7621599 - DNA, 22 bp, Homo sapiens
ttcaagtaaatcactttttgtc

SEQ ID NO: 7621600 - DNA, 22 bp, Homo sapiens
ttcaagtaacacaaatgcaccc

SEQ ID NO: 7621601 - DNA, 22 bp, Homo sapiens
ttcaagtaacacaaatgcaccc

SEQ ID NO: 7621602 - DNA, 22 bp, Homo sapiens
ttcaagtaatgctactcctatg

SEQ ID NO: 7621603 - DNA, 22 bp, Homo sapiens
ttcaagtaatgctactcctatg

SEQ ID NO: 7621604 - DNA, 22 bp, Homo sapiens
ttcaagtaggccagctgcatgg

SEQ ID NO: 7621605 - DNA, 22 bp, Homo sapiens
ttcaagtagaaagtattgatga

SEQ ID NO: 7621606 - DNA, 22 bp, Homo sapiens
ttcaagtagaaagtattgatga

SEQ ID NO: 7621607 - DNA, 22 bp, Homo sapiens
ttcaagtagaaagtattgatga

SEQ ID NO: 7621608 - DNA, 22 bp, Homo sapiens
ttcaagtagctaaattagctgc

SEQ ID NO: 7621609 - DNA, 22 bp, Homo sapiens
ttcaagtagctaaattagctgc

SEQ ID NO: 7621610 - DNA, 22 bp, Homo sapiens
ttcaagtaatgctactcctatg

SEQ ID NO: 7621611 - DNA, 22 bp, Homo sapiens
ttcaagtacattgtgttttcct

SEQ ID NO: 7621612 - DNA, 22 bp, Homo sapiens
ttcaagtacattgtgttttcct

SEQ ID NO: 7621613 - DNA, 22 bp, Homo sapiens
ttcaagtactgtagatttcagg

SEQ ID NO: 7621614 - DNA, 22 bp, Homo sapiens
ttcaagtactgtagatttcagg

SEQ ID NO: 7621615 - DNA, 22 bp, Homo sapiens
ttcaagtcctttggaaggcctg

SEQ ID NO: 7621616 - DNA, 22 bp, Homo sapiens
ttcaagtcatgttaactgcttc

SEQ ID NO: 7621617 - DNA, 21 bp, Homo sapiens
ttcaagtctctaggacttctc

SEQ ID NO: 7621618 - DNA, 21 bp, Homo sapiens
ttcaagtctctaggacttctc

SEQ ID NO: 7621619 - DNA, 22 bp, Homo sapiens
ttcaatatctctaagaatgagg

SEQ ID NO: 7621620 - DNA, 22 bp, Homo sapiens
ttcaatatctctaagaatgagg

SEQ ID NO: 7621621 - DNA, 22 bp, Homo sapiens
ttcaatatctctaagaatgagg

SEQ ID NO: 7621622 - DNA, 22 bp, Homo sapiens
ttcaatatctctaagaatgagg

SEQ ID NO: 7621623 - DNA, 22 bp, Homo sapiens
ttcaatatctctaagaatgagg

SEQ ID NO: 7621624 - DNA, 22 bp, Homo sapiens
ttcaatatctctaagaatgagg

SEQ ID NO: 7621625 - DNA, 22 bp, Homo sapiens
ttcaagtatgagaaaggggact

SEQ ID NO: 7621626 - DNA, 22 bp, Homo sapiens
ttcaagtatatttaacatcgta

SEQ ID NO: 7621627 - DNA, 22 bp, Homo sapiens
ttcaagtaggccagctgcatgg

SEQ ID NO: 7621628 - DNA, 22 bp, Homo sapiens
ttcaagtagtcacacatgatat

SEQ ID NO: 7621629 - DNA, 22 bp, Homo sapiens
ttcaagtagtcacacatgatat

SEQ ID NO: 7621630 - DNA, 22 bp, Homo sapiens
ttcaagtcaaggaaagaggtct

SEQ ID NO: 7621631 - DNA, 22 bp, Homo sapiens
ttcaagtcaaggaaagaggtct

SEQ ID NO: 7621632 - DNA, 22 bp, Homo sapiens
ttcaagtcaaggaaagaggtct

SEQ ID NO: 7621633 - DNA, 22 bp, Homo sapiens
ttcaagtcaatttttgaatgac

SEQ ID NO: 7621634 - DNA, 22 bp, Homo sapiens
ttcaagtcagagcaagccaagt

SEQ ID NO: 7621635 - DNA, 22 bp, Homo sapiens
ttcaagtcaatttttgaatgac

SEQ ID NO: 7621636 - DNA, 22 bp, Homo sapiens
ttcaagtcatgttaactgcttc

SEQ ID NO: 7621637 - DNA, 22 bp, Homo sapiens
ttcaatcattagaatctcaggc

SEQ ID NO: 7621638 - DNA, 22 bp, Homo sapiens
ttcaatcattagaatctcaggc

SEQ ID NO: 7621639 - DNA, 22 bp, Homo sapiens
ttcaatcattagaatctcaggc

SEQ ID NO: 7621640 - DNA, 22 bp, Homo sapiens
ttcaatatgatattagctgtgg

SEQ ID NO: 7621641 - DNA, 22 bp, Homo sapiens
ttcaatatgatattagctgtgg

SEQ ID NO: 7621642 - DNA, 22 bp, Homo sapiens
ttcaatatgatattagctgtgg

SEQ ID NO: 7621643 - DNA, 22 bp, Homo sapiens
ttcaatatgatattagctgtgg

SEQ ID NO: 7621644 - DNA, 22 bp, Homo sapiens
ttcaatatctctaagaatgagg

SEQ ID NO: 7621645 - DNA, 22 bp, Homo sapiens
ttcaatcatttttacatagtcc

SEQ ID NO: 7621646 - DNA, 22 bp, Homo sapiens
ttcaatcatttttacatagtcc

SEQ ID NO: 7621647 - DNA, 22 bp, Homo sapiens
ttcaatcatttttacatagtcc

SEQ ID NO: 7621648 - DNA, 22 bp, Homo sapiens
ttcaatcatttttacatagtcc

SEQ ID NO: 7621649 - DNA, 22 bp, Homo sapiens
ttcaatcattgcaaagtaatgg

SEQ ID NO: 7621650 - DNA, 17 bp, Homo sapiens
ttcaatgattaatgcat

SEQ ID NO: 7621651 - DNA, 21 bp, Homo sapiens
ttcaatgaaaacaaagtgagg

SEQ ID NO: 7621652 - DNA, 17 bp, Homo sapiens
ttcaatgattaatgcat

SEQ ID NO: 7621653 - DNA, 22 bp, Homo sapiens
ttcactgtactttggcaatgct

SEQ ID NO: 7621654 - DNA, 22 bp, Homo sapiens
ttcactgtactgactgtcttat

SEQ ID NO: 7621655 - DNA, 22 bp, Homo sapiens
ttcactgtatgagagggcttga

SEQ ID NO: 7621656 - DNA, 22 bp, Homo sapiens
ttcactgtatgagagggcttga

SEQ ID NO: 7621657 - DNA, 22 bp, Homo sapiens
ttcaatgatttttagggatcat

SEQ ID NO: 7621658 - DNA, 22 bp, Homo sapiens
ttcactgtactgactgtcttat

SEQ ID NO: 7621659 - DNA, 22 bp, Homo sapiens
ttccaaggcaacagcctaggct

SEQ ID NO: 7621660 - DNA, 22 bp, Homo sapiens
ttccaaggcaacagcctaggct

SEQ ID NO: 7621661 - DNA, 22 bp, Homo sapiens
ttccaaggcaacagcctaggct

SEQ ID NO: 7621662 - DNA, 22 bp, Homo sapiens
ttccaaggagtgaacttcaaat

SEQ ID NO: 7621663 - DNA, 22 bp, Homo sapiens
ttccaaggcaacagcctaggct

SEQ ID NO: 7621664 - DNA, 22 bp, Homo sapiens
ttccaaggcagttttctctctg

SEQ ID NO: 7621665 - DNA, 22 bp, Homo sapiens
ttccaaggcatgttctcaagta

SEQ ID NO: 7621666 - DNA, 22 bp, Homo sapiens
ttccaaggcagttttctctctg

SEQ ID NO: 7621667 - DNA, 19 bp, Homo sapiens
ttccaaggcatttctttgc

SEQ ID NO: 7621668 - DNA, 19 bp, Homo sapiens
ttccaaggcatttctttgc

SEQ ID NO: 7621669 - DNA, 22 bp, Homo sapiens
ttccaaggcagttttctctctg

SEQ ID NO: 7621670 - DNA, 19 bp, Homo sapiens
ttccaaggcatttctttgc

SEQ ID NO: 7621671 - DNA, 22 bp, Homo sapiens
ttccaaggccagacagggcagt

SEQ ID NO: 7621672 - DNA, 22 bp, Homo sapiens
ttccaaggccagacagggcagt

SEQ ID NO: 7621673 - DNA, 22 bp, Homo sapiens
ttccaaggccagacagggcagt

SEQ ID NO: 7621674 - DNA, 22 bp, Homo sapiens
ttccaaggccagacagggcagt

SEQ ID NO: 7621675 - DNA, 22 bp, Homo sapiens
ttccaaggcatgttctcaagta

SEQ ID NO: 7621676 - DNA, 22 bp, Homo sapiens
ttccaaggcatgttctcaagta

SEQ ID NO: 7621677 - DNA, 22 bp, Homo sapiens
ttccaaggcatgttctcaagta

SEQ ID NO: 7621678 - DNA, 22 bp, Homo sapiens
ttccaaggcatgttctcaagta

SEQ ID NO: 7621679 - DNA, 22 bp, Homo sapiens
ttccaaggcgatggcgcagaac

SEQ ID NO: 7621680 - DNA, 22 bp, Homo sapiens
ttccaaggcccagcagagagga

SEQ ID NO: 7621681 - DNA, 22 bp, Homo sapiens
ttccaaggcgatggcgcagaac

SEQ ID NO: 7621682 - DNA, 22 bp, Homo sapiens
ttccaaggcgatggcgcagaac

SEQ ID NO: 7621683 - DNA, 22 bp, Homo sapiens
ttccaaggcgatggcgcagaac

SEQ ID NO: 7621684 - DNA, 22 bp, Homo sapiens
ttccaaggcgcgccggcgccac

SEQ ID NO: 7621685 - DNA, 22 bp, Homo sapiens
ttccaaggcgcgccggcgccac

SEQ ID NO: 7621686 - DNA, 22 bp, Homo sapiens
ttccaaggctaggttgtaaagg

SEQ ID NO: 7621687 - DNA, 22 bp, Homo sapiens
ttccaaggctaggttgtaaagg

SEQ ID NO: 7621688 - DNA, 22 bp, Homo sapiens
ttccaaggcgcgccggcgccac

SEQ ID NO: 7621689 - DNA, 22 bp, Homo sapiens
ttccaaggctaggttgtaaagg

SEQ ID NO: 7621690 - DNA, 22 bp, Homo sapiens
ttccaaggcccagcagagagga

SEQ ID NO: 7621691 - DNA, 22 bp, Homo sapiens
ttccaaggccaggccctgaggt

SEQ ID NO: 7621692 - DNA, 22 bp, Homo sapiens
ttccaaggccaggccctgaggt

SEQ ID NO: 7621693 - DNA, 22 bp, Homo sapiens
ttccaaggcccagcagagagga

SEQ ID NO: 7621694 - DNA, 22 bp, Homo sapiens
ttccaaggcccagcagagagga

SEQ ID NO: 7621695 - DNA, 22 bp, Homo sapiens
ttccaaggcccagcagagagga

SEQ ID NO: 7621696 - DNA, 22 bp, Homo sapiens
ttccaaggccaggccctgaggt

SEQ ID NO: 7621697 - DNA, 22 bp, Homo sapiens
ttccaaggcccagcagagagga

SEQ ID NO: 7621698 - DNA, 22 bp, Homo sapiens
ttccaaggccaggccctgaggt

SEQ ID NO: 7621699 - DNA, 17 bp, Homo sapiens
ttccaaggagcatttga

SEQ ID NO: 7621700 - DNA, 17 bp, Homo sapiens
ttccaaggagcatttga

SEQ ID NO: 7621701 - DNA, 17 bp, Homo sapiens
ttccaaggagcatttga

SEQ ID NO: 7621702 - DNA, 17 bp, Homo sapiens
ttccaaggagcatttga

SEQ ID NO: 7621703 - DNA, 22 bp, Homo sapiens
ttccaaggattgaaatgtagtc

SEQ ID NO: 7621704 - DNA, 22 bp, Homo sapiens
ttccaaggattgaaatgtagtc

SEQ ID NO: 7621705 - DNA, 22 bp, Homo sapiens
ttccaaggattgaaatgtagtc

SEQ ID NO: 7621706 - DNA, 22 bp, Homo sapiens
ttccaaggattgaaatgtagtc

SEQ ID NO: 7621707 - DNA, 22 bp, Homo sapiens
ttccaaggagtgaacttcaaat

SEQ ID NO: 7621708 - DNA, 22 bp, Homo sapiens
ttccaaggagtgaacttcaaat

SEQ ID NO: 7621709 - DNA, 22 bp, Homo sapiens
ttccaaggagagctcgacctca

SEQ ID NO: 7621710 - DNA, 22 bp, Homo sapiens
ttccaaggagagctcgacctca

SEQ ID NO: 7621711 - DNA, 22 bp, Homo sapiens
ttccaaggagaacactctgtag

SEQ ID NO: 7621712 - DNA, 22 bp, Homo sapiens
ttccaaggagagctcgacctca

SEQ ID NO: 7621713 - DNA, 22 bp, Homo sapiens
ttccaaggagaacactctgtag

SEQ ID NO: 7621714 - DNA, 22 bp, Homo sapiens
ttccaaggagaacactctgtag

SEQ ID NO: 7621715 - DNA, 22 bp, Homo sapiens
ttccaagagctgctggggtaag

SEQ ID NO: 7621716 - DNA, 22 bp, Homo sapiens
ttccaagagtcagctgatccca

SEQ ID NO: 7621717 - DNA, 22 bp, Homo sapiens
ttccaagagtcagctgatccca

SEQ ID NO: 7621718 - DNA, 22 bp, Homo sapiens
ttccaagagtcagctgatccca

SEQ ID NO: 7621719 - DNA, 22 bp, Homo sapiens
ttccaagacttggccagcaggg

SEQ ID NO: 7621720 - DNA, 22 bp, Homo sapiens
ttccaagagcctttcttctaga

SEQ ID NO: 7621721 - DNA, 22 bp, Homo sapiens
ttccaagagcctttcttctaga

SEQ ID NO: 7621722 - DNA, 22 bp, Homo sapiens
ttccaagagctttaattgttga

SEQ ID NO: 7621723 - DNA, 22 bp, Homo sapiens
ttccaagagctttaattgttga

SEQ ID NO: 7621724 - DNA, 20 bp, Homo sapiens
ttccaactcacatctctaca

SEQ ID NO: 7621725 - DNA, 22 bp, Homo sapiens
ttccaactttaaaattcattct

SEQ ID NO: 7621726 - DNA, 22 bp, Homo sapiens
ttccaacttcccatccctgctg

SEQ ID NO: 7621727 - DNA, 19 bp, Homo sapiens
ttccaaaatcaggatttga

SEQ ID NO: 7621728 - DNA, 22 bp, Homo sapiens
ttccaacaatgtgttattgttc

SEQ ID NO: 7621729 - DNA, 22 bp, Homo sapiens
ttccaacaatgtgttattgttc

SEQ ID NO: 7621730 - DNA, 20 bp, Homo sapiens
ttccaactcacatctctaca

SEQ ID NO: 7621731 - DNA, 20 bp, Homo sapiens
ttccaactcacatctctaca

SEQ ID NO: 7621732 - DNA, 20 bp, Homo sapiens
ttccaactcacatctctaca

SEQ ID NO: 7621733 - DNA, 22 bp, Homo sapiens
ttccaactttgaaaatgttatg

SEQ ID NO: 7621734 - DNA, 22 bp, Homo sapiens
ttccaactttgtcatatattat

SEQ ID NO: 7621735 - DNA, 22 bp, Homo sapiens
ttccaagaaacaagtgatgcag

SEQ ID NO: 7621736 - DNA, 22 bp, Homo sapiens
ttccaactttgtcatatattat

SEQ ID NO: 7621737 - DNA, 22 bp, Homo sapiens
ttccaagacacctttagtcact

SEQ ID NO: 7621738 - DNA, 22 bp, Homo sapiens
ttccaagaagtcaacaggtagt

SEQ ID NO: 7621739 - DNA, 22 bp, Homo sapiens
ttccaagaagtcaacaggtagt

SEQ ID NO: 7621740 - DNA, 22 bp, Homo sapiens
ttccaagaagtcaacaggtagt

SEQ ID NO: 7621741 - DNA, 19 bp, Homo sapiens
ttccaaaatcaggatttga

SEQ ID NO: 7621742 - DNA, 19 bp, Homo sapiens
ttccaaaatcaggatttga

SEQ ID NO: 7621743 - DNA, 19 bp, Homo sapiens
ttccaaaatcaggatttga

SEQ ID NO: 7621744 - DNA, 19 bp, Homo sapiens
ttccaaaatcaggatttga

SEQ ID NO: 7621745 - DNA, 22 bp, Homo sapiens
ttccaaaacaatattctgtgaa

SEQ ID NO: 7621746 - DNA, 19 bp, Homo sapiens
ttccaaaatcaggatttga

SEQ ID NO: 7621747 - DNA, 22 bp, Homo sapiens
ttcatcaggcatcatgctcaag

SEQ ID NO: 7621748 - DNA, 21 bp, Homo sapiens
ttcatcagccagaaatcaagc

SEQ ID NO: 7621749 - DNA, 21 bp, Homo sapiens
ttcatcagccagaaatcaagc

SEQ ID NO: 7621750 - DNA, 21 bp, Homo sapiens
ttcatcagccagaaatcaagc

SEQ ID NO: 7621751 - DNA, 22 bp, Homo sapiens
ttcatcaggcatcatgctcaag

SEQ ID NO: 7621752 - DNA, 22 bp, Homo sapiens
ttccaaaacaatattctgtgaa

SEQ ID NO: 7621753 - DNA, 23 bp, Homo sapiens
ttcatcagttgctgttgcagaac

SEQ ID NO: 7621754 - DNA, 22 bp, Homo sapiens
ttccaaaacaatattctgtgaa

SEQ ID NO: 7621755 - DNA, 22 bp, Homo sapiens
ttccaaaacaatattctgtgaa

SEQ ID NO: 7621756 - DNA, 22 bp, Homo sapiens
ttccaatgactagtggcatcct

SEQ ID NO: 7621757 - DNA, 22 bp, Homo sapiens
ttccaatgactagtggcatcct

SEQ ID NO: 7621758 - DNA, 22 bp, Homo sapiens
ttccaatcaggataataattag

SEQ ID NO: 7621759 - DNA, 22 bp, Homo sapiens
ttccaatgacatttgttttaaa

SEQ ID NO: 7621760 - DNA, 22 bp, Homo sapiens
ttccaatggaatcatgtcttga

SEQ ID NO: 7621761 - DNA, 22 bp, Homo sapiens
ttccaatgtatgatagacttag

SEQ ID NO: 7621762 - DNA, 22 bp, Homo sapiens
ttccaatatttacaatgcatta

SEQ ID NO: 7621763 - DNA, 22 bp, Homo sapiens
ttccaatagtgtgaccttatag

SEQ ID NO: 7621764 - DNA, 22 bp, Homo sapiens
ttccaatatttacaatgcatta

SEQ ID NO: 7621765 - DNA, 22 bp, Homo sapiens
ttccaataaaatgttatttgca

SEQ ID NO: 7621766 - DNA, 22 bp, Homo sapiens
ttccaatagtgtgaccttatag

SEQ ID NO: 7621767 - DNA, 22 bp, Homo sapiens
ttccaatatttacaatgcatta

SEQ ID NO: 7621768 - DNA, 22 bp, Homo sapiens
ttccaatccaaacttcaccttt

SEQ ID NO: 7621769 - DNA, 22 bp, Homo sapiens
ttccaattgtgagattttttaa

SEQ ID NO: 7621770 - DNA, 22 bp, Homo sapiens
ttccaattgcagatcagataca

SEQ ID NO: 7621771 - DNA, 22 bp, Homo sapiens
ttccataaaggtgatagtatac

SEQ ID NO: 7621772 - DNA, 21 bp, Homo sapiens
ttccagttttaattaaattgt

SEQ ID NO: 7621773 - DNA, 21 bp, Homo sapiens
ttccagttttaattaaattgt

SEQ ID NO: 7621774 - DNA, 22 bp, Homo sapiens
ttccataataggcttaagtgaa

SEQ ID NO: 7621775 - DNA, 22 bp, Homo sapiens
ttccataactgaccgaatgcat

SEQ ID NO: 7621776 - DNA, 22 bp, Homo sapiens
ttccataaaggtgatagtatac

SEQ ID NO: 7621777 - DNA, 22 bp, Homo sapiens
ttccataatgagattcccagcc

SEQ ID NO: 7621778 - DNA, 22 bp, Homo sapiens
ttccataatgagattcccagcc

SEQ ID NO: 7621779 - DNA, 22 bp, Homo sapiens
ttccataatcaccttattcttt

SEQ ID NO: 7621780 - DNA, 22 bp, Homo sapiens
ttccataatcaccttattcttt

SEQ ID NO: 7621781 - DNA, 22 bp, Homo sapiens
ttccataatcaccttattcttt

SEQ ID NO: 7621782 - DNA, 22 bp, Homo sapiens
ttccataatcaccttattcttt

SEQ ID NO: 7621783 - DNA, 22 bp, Homo sapiens
ttccataattaagtggagagaa

SEQ ID NO: 7621784 - DNA, 22 bp, Homo sapiens
ttccatacgactgaggtctcgg

SEQ ID NO: 7621785 - DNA, 22 bp, Homo sapiens
ttccatacgactgaggtctcgg

SEQ ID NO: 7621786 - DNA, 22 bp, Homo sapiens
ttccatacgactgaggtctcgg

SEQ ID NO: 7621787 - DNA, 22 bp, Homo sapiens
ttccatatgaaaaagctgttgc

SEQ ID NO: 7621788 - DNA, 22 bp, Homo sapiens
ttccatattagactatgtgggg

SEQ ID NO: 7621789 - DNA, 22 bp, Homo sapiens
ttccatatgtatatagctgtta

SEQ ID NO: 7621790 - DNA, 22 bp, Homo sapiens
ttccatatgtatatagctgtta

SEQ ID NO: 7621791 - DNA, 22 bp, Homo sapiens
ttccaataaaatgttatttgca

SEQ ID NO: 7621792 - DNA, 22 bp, Homo sapiens
ttccaataaaatgttatttgca

SEQ ID NO: 7621793 - DNA, 22 bp, Homo sapiens
ttccaagttaggcgagctggtg

SEQ ID NO: 7621794 - DNA, 22 bp, Homo sapiens
ttccaagtgttgagattagagg

SEQ ID NO: 7621795 - DNA, 22 bp, Homo sapiens
ttccaagtgtcagatcagattt

SEQ ID NO: 7621796 - DNA, 22 bp, Homo sapiens
ttccaagtgaaagtagctttgt

SEQ ID NO: 7621797 - DNA, 22 bp, Homo sapiens
ttccaagtgaaagtagctttgt

SEQ ID NO: 7621798 - DNA, 22 bp, Homo sapiens
ttccaagtgcccatatttcatc

SEQ ID NO: 7621799 - DNA, 22 bp, Homo sapiens
ttccaagtgcccatatttcatc

SEQ ID NO: 7621800 - DNA, 22 bp, Homo sapiens
ttccaagtgcccatatttcatc

SEQ ID NO: 7621801 - DNA, 22 bp, Homo sapiens
ttccaagtgctgaggacagtag

SEQ ID NO: 7621802 - DNA, 23 bp, Homo sapiens
ttccaagtgctttacttaatcct

SEQ ID NO: 7621803 - DNA, 22 bp, Homo sapiens
ttccaaggctgctatttgtttc

SEQ ID NO: 7621804 - DNA, 22 bp, Homo sapiens
ttccaaggctctcttcccacaa

SEQ ID NO: 7621805 - DNA, 22 bp, Homo sapiens
ttccaaggctctcttcccacaa

SEQ ID NO: 7621806 - DNA, 22 bp, Homo sapiens
ttccaaggctgctatttgtttc

SEQ ID NO: 7621807 - DNA, 22 bp, Homo sapiens
ttccaaggctgtaaaattggtt

SEQ ID NO: 7621808 - DNA, 22 bp, Homo sapiens
ttccaaggctgtaaaattggtt

SEQ ID NO: 7621809 - DNA, 22 bp, Homo sapiens
ttccaaggctgctatttgtttc

SEQ ID NO: 7621810 - DNA, 22 bp, Homo sapiens
ttccaaggctaggttgtaaagg

SEQ ID NO: 7621811 - DNA, 22 bp, Homo sapiens
ttccaaggctgctatttgtttc

SEQ ID NO: 7621812 - DNA, 22 bp, Homo sapiens
ttccaaggctctcttcccacaa

SEQ ID NO: 7621813 - DNA, 23 bp, Homo sapiens
ttccaaggggatgtctccaagtg

SEQ ID NO: 7621814 - DNA, 22 bp, Homo sapiens
ttccaagggaatgtttatgagt

SEQ ID NO: 7621815 - DNA, 23 bp, Homo sapiens
ttccaaggggatgtctccaagtg

SEQ ID NO: 7621816 - DNA, 23 bp, Homo sapiens
ttccaaggggatgtctccaagtg

SEQ ID NO: 7621817 - DNA, 22 bp, Homo sapiens
ttccaagggaatgtttatgagt

SEQ ID NO: 7621818 - DNA, 22 bp, Homo sapiens
ttccaagggaatgtttatgagt

SEQ ID NO: 7621819 - DNA, 23 bp, Homo sapiens
ttccaaggggatgtctccaagtg

SEQ ID NO: 7621820 - DNA, 22 bp, Homo sapiens
ttccaaggctgtcctcactttg

SEQ ID NO: 7621821 - DNA, 22 bp, Homo sapiens
ttccaaggctgtcctcactttg

SEQ ID NO: 7621822 - DNA, 22 bp, Homo sapiens
ttccaaggctgtaaaattggtt

SEQ ID NO: 7621823 - DNA, 22 bp, Homo sapiens
ttccaaggctgtcctcactttg

SEQ ID NO: 7621824 - DNA, 22 bp, Homo sapiens
ttccaagggaatgtttatgagt

SEQ ID NO: 7621825 - DNA, 22 bp, Homo sapiens
ttccaaggttactggtggttta

SEQ ID NO: 7621826 - DNA, 22 bp, Homo sapiens
ttccaaggtgttctgctggttt

SEQ ID NO: 7621827 - DNA, 22 bp, Homo sapiens
ttccaaggttagtttttagggt

SEQ ID NO: 7621828 - DNA, 22 bp, Homo sapiens
ttccaaggttactggtggttta

SEQ ID NO: 7621829 - DNA, 22 bp, Homo sapiens
ttccaaggttactggtggttta

SEQ ID NO: 7621830 - DNA, 22 bp, Homo sapiens
ttccaaggttagtttttagggt

SEQ ID NO: 7621831 - DNA, 22 bp, Homo sapiens
ttccaaggtttctccagcctcc

SEQ ID NO: 7621832 - DNA, 22 bp, Homo sapiens
ttccaaggtttctccagcctcc

SEQ ID NO: 7621833 - DNA, 22 bp, Homo sapiens
ttccaaggttagtttttagggt

SEQ ID NO: 7621834 - DNA, 22 bp, Homo sapiens
ttccaaggtttctccagcctcc

SEQ ID NO: 7621835 - DNA, 22 bp, Homo sapiens
ttccaaggtgggactggggtgc

SEQ ID NO: 7621836 - DNA, 22 bp, Homo sapiens
ttccaaggtgttctgctggttt

SEQ ID NO: 7621837 - DNA, 22 bp, Homo sapiens
ttccaaggtgggactggggtgc

SEQ ID NO: 7621838 - DNA, 22 bp, Homo sapiens
ttccaaggtgggactggggtgc

SEQ ID NO: 7621839 - DNA, 22 bp, Homo sapiens
ttccaaggtgttctgctggttt

SEQ ID NO: 7621840 - DNA, 20 bp, Homo sapiens
ttccaaggtctatgcttctt

SEQ ID NO: 7621841 - DNA, 20 bp, Homo sapiens
ttccaaggtctatgcttctt

SEQ ID NO: 7621842 - DNA, 20 bp, Homo sapiens
ttccaaggtctatgcttctt

SEQ ID NO: 7621843 - DNA, 17 bp, Homo sapiens
ttcccctgaccaagcct

SEQ ID NO: 7621844 - DNA, 17 bp, Homo sapiens
ttcccctgaccaagcct

SEQ ID NO: 7621845 - DNA, 22 bp, Homo sapiens
ttcccctctcagatctggccta

SEQ ID NO: 7621846 - DNA, 22 bp, Homo sapiens
ttcccctgtcacagtggttctc

SEQ ID NO: 7621847 - DNA, 22 bp, Homo sapiens
ttccccttatcaccagcctgtc

SEQ ID NO: 7621848 - DNA, 22 bp, Homo sapiens
ttccccttatcaccagcctgtc

SEQ ID NO: 7621849 - DNA, 22 bp, Homo sapiens
ttccccttataagtctggcttc

SEQ ID NO: 7621850 - DNA, 22 bp, Homo sapiens
ttccccttataagtctggcttc

SEQ ID NO: 7621851 - DNA, 22 bp, Homo sapiens
ttccccttgataagcagggttg

SEQ ID NO: 7621852 - DNA, 22 bp, Homo sapiens
ttccccttgataatgcagtaag

SEQ ID NO: 7621853 - DNA, 22 bp, Homo sapiens
ttccccttgataagcagggttg

SEQ ID NO: 7621854 - DNA, 22 bp, Homo sapiens
ttccccttgataatgcagtaag

SEQ ID NO: 7621855 - DNA, 22 bp, Homo sapiens
ttccccttgataatgcagtaag

SEQ ID NO: 7621856 - DNA, 22 bp, Homo sapiens
ttccccttgcactatcaccctg

SEQ ID NO: 7621857 - DNA, 22 bp, Homo sapiens
ttccccttgcactatcaccctg

SEQ ID NO: 7621858 - DNA, 22 bp, Homo sapiens
ttccccttgggctgtggaggag

SEQ ID NO: 7621859 - DNA, 22 bp, Homo sapiens
ttccccttgggctgtggaggag

SEQ ID NO: 7621860 - DNA, 19 bp, Homo sapiens
ttcccctccccagggatag

SEQ ID NO: 7621861 - DNA, 19 bp, Homo sapiens
ttcccctccccagggatag

SEQ ID NO: 7621862 - DNA, 22 bp, Homo sapiens
ttcccctctcagatctggccta

SEQ ID NO: 7621863 - DNA, 22 bp, Homo sapiens
ttcccctctcagatctggccta

SEQ ID NO: 7621864 - DNA, 22 bp, Homo sapiens
ttcccccacctggggtacagga

SEQ ID NO: 7621865 - DNA, 22 bp, Homo sapiens
ttcccccacctggggtacagga

SEQ ID NO: 7621866 - DNA, 22 bp, Homo sapiens
ttcccccacctggggtacagga

SEQ ID NO: 7621867 - DNA, 22 bp, Homo sapiens
ttccccagtagtgacaatcaaa

SEQ ID NO: 7621868 - DNA, 22 bp, Homo sapiens
ttccccagtaacatacatgtga

SEQ ID NO: 7621869 - DNA, 22 bp, Homo sapiens
ttccccagtaacatacatgtga

SEQ ID NO: 7621870 - DNA, 22 bp, Homo sapiens
ttccccaggtgattctcatggc

SEQ ID NO: 7621871 - DNA, 22 bp, Homo sapiens
ttccccaggtgattctcatggc

SEQ ID NO: 7621872 - DNA, 22 bp, Homo sapiens
ttccccagggaagctcctgcgc

SEQ ID NO: 7621873 - DNA, 22 bp, Homo sapiens
ttccccaggctggagtgcagtg

SEQ ID NO: 7621874 - DNA, 22 bp, Homo sapiens
ttccccagggaagctcctgcgc

SEQ ID NO: 7621875 - DNA, 22 bp, Homo sapiens
ttccccaggctggagtgcagtg

SEQ ID NO: 7621876 - DNA, 22 bp, Homo sapiens
ttccccaggtgattctcatggc

SEQ ID NO: 7621877 - DNA, 22 bp, Homo sapiens
ttccccaggggctcctgccttt

SEQ ID NO: 7621878 - DNA, 22 bp, Homo sapiens
ttccccaggtgattctcatggc

SEQ ID NO: 7621879 - DNA, 22 bp, Homo sapiens
ttccccaggggctcctgccttt

SEQ ID NO: 7621880 - DNA, 22 bp, Homo sapiens
ttccccagggaagctcctgcgc

SEQ ID NO: 7621881 - DNA, 22 bp, Homo sapiens
ttcccatttgtggtagtgaatt

SEQ ID NO: 7621882 - DNA, 22 bp, Homo sapiens
ttccccaggcggctttttcagc

SEQ ID NO: 7621883 - DNA, 22 bp, Homo sapiens
ttccccaggctggagtgcagtg

SEQ ID NO: 7621884 - DNA, 22 bp, Homo sapiens
ttccccaggctggagtgcagtg

SEQ ID NO: 7621885 - DNA, 22 bp, Homo sapiens
ttccccaggctggagtgcagtg

SEQ ID NO: 7621886 - DNA, 21 bp, Homo sapiens
ttcccatcttttctgagtctg

SEQ ID NO: 7621887 - DNA, 21 bp, Homo sapiens
ttcccatcttttctgagtctg

SEQ ID NO: 7621888 - DNA, 22 bp, Homo sapiens
ttcccatcgtctccttcacctt

SEQ ID NO: 7621889 - DNA, 21 bp, Homo sapiens
ttcccatcttttctgagtctg

SEQ ID NO: 7621890 - DNA, 21 bp, Homo sapiens
ttcccatcttttctgagtctg

SEQ ID NO: 7621891 - DNA, 22 bp, Homo sapiens
ttcccagtgattaaggcagtgg

SEQ ID NO: 7621892 - DNA, 22 bp, Homo sapiens
ttcccagtgattaaggcagtgg

SEQ ID NO: 7621893 - DNA, 22 bp, Homo sapiens
ttcccagtgaggaagcaatgca

SEQ ID NO: 7621894 - DNA, 22 bp, Homo sapiens
ttcccaggtaattctgaggcag

SEQ ID NO: 7621895 - DNA, 22 bp, Homo sapiens
ttcccaggtaattctgaggcag

SEQ ID NO: 7621896 - DNA, 22 bp, Homo sapiens
ttcccaggtaattctgaggcag

SEQ ID NO: 7621897 - DNA, 22 bp, Homo sapiens
ttcccaggtaattctgaggcag

SEQ ID NO: 7621898 - DNA, 22 bp, Homo sapiens
ttcccaggctgtgctaccagag

SEQ ID NO: 7621899 - DNA, 22 bp, Homo sapiens
ttcccaggactctgggtgtctt

SEQ ID NO: 7621900 - DNA, 22 bp, Homo sapiens
ttcccaggtaattctgaggcag

SEQ ID NO: 7621901 - DNA, 22 bp, Homo sapiens
ttcccaggctgtgctaccagag

SEQ ID NO: 7621902 - DNA, 22 bp, Homo sapiens
ttcccaggctgtgctaccagag

SEQ ID NO: 7621903 - DNA, 19 bp, Homo sapiens
ttcccaggaaaggggtgca

SEQ ID NO: 7621904 - DNA, 22 bp, Homo sapiens
ttcccaggactctgggtgtctt

SEQ ID NO: 7621905 - DNA, 22 bp, Homo sapiens
ttcccaggactctgggtgtctt

SEQ ID NO: 7621906 - DNA, 22 bp, Homo sapiens
ttcccaggactctgggtgtctt

SEQ ID NO: 7621907 - DNA, 22 bp, Homo sapiens
ttcccaggactctgggtgtctt

SEQ ID NO: 7621908 - DNA, 22 bp, Homo sapiens
ttcccaggactctgggtgtctt

SEQ ID NO: 7621909 - DNA, 22 bp, Homo sapiens
ttcccagattggagggcagggg

SEQ ID NO: 7621910 - DNA, 22 bp, Homo sapiens
ttcccagattggagggcagggg

SEQ ID NO: 7621911 - DNA, 21 bp, Homo sapiens
ttcccagcacctagcacaggt

SEQ ID NO: 7621912 - DNA, 22 bp, Homo sapiens
ttcccagattggagggcagggg

SEQ ID NO: 7621913 - DNA, 21 bp, Homo sapiens
ttcccagcacctagcacaggt

SEQ ID NO: 7621914 - DNA, 21 bp, Homo sapiens
ttcccagcacctagcacaggt

SEQ ID NO: 7621915 - DNA, 19 bp, Homo sapiens
ttcccaggaaaggggtgca

SEQ ID NO: 7621916 - DNA, 19 bp, Homo sapiens
ttcccaggaaaggggtgca

SEQ ID NO: 7621917 - DNA, 22 bp, Homo sapiens
ttccattgagtacctggagaca

SEQ ID NO: 7621918 - DNA, 22 bp, Homo sapiens
ttccattgagtacctggagaca

SEQ ID NO: 7621919 - DNA, 22 bp, Homo sapiens
ttccattggtaaaatgagagtg

SEQ ID NO: 7621920 - DNA, 22 bp, Homo sapiens
ttccatttattcttgtccagat

SEQ ID NO: 7621921 - DNA, 21 bp, Homo sapiens
ttccattatctctcagccatc

SEQ ID NO: 7621922 - DNA, 21 bp, Homo sapiens
ttccattatctctcagccatc

SEQ ID NO: 7621923 - DNA, 22 bp, Homo sapiens
ttccatgctaagacacgcaggg

SEQ ID NO: 7621924 - DNA, 22 bp, Homo sapiens
ttccatgggtctgggggctcca

SEQ ID NO: 7621925 - DNA, 22 bp, Homo sapiens
ttccatgtactgggttttgtat

SEQ ID NO: 7621926 - DNA, 22 bp, Homo sapiens
ttcccagaattgttgggaactg

SEQ ID NO: 7621927 - DNA, 22 bp, Homo sapiens
ttcccagaattgttgggaactg

SEQ ID NO: 7621928 - DNA, 22 bp, Homo sapiens
ttcccagaatgaatggatggag

SEQ ID NO: 7621929 - DNA, 22 bp, Homo sapiens
ttcccagaattgttgggaactg

SEQ ID NO: 7621930 - DNA, 22 bp, Homo sapiens
ttcccagaattgttgggaactg

SEQ ID NO: 7621931 - DNA, 22 bp, Homo sapiens
ttcccagacctgtaggatcaga

SEQ ID NO: 7621932 - DNA, 22 bp, Homo sapiens
ttcccagacctgtaggatcaga

SEQ ID NO: 7621933 - DNA, 22 bp, Homo sapiens
ttcccagacctgtaggatcaga

SEQ ID NO: 7621934 - DNA, 22 bp, Homo sapiens
ttcccagactccacactgaggc

SEQ ID NO: 7621935 - DNA, 19 bp, Homo sapiens
ttcccagagccatgagtga

SEQ ID NO: 7621936 - DNA, 19 bp, Homo sapiens
ttcccagagccatgagtga

SEQ ID NO: 7621937 - DNA, 19 bp, Homo sapiens
ttcccagagccatgagtga

SEQ ID NO: 7621938 - DNA, 19 bp, Homo sapiens
ttcccagagccatgagtga

SEQ ID NO: 7621939 - DNA, 22 bp, Homo sapiens
ttcccagaggcaaagtctggat

SEQ ID NO: 7621940 - DNA, 22 bp, Homo sapiens
ttcccagaggcaaagtctggat

SEQ ID NO: 7621941 - DNA, 22 bp, Homo sapiens
ttcccagaggagatttgcttat

SEQ ID NO: 7621942 - DNA, 22 bp, Homo sapiens
ttcccagactccacactgaggc

SEQ ID NO: 7621943 - DNA, 22 bp, Homo sapiens
ttcccagagaaggatgaaaaag

SEQ ID NO: 7621944 - DNA, 22 bp, Homo sapiens
ttcccagagaaggatgaaaaag

SEQ ID NO: 7621945 - DNA, 22 bp, Homo sapiens
ttcccagagaaggatgaaaaag

SEQ ID NO: 7621946 - DNA, 22 bp, Homo sapiens
ttcccagagaaggatgaaaaag

SEQ ID NO: 7621947 - DNA, 22 bp, Homo sapiens
ttcccagagataagacgtctta

SEQ ID NO: 7621948 - DNA, 22 bp, Homo sapiens
ttcccagagataagacgtctta

SEQ ID NO: 7621949 - DNA, 22 bp, Homo sapiens
ttccatcattaacaccacaagg

SEQ ID NO: 7621950 - DNA, 22 bp, Homo sapiens
ttccatcacatcactgaagaca

SEQ ID NO: 7621951 - DNA, 22 bp, Homo sapiens
ttccatcattaacaccacaagg

SEQ ID NO: 7621952 - DNA, 22 bp, Homo sapiens
ttccatccatgtcccgtttctg

SEQ ID NO: 7621953 - DNA, 22 bp, Homo sapiens
ttccatattcccaattttgcca

SEQ ID NO: 7621954 - DNA, 22 bp, Homo sapiens
ttccatattagactatgtgggg

SEQ ID NO: 7621955 - DNA, 22 bp, Homo sapiens
ttccatattggaaggcacaggc

SEQ ID NO: 7621956 - DNA, 22 bp, Homo sapiens
ttccatattgtactctttggag

SEQ ID NO: 7621957 - DNA, 22 bp, Homo sapiens
ttccatgaaagtgaaatggagc

SEQ ID NO: 7621958 - DNA, 22 bp, Homo sapiens
ttccatctttcagctttgttgg

SEQ ID NO: 7621959 - DNA, 22 bp, Homo sapiens
ttccatctttcagctttgttgg

SEQ ID NO: 7621960 - DNA, 22 bp, Homo sapiens
ttccatctgctaggtaaatgaa

SEQ ID NO: 7621961 - DNA, 22 bp, Homo sapiens
ttccatctgctaggtaaatgaa

SEQ ID NO: 7621962 - DNA, 22 bp, Homo sapiens
ttccatctgagagctgtgaaga

SEQ ID NO: 7621963 - DNA, 22 bp, Homo sapiens
ttccatcctaataaaagaagtt

SEQ ID NO: 7621964 - DNA, 22 bp, Homo sapiens
ttccatgactgaagcaggggcg

SEQ ID NO: 7621965 - DNA, 22 bp, Homo sapiens
ttccatgactgaagcaggggcg

SEQ ID NO: 7621966 - DNA, 22 bp, Homo sapiens
ttccatgaaggagactgagaag

SEQ ID NO: 7621967 - DNA, 22 bp, Homo sapiens
ttccatgaagggcagcctctca

SEQ ID NO: 7621968 - DNA, 22 bp, Homo sapiens
ttccatgacaccgagggaagtc

SEQ ID NO: 7621969 - DNA, 22 bp, Homo sapiens
ttccatgacaccgagggaagtc

SEQ ID NO: 7621970 - DNA, 22 bp, Homo sapiens
ttccatgaagggcagcctctca

SEQ ID NO: 7621971 - DNA, 22 bp, Homo sapiens
ttccatgaaatgtgttatgctt

SEQ ID NO: 7621972 - DNA, 22 bp, Homo sapiens
ttccatgagtagcagtatttcc

SEQ ID NO: 7621973 - DNA, 22 bp, Homo sapiens
ttccatgagtagcagtatttcc

SEQ ID NO: 7621974 - DNA, 18 bp, Homo sapiens
ttccatgattcctttcac

SEQ ID NO: 7621975 - DNA, 22 bp, Homo sapiens
ttccatgagctctgagttcaca

SEQ ID NO: 7621976 - DNA, 22 bp, Homo sapiens
ttccatgagtagcagtatttcc

SEQ ID NO: 7621977 - DNA, 22 bp, Homo sapiens
ttccatgcctagaacaggattc

SEQ ID NO: 7621978 - DNA, 22 bp, Homo sapiens
ttccatgcaagaagtatggctc

SEQ ID NO: 7621979 - DNA, 22 bp, Homo sapiens
ttccatgctaagacacgcaggg

SEQ ID NO: 7621980 - DNA, 22 bp, Homo sapiens
ttccatgcctctatttagaatt

SEQ ID NO: 7621981 - DNA, 22 bp, Homo sapiens
ttccatgcctctatttagaatt

SEQ ID NO: 7621982 - DNA, 22 bp, Homo sapiens
ttatttaattttctcactcaga

SEQ ID NO: 7621983 - DNA, 22 bp, Homo sapiens
ttatttaatgtgatctgaagag

SEQ ID NO: 7621984 - DNA, 22 bp, Homo sapiens
ttatttaatgtgatctgaagag

SEQ ID NO: 7621985 - DNA, 22 bp, Homo sapiens
ttatttaatgtgatctgaagag

SEQ ID NO: 7621986 - DNA, 22 bp, Homo sapiens
ttatttaatgtgatctgaagag

SEQ ID NO: 7621987 - DNA, 22 bp, Homo sapiens
ttatttaatgtgatctgaagag

SEQ ID NO: 7621988 - DNA, 22 bp, Homo sapiens
ttatttaatgtgatctgaagag

SEQ ID NO: 7621989 - DNA, 22 bp, Homo sapiens
ttatttaattttctcactcaga

SEQ ID NO: 7621990 - DNA, 22 bp, Homo sapiens
ttatttaattttctcactcaga

SEQ ID NO: 7621991 - DNA, 22 bp, Homo sapiens
ttatttaattttctcactcaga

SEQ ID NO: 7621992 - DNA, 22 bp, Homo sapiens
ttatttaattttctcactcaga

SEQ ID NO: 7621993 - DNA, 22 bp, Homo sapiens
ttatttaattttctcactcaga

SEQ ID NO: 7621994 - DNA, 22 bp, Homo sapiens
ttatttaattttctcactcaga

SEQ ID NO: 7621995 - DNA, 22 bp, Homo sapiens
ttatttaattttctcactcaga

SEQ ID NO: 7621996 - DNA, 22 bp, Homo sapiens
ttatttagtctagatgaatttt

SEQ ID NO: 7621997 - DNA, 22 bp, Homo sapiens
ttatttagtctagatgaatttt

SEQ ID NO: 7621998 - DNA, 22 bp, Homo sapiens
ttatttagtctagatgaatttt

SEQ ID NO: 7621999 - DNA, 22 bp, Homo sapiens
ttatttagtctagatgaatttt

SEQ ID NO: 7622000 - DNA, 22 bp, Homo sapiens
ttatttaggaggaaactgaggt

SEQ ID NO: 7622001 - DNA, 22 bp, Homo sapiens
ttatttaggaggaaactgaggt

SEQ ID NO: 7622002 - DNA, 22 bp, Homo sapiens
ttatttaggaggaaactgaggt

SEQ ID NO: 7622003 - DNA, 22 bp, Homo sapiens
ttatttaggagaaggaaccctg

SEQ ID NO: 7622004 - DNA, 22 bp, Homo sapiens
ttatttaggagaaggaaccctg

SEQ ID NO: 7622005 - DNA, 22 bp, Homo sapiens
ttatttactggatggccttggg

SEQ ID NO: 7622006 - DNA, 22 bp, Homo sapiens
ttatttactggatggccttggg

SEQ ID NO: 7622007 - DNA, 22 bp, Homo sapiens
ttatttacaactcttctcttcc

SEQ ID NO: 7622008 - DNA, 22 bp, Homo sapiens
ttatttacaactcttctcttcc

SEQ ID NO: 7622009 - DNA, 22 bp, Homo sapiens
ttatttacaactcttctcttcc

SEQ ID NO: 7622010 - DNA, 22 bp, Homo sapiens
ttatttaattttctcactcaga

SEQ ID NO: 7622011 - DNA, 22 bp, Homo sapiens
ttatttacaactcttctcttcc

SEQ ID NO: 7622012 - DNA, 22 bp, Homo sapiens
ttatttacaactcttctcttcc

SEQ ID NO: 7622013 - DNA, 22 bp, Homo sapiens
ttatttacaactcttctcttcc

SEQ ID NO: 7622014 - DNA, 22 bp, Homo sapiens
ttatttacaactcttctcttcc

SEQ ID NO: 7622015 - DNA, 22 bp, Homo sapiens
ttatttacaactcttctcttcc

SEQ ID NO: 7622016 - DNA, 22 bp, Homo sapiens
ttatttactggatggccttggg

SEQ ID NO: 7622017 - DNA, 22 bp, Homo sapiens
ttatttactggatggccttggg

SEQ ID NO: 7622018 - DNA, 22 bp, Homo sapiens
ttatttactggatggccttggg

SEQ ID NO: 7622019 - DNA, 22 bp, Homo sapiens
ttatttactggatggccttggg

SEQ ID NO: 7622020 - DNA, 22 bp, Homo sapiens
ttatttacaactcttctcttcc

SEQ ID NO: 7622021 - DNA, 22 bp, Homo sapiens
ttatttgtggcatatgagacga

SEQ ID NO: 7622022 - DNA, 22 bp, Homo sapiens
ttatttgtggcatatgagacga

SEQ ID NO: 7622023 - DNA, 22 bp, Homo sapiens
ttatttgtggcatatgagacga

SEQ ID NO: 7622024 - DNA, 22 bp, Homo sapiens
ttatttgtggcatatgagacga

SEQ ID NO: 7622025 - DNA, 22 bp, Homo sapiens
ttatttatggcactgttggtgg

SEQ ID NO: 7622026 - DNA, 22 bp, Homo sapiens
ttatttgtggcatatgagacga

SEQ ID NO: 7622027 - DNA, 22 bp, Homo sapiens
ttatttgtggcatccatgttgg

SEQ ID NO: 7622028 - DNA, 22 bp, Homo sapiens
ttatttgtggcatccatgttgg

SEQ ID NO: 7622029 - DNA, 22 bp, Homo sapiens
ttatttgttttctgagaagtat

SEQ ID NO: 7622030 - DNA, 22 bp, Homo sapiens
ttatttgttttctgagaagtat

SEQ ID NO: 7622031 - DNA, 20 bp, Homo sapiens
ttatttgtttactttggtcc

SEQ ID NO: 7622032 - DNA, 18 bp, Homo sapiens
ttatttgttacagcacat

SEQ ID NO: 7622033 - DNA, 20 bp, Homo sapiens
ttatttgtttactttggtcc

SEQ ID NO: 7622034 - DNA, 20 bp, Homo sapiens
ttatttgtttactttggtcc

SEQ ID NO: 7622035 - DNA, 20 bp, Homo sapiens
ttatttgtttactttggtcc

SEQ ID NO: 7622036 - DNA, 22 bp, Homo sapiens
ttatttatatctctgcagttta

SEQ ID NO: 7622037 - DNA, 22 bp, Homo sapiens
ttatttatggcactgttggtgg

SEQ ID NO: 7622038 - DNA, 22 bp, Homo sapiens
ttatttatggcactgttggtgg

SEQ ID NO: 7622039 - DNA, 22 bp, Homo sapiens
ttatttgtggcatatgagacga

SEQ ID NO: 7622040 - DNA, 22 bp, Homo sapiens
ttatttgtggcatatgagacga

SEQ ID NO: 7622041 - DNA, 22 bp, Homo sapiens
ttatttatggcactgttggtgg

SEQ ID NO: 7622042 - DNA, 22 bp, Homo sapiens
ttatttatatctctgcagttta

SEQ ID NO: 7622043 - DNA, 22 bp, Homo sapiens
ttatttatatctctgcagttta

SEQ ID NO: 7622044 - DNA, 22 bp, Homo sapiens
ttatttagtctagatgaatttt

SEQ ID NO: 7622045 - DNA, 22 bp, Homo sapiens
ttatttagtctagatgaatttt

SEQ ID NO: 7622046 - DNA, 22 bp, Homo sapiens
ttatttatatctctgcagttta

SEQ ID NO: 7622047 - DNA, 22 bp, Homo sapiens
ttatttatatctctgcagttta

SEQ ID NO: 7622048 - DNA, 22 bp, Homo sapiens
ttattgtttactagtttgcaga

SEQ ID NO: 7622049 - DNA, 22 bp, Homo sapiens
ttattgtttactagtttgcaga

SEQ ID NO: 7622050 - DNA, 22 bp, Homo sapiens
ttattgtttactagtttgcaga

SEQ ID NO: 7622051 - DNA, 22 bp, Homo sapiens
ttattgtttgggtataatttga

SEQ ID NO: 7622052 - DNA, 22 bp, Homo sapiens
ttattgtttgggtataatttga

SEQ ID NO: 7622053 - DNA, 22 bp, Homo sapiens
ttattgtttgggtataatttga

SEQ ID NO: 7622054 - DNA, 22 bp, Homo sapiens
ttattgtttgggtataatttga

SEQ ID NO: 7622055 - DNA, 22 bp, Homo sapiens
ttattgtttgggtataatttga

SEQ ID NO: 7622056 - DNA, 22 bp, Homo sapiens
ttattgtttgggtataatttga

SEQ ID NO: 7622057 - DNA, 22 bp, Homo sapiens
ttattgtttgggtataatttga

SEQ ID NO: 7622058 - DNA, 22 bp, Homo sapiens
ttattgttagtgagactgtaga

SEQ ID NO: 7622059 - DNA, 22 bp, Homo sapiens
ttattgtttaaagccatgtaaa

SEQ ID NO: 7622060 - DNA, 22 bp, Homo sapiens
ttattgtttaaagccatgtaaa

SEQ ID NO: 7622061 - DNA, 22 bp, Homo sapiens
ttattgttagtgagactgtaga

SEQ ID NO: 7622062 - DNA, 22 bp, Homo sapiens
ttattgttagtgagactgtaga

SEQ ID NO: 7622063 - DNA, 22 bp, Homo sapiens
ttattaaaatgcggatttggct

SEQ ID NO: 7622064 - DNA, 22 bp, Homo sapiens
ttatgttttatggctatatcat

SEQ ID NO: 7622065 - DNA, 22 bp, Homo sapiens
ttattaaaatgcggatttggct

SEQ ID NO: 7622066 - DNA, 22 bp, Homo sapiens
ttattaaaatgcggatttggct

SEQ ID NO: 7622067 - DNA, 22 bp, Homo sapiens
ttattaaaatgcggatttggct

SEQ ID NO: 7622068 - DNA, 22 bp, Homo sapiens
ttattaaaatgcggatttggct

SEQ ID NO: 7622069 - DNA, 22 bp, Homo sapiens
ttattgttagtgagactgtaga

SEQ ID NO: 7622070 - DNA, 22 bp, Homo sapiens
ttattaaaatgcggatttggct

SEQ ID NO: 7622071 - DNA, 22 bp, Homo sapiens
ttattgttagtgagactgtaga

SEQ ID NO: 7622072 - DNA, 22 bp, Homo sapiens
ttattgttagtgagactgtaga

SEQ ID NO: 7622073 - DNA, 22 bp, Homo sapiens
ttatgttttatggctatatcat

SEQ ID NO: 7622074 - DNA, 22 bp, Homo sapiens
ttatgttttatggctatatcat

SEQ ID NO: 7622075 - DNA, 22 bp, Homo sapiens
ttatgttttaagtgtgtatctt

SEQ ID NO: 7622076 - DNA, 22 bp, Homo sapiens
ttatgttttaagtgtgtatctt

SEQ ID NO: 7622077 - DNA, 22 bp, Homo sapiens
ttatgttttaagtgtgtatctt

SEQ ID NO: 7622078 - DNA, 22 bp, Homo sapiens
ttatgttttaagtgtgtatctt

SEQ ID NO: 7622079 - DNA, 22 bp, Homo sapiens
ttatgtttgagtatatgactca

SEQ ID NO: 7622080 - DNA, 22 bp, Homo sapiens
ttatgttttaagtgtgtatctt

SEQ ID NO: 7622081 - DNA, 22 bp, Homo sapiens
ttatgtttgagtatatgactca

SEQ ID NO: 7622082 - DNA, 22 bp, Homo sapiens
ttatgtttgagtatatgactca

SEQ ID NO: 7622083 - DNA, 22 bp, Homo sapiens
ttatgtttgagtatatgactca

SEQ ID NO: 7622084 - DNA, 22 bp, Homo sapiens
ttatgtttgagtatatgactca

SEQ ID NO: 7622085 - DNA, 22 bp, Homo sapiens
ttatgtttgagtatatgactca

SEQ ID NO: 7622086 - DNA, 22 bp, Homo sapiens
ttatgttatgctatttcagata

SEQ ID NO: 7622087 - DNA, 22 bp, Homo sapiens
ttatgtgtgtgtatacatacaa

SEQ ID NO: 7622088 - DNA, 22 bp, Homo sapiens
ttatgttatgaatggatgatct

SEQ ID NO: 7622089 - DNA, 22 bp, Homo sapiens
ttatgttatgctatttcagata

SEQ ID NO: 7622090 - DNA, 22 bp, Homo sapiens
ttatgttgggaaaagtcagatt

SEQ ID NO: 7622091 - DNA, 22 bp, Homo sapiens
ttatttaaaagtggtaagattc

SEQ ID NO: 7622092 - DNA, 22 bp, Homo sapiens
ttatttaaaagtggtaagattc

SEQ ID NO: 7622093 - DNA, 22 bp, Homo sapiens
ttatttaaaagtggtaagattc

SEQ ID NO: 7622094 - DNA, 22 bp, Homo sapiens
ttatttaaaagtggtaagattc

SEQ ID NO: 7622095 - DNA, 22 bp, Homo sapiens
ttatttaaaagtggtaagattc

SEQ ID NO: 7622096 - DNA, 22 bp, Homo sapiens
ttatttaaaagtggtaagattc

SEQ ID NO: 7622097 - DNA, 22 bp, Homo sapiens
ttatttaaaagtggtaagattc

SEQ ID NO: 7622098 - DNA, 22 bp, Homo sapiens
ttatttaaaagtggtaagattc

SEQ ID NO: 7622099 - DNA, 22 bp, Homo sapiens
ttatttaaaagtggtaagattc

SEQ ID NO: 7622100 - DNA, 22 bp, Homo sapiens
ttattgtttgggtataatttga

SEQ ID NO: 7622101 - DNA, 22 bp, Homo sapiens
ttattgtttgggtataatttga

SEQ ID NO: 7622102 - DNA, 22 bp, Homo sapiens
ttattgtttgggtataatttga

SEQ ID NO: 7622103 - DNA, 22 bp, Homo sapiens
ttattgtttgggtataatttga

SEQ ID NO: 7622104 - DNA, 22 bp, Homo sapiens
ttattgtttgggtataatttga

SEQ ID NO: 7622105 - DNA, 22 bp, Homo sapiens
ttatttaaaatgtaggttggga

SEQ ID NO: 7622106 - DNA, 22 bp, Homo sapiens
ttatttaaaagtggtaagattc

SEQ ID NO: 7622107 - DNA, 22 bp, Homo sapiens
ttatttaaaagtggtaagattc

SEQ ID NO: 7622108 - DNA, 22 bp, Homo sapiens
ttatttaaaagtggtaagattc

SEQ ID NO: 7622109 - DNA, 22 bp, Homo sapiens
ttatttaaaagtggtaagattc

SEQ ID NO: 7622110 - DNA, 22 bp, Homo sapiens
ttatttaaaagtggtaagattc

SEQ ID NO: 7622111 - DNA, 22 bp, Homo sapiens
ttatttaaaagtggtaagattc

SEQ ID NO: 7622112 - DNA, 22 bp, Homo sapiens
ttatttaaaagtggtaagattc

SEQ ID NO: 7622113 - DNA, 22 bp, Homo sapiens
ttatttaatgtgatctgaagag

SEQ ID NO: 7622114 - DNA, 22 bp, Homo sapiens
ttatttaatgtgatctgaagag

SEQ ID NO: 7622115 - DNA, 22 bp, Homo sapiens
ttatttaatgtgatctgaagag

SEQ ID NO: 7622116 - DNA, 22 bp, Homo sapiens
ttatttaatgtgatctgaagag

SEQ ID NO: 7622117 - DNA, 22 bp, Homo sapiens
ttatttaaaatgtaggttggga

SEQ ID NO: 7622118 - DNA, 22 bp, Homo sapiens
ttatttaaaatgtaggttggga

SEQ ID NO: 7622119 - DNA, 22 bp, Homo sapiens
ttatttaaaatgtaggttggga

SEQ ID NO: 7622120 - DNA, 22 bp, Homo sapiens
ttatttaaaatgtaggttggga

SEQ ID NO: 7622121 - DNA, 22 bp, Homo sapiens
ttatttaatgtgatctgaagag

SEQ ID NO: 7622122 - DNA, 22 bp, Homo sapiens
ttatttaatgtgatctgaagag

SEQ ID NO: 7622123 - DNA, 22 bp, Homo sapiens
ttatttaatgtgatctgaagag

SEQ ID NO: 7622124 - DNA, 22 bp, Homo sapiens
ttatttaatgtgatctgaagag

SEQ ID NO: 7622125 - DNA, 22 bp, Homo sapiens
ttcaaacaaaactctttcctat

SEQ ID NO: 7622126 - DNA, 22 bp, Homo sapiens
ttcaaacaaaactgttcccata

SEQ ID NO: 7622127 - DNA, 22 bp, Homo sapiens
ttcaaacaaaactgttcccata

SEQ ID NO: 7622128 - DNA, 22 bp, Homo sapiens
ttcaaacaaaactgttcccata

SEQ ID NO: 7622129 - DNA, 22 bp, Homo sapiens
ttcaaacaactcatttatgcaa

SEQ ID NO: 7622130 - DNA, 22 bp, Homo sapiens
ttcaaacaactcatttatgcaa

SEQ ID NO: 7622131 - DNA, 22 bp, Homo sapiens
ttcaaacaactcatttatgcaa

SEQ ID NO: 7622132 - DNA, 22 bp, Homo sapiens
ttcaaacaactcatttatgcaa

SEQ ID NO: 7622133 - DNA, 22 bp, Homo sapiens
ttcaaacaactcatttatgcaa

SEQ ID NO: 7622134 - DNA, 22 bp, Homo sapiens
ttcaagaaggtacatttacatc

SEQ ID NO: 7622135 - DNA, 22 bp, Homo sapiens
ttcaagaaggtacatttacatc

SEQ ID NO: 7622136 - DNA, 22 bp, Homo sapiens
ttcaaaattgttctaagctctg

SEQ ID NO: 7622137 - DNA, 22 bp, Homo sapiens
ttcaaaattgttctaagctctg

SEQ ID NO: 7622138 - DNA, 22 bp, Homo sapiens
ttcaaaattgttctaagctctg

SEQ ID NO: 7622139 - DNA, 22 bp, Homo sapiens
ttcaaaattgttctaagctctg

SEQ ID NO: 7622140 - DNA, 22 bp, Homo sapiens
ttcaaaattgttctaagctctg

SEQ ID NO: 7622141 - DNA, 22 bp, Homo sapiens
ttcaaacaaaactctttcctat

SEQ ID NO: 7622142 - DNA, 22 bp, Homo sapiens
ttcaaacaaaactctttcctat

SEQ ID NO: 7622143 - DNA, 22 bp, Homo sapiens
ttcaaacaaaactctttcctat

SEQ ID NO: 7622144 - DNA, 22 bp, Homo sapiens
ttcaaaattgttctaagctctg

SEQ ID NO: 7622145 - DNA, 22 bp, Homo sapiens
ttcaaaattgttctaagctctg

SEQ ID NO: 7622146 - DNA, 22 bp, Homo sapiens
ttcaaaattgttctaagctctg

SEQ ID NO: 7622147 - DNA, 17 bp, Homo sapiens
ttcaagatattgaaatg

SEQ ID NO: 7622148 - DNA, 17 bp, Homo sapiens
ttcaagatattgaaatg

SEQ ID NO: 7622149 - DNA, 17 bp, Homo sapiens
ttcaagatattgaaatg

SEQ ID NO: 7622150 - DNA, 22 bp, Homo sapiens
ttcaagataataggaatgaaaa

SEQ ID NO: 7622151 - DNA, 22 bp, Homo sapiens
ttcaagatccagcacaacagtg

SEQ ID NO: 7622152 - DNA, 21 bp, Homo sapiens
ttcaagatatttaaaaggtgg

SEQ ID NO: 7622153 - DNA, 17 bp, Homo sapiens
ttcaagatattgaaatg

SEQ ID NO: 7622154 - DNA, 23 bp, Homo sapiens
ttcaagagccatgctcttcttat

SEQ ID NO: 7622155 - DNA, 22 bp, Homo sapiens
ttcaagaatcttcctgaccact

SEQ ID NO: 7622156 - DNA, 18 bp, Homo sapiens
ttcaagagtttctctagg

SEQ ID NO: 7622157 - DNA, 22 bp, Homo sapiens
ttcaagagtccaggagagtctg

SEQ ID NO: 7622158 - DNA, 18 bp, Homo sapiens
ttcaagagtttctctagg

SEQ ID NO: 7622159 - DNA, 18 bp, Homo sapiens
ttcaagagtttctctagg

SEQ ID NO: 7622160 - DNA, 22 bp, Homo sapiens
ttcaagcagttaagcagtctcc

SEQ ID NO: 7622161 - DNA, 23 bp, Homo sapiens
ttcaagggttatttgttagcact

SEQ ID NO: 7622162 - DNA, 22 bp, Homo sapiens
ttcaagggaaaacacagtgaat

SEQ ID NO: 7622163 - DNA, 22 bp, Homo sapiens
ttcaaggcaagtactttaattt

SEQ ID NO: 7622164 - DNA, 22 bp, Homo sapiens
ttcaaggctaaggaagggaagg

SEQ ID NO: 7622165 - DNA, 22 bp, Homo sapiens
ttcaaggctaaggaagggaagg

SEQ ID NO: 7622166 - DNA, 22 bp, Homo sapiens
ttcaagggaaaacacagtgaat

SEQ ID NO: 7622167 - DNA, 22 bp, Homo sapiens
ttcaagggaaaacacagtgaat

SEQ ID NO: 7622168 - DNA, 22 bp, Homo sapiens
ttcaaggagattggagtctact

SEQ ID NO: 7622169 - DNA, 22 bp, Homo sapiens
ttcaagcagagatatttcaaga

SEQ ID NO: 7622170 - DNA, 22 bp, Homo sapiens
ttcaagcagggattggtgatgg

SEQ ID NO: 7622171 - DNA, 22 bp, Homo sapiens
ttcaagcagagatatttcaaga

SEQ ID NO: 7622172 - DNA, 22 bp, Homo sapiens
ttcaagatgtcttcacaatagt

SEQ ID NO: 7622173 - DNA, 22 bp, Homo sapiens
ttcaagatgtcttcacaatagt

SEQ ID NO: 7622174 - DNA, 22 bp, Homo sapiens
ttcaagatgtcttcacaatagt

SEQ ID NO: 7622175 - DNA, 22 bp, Homo sapiens
ttcaagcaccaaattagtaggc

SEQ ID NO: 7622176 - DNA, 22 bp, Homo sapiens
ttcaagatgacccagtcacacg

SEQ ID NO: 7622177 - DNA, 22 bp, Homo sapiens
ttcaagatcttccaaaggatac

SEQ ID NO: 7622178 - DNA, 22 bp, Homo sapiens
ttcaagatcttccaaaggatac

SEQ ID NO: 7622179 - DNA, 22 bp, Homo sapiens
ttcaagatcgagtttaaagtga

SEQ ID NO: 7622180 - DNA, 22 bp, Homo sapiens
ttcaagatcgagtttaaagtga

SEQ ID NO: 7622181 - DNA, 22 bp, Homo sapiens
ttcaagatcgagtttaaagtga

SEQ ID NO: 7622182 - DNA, 22 bp, Homo sapiens
ttcaagatcgagtttaaagtga

SEQ ID NO: 7622183 - DNA, 22 bp, Homo sapiens
ttcaagatggctgcaaatactt

SEQ ID NO: 7622184 - DNA, 22 bp, Homo sapiens
ttcaagatggctgcaaatactt

SEQ ID NO: 7622185 - DNA, 22 bp, Homo sapiens
ttattttggtaaatgtttgcct

SEQ ID NO: 7622186 - DNA, 22 bp, Homo sapiens
ttattttggtaaatgtttgcct

SEQ ID NO: 7622187 - DNA, 22 bp, Homo sapiens
ttattttgccacaggtgacctt

SEQ ID NO: 7622188 - DNA, 22 bp, Homo sapiens
ttattttggtaaatgtttgcct

SEQ ID NO: 7622189 - DNA, 22 bp, Homo sapiens
ttattttggtaaatgtttgcct

SEQ ID NO: 7622190 - DNA, 22 bp, Homo sapiens
ttattttggtaaatgtttgcct

SEQ ID NO: 7622191 - DNA, 22 bp, Homo sapiens
ttattttgtagctctgatcttt

SEQ ID NO: 7622192 - DNA, 22 bp, Homo sapiens
ttattttgtagctctgatcttt

SEQ ID NO: 7622193 - DNA, 22 bp, Homo sapiens
ttattttgtagctctgatcttt

SEQ ID NO: 7622194 - DNA, 22 bp, Homo sapiens
ttattttgtagctctgatcttt

SEQ ID NO: 7622195 - DNA, 22 bp, Homo sapiens
ttcaaaagactcagatgtagcg

SEQ ID NO: 7622196 - DNA, 23 bp, Homo sapiens
ttcaaaactggaaaatcagatgc

SEQ ID NO: 7622197 - DNA, 23 bp, Homo sapiens
ttcaaaactggaaaatcagatgc

SEQ ID NO: 7622198 - DNA, 23 bp, Homo sapiens
ttcaaaactggaaaatcagatgc

SEQ ID NO: 7622199 - DNA, 22 bp, Homo sapiens
ttattttgtagctctgatcttt

SEQ ID NO: 7622200 - DNA, 23 bp, Homo sapiens
ttcaaaactggaaaatcagatgc

SEQ ID NO: 7622201 - DNA, 22 bp, Homo sapiens
ttattttgtagctctgatcttt

SEQ ID NO: 7622202 - DNA, 22 bp, Homo sapiens
ttattttgtagctctgatcttt

SEQ ID NO: 7622203 - DNA, 22 bp, Homo sapiens
ttcaaaagcggtccaggaagat

SEQ ID NO: 7622204 - DNA, 22 bp, Homo sapiens
ttcaaaagcggtccaggaagat

SEQ ID NO: 7622205 - DNA, 22 bp, Homo sapiens
ttcaaaagcggtccaggaagat

SEQ ID NO: 7622206 - DNA, 22 bp, Homo sapiens
ttcaaaagtaatcagtattaga

SEQ ID NO: 7622207 - DNA, 22 bp, Homo sapiens
ttcaaaagtaatcagtattaga

SEQ ID NO: 7622208 - DNA, 22 bp, Homo sapiens
ttcaaaatccgggaggcgcccc

SEQ ID NO: 7622209 - DNA, 22 bp, Homo sapiens
ttcaaaagtaatcagtattaga

SEQ ID NO: 7622210 - DNA, 21 bp, Homo sapiens
ttcaaaatggtgtgtttgtct

SEQ ID NO: 7622211 - DNA, 21 bp, Homo sapiens
ttcaaaatggtgtgtttgtct

SEQ ID NO: 7622212 - DNA, 21 bp, Homo sapiens
ttcaaaatggtgtgtttgtct

SEQ ID NO: 7622213 - DNA, 21 bp, Homo sapiens
ttcaaaatggtgtgtttgtct

SEQ ID NO: 7622214 - DNA, 21 bp, Homo sapiens
ttcaaaatggtgtgtttgtct

SEQ ID NO: 7622215 - DNA, 22 bp, Homo sapiens
ttcaaaatgcacaaagggctag

SEQ ID NO: 7622216 - DNA, 22 bp, Homo sapiens
ttcaaaatgcacaaagggctag

SEQ ID NO: 7622217 - DNA, 21 bp, Homo sapiens
ttcaaaatggtgtgtttgtct

SEQ ID NO: 7622218 - DNA, 21 bp, Homo sapiens
ttcaaaatggtgtgtttgtct

SEQ ID NO: 7622219 - DNA, 21 bp, Homo sapiens
ttcaaaatggtgtgtttgtct

SEQ ID NO: 7622220 - DNA, 22 bp, Homo sapiens
ttattttaccttcctctgagct

SEQ ID NO: 7622221 - DNA, 22 bp, Homo sapiens
ttattttaccttcctctgagct

SEQ ID NO: 7622222 - DNA, 22 bp, Homo sapiens
ttattttaccttcctctgagct

SEQ ID NO: 7622223 - DNA, 22 bp, Homo sapiens
ttattttaccttcctctgagct

SEQ ID NO: 7622224 - DNA, 22 bp, Homo sapiens
ttattttaccttcctctgagct

SEQ ID NO: 7622225 - DNA, 22 bp, Homo sapiens
ttattttaccttcctctgagct

SEQ ID NO: 7622226 - DNA, 22 bp, Homo sapiens
ttattttaccttcctctgagct

SEQ ID NO: 7622227 - DNA, 22 bp, Homo sapiens
ttattttaccttcctctgagct

SEQ ID NO: 7622228 - DNA, 22 bp, Homo sapiens
ttattttaccttcctctgagct

SEQ ID NO: 7622229 - DNA, 22 bp, Homo sapiens
ttattttcagctaggaaagcca

SEQ ID NO: 7622230 - DNA, 22 bp, Homo sapiens
ttattttcagctaggaaagcca

SEQ ID NO: 7622231 - DNA, 22 bp, Homo sapiens
ttattttcagctaggaaagcca

SEQ ID NO: 7622232 - DNA, 22 bp, Homo sapiens
ttattttctcctcagaaagtgg

SEQ ID NO: 7622233 - DNA, 22 bp, Homo sapiens
ttattttctcctcagaaagtgg

SEQ ID NO: 7622234 - DNA, 22 bp, Homo sapiens
ttattttctcctcagaaagtgg

SEQ ID NO: 7622235 - DNA, 22 bp, Homo sapiens
ttattttctcctcagaaagtgg

SEQ ID NO: 7622236 - DNA, 22 bp, Homo sapiens
ttattttcagctaggaaagcca

SEQ ID NO: 7622237 - DNA, 22 bp, Homo sapiens
ttattttctcctcagaaagtgg

SEQ ID NO: 7622238 - DNA, 22 bp, Homo sapiens
ttattttctcctcagaaagtgg

SEQ ID NO: 7622239 - DNA, 22 bp, Homo sapiens
ttattttctcctcagaaagtgg

SEQ ID NO: 7622240 - DNA, 22 bp, Homo sapiens
ttattttgagagaatgtgtgct

SEQ ID NO: 7622241 - DNA, 22 bp, Homo sapiens
ttattttgccacaggtgacctt

SEQ ID NO: 7622242 - DNA, 22 bp, Homo sapiens
ttattttgccacaggtgacctt

SEQ ID NO: 7622243 - DNA, 22 bp, Homo sapiens
ttattttgccacaggtgacctt

SEQ ID NO: 7622244 - DNA, 22 bp, Homo sapiens
ttattttggtaaatgtttgcct

SEQ ID NO: 7622245 - DNA, 22 bp, Homo sapiens
ttattttggtaaatgtttgcct

SEQ ID NO: 7622246 - DNA, 22 bp, Homo sapiens
ttattttgccacaggtgacctt

SEQ ID NO: 7622247 - DNA, 22 bp, Homo sapiens
ttattttggtaaatgtttgcct

SEQ ID NO: 7622248 - DNA, 22 bp, Homo sapiens
ttattttgagagaatgtgtgct

SEQ ID NO: 7622249 - DNA, 22 bp, Homo sapiens
ttattttgagagaatgtgtgct

SEQ ID NO: 7622250 - DNA, 22 bp, Homo sapiens
ttattttgccacaggtgacctt

SEQ ID NO: 7622251 - DNA, 22 bp, Homo sapiens
ttattttctcctcagaaagtgg

SEQ ID NO: 7622252 - DNA, 22 bp, Homo sapiens
ttattttctcctcagaaagtgg

SEQ ID NO: 7622253 - DNA, 22 bp, Homo sapiens
ttattttgagagaatgtgtgct

SEQ ID NO: 7622254 - DNA, 22 bp, Homo sapiens
ttattttctcctcagaaagtgg

SEQ ID NO: 7622255 - DNA, 22 bp, Homo sapiens
ttattttctcctcagaaagtgg

SEQ ID NO: 7622256 - DNA, 22 bp, Homo sapiens
ttattttgagagaatgtgtgct

SEQ ID NO: 7622257 - DNA, 22 bp, Homo sapiens
ttattttgagagaatgtgtgct

SEQ ID NO: 7622258 - DNA, 22 bp, Homo sapiens
ttattttgagagaatgtgtgct

SEQ ID NO: 7622259 - DNA, 22 bp, Homo sapiens
ttatgcagaggcatgctcactc

SEQ ID NO: 7622260 - DNA, 22 bp, Homo sapiens
ttatgcaaggacttattacagt

SEQ ID NO: 7622261 - DNA, 22 bp, Homo sapiens
ttatgcaaggacttattacagt

SEQ ID NO: 7622262 - DNA, 22 bp, Homo sapiens
ttatgcaaggacttattacagt

SEQ ID NO: 7622263 - DNA, 22 bp, Homo sapiens
ttatgcaaggacttattacagt

SEQ ID NO: 7622264 - DNA, 22 bp, Homo sapiens
ttatgcaaggacttattacagt

SEQ ID NO: 7622265 - DNA, 23 bp, Homo sapiens
ttatgcaagcttcctggtctcag

SEQ ID NO: 7622266 - DNA, 20 bp, Homo sapiens
ttatgcaagcatcaatattg

SEQ ID NO: 7622267 - DNA, 23 bp, Homo sapiens
ttatgcaagcttcctggtctcag

SEQ ID NO: 7622268 - DNA, 23 bp, Homo sapiens
ttatgcaagcttcctggtctcag

SEQ ID NO: 7622269 - DNA, 20 bp, Homo sapiens
ttatgcaagcatcaatattg

SEQ ID NO: 7622270 - DNA, 20 bp, Homo sapiens
ttatgcaagcatcaatattg

SEQ ID NO: 7622271 - DNA, 22 bp, Homo sapiens
ttatacagtttatacttagaat

SEQ ID NO: 7622272 - DNA, 22 bp, Homo sapiens
ttatacagtttatacttagaat

SEQ ID NO: 7622273 - DNA, 22 bp, Homo sapiens
ttatacagtttatacttagaat

SEQ ID NO: 7622274 - DNA, 22 bp, Homo sapiens
ttatacagggagtttccctgca

SEQ ID NO: 7622275 - DNA, 22 bp, Homo sapiens
ttatacaggagattccttactt

SEQ ID NO: 7622276 - DNA, 22 bp, Homo sapiens
ttatacaccatcactgccttgg

SEQ ID NO: 7622277 - DNA, 22 bp, Homo sapiens
ttatacaccatcactgccttgg

SEQ ID NO: 7622278 - DNA, 22 bp, Homo sapiens
ttatacacgtttatggagctac

SEQ ID NO: 7622279 - DNA, 22 bp, Homo sapiens
ttatacactgcagaaccagcat

SEQ ID NO: 7622280 - DNA, 22 bp, Homo sapiens
ttatacacgtttatggagctac

SEQ ID NO: 7622281 - DNA, 22 bp, Homo sapiens
ttatacagcattgctagtgatg

SEQ ID NO: 7622282 - DNA, 22 bp, Homo sapiens
ttatacagcattgctagtgatg

SEQ ID NO: 7622283 - DNA, 22 bp, Homo sapiens
ttatacagcattgctagtgatg

SEQ ID NO: 7622284 - DNA, 22 bp, Homo sapiens
ttataattctggcataggctgt

SEQ ID NO: 7622285 - DNA, 22 bp, Homo sapiens
ttataattctggcataggctgt

SEQ ID NO: 7622286 - DNA, 22 bp, Homo sapiens
ttataattctggcataggctgt

SEQ ID NO: 7622287 - DNA, 22 bp, Homo sapiens
ttataattgcttattagaccca

SEQ ID NO: 7622288 - DNA, 22 bp, Homo sapiens
ttataattgcttattagaccca

SEQ ID NO: 7622289 - DNA, 22 bp, Homo sapiens
ttatacacaattcttttactac

SEQ ID NO: 7622290 - DNA, 22 bp, Homo sapiens
ttatacacaattcttttactac

SEQ ID NO: 7622291 - DNA, 22 bp, Homo sapiens
ttatacacaattcttttactac

SEQ ID NO: 7622292 - DNA, 22 bp, Homo sapiens
ttatacacaattcttttactac

SEQ ID NO: 7622293 - DNA, 22 bp, Homo sapiens
ttagttagagccctatgttagg

SEQ ID NO: 7622294 - DNA, 22 bp, Homo sapiens
ttagttagaataatacaagtaa

SEQ ID NO: 7622295 - DNA, 22 bp, Homo sapiens
ttagttatactactgaatggag

SEQ ID NO: 7622296 - DNA, 22 bp, Homo sapiens
ttagttatactactgaatggag

SEQ ID NO: 7622297 - DNA, 22 bp, Homo sapiens
ttagttcactgctatatcatca

SEQ ID NO: 7622298 - DNA, 22 bp, Homo sapiens
ttagttatttttgtcctccaag

SEQ ID NO: 7622299 - DNA, 22 bp, Homo sapiens
ttagttatagtgaagaaatact

SEQ ID NO: 7622300 - DNA, 22 bp, Homo sapiens
ttagttatagtgaagaaatact

SEQ ID NO: 7622301 - DNA, 22 bp, Homo sapiens
ttagttattaggtggcagagct

SEQ ID NO: 7622302 - DNA, 22 bp, Homo sapiens
ttagttatactactgaatggag

SEQ ID NO: 7622303 - DNA, 22 bp, Homo sapiens
ttagttgaatatgcatttttgc

SEQ ID NO: 7622304 - DNA, 22 bp, Homo sapiens
ttagttctcatgaattttaagt

SEQ ID NO: 7622305 - DNA, 20 bp, Homo sapiens
ttagttgagtagctcctgaa

SEQ ID NO: 7622306 - DNA, 22 bp, Homo sapiens
ttataaggtgccctgtgtccag

SEQ ID NO: 7622307 - DNA, 22 bp, Homo sapiens
ttataagctctgaaatctccta

SEQ ID NO: 7622308 - DNA, 22 bp, Homo sapiens
ttataagagtatatagtgtact

SEQ ID NO: 7622309 - DNA, 22 bp, Homo sapiens
ttataattctggcataggctgt

SEQ ID NO: 7622310 - DNA, 22 bp, Homo sapiens
ttataattctggcataggctgt

SEQ ID NO: 7622311 - DNA, 22 bp, Homo sapiens
ttataattctggcataggctgt

SEQ ID NO: 7622312 - DNA, 22 bp, Homo sapiens
ttataattctggcataggctgt

SEQ ID NO: 7622313 - DNA, 22 bp, Homo sapiens
ttagttgcaatctattgacgtt

SEQ ID NO: 7622314 - DNA, 22 bp, Homo sapiens
ttagttgcatgccagacttggc

SEQ ID NO: 7622315 - DNA, 22 bp, Homo sapiens
ttagttgccagtgaggaggatt

SEQ ID NO: 7622316 - DNA, 22 bp, Homo sapiens
ttagttgcatgccagacttggc

SEQ ID NO: 7622317 - DNA, 22 bp, Homo sapiens
ttagttgccagtgaggaggatt

SEQ ID NO: 7622318 - DNA, 22 bp, Homo sapiens
ttagttgcctcagtgggcactt

SEQ ID NO: 7622319 - DNA, 22 bp, Homo sapiens
ttagttgctcactacaaggtta

SEQ ID NO: 7622320 - DNA, 22 bp, Homo sapiens
ttagttgctggcagaccctagg

SEQ ID NO: 7622321 - DNA, 22 bp, Homo sapiens
ttagttgtaaaatggaatttgt

SEQ ID NO: 7622322 - DNA, 22 bp, Homo sapiens
ttagtttataattcatttctgt

SEQ ID NO: 7622323 - DNA, 22 bp, Homo sapiens
ttagtttataattcatttctgt

SEQ ID NO: 7622324 - DNA, 22 bp, Homo sapiens
ttagttgcctcagtgggcactt

SEQ ID NO: 7622325 - DNA, 22 bp, Homo sapiens
ttataactttggatatgacaag

SEQ ID NO: 7622326 - DNA, 23 bp, Homo sapiens
ttataagaagcatcacaggaaga

SEQ ID NO: 7622327 - DNA, 23 bp, Homo sapiens
ttataagaagcatcacaggaaga

SEQ ID NO: 7622328 - DNA, 23 bp, Homo sapiens
ttataagaagcatcacaggaaga

SEQ ID NO: 7622329 - DNA, 22 bp, Homo sapiens
ttatggaagtgcaaattgtgtg

SEQ ID NO: 7622330 - DNA, 22 bp, Homo sapiens
ttatggaaaatacaattataag

SEQ ID NO: 7622331 - DNA, 22 bp, Homo sapiens
ttatggaataacctttctgaaa

SEQ ID NO: 7622332 - DNA, 22 bp, Homo sapiens
ttatggaagtgcaaattgtgtg

SEQ ID NO: 7622333 - DNA, 22 bp, Homo sapiens
ttatggaaaatacaattataag

SEQ ID NO: 7622334 - DNA, 22 bp, Homo sapiens
ttatggaaaatacaattataag

SEQ ID NO: 7622335 - DNA, 22 bp, Homo sapiens
ttatggaaatgaaattttattg

SEQ ID NO: 7622336 - DNA, 22 bp, Homo sapiens
ttatgctgttaggaaaatcaaa

SEQ ID NO: 7622337 - DNA, 22 bp, Homo sapiens
ttatgctagttgaaataacaca

SEQ ID NO: 7622338 - DNA, 22 bp, Homo sapiens
ttatgcttaaaatcactaggat

SEQ ID NO: 7622339 - DNA, 22 bp, Homo sapiens
ttatgcttgcagatttaagggt

SEQ ID NO: 7622340 - DNA, 22 bp, Homo sapiens
ttatggaaaactccagagagta

SEQ ID NO: 7622341 - DNA, 22 bp, Homo sapiens
ttatggaaaatacaattataag

SEQ ID NO: 7622342 - DNA, 22 bp, Homo sapiens
ttatgctgttaggaaaatcaaa

SEQ ID NO: 7622343 - DNA, 22 bp, Homo sapiens
ttatggaaaactccagagagta

SEQ ID NO: 7622344 - DNA, 22 bp, Homo sapiens
ttatggaaaactccagagagta

SEQ ID NO: 7622345 - DNA, 22 bp, Homo sapiens
ttatgcttttagaatttagcat

SEQ ID NO: 7622346 - DNA, 23 bp, Homo sapiens
ttatgctttggcactcttgttag

SEQ ID NO: 7622347 - DNA, 22 bp, Homo sapiens
ttatgcttgttcacagaggtca

SEQ ID NO: 7622348 - DNA, 22 bp, Homo sapiens
ttatgctttgtgggcctacttt

SEQ ID NO: 7622349 - DNA, 22 bp, Homo sapiens
ttatgctagttgaaataacaca

SEQ ID NO: 7622350 - DNA, 22 bp, Homo sapiens
ttatgctagttgaaataacaca

SEQ ID NO: 7622351 - DNA, 22 bp, Homo sapiens
ttatgctagtatagtccttaga

SEQ ID NO: 7622352 - DNA, 22 bp, Homo sapiens
ttatgctagtatagtccttaga

SEQ ID NO: 7622353 - DNA, 22 bp, Homo sapiens
ttatgctaagtgcaacaagcca

SEQ ID NO: 7622354 - DNA, 22 bp, Homo sapiens
ttatgctaagtggaataagcca

SEQ ID NO: 7622355 - DNA, 22 bp, Homo sapiens
ttatgcatatagcagatacgag

SEQ ID NO: 7622356 - DNA, 22 bp, Homo sapiens
ttatgctaaatgaatcaagtca

SEQ ID NO: 7622357 - DNA, 22 bp, Homo sapiens
ttatgctaacctcatcttctcc

SEQ ID NO: 7622358 - DNA, 22 bp, Homo sapiens
ttatgctaacctcatcttctcc

SEQ ID NO: 7622359 - DNA, 22 bp, Homo sapiens
ttatgctaacctcatcttctcc

SEQ ID NO: 7622360 - DNA, 22 bp, Homo sapiens
ttatgctaacctcatcttctcc

SEQ ID NO: 7622361 - DNA, 22 bp, Homo sapiens
ttatgctaagtgaaataagcca

SEQ ID NO: 7622362 - DNA, 20 bp, Homo sapiens
ttatgcaggtcatctcaact

SEQ ID NO: 7622363 - DNA, 22 bp, Homo sapiens
ttatgcatgagataaaaattgg

SEQ ID NO: 7622364 - DNA, 22 bp, Homo sapiens
ttatgcatgagataaaaattgg

SEQ ID NO: 7622365 - DNA, 22 bp, Homo sapiens
ttatgcaggtacatgctgaaaa

SEQ ID NO: 7622366 - DNA, 21 bp, Homo sapiens
ttatggagaaggaaagtaagg

SEQ ID NO: 7622367 - DNA, 22 bp, Homo sapiens
ttatggaatttgcaaaaggtta

SEQ ID NO: 7622368 - DNA, 22 bp, Homo sapiens
ttatggaatttgcaaaaggtta

SEQ ID NO: 7622369 - DNA, 22 bp, Homo sapiens
ttatggaatttgcaaaaggtta

SEQ ID NO: 7622370 - DNA, 22 bp, Homo sapiens
ttatggaatggagaaagtctgc

SEQ ID NO: 7622371 - DNA, 22 bp, Homo sapiens
ttatggaatggagaaagtctgc

SEQ ID NO: 7622372 - DNA, 22 bp, Homo sapiens
ttatggaatggagaaagtctgc

SEQ ID NO: 7622373 - DNA, 22 bp, Homo sapiens
ttatggaatggagaaagtctgc

SEQ ID NO: 7622374 - DNA, 22 bp, Homo sapiens
ttatggaataacctttctgaaa

SEQ ID NO: 7622375 - DNA, 22 bp, Homo sapiens
ttatggaatacttatgctgcag

SEQ ID NO: 7622376 - DNA, 22 bp, Homo sapiens
ttatggcaagggttttaatttg

SEQ ID NO: 7622377 - DNA, 22 bp, Homo sapiens
ttatggagtgcttacctgccag

SEQ ID NO: 7622378 - DNA, 22 bp, Homo sapiens
ttatggcaagggttttaatttg

SEQ ID NO: 7622379 - DNA, 22 bp, Homo sapiens
ttatggagtgcttacctgccag

SEQ ID NO: 7622380 - DNA, 23 bp, Homo sapiens
ttatggagtgccagacatttggc

SEQ ID NO: 7622381 - DNA, 22 bp, Homo sapiens
ttatggagcagacagctggtca

SEQ ID NO: 7622382 - DNA, 22 bp, Homo sapiens
ttatggagactttcagaagcgg

SEQ ID NO: 7622383 - DNA, 22 bp, Homo sapiens
ttatgtgcagaacctgggcttc

SEQ ID NO: 7622384 - DNA, 22 bp, Homo sapiens
ttatgtgcttcaactgagccta

SEQ ID NO: 7622385 - DNA, 22 bp, Homo sapiens
ttatgtgtacctcaatctgagg

SEQ ID NO: 7622386 - DNA, 22 bp, Homo sapiens
ttatgtgccactttttgaagat

SEQ ID NO: 7622387 - DNA, 22 bp, Homo sapiens
ttatgtgccactttttgaagat

SEQ ID NO: 7622388 - DNA, 22 bp, Homo sapiens
ttatgtcttaagtatgctaatt

SEQ ID NO: 7622389 - DNA, 22 bp, Homo sapiens
ttatgtcttaagtatgctaatt

SEQ ID NO: 7622390 - DNA, 22 bp, Homo sapiens
ttatgtgtataattacaggaag

SEQ ID NO: 7622391 - DNA, 22 bp, Homo sapiens
ttatgtgtgtacatgcatatgt

SEQ ID NO: 7622392 - DNA, 20 bp, Homo sapiens
ttatgtgtacctgtgctccc

SEQ ID NO: 7622393 - DNA, 22 bp, Homo sapiens
ttatgtgtgtacatgcatatgt

SEQ ID NO: 7622394 - DNA, 22 bp, Homo sapiens
ttatgtgtgtgtatacatacaa

SEQ ID NO: 7622395 - DNA, 22 bp, Homo sapiens
ttatgtgtgtacatgcatatgt

SEQ ID NO: 7622396 - DNA, 22 bp, Homo sapiens
ttatgtgtgtgtatacatacaa

SEQ ID NO: 7622397 - DNA, 22 bp, Homo sapiens
ttatgttatgaatggatgatct

SEQ ID NO: 7622398 - DNA, 22 bp, Homo sapiens
ttagtggggatgtatgggaggc

SEQ ID NO: 7622399 - DNA, 22 bp, Homo sapiens
ttagtgggatattggctattca

SEQ ID NO: 7622400 - DNA, 22 bp, Homo sapiens
ttagtggtaaggatgaaatttc

SEQ ID NO: 7622401 - DNA, 22 bp, Homo sapiens
ttagtggtactcagggagggaa

SEQ ID NO: 7622402 - DNA, 22 bp, Homo sapiens
ttagtgctcatccagatggggg

SEQ ID NO: 7622403 - DNA, 22 bp, Homo sapiens
ttagtgcttctgtccaaatata

SEQ ID NO: 7622404 - DNA, 22 bp, Homo sapiens
ttagtgcttctgtccaaatata

SEQ ID NO: 7622405 - DNA, 22 bp, Homo sapiens
ttagtgcttggcacacaataca

SEQ ID NO: 7622406 - DNA, 22 bp, Homo sapiens
ttagtgcttgttttaaaaatat

SEQ ID NO: 7622407 - DNA, 20 bp, Homo sapiens
ttagtggacagtattacata

SEQ ID NO: 7622408 - DNA, 22 bp, Homo sapiens
ttagtggagagttattatcagc

SEQ ID NO: 7622409 - DNA, 22 bp, Homo sapiens
ttagtgtaaattgtgcttgaga

SEQ ID NO: 7622410 - DNA, 23 bp, Homo sapiens
ttagtgtaaggcaggcacagttg

SEQ ID NO: 7622411 - DNA, 22 bp, Homo sapiens
ttagtgtacttagtgctctaag

SEQ ID NO: 7622412 - DNA, 17 bp, Homo sapiens
ttagtgtatctgttttg

SEQ ID NO: 7622413 - DNA, 17 bp, Homo sapiens
ttagtgtatctgttttg

SEQ ID NO: 7622414 - DNA, 22 bp, Homo sapiens
ttagtgtattttcaaatgtaga

SEQ ID NO: 7622415 - DNA, 17 bp, Homo sapiens
ttagtgtatctgttttg

SEQ ID NO: 7622416 - DNA, 22 bp, Homo sapiens
ttagttaattgactatgttgca

SEQ ID NO: 7622417 - DNA, 22 bp, Homo sapiens
ttagttaattgactatgttgca

SEQ ID NO: 7622418 - DNA, 22 bp, Homo sapiens
ttagttaaaattctgctgacat

SEQ ID NO: 7622419 - DNA, 22 bp, Homo sapiens
ttagttaaaagataattttgga

SEQ ID NO: 7622420 - DNA, 22 bp, Homo sapiens
ttagtgtttaaaggtttcagag

SEQ ID NO: 7622421 - DNA, 22 bp, Homo sapiens
ttagtgtgttatataccaagct

SEQ ID NO: 7622422 - DNA, 22 bp, Homo sapiens
ttagtgtttaaaggtttcagag

SEQ ID NO: 7622423 - DNA, 22 bp, Homo sapiens
ttagtgttagggcctgttacct

SEQ ID NO: 7622424 - DNA, 22 bp, Homo sapiens
ttagtgttcacagccactctat

SEQ ID NO: 7622425 - DNA, 22 bp, Homo sapiens
ttagtgtgtccagttctgaaaa

SEQ ID NO: 7622426 - DNA, 22 bp, Homo sapiens
ttagtgtgttaatgagtatatc

SEQ ID NO: 7622427 - DNA, 22 bp, Homo sapiens
ttagtgtgttaatgagtatatc

SEQ ID NO: 7622428 - DNA, 22 bp, Homo sapiens
ttagtgtgttatataccaagct

SEQ ID NO: 7622429 - DNA, 22 bp, Homo sapiens
ttagtgtgttatataccaagct

SEQ ID NO: 7622430 - DNA, 22 bp, Homo sapiens
ttagtgtgcatggatctgtgga

SEQ ID NO: 7622431 - DNA, 22 bp, Homo sapiens
ttagtgtgtccagttctgaaaa

SEQ ID NO: 7622432 - DNA, 22 bp, Homo sapiens
ttagtgtgtccagttctgaaaa

SEQ ID NO: 7622433 - DNA, 22 bp, Homo sapiens
ttagtgtctggctatatttaaa

SEQ ID NO: 7622434 - DNA, 22 bp, Homo sapiens
ttagtgtctggctatatttaaa

SEQ ID NO: 7622435 - DNA, 22 bp, Homo sapiens
ttagtgtctttcaaaaggttta

SEQ ID NO: 7622436 - DNA, 22 bp, Homo sapiens
ttagtgtgcatggatctgtgga

SEQ ID NO: 7622437 - DNA, 22 bp, Homo sapiens
tcctctggcccagctgcctctg

SEQ ID NO: 7622438 - DNA, 22 bp, Homo sapiens
tcctctggcccagctgcctctg

SEQ ID NO: 7622439 - DNA, 22 bp, Homo sapiens
tcctctggatataagcctcacc

SEQ ID NO: 7622440 - DNA, 22 bp, Homo sapiens
tcctctggcccagctgcctctg

SEQ ID NO: 7622441 - DNA, 22 bp, Homo sapiens
tcctctggcccagctgcctctg

SEQ ID NO: 7622442 - DNA, 22 bp, Homo sapiens
tcctctggcccagctgcctctg

SEQ ID NO: 7622443 - DNA, 22 bp, Homo sapiens
tcctctggctctttccctagga

SEQ ID NO: 7622444 - DNA, 22 bp, Homo sapiens
tcctctggctctttccctagga

SEQ ID NO: 7622445 - DNA, 22 bp, Homo sapiens
tcctctggctctttccctagga

SEQ ID NO: 7622446 - DNA, 22 bp, Homo sapiens
tcctctggctctttccctagga

SEQ ID NO: 7622447 - DNA, 22 bp, Homo sapiens
tcctctggctctttccctagga

SEQ ID NO: 7622448 - DNA, 22 bp, Homo sapiens
tcctctggccttggaatccttt

SEQ ID NO: 7622449 - DNA, 22 bp, Homo sapiens
tcctctggccttggaatccttt

SEQ ID NO: 7622450 - DNA, 22 bp, Homo sapiens
tcctctgggcctatttgttcac

SEQ ID NO: 7622451 - DNA, 22 bp, Homo sapiens
tcctctgggcctatttgttcac

SEQ ID NO: 7622452 - DNA, 22 bp, Homo sapiens
tcctctgggcctatttgttcac

SEQ ID NO: 7622453 - DNA, 22 bp, Homo sapiens
tcctctggctctttccctagga

SEQ ID NO: 7622454 - DNA, 22 bp, Homo sapiens
tcctctggctctttccctagga

SEQ ID NO: 7622455 - DNA, 21 bp, Homo sapiens
tcctctgctctcataccacaa

SEQ ID NO: 7622456 - DNA, 21 bp, Homo sapiens
tcctctgctctcataccacaa

SEQ ID NO: 7622457 - DNA, 21 bp, Homo sapiens
tcctctgctctcataccacaa

SEQ ID NO: 7622458 - DNA, 22 bp, Homo sapiens
tcctctgctccatctttactgt

SEQ ID NO: 7622459 - DNA, 22 bp, Homo sapiens
tcctctgctccatctttactgt

SEQ ID NO: 7622460 - DNA, 22 bp, Homo sapiens
tcctctgctggaagggcaagag

SEQ ID NO: 7622461 - DNA, 22 bp, Homo sapiens
tcctctgctgttctggttcttt

SEQ ID NO: 7622462 - DNA, 22 bp, Homo sapiens
tcctctggatataagcctcacc

SEQ ID NO: 7622463 - DNA, 22 bp, Homo sapiens
tcctctggatataagcctcacc

SEQ ID NO: 7622464 - DNA, 22 bp, Homo sapiens
tcctctggaacctcacccttgc

SEQ ID NO: 7622465 - DNA, 22 bp, Homo sapiens
tcctctggaacctcacccttgc

SEQ ID NO: 7622466 - DNA, 22 bp, Homo sapiens
tcctctggaacctcacccttgc

SEQ ID NO: 7622467 - DNA, 22 bp, Homo sapiens
tcctctggatataagcctcacc

SEQ ID NO: 7622468 - DNA, 22 bp, Homo sapiens
tcctctggatataagcctcacc

SEQ ID NO: 7622469 - DNA, 22 bp, Homo sapiens
tcctctggatataagcctcacc

SEQ ID NO: 7622470 - DNA, 22 bp, Homo sapiens
tcctctggatataagcctcacc

SEQ ID NO: 7622471 - DNA, 19 bp, Homo sapiens
tcctccttacttcctcttg

SEQ ID NO: 7622472 - DNA, 19 bp, Homo sapiens
tcctccttacttcctcttg

SEQ ID NO: 7622473 - DNA, 21 bp, Homo sapiens
tcctccttcaagtcctggcct

SEQ ID NO: 7622474 - DNA, 22 bp, Homo sapiens
tcctcctgtttctcaggcctgg

SEQ ID NO: 7622475 - DNA, 22 bp, Homo sapiens
tcctcctgtttctcaggcctgg

SEQ ID NO: 7622476 - DNA, 22 bp, Homo sapiens
tcctcctgtttctcaggcctgg

SEQ ID NO: 7622477 - DNA, 22 bp, Homo sapiens
tcctcctgtttctcaggcctgg

SEQ ID NO: 7622478 - DNA, 19 bp, Homo sapiens
tcctccttacttcctcttg

SEQ ID NO: 7622479 - DNA, 20 bp, Homo sapiens
tcctccttgcagagcccaga

SEQ ID NO: 7622480 - DNA, 21 bp, Homo sapiens
tcctccttcaagtcctggcct

SEQ ID NO: 7622481 - DNA, 21 bp, Homo sapiens
tcctccttcaagtcctggcct

SEQ ID NO: 7622482 - DNA, 22 bp, Homo sapiens
tcctcctgtttctcaggcctgg

SEQ ID NO: 7622483 - DNA, 22 bp, Homo sapiens
tcctcctgtttctcaggcctgg

SEQ ID NO: 7622484 - DNA, 22 bp, Homo sapiens
tcctcctgtttctcaggcctgg

SEQ ID NO: 7622485 - DNA, 22 bp, Homo sapiens
tcctcctgtttctcaggcctgg

SEQ ID NO: 7622486 - DNA, 22 bp, Homo sapiens
tcctcctgtttctcaggcctgg

SEQ ID NO: 7622487 - DNA, 22 bp, Homo sapiens
tcctcctgtctaccagttcctg

SEQ ID NO: 7622488 - DNA, 22 bp, Homo sapiens
tcctcctgtctaccagttcctg

SEQ ID NO: 7622489 - DNA, 22 bp, Homo sapiens
tcctcctgtctaccagttcctg

SEQ ID NO: 7622490 - DNA, 22 bp, Homo sapiens
tcctcctgtctaccagttcctg

SEQ ID NO: 7622491 - DNA, 21 bp, Homo sapiens
tcctcctggccaggcggcccc

SEQ ID NO: 7622492 - DNA, 21 bp, Homo sapiens
tcctcctgtagagggtcctgg

SEQ ID NO: 7622493 - DNA, 21 bp, Homo sapiens
tcctcctgtagagggtcctgg

SEQ ID NO: 7622494 - DNA, 21 bp, Homo sapiens
tcctcctggccaggcggcccc

SEQ ID NO: 7622495 - DNA, 21 bp, Homo sapiens
tcctcctgtagagggtcctgg

SEQ ID NO: 7622496 - DNA, 21 bp, Homo sapiens
tcctcctgtagagggtcctgg

SEQ ID NO: 7622497 - DNA, 21 bp, Homo sapiens
tcctcctgtagagggtcctgg

SEQ ID NO: 7622498 - DNA, 21 bp, Homo sapiens
tcctcctgtagagggtcctgg

SEQ ID NO: 7622499 - DNA, 21 bp, Homo sapiens
tcctcctgtagagggtcctgg

SEQ ID NO: 7622500 - DNA, 22 bp, Homo sapiens
tcctcctgtctaccagttcctg

SEQ ID NO: 7622501 - DNA, 21 bp, Homo sapiens
tcctcctgtagagggtcctgg

SEQ ID NO: 7622502 - DNA, 22 bp, Homo sapiens
tcctctgctcagcattcctcac

SEQ ID NO: 7622503 - DNA, 22 bp, Homo sapiens
tcctctccaggtgagccgaaat

SEQ ID NO: 7622504 - DNA, 22 bp, Homo sapiens
tcctctgccccagatgaaattt

SEQ ID NO: 7622505 - DNA, 22 bp, Homo sapiens
tcctctgccccagatgaaattt

SEQ ID NO: 7622506 - DNA, 22 bp, Homo sapiens
tcctctgccccagatgaaattt

SEQ ID NO: 7622507 - DNA, 22 bp, Homo sapiens
tcctctgctccaggctggactt

SEQ ID NO: 7622508 - DNA, 22 bp, Homo sapiens
tcctctgctccaggctggactt

SEQ ID NO: 7622509 - DNA, 22 bp, Homo sapiens
tcctctgctcagcattcctcac

SEQ ID NO: 7622510 - DNA, 22 bp, Homo sapiens
tcctctgctcagcattcctcac

SEQ ID NO: 7622511 - DNA, 22 bp, Homo sapiens
tcctctccagcaaactggctat

SEQ ID NO: 7622512 - DNA, 22 bp, Homo sapiens
tcctctccagcaaactggctat

SEQ ID NO: 7622513 - DNA, 22 bp, Homo sapiens
tcctctccagcaaactggctat

SEQ ID NO: 7622514 - DNA, 22 bp, Homo sapiens
tcctctccaggtgagccgaaat

SEQ ID NO: 7622515 - DNA, 22 bp, Homo sapiens
tcctctccaggtgagccgaaat

SEQ ID NO: 7622516 - DNA, 22 bp, Homo sapiens
tcctctccagcaaactggctat

SEQ ID NO: 7622517 - DNA, 22 bp, Homo sapiens
tcctctccagcaaactggctat

SEQ ID NO: 7622518 - DNA, 22 bp, Homo sapiens
tcctctccagcaaactggctat

SEQ ID NO: 7622519 - DNA, 18 bp, Homo sapiens
tcctcctttggccttttc

SEQ ID NO: 7622520 - DNA, 22 bp, Homo sapiens
tcctcctttccccgctggagcc

SEQ ID NO: 7622521 - DNA, 22 bp, Homo sapiens
tcctcctttccccgctggagcc

SEQ ID NO: 7622522 - DNA, 22 bp, Homo sapiens
tcctccttgttttgtctctgct

SEQ ID NO: 7622523 - DNA, 22 bp, Homo sapiens
tcctccttgttttcctgtttac

SEQ ID NO: 7622524 - DNA, 22 bp, Homo sapiens
tcctccttgttttgtctctgct

SEQ ID NO: 7622525 - DNA, 23 bp, Homo sapiens
tcctcgcaggagggagatgatgc

SEQ ID NO: 7622526 - DNA, 22 bp, Homo sapiens
tcctcggctgggccccaggctt

SEQ ID NO: 7622527 - DNA, 23 bp, Homo sapiens
tcctcgcaggagggagatgatgc

SEQ ID NO: 7622528 - DNA, 23 bp, Homo sapiens
tcctcgtgcctatgagcagtgcc

SEQ ID NO: 7622529 - DNA, 20 bp, Homo sapiens
tcctctaattttaagctgta

SEQ ID NO: 7622530 - DNA, 23 bp, Homo sapiens
tcctcgtgcctatgagcagtgcc

SEQ ID NO: 7622531 - DNA, 22 bp, Homo sapiens
ttctgcagcatgaggctggagc

SEQ ID NO: 7622532 - DNA, 22 bp, Homo sapiens
ttctgcagcatgaggctggagc

SEQ ID NO: 7622533 - DNA, 22 bp, Homo sapiens
ttctgcagatcaacttgactgc

SEQ ID NO: 7622534 - DNA, 22 bp, Homo sapiens
ttctgcagcatgaggctggagc

SEQ ID NO: 7622535 - DNA, 23 bp, Homo sapiens
ttctgcatgtttcagagctggga

SEQ ID NO: 7622536 - DNA, 21 bp, Homo sapiens
ttctgcattaaggtggagata

SEQ ID NO: 7622537 - DNA, 22 bp, Homo sapiens
ttctgcattatacacaacctaa

SEQ ID NO: 7622538 - DNA, 22 bp, Homo sapiens
ttctgcattatacacaacctaa

SEQ ID NO: 7622539 - DNA, 22 bp, Homo sapiens
ttctgcattatacacaacctaa

SEQ ID NO: 7622540 - DNA, 22 bp, Homo sapiens
ttctgcattcaaattatgtgag

SEQ ID NO: 7622541 - DNA, 22 bp, Homo sapiens
ttctgcattcaaattatgtgag

SEQ ID NO: 7622542 - DNA, 22 bp, Homo sapiens
ttctgcagcatgaggctggagc

SEQ ID NO: 7622543 - DNA, 22 bp, Homo sapiens
ttctgcactaaatatcaaatat

SEQ ID NO: 7622544 - DNA, 22 bp, Homo sapiens
ttctgcagatcaacttgactgc

SEQ ID NO: 7622545 - DNA, 22 bp, Homo sapiens
ttctgcaccatcttccagctga

SEQ ID NO: 7622546 - DNA, 22 bp, Homo sapiens
ttctgcacaaattttaggttat

SEQ ID NO: 7622547 - DNA, 22 bp, Homo sapiens
ttctgcacagtcactcctggct

SEQ ID NO: 7622548 - DNA, 22 bp, Homo sapiens
ttctgcattgacttttatttcc

SEQ ID NO: 7622549 - DNA, 22 bp, Homo sapiens
ttctgcatttaaaatattacta

SEQ ID NO: 7622550 - DNA, 22 bp, Homo sapiens
ttctgcatttaaaatattacta

SEQ ID NO: 7622551 - DNA, 22 bp, Homo sapiens
ttctgcatttctaataagttcc

SEQ ID NO: 7622552 - DNA, 22 bp, Homo sapiens
ttctgcatttctaataagttcc

SEQ ID NO: 7622553 - DNA, 22 bp, Homo sapiens
ttctgcattggagtctattctt

SEQ ID NO: 7622554 - DNA, 22 bp, Homo sapiens
ttctgcattggagtctattctt

SEQ ID NO: 7622555 - DNA, 22 bp, Homo sapiens
ttctgcattcatttttcctaca

SEQ ID NO: 7622556 - DNA, 22 bp, Homo sapiens
ttctgccagctcagagctctag

SEQ ID NO: 7622557 - DNA, 23 bp, Homo sapiens
ttctgccactgaaaatgcctcag

SEQ ID NO: 7622558 - DNA, 22 bp, Homo sapiens
ttctgccagtgaaaataatgat

SEQ ID NO: 7622559 - DNA, 22 bp, Homo sapiens
ttctgccaaaggctttgttttg

SEQ ID NO: 7622560 - DNA, 22 bp, Homo sapiens
ttctgcatttctaataagttcc

SEQ ID NO: 7622561 - DNA, 22 bp, Homo sapiens
ttctgccaaagaagtaaatgga

SEQ ID NO: 7622562 - DNA, 22 bp, Homo sapiens
ttctgccaaaggctttgttttg

SEQ ID NO: 7622563 - DNA, 19 bp, Homo sapiens
ttctgccctctcttctagc

SEQ ID NO: 7622564 - DNA, 19 bp, Homo sapiens
ttctgccctctcttctagc

SEQ ID NO: 7622565 - DNA, 22 bp, Homo sapiens
ttctgcccttgccagacaagta

SEQ ID NO: 7622566 - DNA, 22 bp, Homo sapiens
ttctgcccaccacactttatct

SEQ ID NO: 7622567 - DNA, 22 bp, Homo sapiens
ttctgccagtgatcaataattg

SEQ ID NO: 7622568 - DNA, 22 bp, Homo sapiens
ttctgccatctgcagaagggga

SEQ ID NO: 7622569 - DNA, 22 bp, Homo sapiens
ttctgccattgccatgagggct

SEQ ID NO: 7622570 - DNA, 20 bp, Homo sapiens
ttctgcctagggttagcctg

SEQ ID NO: 7622571 - DNA, 22 bp, Homo sapiens
ttctgcctgatgtagtcatacc

SEQ ID NO: 7622572 - DNA, 22 bp, Homo sapiens
ttctgcctgatgtagtcatacc

SEQ ID NO: 7622573 - DNA, 20 bp, Homo sapiens
ttctgcctagggttagcctg

SEQ ID NO: 7622574 - DNA, 22 bp, Homo sapiens
ttctggagcttggcttgtatgt

SEQ ID NO: 7622575 - DNA, 22 bp, Homo sapiens
ttctggaggacaactgttttca

SEQ ID NO: 7622576 - DNA, 20 bp, Homo sapiens
ttctggaggctacaagtctg

SEQ ID NO: 7622577 - DNA, 22 bp, Homo sapiens
ttctggaggctccagggaagaa

SEQ ID NO: 7622578 - DNA, 22 bp, Homo sapiens
ttctggaggctccagggaagaa

SEQ ID NO: 7622579 - DNA, 22 bp, Homo sapiens
ttctggaggctccagggaagaa

SEQ ID NO: 7622580 - DNA, 22 bp, Homo sapiens
ttctggaggctccagggaagaa

SEQ ID NO: 7622581 - DNA, 22 bp, Homo sapiens
ttctggaggcgggcgacctcgc

SEQ ID NO: 7622582 - DNA, 20 bp, Homo sapiens
ttctggaggctacaagtctg

SEQ ID NO: 7622583 - DNA, 20 bp, Homo sapiens
ttctggaggctacaagtctg

SEQ ID NO: 7622584 - DNA, 20 bp, Homo sapiens
ttctggaggctacaagtctg

SEQ ID NO: 7622585 - DNA, 22 bp, Homo sapiens
ttctggaggcgggcgacctcgc

SEQ ID NO: 7622586 - DNA, 22 bp, Homo sapiens
ttctggaggccccttccttctc

SEQ ID NO: 7622587 - DNA, 22 bp, Homo sapiens
ttctggaggccagctgccacct

SEQ ID NO: 7622588 - DNA, 22 bp, Homo sapiens
ttctggaggccagctgccacct

SEQ ID NO: 7622589 - DNA, 22 bp, Homo sapiens
ttctggaggagaaagggtgggc

SEQ ID NO: 7622590 - DNA, 22 bp, Homo sapiens
ttctggaggagaaagggtgggc

SEQ ID NO: 7622591 - DNA, 22 bp, Homo sapiens
ttctggaggagaaagggtgggc

SEQ ID NO: 7622592 - DNA, 22 bp, Homo sapiens
ttctggaggagaaagggtgggc

SEQ ID NO: 7622593 - DNA, 22 bp, Homo sapiens
ttctgattgctgatgaggccca

SEQ ID NO: 7622594 - DNA, 22 bp, Homo sapiens
ttctgattgctgatgaggccca

SEQ ID NO: 7622595 - DNA, 22 bp, Homo sapiens
ttctgattgctgatgaggccca

SEQ ID NO: 7622596 - DNA, 22 bp, Homo sapiens
ttctgattgctgatgaggccca

SEQ ID NO: 7622597 - DNA, 22 bp, Homo sapiens
ttctgattgctgatgaggccca

SEQ ID NO: 7622598 - DNA, 22 bp, Homo sapiens
ttctgattgctgatgaggccca

SEQ ID NO: 7622599 - DNA, 22 bp, Homo sapiens
ttctgattgctgatgaggccca

SEQ ID NO: 7622600 - DNA, 22 bp, Homo sapiens
ttctgattgctgatgaggccca

SEQ ID NO: 7622601 - DNA, 22 bp, Homo sapiens
ttctgattgttggaggatgctt

SEQ ID NO: 7622602 - DNA, 22 bp, Homo sapiens
ttctgcaatcgctctgaccatt

SEQ ID NO: 7622603 - DNA, 22 bp, Homo sapiens
ttctgcaatcgctctgaccatt

SEQ ID NO: 7622604 - DNA, 22 bp, Homo sapiens
ttctgattcatgatccagttct

SEQ ID NO: 7622605 - DNA, 22 bp, Homo sapiens
ttctgattcatgatccagttct

SEQ ID NO: 7622606 - DNA, 22 bp, Homo sapiens
ttctgattcatgatccagttct

SEQ ID NO: 7622607 - DNA, 22 bp, Homo sapiens
ttctgatgcatgggtctctgtt

SEQ ID NO: 7622608 - DNA, 22 bp, Homo sapiens
ttctgatggtggaatgcttcag

SEQ ID NO: 7622609 - DNA, 22 bp, Homo sapiens
ttctgatggtggaatgcttcag

SEQ ID NO: 7622610 - DNA, 22 bp, Homo sapiens
ttctgatggtggaatgcttcag

SEQ ID NO: 7622611 - DNA, 22 bp, Homo sapiens
ttctgatactggaatcgatgcc

SEQ ID NO: 7622612 - DNA, 22 bp, Homo sapiens
ttctgatatagtgattgattta

SEQ ID NO: 7622613 - DNA, 22 bp, Homo sapiens
ttctgatgaggaggtctctaag

SEQ ID NO: 7622614 - DNA, 22 bp, Homo sapiens
ttctgatgatggcggctggagc

SEQ ID NO: 7622615 - DNA, 22 bp, Homo sapiens
ttctgatgatggcggctggagc

SEQ ID NO: 7622616 - DNA, 22 bp, Homo sapiens
ttctgatgatggcggctggagc

SEQ ID NO: 7622617 - DNA, 22 bp, Homo sapiens
ttctgagtctcctgtcgacagt

SEQ ID NO: 7622618 - DNA, 22 bp, Homo sapiens
ttctgagtctcctgtcgacagt

SEQ ID NO: 7622619 - DNA, 22 bp, Homo sapiens
ttctgataacaaacaccaattt

SEQ ID NO: 7622620 - DNA, 22 bp, Homo sapiens
ttctgataacaaacaccaattt

SEQ ID NO: 7622621 - DNA, 22 bp, Homo sapiens
ttctgataccttgcaggatcct

SEQ ID NO: 7622622 - DNA, 22 bp, Homo sapiens
ttctgataataccacatcgcag

SEQ ID NO: 7622623 - DNA, 22 bp, Homo sapiens
ttctgatacagtcccaacacaa

SEQ ID NO: 7622624 - DNA, 22 bp, Homo sapiens
ttctgaggtccatgcagtactg

SEQ ID NO: 7622625 - DNA, 22 bp, Homo sapiens
ttctgagggaggttctctggga

SEQ ID NO: 7622626 - DNA, 22 bp, Homo sapiens
ttctgagggctaatgtactgta

SEQ ID NO: 7622627 - DNA, 22 bp, Homo sapiens
ttctgagggaaccttgttcttg

SEQ ID NO: 7622628 - DNA, 22 bp, Homo sapiens
ttctgagggaggttctctggga

SEQ ID NO: 7622629 - DNA, 22 bp, Homo sapiens
ttctgagggaggttctctggga

SEQ ID NO: 7622630 - DNA, 22 bp, Homo sapiens
ttctgaggctttcccgtcccct

SEQ ID NO: 7622631 - DNA, 22 bp, Homo sapiens
ttctgaggccattaccaataaa

SEQ ID NO: 7622632 - DNA, 22 bp, Homo sapiens
ttctgaggctttcccgtcccct

SEQ ID NO: 7622633 - DNA, 22 bp, Homo sapiens
ttctgaggccattaccaataaa

SEQ ID NO: 7622634 - DNA, 22 bp, Homo sapiens
ttctgaggcatagaggatgaga

SEQ ID NO: 7622635 - DNA, 22 bp, Homo sapiens
ttctgaggaggagcaaaaactc

SEQ ID NO: 7622636 - DNA, 22 bp, Homo sapiens
ttctgaggcactggctctccca

SEQ ID NO: 7622637 - DNA, 22 bp, Homo sapiens
ttctgaggaggagcaaaaactc

SEQ ID NO: 7622638 - DNA, 22 bp, Homo sapiens
ttctgaggcactggctctccca

SEQ ID NO: 7622639 - DNA, 20 bp, Homo sapiens
ttctctttgggtccagagaa

SEQ ID NO: 7622640 - DNA, 20 bp, Homo sapiens
ttctctttgggtccagagaa

SEQ ID NO: 7622641 - DNA, 20 bp, Homo sapiens
ttctctttgggtccagagaa

SEQ ID NO: 7622642 - DNA, 22 bp, Homo sapiens
ttctcttttagaggctccatga

SEQ ID NO: 7622643 - DNA, 22 bp, Homo sapiens
ttctcttttagaggctccatga

SEQ ID NO: 7622644 - DNA, 22 bp, Homo sapiens
ttctcttttagaggctccatga

SEQ ID NO: 7622645 - DNA, 22 bp, Homo sapiens
ttctgagctgcaacactaacat

SEQ ID NO: 7622646 - DNA, 22 bp, Homo sapiens
ttctcttttagaggctccatga

SEQ ID NO: 7622647 - DNA, 22 bp, Homo sapiens
ttctgagctgcaacactaacat

SEQ ID NO: 7622648 - DNA, 22 bp, Homo sapiens
ttctctttatgtatttagtggg

SEQ ID NO: 7622649 - DNA, 22 bp, Homo sapiens
ttctctttctacagtgtgattg

SEQ ID NO: 7622650 - DNA, 22 bp, Homo sapiens
ttctctttatgtatttagtggg

SEQ ID NO: 7622651 - DNA, 22 bp, Homo sapiens
ttctctttatgtatttagtggg

SEQ ID NO: 7622652 - DNA, 22 bp, Homo sapiens
ttctctttatgtatttagtggg

SEQ ID NO: 7622653 - DNA, 22 bp, Homo sapiens
ttctctttatgtatttagtggg

SEQ ID NO: 7622654 - DNA, 22 bp, Homo sapiens
ttctctttatgtatttagtggg

SEQ ID NO: 7622655 - DNA, 23 bp, Homo sapiens
ttctctttagatttacattactc

SEQ ID NO: 7622656 - DNA, 22 bp, Homo sapiens
ttctctttatgtatttagtggg

SEQ ID NO: 7622657 - DNA, 22 bp, Homo sapiens
ttctctttctgctgggctggaa

SEQ ID NO: 7622658 - DNA, 22 bp, Homo sapiens
ttctctttgacattattcaggt

SEQ ID NO: 7622659 - DNA, 22 bp, Homo sapiens
ttctctttgacattattcaggt

SEQ ID NO: 7622660 - DNA, 22 bp, Homo sapiens
ttctctttgacattattcaggt

SEQ ID NO: 7622661 - DNA, 22 bp, Homo sapiens
ttctctttgacattattcaggt

SEQ ID NO: 7622662 - DNA, 22 bp, Homo sapiens
ttctcctcagcaaggcagcttt

SEQ ID NO: 7622663 - DNA, 22 bp, Homo sapiens
ttctcctcagcaaggcagcttt

SEQ ID NO: 7622664 - DNA, 21 bp, Homo sapiens
ttctcctccaagttgctcctg

SEQ ID NO: 7622665 - DNA, 22 bp, Homo sapiens
ttctcctcactgcagcctttca

SEQ ID NO: 7622666 - DNA, 22 bp, Homo sapiens
ttctcctaggatcaggggtcct

SEQ ID NO: 7622667 - DNA, 22 bp, Homo sapiens
ttctcctcagcaaggcagcttt

SEQ ID NO: 7622668 - DNA, 22 bp, Homo sapiens
ttctccctgtcctatcaagact

SEQ ID NO: 7622669 - DNA, 22 bp, Homo sapiens
ttctccctgtcctatcaagact

SEQ ID NO: 7622670 - DNA, 22 bp, Homo sapiens
ttctccctgtcctatcaagact

SEQ ID NO: 7622671 - DNA, 22 bp, Homo sapiens
ttctccctggtatttacttagt

SEQ ID NO: 7622672 - DNA, 22 bp, Homo sapiens
ttctccgctaagttctctgcag

SEQ ID NO: 7622673 - DNA, 22 bp, Homo sapiens
ttctccgctaagttctctgcag

SEQ ID NO: 7622674 - DNA, 22 bp, Homo sapiens
ttctccgctaagttctctgcag

SEQ ID NO: 7622675 - DNA, 22 bp, Homo sapiens
ttctccgctaagttctctgcag

SEQ ID NO: 7622676 - DNA, 22 bp, Homo sapiens
ttctccgctaagttctctgcag

SEQ ID NO: 7622677 - DNA, 22 bp, Homo sapiens
ttctcctctgttaccttgcaaa

SEQ ID NO: 7622678 - DNA, 22 bp, Homo sapiens
ttctcctctgttaccttgcaaa

SEQ ID NO: 7622679 - DNA, 22 bp, Homo sapiens
ttctcctctgttaccttgcaaa

SEQ ID NO: 7622680 - DNA, 18 bp, Homo sapiens
ttctctggtggatgttat

SEQ ID NO: 7622681 - DNA, 22 bp, Homo sapiens
ttctcctctgttggccttccct

SEQ ID NO: 7622682 - DNA, 22 bp, Homo sapiens
ttctcctctgttaccttgcaaa

SEQ ID NO: 7622683 - DNA, 22 bp, Homo sapiens
ttctcctctgttggccttccct

SEQ ID NO: 7622684 - DNA, 17 bp, Homo sapiens
ttctcctctgtgtcctt

SEQ ID NO: 7622685 - DNA, 17 bp, Homo sapiens
ttctcctctgtgtcctt

SEQ ID NO: 7622686 - DNA, 17 bp, Homo sapiens
ttctcctctgtgtcctt

SEQ ID NO: 7622687 - DNA, 22 bp, Homo sapiens
ttctcctctacatagactgtgc

SEQ ID NO: 7622688 - DNA, 22 bp, Homo sapiens
ttctcctctgcaatgactggca

SEQ ID NO: 7622689 - DNA, 21 bp, Homo sapiens
ttctcctccaagttgctcctg

SEQ ID NO: 7622690 - DNA, 22 bp, Homo sapiens
ttctcctctacatagactgtgc

SEQ ID NO: 7622691 - DNA, 22 bp, Homo sapiens
ttctcctctacatagactgtgc

SEQ ID NO: 7622692 - DNA, 21 bp, Homo sapiens
ttctcctccaagttgctcctg

SEQ ID NO: 7622693 - DNA, 22 bp, Homo sapiens
ttctcctcagcaaggcagcttt

SEQ ID NO: 7622694 - DNA, 21 bp, Homo sapiens
ttctcctccaagttgctcctg

SEQ ID NO: 7622695 - DNA, 21 bp, Homo sapiens
ttctcctccaagttgctcctg

SEQ ID NO: 7622696 - DNA, 20 bp, Homo sapiens
ttctccagtgcggtagccat

SEQ ID NO: 7622697 - DNA, 22 bp, Homo sapiens
ttctccagttatattatgttaa

SEQ ID NO: 7622698 - DNA, 22 bp, Homo sapiens
ttctccagttatattatgttaa

SEQ ID NO: 7622699 - DNA, 22 bp, Homo sapiens
ttctccagtttctcccttcagt

SEQ ID NO: 7622700 - DNA, 22 bp, Homo sapiens
ttctccatttaacttccttatg

SEQ ID NO: 7622701 - DNA, 22 bp, Homo sapiens
ttctccatttaacttccttatg

SEQ ID NO: 7622702 - DNA, 22 bp, Homo sapiens
ttctccatttaacttccttatg

SEQ ID NO: 7622703 - DNA, 22 bp, Homo sapiens
ttctccatttaacttccttatg

SEQ ID NO: 7622704 - DNA, 22 bp, Homo sapiens
ttctccatttaacttccttatg

SEQ ID NO: 7622705 - DNA, 21 bp, Homo sapiens
ttctccccagcgaatcctcgg

SEQ ID NO: 7622706 - DNA, 21 bp, Homo sapiens
ttctccccagcgaatcctcgg

SEQ ID NO: 7622707 - DNA, 21 bp, Homo sapiens
ttctccccagcgaatcctcgg

SEQ ID NO: 7622708 - DNA, 22 bp, Homo sapiens
ttctcccatctcagtcttacat

SEQ ID NO: 7622709 - DNA, 22 bp, Homo sapiens
ttctccccaactccatcaacac

SEQ ID NO: 7622710 - DNA, 22 bp, Homo sapiens
ttctccccaactccatcaacac

SEQ ID NO: 7622711 - DNA, 22 bp, Homo sapiens
ttctcccatctcagtcttacat

SEQ ID NO: 7622712 - DNA, 22 bp, Homo sapiens
ttctccctgccaaagctgcctc

SEQ ID NO: 7622713 - DNA, 22 bp, Homo sapiens
ttctcccctgaccctgatgagg

SEQ ID NO: 7622714 - DNA, 22 bp, Homo sapiens
ttctcccctttagggcctacgg

SEQ ID NO: 7622715 - DNA, 22 bp, Homo sapiens
ttctcccctttagggcctacgg

SEQ ID NO: 7622716 - DNA, 22 bp, Homo sapiens
ttctccccgtctctctgaggcc

SEQ ID NO: 7622717 - DNA, 22 bp, Homo sapiens
ttctccccgtctctctgaggcc

SEQ ID NO: 7622718 - DNA, 22 bp, Homo sapiens
ttctcccctctgaaatggggct

SEQ ID NO: 7622719 - DNA, 22 bp, Homo sapiens
ttctcccctctgaaatggggct

SEQ ID NO: 7622720 - DNA, 22 bp, Homo sapiens
ttctcccctgaccctgatgagg

SEQ ID NO: 7622721 - DNA, 22 bp, Homo sapiens
ttctcccctgaccctgatgagg

SEQ ID NO: 7622722 - DNA, 22 bp, Homo sapiens
ttctcccactccgtgcttcagt

SEQ ID NO: 7622723 - DNA, 22 bp, Homo sapiens
ttctcccagaccaaaggcagca

SEQ ID NO: 7622724 - DNA, 22 bp, Homo sapiens
ttctcccagaccaaaggcagca

SEQ ID NO: 7622725 - DNA, 22 bp, Homo sapiens
ttctcccatctcagtcttacat

SEQ ID NO: 7622726 - DNA, 22 bp, Homo sapiens
ttctcccatctcagtcttacat

SEQ ID NO: 7622727 - DNA, 22 bp, Homo sapiens
ttctcccactccgtgcttcagt

SEQ ID NO: 7622728 - DNA, 22 bp, Homo sapiens
ttctcccactccgtgcttcagt

SEQ ID NO: 7622729 - DNA, 22 bp, Homo sapiens
ttctcccactccgtgcttcagt

SEQ ID NO: 7622730 - DNA, 22 bp, Homo sapiens
ttctcccactccgtgcttcagt

SEQ ID NO: 7622731 - DNA, 22 bp, Homo sapiens
ttctcccactccgtgcttcagt

SEQ ID NO: 7622732 - DNA, 22 bp, Homo sapiens
ttctcccactccgtgcttcagt

SEQ ID NO: 7622733 - DNA, 22 bp, Homo sapiens
ttctcccactccgtgcttcagt

SEQ ID NO: 7622734 - DNA, 22 bp, Homo sapiens
ttctcttagctgtaaagtcaat

SEQ ID NO: 7622735 - DNA, 22 bp, Homo sapiens
ttctcttagctgtaaagtcaat

SEQ ID NO: 7622736 - DNA, 22 bp, Homo sapiens
ttctcttagctgtaaagtcaat

SEQ ID NO: 7622737 - DNA, 22 bp, Homo sapiens
ttctctgttttcccctcgatgt

SEQ ID NO: 7622738 - DNA, 22 bp, Homo sapiens
ttctctgttttcccctcgatgt

SEQ ID NO: 7622739 - DNA, 22 bp, Homo sapiens
ttctcttacattttctcagcct

SEQ ID NO: 7622740 - DNA, 22 bp, Homo sapiens
ttctcttattctggatatgcag

SEQ ID NO: 7622741 - DNA, 22 bp, Homo sapiens
ttctcttcacagggatcatcct

SEQ ID NO: 7622742 - DNA, 22 bp, Homo sapiens
ttctcttattctggatatgcag

SEQ ID NO: 7622743 - DNA, 22 bp, Homo sapiens
ttctcttatctggcattattgg

SEQ ID NO: 7622744 - DNA, 22 bp, Homo sapiens
ttctcttatctggcattattgg

SEQ ID NO: 7622745 - DNA, 19 bp, Homo sapiens
ttctctgtgctagactctg

SEQ ID NO: 7622746 - DNA, 19 bp, Homo sapiens
ttctctgtgctagactctg

SEQ ID NO: 7622747 - DNA, 22 bp, Homo sapiens
ttctctgtggattgggtgagag

SEQ ID NO: 7622748 - DNA, 22 bp, Homo sapiens
ttctctgttttcccctcgatgt

SEQ ID NO: 7622749 - DNA, 22 bp, Homo sapiens
ttctctgtagttgcctggtgga

SEQ ID NO: 7622750 - DNA, 22 bp, Homo sapiens
ttctctgtagttgcctggtgga

SEQ ID NO: 7622751 - DNA, 22 bp, Homo sapiens
ttctctgtgagggtgctggatt

SEQ ID NO: 7622752 - DNA, 22 bp, Homo sapiens
ttctctgtgagggtgctggatt

SEQ ID NO: 7622753 - DNA, 22 bp, Homo sapiens
ttctctgtagttgcctggtgga

SEQ ID NO: 7622754 - DNA, 22 bp, Homo sapiens
ttctctggtttgctgtttctga

SEQ ID NO: 7622755 - DNA, 22 bp, Homo sapiens
ttctctggtttgctgtttctga

SEQ ID NO: 7622756 - DNA, 22 bp, Homo sapiens
ttctctggtttgctgtttctga

SEQ ID NO: 7622757 - DNA, 22 bp, Homo sapiens
ttctcttctgttcagtgcccaa

SEQ ID NO: 7622758 - DNA, 17 bp, Homo sapiens
ttctcttcctggatagt

SEQ ID NO: 7622759 - DNA, 22 bp, Homo sapiens
ttctcttctgttcagtgcccaa

SEQ ID NO: 7622760 - DNA, 22 bp, Homo sapiens
ttctcttctgttcagtgcccaa

SEQ ID NO: 7622761 - DNA, 22 bp, Homo sapiens
ttctcttgactaccagttagga

SEQ ID NO: 7622762 - DNA, 22 bp, Homo sapiens
ttctcttctgttcagtgcccaa

SEQ ID NO: 7622763 - DNA, 23 bp, Homo sapiens
ttctctttagatttacattactc

SEQ ID NO: 7622764 - DNA, 23 bp, Homo sapiens
ttctctttagatttacattactc

SEQ ID NO: 7622765 - DNA, 22 bp, Homo sapiens
ttctcttgagctggtcatgttt

SEQ ID NO: 7622766 - DNA, 22 bp, Homo sapiens
ttctcttgtgccaagttgttgc

SEQ ID NO: 7622767 - DNA, 23 bp, Homo sapiens
ttctctttagatttacattactc

SEQ ID NO: 7622768 - DNA, 23 bp, Homo sapiens
ttctctttagatttacattactc

SEQ ID NO: 7622769 - DNA, 23 bp, Homo sapiens
ttctctttagatttacattactc

SEQ ID NO: 7622770 - DNA, 23 bp, Homo sapiens
ttctctttagatttacattactc

SEQ ID NO: 7622771 - DNA, 22 bp, Homo sapiens
ttctcttcccactttctgtatt

SEQ ID NO: 7622772 - DNA, 22 bp, Homo sapiens
ttctcttcccactttctgtatt

SEQ ID NO: 7622773 - DNA, 17 bp, Homo sapiens
ttctcttcctggatagt

SEQ ID NO: 7622774 - DNA, 17 bp, Homo sapiens
ttctcttcctggatagt

SEQ ID NO: 7622775 - DNA, 22 bp, Homo sapiens
ttctcttcccactttctgtatt

SEQ ID NO: 7622776 - DNA, 17 bp, Homo sapiens
ttctcttcctggatagt

SEQ ID NO: 7622777 - DNA, 22 bp, Homo sapiens
ttctcttcatctcagtaaatgt

SEQ ID NO: 7622778 - DNA, 22 bp, Homo sapiens
ttctcttcatctcagtaaatgt

SEQ ID NO: 7622779 - DNA, 22 bp, Homo sapiens
ttctcttcatctcagtaaatgt

SEQ ID NO: 7622780 - DNA, 22 bp, Homo sapiens
ttctcttcatctcagtaaatgt

SEQ ID NO: 7622781 - DNA, 22 bp, Homo sapiens
ttctcttcccactttctgtatt

SEQ ID NO: 7622782 - DNA, 22 bp, Homo sapiens
ttctcttcccactttctgtatt

SEQ ID NO: 7622783 - DNA, 22 bp, Homo sapiens
ttctcttccagccgggcttgca

SEQ ID NO: 7622784 - DNA, 22 bp, Homo sapiens
ttctcacactttccactgaggt

SEQ ID NO: 7622785 - DNA, 22 bp, Homo sapiens
ttctcacactttccactgaggt

SEQ ID NO: 7622786 - DNA, 22 bp, Homo sapiens
ttctcacactttccactgaggt

SEQ ID NO: 7622787 - DNA, 22 bp, Homo sapiens
ttctcacactttccactgaggt

SEQ ID NO: 7622788 - DNA, 22 bp, Homo sapiens
ttctcacaattcttgtatttgc

SEQ ID NO: 7622789 - DNA, 22 bp, Homo sapiens
ttctcacaattcttgtatttgc

SEQ ID NO: 7622790 - DNA, 22 bp, Homo sapiens
ttctcacaattcttgtatttgc

SEQ ID NO: 7622791 - DNA, 22 bp, Homo sapiens
ttctcacaaatccatccaggag

SEQ ID NO: 7622792 - DNA, 22 bp, Homo sapiens
ttctcacaaatccatccaggag

SEQ ID NO: 7622793 - DNA, 22 bp, Homo sapiens
ttctcaaggacaaaatgacatg

SEQ ID NO: 7622794 - DNA, 22 bp, Homo sapiens
ttctcaaggacaaaatgacatg

SEQ ID NO: 7622795 - DNA, 22 bp, Homo sapiens
ttctcaagtgagtggtaaatga

SEQ ID NO: 7622796 - DNA, 22 bp, Homo sapiens
ttctcaagtgagtggtaaatga

SEQ ID NO: 7622797 - DNA, 22 bp, Homo sapiens
ttctcacaaatccatccaggag

SEQ ID NO: 7622798 - DNA, 22 bp, Homo sapiens
ttctcacaggctggaatgatga

SEQ ID NO: 7622799 - DNA, 22 bp, Homo sapiens
ttctcacaggatttcttttagt

SEQ ID NO: 7622800 - DNA, 22 bp, Homo sapiens
ttctcacaggctggaatgatga

SEQ ID NO: 7622801 - DNA, 22 bp, Homo sapiens
ttctcacaggaagtaggacttt

SEQ ID NO: 7622802 - DNA, 22 bp, Homo sapiens
ttctcacaggaagtaggacttt

SEQ ID NO: 7622803 - DNA, 22 bp, Homo sapiens
ttctcacactttccactgaggt

SEQ ID NO: 7622804 - DNA, 22 bp, Homo sapiens
ttctcacagaagcacgaagcct

SEQ ID NO: 7622805 - DNA, 22 bp, Homo sapiens
ttctcacaggatttcttttagt

SEQ ID NO: 7622806 - DNA, 22 bp, Homo sapiens
ttctcacaggatttcttttagt

SEQ ID NO: 7622807 - DNA, 22 bp, Homo sapiens
ttctcacaggatttcttttagt

SEQ ID NO: 7622808 - DNA, 22 bp, Homo sapiens
ttctcagaattgactgggagca

SEQ ID NO: 7622809 - DNA, 22 bp, Homo sapiens
ttctcagaaaatgtagagaaaa

SEQ ID NO: 7622810 - DNA, 22 bp, Homo sapiens
ttctcagaattgactgggagca

SEQ ID NO: 7622811 - DNA, 22 bp, Homo sapiens
ttctcagaattgactgggagca

SEQ ID NO: 7622812 - DNA, 22 bp, Homo sapiens
ttctcagaaaatgtagagaaaa

SEQ ID NO: 7622813 - DNA, 22 bp, Homo sapiens
ttctcagaattgactgggagca

SEQ ID NO: 7622814 - DNA, 22 bp, Homo sapiens
ttctcagaaaatgtagagaaaa

SEQ ID NO: 7622815 - DNA, 22 bp, Homo sapiens
ttctcagaaaagcaagctttct

SEQ ID NO: 7622816 - DNA, 22 bp, Homo sapiens
ttctcagaaaagcaagctttct

SEQ ID NO: 7622817 - DNA, 22 bp, Homo sapiens
ttctcactatgtatgtagattg

SEQ ID NO: 7622818 - DNA, 22 bp, Homo sapiens
ttctcactatgtatgtagattg

SEQ ID NO: 7622819 - DNA, 22 bp, Homo sapiens
ttctcacattcagaacttttat

SEQ ID NO: 7622820 - DNA, 22 bp, Homo sapiens
ttctcacattcagaacttttat

SEQ ID NO: 7622821 - DNA, 22 bp, Homo sapiens
ttctcacagtacctaacatgta

SEQ ID NO: 7622822 - DNA, 22 bp, Homo sapiens
ttctcacagtacctaacatgta

SEQ ID NO: 7622823 - DNA, 22 bp, Homo sapiens
ttctcacagtacctaacatgta

SEQ ID NO: 7622824 - DNA, 22 bp, Homo sapiens
ttctcacagtacctaacatgta

SEQ ID NO: 7622825 - DNA, 22 bp, Homo sapiens
ttctcacagtacctaacatgta

SEQ ID NO: 7622826 - DNA, 22 bp, Homo sapiens
ttctcacaggctggaatgatga

SEQ ID NO: 7622827 - DNA, 22 bp, Homo sapiens
ttctaagaaatggaaaacgatt

SEQ ID NO: 7622828 - DNA, 22 bp, Homo sapiens
ttctatatgacttctaggcagg

SEQ ID NO: 7622829 - DNA, 22 bp, Homo sapiens
ttctatattcgcttcccaaggc

SEQ ID NO: 7622830 - DNA, 22 bp, Homo sapiens
ttctatattggaagtgagaaat

SEQ ID NO: 7622831 - DNA, 22 bp, Homo sapiens
ttctatattggaagtgagaaat

SEQ ID NO: 7622832 - DNA, 22 bp, Homo sapiens
ttctaactttcaaggtcctttc

SEQ ID NO: 7622833 - DNA, 22 bp, Homo sapiens
ttctaactttcaaggtcctttc

SEQ ID NO: 7622834 - DNA, 22 bp, Homo sapiens
ttctaactggcttgacagtttc

SEQ ID NO: 7622835 - DNA, 21 bp, Homo sapiens
ttctaactgggtgggccttga

SEQ ID NO: 7622836 - DNA, 22 bp, Homo sapiens
ttctaacttaacactcctgtga

SEQ ID NO: 7622837 - DNA, 22 bp, Homo sapiens
ttctaactttcaaggtcctttc

SEQ ID NO: 7622838 - DNA, 22 bp, Homo sapiens
ttctatgaaggtaagatgtacg

SEQ ID NO: 7622839 - DNA, 22 bp, Homo sapiens
ttctatgaaggtaagatgtacg

SEQ ID NO: 7622840 - DNA, 22 bp, Homo sapiens
ttctatgaaggtaagatgtacg

SEQ ID NO: 7622841 - DNA, 22 bp, Homo sapiens
ttctatgaaggtaagatgtacg

SEQ ID NO: 7622842 - DNA, 22 bp, Homo sapiens
ttctatcatttagttgtcttct

SEQ ID NO: 7622843 - DNA, 22 bp, Homo sapiens
ttctatcatacttgaatacatt

SEQ ID NO: 7622844 - DNA, 22 bp, Homo sapiens
ttctatcagcatagttgaaata

SEQ ID NO: 7622845 - DNA, 22 bp, Homo sapiens
ttctatcatacttgaatacatt

SEQ ID NO: 7622846 - DNA, 22 bp, Homo sapiens
ttctatcatacttgaatacatt

SEQ ID NO: 7622847 - DNA, 22 bp, Homo sapiens
ttctatcatacttgaatacatt

SEQ ID NO: 7622848 - DNA, 22 bp, Homo sapiens
ttctatattgttaaaggttata

SEQ ID NO: 7622849 - DNA, 22 bp, Homo sapiens
ttctatattgttaaaggttata

SEQ ID NO: 7622850 - DNA, 22 bp, Homo sapiens
ttctcaaggacaaaatgacatg

SEQ ID NO: 7622851 - DNA, 22 bp, Homo sapiens
ttctcaactctcaagagaagct

SEQ ID NO: 7622852 - DNA, 22 bp, Homo sapiens
ttctcaagaacatatgtagggt

SEQ ID NO: 7622853 - DNA, 22 bp, Homo sapiens
ttctcaaagggtggtttgcaaa

SEQ ID NO: 7622854 - DNA, 22 bp, Homo sapiens
ttctcaaagggtggtttgcaaa

SEQ ID NO: 7622855 - DNA, 22 bp, Homo sapiens
ttctatgattcatttagaagtt

SEQ ID NO: 7622856 - DNA, 19 bp, Homo sapiens
ttctatgattaacatgaga

SEQ ID NO: 7622857 - DNA, 22 bp, Homo sapiens
ttctcaaagaaagctgtcatta

SEQ ID NO: 7622858 - DNA, 22 bp, Homo sapiens
ttctcaaagaaagctgtcatta

SEQ ID NO: 7622859 - DNA, 22 bp, Homo sapiens
ttctcaaagaaagctgtcatta

SEQ ID NO: 7622860 - DNA, 22 bp, Homo sapiens
ttctatgattcatttagaagtt

SEQ ID NO: 7622861 - DNA, 22 bp, Homo sapiens
ttctatatttatgggcatcacc

SEQ ID NO: 7622862 - DNA, 22 bp, Homo sapiens
ttctcaaagaaagctgtcatta

SEQ ID NO: 7622863 - DNA, 22 bp, Homo sapiens
ttctcaaagaaagctgtcatta

SEQ ID NO: 7622864 - DNA, 22 bp, Homo sapiens
ttctccaggcttgggccaggtc

SEQ ID NO: 7622865 - DNA, 22 bp, Homo sapiens
ttctccaggcttgggccaggtc

SEQ ID NO: 7622866 - DNA, 22 bp, Homo sapiens
ttctccaggcttgggccaggtc

SEQ ID NO: 7622867 - DNA, 21 bp, Homo sapiens
ttctccagggggagctctctc

SEQ ID NO: 7622868 - DNA, 22 bp, Homo sapiens
ttctccaggggagggttctcca

SEQ ID NO: 7622869 - DNA, 19 bp, Homo sapiens
ttctccagggacttaggga

SEQ ID NO: 7622870 - DNA, 22 bp, Homo sapiens
ttctccaggccgcgcagggggc

SEQ ID NO: 7622871 - DNA, 19 bp, Homo sapiens
ttctccaggctgcagaggg

SEQ ID NO: 7622872 - DNA, 19 bp, Homo sapiens
ttctccaggctgcagaggg

SEQ ID NO: 7622873 - DNA, 19 bp, Homo sapiens
ttctccagcctgacctgag

SEQ ID NO: 7622874 - DNA, 19 bp, Homo sapiens
ttctccagcctgacctgag

SEQ ID NO: 7622875 - DNA, 19 bp, Homo sapiens
ttctccagcctgacctgag

SEQ ID NO: 7622876 - DNA, 22 bp, Homo sapiens
ttctccagcctattggcctatc

SEQ ID NO: 7622877 - DNA, 22 bp, Homo sapiens
ttctccagcctattggcctatc

SEQ ID NO: 7622878 - DNA, 22 bp, Homo sapiens
ttctccagcacattttctttga

SEQ ID NO: 7622879 - DNA, 22 bp, Homo sapiens
ttctccagagtttctctcactg

SEQ ID NO: 7622880 - DNA, 19 bp, Homo sapiens
ttctccagcctgacctgag

SEQ ID NO: 7622881 - DNA, 19 bp, Homo sapiens
ttctccagcctgacctgag

SEQ ID NO: 7622882 - DNA, 19 bp, Homo sapiens
ttctccagcctgacctgag

SEQ ID NO: 7622883 - DNA, 19 bp, Homo sapiens
ttctccagcctgacctgag

SEQ ID NO: 7622884 - DNA, 19 bp, Homo sapiens
ttctccagcctgacctgag

SEQ ID NO: 7622885 - DNA, 22 bp, Homo sapiens
ttctccagctcatcagggaggg

SEQ ID NO: 7622886 - DNA, 22 bp, Homo sapiens
ttctccagctcatcagggaggg

SEQ ID NO: 7622887 - DNA, 21 bp, Homo sapiens
ttctccaggcaaccatttcag

SEQ ID NO: 7622888 - DNA, 22 bp, Homo sapiens
ttctcagagctcactgtagtaa

SEQ ID NO: 7622889 - DNA, 22 bp, Homo sapiens
ttctcagagctcactgtagtaa

SEQ ID NO: 7622890 - DNA, 22 bp, Homo sapiens
ttctcagagctcactgtagtaa

SEQ ID NO: 7622891 - DNA, 19 bp, Homo sapiens
ttctcagagcttgcagcac

SEQ ID NO: 7622892 - DNA, 19 bp, Homo sapiens
ttctcagagcttgcagcac

SEQ ID NO: 7622893 - DNA, 22 bp, Homo sapiens
ttctcagaggagtcgggagctg

SEQ ID NO: 7622894 - DNA, 22 bp, Homo sapiens
ttctcagagcactgctgacaaa

SEQ ID NO: 7622895 - DNA, 22 bp, Homo sapiens
ttctcagagcactgctgacaaa

SEQ ID NO: 7622896 - DNA, 22 bp, Homo sapiens
ttctcagacttccagcaccagc

SEQ ID NO: 7622897 - DNA, 18 bp, Homo sapiens
ttctcagactttggaagt

SEQ ID NO: 7622898 - DNA, 18 bp, Homo sapiens
ttctcagactttggaagt

SEQ ID NO: 7622899 - DNA, 22 bp, Homo sapiens
ttctcagagcactgctgacaaa

SEQ ID NO: 7622900 - DNA, 22 bp, Homo sapiens
ttctcagacttccagcaccagc

SEQ ID NO: 7622901 - DNA, 22 bp, Homo sapiens
ttctcagacttccagcaccagc

SEQ ID NO: 7622902 - DNA, 22 bp, Homo sapiens
ttctcagaattgactgggagca

SEQ ID NO: 7622903 - DNA, 22 bp, Homo sapiens
ttctcagacttccagcaccagc

SEQ ID NO: 7622904 - DNA, 22 bp, Homo sapiens
ttctcagatatttgtatggaac

SEQ ID NO: 7622905 - DNA, 22 bp, Homo sapiens
ttctcagatatttactgagcat

SEQ ID NO: 7622906 - DNA, 22 bp, Homo sapiens
ttctcagatatttgtatggaac

SEQ ID NO: 7622907 - DNA, 22 bp, Homo sapiens
ttctcagatatttactgagcat

SEQ ID NO: 7622908 - DNA, 22 bp, Homo sapiens
ttctcagatccatcagaagtcc

SEQ ID NO: 7622909 - DNA, 22 bp, Homo sapiens
ttctcagatatttgtatggaac

SEQ ID NO: 7622910 - DNA, 22 bp, Homo sapiens
ttctcagatatttgtatggaac

SEQ ID NO: 7622911 - DNA, 22 bp, Homo sapiens
ttctcagatccatcagaagtcc

SEQ ID NO: 7622912 - DNA, 22 bp, Homo sapiens
ttctcagatccatcagaagtcc

SEQ ID NO: 7622913 - DNA, 22 bp, Homo sapiens
ttctccagagtttctctcactg

SEQ ID NO: 7622914 - DNA, 22 bp, Homo sapiens
ttctcagatatttactgagcat

SEQ ID NO: 7622915 - DNA, 22 bp, Homo sapiens
ttctcagagtgaccaagtcttt

SEQ ID NO: 7622916 - DNA, 22 bp, Homo sapiens
ttctcagagtgaccaagtcttt

SEQ ID NO: 7622917 - DNA, 22 bp, Homo sapiens
ttctcagagtgaccaagtcttt

SEQ ID NO: 7622918 - DNA, 21 bp, Homo sapiens
ttctcagagtctattacagtt

SEQ ID NO: 7622919 - DNA, 21 bp, Homo sapiens
ttctcagagtctattacagtt

SEQ ID NO: 7622920 - DNA, 21 bp, Homo sapiens
ttctcagagtctattacagtt

SEQ ID NO: 7622921 - DNA, 22 bp, Homo sapiens
ttctcagaggagtcgggagctg

SEQ ID NO: 7622922 - DNA, 22 bp, Homo sapiens
ttctcagaggctgctaagtgca

SEQ ID NO: 7622923 - DNA, 22 bp, Homo sapiens
ttccctgcaacctttccctggg

SEQ ID NO: 7622924 - DNA, 22 bp, Homo sapiens
ttccttgttgaaaatgtctgca

SEQ ID NO: 7622925 - DNA, 22 bp, Homo sapiens
ttccttgttgaaaatgtctgca

SEQ ID NO: 7622926 - DNA, 22 bp, Homo sapiens
ttccttgtttcaagccatccac

SEQ ID NO: 7622927 - DNA, 22 bp, Homo sapiens
ttccttgttgaaaatgtctgca

SEQ ID NO: 7622928 - DNA, 22 bp, Homo sapiens
ttccttgtttcaagccatccac

SEQ ID NO: 7622929 - DNA, 22 bp, Homo sapiens
ttccctgcaacctttccctggg

SEQ ID NO: 7622930 - DNA, 22 bp, Homo sapiens
ttccctgatggccccaaggata

SEQ ID NO: 7622931 - DNA, 22 bp, Homo sapiens
ttccctgagtctccctgagtct

SEQ ID NO: 7622932 - DNA, 22 bp, Homo sapiens
ttccctgatcacgtgtcaggag

SEQ ID NO: 7622933 - DNA, 22 bp, Homo sapiens
ttccctgagtctccctgagtct

SEQ ID NO: 7622934 - DNA, 22 bp, Homo sapiens
ttccctctttcactgtgatttt

SEQ ID NO: 7622935 - DNA, 22 bp, Homo sapiens
ttccctctttcactgtgatttt

SEQ ID NO: 7622936 - DNA, 22 bp, Homo sapiens
ttccctctgcgcattgaatttc

SEQ ID NO: 7622937 - DNA, 22 bp, Homo sapiens
ttccctgagtctccctgagtct

SEQ ID NO: 7622938 - DNA, 22 bp, Homo sapiens
ttccctgaagacctcatgtgac

SEQ ID NO: 7622939 - DNA, 22 bp, Homo sapiens
ttccctgaagacctcatgtgac

SEQ ID NO: 7622940 - DNA, 22 bp, Homo sapiens
ttccctcttttccaacagttgt

SEQ ID NO: 7622941 - DNA, 22 bp, Homo sapiens
ttccctgaagacctcatgtgac

SEQ ID NO: 7622942 - DNA, 20 bp, Homo sapiens
ttcgctgggagtggccaggc

SEQ ID NO: 7622943 - DNA, 20 bp, Homo sapiens
ttcgctgggagtggccaggc

SEQ ID NO: 7622944 - DNA, 20 bp, Homo sapiens
ttcgctgggagtggccaggc

SEQ ID NO: 7622945 - DNA, 20 bp, Homo sapiens
ttcgctgggagtggccaggc

SEQ ID NO: 7622946 - DNA, 20 bp, Homo sapiens
ttcgctgggagtggccaggc

SEQ ID NO: 7622947 - DNA, 22 bp, Homo sapiens
ttcgcattcagctttgccactg

SEQ ID NO: 7622948 - DNA, 22 bp, Homo sapiens
ttcgcccagctccaggctggcc

SEQ ID NO: 7622949 - DNA, 22 bp, Homo sapiens
ttcgactctgtgcctgaagagc

SEQ ID NO: 7622950 - DNA, 21 bp, Homo sapiens
ttcctttttatggcttagtgg

SEQ ID NO: 7622951 - DNA, 22 bp, Homo sapiens
ttcgagttggctttattaaact

SEQ ID NO: 7622952 - DNA, 22 bp, Homo sapiens
ttcgactctgtgcctgaagagc

SEQ ID NO: 7622953 - DNA, 22 bp, Homo sapiens
ttcgagtctttgtttggatagt

SEQ ID NO: 7622954 - DNA, 22 bp, Homo sapiens
ttcgcagggagacaggctctct

SEQ ID NO: 7622955 - DNA, 22 bp, Homo sapiens
ttcctttagtgtcatatacttt

SEQ ID NO: 7622956 - DNA, 22 bp, Homo sapiens
ttcctttagtgtcatatacttt

SEQ ID NO: 7622957 - DNA, 22 bp, Homo sapiens
ttcctttagggaaatcgtctca

SEQ ID NO: 7622958 - DNA, 22 bp, Homo sapiens
ttcctttagggaaatcgtctca

SEQ ID NO: 7622959 - DNA, 22 bp, Homo sapiens
ttccttgtttcaagccatccac

SEQ ID NO: 7622960 - DNA, 22 bp, Homo sapiens
ttccttgtttgtagctctggga

SEQ ID NO: 7622961 - DNA, 22 bp, Homo sapiens
ttcctttagtgtcatatacttt

SEQ ID NO: 7622962 - DNA, 21 bp, Homo sapiens
ttcctttttatggcttagtgg

SEQ ID NO: 7622963 - DNA, 22 bp, Homo sapiens
ttccctctccaggagccctgag

SEQ ID NO: 7622964 - DNA, 22 bp, Homo sapiens
ttccctctccaggagccctgag

SEQ ID NO: 7622965 - DNA, 22 bp, Homo sapiens
ttccctctccaggagccctgag

SEQ ID NO: 7622966 - DNA, 22 bp, Homo sapiens
ttccctctcacttaaagcttgg

SEQ ID NO: 7622967 - DNA, 22 bp, Homo sapiens
ttccctctcacttaaagcttgg

SEQ ID NO: 7622968 - DNA, 22 bp, Homo sapiens
ttccctctctagctttccccaa

SEQ ID NO: 7622969 - DNA, 22 bp, Homo sapiens
ttccctctcctactcaggaaag

SEQ ID NO: 7622970 - DNA, 22 bp, Homo sapiens
ttccctctccaggagccctgag

SEQ ID NO: 7622971 - DNA, 22 bp, Homo sapiens
ttccctctctccagggctgcct

SEQ ID NO: 7622972 - DNA, 22 bp, Homo sapiens
ttccctctctccagggctgcct

SEQ ID NO: 7622973 - DNA, 22 bp, Homo sapiens
ttccctctctccagggctgcct

SEQ ID NO: 7622974 - DNA, 22 bp, Homo sapiens
ttccctctgcgcattgaatttc

SEQ ID NO: 7622975 - DNA, 22 bp, Homo sapiens
ttccctccgaacctcagtgctg

SEQ ID NO: 7622976 - DNA, 22 bp, Homo sapiens
ttccctccctggctgccatttc

SEQ ID NO: 7622977 - DNA, 22 bp, Homo sapiens
ttccctccctggctgccatttc

SEQ ID NO: 7622978 - DNA, 22 bp, Homo sapiens
ttccctccgaacctcagtgctg

SEQ ID NO: 7622979 - DNA, 22 bp, Homo sapiens
ttccctccgaacctcagtgctg

SEQ ID NO: 7622980 - DNA, 22 bp, Homo sapiens
ttccctcctatgcccactgaaa

SEQ ID NO: 7622981 - DNA, 22 bp, Homo sapiens
ttccctcctatgcccactgaaa

SEQ ID NO: 7622982 - DNA, 22 bp, Homo sapiens
ttccctcctatgcccactgaaa

SEQ ID NO: 7622983 - DNA, 22 bp, Homo sapiens
ttccctcctatgcccactgaaa

SEQ ID NO: 7622984 - DNA, 22 bp, Homo sapiens
ttccctcctatgcccactgaaa

SEQ ID NO: 7622985 - DNA, 22 bp, Homo sapiens
ttccctccatttcattttataa

SEQ ID NO: 7622986 - DNA, 22 bp, Homo sapiens
ttccctccatttcattttataa

SEQ ID NO: 7622987 - DNA, 22 bp, Homo sapiens
ttcccctttttgtgtgcagctg

SEQ ID NO: 7622988 - DNA, 22 bp, Homo sapiens
ttcccctttttgtgtgcagctg

SEQ ID NO: 7622989 - DNA, 22 bp, Homo sapiens
ttccctcccccagcctggcagg

SEQ ID NO: 7622990 - DNA, 22 bp, Homo sapiens
ttccctcccccagcctggcagg

SEQ ID NO: 7622991 - DNA, 22 bp, Homo sapiens
ttccctcccccagcctggcagg

SEQ ID NO: 7622992 - DNA, 22 bp, Homo sapiens
ttccctccatttcattttataa

SEQ ID NO: 7622993 - DNA, 22 bp, Homo sapiens
ttccctcccccagcctggcagg

SEQ ID NO: 7622994 - DNA, 22 bp, Homo sapiens
ttccctcccccagcctggcagg

SEQ ID NO: 7622995 - DNA, 22 bp, Homo sapiens
ttccctccctggctgccatttc

SEQ ID NO: 7622996 - DNA, 22 bp, Homo sapiens
ttccctccctggctgccatttc

SEQ ID NO: 7622997 - DNA, 22 bp, Homo sapiens
ttctaaatgtaaatagtatgat

SEQ ID NO: 7622998 - DNA, 22 bp, Homo sapiens
ttctaaatgtaaatagtatgat

SEQ ID NO: 7622999 - DNA, 22 bp, Homo sapiens
ttctaaatgtaaatagtatgat

SEQ ID NO: 7623000 - DNA, 22 bp, Homo sapiens
ttctaaatgtaaatagtatgat

SEQ ID NO: 7623001 - DNA, 22 bp, Homo sapiens
ttctaaatgtaaatagtatgat

SEQ ID NO: 7623002 - DNA, 18 bp, Homo sapiens
ttctaaattctgttttta

SEQ ID NO: 7623003 - DNA, 18 bp, Homo sapiens
ttctaaattctgttttta

SEQ ID NO: 7623004 - DNA, 22 bp, Homo sapiens
ttctaaattttggaagatgcag

SEQ ID NO: 7623005 - DNA, 22 bp, Homo sapiens
ttctaaatggggatcctttctg

SEQ ID NO: 7623006 - DNA, 22 bp, Homo sapiens
ttctaaatggggatcctttctg

SEQ ID NO: 7623007 - DNA, 22 bp, Homo sapiens
ttctaaatggggatcctttctg

SEQ ID NO: 7623008 - DNA, 22 bp, Homo sapiens
ttctaaatggggatcctttctg

SEQ ID NO: 7623009 - DNA, 22 bp, Homo sapiens
ttctaaagtgcaatctgacaga

SEQ ID NO: 7623010 - DNA, 22 bp, Homo sapiens
ttctaaagtgcaatctgacaga

SEQ ID NO: 7623011 - DNA, 22 bp, Homo sapiens
ttctaaagcctgtcctatcaga

SEQ ID NO: 7623012 - DNA, 22 bp, Homo sapiens
ttctaaagcctgtcctatcaga

SEQ ID NO: 7623013 - DNA, 22 bp, Homo sapiens
ttctaaagtgcaatctgacaga

SEQ ID NO: 7623014 - DNA, 22 bp, Homo sapiens
ttctaaagtgcaatctgacaga

SEQ ID NO: 7623015 - DNA, 22 bp, Homo sapiens
ttctaaagtgcaatctgacaga

SEQ ID NO: 7623016 - DNA, 22 bp, Homo sapiens
ttctaaagtgcaatctgacaga

SEQ ID NO: 7623017 - DNA, 22 bp, Homo sapiens
ttctaaagtgcaatctgacaga

SEQ ID NO: 7623018 - DNA, 22 bp, Homo sapiens
ttctaaattttggaagatgcag

SEQ ID NO: 7623019 - DNA, 22 bp, Homo sapiens
ttctaaattttggaagatgcag

SEQ ID NO: 7623020 - DNA, 22 bp, Homo sapiens
ttctaaattttggaagatgcag

SEQ ID NO: 7623021 - DNA, 22 bp, Homo sapiens
ttctaaattttggaagatgcag

SEQ ID NO: 7623022 - DNA, 22 bp, Homo sapiens
ttctaaattttggaagatgcag

SEQ ID NO: 7623023 - DNA, 22 bp, Homo sapiens
ttctaacaagtggcttgttagt

SEQ ID NO: 7623024 - DNA, 22 bp, Homo sapiens
ttctaacaagtggcttgttagt

SEQ ID NO: 7623025 - DNA, 22 bp, Homo sapiens
ttctaactaaagtctttgtttt

SEQ ID NO: 7623026 - DNA, 22 bp, Homo sapiens
ttctaactcaaagcttctttca

SEQ ID NO: 7623027 - DNA, 22 bp, Homo sapiens
ttctaactctacactagctttg

SEQ ID NO: 7623028 - DNA, 22 bp, Homo sapiens
ttctaactctacactagctttg

SEQ ID NO: 7623029 - DNA, 22 bp, Homo sapiens
ttctaactcaaagcttctttca

SEQ ID NO: 7623030 - DNA, 22 bp, Homo sapiens
ttctaactctgttatgtgtttc

SEQ ID NO: 7623031 - DNA, 22 bp, Homo sapiens
ttctaactctacactagctttg

SEQ ID NO: 7623032 - DNA, 22 bp, Homo sapiens
ttctaactctgttatgtgtttc

SEQ ID NO: 7623033 - DNA, 22 bp, Homo sapiens
ttctaactctgttatgtgtttc

SEQ ID NO: 7623034 - DNA, 22 bp, Homo sapiens
ttctaactctgttatgtgtttc

SEQ ID NO: 7623035 - DNA, 22 bp, Homo sapiens
ttcgggctcgcccagatcagtg

SEQ ID NO: 7623036 - DNA, 22 bp, Homo sapiens
ttcgtgtggagatgtttctgca

SEQ ID NO: 7623037 - DNA, 22 bp, Homo sapiens
ttcgggaggcggagcttgcagt

SEQ ID NO: 7623038 - DNA, 22 bp, Homo sapiens
ttcggcttgggtatttctcagg

SEQ ID NO: 7623039 - DNA, 22 bp, Homo sapiens
ttcgggaatttgttggtgattt

SEQ ID NO: 7623040 - DNA, 22 bp, Homo sapiens
ttcgctttgcccgttgtcattt

SEQ ID NO: 7623041 - DNA, 22 bp, Homo sapiens
ttctaaaaccaattctgcttct

SEQ ID NO: 7623042 - DNA, 22 bp, Homo sapiens
ttcgttttctaggaccaacaga

SEQ ID NO: 7623043 - DNA, 22 bp, Homo sapiens
ttctaaaaccaattctgcttct

SEQ ID NO: 7623044 - DNA, 22 bp, Homo sapiens
ttctaaaaccaattctgcttct

SEQ ID NO: 7623045 - DNA, 22 bp, Homo sapiens
ttcgttttctaggaccaacaga

SEQ ID NO: 7623046 - DNA, 22 bp, Homo sapiens
ttcgttttctaggaccaacaga

SEQ ID NO: 7623047 - DNA, 22 bp, Homo sapiens
ttctaaaaccaattctgcttct

SEQ ID NO: 7623048 - DNA, 22 bp, Homo sapiens
ttctaaaaccaattctgcttct

SEQ ID NO: 7623049 - DNA, 22 bp, Homo sapiens
ttctaaaaccaattctgcttct

SEQ ID NO: 7623050 - DNA, 22 bp, Homo sapiens
ttctaaagactcatggaagtgg

SEQ ID NO: 7623051 - DNA, 22 bp, Homo sapiens
ttctaaagagaatgcgtttctg

SEQ ID NO: 7623052 - DNA, 22 bp, Homo sapiens
ttctaaagactcatggaagtgg

SEQ ID NO: 7623053 - DNA, 22 bp, Homo sapiens
ttctaaagactcatggaagtgg

SEQ ID NO: 7623054 - DNA, 22 bp, Homo sapiens
ttctaaagactcatggaagtgg

SEQ ID NO: 7623055 - DNA, 22 bp, Homo sapiens
ttctaaagactcatggaagtgg

SEQ ID NO: 7623056 - DNA, 22 bp, Homo sapiens
ttctaaacttcaattctaaatt

SEQ ID NO: 7623057 - DNA, 22 bp, Homo sapiens
ttctaaacttcaattctaaatt

SEQ ID NO: 7623058 - DNA, 22 bp, Homo sapiens
ttctaaaataagtttatctggt

SEQ ID NO: 7623059 - DNA, 22 bp, Homo sapiens
ttctaaaataagtttatctggt

SEQ ID NO: 7623060 - DNA, 22 bp, Homo sapiens
ttctaaaataagtttatctggt

SEQ ID NO: 7623061 - DNA, 22 bp, Homo sapiens
ttctaaaataagtttatctggt

SEQ ID NO: 7623062 - DNA, 22 bp, Homo sapiens
ttctaaaataagtttatctggt

SEQ ID NO: 7623063 - DNA, 22 bp, Homo sapiens
ttctaaaataagtttatctggt

SEQ ID NO: 7623064 - DNA, 22 bp, Homo sapiens
ttctaaaataagtttatctggt

SEQ ID NO: 7623065 - DNA, 22 bp, Homo sapiens
ttctaaaataagtttatctggt

SEQ ID NO: 7623066 - DNA, 22 bp, Homo sapiens
ttctaaaataagtttatctggt

SEQ ID NO: 7623067 - DNA, 22 bp, Homo sapiens
ttctaaaataagtttatctggt

SEQ ID NO: 7623068 - DNA, 22 bp, Homo sapiens
ttcttctgaaacagtgacagac

SEQ ID NO: 7623069 - DNA, 22 bp, Homo sapiens
ttcttctgaaacagtgacagac

SEQ ID NO: 7623070 - DNA, 22 bp, Homo sapiens
ttcttctgaaacataatcaata

SEQ ID NO: 7623071 - DNA, 22 bp, Homo sapiens
ttcttctgaaacataatcaata

SEQ ID NO: 7623072 - DNA, 22 bp, Homo sapiens
ttcttctgaaacataatcaata

SEQ ID NO: 7623073 - DNA, 22 bp, Homo sapiens
ttcttctgaaacataatcaata

SEQ ID NO: 7623074 - DNA, 22 bp, Homo sapiens
ttcttctgaaacataatcaata

SEQ ID NO: 7623075 - DNA, 22 bp, Homo sapiens
ttcttctgacactgatgctgta

SEQ ID NO: 7623076 - DNA, 22 bp, Homo sapiens
ttcttctgacactgatgctgta

SEQ ID NO: 7623077 - DNA, 20 bp, Homo sapiens
ttcttctctagttatcttca

SEQ ID NO: 7623078 - DNA, 20 bp, Homo sapiens
ttcttctctagttatcttca

SEQ ID NO: 7623079 - DNA, 20 bp, Homo sapiens
ttcttctctagttatcttca

SEQ ID NO: 7623080 - DNA, 20 bp, Homo sapiens
ttcttctctagttatcttca

SEQ ID NO: 7623081 - DNA, 22 bp, Homo sapiens
ttcttctctcatagattaaggt

SEQ ID NO: 7623082 - DNA, 22 bp, Homo sapiens
ttcttctctcatagattaaggt

SEQ ID NO: 7623083 - DNA, 22 bp, Homo sapiens
ttcttctgcctcccacctgata

SEQ ID NO: 7623084 - DNA, 22 bp, Homo sapiens
ttcttctgcctcccacctgata

SEQ ID NO: 7623085 - DNA, 22 bp, Homo sapiens
ttcttctgattgccttctgcaa

SEQ ID NO: 7623086 - DNA, 22 bp, Homo sapiens
ttcttctgcctcccacctgata

SEQ ID NO: 7623087 - DNA, 22 bp, Homo sapiens
ttcttctgcctcccacctgata

SEQ ID NO: 7623088 - DNA, 22 bp, Homo sapiens
ttcttctgattgccttctgcaa

SEQ ID NO: 7623089 - DNA, 22 bp, Homo sapiens
ttcttctgagagaaaaagctca

SEQ ID NO: 7623090 - DNA, 22 bp, Homo sapiens
ttcttctgattgccttctgcaa

SEQ ID NO: 7623091 - DNA, 22 bp, Homo sapiens
ttcttctgagagaaaaagctca

SEQ ID NO: 7623092 - DNA, 22 bp, Homo sapiens
ttcttctgttggcagagcatac

SEQ ID NO: 7623093 - DNA, 22 bp, Homo sapiens
ttcttctgttgaaagggtagag

SEQ ID NO: 7623094 - DNA, 22 bp, Homo sapiens
ttcttctgttggcagagcatac

SEQ ID NO: 7623095 - DNA, 22 bp, Homo sapiens
ttcttctgttggcagagcatac

SEQ ID NO: 7623096 - DNA, 22 bp, Homo sapiens
ttcttctgttggcagagcatac

SEQ ID NO: 7623097 - DNA, 22 bp, Homo sapiens
ttcttctgttggcagagcatac

SEQ ID NO: 7623098 - DNA, 22 bp, Homo sapiens
ttcttctgtgaggtgtgtgcct

SEQ ID NO: 7623099 - DNA, 22 bp, Homo sapiens
ttcttctgtgaggtgtgtgcct

SEQ ID NO: 7623100 - DNA, 22 bp, Homo sapiens
ttcttctgcctcccacctgata

SEQ ID NO: 7623101 - DNA, 22 bp, Homo sapiens
ttctttctcactctttaggaag

SEQ ID NO: 7623102 - DNA, 22 bp, Homo sapiens
ttctttctcactctttaggaag

SEQ ID NO: 7623103 - DNA, 22 bp, Homo sapiens
ttctttctcactctttaggaag

SEQ ID NO: 7623104 - DNA, 22 bp, Homo sapiens
ttctttctcactctttaggaag

SEQ ID NO: 7623105 - DNA, 22 bp, Homo sapiens
ttctttctcaacatgaatgttt

SEQ ID NO: 7623106 - DNA, 21 bp, Homo sapiens
ttcttcttggactgttttggc

SEQ ID NO: 7623107 - DNA, 22 bp, Homo sapiens
ttctttctcactctttaggaag

SEQ ID NO: 7623108 - DNA, 21 bp, Homo sapiens
ttcttcttggactgttttggc

SEQ ID NO: 7623109 - DNA, 22 bp, Homo sapiens
ttctttctcagtgggcagatac

SEQ ID NO: 7623110 - DNA, 22 bp, Homo sapiens
ttctttctcagtgggcagatac

SEQ ID NO: 7623111 - DNA, 22 bp, Homo sapiens
ttctttctcagtgggcagatac

SEQ ID NO: 7623112 - DNA, 22 bp, Homo sapiens
ttctttctcagtgggcagatac

SEQ ID NO: 7623113 - DNA, 22 bp, Homo sapiens
ttctttcttctcaggctgggta

SEQ ID NO: 7623114 - DNA, 22 bp, Homo sapiens
ttctttctctactagcagagct

SEQ ID NO: 7623115 - DNA, 22 bp, Homo sapiens
ttctttctctactagcagagct

SEQ ID NO: 7623116 - DNA, 22 bp, Homo sapiens
ttcttcttcaagtgctgcattc

SEQ ID NO: 7623117 - DNA, 22 bp, Homo sapiens
ttcttcttcaagtgctgcattc

SEQ ID NO: 7623118 - DNA, 22 bp, Homo sapiens
ttcttcttaatgtcctgggaac

SEQ ID NO: 7623119 - DNA, 22 bp, Homo sapiens
ttcttcttaatgtcctgggaac

SEQ ID NO: 7623120 - DNA, 22 bp, Homo sapiens
ttcttcttaatgtcctgggaac

SEQ ID NO: 7623121 - DNA, 22 bp, Homo sapiens
ttcttcttcatttctgacgatg

SEQ ID NO: 7623122 - DNA, 22 bp, Homo sapiens
ttcttcttcatttctgacgatg

SEQ ID NO: 7623123 - DNA, 22 bp, Homo sapiens
ttcttcttcaagtgctgcattc

SEQ ID NO: 7623124 - DNA, 22 bp, Homo sapiens
ttcttcttcaagtgctgcattc

SEQ ID NO: 7623125 - DNA, 22 bp, Homo sapiens
ttcttcttcaagtgctgcattc

SEQ ID NO: 7623126 - DNA, 21 bp, Homo sapiens
ttcttcttggactgttttggc

SEQ ID NO: 7623127 - DNA, 21 bp, Homo sapiens
ttcttcttggactgttttggc

SEQ ID NO: 7623128 - DNA, 22 bp, Homo sapiens
ttcttcttgaaactttaggttg

SEQ ID NO: 7623129 - DNA, 22 bp, Homo sapiens
ttcttcttgaaactttaggttg

SEQ ID NO: 7623130 - DNA, 22 bp, Homo sapiens
ttcttcttgaaactttaggttg

SEQ ID NO: 7623131 - DNA, 22 bp, Homo sapiens
ttcttcttctggctgcacctgg

SEQ ID NO: 7623132 - DNA, 22 bp, Homo sapiens
ttcttcttctggctgcacctgg

SEQ ID NO: 7623133 - DNA, 22 bp, Homo sapiens
ttcttcttctggctgcacctgg

SEQ ID NO: 7623134 - DNA, 22 bp, Homo sapiens
ttcttcttcatttctgacgatg

SEQ ID NO: 7623135 - DNA, 22 bp, Homo sapiens
ttcttcttctggctgcacctgg

SEQ ID NO: 7623136 - DNA, 22 bp, Homo sapiens
ttctttgggcaattgctggccc

SEQ ID NO: 7623137 - DNA, 22 bp, Homo sapiens
ttctttgggcaattgctggccc

SEQ ID NO: 7623138 - DNA, 22 bp, Homo sapiens
ttctttgggcaattgctggccc

SEQ ID NO: 7623139 - DNA, 22 bp, Homo sapiens
ttctttgggcaattgctggccc

SEQ ID NO: 7623140 - DNA, 22 bp, Homo sapiens
ttctttgggattgtagctgtct

SEQ ID NO: 7623141 - DNA, 22 bp, Homo sapiens
ttctttgggattgtagctgtct

SEQ ID NO: 7623142 - DNA, 22 bp, Homo sapiens
ttctttggcttacgtctggcct

SEQ ID NO: 7623143 - DNA, 22 bp, Homo sapiens
ttctttgggattgtagctgtct

SEQ ID NO: 7623144 - DNA, 22 bp, Homo sapiens
ttctttggcttacgtctggcct

SEQ ID NO: 7623145 - DNA, 22 bp, Homo sapiens
ttctttggcttacgtctggcct

SEQ ID NO: 7623146 - DNA, 22 bp, Homo sapiens
ttctttggcttacgtctggcct

SEQ ID NO: 7623147 - DNA, 22 bp, Homo sapiens
ttctttggcttacgtctggcct

SEQ ID NO: 7623148 - DNA, 22 bp, Homo sapiens
ttctttggctgccagtctggag

SEQ ID NO: 7623149 - DNA, 22 bp, Homo sapiens
ttctttggctgccagtctggag

SEQ ID NO: 7623150 - DNA, 22 bp, Homo sapiens
ttctttggcatttcctgtatgt

SEQ ID NO: 7623151 - DNA, 22 bp, Homo sapiens
ttctttggctgccagtctggag

SEQ ID NO: 7623152 - DNA, 22 bp, Homo sapiens
ttctttggggaatattctggtt

SEQ ID NO: 7623153 - DNA, 22 bp, Homo sapiens
ttctttggggaatattctggtt

SEQ ID NO: 7623154 - DNA, 22 bp, Homo sapiens
ttctttggggtctccagcatag

SEQ ID NO: 7623155 - DNA, 22 bp, Homo sapiens
ttctttggggtctccagcatag

SEQ ID NO: 7623156 - DNA, 22 bp, Homo sapiens
ttctttggggtctccagcatag

SEQ ID NO: 7623157 - DNA, 22 bp, Homo sapiens
ttctttggtgggagattgaggt

SEQ ID NO: 7623158 - DNA, 22 bp, Homo sapiens
ttctttggtgggagattgaggt

SEQ ID NO: 7623159 - DNA, 22 bp, Homo sapiens
ttctttggggtctccagcatag

SEQ ID NO: 7623160 - DNA, 22 bp, Homo sapiens
ttctttgggctcagagagggag

SEQ ID NO: 7623161 - DNA, 22 bp, Homo sapiens
ttctttgggctcagagagggag

SEQ ID NO: 7623162 - DNA, 22 bp, Homo sapiens
ttctttgggctcagagagggag

SEQ ID NO: 7623163 - DNA, 22 bp, Homo sapiens
ttctttgggcaattgctggccc

SEQ ID NO: 7623164 - DNA, 22 bp, Homo sapiens
ttctttgggctcagagagggag

SEQ ID NO: 7623165 - DNA, 22 bp, Homo sapiens
ttctttgggctcagagagggag

SEQ ID NO: 7623166 - DNA, 22 bp, Homo sapiens
ttctttggggaatattctggtt

SEQ ID NO: 7623167 - DNA, 23 bp, Homo sapiens
ttctttggaattgggctgcaagg

SEQ ID NO: 7623168 - DNA, 22 bp, Homo sapiens
ttctttggaataagtcaagctg

SEQ ID NO: 7623169 - DNA, 23 bp, Homo sapiens
ttctttggaattgggctgcaagg

SEQ ID NO: 7623170 - DNA, 22 bp, Homo sapiens
ttctttggaataagtcaagctg

SEQ ID NO: 7623171 - DNA, 22 bp, Homo sapiens
ttctttggaataagtcaagctg

SEQ ID NO: 7623172 - DNA, 22 bp, Homo sapiens
ttctttggcatttcctgtatgt

SEQ ID NO: 7623173 - DNA, 22 bp, Homo sapiens
ttctttggcatttcctgtatgt

SEQ ID NO: 7623174 - DNA, 22 bp, Homo sapiens
ttctttggcatttcctgtatgt

SEQ ID NO: 7623175 - DNA, 23 bp, Homo sapiens
ttctttggaattgggctgcaagg

SEQ ID NO: 7623176 - DNA, 22 bp, Homo sapiens
ttctttggaataagtcaagctg

SEQ ID NO: 7623177 - DNA, 22 bp, Homo sapiens
ttctttgcccttaatgaaataa

SEQ ID NO: 7623178 - DNA, 22 bp, Homo sapiens
ttctttgcccttaatgaaataa

SEQ ID NO: 7623179 - DNA, 22 bp, Homo sapiens
ttctttgcccatgtttcctaag

SEQ ID NO: 7623180 - DNA, 19 bp, Homo sapiens
ttctttgagttcttctgag

SEQ ID NO: 7623181 - DNA, 22 bp, Homo sapiens
ttctttgcccatgtttcctaag

SEQ ID NO: 7623182 - DNA, 22 bp, Homo sapiens
ttctttgcccatgtttcctaag

SEQ ID NO: 7623183 - DNA, 22 bp, Homo sapiens
ttctttgcccatgtttcctaag

SEQ ID NO: 7623184 - DNA, 22 bp, Homo sapiens
ttctttgcccttaatgaaataa

SEQ ID NO: 7623185 - DNA, 22 bp, Homo sapiens
ttctttgcccttaatgaaataa

SEQ ID NO: 7623186 - DNA, 22 bp, Homo sapiens
ttctttgaatagatgttcccag

SEQ ID NO: 7623187 - DNA, 22 bp, Homo sapiens
ttctttgaccaaacagttttcc

SEQ ID NO: 7623188 - DNA, 22 bp, Homo sapiens
ttctttgaaatactgttttgcc

SEQ ID NO: 7623189 - DNA, 19 bp, Homo sapiens
ttctttgagttcttctgag

SEQ ID NO: 7623190 - DNA, 19 bp, Homo sapiens
ttctttgagttcttctgag

SEQ ID NO: 7623191 - DNA, 19 bp, Homo sapiens
ttctttgagttcttctgag

SEQ ID NO: 7623192 - DNA, 19 bp, Homo sapiens
ttctttgagttcttctgag

SEQ ID NO: 7623193 - DNA, 22 bp, Homo sapiens
ttctttgaccaaacagttttcc

SEQ ID NO: 7623194 - DNA, 22 bp, Homo sapiens
ttctttgagttagtacagtcca

SEQ ID NO: 7623195 - DNA, 22 bp, Homo sapiens
ttctttctttgtagtcctgaac

SEQ ID NO: 7623196 - DNA, 22 bp, Homo sapiens
ttctttctttgtagtcctgaac

SEQ ID NO: 7623197 - DNA, 22 bp, Homo sapiens
ttctttcttggggaacacactc

SEQ ID NO: 7623198 - DNA, 22 bp, Homo sapiens
ttctttcttggggaacacactc

SEQ ID NO: 7623199 - DNA, 22 bp, Homo sapiens
ttctttcttggggaacacactc

SEQ ID NO: 7623200 - DNA, 22 bp, Homo sapiens
ttctttcttggggaacacactc

SEQ ID NO: 7623201 - DNA, 22 bp, Homo sapiens
ttctttcttggggaacacactc

SEQ ID NO: 7623202 - DNA, 22 bp, Homo sapiens
ttctggatatggattttggtga

SEQ ID NO: 7623203 - DNA, 22 bp, Homo sapiens
ttctggatataacattcagtcc

SEQ ID NO: 7623204 - DNA, 22 bp, Homo sapiens
ttctggatataacattcagtcc

SEQ ID NO: 7623205 - DNA, 22 bp, Homo sapiens
ttctggatatggattttggtga

SEQ ID NO: 7623206 - DNA, 22 bp, Homo sapiens
ttctggatatgggagagggagc

SEQ ID NO: 7623207 - DNA, 22 bp, Homo sapiens
ttctggatcagcatcatgagat

SEQ ID NO: 7623208 - DNA, 22 bp, Homo sapiens
ttctggatcagcatcatgagat

SEQ ID NO: 7623209 - DNA, 22 bp, Homo sapiens
ttctggatgatccatttacaga

SEQ ID NO: 7623210 - DNA, 22 bp, Homo sapiens
ttctggatctgagggggaagat

SEQ ID NO: 7623211 - DNA, 22 bp, Homo sapiens
ttctggatgatccatttacaga

SEQ ID NO: 7623212 - DNA, 22 bp, Homo sapiens
ttctggctttcttgtcaggatg

SEQ ID NO: 7623213 - DNA, 22 bp, Homo sapiens
ttctggctttcttgtcaggatg

SEQ ID NO: 7623214 - DNA, 22 bp, Homo sapiens
ttctggctttcttgtcaggatg

SEQ ID NO: 7623215 - DNA, 22 bp, Homo sapiens
ttctggctttgaccaagttcaa

SEQ ID NO: 7623216 - DNA, 22 bp, Homo sapiens
ttctggagtttgaagatcaggt

SEQ ID NO: 7623217 - DNA, 22 bp, Homo sapiens
ttctggagtttgaagatcaggt

SEQ ID NO: 7623218 - DNA, 22 bp, Homo sapiens
ttctggagtttgaagatcaggt

SEQ ID NO: 7623219 - DNA, 22 bp, Homo sapiens
ttctggagtttgaagatcaggt

SEQ ID NO: 7623220 - DNA, 22 bp, Homo sapiens
ttctggataggggtatggagct

SEQ ID NO: 7623221 - DNA, 22 bp, Homo sapiens
ttctggataggggtatggagct

SEQ ID NO: 7623222 - DNA, 22 bp, Homo sapiens
ttctggagttgtgacctcaggg

SEQ ID NO: 7623223 - DNA, 22 bp, Homo sapiens
ttctggagtttgaagatcaggt

SEQ ID NO: 7623224 - DNA, 22 bp, Homo sapiens
ttctggagttgtgacctcaggg

SEQ ID NO: 7623225 - DNA, 22 bp, Homo sapiens
ttctggctttgaccaagttcaa

SEQ ID NO: 7623226 - DNA, 22 bp, Homo sapiens
ttctggcttttcatgttccagt

SEQ ID NO: 7623227 - DNA, 22 bp, Homo sapiens
ttctggcttttcatgttccagt

SEQ ID NO: 7623228 - DNA, 22 bp, Homo sapiens
ttctggcttttcatgttccagt

SEQ ID NO: 7623229 - DNA, 22 bp, Homo sapiens
ttctgggaacaaagtggagtgg

SEQ ID NO: 7623230 - DNA, 22 bp, Homo sapiens
ttctgggaacaaagtggagtgg

SEQ ID NO: 7623231 - DNA, 20 bp, Homo sapiens
ttctgggaattgggtagctg

SEQ ID NO: 7623232 - DNA, 22 bp, Homo sapiens
ttctgggacatctggacagttt

SEQ ID NO: 7623233 - DNA, 22 bp, Homo sapiens
ttctgggacattgcaggtattc

SEQ ID NO: 7623234 - DNA, 22 bp, Homo sapiens
ttctgggacattgcaggtattc

SEQ ID NO: 7623235 - DNA, 22 bp, Homo sapiens
ttctgggacattgcaggtattc

SEQ ID NO: 7623236 - DNA, 22 bp, Homo sapiens
ttctgggacatctggacagttt

SEQ ID NO: 7623237 - DNA, 22 bp, Homo sapiens
ttctgggacatctggacagttt

SEQ ID NO: 7623238 - DNA, 22 bp, Homo sapiens
ttctgggacatctggacagttt

SEQ ID NO: 7623239 - DNA, 22 bp, Homo sapiens
ttctgggaacaaagtggagtgg

SEQ ID NO: 7623240 - DNA, 20 bp, Homo sapiens
ttctgggaattgggtagctg

SEQ ID NO: 7623241 - DNA, 22 bp, Homo sapiens
ttctggagtgtggaccgctgtt

SEQ ID NO: 7623242 - DNA, 22 bp, Homo sapiens
ttctggagttcaggtccctaaa

SEQ ID NO: 7623243 - DNA, 22 bp, Homo sapiens
ttctggagtgtattgggtctgc

SEQ ID NO: 7623244 - DNA, 22 bp, Homo sapiens
ttctggagtgataaaacaccac

SEQ ID NO: 7623245 - DNA, 22 bp, Homo sapiens
ttctggagtgataaaacaccac

SEQ ID NO: 7623246 - DNA, 22 bp, Homo sapiens
ttctggagtgataaaacaccac

SEQ ID NO: 7623247 - DNA, 22 bp, Homo sapiens
ttctggagtgataaaacaccac

SEQ ID NO: 7623248 - DNA, 22 bp, Homo sapiens
ttctggagtcttcaattttaga

SEQ ID NO: 7623249 - DNA, 22 bp, Homo sapiens
ttctggagtcattggggctgat

SEQ ID NO: 7623250 - DNA, 22 bp, Homo sapiens
ttctggagtcattggggctgat

SEQ ID NO: 7623251 - DNA, 22 bp, Homo sapiens
ttctggagtcccacagccaggg

SEQ ID NO: 7623252 - DNA, 22 bp, Homo sapiens
ttctggagtcccacagccaggg

SEQ ID NO: 7623253 - DNA, 22 bp, Homo sapiens
ttctggagtcccacagccaggg

SEQ ID NO: 7623254 - DNA, 22 bp, Homo sapiens
ttctggagtcccacagccaggg

SEQ ID NO: 7623255 - DNA, 22 bp, Homo sapiens
ttctggagtattcctggcagcc

SEQ ID NO: 7623256 - DNA, 22 bp, Homo sapiens
ttctggagtattcctggcagcc

SEQ ID NO: 7623257 - DNA, 22 bp, Homo sapiens
ttctggagtattcctggcacct

SEQ ID NO: 7623258 - DNA, 22 bp, Homo sapiens
ttctggagtattcctggcagcc

SEQ ID NO: 7623259 - DNA, 22 bp, Homo sapiens
ttctggagggcctgatcacaca

SEQ ID NO: 7623260 - DNA, 22 bp, Homo sapiens
ttctggagggcctgatcacaca

SEQ ID NO: 7623261 - DNA, 22 bp, Homo sapiens
ttctggagggcctgatcacaca

SEQ ID NO: 7623262 - DNA, 22 bp, Homo sapiens
ttctggagggcatgctgctgcc

SEQ ID NO: 7623263 - DNA, 22 bp, Homo sapiens
ttctggagggcatgctgctgcc

SEQ ID NO: 7623264 - DNA, 22 bp, Homo sapiens
ttctggaggctctaagggacaa

SEQ ID NO: 7623265 - DNA, 22 bp, Homo sapiens
ttctggaggctctaagggacaa

SEQ ID NO: 7623266 - DNA, 22 bp, Homo sapiens
ttctggaggctctaagggacaa

SEQ ID NO: 7623267 - DNA, 22 bp, Homo sapiens
ttctggaggctctaagggacaa

SEQ ID NO: 7623268 - DNA, 22 bp, Homo sapiens
ttctggaggtgtgaccattagc

SEQ ID NO: 7623269 - DNA, 22 bp, Homo sapiens
ttctggaggtgtgaccattagc

SEQ ID NO: 7623270 - DNA, 22 bp, Homo sapiens
ttctggaggtgtgaccattagc

SEQ ID NO: 7623271 - DNA, 19 bp, Homo sapiens
ttctggaggttaccctgag

SEQ ID NO: 7623272 - DNA, 22 bp, Homo sapiens
ttctggaggttattaggagtct

SEQ ID NO: 7623273 - DNA, 22 bp, Homo sapiens
ttctggaggttattaggagtct

SEQ ID NO: 7623274 - DNA, 22 bp, Homo sapiens
ttctggagtattcctggcacct

SEQ ID NO: 7623275 - DNA, 22 bp, Homo sapiens
ttctggagtattcctggcacct

SEQ ID NO: 7623276 - DNA, 22 bp, Homo sapiens
ttcttctacagtgattaatagt

SEQ ID NO: 7623277 - DNA, 22 bp, Homo sapiens
ttcttctacagtgattaatagt

SEQ ID NO: 7623278 - DNA, 23 bp, Homo sapiens
ttcttctaaggagggccaccatt

SEQ ID NO: 7623279 - DNA, 23 bp, Homo sapiens
ttcttctaaggagggccaccatt

SEQ ID NO: 7623280 - DNA, 22 bp, Homo sapiens
ttcttctacagtgattaatagt

SEQ ID NO: 7623281 - DNA, 22 bp, Homo sapiens
ttcttctacagtgattaatagt

SEQ ID NO: 7623282 - DNA, 22 bp, Homo sapiens
ttcttctacagtgattaatagt

SEQ ID NO: 7623283 - DNA, 22 bp, Homo sapiens
ttcttctaaatgtgcttattaa

SEQ ID NO: 7623284 - DNA, 22 bp, Homo sapiens
ttcttctaaatgtgcttattaa

SEQ ID NO: 7623285 - DNA, 22 bp, Homo sapiens
ttcttctaaatgtgcttattaa

SEQ ID NO: 7623286 - DNA, 23 bp, Homo sapiens
ttcttctaaggagggccaccatt

SEQ ID NO: 7623287 - DNA, 22 bp, Homo sapiens
ttcttctagagttcagaagcca

SEQ ID NO: 7623288 - DNA, 22 bp, Homo sapiens
ttcttctagagttcagaagcca

SEQ ID NO: 7623289 - DNA, 22 bp, Homo sapiens
ttcttctacctctgagacttgt

SEQ ID NO: 7623290 - DNA, 19 bp, Homo sapiens
ttcttctacctctaccact

SEQ ID NO: 7623291 - DNA, 19 bp, Homo sapiens
ttcttctacctctaccact

SEQ ID NO: 7623292 - DNA, 19 bp, Homo sapiens
ttcttctacctctaccact

SEQ ID NO: 7623293 - DNA, 19 bp, Homo sapiens
ttcttctacctctaccact

SEQ ID NO: 7623294 - DNA, 22 bp, Homo sapiens
ttcttcctctgtaaaaggtgac

SEQ ID NO: 7623295 - DNA, 22 bp, Homo sapiens
ttcttcctctgtaaaaggtgac

SEQ ID NO: 7623296 - DNA, 22 bp, Homo sapiens
ttcttcctctgtaaaaggtgac

SEQ ID NO: 7623297 - DNA, 22 bp, Homo sapiens
ttcttccttggtttcctggata

SEQ ID NO: 7623298 - DNA, 22 bp, Homo sapiens
ttcttccttggtttcctggata

SEQ ID NO: 7623299 - DNA, 22 bp, Homo sapiens
ttcttccttggtttcctggata

SEQ ID NO: 7623300 - DNA, 22 bp, Homo sapiens
ttcttccttggtttcctggata

SEQ ID NO: 7623301 - DNA, 22 bp, Homo sapiens
ttcttccttggtttcctggata

SEQ ID NO: 7623302 - DNA, 22 bp, Homo sapiens
ttcttctcctaaggagagtcct

SEQ ID NO: 7623303 - DNA, 22 bp, Homo sapiens
ttcttctccgaggagggctggt

SEQ ID NO: 7623304 - DNA, 22 bp, Homo sapiens
ttcttctcctaaggagagtcct

SEQ ID NO: 7623305 - DNA, 22 bp, Homo sapiens
ttcttctcctaaggagagtcct

SEQ ID NO: 7623306 - DNA, 22 bp, Homo sapiens
ttcttctcctaaggagagtcct

SEQ ID NO: 7623307 - DNA, 22 bp, Homo sapiens
ttcttctcggctgtcagatagt

SEQ ID NO: 7623308 - DNA, 22 bp, Homo sapiens
ttcttctcggctgtcagatagt

SEQ ID NO: 7623309 - DNA, 22 bp, Homo sapiens
ttcttctcggctgtcagatagt

SEQ ID NO: 7623310 - DNA, 22 bp, Homo sapiens
ttcttctcggctgtcagatagt

SEQ ID NO: 7623311 - DNA, 22 bp, Homo sapiens
ttcttctcagggtcccacatgg

SEQ ID NO: 7623312 - DNA, 22 bp, Homo sapiens
ttcttctccgaggagggctggt

SEQ ID NO: 7623313 - DNA, 23 bp, Homo sapiens
ttcttctcaattagttgattcag

SEQ ID NO: 7623314 - DNA, 23 bp, Homo sapiens
ttcttctcaattagttgattcag

SEQ ID NO: 7623315 - DNA, 22 bp, Homo sapiens
ttcttctcagggtcccacatgg

SEQ ID NO: 7623316 - DNA, 22 bp, Homo sapiens
ttcttctcagggtcccacatgg

SEQ ID NO: 7623317 - DNA, 22 bp, Homo sapiens
ttcttcagagagtagaagcaag

SEQ ID NO: 7623318 - DNA, 22 bp, Homo sapiens
ttcttcagagagtagaagcaag

SEQ ID NO: 7623319 - DNA, 22 bp, Homo sapiens
ttcttcagagagtagaagcaag

SEQ ID NO: 7623320 - DNA, 22 bp, Homo sapiens
ttcttcagagagtagaagcaag

SEQ ID NO: 7623321 - DNA, 22 bp, Homo sapiens
ttcttcagagagtagaagcaag

SEQ ID NO: 7623322 - DNA, 22 bp, Homo sapiens
ttcttcagagagtagaagcaag

SEQ ID NO: 7623323 - DNA, 22 bp, Homo sapiens
ttcttcagatcctacaagtctg

SEQ ID NO: 7623324 - DNA, 22 bp, Homo sapiens
ttcttcagatggtgagacctcc

SEQ ID NO: 7623325 - DNA, 22 bp, Homo sapiens
ttcttcagatcctacaagtctg

SEQ ID NO: 7623326 - DNA, 22 bp, Homo sapiens
ttcttcagatggtgagacctcc

SEQ ID NO: 7623327 - DNA, 22 bp, Homo sapiens
ttcttcagcccatatcttccag

SEQ ID NO: 7623328 - DNA, 23 bp, Homo sapiens
ttcttcagccttatagccctggg

SEQ ID NO: 7623329 - DNA, 23 bp, Homo sapiens
ttcttcagccttatagccctggg

SEQ ID NO: 7623330 - DNA, 22 bp, Homo sapiens
ttcttcagcctaccttgacctc

SEQ ID NO: 7623331 - DNA, 22 bp, Homo sapiens
ttcttcctcacactctcaccca

SEQ ID NO: 7623332 - DNA, 22 bp, Homo sapiens
ttctgggatgtgaatggtttaa

SEQ ID NO: 7623333 - DNA, 22 bp, Homo sapiens
ttcttcagactccctctttaag

SEQ ID NO: 7623334 - DNA, 22 bp, Homo sapiens
ttctgggcacacaggccctggt

SEQ ID NO: 7623335 - DNA, 22 bp, Homo sapiens
ttctgggcacacaggccctggt

SEQ ID NO: 7623336 - DNA, 22 bp, Homo sapiens
ttctgggcacacaggccctggt

SEQ ID NO: 7623337 - DNA, 22 bp, Homo sapiens
ttctgggatgtgaatggtttaa

SEQ ID NO: 7623338 - DNA, 20 bp, Homo sapiens
ttctgggatgcctgcatctt

SEQ ID NO: 7623339 - DNA, 22 bp, Homo sapiens
ttctgggaggctggctgtcata

SEQ ID NO: 7623340 - DNA, 19 bp, Homo sapiens
ttctgggaggggctgactg

SEQ ID NO: 7623341 - DNA, 22 bp, Homo sapiens
ttctgggagagaaagggccttg

SEQ ID NO: 7623342 - DNA, 22 bp, Homo sapiens
ttctgggagagaaagggccttg

SEQ ID NO: 7623343 - DNA, 22 bp, Homo sapiens
ttctgggagaatctaaatggtt

SEQ ID NO: 7623344 - DNA, 22 bp, Homo sapiens
ttctgggagaatctaaatggtt

SEQ ID NO: 7623345 - DNA, 22 bp, Homo sapiens
ttctgggacattgcaggtattc

SEQ ID NO: 7623346 - DNA, 22 bp, Homo sapiens
ttctgggacattgcaggtattc

SEQ ID NO: 7623347 - DNA, 22 bp, Homo sapiens
ttctgggaggatgggaaatcat

SEQ ID NO: 7623348 - DNA, 22 bp, Homo sapiens
ttctgggaggatgggaaatcat

SEQ ID NO: 7623349 - DNA, 22 bp, Homo sapiens
ttctgggagattcatatgaaaa

SEQ ID NO: 7623350 - DNA, 22 bp, Homo sapiens
ttctgggaggcctttgtgtctg

SEQ ID NO: 7623351 - DNA, 22 bp, Homo sapiens
ttctgggaggcctttgtgtctg

SEQ ID NO: 7623352 - DNA, 22 bp, Homo sapiens
ttctgggaggctggctgtcata

SEQ ID NO: 7623353 - DNA, 19 bp, Homo sapiens
ttgaaaatatggatctgag

SEQ ID NO: 7623354 - DNA, 19 bp, Homo sapiens
ttgaaaatatggatctgag

SEQ ID NO: 7623355 - DNA, 19 bp, Homo sapiens
ttgaaaatatggatctgag

SEQ ID NO: 7623356 - DNA, 20 bp, Homo sapiens
ttgaaaatgcattgtgcagt

SEQ ID NO: 7623357 - DNA, 20 bp, Homo sapiens
ttgaaaatgcattgtgcagt

SEQ ID NO: 7623358 - DNA, 20 bp, Homo sapiens
ttgaaaatgcattgtgcagt

SEQ ID NO: 7623359 - DNA, 20 bp, Homo sapiens
ttgaaaatgcattgtgcagt

SEQ ID NO: 7623360 - DNA, 20 bp, Homo sapiens
ttgaaaatgcattgtgcagt

SEQ ID NO: 7623361 - DNA, 22 bp, Homo sapiens
ttgaaaatatcacaggagcagc

SEQ ID NO: 7623362 - DNA, 22 bp, Homo sapiens
ttgaaaatatcacaggagcagc

SEQ ID NO: 7623363 - DNA, 22 bp, Homo sapiens
ttgaaaatatcacaggagcagc

SEQ ID NO: 7623364 - DNA, 22 bp, Homo sapiens
ttgaaaatatcacaggagcagc

SEQ ID NO: 7623365 - DNA, 22 bp, Homo sapiens
ttgaaaatatcacaggagcagc

SEQ ID NO: 7623366 - DNA, 22 bp, Homo sapiens
ttgaaaatatcacaggagcagc

SEQ ID NO: 7623367 - DNA, 22 bp, Homo sapiens
ttgaaaatatcacaggagcagc

SEQ ID NO: 7623368 - DNA, 22 bp, Homo sapiens
ttgaaaatatcacaggagcagc

SEQ ID NO: 7623369 - DNA, 22 bp, Homo sapiens
ttgaaaagttttgaaacactct

SEQ ID NO: 7623370 - DNA, 17 bp, Homo sapiens
ttgaaaagtaagctccc

SEQ ID NO: 7623371 - DNA, 22 bp, Homo sapiens
ttgaaaagttttgaaacactct

SEQ ID NO: 7623372 - DNA, 22 bp, Homo sapiens
ttgaaaagttttgaaacactct

SEQ ID NO: 7623373 - DNA, 22 bp, Homo sapiens
ttgaaaagttttgaaacactct

SEQ ID NO: 7623374 - DNA, 22 bp, Homo sapiens
ttgaaaatggtaagcatgatat

SEQ ID NO: 7623375 - DNA, 22 bp, Homo sapiens
ttgaaaatggtaagcatgatat

SEQ ID NO: 7623376 - DNA, 22 bp, Homo sapiens
ttgaaaatggtaagcatgatat

SEQ ID NO: 7623377 - DNA, 20 bp, Homo sapiens
ttgaaaatgcattgtgcagt

SEQ ID NO: 7623378 - DNA, 22 bp, Homo sapiens
ttgaaacagacaagtaaatgtc

SEQ ID NO: 7623379 - DNA, 22 bp, Homo sapiens
ttgaaacagacaagtaaatgtc

SEQ ID NO: 7623380 - DNA, 22 bp, Homo sapiens
ttgaaacagacaagtaaatgtc

SEQ ID NO: 7623381 - DNA, 22 bp, Homo sapiens
ttgaaacagacaagtaaatgtc

SEQ ID NO: 7623382 - DNA, 22 bp, Homo sapiens
ttgaaacagtagctcatagacc

SEQ ID NO: 7623383 - DNA, 22 bp, Homo sapiens
ttgaaacagtagctcatagacc

SEQ ID NO: 7623384 - DNA, 22 bp, Homo sapiens
ttgaaacagtagctcatagacc

SEQ ID NO: 7623385 - DNA, 22 bp, Homo sapiens
ttgaaacataaaatatttcctg

SEQ ID NO: 7623386 - DNA, 22 bp, Homo sapiens
ttgaaacataaaatatttcctg

SEQ ID NO: 7623387 - DNA, 22 bp, Homo sapiens
ttgaaacatatacaaagtggtg

SEQ ID NO: 7623388 - DNA, 22 bp, Homo sapiens
ttgaaaaaattggtagaggatg

SEQ ID NO: 7623389 - DNA, 22 bp, Homo sapiens
ttgaaaaaattggtagaggatg

SEQ ID NO: 7623390 - DNA, 22 bp, Homo sapiens
ttgaaaaaattggtagaggatg

SEQ ID NO: 7623391 - DNA, 23 bp, Homo sapiens
ttgaaaaatatagtcccattgtc

SEQ ID NO: 7623392 - DNA, 23 bp, Homo sapiens
ttgaaaaatatagtcccattgtc

SEQ ID NO: 7623393 - DNA, 22 bp, Homo sapiens
ttgaaaacatttatattagaat

SEQ ID NO: 7623394 - DNA, 22 bp, Homo sapiens
ttgaaaaccgtgggaggctgaa

SEQ ID NO: 7623395 - DNA, 22 bp, Homo sapiens
ttgaaaactttctagaccaaga

SEQ ID NO: 7623396 - DNA, 22 bp, Homo sapiens
ttgaaaagcaaatgatgggtag

SEQ ID NO: 7623397 - DNA, 17 bp, Homo sapiens
ttgaaaagtaagctccc

SEQ ID NO: 7623398 - DNA, 22 bp, Homo sapiens
ttgaaaactttctagaccaaga

SEQ ID NO: 7623399 - DNA, 22 bp, Homo sapiens
ttgaaaagcaaatgatgggtag

SEQ ID NO: 7623400 - DNA, 22 bp, Homo sapiens
ttgaaaacagcgtagattcaca

SEQ ID NO: 7623401 - DNA, 22 bp, Homo sapiens
ttgaaaacagcgtagattcaca

SEQ ID NO: 7623402 - DNA, 22 bp, Homo sapiens
ttgaaaacatttatattagaat

SEQ ID NO: 7623403 - DNA, 22 bp, Homo sapiens
ttgaaaacatttatattagaat

SEQ ID NO: 7623404 - DNA, 22 bp, Homo sapiens
ttgaaaacatttatattagaat

SEQ ID NO: 7623405 - DNA, 22 bp, Homo sapiens
ttgaaaacagcgtagattcaca

SEQ ID NO: 7623406 - DNA, 22 bp, Homo sapiens
ttgaaaaaattggtagaggatg

SEQ ID NO: 7623407 - DNA, 22 bp, Homo sapiens
ttgaaaaaattggtagaggatg

SEQ ID NO: 7623408 - DNA, 22 bp, Homo sapiens
ttgaaaaaattggtagaggatg

SEQ ID NO: 7623409 - DNA, 22 bp, Homo sapiens
ttctttttggatagctgatgaa

SEQ ID NO: 7623410 - DNA, 22 bp, Homo sapiens
ttctttttggatagctgatgaa

SEQ ID NO: 7623411 - DNA, 22 bp, Homo sapiens
ttctttttggatagctgatgaa

SEQ ID NO: 7623412 - DNA, 22 bp, Homo sapiens
ttctttttggatagctgatgaa

SEQ ID NO: 7623413 - DNA, 22 bp, Homo sapiens
ttctttttggatagctgatgaa

SEQ ID NO: 7623414 - DNA, 22 bp, Homo sapiens
ttctttttatcttcccataaga

SEQ ID NO: 7623415 - DNA, 22 bp, Homo sapiens
ttctttttatcttcccataaga

SEQ ID NO: 7623416 - DNA, 22 bp, Homo sapiens
ttctttttatcttcccataaga

SEQ ID NO: 7623417 - DNA, 22 bp, Homo sapiens
ttctttttatcttcccataaga

SEQ ID NO: 7623418 - DNA, 22 bp, Homo sapiens
ttctttttatcttcccataaga

SEQ ID NO: 7623419 - DNA, 22 bp, Homo sapiens
ttctttttatcttcccataaga

SEQ ID NO: 7623420 - DNA, 22 bp, Homo sapiens
ttctttttggatagctgatgaa

SEQ ID NO: 7623421 - DNA, 22 bp, Homo sapiens
ttctttttggatagctgatgaa

SEQ ID NO: 7623422 - DNA, 22 bp, Homo sapiens
ttctttttggatagctgatgaa

SEQ ID NO: 7623423 - DNA, 22 bp, Homo sapiens
ttctttttggatagctgatgaa

SEQ ID NO: 7623424 - DNA, 19 bp, Homo sapiens
ttgaaagattagctttcta

SEQ ID NO: 7623425 - DNA, 22 bp, Homo sapiens
ttgaaagatatgttaatctttc

SEQ ID NO: 7623426 - DNA, 22 bp, Homo sapiens
ttgaaagatatgttaatctttc

SEQ ID NO: 7623427 - DNA, 22 bp, Homo sapiens
ttgaaagatatgttaatctttc

SEQ ID NO: 7623428 - DNA, 22 bp, Homo sapiens
ttgaaagatatgttaatctttc

SEQ ID NO: 7623429 - DNA, 22 bp, Homo sapiens
ttgaaagatatgttaatctttc

SEQ ID NO: 7623430 - DNA, 22 bp, Homo sapiens
ttgaaagatagtgaagccagcc

SEQ ID NO: 7623431 - DNA, 22 bp, Homo sapiens
ttgacagttgagggttgtctaa

SEQ ID NO: 7623432 - DNA, 22 bp, Homo sapiens
ttgaaagcaggagacacccaga

SEQ ID NO: 7623433 - DNA, 22 bp, Homo sapiens
ttgacagtatagctttacctat

SEQ ID NO: 7623434 - DNA, 23 bp, Homo sapiens
ttgacagtaggtggttttcattg

SEQ ID NO: 7623435 - DNA, 22 bp, Homo sapiens
ttgaaaggaatacagaggccta

SEQ ID NO: 7623436 - DNA, 23 bp, Homo sapiens
ttgaaagattgctaagtaaaaat

SEQ ID NO: 7623437 - DNA, 23 bp, Homo sapiens
ttgaaagattgctaagtaaaaat

SEQ ID NO: 7623438 - DNA, 23 bp, Homo sapiens
ttgaaagattgctaagtaaaaat

SEQ ID NO: 7623439 - DNA, 22 bp, Homo sapiens
ttgaccattatacactggcttg

SEQ ID NO: 7623440 - DNA, 22 bp, Homo sapiens
ttgaccagttccccaaattgct

SEQ ID NO: 7623441 - DNA, 22 bp, Homo sapiens
ttgaccatacctccaggcagtt

SEQ ID NO: 7623442 - DNA, 22 bp, Homo sapiens
ttgagaaacctggcagtagaga

SEQ ID NO: 7623443 - DNA, 22 bp, Homo sapiens
ttgagaaactctgggttagaat

SEQ ID NO: 7623444 - DNA, 22 bp, Homo sapiens
ttgagaaactaacggcttgagc

SEQ ID NO: 7623445 - DNA, 22 bp, Homo sapiens
ttgagaaactaacggcttgagc

SEQ ID NO: 7623446 - DNA, 17 bp, Homo sapiens
ttgaccaaaatgcagcc

SEQ ID NO: 7623447 - DNA, 21 bp, Homo sapiens
ttgaccaagggtgcgtgctcc

SEQ ID NO: 7623448 - DNA, 21 bp, Homo sapiens
ttgaccaagggtgcgtgctcc

SEQ ID NO: 7623449 - DNA, 22 bp, Homo sapiens
ttgaccactgaatggttctgaa

SEQ ID NO: 7623450 - DNA, 22 bp, Homo sapiens
ttgaccactgaatggttctgaa

SEQ ID NO: 7623451 - DNA, 22 bp, Homo sapiens
ttgacatcaaatagatatcttt

SEQ ID NO: 7623452 - DNA, 22 bp, Homo sapiens
ttgacatgtagtatagttgcat

SEQ ID NO: 7623453 - DNA, 22 bp, Homo sapiens
ttgaaacattctcctattgatt

SEQ ID NO: 7623454 - DNA, 22 bp, Homo sapiens
ttgaaacattacctgtatttcc

SEQ ID NO: 7623455 - DNA, 22 bp, Homo sapiens
ttgaaacattacctgtatttcc

SEQ ID NO: 7623456 - DNA, 22 bp, Homo sapiens
ttgaaacattacctgtatttcc

SEQ ID NO: 7623457 - DNA, 22 bp, Homo sapiens
ttgaaactcatcttagtgatgt

SEQ ID NO: 7623458 - DNA, 22 bp, Homo sapiens
ttgaaactcatcttagtgatgt

SEQ ID NO: 7623459 - DNA, 22 bp, Homo sapiens
ttgaaacttagaaattgagctg

SEQ ID NO: 7623460 - DNA, 22 bp, Homo sapiens
ttgaaactgggaagcagggggt

SEQ ID NO: 7623461 - DNA, 22 bp, Homo sapiens
ttgaaactgagtgtgtttgggg

SEQ ID NO: 7623462 - DNA, 22 bp, Homo sapiens
ttgaaactgcttattgaatttg

SEQ ID NO: 7623463 - DNA, 22 bp, Homo sapiens
ttgaaagaaggtggtagagaat

SEQ ID NO: 7623464 - DNA, 22 bp, Homo sapiens
ttgaaagacattatttatatat

SEQ ID NO: 7623465 - DNA, 22 bp, Homo sapiens
ttgaaagacattatttatatat

SEQ ID NO: 7623466 - DNA, 22 bp, Homo sapiens
ttgaaagacttctcctgtgaaa

SEQ ID NO: 7623467 - DNA, 22 bp, Homo sapiens
ttgaaagaggcaaagtttgatc

SEQ ID NO: 7623468 - DNA, 22 bp, Homo sapiens
ttgaaagaggcaaagtttgatc

SEQ ID NO: 7623469 - DNA, 22 bp, Homo sapiens
ttgaaagatagtgaagccagcc

SEQ ID NO: 7623470 - DNA, 22 bp, Homo sapiens
ttgaaagatagtgaagccagcc

SEQ ID NO: 7623471 - DNA, 22 bp, Homo sapiens
ttgaaacttttcttggagaaac

SEQ ID NO: 7623472 - DNA, 22 bp, Homo sapiens
ttgaaagaacaattctgtgatg

SEQ ID NO: 7623473 - DNA, 22 bp, Homo sapiens
ttgaaagaactcttcagagata

SEQ ID NO: 7623474 - DNA, 22 bp, Homo sapiens
ttgaaagaactcttcagagata

SEQ ID NO: 7623475 - DNA, 22 bp, Homo sapiens
ttgaaagaaggtggtagagaat

SEQ ID NO: 7623476 - DNA, 22 bp, Homo sapiens
ttgaaagaacaattctgtgatg

SEQ ID NO: 7623477 - DNA, 22 bp, Homo sapiens
ttgaaagaagaagctgcgatgt

SEQ ID NO: 7623478 - DNA, 22 bp, Homo sapiens
ttgaaagaactcttcagagata

SEQ ID NO: 7623479 - DNA, 22 bp, Homo sapiens
ttgaaagaactcttcagagata

SEQ ID NO: 7623480 - DNA, 22 bp, Homo sapiens
ttgaggtagtacttattattgg

SEQ ID NO: 7623481 - DNA, 22 bp, Homo sapiens
ttgaggtagtacttattattgg

SEQ ID NO: 7623482 - DNA, 22 bp, Homo sapiens
ttgaggtatattcacatatatc

SEQ ID NO: 7623483 - DNA, 22 bp, Homo sapiens
ttgaggtatattcacatatatc

SEQ ID NO: 7623484 - DNA, 22 bp, Homo sapiens
ttgaggtagttctattgtgagt

SEQ ID NO: 7623485 - DNA, 22 bp, Homo sapiens
ttgaggtagttctattgtgagt

SEQ ID NO: 7623486 - DNA, 22 bp, Homo sapiens
ttgaggtaataaacagccattc

SEQ ID NO: 7623487 - DNA, 22 bp, Homo sapiens
ttgaggtaataaacagccattc

SEQ ID NO: 7623488 - DNA, 22 bp, Homo sapiens
ttgaggtacaatgggtcagtta

SEQ ID NO: 7623489 - DNA, 22 bp, Homo sapiens
ttgaggtaaagctactagttag

SEQ ID NO: 7623490 - DNA, 22 bp, Homo sapiens
ttgagggtctggatctgctgct

SEQ ID NO: 7623491 - DNA, 22 bp, Homo sapiens
ttgagggtctggatctgctgct

SEQ ID NO: 7623492 - DNA, 22 bp, Homo sapiens
ttgagggtctggatctgctgct

SEQ ID NO: 7623493 - DNA, 19 bp, Homo sapiens
ttgagggcattctggtgtt

SEQ ID NO: 7623494 - DNA, 19 bp, Homo sapiens
ttgagggcattctggtgtt

SEQ ID NO: 7623495 - DNA, 22 bp, Homo sapiens
ttgagggattttaaatgaacaa

SEQ ID NO: 7623496 - DNA, 19 bp, Homo sapiens
ttgaggggccaggggagat

SEQ ID NO: 7623497 - DNA, 19 bp, Homo sapiens
ttgaggggccaggggagat

SEQ ID NO: 7623498 - DNA, 19 bp, Homo sapiens
ttgaggggccaggggagat

SEQ ID NO: 7623499 - DNA, 19 bp, Homo sapiens
ttgaggggccaggggagat

SEQ ID NO: 7623500 - DNA, 21 bp, Homo sapiens
ttgaggggtattgcttttctc

SEQ ID NO: 7623501 - DNA, 21 bp, Homo sapiens
ttgaggggtattgcttttctc

SEQ ID NO: 7623502 - DNA, 22 bp, Homo sapiens
ttgagggtctggatctgctgct

SEQ ID NO: 7623503 - DNA, 21 bp, Homo sapiens
ttgaggggtattgcttttctc

SEQ ID NO: 7623504 - DNA, 22 bp, Homo sapiens
ttgagggtctggatctgctgct

SEQ ID NO: 7623505 - DNA, 22 bp, Homo sapiens
ttgagggatttacagaggtggg

SEQ ID NO: 7623506 - DNA, 22 bp, Homo sapiens
ttgagggatttacagaggtggg

SEQ ID NO: 7623507 - DNA, 22 bp, Homo sapiens
ttgagggatttacagaggtggg

SEQ ID NO: 7623508 - DNA, 22 bp, Homo sapiens
ttgagggattgcaccagaagag

SEQ ID NO: 7623509 - DNA, 22 bp, Homo sapiens
ttgagggattgcaccagaagag

SEQ ID NO: 7623510 - DNA, 18 bp, Homo sapiens
ttgagggaggggcagagt

SEQ ID NO: 7623511 - DNA, 22 bp, Homo sapiens
ttgagggagcctgggagccatg

SEQ ID NO: 7623512 - DNA, 22 bp, Homo sapiens
ttgagggagcctgggagccatg

SEQ ID NO: 7623513 - DNA, 22 bp, Homo sapiens
ttgagggagatgttgacttcag

SEQ ID NO: 7623514 - DNA, 22 bp, Homo sapiens
ttgagggagcacagattcttat

SEQ ID NO: 7623515 - DNA, 18 bp, Homo sapiens
ttgagggaggggcagagt

SEQ ID NO: 7623516 - DNA, 22 bp, Homo sapiens
ttgagaggatggattagacaaa

SEQ ID NO: 7623517 - DNA, 22 bp, Homo sapiens
ttgagaggctgttgacattctg

SEQ ID NO: 7623518 - DNA, 22 bp, Homo sapiens
ttgagagaggaaacatagtctc

SEQ ID NO: 7623519 - DNA, 22 bp, Homo sapiens
ttgagagaggaaacatagtctc

SEQ ID NO: 7623520 - DNA, 22 bp, Homo sapiens
ttgagaggatggattagacaaa

SEQ ID NO: 7623521 - DNA, 22 bp, Homo sapiens
ttgagaggatggattagacaaa

SEQ ID NO: 7623522 - DNA, 22 bp, Homo sapiens
ttgagaggctgttgacattctg

SEQ ID NO: 7623523 - DNA, 22 bp, Homo sapiens
ttgagagtagagatggcagggc

SEQ ID NO: 7623524 - DNA, 22 bp, Homo sapiens
ttgagagtagagatggcagggc

SEQ ID NO: 7623525 - DNA, 22 bp, Homo sapiens
ttgagagtcatttaaggtgttg

SEQ ID NO: 7623526 - DNA, 22 bp, Homo sapiens
ttgagagtctgagtttggacta

SEQ ID NO: 7623527 - DNA, 22 bp, Homo sapiens
ttgagagtcgattttgaactag

SEQ ID NO: 7623528 - DNA, 22 bp, Homo sapiens
ttgagagtctgagtttggacta

SEQ ID NO: 7623529 - DNA, 22 bp, Homo sapiens
ttgagagtctatcaaatagctt

SEQ ID NO: 7623530 - DNA, 22 bp, Homo sapiens
ttgagagtcgattttgaactag

SEQ ID NO: 7623531 - DNA, 22 bp, Homo sapiens
ttgagagttctgaatgagtaac

SEQ ID NO: 7623532 - DNA, 22 bp, Homo sapiens
ttgagagttaccagcagaggaa

SEQ ID NO: 7623533 - DNA, 22 bp, Homo sapiens
ttgagagtggcttgttgactgc

SEQ ID NO: 7623534 - DNA, 22 bp, Homo sapiens
ttgagagtgccaagcatcctcc

SEQ ID NO: 7623535 - DNA, 22 bp, Homo sapiens
ttgagagtgccaagcatcctcc

SEQ ID NO: 7623536 - DNA, 22 bp, Homo sapiens
ttgagagttttcaatagattgg

SEQ ID NO: 7623537 - DNA, 22 bp, Homo sapiens
ttgagagttttcaatagattgg

SEQ ID NO: 7623538 - DNA, 22 bp, Homo sapiens
ttgagagtttgggggcaatatg

SEQ ID NO: 7623539 - DNA, 22 bp, Homo sapiens
ttgaggctgcacagtacaggct

SEQ ID NO: 7623540 - DNA, 22 bp, Homo sapiens
ttgaggctgcacagtacaggct

SEQ ID NO: 7623541 - DNA, 22 bp, Homo sapiens
ttgagggaaataactgatgctt

SEQ ID NO: 7623542 - DNA, 22 bp, Homo sapiens
ttgagggaacatgagaatcatc

SEQ ID NO: 7623543 - DNA, 22 bp, Homo sapiens
ttgagggaacatgagaatcatc

SEQ ID NO: 7623544 - DNA, 22 bp, Homo sapiens
ttgagggagaaagttggagtag

SEQ ID NO: 7623545 - DNA, 22 bp, Homo sapiens
ttgagggagaaagttggagtag

SEQ ID NO: 7623546 - DNA, 22 bp, Homo sapiens
ttgagggagaaagccgaggtgt

SEQ ID NO: 7623547 - DNA, 22 bp, Homo sapiens
ttgagggagaaagctgaggtgt

SEQ ID NO: 7623548 - DNA, 22 bp, Homo sapiens
ttgagggactttctctattatt

SEQ ID NO: 7623549 - DNA, 22 bp, Homo sapiens
ttgagggacagaggtgctgtct

SEQ ID NO: 7623550 - DNA, 22 bp, Homo sapiens
ttgagataggtggaatctcttt

SEQ ID NO: 7623551 - DNA, 22 bp, Homo sapiens
ttgaggccccatggatgagaac

SEQ ID NO: 7623552 - DNA, 22 bp, Homo sapiens
ttgaggcccggcaggccgagcg

SEQ ID NO: 7623553 - DNA, 22 bp, Homo sapiens
ttgaggcccggcaggccgagcg

SEQ ID NO: 7623554 - DNA, 22 bp, Homo sapiens
ttgaggcccggcaggccgagcg

SEQ ID NO: 7623555 - DNA, 22 bp, Homo sapiens
ttgaggcctgctggaaggtgtt

SEQ ID NO: 7623556 - DNA, 22 bp, Homo sapiens
ttgaggcctgctggaaggtgtt

SEQ ID NO: 7623557 - DNA, 22 bp, Homo sapiens
ttgaggcctgctggaaggtgtt

SEQ ID NO: 7623558 - DNA, 18 bp, Homo sapiens
ttgagaaataagcactaa

SEQ ID NO: 7623559 - DNA, 18 bp, Homo sapiens
ttgagaaataagcactaa

SEQ ID NO: 7623560 - DNA, 18 bp, Homo sapiens
ttgagaaataagcactaa

SEQ ID NO: 7623561 - DNA, 18 bp, Homo sapiens
ttgagaaataagcactaa

SEQ ID NO: 7623562 - DNA, 18 bp, Homo sapiens
ttgagaaataagcactaa

SEQ ID NO: 7623563 - DNA, 18 bp, Homo sapiens
ttgagaaataagcactaa

SEQ ID NO: 7623564 - DNA, 18 bp, Homo sapiens
ttgagaaataagcactaa

SEQ ID NO: 7623565 - DNA, 22 bp, Homo sapiens
ttgagaaataagcatgtctaga

SEQ ID NO: 7623566 - DNA, 22 bp, Homo sapiens
ttgagaaataagcatgtctaga

SEQ ID NO: 7623567 - DNA, 22 bp, Homo sapiens
ttgagaaataagcatgtctaga

SEQ ID NO: 7623568 - DNA, 22 bp, Homo sapiens
ttgagaaataagcatgtctaga

SEQ ID NO: 7623569 - DNA, 18 bp, Homo sapiens
ttgagaaataagcactaa

SEQ ID NO: 7623570 - DNA, 19 bp, Homo sapiens
ttgagaaagttgatttggg

SEQ ID NO: 7623571 - DNA, 19 bp, Homo sapiens
ttgagaaagttgatttggg

SEQ ID NO: 7623572 - DNA, 22 bp, Homo sapiens
ttgagaaaggtaagaacccaca

SEQ ID NO: 7623573 - DNA, 22 bp, Homo sapiens
ttgagaaaggtaagaacccaca

SEQ ID NO: 7623574 - DNA, 22 bp, Homo sapiens
ttgagaaaggggtcaatatctc

SEQ ID NO: 7623575 - DNA, 22 bp, Homo sapiens
ttgagaaaggggtcaatatctc

SEQ ID NO: 7623576 - DNA, 22 bp, Homo sapiens
ttgagaaaggggtcaatatctc

SEQ ID NO: 7623577 - DNA, 22 bp, Homo sapiens
ttgagaaaggggtcaatatctc

SEQ ID NO: 7623578 - DNA, 22 bp, Homo sapiens
ttgagaaactctgggttagaat

SEQ ID NO: 7623579 - DNA, 22 bp, Homo sapiens
ttgagaaaggggtcaatatctc

SEQ ID NO: 7623580 - DNA, 22 bp, Homo sapiens
ttgagaaataagcatgtctaga

SEQ ID NO: 7623581 - DNA, 22 bp, Homo sapiens
ttgagaaataagcatgtctaga

SEQ ID NO: 7623582 - DNA, 22 bp, Homo sapiens
ttgagaaataagcatgtctaga

SEQ ID NO: 7623583 - DNA, 22 bp, Homo sapiens
ttgagaaataagcatgtctaga

SEQ ID NO: 7623584 - DNA, 22 bp, Homo sapiens
ttgagaaataagcatgtctaga

SEQ ID NO: 7623585 - DNA, 22 bp, Homo sapiens
ttgagaaatacttttgtagcct

SEQ ID NO: 7623586 - DNA, 22 bp, Homo sapiens
ttgagaaatacttttgtagcct

SEQ ID NO: 7623587 - DNA, 22 bp, Homo sapiens
ttgagaaatacttttgtagcct

SEQ ID NO: 7623588 - DNA, 19 bp, Homo sapiens
ttgagaaatgggaaaagca

SEQ ID NO: 7623589 - DNA, 16 bp, Homo sapiens
ttgagaaatgaagttt

SEQ ID NO: 7623590 - DNA, 16 bp, Homo sapiens
ttgagaaatgaagttt

SEQ ID NO: 7623591 - DNA, 22 bp, Homo sapiens
ttgagaaatgttttttaagctg

SEQ ID NO: 7623592 - DNA, 22 bp, Homo sapiens
ttgagaaatgttttttaagctg

SEQ ID NO: 7623593 - DNA, 22 bp, Homo sapiens
ttgagaaatgttttttaagctg

SEQ ID NO: 7623594 - DNA, 22 bp, Homo sapiens
ttgagaaatgttttttaagctg

SEQ ID NO: 7623595 - DNA, 19 bp, Homo sapiens
ttgagaaatgggaaaagca

SEQ ID NO: 7623596 - DNA, 19 bp, Homo sapiens
ttgagaaatgggaaaagca

SEQ ID NO: 7623597 - DNA, 19 bp, Homo sapiens
ttgagaaatgggaaaagca

SEQ ID NO: 7623598 - DNA, 19 bp, Homo sapiens
ttgagaacaccaagtactg

SEQ ID NO: 7623599 - DNA, 22 bp, Homo sapiens
ttgagaaatgttttttaagctg

SEQ ID NO: 7623600 - DNA, 22 bp, Homo sapiens
ttgagaaatgttttttaagctg

SEQ ID NO: 7623601 - DNA, 22 bp, Homo sapiens
ttgagaaatgttttttaagctg

SEQ ID NO: 7623602 - DNA, 22 bp, Homo sapiens
ttgagagaaaaaatttattggt

SEQ ID NO: 7623603 - DNA, 22 bp, Homo sapiens
ttgagacagtatctttgttggc

SEQ ID NO: 7623604 - DNA, 22 bp, Homo sapiens
ttgagacactttgggcatcact

SEQ ID NO: 7623605 - DNA, 19 bp, Homo sapiens
ttgagaattatctgagtca

SEQ ID NO: 7623606 - DNA, 22 bp, Homo sapiens
ttgagacactttgggcatcact

SEQ ID NO: 7623607 - DNA, 22 bp, Homo sapiens
ttgagaatgtgttttgctaagt

SEQ ID NO: 7623608 - DNA, 22 bp, Homo sapiens
ttgagacacaaggcacagtaag

SEQ ID NO: 7623609 - DNA, 22 bp, Homo sapiens
ttgagacacaaggcacagtaag

SEQ ID NO: 7623610 - DNA, 22 bp, Homo sapiens
ttgagacaccaaactttcctaa

SEQ ID NO: 7623611 - DNA, 22 bp, Homo sapiens
ttgagacacagtttcactctgt

SEQ ID NO: 7623612 - DNA, 22 bp, Homo sapiens
ttgagacacagtttcactctgt

SEQ ID NO: 7623613 - DNA, 22 bp, Homo sapiens
ttgagacacaaggcacagtaag

SEQ ID NO: 7623614 - DNA, 22 bp, Homo sapiens
ttgagaaggtggtcatttgcaa

SEQ ID NO: 7623615 - DNA, 22 bp, Homo sapiens
ttgagaaggtggtcatttgcaa

SEQ ID NO: 7623616 - DNA, 22 bp, Homo sapiens
ttgagaagaaatagtttgcaat

SEQ ID NO: 7623617 - DNA, 22 bp, Homo sapiens
ttgagaactctgtatgtccagc

SEQ ID NO: 7623618 - DNA, 22 bp, Homo sapiens
ttgagaatgatgagattcttcc

SEQ ID NO: 7623619 - DNA, 22 bp, Homo sapiens
ttgagaatgatgagattcttcc

SEQ ID NO: 7623620 - DNA, 22 bp, Homo sapiens
ttgagaactagcatggtctatc

SEQ ID NO: 7623621 - DNA, 22 bp, Homo sapiens
ttgagaactactttattattct

SEQ ID NO: 7623622 - DNA, 22 bp, Homo sapiens
ttgagaaccactgagttagata

SEQ ID NO: 7623623 - DNA, 22 bp, Homo sapiens
ttgagaactactttattattct

SEQ ID NO: 7623624 - DNA, 22 bp, Homo sapiens
ttgagaaccactgagttagata

SEQ ID NO: 7623625 - DNA, 23 bp, Homo sapiens
ttgagaacaggtgtgagaatggc

SEQ ID NO: 7623626 - DNA, 22 bp, Homo sapiens
ttgagaacaggagtgttctttt

SEQ ID NO: 7623627 - DNA, 22 bp, Homo sapiens
ttgagaacaggagtgttctttt

SEQ ID NO: 7623628 - DNA, 22 bp, Homo sapiens
ttgagaacaggagtgttctttt

SEQ ID NO: 7623629 - DNA, 22 bp, Homo sapiens
attcttcaccatggataatttg

SEQ ID NO: 7623630 - DNA, 22 bp, Homo sapiens
attcttcaccatggataatttg

SEQ ID NO: 7623631 - DNA, 22 bp, Homo sapiens
attcttcaccatggataatttg

SEQ ID NO: 7623632 - DNA, 22 bp, Homo sapiens
attcttcacataagtgctgtac

SEQ ID NO: 7623633 - DNA, 22 bp, Homo sapiens
attcttcacactaaccctgtga

SEQ ID NO: 7623634 - DNA, 22 bp, Homo sapiens
attcttcacataagtgctgtac

SEQ ID NO: 7623635 - DNA, 22 bp, Homo sapiens
attcttcacatggataggatct

SEQ ID NO: 7623636 - DNA, 22 bp, Homo sapiens
attcttcacatggataggatct

SEQ ID NO: 7623637 - DNA, 22 bp, Homo sapiens
attcttcactgtttcagaatga

SEQ ID NO: 7623638 - DNA, 22 bp, Homo sapiens
attcttcactgtttcagaatga

SEQ ID NO: 7623639 - DNA, 22 bp, Homo sapiens
attcttcacctgagtcagtcta

SEQ ID NO: 7623640 - DNA, 22 bp, Homo sapiens
attcttcacctgagtcagtcta

SEQ ID NO: 7623641 - DNA, 22 bp, Homo sapiens
attcttcactgtttcagaatga

SEQ ID NO: 7623642 - DNA, 22 bp, Homo sapiens
attcttcactgtttcagaatga

SEQ ID NO: 7623643 - DNA, 22 bp, Homo sapiens
attcttcacaaatatatagaag

SEQ ID NO: 7623644 - DNA, 22 bp, Homo sapiens
attcttcacaaatatatagaag

SEQ ID NO: 7623645 - DNA, 22 bp, Homo sapiens
attcttcaaagagtgtcaaagt

SEQ ID NO: 7623646 - DNA, 22 bp, Homo sapiens
attcttcaaagagtgtcaaagt

SEQ ID NO: 7623647 - DNA, 22 bp, Homo sapiens
attcttcaaagagtgtcaaagt

SEQ ID NO: 7623648 - DNA, 22 bp, Homo sapiens
attcttcaaagagtgtcaaagt

SEQ ID NO: 7623649 - DNA, 22 bp, Homo sapiens
attcttatttaaatagagtctg

SEQ ID NO: 7623650 - DNA, 22 bp, Homo sapiens
attcttcacacctgttcctgtt

SEQ ID NO: 7623651 - DNA, 22 bp, Homo sapiens
attcttcacacctgttcctgtt

SEQ ID NO: 7623652 - DNA, 22 bp, Homo sapiens
attcttcacacctgttcctgtt

SEQ ID NO: 7623653 - DNA, 22 bp, Homo sapiens
attcttcacactaaccctgtga

SEQ ID NO: 7623654 - DNA, 22 bp, Homo sapiens
attcttacaaagcagagtctgt

SEQ ID NO: 7623655 - DNA, 22 bp, Homo sapiens
attcttaattgccatgctgtat

SEQ ID NO: 7623656 - DNA, 22 bp, Homo sapiens
attcttaattgccatgctgtat

SEQ ID NO: 7623657 - DNA, 22 bp, Homo sapiens
attcttaattgccatgctgtat

SEQ ID NO: 7623658 - DNA, 22 bp, Homo sapiens
attcttacaaagcagagtctgt

SEQ ID NO: 7623659 - DNA, 22 bp, Homo sapiens
attcttattatagtaaaacagt

SEQ ID NO: 7623660 - DNA, 22 bp, Homo sapiens
attcttattatagtaaaacagt

SEQ ID NO: 7623661 - DNA, 22 bp, Homo sapiens
attcttattatagtaaaacagt

SEQ ID NO: 7623662 - DNA, 22 bp, Homo sapiens
attcttattatagtaaaacagt

SEQ ID NO: 7623663 - DNA, 22 bp, Homo sapiens
attcttattatagtaaaacagt

SEQ ID NO: 7623664 - DNA, 22 bp, Homo sapiens
attcttattatagtaaaacagt

SEQ ID NO: 7623665 - DNA, 22 bp, Homo sapiens
attcttaattccaaagactgag

SEQ ID NO: 7623666 - DNA, 22 bp, Homo sapiens
attcttaattccaaagactgag

SEQ ID NO: 7623667 - DNA, 22 bp, Homo sapiens
attcttaattccaaagactgag

SEQ ID NO: 7623668 - DNA, 22 bp, Homo sapiens
attcttaattccaaagactgag

SEQ ID NO: 7623669 - DNA, 22 bp, Homo sapiens
attcttaattccaaagactgag

SEQ ID NO: 7623670 - DNA, 22 bp, Homo sapiens
attcttaattccaaagactgag

SEQ ID NO: 7623671 - DNA, 22 bp, Homo sapiens
attcttaattccaaagactgag

SEQ ID NO: 7623672 - DNA, 22 bp, Homo sapiens
attcttaattccaaagactgag

SEQ ID NO: 7623673 - DNA, 22 bp, Homo sapiens
attctgtgttaggatagatggt

SEQ ID NO: 7623674 - DNA, 22 bp, Homo sapiens
attcttaattgccatgctgtat

SEQ ID NO: 7623675 - DNA, 22 bp, Homo sapiens
attcttaattgccatgctgtat

SEQ ID NO: 7623676 - DNA, 22 bp, Homo sapiens
attcttaattgccatgctgtat

SEQ ID NO: 7623677 - DNA, 22 bp, Homo sapiens
attcttaattgccatgctgtat

SEQ ID NO: 7623678 - DNA, 22 bp, Homo sapiens
attcttaattgccatgctgtat

SEQ ID NO: 7623679 - DNA, 22 bp, Homo sapiens
attcttaattccaaagactgag

SEQ ID NO: 7623680 - DNA, 22 bp, Homo sapiens
attcttaattccaaagactgag

SEQ ID NO: 7623681 - DNA, 22 bp, Homo sapiens
attcttaattccaaagactgag

SEQ ID NO: 7623682 - DNA, 22 bp, Homo sapiens
attcttaattccaaagactgag

SEQ ID NO: 7623683 - DNA, 20 bp, Homo sapiens
attctcacatggctccgggc

SEQ ID NO: 7623684 - DNA, 22 bp, Homo sapiens
attctcaattttgccaaagggt

SEQ ID NO: 7623685 - DNA, 22 bp, Homo sapiens
attctcagatcttagaggaata

SEQ ID NO: 7623686 - DNA, 22 bp, Homo sapiens
attctcagatcttagaggaata

SEQ ID NO: 7623687 - DNA, 22 bp, Homo sapiens
attctcagatcttagaggaata

SEQ ID NO: 7623688 - DNA, 22 bp, Homo sapiens
attctcagctttcaaatagaca

SEQ ID NO: 7623689 - DNA, 22 bp, Homo sapiens
attctcagctttcaaatagaca

SEQ ID NO: 7623690 - DNA, 22 bp, Homo sapiens
attctcagctttcaaatagaca

SEQ ID NO: 7623691 - DNA, 21 bp, Homo sapiens
attctcaggcccatcctcagg

SEQ ID NO: 7623692 - DNA, 22 bp, Homo sapiens
attctcagctttcaaatagaca

SEQ ID NO: 7623693 - DNA, 22 bp, Homo sapiens
attctcaaagccagagtcaacg

SEQ ID NO: 7623694 - DNA, 22 bp, Homo sapiens
attctcaaacaagtggtttgat

SEQ ID NO: 7623695 - DNA, 22 bp, Homo sapiens
attctcaaacaagtggtttgat

SEQ ID NO: 7623696 - DNA, 22 bp, Homo sapiens
attctcaatggctactttcata

SEQ ID NO: 7623697 - DNA, 22 bp, Homo sapiens
attctcaactactgcgagagct

SEQ ID NO: 7623698 - DNA, 22 bp, Homo sapiens
attctcaactactgcgagagct

SEQ ID NO: 7623699 - DNA, 22 bp, Homo sapiens
attctcaagctggctgggagca

SEQ ID NO: 7623700 - DNA, 22 bp, Homo sapiens
attctcaagctggctgggagca

SEQ ID NO: 7623701 - DNA, 22 bp, Homo sapiens
attctcaaacaagtggtttgat

SEQ ID NO: 7623702 - DNA, 22 bp, Homo sapiens
attctcaatggctactttcata

SEQ ID NO: 7623703 - DNA, 22 bp, Homo sapiens
attctcaatggctactttcata

SEQ ID NO: 7623704 - DNA, 22 bp, Homo sapiens
attctgtctaagctggctacgt

SEQ ID NO: 7623705 - DNA, 22 bp, Homo sapiens
attctgtgatagttgatcctta

SEQ ID NO: 7623706 - DNA, 22 bp, Homo sapiens
attctgtgactaccgtcccaca

SEQ ID NO: 7623707 - DNA, 22 bp, Homo sapiens
attctgtgactaccgtcccaca

SEQ ID NO: 7623708 - DNA, 22 bp, Homo sapiens
attctgtctttttatacatcta

SEQ ID NO: 7623709 - DNA, 22 bp, Homo sapiens
attctgtctttttatacatcta

SEQ ID NO: 7623710 - DNA, 22 bp, Homo sapiens
attctgtgatagttgatcctta

SEQ ID NO: 7623711 - DNA, 22 bp, Homo sapiens
attctggaattctaagattctg

SEQ ID NO: 7623712 - DNA, 22 bp, Homo sapiens
attctggaattctaagattctg

SEQ ID NO: 7623713 - DNA, 22 bp, Homo sapiens
attctggaattctaagattctg

SEQ ID NO: 7623714 - DNA, 21 bp, Homo sapiens
attctgtcatcccagctactt

SEQ ID NO: 7623715 - DNA, 22 bp, Homo sapiens
attctgtcattacaaaaggcag

SEQ ID NO: 7623716 - DNA, 22 bp, Homo sapiens
attctggaagcaagcttttaaa

SEQ ID NO: 7623717 - DNA, 22 bp, Homo sapiens
attctggaattctaagattctg

SEQ ID NO: 7623718 - DNA, 22 bp, Homo sapiens
attctggaagcaagcttttaaa

SEQ ID NO: 7623719 - DNA, 21 bp, Homo sapiens
attctcaggcccatcctcagg

SEQ ID NO: 7623720 - DNA, 22 bp, Homo sapiens
attctcagggagtattttctat

SEQ ID NO: 7623721 - DNA, 22 bp, Homo sapiens
attctcagggagtattttctat

SEQ ID NO: 7623722 - DNA, 22 bp, Homo sapiens
attctcagggagtattttctat

SEQ ID NO: 7623723 - DNA, 22 bp, Homo sapiens
attctcagggagtattttctat

SEQ ID NO: 7623724 - DNA, 22 bp, Homo sapiens
attctatcaagctgtcttcttt

SEQ ID NO: 7623725 - DNA, 22 bp, Homo sapiens
attctatctctatatttctgca

SEQ ID NO: 7623726 - DNA, 22 bp, Homo sapiens
attctattaatatttctaggaa

SEQ ID NO: 7623727 - DNA, 22 bp, Homo sapiens
attctatcaagctgtcttcttt

SEQ ID NO: 7623728 - DNA, 22 bp, Homo sapiens
attctatagacagaaggtcaat

SEQ ID NO: 7623729 - DNA, 22 bp, Homo sapiens
attctatagacagaaggtcaat

SEQ ID NO: 7623730 - DNA, 22 bp, Homo sapiens
attctatagacagaaggtcaat

SEQ ID NO: 7623731 - DNA, 22 bp, Homo sapiens
attctatagacagaaggtcaat

SEQ ID NO: 7623732 - DNA, 22 bp, Homo sapiens
attctagtgtttccattacaag

SEQ ID NO: 7623733 - DNA, 22 bp, Homo sapiens
attctaggcttgaaacatgaag

SEQ ID NO: 7623734 - DNA, 22 bp, Homo sapiens
attctcaaaacataacttcact

SEQ ID NO: 7623735 - DNA, 22 bp, Homo sapiens
attctcaaaacataacttcact

SEQ ID NO: 7623736 - DNA, 22 bp, Homo sapiens
attctcaaaacataacttcact

SEQ ID NO: 7623737 - DNA, 22 bp, Homo sapiens
attctattttttaagaagtagt

SEQ ID NO: 7623738 - DNA, 22 bp, Homo sapiens
attctattttttaagaagtagt

SEQ ID NO: 7623739 - DNA, 21 bp, Homo sapiens
attctagacaacactgaaatc

SEQ ID NO: 7623740 - DNA, 22 bp, Homo sapiens
attctagacatctgcagttgtt

SEQ ID NO: 7623741 - DNA, 22 bp, Homo sapiens
attctagacatctgcagttgtt

SEQ ID NO: 7623742 - DNA, 22 bp, Homo sapiens
attctagagtttcaatccaagg

SEQ ID NO: 7623743 - DNA, 22 bp, Homo sapiens
attctagagcagtgattctcat

SEQ ID NO: 7623744 - DNA, 17 bp, Homo sapiens
attctagatgaggtgct

SEQ ID NO: 7623745 - DNA, 17 bp, Homo sapiens
attctagatgaggtgct

SEQ ID NO: 7623746 - DNA, 22 bp, Homo sapiens
attctagataagaaaagggctg

SEQ ID NO: 7623747 - DNA, 22 bp, Homo sapiens
attctagatacctaggggattt

SEQ ID NO: 7623748 - DNA, 22 bp, Homo sapiens
attctagataagaaaagggctg

SEQ ID NO: 7623749 - DNA, 22 bp, Homo sapiens
attctagagtttcaatccaagg

SEQ ID NO: 7623750 - DNA, 22 bp, Homo sapiens
attctagataagaaaagggctg

SEQ ID NO: 7623751 - DNA, 22 bp, Homo sapiens
attctagtgtttccattacaag

SEQ ID NO: 7623752 - DNA, 22 bp, Homo sapiens
attctaggcttgaaacatgaag

SEQ ID NO: 7623753 - DNA, 22 bp, Homo sapiens
attctaggacttgagagctaag

SEQ ID NO: 7623754 - DNA, 22 bp, Homo sapiens
attctagctcatctactttcca

SEQ ID NO: 7623755 - DNA, 22 bp, Homo sapiens
attctaggacttgagagctaag

SEQ ID NO: 7623756 - DNA, 22 bp, Homo sapiens
attctagccattgtattcttcc

SEQ ID NO: 7623757 - DNA, 22 bp, Homo sapiens
attctagcagttacaggctgat

SEQ ID NO: 7623758 - DNA, 22 bp, Homo sapiens
attctagccaaccatctgagat

SEQ ID NO: 7623759 - DNA, 22 bp, Homo sapiens
attctagatgctgtaagtagca

SEQ ID NO: 7623760 - DNA, 22 bp, Homo sapiens
attctagatgctgtaagtagca

SEQ ID NO: 7623761 - DNA, 22 bp, Homo sapiens
attctagatgctgtaagtagca

SEQ ID NO: 7623762 - DNA, 22 bp, Homo sapiens
attgaaattgatgaaattcttg

SEQ ID NO: 7623763 - DNA, 22 bp, Homo sapiens
attgaaattgatgaaattcttg

SEQ ID NO: 7623764 - DNA, 22 bp, Homo sapiens
attgaaattgatgaaattcttg

SEQ ID NO: 7623765 - DNA, 22 bp, Homo sapiens
attgaaattgatgaaattcttg

SEQ ID NO: 7623766 - DNA, 22 bp, Homo sapiens
attgaaaaatgactattgctta

SEQ ID NO: 7623767 - DNA, 22 bp, Homo sapiens
attgaaaaatgactattgctta

SEQ ID NO: 7623768 - DNA, 22 bp, Homo sapiens
attgaaaaatgactattgctta

SEQ ID NO: 7623769 - DNA, 22 bp, Homo sapiens
attgaaaaatgactattgctta

SEQ ID NO: 7623770 - DNA, 22 bp, Homo sapiens
attgaaaaatgactattgctta

SEQ ID NO: 7623771 - DNA, 22 bp, Homo sapiens
attgaaaaatgactattgctta

SEQ ID NO: 7623772 - DNA, 22 bp, Homo sapiens
attcttcagcaggggacactat

SEQ ID NO: 7623773 - DNA, 22 bp, Homo sapiens
attcttcagcaggggacactat

SEQ ID NO: 7623774 - DNA, 22 bp, Homo sapiens
attcttcagcaggggacactat

SEQ ID NO: 7623775 - DNA, 22 bp, Homo sapiens
attcttcagcaggggacactat

SEQ ID NO: 7623776 - DNA, 22 bp, Homo sapiens
attcttcagaatatctggcact

SEQ ID NO: 7623777 - DNA, 22 bp, Homo sapiens
attcttcagaatatctggcact

SEQ ID NO: 7623778 - DNA, 22 bp, Homo sapiens
attcttcagaatatctggcact

SEQ ID NO: 7623779 - DNA, 22 bp, Homo sapiens
attcttcagatcagcagggcct

SEQ ID NO: 7623780 - DNA, 22 bp, Homo sapiens
attcttcagaatatctggcact

SEQ ID NO: 7623781 - DNA, 22 bp, Homo sapiens
attgaacagaaaccatcagagt

SEQ ID NO: 7623782 - DNA, 23 bp, Homo sapiens
attgaacagagagaaaaacatcc

SEQ ID NO: 7623783 - DNA, 23 bp, Homo sapiens
attgaacagagagaaaaacatcc

SEQ ID NO: 7623784 - DNA, 23 bp, Homo sapiens
attgaacagagagaaaaacatcc

SEQ ID NO: 7623785 - DNA, 22 bp, Homo sapiens
attgaacagaaaaactcagaga

SEQ ID NO: 7623786 - DNA, 20 bp, Homo sapiens
attgaaatttttctgagatt

SEQ ID NO: 7623787 - DNA, 20 bp, Homo sapiens
attgaaatttttctgagatt

SEQ ID NO: 7623788 - DNA, 22 bp, Homo sapiens
attgaacatacatatccacacc

SEQ ID NO: 7623789 - DNA, 22 bp, Homo sapiens
attgaacatacatatccacacc

SEQ ID NO: 7623790 - DNA, 23 bp, Homo sapiens
attgaacagagagaaaaacatcc

SEQ ID NO: 7623791 - DNA, 22 bp, Homo sapiens
attgacaaatctgaacatacgg

SEQ ID NO: 7623792 - DNA, 22 bp, Homo sapiens
attgacaaatctgaacatacgg

SEQ ID NO: 7623793 - DNA, 22 bp, Homo sapiens
attgacaaatctgaacatacgg

SEQ ID NO: 7623794 - DNA, 22 bp, Homo sapiens
attgacaaatctgaacatacgg

SEQ ID NO: 7623795 - DNA, 22 bp, Homo sapiens
attgacaaatctgaacatacgg

SEQ ID NO: 7623796 - DNA, 22 bp, Homo sapiens
attgacaaaaacaggtggttga

SEQ ID NO: 7623797 - DNA, 23 bp, Homo sapiens
attgaatgtgcttttctacttag

SEQ ID NO: 7623798 - DNA, 23 bp, Homo sapiens
attgaatgtgcttttctacttag

SEQ ID NO: 7623799 - DNA, 22 bp, Homo sapiens
attgaatgcttgctaacacttt

SEQ ID NO: 7623800 - DNA, 22 bp, Homo sapiens
attgaatgtctactatgtgcaa

SEQ ID NO: 7623801 - DNA, 22 bp, Homo sapiens
attgaatgtcctttagtaaaaa

SEQ ID NO: 7623802 - DNA, 22 bp, Homo sapiens
attgaagggcattagtcatcag

SEQ ID NO: 7623803 - DNA, 22 bp, Homo sapiens
attgaagcatacacaatgagga

SEQ ID NO: 7623804 - DNA, 22 bp, Homo sapiens
attgaagggtgaccagccatcc

SEQ ID NO: 7623805 - DNA, 22 bp, Homo sapiens
attgaagggtgaccagccatcc

SEQ ID NO: 7623806 - DNA, 22 bp, Homo sapiens
attgaatagatgcattatacta

SEQ ID NO: 7623807 - DNA, 22 bp, Homo sapiens
attgaatagatgcattatacta

SEQ ID NO: 7623808 - DNA, 22 bp, Homo sapiens
attgaatagctgcttgttgtat

SEQ ID NO: 7623809 - DNA, 22 bp, Homo sapiens
attgaatagatgcattatacta

SEQ ID NO: 7623810 - DNA, 22 bp, Homo sapiens
attgaatagatgcattatacta

SEQ ID NO: 7623811 - DNA, 22 bp, Homo sapiens
attgaatagatgcattatacta

SEQ ID NO: 7623812 - DNA, 22 bp, Homo sapiens
attgaagattctgacatcagaa

SEQ ID NO: 7623813 - DNA, 22 bp, Homo sapiens
attgaagattaaatgcttcctt

SEQ ID NO: 7623814 - DNA, 22 bp, Homo sapiens
attgaagattctgacatcagaa

SEQ ID NO: 7623815 - DNA, 22 bp, Homo sapiens
attgaagagaagctaaatagag

SEQ ID NO: 7623816 - DNA, 22 bp, Homo sapiens
attgaagagttgattattatct

SEQ ID NO: 7623817 - DNA, 22 bp, Homo sapiens
attgaagagttgattattatct

SEQ ID NO: 7623818 - DNA, 22 bp, Homo sapiens
attgaagatcagggaaagattc

SEQ ID NO: 7623819 - DNA, 22 bp, Homo sapiens
attgaagatcagggaaagattc

SEQ ID NO: 7623820 - DNA, 22 bp, Homo sapiens
attgaagaaacccaaataatgg

SEQ ID NO: 7623821 - DNA, 22 bp, Homo sapiens
attgaactgtctttgaagaaat

SEQ ID NO: 7623822 - DNA, 22 bp, Homo sapiens
attgaagagaagctaaatagag

SEQ ID NO: 7623823 - DNA, 22 bp, Homo sapiens
attgaagagaagctaaatagag

SEQ ID NO: 7623824 - DNA, 22 bp, Homo sapiens
attgaagaaacccaaataatgg

SEQ ID NO: 7623825 - DNA, 22 bp, Homo sapiens
attgaagaaacccaaataatgg

SEQ ID NO: 7623826 - DNA, 22 bp, Homo sapiens
attgaagaaacccaaataatgg

SEQ ID NO: 7623827 - DNA, 22 bp, Homo sapiens
attgctgttgttatggcactgt

SEQ ID NO: 7623828 - DNA, 22 bp, Homo sapiens
attgcttactaatcatcttcag

SEQ ID NO: 7623829 - DNA, 22 bp, Homo sapiens
attgctgtgtctggggcagatg

SEQ ID NO: 7623830 - DNA, 22 bp, Homo sapiens
attgctggtagtcagtgtccct

SEQ ID NO: 7623831 - DNA, 22 bp, Homo sapiens
attgctggtagtcagtgtccct

SEQ ID NO: 7623832 - DNA, 22 bp, Homo sapiens
attgctggatgagctcttggat

SEQ ID NO: 7623833 - DNA, 22 bp, Homo sapiens
attgctggatgagctcttggat

SEQ ID NO: 7623834 - DNA, 22 bp, Homo sapiens
attgctggcagctggatctgca

SEQ ID NO: 7623835 - DNA, 22 bp, Homo sapiens
attgctggcatcagtgacaata

SEQ ID NO: 7623836 - DNA, 22 bp, Homo sapiens
attgctggcatcagtgacaata

SEQ ID NO: 7623837 - DNA, 22 bp, Homo sapiens
attgctggcagctggatctgca

SEQ ID NO: 7623838 - DNA, 22 bp, Homo sapiens
attgctggctgccatcttgccc

SEQ ID NO: 7623839 - DNA, 22 bp, Homo sapiens
attgctgggaatatttagccca

SEQ ID NO: 7623840 - DNA, 22 bp, Homo sapiens
attgctgggaggatgtgtgttc

SEQ ID NO: 7623841 - DNA, 22 bp, Homo sapiens
attgctgggaggatgtgtgttc

SEQ ID NO: 7623842 - DNA, 22 bp, Homo sapiens
attgctggcccagatgctttag

SEQ ID NO: 7623843 - DNA, 22 bp, Homo sapiens
attgctggcccagatgctttag

SEQ ID NO: 7623844 - DNA, 22 bp, Homo sapiens
attgctggctgccatcttgccc

SEQ ID NO: 7623845 - DNA, 22 bp, Homo sapiens
attgctggcatcagtgacaata

SEQ ID NO: 7623846 - DNA, 22 bp, Homo sapiens
attgctggcccagatgctttag

SEQ ID NO: 7623847 - DNA, 22 bp, Homo sapiens
attgacaggtctttgggagtat

SEQ ID NO: 7623848 - DNA, 22 bp, Homo sapiens
attgacagtgttaaagttgcct

SEQ ID NO: 7623849 - DNA, 22 bp, Homo sapiens
attgacatgtaggctacaagga

SEQ ID NO: 7623850 - DNA, 22 bp, Homo sapiens
attgacatgtaggctacaagga

SEQ ID NO: 7623851 - DNA, 23 bp, Homo sapiens
attgaccagctgtctcattttca

SEQ ID NO: 7623852 - DNA, 23 bp, Homo sapiens
attgaccagctgtctcattttca

SEQ ID NO: 7623853 - DNA, 22 bp, Homo sapiens
attgacattaactatattagcc

SEQ ID NO: 7623854 - DNA, 22 bp, Homo sapiens
attgctgcttcttgcatgaagt

SEQ ID NO: 7623855 - DNA, 22 bp, Homo sapiens
attgctggatgagctcttggat

SEQ ID NO: 7623856 - DNA, 22 bp, Homo sapiens
attgcagaacatgaggtcttct

SEQ ID NO: 7623857 - DNA, 22 bp, Homo sapiens
attgcagaacatgaggtcttct

SEQ ID NO: 7623858 - DNA, 22 bp, Homo sapiens
attgcacttcagcctgggtgac

SEQ ID NO: 7623859 - DNA, 22 bp, Homo sapiens
attgcacttcagcctgggtgac

SEQ ID NO: 7623860 - DNA, 22 bp, Homo sapiens
attgcactccggcctgggtgac

SEQ ID NO: 7623861 - DNA, 22 bp, Homo sapiens
attgcacttcagcctgggtgac

SEQ ID NO: 7623862 - DNA, 22 bp, Homo sapiens
attgcacttcagcctgggtgac

SEQ ID NO: 7623863 - DNA, 22 bp, Homo sapiens
attgcacttcagcctgggtgac

SEQ ID NO: 7623864 - DNA, 22 bp, Homo sapiens
attgcacttcagcctgggtgac

SEQ ID NO: 7623865 - DNA, 22 bp, Homo sapiens
attgacaaatggatgttgacat

SEQ ID NO: 7623866 - DNA, 22 bp, Homo sapiens
attgacaaatggatgttgacat

SEQ ID NO: 7623867 - DNA, 22 bp, Homo sapiens
attgacaaccctggtatgagca

SEQ ID NO: 7623868 - DNA, 22 bp, Homo sapiens
attgacaaccctggtatgagca

SEQ ID NO: 7623869 - DNA, 22 bp, Homo sapiens
attgacaagaaagatattttta

SEQ ID NO: 7623870 - DNA, 22 bp, Homo sapiens
attgacaagaaagatattttta

SEQ ID NO: 7623871 - DNA, 22 bp, Homo sapiens
attgacaagaaagatattttta

SEQ ID NO: 7623872 - DNA, 22 bp, Homo sapiens
attgacaagacaatggctctta

SEQ ID NO: 7623873 - DNA, 22 bp, Homo sapiens
attgacaagaaagatattttta

SEQ ID NO: 7623874 - DNA, 22 bp, Homo sapiens
attgacaagcagtatgtcttag

SEQ ID NO: 7623875 - DNA, 22 bp, Homo sapiens
attgacaaggaaactataccag

SEQ ID NO: 7623876 - DNA, 22 bp, Homo sapiens
attgacaagcagtatgtcttag

SEQ ID NO: 7623877 - DNA, 22 bp, Homo sapiens
attgacaagcagtatgtcttag

SEQ ID NO: 7623878 - DNA, 22 bp, Homo sapiens
attgacaatctactatgttctg

SEQ ID NO: 7623879 - DNA, 22 bp, Homo sapiens
attgacaatctactatgttctg

SEQ ID NO: 7623880 - DNA, 22 bp, Homo sapiens
attgacaatctactatgttctg

SEQ ID NO: 7623881 - DNA, 22 bp, Homo sapiens
attgacaagtgagctgggctgc

SEQ ID NO: 7623882 - DNA, 22 bp, Homo sapiens
attgacagaaaattggatggca

SEQ ID NO: 7623883 - DNA, 20 bp, Homo sapiens
attgacagaaagtgttcacc

SEQ ID NO: 7623884 - DNA, 22 bp, Homo sapiens
attgacagagctttcaccatga

SEQ ID NO: 7623885 - DNA, 22 bp, Homo sapiens
attgacagcaggggctgtcact

SEQ ID NO: 7623886 - DNA, 22 bp, Homo sapiens
attgacacaatgggatgtaagg

SEQ ID NO: 7623887 - DNA, 22 bp, Homo sapiens
attgacagaaaagatgttggat

SEQ ID NO: 7623888 - DNA, 22 bp, Homo sapiens
attgacagaaaagatgttggat

SEQ ID NO: 7623889 - DNA, 22 bp, Homo sapiens
attgacaattctatgcagagca

SEQ ID NO: 7623890 - DNA, 22 bp, Homo sapiens
attgacaattctatgcagagca

SEQ ID NO: 7623891 - DNA, 22 bp, Homo sapiens
attgacaattctatgcagagca

SEQ ID NO: 7623892 - DNA, 22 bp, Homo sapiens
attgacaattctatgcagagca

SEQ ID NO: 7623893 - DNA, 22 bp, Homo sapiens
attgacaatgtatttgtatctg

SEQ ID NO: 7623894 - DNA, 22 bp, Homo sapiens
attgacaatgtatttgtatctg

SEQ ID NO: 7623895 - DNA, 16 bp, Homo sapiens
gcagaggaaaggggag

SEQ ID NO: 7623896 - DNA, 16 bp, Homo sapiens
gcagaggaaaggggag

SEQ ID NO: 7623897 - DNA, 22 bp, Homo sapiens
attccactttatgtctgtatga

SEQ ID NO: 7623898 - DNA, 22 bp, Homo sapiens
attccactttatgtctgtatga

SEQ ID NO: 7623899 - DNA, 20 bp, Homo sapiens
attccacttgtttgaggtac

SEQ ID NO: 7623900 - DNA, 22 bp, Homo sapiens
gcagagcttctgtccttcagga

SEQ ID NO: 7623901 - DNA, 22 bp, Homo sapiens
gcagagcttctgtccttcagga

SEQ ID NO: 7623902 - DNA, 22 bp, Homo sapiens
gcagagcttctgtccttcagga

SEQ ID NO: 7623903 - DNA, 20 bp, Homo sapiens
attcccttctccctgtttga

SEQ ID NO: 7623904 - DNA, 20 bp, Homo sapiens
attcccttctccctgtttga

SEQ ID NO: 7623905 - DNA, 20 bp, Homo sapiens
attcccttctccctgtttga

SEQ ID NO: 7623906 - DNA, 22 bp, Homo sapiens
attcctaaagtaatacactaga

SEQ ID NO: 7623907 - DNA, 21 bp, Homo sapiens
attccacttttccttcaggga

SEQ ID NO: 7623908 - DNA, 22 bp, Homo sapiens
attccactttgctaatcttctg

SEQ ID NO: 7623909 - DNA, 22 bp, Homo sapiens
attcctcaaaggtagcccatta

SEQ ID NO: 7623910 - DNA, 22 bp, Homo sapiens
attcctcaaaggtagcccatta

SEQ ID NO: 7623911 - DNA, 22 bp, Homo sapiens
attcctcaaaggtagcccatta

SEQ ID NO: 7623912 - DNA, 22 bp, Homo sapiens
attcctcaaaggtagcccatta

SEQ ID NO: 7623913 - DNA, 22 bp, Homo sapiens
attcctattgccagcatagtat

SEQ ID NO: 7623914 - DNA, 19 bp, Homo sapiens
attcctcaaggacagaaat

SEQ ID NO: 7623915 - DNA, 19 bp, Homo sapiens
attcctcaaggacagaaat

SEQ ID NO: 7623916 - DNA, 22 bp, Homo sapiens
attcctaaagtaatacactaga

SEQ ID NO: 7623917 - DNA, 21 bp, Homo sapiens
attccacttttccttcaggga

SEQ ID NO: 7623918 - DNA, 22 bp, Homo sapiens
attcctaaggaaggctggcaag

SEQ ID NO: 7623919 - DNA, 22 bp, Homo sapiens
attcctagatgaattacattgc

SEQ ID NO: 7623920 - DNA, 22 bp, Homo sapiens
attcctagatgaattacattgc

SEQ ID NO: 7623921 - DNA, 22 bp, Homo sapiens
attcctatgttacagcgatcca

SEQ ID NO: 7623922 - DNA, 22 bp, Homo sapiens
attcctcagcaggccttttgtt

SEQ ID NO: 7623923 - DNA, 22 bp, Homo sapiens
attcctcagcaggccttttgtt

SEQ ID NO: 7623924 - DNA, 19 bp, Homo sapiens
attcctcaaggacagaaat

SEQ ID NO: 7623925 - DNA, 22 bp, Homo sapiens
attcctcagcaggccttttgtt

SEQ ID NO: 7623926 - DNA, 20 bp, Homo sapiens
attcctcagccccagcctca

SEQ ID NO: 7623927 - DNA, 20 bp, Homo sapiens
attcctcagccccagcctca

SEQ ID NO: 7623928 - DNA, 20 bp, Homo sapiens
attcctcagccccagcctca

SEQ ID NO: 7623929 - DNA, 20 bp, Homo sapiens
attcctcagccccagcctca

SEQ ID NO: 7623930 - DNA, 22 bp, Homo sapiens
attcctcattatttactgagga

SEQ ID NO: 7623931 - DNA, 22 bp, Homo sapiens
attcctcattatttactgagga

SEQ ID NO: 7623932 - DNA, 22 bp, Homo sapiens
attcctcattatttactgagga

SEQ ID NO: 7623933 - DNA, 22 bp, Homo sapiens
attcctcatttgttgagaacca

SEQ ID NO: 7623934 - DNA, 22 bp, Homo sapiens
attcctcatttgttgagaacca

SEQ ID NO: 7623935 - DNA, 22 bp, Homo sapiens
gcagcaggcatggccgccctgg

SEQ ID NO: 7623936 - DNA, 22 bp, Homo sapiens
gcagcaggcatggccgccctgg

SEQ ID NO: 7623937 - DNA, 22 bp, Homo sapiens
gcagcaggcatggccgccctgg

SEQ ID NO: 7623938 - DNA, 22 bp, Homo sapiens
gcagcaggcttttcataccttg

SEQ ID NO: 7623939 - DNA, 22 bp, Homo sapiens
gcagcaggcatggccgccctgg

SEQ ID NO: 7623940 - DNA, 22 bp, Homo sapiens
gcagcaggcttttcataccttg

SEQ ID NO: 7623941 - DNA, 22 bp, Homo sapiens
gcagcaggcttttcataccttg

SEQ ID NO: 7623942 - DNA, 22 bp, Homo sapiens
attccttctattctctgtgggt

SEQ ID NO: 7623943 - DNA, 22 bp, Homo sapiens
attccttctattctctgtgggt

SEQ ID NO: 7623944 - DNA, 22 bp, Homo sapiens
attccttctaaaacgctgccct

SEQ ID NO: 7623945 - DNA, 22 bp, Homo sapiens
attccttctaaaacgctgccct

SEQ ID NO: 7623946 - DNA, 22 bp, Homo sapiens
attcctgtcccttcattgttga

SEQ ID NO: 7623947 - DNA, 22 bp, Homo sapiens
attccttctaaaacgctgccct

SEQ ID NO: 7623948 - DNA, 22 bp, Homo sapiens
gcagcaggcatggccgccctgg

SEQ ID NO: 7623949 - DNA, 22 bp, Homo sapiens
gcagcaggcacttaccgttgct

SEQ ID NO: 7623950 - DNA, 23 bp, Homo sapiens
attcctgaggctccttatgcacc

SEQ ID NO: 7623951 - DNA, 23 bp, Homo sapiens
attcctgaggctccttatgcacc

SEQ ID NO: 7623952 - DNA, 22 bp, Homo sapiens
attcctgcattggtcaacccat

SEQ ID NO: 7623953 - DNA, 22 bp, Homo sapiens
attcctggtggcagaaacatga

SEQ ID NO: 7623954 - DNA, 22 bp, Homo sapiens
attcctgattaacgacctttca

SEQ ID NO: 7623955 - DNA, 22 bp, Homo sapiens
attcctggtggcagaaacatga

SEQ ID NO: 7623956 - DNA, 22 bp, Homo sapiens
attcctgagacttatctgtttc

SEQ ID NO: 7623957 - DNA, 23 bp, Homo sapiens
attcctgaggctccttatgcacc

SEQ ID NO: 7623958 - DNA, 23 bp, Homo sapiens
attcctgaggctccttatgcacc

SEQ ID NO: 7623959 - DNA, 22 bp, Homo sapiens
attcctgagacttatctgtttc

SEQ ID NO: 7623960 - DNA, 22 bp, Homo sapiens
attcctgactgttagagtttgc

SEQ ID NO: 7623961 - DNA, 22 bp, Homo sapiens
attcctcatttgttgagaacca

SEQ ID NO: 7623962 - DNA, 22 bp, Homo sapiens
attcctcatttgttgagaacca

SEQ ID NO: 7623963 - DNA, 22 bp, Homo sapiens
attcctgactgctagtcattca

SEQ ID NO: 7623964 - DNA, 22 bp, Homo sapiens
attcctgaagaaggtatgttgc

SEQ ID NO: 7623965 - DNA, 22 bp, Homo sapiens
attcctttggactcctccttgc

SEQ ID NO: 7623966 - DNA, 22 bp, Homo sapiens
attccttgtttcactgaaaagg

SEQ ID NO: 7623967 - DNA, 22 bp, Homo sapiens
attccttgtttcactgaaaagg

SEQ ID NO: 7623968 - DNA, 22 bp, Homo sapiens
attcctttggactcctccttgc

SEQ ID NO: 7623969 - DNA, 22 bp, Homo sapiens
attccttgtttcactgaaaagg

SEQ ID NO: 7623970 - DNA, 22 bp, Homo sapiens
attcctttggactcctccttgc

SEQ ID NO: 7623971 - DNA, 22 bp, Homo sapiens
attctacacaaagcaagaagac

SEQ ID NO: 7623972 - DNA, 22 bp, Homo sapiens
gcagcaggtccgcatcatcatc

SEQ ID NO: 7623973 - DNA, 22 bp, Homo sapiens
attctacacaaagcaagaagac

SEQ ID NO: 7623974 - DNA, 22 bp, Homo sapiens
attctacacaaagcaagaagac

SEQ ID NO: 7623975 - DNA, 22 bp, Homo sapiens
gcagcagggtgccagctttgca

SEQ ID NO: 7623976 - DNA, 22 bp, Homo sapiens
gcagcaggtccgcatcatcatc

SEQ ID NO: 7623977 - DNA, 22 bp, Homo sapiens
gcagcagggtgccagctttgca

SEQ ID NO: 7623978 - DNA, 22 bp, Homo sapiens
gcagcaggtccgcatcatcatc

SEQ ID NO: 7623979 - DNA, 22 bp, Homo sapiens
gcagcaggcttttcataccttg

SEQ ID NO: 7623980 - DNA, 22 bp, Homo sapiens
gcagcaggcttttcataccttg

SEQ ID NO: 7623981 - DNA, 22 bp, Homo sapiens
gcagcaggcttttcataccttg

SEQ ID NO: 7623982 - DNA, 22 bp, Homo sapiens
gcagcaggcttttcataccttg

SEQ ID NO: 7623983 - DNA, 22 bp, Homo sapiens
gcagcaggcttttcataccttg

SEQ ID NO: 7623984 - DNA, 22 bp, Homo sapiens
gcagcaggcttttcataccttg

SEQ ID NO: 7623985 - DNA, 22 bp, Homo sapiens
gcagcagggagcaggggtgtca

SEQ ID NO: 7623986 - DNA, 22 bp, Homo sapiens
gcagcagggagcaggggtgtca

SEQ ID NO: 7623987 - DNA, 22 bp, Homo sapiens
gcagcagggagcaggggtgtca

SEQ ID NO: 7623988 - DNA, 22 bp, Homo sapiens
gcagcagggagcaggggtgtca

SEQ ID NO: 7623989 - DNA, 22 bp, Homo sapiens
gcagcagggtgccagctttgca

SEQ ID NO: 7623990 - DNA, 22 bp, Homo sapiens
gcagcagggtgccagctttgca

SEQ ID NO: 7623991 - DNA, 22 bp, Homo sapiens
gcagcagggtgccagctttgca

SEQ ID NO: 7623992 - DNA, 22 bp, Homo sapiens
gcagcagggagcaggggtgtca

SEQ ID NO: 7623993 - DNA, 22 bp, Homo sapiens
gcagcagggagcaggggtgtca

SEQ ID NO: 7623994 - DNA, 22 bp, Homo sapiens
gcagcagggtgccagctttgca

SEQ ID NO: 7623995 - DNA, 22 bp, Homo sapiens
gcagcagggagcaggggtgtca

SEQ ID NO: 7623996 - DNA, 22 bp, Homo sapiens
gcagcagggagcaggggtgtca

SEQ ID NO: 7623997 - DNA, 22 bp, Homo sapiens
gcagcagggagcaggggtgtca

SEQ ID NO: 7623998 - DNA, 22 bp, Homo sapiens
gcagcagggagcaggggtgtca

SEQ ID NO: 7623999 - DNA, 22 bp, Homo sapiens
attctacacaacatgatgatgg

SEQ ID NO: 7624000 - DNA, 22 bp, Homo sapiens
attctacacaacatgatgatgg

SEQ ID NO: 7624001 - DNA, 22 bp, Homo sapiens
attctacacaacatgatgatgg

SEQ ID NO: 7624002 - DNA, 22 bp, Homo sapiens
attctacacaacatgatgatgg

SEQ ID NO: 7624003 - DNA, 22 bp, Homo sapiens
attctacacctctctcatttag

SEQ ID NO: 7624004 - DNA, 22 bp, Homo sapiens
attctacacaacatgatgatgg

SEQ ID NO: 7624005 - DNA, 22 bp, Homo sapiens
attctacacctctctcatttag

SEQ ID NO: 7624006 - DNA, 22 bp, Homo sapiens
attctacacctctctcatttag

SEQ ID NO: 7624007 - DNA, 22 bp, Homo sapiens
attctacagggtacgttgggga

SEQ ID NO: 7624008 - DNA, 22 bp, Homo sapiens
attctacatgatagaagggaga

SEQ ID NO: 7624009 - DNA, 22 bp, Homo sapiens
attctacatgatagaagggaga

SEQ ID NO: 7624010 - DNA, 22 bp, Homo sapiens
attctacaggactggcaatccc

SEQ ID NO: 7624011 - DNA, 22 bp, Homo sapiens
attctacaggactggcaatccc

SEQ ID NO: 7624012 - DNA, 22 bp, Homo sapiens
attctacagatgaaagcggctg

SEQ ID NO: 7624013 - DNA, 22 bp, Homo sapiens
attctacacctctctcatttag

SEQ ID NO: 7624014 - DNA, 22 bp, Homo sapiens
attctactcattgatctatata

SEQ ID NO: 7624015 - DNA, 22 bp, Homo sapiens
attctactcattgatctatata

SEQ ID NO: 7624016 - DNA, 22 bp, Homo sapiens
attctacatttggagtgatgtc

SEQ ID NO: 7624017 - DNA, 22 bp, Homo sapiens
attctactttgtgtaattatct

SEQ ID NO: 7624018 - DNA, 22 bp, Homo sapiens
attctactgcttggaatatctt

SEQ ID NO: 7624019 - DNA, 22 bp, Homo sapiens
attctactgcttggaatatctt

SEQ ID NO: 7624020 - DNA, 22 bp, Homo sapiens
attctactgcttggaatatctt

SEQ ID NO: 7624021 - DNA, 22 bp, Homo sapiens
attctagaaaccagggaggcat

SEQ ID NO: 7624022 - DNA, 22 bp, Homo sapiens
attctagaacagaggtttctaa

SEQ ID NO: 7624023 - DNA, 22 bp, Homo sapiens
attctagaaaccagggaggcat

SEQ ID NO: 7624024 - DNA, 18 bp, Homo sapiens
attctagaagatgccttg

SEQ ID NO: 7624025 - DNA, 22 bp, Homo sapiens
attctagaacagaggtttctaa

SEQ ID NO: 7624026 - DNA, 18 bp, Homo sapiens
attctagaagatgccttg

SEQ ID NO: 7624027 - DNA, 22 bp, Homo sapiens
attctagaaggcaaagcaaggg

SEQ ID NO: 7624028 - DNA, 22 bp, Homo sapiens
attctagaaggcaaagcaaggg

SEQ ID NO: 7624029 - DNA, 22 bp, Homo sapiens
attctagaaggcaaagcaaggg

SEQ ID NO: 7624030 - DNA, 22 bp, Homo sapiens
attctagaatttaaatttgcca

SEQ ID NO: 7624031 - DNA, 21 bp, Homo sapiens
attctagacaacactgaaatc

SEQ ID NO: 7624032 - DNA, 21 bp, Homo sapiens
attctagacaacactgaaatc

SEQ ID NO: 7624033 - DNA, 21 bp, Homo sapiens
attctagacaacactgaaatc

SEQ ID NO: 7624034 - DNA, 21 bp, Homo sapiens
attctagacaacactgaaatc

SEQ ID NO: 7624035 - DNA, 22 bp, Homo sapiens
attattggacacttcttctgca

SEQ ID NO: 7624036 - DNA, 22 bp, Homo sapiens
attattggacacttcttctgca

SEQ ID NO: 7624037 - DNA, 22 bp, Homo sapiens
attattggacacttcttctgca

SEQ ID NO: 7624038 - DNA, 22 bp, Homo sapiens
attattgctgacatggtgttga

SEQ ID NO: 7624039 - DNA, 22 bp, Homo sapiens
attattgctgacatggtgttga

SEQ ID NO: 7624040 - DNA, 22 bp, Homo sapiens
attattggtacaccgtagtcat

SEQ ID NO: 7624041 - DNA, 22 bp, Homo sapiens
attattggtacaccgtagtcat

SEQ ID NO: 7624042 - DNA, 22 bp, Homo sapiens
attattgtactttcaataaggt

SEQ ID NO: 7624043 - DNA, 22 bp, Homo sapiens
attattgtactttcaataaggt

SEQ ID NO: 7624044 - DNA, 22 bp, Homo sapiens
attattgtcatcttaatcttaa

SEQ ID NO: 7624045 - DNA, 22 bp, Homo sapiens
attattgtactttcaataaggt

SEQ ID NO: 7624046 - DNA, 22 bp, Homo sapiens
attattgtactttcaataaggt

SEQ ID NO: 7624047 - DNA, 22 bp, Homo sapiens
attattgtactttcaataaggt

SEQ ID NO: 7624048 - DNA, 22 bp, Homo sapiens
attattgtgtaaaatgaggctt

SEQ ID NO: 7624049 - DNA, 22 bp, Homo sapiens
attattgtgtaaaatgaggctt

SEQ ID NO: 7624050 - DNA, 22 bp, Homo sapiens
attattgtgataggtgtcagtg

SEQ ID NO: 7624051 - DNA, 22 bp, Homo sapiens
attattgtgataggtgtcagtg

SEQ ID NO: 7624052 - DNA, 22 bp, Homo sapiens
attattgtcatcttaatcttaa

SEQ ID NO: 7624053 - DNA, 22 bp, Homo sapiens
attatttacagtgtgctcgaag

SEQ ID NO: 7624054 - DNA, 22 bp, Homo sapiens
attatttacagtgtgctcgaag

SEQ ID NO: 7624055 - DNA, 22 bp, Homo sapiens
attatttacagtgtgctcgaag

SEQ ID NO: 7624056 - DNA, 22 bp, Homo sapiens
attatttacagtgtgctcgaag

SEQ ID NO: 7624057 - DNA, 22 bp, Homo sapiens
attatttagaaatcgattgaaa

SEQ ID NO: 7624058 - DNA, 22 bp, Homo sapiens
attatttagaaatcgattgaaa

SEQ ID NO: 7624059 - DNA, 22 bp, Homo sapiens
attatttagaaatcgattgaaa

SEQ ID NO: 7624060 - DNA, 22 bp, Homo sapiens
attatttagaaatcgattgaaa

SEQ ID NO: 7624061 - DNA, 22 bp, Homo sapiens
attatttacagtgtgctcgaag

SEQ ID NO: 7624062 - DNA, 22 bp, Homo sapiens
attatttagaaatcgattgaaa

SEQ ID NO: 7624063 - DNA, 22 bp, Homo sapiens
attatttagaaatcgattgaaa

SEQ ID NO: 7624064 - DNA, 22 bp, Homo sapiens
attatttacagtgtgctcgaag

SEQ ID NO: 7624065 - DNA, 22 bp, Homo sapiens
attattgttttaatagtagaga

SEQ ID NO: 7624066 - DNA, 22 bp, Homo sapiens
attattgttttaatagtagaga

SEQ ID NO: 7624067 - DNA, 22 bp, Homo sapiens
attattgttttaatagtagaga

SEQ ID NO: 7624068 - DNA, 22 bp, Homo sapiens
attattgttttaatagtagaga

SEQ ID NO: 7624069 - DNA, 22 bp, Homo sapiens
attattgttttaatagtagaga

SEQ ID NO: 7624070 - DNA, 22 bp, Homo sapiens
attattgttagtgacagggtga

SEQ ID NO: 7624071 - DNA, 22 bp, Homo sapiens
attattgttagtgacagggtga

SEQ ID NO: 7624072 - DNA, 22 bp, Homo sapiens
attattgttgcggctgttaccg

SEQ ID NO: 7624073 - DNA, 22 bp, Homo sapiens
attattgttgcggctgttaccg

SEQ ID NO: 7624074 - DNA, 22 bp, Homo sapiens
attatttagaaatcgattgaaa

SEQ ID NO: 7624075 - DNA, 22 bp, Homo sapiens
attatttagaaatcgattgaaa

SEQ ID NO: 7624076 - DNA, 22 bp, Homo sapiens
attatttatcctcttggtctat

SEQ ID NO: 7624077 - DNA, 22 bp, Homo sapiens
attatttatcctcttggtctat

SEQ ID NO: 7624078 - DNA, 22 bp, Homo sapiens
attatttatcctcttggtctat

SEQ ID NO: 7624079 - DNA, 22 bp, Homo sapiens
attatttatcctcttggtctat

SEQ ID NO: 7624080 - DNA, 22 bp, Homo sapiens
attatttatcctcttggtctat

SEQ ID NO: 7624081 - DNA, 22 bp, Homo sapiens
attatttatcctcttggtctat

SEQ ID NO: 7624082 - DNA, 21 bp, Homo sapiens
attcagagtaattcatcttta

SEQ ID NO: 7624083 - DNA, 21 bp, Homo sapiens
attcagagtaattcatcttta

SEQ ID NO: 7624084 - DNA, 21 bp, Homo sapiens
attcagagtaattcatcttta

SEQ ID NO: 7624085 - DNA, 22 bp, Homo sapiens
attcagagattgttattcagac

SEQ ID NO: 7624086 - DNA, 22 bp, Homo sapiens
attcagagattgttattcagac

SEQ ID NO: 7624087 - DNA, 22 bp, Homo sapiens
attcagactgtctaaatggttt

SEQ ID NO: 7624088 - DNA, 22 bp, Homo sapiens
attatttcagtcagacactggc

SEQ ID NO: 7624089 - DNA, 22 bp, Homo sapiens
attatttcagtcagacactggc

SEQ ID NO: 7624090 - DNA, 22 bp, Homo sapiens
attcagtcaaaaatgatggaga

SEQ ID NO: 7624091 - DNA, 22 bp, Homo sapiens
attcagtctcatcaaattcact

SEQ ID NO: 7624092 - DNA, 21 bp, Homo sapiens
attcagagtaattcatcttta

SEQ ID NO: 7624093 - DNA, 21 bp, Homo sapiens
attcagagtaattcatcttta

SEQ ID NO: 7624094 - DNA, 22 bp, Homo sapiens
attcagtgacctaattacttac

SEQ ID NO: 7624095 - DNA, 22 bp, Homo sapiens
attatttatcctcttggtctat

SEQ ID NO: 7624096 - DNA, 22 bp, Homo sapiens
attcagtgacctaattacttac

SEQ ID NO: 7624097 - DNA, 22 bp, Homo sapiens
attcagtgacctaattacttac

SEQ ID NO: 7624098 - DNA, 22 bp, Homo sapiens
attcagtgagtgtttaccggaa

SEQ ID NO: 7624099 - DNA, 22 bp, Homo sapiens
attcagtgattcatttgtacaa

SEQ ID NO: 7624100 - DNA, 22 bp, Homo sapiens
attcagtggatatcttcacttt

SEQ ID NO: 7624101 - DNA, 22 bp, Homo sapiens
attcagtgggtgctcagcacaa

SEQ ID NO: 7624102 - DNA, 22 bp, Homo sapiens
attcagtgggtgctcagcacaa

SEQ ID NO: 7624103 - DNA, 22 bp, Homo sapiens
attcagtggatatcttcacttt

SEQ ID NO: 7624104 - DNA, 22 bp, Homo sapiens
attcagtgctgtaatacgctaa

SEQ ID NO: 7624105 - DNA, 22 bp, Homo sapiens
attcagtggatatcttcacttt

SEQ ID NO: 7624106 - DNA, 22 bp, Homo sapiens
attcagtgccaaggagaacttg

SEQ ID NO: 7624107 - DNA, 22 bp, Homo sapiens
attcagtgattcatttgtacaa

SEQ ID NO: 7624108 - DNA, 22 bp, Homo sapiens
attcagtgccaaggagaacttg

SEQ ID NO: 7624109 - DNA, 22 bp, Homo sapiens
attcagtgccaaggagaacttg

SEQ ID NO: 7624110 - DNA, 22 bp, Homo sapiens
attcagtgccaaggagaacttg

SEQ ID NO: 7624111 - DNA, 22 bp, Homo sapiens
attcagtgctgtaatacgctaa

SEQ ID NO: 7624112 - DNA, 19 bp, Homo sapiens
attcagtgtctctgacttc

SEQ ID NO: 7624113 - DNA, 19 bp, Homo sapiens
attcagtgtctctgacttc

SEQ ID NO: 7624114 - DNA, 19 bp, Homo sapiens
attcagtgtctctgacttc

SEQ ID NO: 7624115 - DNA, 22 bp, Homo sapiens
attcagtgtctactccattgcc

SEQ ID NO: 7624116 - DNA, 22 bp, Homo sapiens
attcagtgtctactccattgcc

SEQ ID NO: 7624117 - DNA, 22 bp, Homo sapiens
attcagtgtatcaatgaatgct

SEQ ID NO: 7624118 - DNA, 22 bp, Homo sapiens
attcagtgtatcaatgaatgct

SEQ ID NO: 7624119 - DNA, 22 bp, Homo sapiens
attcagtgtagttattatcttt

SEQ ID NO: 7624120 - DNA, 22 bp, Homo sapiens
attcagtgggtgctcagcacaa

SEQ ID NO: 7624121 - DNA, 22 bp, Homo sapiens
attcagtgtagttattatcttt

SEQ ID NO: 7624122 - DNA, 22 bp, Homo sapiens
attcagtgtgaggttttcaagt

SEQ ID NO: 7624123 - DNA, 22 bp, Homo sapiens
attcagtgtgaggttttcaagt

SEQ ID NO: 7624124 - DNA, 22 bp, Homo sapiens
attcagtgtcttgatctgggaa

SEQ ID NO: 7624125 - DNA, 22 bp, Homo sapiens
attcagtgtggacccatttaaa

SEQ ID NO: 7624126 - DNA, 22 bp, Homo sapiens
attcagtgtttgcagcaacttt

SEQ ID NO: 7624127 - DNA, 22 bp, Homo sapiens
attcagtgtttgcagcaacttt

SEQ ID NO: 7624128 - DNA, 22 bp, Homo sapiens
attcagtgtttgcagcaacttt

SEQ ID NO: 7624129 - DNA, 22 bp, Homo sapiens
attcagtgtttgcagcaacttt

SEQ ID NO: 7624130 - DNA, 22 bp, Homo sapiens
attcagttaaaaactgtacttc

SEQ ID NO: 7624131 - DNA, 22 bp, Homo sapiens
attcagttaaaaactgtacttc

SEQ ID NO: 7624132 - DNA, 22 bp, Homo sapiens
attcagttaaaaactgtacttc

SEQ ID NO: 7624133 - DNA, 22 bp, Homo sapiens
attcagttactctagacacttc

SEQ ID NO: 7624134 - DNA, 22 bp, Homo sapiens
attcagttactctagacacttc

SEQ ID NO: 7624135 - DNA, 22 bp, Homo sapiens
attcagttactctagacacttc

SEQ ID NO: 7624136 - DNA, 22 bp, Homo sapiens
attcagttaagggtcttgagat

SEQ ID NO: 7624137 - DNA, 22 bp, Homo sapiens
attcagttaagggtcttgagat

SEQ ID NO: 7624138 - DNA, 22 bp, Homo sapiens
attcagttaagggtcttgagat

SEQ ID NO: 7624139 - DNA, 22 bp, Homo sapiens
attcagttagatcatcctaatt

SEQ ID NO: 7624140 - DNA, 22 bp, Homo sapiens
attcagttagatcatcctaatt

SEQ ID NO: 7624141 - DNA, 22 bp, Homo sapiens
attcagttagatcatcctaatt

SEQ ID NO: 7624142 - DNA, 22 bp, Homo sapiens
attcagttagccacagctattc

SEQ ID NO: 7624143 - DNA, 22 bp, Homo sapiens
attcagttagccacagctattc

SEQ ID NO: 7624144 - DNA, 22 bp, Homo sapiens
attcagttagccacagctattc

SEQ ID NO: 7624145 - DNA, 22 bp, Homo sapiens
attcagttagccacagctattc

SEQ ID NO: 7624146 - DNA, 22 bp, Homo sapiens
attcagttatttactttgctat

SEQ ID NO: 7624147 - DNA, 22 bp, Homo sapiens
attcagttccttgtgattgtag

SEQ ID NO: 7624148 - DNA, 22 bp, Homo sapiens
attcagttccttgtgattgtag

SEQ ID NO: 7624149 - DNA, 22 bp, Homo sapiens
attcagttccttgagggtatag

SEQ ID NO: 7624150 - DNA, 22 bp, Homo sapiens
attcagttccttgagggtatag

SEQ ID NO: 7624151 - DNA, 22 bp, Homo sapiens
attcagttccttgagggtatag

SEQ ID NO: 7624152 - DNA, 22 bp, Homo sapiens
attcagttccttgagggtatag

SEQ ID NO: 7624153 - DNA, 22 bp, Homo sapiens
attcagttatttactttgctat

SEQ ID NO: 7624154 - DNA, 22 bp, Homo sapiens
attcagttatttactttgctat

SEQ ID NO: 7624155 - DNA, 22 bp, Homo sapiens
attcagttagccacagctattc

SEQ ID NO: 7624156 - DNA, 22 bp, Homo sapiens
attcagttagtagatttggtca

SEQ ID NO: 7624157 - DNA, 22 bp, Homo sapiens
attcagttagtagatttggtca

SEQ ID NO: 7624158 - DNA, 22 bp, Homo sapiens
attcagttagtagatttggtca

SEQ ID NO: 7624159 - DNA, 22 bp, Homo sapiens
attcagttattcagagaaggga

SEQ ID NO: 7624160 - DNA, 22 bp, Homo sapiens
attcagttatttactttgctat

SEQ ID NO: 7624161 - DNA, 22 bp, Homo sapiens
attcagttattcagagaaggga

SEQ ID NO: 7624162 - DNA, 22 bp, Homo sapiens
attcagttagtagatttggtca

SEQ ID NO: 7624163 - DNA, 22 bp, Homo sapiens
attcagttattcagagaaggga

SEQ ID NO: 7624164 - DNA, 22 bp, Homo sapiens
attcagttattcagagaaggga

SEQ ID NO: 7624165 - DNA, 21 bp, Homo sapiens
gcagagctggaaccaggaccc

SEQ ID NO: 7624166 - DNA, 21 bp, Homo sapiens
gcagagctggaaccaggaccc

SEQ ID NO: 7624167 - DNA, 23 bp, Homo sapiens
gcagagctgccctattgccttgg

SEQ ID NO: 7624168 - DNA, 23 bp, Homo sapiens
gcagagctgccctattgccttgg

SEQ ID NO: 7624169 - DNA, 21 bp, Homo sapiens
gcagagctggaaccaggaccc

SEQ ID NO: 7624170 - DNA, 22 bp, Homo sapiens
gcagagctgcagcgaggcctgg

SEQ ID NO: 7624171 - DNA, 23 bp, Homo sapiens
gcagagctgccctattgccttgg

SEQ ID NO: 7624172 - DNA, 22 bp, Homo sapiens
gcagagctgggatttgtactgg

SEQ ID NO: 7624173 - DNA, 18 bp, Homo sapiens
gcagagctgggattccca

SEQ ID NO: 7624174 - DNA, 22 bp, Homo sapiens
gcagagctgggtctgtatccaa

SEQ ID NO: 7624175 - DNA, 22 bp, Homo sapiens
gcagagctgggatatgaaccca

SEQ ID NO: 7624176 - DNA, 18 bp, Homo sapiens
gcagagctgggattccca

SEQ ID NO: 7624177 - DNA, 22 bp, Homo sapiens
gcagagctggaactggtactca

SEQ ID NO: 7624178 - DNA, 21 bp, Homo sapiens
gcagagctggaaccaggaccc

SEQ ID NO: 7624179 - DNA, 22 bp, Homo sapiens
gcagagctgggtctgtatccaa

SEQ ID NO: 7624180 - DNA, 22 bp, Homo sapiens
gcagagctgggtctgtatccaa

SEQ ID NO: 7624181 - DNA, 22 bp, Homo sapiens
gcagagctggtacttgagcctg

SEQ ID NO: 7624182 - DNA, 22 bp, Homo sapiens
gcagagctggtacttgagcctg

SEQ ID NO: 7624183 - DNA, 22 bp, Homo sapiens
gcagagctgtctaagtcacttc

SEQ ID NO: 7624184 - DNA, 22 bp, Homo sapiens
gcagagctgtctaagtcacttc

SEQ ID NO: 7624185 - DNA, 20 bp, Homo sapiens
gcagagctgttctgtgggga

SEQ ID NO: 7624186 - DNA, 22 bp, Homo sapiens
gcagagcttctgtccttcagga

SEQ ID NO: 7624187 - DNA, 20 bp, Homo sapiens
gcagagctgttctgtgggga

SEQ ID NO: 7624188 - DNA, 20 bp, Homo sapiens
gcagagctgttctgtgggga

SEQ ID NO: 7624189 - DNA, 20 bp, Homo sapiens
gcagagctgttctgtgggga

SEQ ID NO: 7624190 - DNA, 22 bp, Homo sapiens
gcagagctgttaatggagctga

SEQ ID NO: 7624191 - DNA, 22 bp, Homo sapiens
gcagagctgttaatggagctga

SEQ ID NO: 7624192 - DNA, 22 bp, Homo sapiens
gcagagctgttaatggagctga

SEQ ID NO: 7624193 - DNA, 22 bp, Homo sapiens
gcagagctgttaatggagctga

SEQ ID NO: 7624194 - DNA, 22 bp, Homo sapiens
gcagagctgttaatggagctga

SEQ ID NO: 7624195 - DNA, 22 bp, Homo sapiens
attattcattggtaggcaagct

SEQ ID NO: 7624196 - DNA, 22 bp, Homo sapiens
attattcatggtcttccacaat

SEQ ID NO: 7624197 - DNA, 22 bp, Homo sapiens
attattcatggtcttccacaat

SEQ ID NO: 7624198 - DNA, 22 bp, Homo sapiens
attattcatggtcttccacaat

SEQ ID NO: 7624199 - DNA, 22 bp, Homo sapiens
attattcatggtcttccacaat

SEQ ID NO: 7624200 - DNA, 22 bp, Homo sapiens
attattcatggtcttccacaat

SEQ ID NO: 7624201 - DNA, 22 bp, Homo sapiens
attattcatggtcttccacaat

SEQ ID NO: 7624202 - DNA, 22 bp, Homo sapiens
attattcattggtaggcaagct

SEQ ID NO: 7624203 - DNA, 22 bp, Homo sapiens
attattctctggaggaaagatt

SEQ ID NO: 7624204 - DNA, 22 bp, Homo sapiens
attattctctggaggaaagatt

SEQ ID NO: 7624205 - DNA, 22 bp, Homo sapiens
attattctctggaggaaagatt

SEQ ID NO: 7624206 - DNA, 20 bp, Homo sapiens
attattcatacatgtgtgac

SEQ ID NO: 7624207 - DNA, 22 bp, Homo sapiens
attattcagtcttgtaaggagt

SEQ ID NO: 7624208 - DNA, 22 bp, Homo sapiens
attattcagtcttgtaaggagt

SEQ ID NO: 7624209 - DNA, 20 bp, Homo sapiens
attattcatacatgtgtgac

SEQ ID NO: 7624210 - DNA, 20 bp, Homo sapiens
attattcatacatgtgtgac

SEQ ID NO: 7624211 - DNA, 20 bp, Homo sapiens
attattcatacatgtgtgac

SEQ ID NO: 7624212 - DNA, 22 bp, Homo sapiens
attattctttgataaatggcag

SEQ ID NO: 7624213 - DNA, 22 bp, Homo sapiens
attattctttgataaatggcag

SEQ ID NO: 7624214 - DNA, 22 bp, Homo sapiens
attattcttgaggtgtttattg

SEQ ID NO: 7624215 - DNA, 22 bp, Homo sapiens
attattcttgaggtgtttattg

SEQ ID NO: 7624216 - DNA, 22 bp, Homo sapiens
attattgccagctattacaaca

SEQ ID NO: 7624217 - DNA, 22 bp, Homo sapiens
attattgccagctattacaaca

SEQ ID NO: 7624218 - DNA, 22 bp, Homo sapiens
attattgcaagcagtgaaggga

SEQ ID NO: 7624219 - DNA, 22 bp, Homo sapiens
attattgcaagcagtgaaggga

SEQ ID NO: 7624220 - DNA, 22 bp, Homo sapiens
attattgcaatttgacattcag

SEQ ID NO: 7624221 - DNA, 22 bp, Homo sapiens
attattgcaatttgacattcag

SEQ ID NO: 7624222 - DNA, 22 bp, Homo sapiens
attattgcaatttgacattcag

SEQ ID NO: 7624223 - DNA, 22 bp, Homo sapiens
attattcttatgtcatcatggc

SEQ ID NO: 7624224 - DNA, 22 bp, Homo sapiens
attattcttaatgcagggatta

SEQ ID NO: 7624225 - DNA, 22 bp, Homo sapiens
attattcttaatgcagggatta

SEQ ID NO: 7624226 - DNA, 22 bp, Homo sapiens
attattcttatgtcatcatggc

SEQ ID NO: 7624227 - DNA, 22 bp, Homo sapiens
attattcttatgtcatcatggc

SEQ ID NO: 7624228 - DNA, 22 bp, Homo sapiens
attattcttatgtcatcatggc

SEQ ID NO: 7624229 - DNA, 22 bp, Homo sapiens
attattcttatgtcatcatggc

SEQ ID NO: 7624230 - DNA, 22 bp, Homo sapiens
attattcttgaggtgtttattg

SEQ ID NO: 7624231 - DNA, 22 bp, Homo sapiens
attattcaatcatattaaaagt

SEQ ID NO: 7624232 - DNA, 22 bp, Homo sapiens
attattcaatcatattaaaagt

SEQ ID NO: 7624233 - DNA, 22 bp, Homo sapiens
attattcaatcatattaaaagt

SEQ ID NO: 7624234 - DNA, 22 bp, Homo sapiens
attattcaatcatattaaaagt

SEQ ID NO: 7624235 - DNA, 22 bp, Homo sapiens
attattcaatcatattaaaagt

SEQ ID NO: 7624236 - DNA, 22 bp, Homo sapiens
attattcaatcatattaaaagt

SEQ ID NO: 7624237 - DNA, 22 bp, Homo sapiens
attattcaatcatattaaaagt

SEQ ID NO: 7624238 - DNA, 22 bp, Homo sapiens
attattcaatcatattaaaagt

SEQ ID NO: 7624239 - DNA, 22 bp, Homo sapiens
attattcaatcatattaaaagt

SEQ ID NO: 7624240 - DNA, 22 bp, Homo sapiens
attattcaatcatattaaaagt

SEQ ID NO: 7624241 - DNA, 22 bp, Homo sapiens
attattcaacacttgagaaatt

SEQ ID NO: 7624242 - DNA, 22 bp, Homo sapiens
attattcaacacttgagaaatt

SEQ ID NO: 7624243 - DNA, 22 bp, Homo sapiens
attattcagtcttgtaaggagt

SEQ ID NO: 7624244 - DNA, 22 bp, Homo sapiens
attattcagtcttgtaaggagt

SEQ ID NO: 7624245 - DNA, 22 bp, Homo sapiens
attattcaatgttatttcagtg

SEQ ID NO: 7624246 - DNA, 22 bp, Homo sapiens
attattcaatgttatttcagtg

SEQ ID NO: 7624247 - DNA, 22 bp, Homo sapiens
attattcaatgttatttcagtg

SEQ ID NO: 7624248 - DNA, 22 bp, Homo sapiens
attattcaatgttatttcagtg

SEQ ID NO: 7624249 - DNA, 22 bp, Homo sapiens
attattcaatgttatttcagtg

SEQ ID NO: 7624250 - DNA, 22 bp, Homo sapiens
attattcaatgttatttcagtg

SEQ ID NO: 7624251 - DNA, 22 bp, Homo sapiens
attattcaatgttatttcagtg

SEQ ID NO: 7624252 - DNA, 22 bp, Homo sapiens
attattcaatcatattaaaagt

SEQ ID NO: 7624253 - DNA, 20 bp, Homo sapiens
attagagctacatggctaca

SEQ ID NO: 7624254 - DNA, 22 bp, Homo sapiens
attagagcagtaattgtggcag

SEQ ID NO: 7624255 - DNA, 22 bp, Homo sapiens
attagagcagtgtattatgata

SEQ ID NO: 7624256 - DNA, 22 bp, Homo sapiens
attagagagagcatattactgg

SEQ ID NO: 7624257 - DNA, 22 bp, Homo sapiens
attagagagagcatattactgg

SEQ ID NO: 7624258 - DNA, 22 bp, Homo sapiens
attagagaaatgttgccaagat

SEQ ID NO: 7624259 - DNA, 22 bp, Homo sapiens
attattaaagctacatcaagga

SEQ ID NO: 7624260 - DNA, 22 bp, Homo sapiens
attagagctgttagtgaagtgc

SEQ ID NO: 7624261 - DNA, 22 bp, Homo sapiens
attattaaagctacatcaagga

SEQ ID NO: 7624262 - DNA, 22 bp, Homo sapiens
attattaaagctacatcaagga

SEQ ID NO: 7624263 - DNA, 22 bp, Homo sapiens
attattaaagctacatcaagga

SEQ ID NO: 7624264 - DNA, 22 bp, Homo sapiens
attattaaagctacatcaagga

SEQ ID NO: 7624265 - DNA, 17 bp, Homo sapiens
gcaagggatgggagatt

SEQ ID NO: 7624266 - DNA, 21 bp, Homo sapiens
gcaaggcttttgtgtttccca

SEQ ID NO: 7624267 - DNA, 21 bp, Homo sapiens
gcaaggcttttgtgtttccca

SEQ ID NO: 7624268 - DNA, 21 bp, Homo sapiens
gcaaggcttttgtgtttccca

SEQ ID NO: 7624269 - DNA, 22 bp, Homo sapiens
gcaaggctttgtgaattttaaa

SEQ ID NO: 7624270 - DNA, 22 bp, Homo sapiens
gcaaggctgttgctgctgcaag

SEQ ID NO: 7624271 - DNA, 22 bp, Homo sapiens
gcaaggctgttgctgctgcaag

SEQ ID NO: 7624272 - DNA, 22 bp, Homo sapiens
gcaaggctgtgcactttgcatt

SEQ ID NO: 7624273 - DNA, 22 bp, Homo sapiens
gcaaggctgtgcactttgcatt

SEQ ID NO: 7624274 - DNA, 22 bp, Homo sapiens
gcaaggctttgtgaattttaaa

SEQ ID NO: 7624275 - DNA, 22 bp, Homo sapiens
gcaaggctttgtgaattttaaa

SEQ ID NO: 7624276 - DNA, 22 bp, Homo sapiens
gcaaggctgttgctgctgcaag

SEQ ID NO: 7624277 - DNA, 22 bp, Homo sapiens
gcaaggctgttgctgctgcaag

SEQ ID NO: 7624278 - DNA, 17 bp, Homo sapiens
gcaagggatgggagatt

SEQ ID NO: 7624279 - DNA, 21 bp, Homo sapiens
gcaaggcttttgtgtttccca

SEQ ID NO: 7624280 - DNA, 17 bp, Homo sapiens
gcaagggatgggagatt

SEQ ID NO: 7624281 - DNA, 17 bp, Homo sapiens
gcaagggatgggagatt

SEQ ID NO: 7624282 - DNA, 17 bp, Homo sapiens
gcaagggatgggagatt

SEQ ID NO: 7624283 - DNA, 17 bp, Homo sapiens
gcaagggatgggagatt

SEQ ID NO: 7624284 - DNA, 22 bp, Homo sapiens
gcaagggcatggctctgatcaa

SEQ ID NO: 7624285 - DNA, 22 bp, Homo sapiens
gcaagggtgtgaaccaatgaga

SEQ ID NO: 7624286 - DNA, 17 bp, Homo sapiens
gcaagggatgggagatt

SEQ ID NO: 7624287 - DNA, 17 bp, Homo sapiens
gcaagggatgggagatt

SEQ ID NO: 7624288 - DNA, 17 bp, Homo sapiens
gcaagggatgggagatt

SEQ ID NO: 7624289 - DNA, 22 bp, Homo sapiens
gcaaggtgttttaacaggaaaa

SEQ ID NO: 7624290 - DNA, 22 bp, Homo sapiens
gcaaggtgttttaacaggaaaa

SEQ ID NO: 7624291 - DNA, 21 bp, Homo sapiens
gcaagtactatcatcattatc

SEQ ID NO: 7624292 - DNA, 22 bp, Homo sapiens
gcaagtcccttgttcacttgga

SEQ ID NO: 7624293 - DNA, 22 bp, Homo sapiens
gcaagtcccttgttcacttgga

SEQ ID NO: 7624294 - DNA, 21 bp, Homo sapiens
gcaagtgtttctgacagtggc

SEQ ID NO: 7624295 - DNA, 22 bp, Homo sapiens
gcaagtgtctgaggttttgtat

SEQ ID NO: 7624296 - DNA, 23 bp, Homo sapiens
gcaagtgaggcgtcagcagtcaa

SEQ ID NO: 7624297 - DNA, 22 bp, Homo sapiens
gcaagtgatgatggcaacttca

SEQ ID NO: 7624298 - DNA, 22 bp, Homo sapiens
gcaagtgattgtcacgtccctt

SEQ ID NO: 7624299 - DNA, 20 bp, Homo sapiens
gcaagtgaaaactatgggtg

SEQ ID NO: 7624300 - DNA, 22 bp, Homo sapiens
gcaagtcctttgcatgcaggga

SEQ ID NO: 7624301 - DNA, 22 bp, Homo sapiens
gcaagtgaatgaggttgagatt

SEQ ID NO: 7624302 - DNA, 22 bp, Homo sapiens
gcaagtgagaggcatcattaga

SEQ ID NO: 7624303 - DNA, 22 bp, Homo sapiens
gcaagtgagaggcatcattaga

SEQ ID NO: 7624304 - DNA, 23 bp, Homo sapiens
gcaagtgaggcgtcagcagtcaa

SEQ ID NO: 7624305 - DNA, 22 bp, Homo sapiens
attagaagaggctgacgaatgt

SEQ ID NO: 7624306 - DNA, 22 bp, Homo sapiens
attagaagaggctgacgaatgt

SEQ ID NO: 7624307 - DNA, 22 bp, Homo sapiens
attagaagatagtgatttctgc

SEQ ID NO: 7624308 - DNA, 22 bp, Homo sapiens
attagaagatagtgatttctgc

SEQ ID NO: 7624309 - DNA, 22 bp, Homo sapiens
attagaagcgtgaatcctttca

SEQ ID NO: 7624310 - DNA, 21 bp, Homo sapiens
attagaaggtatttagggcct

SEQ ID NO: 7624311 - DNA, 22 bp, Homo sapiens
attagaatgaagtataggattt

SEQ ID NO: 7624312 - DNA, 22 bp, Homo sapiens
attagaatgaagtataggattt

SEQ ID NO: 7624313 - DNA, 22 bp, Homo sapiens
gcaataaaatgtaatgattggg

SEQ ID NO: 7624314 - DNA, 22 bp, Homo sapiens
gcaataaaatgtaatgattggg

SEQ ID NO: 7624315 - DNA, 22 bp, Homo sapiens
gcaagtttagctaactggccca

SEQ ID NO: 7624316 - DNA, 22 bp, Homo sapiens
gcaataaaatgtaatgattggg

SEQ ID NO: 7624317 - DNA, 22 bp, Homo sapiens
attagaagaggctgacgaatgt

SEQ ID NO: 7624318 - DNA, 22 bp, Homo sapiens
gcaagttggagactcatgagaa

SEQ ID NO: 7624319 - DNA, 22 bp, Homo sapiens
gcaagttggagactcatgagaa

SEQ ID NO: 7624320 - DNA, 21 bp, Homo sapiens
gcaagtgtttctgacagtggc

SEQ ID NO: 7624321 - DNA, 22 bp, Homo sapiens
attagacatcatatgattcagc

SEQ ID NO: 7624322 - DNA, 22 bp, Homo sapiens
attagacatcatatgattcagc

SEQ ID NO: 7624323 - DNA, 23 bp, Homo sapiens
attagacactttgggttgtcttc

SEQ ID NO: 7624324 - DNA, 22 bp, Homo sapiens
attagaattatgcttgctaatg

SEQ ID NO: 7624325 - DNA, 22 bp, Homo sapiens
attagaattatgcttgctaatg

SEQ ID NO: 7624326 - DNA, 22 bp, Homo sapiens
attagaattatgcttgctaatg

SEQ ID NO: 7624327 - DNA, 22 bp, Homo sapiens
attagaatgacagaaatgaggc

SEQ ID NO: 7624328 - DNA, 22 bp, Homo sapiens
attagaatgcagggttcattgt

SEQ ID NO: 7624329 - DNA, 22 bp, Homo sapiens
attagaatgcagggttcattgt

SEQ ID NO: 7624330 - DNA, 22 bp, Homo sapiens
attagaatgacagaaatgaggc

SEQ ID NO: 7624331 - DNA, 22 bp, Homo sapiens
attagaatgcagggttcattgt

SEQ ID NO: 7624332 - DNA, 22 bp, Homo sapiens
attagaattatgcttgctaatg

SEQ ID NO: 7624333 - DNA, 22 bp, Homo sapiens
attagaatgcagggttcattgt

SEQ ID NO: 7624334 - DNA, 22 bp, Homo sapiens
attaatatgagaaagtggcaga

SEQ ID NO: 7624335 - DNA, 22 bp, Homo sapiens
attaatatgagaaagtggcaga

SEQ ID NO: 7624336 - DNA, 22 bp, Homo sapiens
attaatattggttcattagctg

SEQ ID NO: 7624337 - DNA, 22 bp, Homo sapiens
attaatattggttcattagctg

SEQ ID NO: 7624338 - DNA, 22 bp, Homo sapiens
attaatattggttcattagctg

SEQ ID NO: 7624339 - DNA, 22 bp, Homo sapiens
attaatatcctgctggctaaat

SEQ ID NO: 7624340 - DNA, 22 bp, Homo sapiens
attaatatcctgctggctaaat

SEQ ID NO: 7624341 - DNA, 22 bp, Homo sapiens
attaatatcctgctggctaaat

SEQ ID NO: 7624342 - DNA, 22 bp, Homo sapiens
attaagctccaagttgctctga

SEQ ID NO: 7624343 - DNA, 22 bp, Homo sapiens
attaagctccaagttgctctga

SEQ ID NO: 7624344 - DNA, 22 bp, Homo sapiens
attaagatgtgggaaaatttaa

SEQ ID NO: 7624345 - DNA, 22 bp, Homo sapiens
attaagatgtgggaaaatttaa

SEQ ID NO: 7624346 - DNA, 22 bp, Homo sapiens
attaagcattcagggctagaga

SEQ ID NO: 7624347 - DNA, 22 bp, Homo sapiens
attaatatacactgttagcatg

SEQ ID NO: 7624348 - DNA, 22 bp, Homo sapiens
attaatatacactgttagcatg

SEQ ID NO: 7624349 - DNA, 22 bp, Homo sapiens
gatgatctgcaagaactacatg

SEQ ID NO: 7624350 - DNA, 22 bp, Homo sapiens
gatgatgacagtgattagactg

SEQ ID NO: 7624351 - DNA, 22 bp, Homo sapiens
gatgatctgcaagaactacatg

SEQ ID NO: 7624352 - DNA, 22 bp, Homo sapiens
gatgatctgaggtacatgaaac

SEQ ID NO: 7624353 - DNA, 22 bp, Homo sapiens
gatgatcatctgtaaagttaga

SEQ ID NO: 7624354 - DNA, 22 bp, Homo sapiens
gatgatattttgactggagaat

SEQ ID NO: 7624355 - DNA, 22 bp, Homo sapiens
gatgatcatctgtaaagttaga

SEQ ID NO: 7624356 - DNA, 22 bp, Homo sapiens
gatgatggacaaagcattggtg

SEQ ID NO: 7624357 - DNA, 22 bp, Homo sapiens
gatgatggacaaagcattggtg

SEQ ID NO: 7624358 - DNA, 22 bp, Homo sapiens
attaagatcattgtagaagatt

SEQ ID NO: 7624359 - DNA, 22 bp, Homo sapiens
attaagatgtgggaaaatttaa

SEQ ID NO: 7624360 - DNA, 22 bp, Homo sapiens
gatgatgagataaggataactt

SEQ ID NO: 7624361 - DNA, 22 bp, Homo sapiens
gatgatgagataaggataactt

SEQ ID NO: 7624362 - DNA, 22 bp, Homo sapiens
gatgatgctctagtggagtttt

SEQ ID NO: 7624363 - DNA, 22 bp, Homo sapiens
gatgatgaggccatgaggcagg

SEQ ID NO: 7624364 - DNA, 22 bp, Homo sapiens
attaatttccaggcactgtgct

SEQ ID NO: 7624365 - DNA, 22 bp, Homo sapiens
attaatttccaggcactgtgct

SEQ ID NO: 7624366 - DNA, 22 bp, Homo sapiens
attaatttccaggcactgtgct

SEQ ID NO: 7624367 - DNA, 22 bp, Homo sapiens
attaattgggaacttgttgaaa

SEQ ID NO: 7624368 - DNA, 22 bp, Homo sapiens
attaatgtgtagccaacttaat

SEQ ID NO: 7624369 - DNA, 22 bp, Homo sapiens
attaatgtctaccagttgtgtg

SEQ ID NO: 7624370 - DNA, 22 bp, Homo sapiens
attaatgtgtagccaacttaat

SEQ ID NO: 7624371 - DNA, 22 bp, Homo sapiens
attaatgtgtagccaacttaat

SEQ ID NO: 7624372 - DNA, 22 bp, Homo sapiens
attaattttacctttgtaaaca

SEQ ID NO: 7624373 - DNA, 22 bp, Homo sapiens
attaattttacctttgtaaaca

SEQ ID NO: 7624374 - DNA, 22 bp, Homo sapiens
attaattttacctttgtaaaca

SEQ ID NO: 7624375 - DNA, 22 bp, Homo sapiens
attaattttacctttgtaaaca

SEQ ID NO: 7624376 - DNA, 22 bp, Homo sapiens
attaatttccaggcactgtgct

SEQ ID NO: 7624377 - DNA, 22 bp, Homo sapiens
attaattttacctttgtaaaca

SEQ ID NO: 7624378 - DNA, 22 bp, Homo sapiens
attaattttacctttgtaaaca

SEQ ID NO: 7624379 - DNA, 22 bp, Homo sapiens
attaatgacgcagataataatt

SEQ ID NO: 7624380 - DNA, 20 bp, Homo sapiens
attaatgaatacattttgat

SEQ ID NO: 7624381 - DNA, 20 bp, Homo sapiens
attaatgaatacattttgat

SEQ ID NO: 7624382 - DNA, 20 bp, Homo sapiens
attaatgaatacattttgat

SEQ ID NO: 7624383 - DNA, 22 bp, Homo sapiens
attaatgacgcagataataatt

SEQ ID NO: 7624384 - DNA, 22 bp, Homo sapiens
attaatgagcttctgcactcat

SEQ ID NO: 7624385 - DNA, 22 bp, Homo sapiens
attaatgacgcagataataatt

SEQ ID NO: 7624386 - DNA, 22 bp, Homo sapiens
attaatgacgcagataataatt

SEQ ID NO: 7624387 - DNA, 22 bp, Homo sapiens
attaatgacgcagataataatt

SEQ ID NO: 7624388 - DNA, 22 bp, Homo sapiens
attaatgacgcagataataatt

SEQ ID NO: 7624389 - DNA, 18 bp, Homo sapiens
attaatcataaaatgctg

SEQ ID NO: 7624390 - DNA, 22 bp, Homo sapiens
attaatcatttctgcattatct

SEQ ID NO: 7624391 - DNA, 22 bp, Homo sapiens
attaatcatttctgcattatct

SEQ ID NO: 7624392 - DNA, 22 bp, Homo sapiens
attaatcatttctgcattatct

SEQ ID NO: 7624393 - DNA, 22 bp, Homo sapiens
attaatcatttctgcattatct

SEQ ID NO: 7624394 - DNA, 22 bp, Homo sapiens
attaatattggttcattagctg

SEQ ID NO: 7624395 - DNA, 18 bp, Homo sapiens
attaatcataaaatgctg

SEQ ID NO: 7624396 - DNA, 18 bp, Homo sapiens
attaatcataaaatgctg

SEQ ID NO: 7624397 - DNA, 18 bp, Homo sapiens
attaatcataaaatgctg

SEQ ID NO: 7624398 - DNA, 22 bp, Homo sapiens
attaatatttgcaccttctgtc

SEQ ID NO: 7624399 - DNA, 22 bp, Homo sapiens
attaatatttgcaccttctgtc

SEQ ID NO: 7624400 - DNA, 22 bp, Homo sapiens
attacaaaagaagggagaaggt

SEQ ID NO: 7624401 - DNA, 22 bp, Homo sapiens
attacaaaagaagggagaaggt

SEQ ID NO: 7624402 - DNA, 22 bp, Homo sapiens
attacaaaagaagggagaaggt

SEQ ID NO: 7624403 - DNA, 22 bp, Homo sapiens
attacaaaagaagggagaaggt

SEQ ID NO: 7624404 - DNA, 22 bp, Homo sapiens
attacaaaagaagggagaaggt

SEQ ID NO: 7624405 - DNA, 22 bp, Homo sapiens
attacaaaagaagggagaaggt

SEQ ID NO: 7624406 - DNA, 22 bp, Homo sapiens
attaatttttctgacagccaca

SEQ ID NO: 7624407 - DNA, 22 bp, Homo sapiens
attaatttttctgacagccaca

SEQ ID NO: 7624408 - DNA, 22 bp, Homo sapiens
attaatttttctgacagccaca

SEQ ID NO: 7624409 - DNA, 22 bp, Homo sapiens
attacaaaagaagggagaaggt

SEQ ID NO: 7624410 - DNA, 22 bp, Homo sapiens
attacaaaagaagggagaaggt

SEQ ID NO: 7624411 - DNA, 22 bp, Homo sapiens
attacaaaagaagggagaaggt

SEQ ID NO: 7624412 - DNA, 22 bp, Homo sapiens
attacaaaagaagggagaaggt

SEQ ID NO: 7624413 - DNA, 22 bp, Homo sapiens
attacaaaagaagggagaaggt

SEQ ID NO: 7624414 - DNA, 22 bp, Homo sapiens
attacaaaagaagggagaaggt

SEQ ID NO: 7624415 - DNA, 22 bp, Homo sapiens
attacaaaagaagggagaaggt

SEQ ID NO: 7624416 - DNA, 22 bp, Homo sapiens
attacaaaagaagggagaaggt

SEQ ID NO: 7624417 - DNA, 22 bp, Homo sapiens
attacaagtagactaactttca

SEQ ID NO: 7624418 - DNA, 22 bp, Homo sapiens
attacaagggtctgactggagg

SEQ ID NO: 7624419 - DNA, 22 bp, Homo sapiens
attacaagggtctgactggagg

SEQ ID NO: 7624420 - DNA, 22 bp, Homo sapiens
attacaataaggtttatttgta

SEQ ID NO: 7624421 - DNA, 22 bp, Homo sapiens
attacaagtttcagtgttttgc

SEQ ID NO: 7624422 - DNA, 22 bp, Homo sapiens
attacaataaggtttatttgta

SEQ ID NO: 7624423 - DNA, 22 bp, Homo sapiens
attacaataaggtttatttgta

SEQ ID NO: 7624424 - DNA, 22 bp, Homo sapiens
attacaataaggtttatttgta

SEQ ID NO: 7624425 - DNA, 22 bp, Homo sapiens
attacaacaagaaaagggtaag

SEQ ID NO: 7624426 - DNA, 22 bp, Homo sapiens
attacaactatgtgctctgcaa

SEQ ID NO: 7624427 - DNA, 22 bp, Homo sapiens
attacaactacataatctcaga

SEQ ID NO: 7624428 - DNA, 22 bp, Homo sapiens
attacaactacataatctcaga

SEQ ID NO: 7624429 - DNA, 22 bp, Homo sapiens
attacaagatgcatccatattt

SEQ ID NO: 7624430 - DNA, 22 bp, Homo sapiens
attacaactgttcccactgtct

SEQ ID NO: 7624431 - DNA, 22 bp, Homo sapiens
attacaactggaatggtgctgg

SEQ ID NO: 7624432 - DNA, 22 bp, Homo sapiens
attacaataaggtttatttgta

SEQ ID NO: 7624433 - DNA, 22 bp, Homo sapiens
attacaataatacatgctcatt

SEQ ID NO: 7624434 - DNA, 22 bp, Homo sapiens
attacaataatacatgctcatt

SEQ ID NO: 7624435 - DNA, 22 bp, Homo sapiens
attacaataatacatgctcatt

SEQ ID NO: 7624436 - DNA, 22 bp, Homo sapiens
attacaataatacatgctcatt

SEQ ID NO: 7624437 - DNA, 22 bp, Homo sapiens
attacaataatacatgctcatt

SEQ ID NO: 7624438 - DNA, 22 bp, Homo sapiens
attacaataatacatgctcatt

SEQ ID NO: 7624439 - DNA, 22 bp, Homo sapiens
attacaataatacatgctcatt

SEQ ID NO: 7624440 - DNA, 22 bp, Homo sapiens
attacaataatacatgctcatt

SEQ ID NO: 7624441 - DNA, 22 bp, Homo sapiens
gcaactttagaaaaatctataa

SEQ ID NO: 7624442 - DNA, 22 bp, Homo sapiens
gcaactttagaaaaatctataa

SEQ ID NO: 7624443 - DNA, 22 bp, Homo sapiens
gcaacttaaggttagaggaaag

SEQ ID NO: 7624444 - DNA, 22 bp, Homo sapiens
gcaacttaggagttagagcatg

SEQ ID NO: 7624445 - DNA, 21 bp, Homo sapiens
gcaacttatcgcattctgcag

SEQ ID NO: 7624446 - DNA, 21 bp, Homo sapiens
gcaacttatcgcattctgcag

SEQ ID NO: 7624447 - DNA, 22 bp, Homo sapiens
gcaactttagggccagcaagta

SEQ ID NO: 7624448 - DNA, 22 bp, Homo sapiens
gcaactttcaagcaccatgggg

SEQ ID NO: 7624449 - DNA, 22 bp, Homo sapiens
gcaactttcaagcaccatgggg

SEQ ID NO: 7624450 - DNA, 22 bp, Homo sapiens
attacaataatacatgctcatt

SEQ ID NO: 7624451 - DNA, 22 bp, Homo sapiens
attacaataatacatgctcatt

SEQ ID NO: 7624452 - DNA, 22 bp, Homo sapiens
attacaataatacatgctcatt

SEQ ID NO: 7624453 - DNA, 22 bp, Homo sapiens
gcaaggctgtgcactttgcatt

SEQ ID NO: 7624454 - DNA, 22 bp, Homo sapiens
gcaaggctgtgcactttgcatt

SEQ ID NO: 7624455 - DNA, 22 bp, Homo sapiens
gcaaggctgtgcactttgcatt

SEQ ID NO: 7624456 - DNA, 22 bp, Homo sapiens
gcaaggctggtggtggtgaagt

SEQ ID NO: 7624457 - DNA, 22 bp, Homo sapiens
gcaaggctgggagatgaggcct

SEQ ID NO: 7624458 - DNA, 22 bp, Homo sapiens
gcaaggctgggagatgaggcct

SEQ ID NO: 7624459 - DNA, 22 bp, Homo sapiens
gcaaggctgggagatgaggcct

SEQ ID NO: 7624460 - DNA, 22 bp, Homo sapiens
gcaaggctgggagatgaggcct

SEQ ID NO: 7624461 - DNA, 22 bp, Homo sapiens
gcaaggctgctgccacccatct

SEQ ID NO: 7624462 - DNA, 22 bp, Homo sapiens
gcaaggctgctgccacccatct

SEQ ID NO: 7624463 - DNA, 22 bp, Homo sapiens
gcaaggctgctgccacccatct

SEQ ID NO: 7624464 - DNA, 22 bp, Homo sapiens
gcaaggctgggagatgaggcct

SEQ ID NO: 7624465 - DNA, 22 bp, Homo sapiens
gcaaggctgctgccacccatct

SEQ ID NO: 7624466 - DNA, 22 bp, Homo sapiens
gcaaggctgcccacttcaaaag

SEQ ID NO: 7624467 - DNA, 22 bp, Homo sapiens
gcaaggctgcccacttcaaaag

SEQ ID NO: 7624468 - DNA, 22 bp, Homo sapiens
gcaaggctgcccacttcaaaag

SEQ ID NO: 7624469 - DNA, 22 bp, Homo sapiens
gcaaggctgagcacatttgcat

SEQ ID NO: 7624470 - DNA, 22 bp, Homo sapiens
gcaaggctgacctctctagact

SEQ ID NO: 7624471 - DNA, 22 bp, Homo sapiens
gcaaggctgagcacatttgcat

SEQ ID NO: 7624472 - DNA, 22 bp, Homo sapiens
gcaagaaaaaggcttcatgaac

SEQ ID NO: 7624473 - DNA, 22 bp, Homo sapiens
gcaagaaaaaggcttcatgaac

SEQ ID NO: 7624474 - DNA, 22 bp, Homo sapiens
gcaaggctgacctctctagact

SEQ ID NO: 7624475 - DNA, 22 bp, Homo sapiens
gcaaggctgacctctctagact

SEQ ID NO: 7624476 - DNA, 22 bp, Homo sapiens
gcaagaaaaaggcttcatgaac

SEQ ID NO: 7624477 - DNA, 22 bp, Homo sapiens
atgtgttgcagaagattaagct

SEQ ID NO: 7624478 - DNA, 22 bp, Homo sapiens
atgtgttgcagaagattaagct

SEQ ID NO: 7624479 - DNA, 22 bp, Homo sapiens
atgtgttctgaggcagatgact

SEQ ID NO: 7624480 - DNA, 22 bp, Homo sapiens
atgtgttcgctagattgctgtt

SEQ ID NO: 7624481 - DNA, 22 bp, Homo sapiens
atgtgttcagttgacaggagca

SEQ ID NO: 7624482 - DNA, 22 bp, Homo sapiens
atgtgttcacgtgcacatgtgc

SEQ ID NO: 7624483 - DNA, 22 bp, Homo sapiens
atgtgttaattggagcagcagg

SEQ ID NO: 7624484 - DNA, 22 bp, Homo sapiens
atgtgttaattggagcagcagg

SEQ ID NO: 7624485 - DNA, 22 bp, Homo sapiens
atgtgttaattggagcagcagg

SEQ ID NO: 7624486 - DNA, 22 bp, Homo sapiens
atgtgttagtttgtgattatac

SEQ ID NO: 7624487 - DNA, 22 bp, Homo sapiens
atgtgttagtttgtgattatac

SEQ ID NO: 7624488 - DNA, 22 bp, Homo sapiens
atgtgttcacgtgcacatgtgc

SEQ ID NO: 7624489 - DNA, 22 bp, Homo sapiens
atgtgtgtgtttaatcctcaaa

SEQ ID NO: 7624490 - DNA, 22 bp, Homo sapiens
atgtgtgtgtttaatcctcaaa

SEQ ID NO: 7624491 - DNA, 22 bp, Homo sapiens
atgtgtgtgtttaatcctcaaa

SEQ ID NO: 7624492 - DNA, 22 bp, Homo sapiens
atgtgtgtgtttaatcctcaaa

SEQ ID NO: 7624493 - DNA, 22 bp, Homo sapiens
atgtgttaatgagcaatgacct

SEQ ID NO: 7624494 - DNA, 22 bp, Homo sapiens
atgtgttaatgtcaaccagaaa

SEQ ID NO: 7624495 - DNA, 22 bp, Homo sapiens
atgtgttaatgtcaaccagaaa

SEQ ID NO: 7624496 - DNA, 22 bp, Homo sapiens
atgtgtgtgtgcgcgcgcagga

SEQ ID NO: 7624497 - DNA, 22 bp, Homo sapiens
atgtgtgtgtgcgcgcgcagga

SEQ ID NO: 7624498 - DNA, 22 bp, Homo sapiens
atgtgtgtgtttaatcctcaaa

SEQ ID NO: 7624499 - DNA, 22 bp, Homo sapiens
atgtgtgtgtttaatcctcaaa

SEQ ID NO: 7624500 - DNA, 22 bp, Homo sapiens
atgtgtgtgtttaatcctcaaa

SEQ ID NO: 7624501 - DNA, 22 bp, Homo sapiens
atgtgtgtgtgcgcgcgcagga

SEQ ID NO: 7624502 - DNA, 22 bp, Homo sapiens
atgtgtgtgtgcgcgcgcagga

SEQ ID NO: 7624503 - DNA, 22 bp, Homo sapiens
atgtgtgtgtatatacacacat

SEQ ID NO: 7624504 - DNA, 22 bp, Homo sapiens
atgtgtgtgtatatacacacat

SEQ ID NO: 7624505 - DNA, 22 bp, Homo sapiens
atgtgtgtgtgcgcgcgcagga

SEQ ID NO: 7624506 - DNA, 22 bp, Homo sapiens
atgtgtgtgtatatacacacat

SEQ ID NO: 7624507 - DNA, 22 bp, Homo sapiens
atgtgtgtgtatatacacacat

SEQ ID NO: 7624508 - DNA, 22 bp, Homo sapiens
atgtgtgtgtatatacacacat

SEQ ID NO: 7624509 - DNA, 22 bp, Homo sapiens
atgtgtgtgtatatacacacat

SEQ ID NO: 7624510 - DNA, 22 bp, Homo sapiens
atgtgtgtgtatatacacacat

SEQ ID NO: 7624511 - DNA, 22 bp, Homo sapiens
atgtgtttggttatatggtatt

SEQ ID NO: 7624512 - DNA, 22 bp, Homo sapiens
atgtgtttggttatatggtatt

SEQ ID NO: 7624513 - DNA, 22 bp, Homo sapiens
atgtgtttaccaggggaacatg

SEQ ID NO: 7624514 - DNA, 22 bp, Homo sapiens
atgtgtttaccaggggaacatg

SEQ ID NO: 7624515 - DNA, 22 bp, Homo sapiens
atgtgtttataattactcaatc

SEQ ID NO: 7624516 - DNA, 22 bp, Homo sapiens
atgtgtttataattactcaatc

SEQ ID NO: 7624517 - DNA, 22 bp, Homo sapiens
atgtgtttataattactcaatc

SEQ ID NO: 7624518 - DNA, 22 bp, Homo sapiens
atgtgtttataattactcaatc

SEQ ID NO: 7624519 - DNA, 22 bp, Homo sapiens
atgtgtttgtacctttaaatat

SEQ ID NO: 7624520 - DNA, 22 bp, Homo sapiens
atgtgtttgtacctttaaatat

SEQ ID NO: 7624521 - DNA, 22 bp, Homo sapiens
atgtgtttgtacctttaaatat

SEQ ID NO: 7624522 - DNA, 22 bp, Homo sapiens
atgtgtttggttatatggtatt

SEQ ID NO: 7624523 - DNA, 22 bp, Homo sapiens
atgtgtttgtacctttaaatat

SEQ ID NO: 7624524 - DNA, 22 bp, Homo sapiens
atgtgtttgtcctgcagaaata

SEQ ID NO: 7624525 - DNA, 22 bp, Homo sapiens
atgtgtttgtacctttaaatat

SEQ ID NO: 7624526 - DNA, 22 bp, Homo sapiens
atgtgtttgtcctgcagaaata

SEQ ID NO: 7624527 - DNA, 22 bp, Homo sapiens
atgtgtttgtcctgcagaaata

SEQ ID NO: 7624528 - DNA, 22 bp, Homo sapiens
atgtttctcactgtttctctat

SEQ ID NO: 7624529 - DNA, 22 bp, Homo sapiens
atgttaaaaaccagtacagttg

SEQ ID NO: 7624530 - DNA, 20 bp, Homo sapiens
atgtttctctgtcgtgattt

SEQ ID NO: 7624531 - DNA, 22 bp, Homo sapiens
atgttaaaaaccagtacagttg

SEQ ID NO: 7624532 - DNA, 22 bp, Homo sapiens
atgttaaaaaccagtacagttg

SEQ ID NO: 7624533 - DNA, 22 bp, Homo sapiens
atgttaaaaaccagtacagttg

SEQ ID NO: 7624534 - DNA, 22 bp, Homo sapiens
atgttaaaaaccagtacagttg

SEQ ID NO: 7624535 - DNA, 22 bp, Homo sapiens
atgtgtttttattctggcatgt

SEQ ID NO: 7624536 - DNA, 22 bp, Homo sapiens
atgtgtttttattctggcatgt

SEQ ID NO: 7624537 - DNA, 22 bp, Homo sapiens
atgtgttttggtaatttctgct

SEQ ID NO: 7624538 - DNA, 22 bp, Homo sapiens
atgtgttttggtggatcattca

SEQ ID NO: 7624539 - DNA, 22 bp, Homo sapiens
atgtgttttggtggatcattca

SEQ ID NO: 7624540 - DNA, 22 bp, Homo sapiens
atgtgttttggtaatttctgct

SEQ ID NO: 7624541 - DNA, 22 bp, Homo sapiens
atgtgttttggtaatttctgct

SEQ ID NO: 7624542 - DNA, 22 bp, Homo sapiens
atgtgttttggtaatttctgct

SEQ ID NO: 7624543 - DNA, 22 bp, Homo sapiens
atgtgttttggtaatttctgct

SEQ ID NO: 7624544 - DNA, 22 bp, Homo sapiens
atgtgttttggtaatttctgct

SEQ ID NO: 7624545 - DNA, 22 bp, Homo sapiens
atgttttctagagtttaaaatc

SEQ ID NO: 7624546 - DNA, 22 bp, Homo sapiens
atgttttctagagtttaaaatc

SEQ ID NO: 7624547 - DNA, 22 bp, Homo sapiens
atgttttctagagtttaaaatc

SEQ ID NO: 7624548 - DNA, 22 bp, Homo sapiens
atgttttctagagtttaaaatc

SEQ ID NO: 7624549 - DNA, 22 bp, Homo sapiens
atgttttctagagtttaaaatc

SEQ ID NO: 7624550 - DNA, 22 bp, Homo sapiens
atgttttctagagtttaaaatc

SEQ ID NO: 7624551 - DNA, 22 bp, Homo sapiens
atgttttctagagtttaaaatc

SEQ ID NO: 7624552 - DNA, 22 bp, Homo sapiens
atgttttcctgggagagcactc

SEQ ID NO: 7624553 - DNA, 22 bp, Homo sapiens
atgttttcctgggagagcactc

SEQ ID NO: 7624554 - DNA, 22 bp, Homo sapiens
atgttttgctggatgttggcta

SEQ ID NO: 7624555 - DNA, 22 bp, Homo sapiens
atgttttgctggatgttggcta

SEQ ID NO: 7624556 - DNA, 22 bp, Homo sapiens
atgttttctttcagacttccct

SEQ ID NO: 7624557 - DNA, 22 bp, Homo sapiens
atgttttgattggttaggtctg

SEQ ID NO: 7624558 - DNA, 22 bp, Homo sapiens
atgttttgattggttaggtctg

SEQ ID NO: 7624559 - DNA, 22 bp, Homo sapiens
atgttttctccatgttatgctt

SEQ ID NO: 7624560 - DNA, 22 bp, Homo sapiens
atgttttctccatgttatgctt

SEQ ID NO: 7624561 - DNA, 22 bp, Homo sapiens
atgttttctttcagacttccct

SEQ ID NO: 7624562 - DNA, 22 bp, Homo sapiens
atgttttctttcagacttccct

SEQ ID NO: 7624563 - DNA, 22 bp, Homo sapiens
atgttttccattgccatggaaa

SEQ ID NO: 7624564 - DNA, 22 bp, Homo sapiens
atgttttccattgccatggaaa

SEQ ID NO: 7624565 - DNA, 22 bp, Homo sapiens
atgttttcaaagtaaacttgta

SEQ ID NO: 7624566 - DNA, 22 bp, Homo sapiens
atgttttccccaaatgatcttc

SEQ ID NO: 7624567 - DNA, 22 bp, Homo sapiens
atgttttccccaaatgatcttc

SEQ ID NO: 7624568 - DNA, 22 bp, Homo sapiens
atgttttccccaaatgatcttc

SEQ ID NO: 7624569 - DNA, 22 bp, Homo sapiens
atgttttccattgccatggaaa

SEQ ID NO: 7624570 - DNA, 22 bp, Homo sapiens
atgttttcctgggagagcactc

SEQ ID NO: 7624571 - DNA, 22 bp, Homo sapiens
atgttttccccaaatgatcttc

SEQ ID NO: 7624572 - DNA, 22 bp, Homo sapiens
atgttttattaccaacttgtac

SEQ ID NO: 7624573 - DNA, 22 bp, Homo sapiens
atgttttattaccaacttgtac

SEQ ID NO: 7624574 - DNA, 22 bp, Homo sapiens
atgttttattaccaacttgtac

SEQ ID NO: 7624575 - DNA, 22 bp, Homo sapiens
atgttttattaccaacttgtac

SEQ ID NO: 7624576 - DNA, 22 bp, Homo sapiens
atgttttattaccaacttgtac

SEQ ID NO: 7624577 - DNA, 22 bp, Homo sapiens
atgttttattaccaacttgtac

SEQ ID NO: 7624578 - DNA, 22 bp, Homo sapiens
atgttttcaaagtaaacttgta

SEQ ID NO: 7624579 - DNA, 22 bp, Homo sapiens
atgttttcaaagtaaacttgta

SEQ ID NO: 7624580 - DNA, 22 bp, Homo sapiens
atgttttatgcttcagatgagg

SEQ ID NO: 7624581 - DNA, 22 bp, Homo sapiens
atgttttatgcttcagatgagg

SEQ ID NO: 7624582 - DNA, 19 bp, Homo sapiens
atgttttatgctgatggga

SEQ ID NO: 7624583 - DNA, 19 bp, Homo sapiens
atgttttatgctgatggga

SEQ ID NO: 7624584 - DNA, 19 bp, Homo sapiens
atgttttatgctgatggga

SEQ ID NO: 7624585 - DNA, 22 bp, Homo sapiens
atgttttatattttgcagcagt

SEQ ID NO: 7624586 - DNA, 22 bp, Homo sapiens
atgttttatattttgcagcagt

SEQ ID NO: 7624587 - DNA, 22 bp, Homo sapiens
atgttttatgcttcagatgagg

SEQ ID NO: 7624588 - DNA, 22 bp, Homo sapiens
atgttttatgcttcagatgagg

SEQ ID NO: 7624589 - DNA, 22 bp, Homo sapiens
atgttttatgcttcagatgagg

SEQ ID NO: 7624590 - DNA, 22 bp, Homo sapiens
atgttttatgcttcagatgagg

SEQ ID NO: 7624591 - DNA, 22 bp, Homo sapiens
atgttttatgcttcagatgagg

SEQ ID NO: 7624592 - DNA, 22 bp, Homo sapiens
atgttttatgttccactcaagg

SEQ ID NO: 7624593 - DNA, 22 bp, Homo sapiens
atgttttatgttccactcaagg

SEQ ID NO: 7624594 - DNA, 23 bp, Homo sapiens
atgttttatgtctctagctgcca

SEQ ID NO: 7624595 - DNA, 22 bp, Homo sapiens
atgttttatgttccactcaagg

SEQ ID NO: 7624596 - DNA, 22 bp, Homo sapiens
atgttttatgttccactcaagg

SEQ ID NO: 7624597 - DNA, 22 bp, Homo sapiens
atgttttatgttccactcaagg

SEQ ID NO: 7624598 - DNA, 22 bp, Homo sapiens
atgttttatgttccactcaagg

SEQ ID NO: 7624599 - DNA, 20 bp, Homo sapiens
atgttttataaaagaacggg

SEQ ID NO: 7624600 - DNA, 20 bp, Homo sapiens
atgttttataaaagaacggg

SEQ ID NO: 7624601 - DNA, 22 bp, Homo sapiens
atgttttaccctttgcacaaac

SEQ ID NO: 7624602 - DNA, 22 bp, Homo sapiens
atgttttaccctttgcacaaac

SEQ ID NO: 7624603 - DNA, 18 bp, Homo sapiens
atgtttctcttggctctg

SEQ ID NO: 7624604 - DNA, 22 bp, Homo sapiens
atgtttctgaagtttacagata

SEQ ID NO: 7624605 - DNA, 22 bp, Homo sapiens
atgtttctgaagtttacagata

SEQ ID NO: 7624606 - DNA, 22 bp, Homo sapiens
atgtttctgaagtttacagata

SEQ ID NO: 7624607 - DNA, 22 bp, Homo sapiens
atgtttctgaagtttacagata

SEQ ID NO: 7624608 - DNA, 22 bp, Homo sapiens
atgtttctgaagtttacagata

SEQ ID NO: 7624609 - DNA, 22 bp, Homo sapiens
atgttttaccctttgcacaaac

SEQ ID NO: 7624610 - DNA, 22 bp, Homo sapiens
atgttttatattttgcagcagt

SEQ ID NO: 7624611 - DNA, 22 bp, Homo sapiens
atgttttatattttgcagcagt

SEQ ID NO: 7624612 - DNA, 22 bp, Homo sapiens
atgttttatattttgcagcagt

SEQ ID NO: 7624613 - DNA, 22 bp, Homo sapiens
atgttttatattttgcagcagt

SEQ ID NO: 7624614 - DNA, 22 bp, Homo sapiens
atgttttatattttgcagcagt

SEQ ID NO: 7624615 - DNA, 20 bp, Homo sapiens
atgttttataaaagaacggg

SEQ ID NO: 7624616 - DNA, 20 bp, Homo sapiens
atgttttataaaagaacggg

SEQ ID NO: 7624617 - DNA, 22 bp, Homo sapiens
atgttttaccctttgcacaaac

SEQ ID NO: 7624618 - DNA, 20 bp, Homo sapiens
atgttttataaaagaacggg

SEQ ID NO: 7624619 - DNA, 20 bp, Homo sapiens
atgttttataaaagaacggg

SEQ ID NO: 7624620 - DNA, 22 bp, Homo sapiens
atgtttttgagatacaaacaga

SEQ ID NO: 7624621 - DNA, 22 bp, Homo sapiens
atgtttttggaaatgggaacat

SEQ ID NO: 7624622 - DNA, 22 bp, Homo sapiens
atgtttttggcttcaagtttct

SEQ ID NO: 7624623 - DNA, 22 bp, Homo sapiens
atgtttttggcttcaagtttct

SEQ ID NO: 7624624 - DNA, 22 bp, Homo sapiens
atgtttttggaaatgggaacat

SEQ ID NO: 7624625 - DNA, 22 bp, Homo sapiens
atgtttttggaaatgggaacat

SEQ ID NO: 7624626 - DNA, 22 bp, Homo sapiens
atgtttttggaaatgggaacat

SEQ ID NO: 7624627 - DNA, 22 bp, Homo sapiens
atgtttttggaaatgggaacat

SEQ ID NO: 7624628 - DNA, 22 bp, Homo sapiens
attaaaactaaaatgcctgatt

SEQ ID NO: 7624629 - DNA, 22 bp, Homo sapiens
atgtttttggcttcaagtttct

SEQ ID NO: 7624630 - DNA, 22 bp, Homo sapiens
atgtttttggcttcaagtttct

SEQ ID NO: 7624631 - DNA, 22 bp, Homo sapiens
atgtttttggcttcaagtttct

SEQ ID NO: 7624632 - DNA, 22 bp, Homo sapiens
attaaaagagataatgtgtgtt

SEQ ID NO: 7624633 - DNA, 22 bp, Homo sapiens
attaaaagcttcccaagagtta

SEQ ID NO: 7624634 - DNA, 22 bp, Homo sapiens
attaaaagagataatgtgtgtt

SEQ ID NO: 7624635 - DNA, 22 bp, Homo sapiens
atgtttttaaatagacttacag

SEQ ID NO: 7624636 - DNA, 22 bp, Homo sapiens
atgtttttaaatagacttacag

SEQ ID NO: 7624637 - DNA, 22 bp, Homo sapiens
atgtttttcataccagtgttgg

SEQ ID NO: 7624638 - DNA, 22 bp, Homo sapiens
atgtttttcataccagtgttgg

SEQ ID NO: 7624639 - DNA, 22 bp, Homo sapiens
atgtttttcataccagtgttgg

SEQ ID NO: 7624640 - DNA, 22 bp, Homo sapiens
atgtttttcataccagtgttgg

SEQ ID NO: 7624641 - DNA, 22 bp, Homo sapiens
atgtttttcataccagtgttgg

SEQ ID NO: 7624642 - DNA, 22 bp, Homo sapiens
atgtttttcataccagtgttgg

SEQ ID NO: 7624643 - DNA, 22 bp, Homo sapiens
atgtttttcataccagtgttgg

SEQ ID NO: 7624644 - DNA, 22 bp, Homo sapiens
atgtttttgagatacaaacaga

SEQ ID NO: 7624645 - DNA, 22 bp, Homo sapiens
atgtttttgagatacaaacaga

SEQ ID NO: 7624646 - DNA, 22 bp, Homo sapiens
atgtttttgagatacaaacaga

SEQ ID NO: 7624647 - DNA, 22 bp, Homo sapiens
atgtttttgagatacaaacaga

SEQ ID NO: 7624648 - DNA, 22 bp, Homo sapiens
atgtttttgagatacaaacaga

SEQ ID NO: 7624649 - DNA, 22 bp, Homo sapiens
atgtttttgagatacaaacaga

SEQ ID NO: 7624650 - DNA, 22 bp, Homo sapiens
atgtttttgagatacaaacaga

SEQ ID NO: 7624651 - DNA, 22 bp, Homo sapiens
atgtttttgagatacaaacaga

SEQ ID NO: 7624652 - DNA, 22 bp, Homo sapiens
atgtttttcataccagtgttgg

SEQ ID NO: 7624653 - DNA, 22 bp, Homo sapiens
atgtttttgagatacaaacaga

SEQ ID NO: 7624654 - DNA, 22 bp, Homo sapiens
atgtttttgagatacaaacaga

SEQ ID NO: 7624655 - DNA, 22 bp, Homo sapiens
attaaatactgcaggctaagca

SEQ ID NO: 7624656 - DNA, 22 bp, Homo sapiens
attaaatactgcaggctaagca

SEQ ID NO: 7624657 - DNA, 22 bp, Homo sapiens
attaaatactgcaggctaagca

SEQ ID NO: 7624658 - DNA, 22 bp, Homo sapiens
attaaatactgcaggctaagca

SEQ ID NO: 7624659 - DNA, 22 bp, Homo sapiens
attaaatgatggcatgtcttat

SEQ ID NO: 7624660 - DNA, 22 bp, Homo sapiens
attaaatgatggcatgtcttat

SEQ ID NO: 7624661 - DNA, 22 bp, Homo sapiens
attaaatgatggcatgtcttat

SEQ ID NO: 7624662 - DNA, 22 bp, Homo sapiens
attaaatggtggtcattcattt

SEQ ID NO: 7624663 - DNA, 22 bp, Homo sapiens
attaaatggtggtcattcattt

SEQ ID NO: 7624664 - DNA, 22 bp, Homo sapiens
attaaatgatggcatgtcttat

SEQ ID NO: 7624665 - DNA, 22 bp, Homo sapiens
attaaatgatggcatgtcttat

SEQ ID NO: 7624666 - DNA, 22 bp, Homo sapiens
attaaatgttccttaaattata

SEQ ID NO: 7624667 - DNA, 22 bp, Homo sapiens
attaaatgttccttaaattata

SEQ ID NO: 7624668 - DNA, 22 bp, Homo sapiens
attaaatgttccttaaattata

SEQ ID NO: 7624669 - DNA, 22 bp, Homo sapiens
attaaatgttccttaaattata

SEQ ID NO: 7624670 - DNA, 22 bp, Homo sapiens
attaaatggtggtcattcattt

SEQ ID NO: 7624671 - DNA, 22 bp, Homo sapiens
attaaatggtggtcattcattt

SEQ ID NO: 7624672 - DNA, 22 bp, Homo sapiens
attaaatggtggtcattcattt

SEQ ID NO: 7624673 - DNA, 22 bp, Homo sapiens
attaaaattccaaggtatgcca

SEQ ID NO: 7624674 - DNA, 22 bp, Homo sapiens
attaaaattccaaggtatgcca

SEQ ID NO: 7624675 - DNA, 22 bp, Homo sapiens
attaaaattccaaggtatgcca

SEQ ID NO: 7624676 - DNA, 22 bp, Homo sapiens
attaaaattccaaggtatgcca

SEQ ID NO: 7624677 - DNA, 22 bp, Homo sapiens
attaaaagcttcccaagagtta

SEQ ID NO: 7624678 - DNA, 22 bp, Homo sapiens
attaaaagcttcccaagagtta

SEQ ID NO: 7624679 - DNA, 22 bp, Homo sapiens
attaaaagcttcccaagagtta

SEQ ID NO: 7624680 - DNA, 22 bp, Homo sapiens
attaaaagcttcccaagagtta

SEQ ID NO: 7624681 - DNA, 22 bp, Homo sapiens
attaaaagcttcccaagagtta

SEQ ID NO: 7624682 - DNA, 22 bp, Homo sapiens
attaaaagcttcccaagagtta

SEQ ID NO: 7624683 - DNA, 22 bp, Homo sapiens
attaaacaatgtaaagttcttg

SEQ ID NO: 7624684 - DNA, 22 bp, Homo sapiens
attaaacaatgtaaagttcttg

SEQ ID NO: 7624685 - DNA, 22 bp, Homo sapiens
attaaatactgcaggctaagca

SEQ ID NO: 7624686 - DNA, 22 bp, Homo sapiens
attaaatactgcaggctaagca

SEQ ID NO: 7624687 - DNA, 22 bp, Homo sapiens
attaaaattccaaggtatgcca

SEQ ID NO: 7624688 - DNA, 22 bp, Homo sapiens
attaaaattccaaggtatgcca

SEQ ID NO: 7624689 - DNA, 22 bp, Homo sapiens
attaaaattccaaggtatgcca

SEQ ID NO: 7624690 - DNA, 22 bp, Homo sapiens
attaaaattccaaggtatgcca

SEQ ID NO: 7624691 - DNA, 22 bp, Homo sapiens
attaaattaagtggctaattta

SEQ ID NO: 7624692 - DNA, 22 bp, Homo sapiens
attaaattagcaaactgtgaaa

SEQ ID NO: 7624693 - DNA, 22 bp, Homo sapiens
attaaattaagtggctaattta

SEQ ID NO: 7624694 - DNA, 22 bp, Homo sapiens
attaaattaagtggctaattta

SEQ ID NO: 7624695 - DNA, 22 bp, Homo sapiens
attaaattaagtggctaattta

SEQ ID NO: 7624696 - DNA, 22 bp, Homo sapiens
attaaattaagtggctaattta

SEQ ID NO: 7624697 - DNA, 22 bp, Homo sapiens
attaaattagcaaactgtgaaa

SEQ ID NO: 7624698 - DNA, 22 bp, Homo sapiens
attaaattagcaaactgtgaaa

SEQ ID NO: 7624699 - DNA, 22 bp, Homo sapiens
gatgaggcaagccagaggactg

SEQ ID NO: 7624700 - DNA, 22 bp, Homo sapiens
gatgaggcaagccagaggactg

SEQ ID NO: 7624701 - DNA, 22 bp, Homo sapiens
attaaattagcaaactgtgaaa

SEQ ID NO: 7624702 - DNA, 22 bp, Homo sapiens
attaaattagcaaactgtgaaa

SEQ ID NO: 7624703 - DNA, 22 bp, Homo sapiens
gatgaggaatttgaggttagaa

SEQ ID NO: 7624704 - DNA, 22 bp, Homo sapiens
attaaatgttccttaaattata

SEQ ID NO: 7624705 - DNA, 22 bp, Homo sapiens
attaaatgttccttaaattata

SEQ ID NO: 7624706 - DNA, 22 bp, Homo sapiens
attaaatgttccttaaattata

SEQ ID NO: 7624707 - DNA, 22 bp, Homo sapiens
attaaatgttccttaaattata

SEQ ID NO: 7624708 - DNA, 22 bp, Homo sapiens
attaaatgttccttaaattata

SEQ ID NO: 7624709 - DNA, 22 bp, Homo sapiens
attaaatgttggacgtatacat

SEQ ID NO: 7624710 - DNA, 22 bp, Homo sapiens
attaaatgttggacgtatacat

SEQ ID NO: 7624711 - DNA, 22 bp, Homo sapiens
attaaatgttccttaaattata

SEQ ID NO: 7624712 - DNA, 22 bp, Homo sapiens
attaaatgttccttaaattata

SEQ ID NO: 7624713 - DNA, 22 bp, Homo sapiens
attaaatgttccttaaattata

SEQ ID NO: 7624714 - DNA, 22 bp, Homo sapiens
attaaatgttggacgtatacat

SEQ ID NO: 7624715 - DNA, 22 bp, Homo sapiens
attaaatgttggacgtatacat

SEQ ID NO: 7624716 - DNA, 22 bp, Homo sapiens
attaaatgttggcatattttgt

SEQ ID NO: 7624717 - DNA, 22 bp, Homo sapiens
attaaatgttggcatattttgt

SEQ ID NO: 7624718 - DNA, 22 bp, Homo sapiens
attaaatgttggcatattttgt

SEQ ID NO: 7624719 - DNA, 22 bp, Homo sapiens
attaaattaagtggctaattta

SEQ ID NO: 7624720 - DNA, 22 bp, Homo sapiens
attaaatgttggcatattttgt

SEQ ID NO: 7624721 - DNA, 22 bp, Homo sapiens
attaaatgttggcatattttgt

SEQ ID NO: 7624722 - DNA, 22 bp, Homo sapiens
attaaatgttggcatattttgt

SEQ ID NO: 7624723 - DNA, 22 bp, Homo sapiens
attaaatgttggacgtatacat

SEQ ID NO: 7624724 - DNA, 22 bp, Homo sapiens
gatgagttctttctattctatt

SEQ ID NO: 7624725 - DNA, 22 bp, Homo sapiens
gatgagtaatagctaatggttc

SEQ ID NO: 7624726 - DNA, 21 bp, Homo sapiens
gatgagttttctgtgatgttc

SEQ ID NO: 7624727 - DNA, 22 bp, Homo sapiens
gatgatatatatggaaagccta

SEQ ID NO: 7624728 - DNA, 22 bp, Homo sapiens
gatgaggggtcattggctggga

SEQ ID NO: 7624729 - DNA, 22 bp, Homo sapiens
gatgagggcctggtggctgtgc

SEQ ID NO: 7624730 - DNA, 22 bp, Homo sapiens
gatgaggggtcattggctggga

SEQ ID NO: 7624731 - DNA, 22 bp, Homo sapiens
gatgaggggtcattggctggga

SEQ ID NO: 7624732 - DNA, 22 bp, Homo sapiens
gatgaggtctacattgttaaaa

SEQ ID NO: 7624733 - DNA, 22 bp, Homo sapiens
gatgaggtcatgttttacatat

SEQ ID NO: 7624734 - DNA, 18 bp, Homo sapiens
gatgaggctgtctgagaa

SEQ ID NO: 7624735 - DNA, 18 bp, Homo sapiens
gatgaggctgtctgagaa

SEQ ID NO: 7624736 - DNA, 22 bp, Homo sapiens
gatgaggctgtagagggtggca

SEQ ID NO: 7624737 - DNA, 18 bp, Homo sapiens
gatgaggctgtctgagaa

SEQ ID NO: 7624738 - DNA, 22 bp, Homo sapiens
gatgaggctgtgtctgcacaag

SEQ ID NO: 7624739 - DNA, 22 bp, Homo sapiens
gatgaggctgtgtctgcacaag

SEQ ID NO: 7624740 - DNA, 22 bp, Homo sapiens
gatgagggcctggtggctgtgc

SEQ ID NO: 7624741 - DNA, 22 bp, Homo sapiens
gatgagggcctggtggctgtgc

SEQ ID NO: 7624742 - DNA, 22 bp, Homo sapiens
gatgagggcctggtggctgtgc

SEQ ID NO: 7624743 - DNA, 22 bp, Homo sapiens
gatgaggcaagccagaggactg

SEQ ID NO: 7624744 - DNA, 22 bp, Homo sapiens
gatgaggcagctcagggggaaa

SEQ ID NO: 7624745 - DNA, 22 bp, Homo sapiens
gatgaggcaggagtttgcttgt

SEQ ID NO: 7624746 - DNA, 22 bp, Homo sapiens
gatgaggcgagcacgttgtttg

SEQ ID NO: 7624747 - DNA, 22 bp, Homo sapiens
gatgaggccacacggggtgggc

SEQ ID NO: 7624748 - DNA, 22 bp, Homo sapiens
gatgaggccacacggggtgggc

SEQ ID NO: 7624749 - DNA, 22 bp, Homo sapiens
gatgaggctgtagagggtggca

SEQ ID NO: 7624750 - DNA, 22 bp, Homo sapiens
gatgaggctgtagagggtggca

SEQ ID NO: 7624751 - DNA, 22 bp, Homo sapiens
gatgaggctagagacatgtgta

SEQ ID NO: 7624752 - DNA, 22 bp, Homo sapiens
atttattgagagggaggggaat

SEQ ID NO: 7624753 - DNA, 22 bp, Homo sapiens
atttattgagagggaggggaat

SEQ ID NO: 7624754 - DNA, 22 bp, Homo sapiens
atttattgagagggaggggaat

SEQ ID NO: 7624755 - DNA, 22 bp, Homo sapiens
atttattgagagggaggggaat

SEQ ID NO: 7624756 - DNA, 22 bp, Homo sapiens
atttattgagagggaggggaat

SEQ ID NO: 7624757 - DNA, 22 bp, Homo sapiens
atttattgagagggaggggaat

SEQ ID NO: 7624758 - DNA, 22 bp, Homo sapiens
atttattgagcctttcctatgt

SEQ ID NO: 7624759 - DNA, 22 bp, Homo sapiens
atttattgagcctttcctatgt

SEQ ID NO: 7624760 - DNA, 22 bp, Homo sapiens
atttattgagcctttcctatgt

SEQ ID NO: 7624761 - DNA, 22 bp, Homo sapiens
atttattgagcctttcctatgt

SEQ ID NO: 7624762 - DNA, 22 bp, Homo sapiens
atttattgagcctttcctatgt

SEQ ID NO: 7624763 - DNA, 22 bp, Homo sapiens
atttattgagcctttcctatgt

SEQ ID NO: 7624764 - DNA, 22 bp, Homo sapiens
atttattgagcctttcctatgt

SEQ ID NO: 7624765 - DNA, 22 bp, Homo sapiens
atttattgagagggaggggaat

SEQ ID NO: 7624766 - DNA, 22 bp, Homo sapiens
atttattgagacttaacaaccc

SEQ ID NO: 7624767 - DNA, 22 bp, Homo sapiens
atttattgagacttaacaaccc

SEQ ID NO: 7624768 - DNA, 22 bp, Homo sapiens
atttattgagacttaacaaccc

SEQ ID NO: 7624769 - DNA, 22 bp, Homo sapiens
atttattgagacttaacaaccc

SEQ ID NO: 7624770 - DNA, 22 bp, Homo sapiens
atttattgagacttaacaaccc

SEQ ID NO: 7624771 - DNA, 22 bp, Homo sapiens
atttattgagacttaacaaccc

SEQ ID NO: 7624772 - DNA, 22 bp, Homo sapiens
atttattgagacttaacaaccc

SEQ ID NO: 7624773 - DNA, 22 bp, Homo sapiens
atttattgagacttaacaaccc

SEQ ID NO: 7624774 - DNA, 22 bp, Homo sapiens
atttattgagacttaacaaccc

SEQ ID NO: 7624775 - DNA, 22 bp, Homo sapiens
atttattgagacttaacaaccc

SEQ ID NO: 7624776 - DNA, 22 bp, Homo sapiens
atttattatgggatttggcaca

SEQ ID NO: 7624777 - DNA, 21 bp, Homo sapiens
atttagaaggaaattttgcaa

SEQ ID NO: 7624778 - DNA, 22 bp, Homo sapiens
atttagaagctaatttttcaga

SEQ ID NO: 7624779 - DNA, 22 bp, Homo sapiens
atttattatgggatttggcaca

SEQ ID NO: 7624780 - DNA, 22 bp, Homo sapiens
atttattatgggatttggctca

SEQ ID NO: 7624781 - DNA, 22 bp, Homo sapiens
atttattatgggatttggctca

SEQ ID NO: 7624782 - DNA, 22 bp, Homo sapiens
atttattatgggatttggctca

SEQ ID NO: 7624783 - DNA, 22 bp, Homo sapiens
atttattatgggatttggctca

SEQ ID NO: 7624784 - DNA, 22 bp, Homo sapiens
atttattatgggatttggctca

SEQ ID NO: 7624785 - DNA, 22 bp, Homo sapiens
atttattatgggatttggctca

SEQ ID NO: 7624786 - DNA, 22 bp, Homo sapiens
atttattgagacttaacaaccc

SEQ ID NO: 7624787 - DNA, 22 bp, Homo sapiens
atttattggatgcttacttggg

SEQ ID NO: 7624788 - DNA, 22 bp, Homo sapiens
atttattggatgcttacttggg

SEQ ID NO: 7624789 - DNA, 22 bp, Homo sapiens
atttattggatgcttacttggg

SEQ ID NO: 7624790 - DNA, 22 bp, Homo sapiens
atttattggatgcttacttggg

SEQ ID NO: 7624791 - DNA, 22 bp, Homo sapiens
atttattggatgcttacttggg

SEQ ID NO: 7624792 - DNA, 22 bp, Homo sapiens
atttattgagcctttcctatgt

SEQ ID NO: 7624793 - DNA, 22 bp, Homo sapiens
atttattgagcctttcctatgt

SEQ ID NO: 7624794 - DNA, 22 bp, Homo sapiens
atttattgagcctttcctatgt

SEQ ID NO: 7624795 - DNA, 22 bp, Homo sapiens
atttattggatgcttacttggg

SEQ ID NO: 7624796 - DNA, 22 bp, Homo sapiens
atttattggatgcttacttggg

SEQ ID NO: 7624797 - DNA, 22 bp, Homo sapiens
atttattggatgcttacttggg

SEQ ID NO: 7624798 - DNA, 22 bp, Homo sapiens
atttattggatgcttacttggg

SEQ ID NO: 7624799 - DNA, 22 bp, Homo sapiens
atttattggatgcttacttggg

SEQ ID NO: 7624800 - DNA, 22 bp, Homo sapiens
atttattggatgcttacttggg

SEQ ID NO: 7624801 - DNA, 22 bp, Homo sapiens
gccaggcatttgttaggtgctg

SEQ ID NO: 7624802 - DNA, 22 bp, Homo sapiens
gccaggcatttgttaggtgctg

SEQ ID NO: 7624803 - DNA, 22 bp, Homo sapiens
gccaggcatttgttaggtgctg

SEQ ID NO: 7624804 - DNA, 22 bp, Homo sapiens
gccaggcatttgttaggtgctg

SEQ ID NO: 7624805 - DNA, 22 bp, Homo sapiens
gccaggccactcccgggtcctg

SEQ ID NO: 7624806 - DNA, 22 bp, Homo sapiens
gccaggcatttgttaggtgctg

SEQ ID NO: 7624807 - DNA, 22 bp, Homo sapiens
gccaggccactcccgggtcctg

SEQ ID NO: 7624808 - DNA, 22 bp, Homo sapiens
gccaggcatttgttaggtgctg

SEQ ID NO: 7624809 - DNA, 22 bp, Homo sapiens
gccaggcatttgttaggtgctg

SEQ ID NO: 7624810 - DNA, 22 bp, Homo sapiens
gccaggcattctagaagtagtg

SEQ ID NO: 7624811 - DNA, 22 bp, Homo sapiens
gccaggcattctagaagtagtg

SEQ ID NO: 7624812 - DNA, 22 bp, Homo sapiens
gccaggcattctagaagtagtg

SEQ ID NO: 7624813 - DNA, 22 bp, Homo sapiens
atttattggtttgcatggtgaa

SEQ ID NO: 7624814 - DNA, 22 bp, Homo sapiens
atttattggtttgcatggtgaa

SEQ ID NO: 7624815 - DNA, 22 bp, Homo sapiens
atttattggtttgcatggtgaa

SEQ ID NO: 7624816 - DNA, 22 bp, Homo sapiens
gccaggcattctagaagtagtg

SEQ ID NO: 7624817 - DNA, 22 bp, Homo sapiens
gccaggcatttattgattgaat

SEQ ID NO: 7624818 - DNA, 22 bp, Homo sapiens
gccaggcatttattgattgaat

SEQ ID NO: 7624819 - DNA, 22 bp, Homo sapiens
gccaggcatttattgattgaat

SEQ ID NO: 7624820 - DNA, 22 bp, Homo sapiens
gccaggcatttattgattgaat

SEQ ID NO: 7624821 - DNA, 22 bp, Homo sapiens
gccaggcctgcaagtgctggtg

SEQ ID NO: 7624822 - DNA, 22 bp, Homo sapiens
gccaggcctgcaagtgctggtg

SEQ ID NO: 7624823 - DNA, 22 bp, Homo sapiens
gccaggcctgcaagtgctggtg

SEQ ID NO: 7624824 - DNA, 22 bp, Homo sapiens
gccaggcctgcaagtgctggtg

SEQ ID NO: 7624825 - DNA, 22 bp, Homo sapiens
gccaggcctgcaagtgctggtg

SEQ ID NO: 7624826 - DNA, 22 bp, Homo sapiens
gccaggccctgggcacttcgtg

SEQ ID NO: 7624827 - DNA, 22 bp, Homo sapiens
gccaggccctgggcacttcgtg

SEQ ID NO: 7624828 - DNA, 22 bp, Homo sapiens
gccaggccctgggcacttcgtg

SEQ ID NO: 7624829 - DNA, 22 bp, Homo sapiens
gccaggccctgggcacttcgtg

SEQ ID NO: 7624830 - DNA, 22 bp, Homo sapiens
gccaggccctgggcacttcgtg

SEQ ID NO: 7624831 - DNA, 22 bp, Homo sapiens
gccaggccctgggcacttcgtg

SEQ ID NO: 7624832 - DNA, 22 bp, Homo sapiens
gccaggccctgggcacttcgtg

SEQ ID NO: 7624833 - DNA, 22 bp, Homo sapiens
gccaggccctgggcacttcgtg

SEQ ID NO: 7624834 - DNA, 22 bp, Homo sapiens
gccaggccactcccgggtcctg

SEQ ID NO: 7624835 - DNA, 22 bp, Homo sapiens
gccaggccactcccgggtcctg

SEQ ID NO: 7624836 - DNA, 22 bp, Homo sapiens
gccaggccactcccgggtcctg

SEQ ID NO: 7624837 - DNA, 22 bp, Homo sapiens
atttcacaaaccatcctgattt

SEQ ID NO: 7624838 - DNA, 22 bp, Homo sapiens
atttcacaaaccatcctgattt

SEQ ID NO: 7624839 - DNA, 22 bp, Homo sapiens
atttcacaaaccatcctgattt

SEQ ID NO: 7624840 - DNA, 22 bp, Homo sapiens
atttcaagtgttgagctcataa

SEQ ID NO: 7624841 - DNA, 19 bp, Homo sapiens
gccaggcctggacctgcag

SEQ ID NO: 7624842 - DNA, 22 bp, Homo sapiens
gccaggcctgcaagtgctggtg

SEQ ID NO: 7624843 - DNA, 22 bp, Homo sapiens
gccaggcctgcaagtgctggtg

SEQ ID NO: 7624844 - DNA, 22 bp, Homo sapiens
gccaggcctgcaagtgctggtg

SEQ ID NO: 7624845 - DNA, 19 bp, Homo sapiens
gccaggcctggacctgcag

SEQ ID NO: 7624846 - DNA, 19 bp, Homo sapiens
gccaggcctggacctgcag

SEQ ID NO: 7624847 - DNA, 19 bp, Homo sapiens
gccaggcctggacctgcag

SEQ ID NO: 7624848 - DNA, 22 bp, Homo sapiens
atttcagagtgagagtgctcaa

SEQ ID NO: 7624849 - DNA, 22 bp, Homo sapiens
atttcagagtgagagtgctcaa

SEQ ID NO: 7624850 - DNA, 22 bp, Homo sapiens
atttcagagtagatcgttattt

SEQ ID NO: 7624851 - DNA, 22 bp, Homo sapiens
atttcagagctttgcagctaat

SEQ ID NO: 7624852 - DNA, 22 bp, Homo sapiens
atttcagagctttgcagctaat

SEQ ID NO: 7624853 - DNA, 22 bp, Homo sapiens
atttcagagtagatcgttattt

SEQ ID NO: 7624854 - DNA, 22 bp, Homo sapiens
atttcagagtagatcgttattt

SEQ ID NO: 7624855 - DNA, 22 bp, Homo sapiens
atttcagagtagatcgttattt

SEQ ID NO: 7624856 - DNA, 22 bp, Homo sapiens
atttcagatgaccaaatggaaa

SEQ ID NO: 7624857 - DNA, 22 bp, Homo sapiens
atttcagagtgagagtgctcaa

SEQ ID NO: 7624858 - DNA, 22 bp, Homo sapiens
atttcagatgaccaaatggaaa

SEQ ID NO: 7624859 - DNA, 22 bp, Homo sapiens
atttcagatgaccaaatggaaa

SEQ ID NO: 7624860 - DNA, 22 bp, Homo sapiens
atttcagatgaccaaatggaaa

SEQ ID NO: 7624861 - DNA, 22 bp, Homo sapiens
atttcagattcagaaatgtagg

SEQ ID NO: 7624862 - DNA, 22 bp, Homo sapiens
atttcagattcagaaatgtagg

SEQ ID NO: 7624863 - DNA, 22 bp, Homo sapiens
atttcagattcagaaatgtagg

SEQ ID NO: 7624864 - DNA, 22 bp, Homo sapiens
atttcagatgaccaaatggaaa

SEQ ID NO: 7624865 - DNA, 22 bp, Homo sapiens
atttcagatgaccaaatggaaa

SEQ ID NO: 7624866 - DNA, 22 bp, Homo sapiens
atttcagattcgagaggaagtg

SEQ ID NO: 7624867 - DNA, 22 bp, Homo sapiens
atttcagattcgagaggaagtg

SEQ ID NO: 7624868 - DNA, 22 bp, Homo sapiens
atttcagattcgagaggaagtg

SEQ ID NO: 7624869 - DNA, 22 bp, Homo sapiens
atttcagattcagaaatgtagg

SEQ ID NO: 7624870 - DNA, 22 bp, Homo sapiens
atttcagattcagaaatgtagg

SEQ ID NO: 7624871 - DNA, 22 bp, Homo sapiens
atttcagattcagaaatgtagg

SEQ ID NO: 7624872 - DNA, 21 bp, Homo sapiens
atttcagagcacacaagtaaa

SEQ ID NO: 7624873 - DNA, 21 bp, Homo sapiens
atttcagagcacacaagtaaa

SEQ ID NO: 7624874 - DNA, 21 bp, Homo sapiens
atttcagagcacacaagtaaa

SEQ ID NO: 7624875 - DNA, 22 bp, Homo sapiens
atttcagagaatgaacctaatc

SEQ ID NO: 7624876 - DNA, 22 bp, Homo sapiens
atttcagagaatgaacctaatc

SEQ ID NO: 7624877 - DNA, 22 bp, Homo sapiens
atttcagagaatgaacctaatc

SEQ ID NO: 7624878 - DNA, 21 bp, Homo sapiens
atttcagagcacacaagtaaa

SEQ ID NO: 7624879 - DNA, 21 bp, Homo sapiens
atttcagagcacacaagtaaa

SEQ ID NO: 7624880 - DNA, 21 bp, Homo sapiens
atttcagagcacacaagtaaa

SEQ ID NO: 7624881 - DNA, 21 bp, Homo sapiens
atttcagagcacacaagtaaa

SEQ ID NO: 7624882 - DNA, 22 bp, Homo sapiens
atttcagactgtgttggaaaat

SEQ ID NO: 7624883 - DNA, 22 bp, Homo sapiens
atttcagactgtgttggaaaat

SEQ ID NO: 7624884 - DNA, 22 bp, Homo sapiens
atttcagactgtgttggaaaat

SEQ ID NO: 7624885 - DNA, 22 bp, Homo sapiens
atttcagactgtgttggaaaat

SEQ ID NO: 7624886 - DNA, 22 bp, Homo sapiens
atttcagaatgtcctaatttag

SEQ ID NO: 7624887 - DNA, 22 bp, Homo sapiens
atttcagaatgtcctaatttag

SEQ ID NO: 7624888 - DNA, 22 bp, Homo sapiens
atttcagaatgtcctaatttag

SEQ ID NO: 7624889 - DNA, 21 bp, Homo sapiens
atttcagaaatattggtggga

SEQ ID NO: 7624890 - DNA, 22 bp, Homo sapiens
atttcagaatgtcctaatttag

SEQ ID NO: 7624891 - DNA, 22 bp, Homo sapiens
atttcagaatgtcctaatttag

SEQ ID NO: 7624892 - DNA, 22 bp, Homo sapiens
atttcagtgtcttcttctccct

SEQ ID NO: 7624893 - DNA, 22 bp, Homo sapiens
atttcagtgagaaagcaatcaa

SEQ ID NO: 7624894 - DNA, 22 bp, Homo sapiens
atttcagtgagaaagcaatcaa

SEQ ID NO: 7624895 - DNA, 22 bp, Homo sapiens
atttcagtgttggttagcaagc

SEQ ID NO: 7624896 - DNA, 22 bp, Homo sapiens
atttcagtagtccttacttgta

SEQ ID NO: 7624897 - DNA, 22 bp, Homo sapiens
atttcagtattatacaactgct

SEQ ID NO: 7624898 - DNA, 22 bp, Homo sapiens
atttcagtagaaaatcttgatt

SEQ ID NO: 7624899 - DNA, 22 bp, Homo sapiens
atttcaggtacctgtgggatcc

SEQ ID NO: 7624900 - DNA, 22 bp, Homo sapiens
atttcagggtgtcttccaactg

SEQ ID NO: 7624901 - DNA, 22 bp, Homo sapiens
atttcagggtaaaaagtgttca

SEQ ID NO: 7624902 - DNA, 22 bp, Homo sapiens
atttcagggtaaaaagtgttca

SEQ ID NO: 7624903 - DNA, 22 bp, Homo sapiens
atttcagcagcccatgtttgga

SEQ ID NO: 7624904 - DNA, 22 bp, Homo sapiens
atttcagattcgagaggaagtg

SEQ ID NO: 7624905 - DNA, 22 bp, Homo sapiens
atttcagattcgagaggaagtg

SEQ ID NO: 7624906 - DNA, 22 bp, Homo sapiens
atttcaggagcagtttcagtgg

SEQ ID NO: 7624907 - DNA, 22 bp, Homo sapiens
atttcagcccagtatgagcccc

SEQ ID NO: 7624908 - DNA, 22 bp, Homo sapiens
atttcagctctgccggagagag

SEQ ID NO: 7624909 - DNA, 22 bp, Homo sapiens
atttcagggagtcatttacaca

SEQ ID NO: 7624910 - DNA, 22 bp, Homo sapiens
atttcagggagtcatttacaca

SEQ ID NO: 7624911 - DNA, 22 bp, Homo sapiens
atttcagggagtcatttacaca

SEQ ID NO: 7624912 - DNA, 22 bp, Homo sapiens
atttcaggccaccagatgtctt

SEQ ID NO: 7624913 - DNA, 22 bp, Homo sapiens
atttcaggccaccagatgtctt

SEQ ID NO: 7624914 - DNA, 22 bp, Homo sapiens
atttcagtgttttaagagttca

SEQ ID NO: 7624915 - DNA, 22 bp, Homo sapiens
atttcagtgttttaagagttca

SEQ ID NO: 7624916 - DNA, 20 bp, Homo sapiens
atttcagtgtttgcaatttc

SEQ ID NO: 7624917 - DNA, 22 bp, Homo sapiens
atttcatagattgtaaatccct

SEQ ID NO: 7624918 - DNA, 22 bp, Homo sapiens
atttcatagattgtaaatccct

SEQ ID NO: 7624919 - DNA, 22 bp, Homo sapiens
atttcatagattgtaaatccct

SEQ ID NO: 7624920 - DNA, 22 bp, Homo sapiens
atttcatagattgtaaatccct

SEQ ID NO: 7624921 - DNA, 22 bp, Homo sapiens
atttcatactaaggctcaaaaa

SEQ ID NO: 7624922 - DNA, 22 bp, Homo sapiens
atttcatactaaggctcaaaaa

SEQ ID NO: 7624923 - DNA, 22 bp, Homo sapiens
atttcatactaaggctcaaaaa

SEQ ID NO: 7624924 - DNA, 22 bp, Homo sapiens
atttcatcccaggctctggaag

SEQ ID NO: 7624925 - DNA, 22 bp, Homo sapiens
atttcatccagagtcctattag

SEQ ID NO: 7624926 - DNA, 22 bp, Homo sapiens
atttcatatgtatcacctagcc

SEQ ID NO: 7624927 - DNA, 22 bp, Homo sapiens
atttcatatgtatcacctagcc

SEQ ID NO: 7624928 - DNA, 22 bp, Homo sapiens
atttcatatgtatcacctagcc

SEQ ID NO: 7624929 - DNA, 22 bp, Homo sapiens
atttcatagattgtaaatccct

SEQ ID NO: 7624930 - DNA, 21 bp, Homo sapiens
atttcatggtgcttttaagaa

SEQ ID NO: 7624931 - DNA, 21 bp, Homo sapiens
atttcatggtgcttttaagaa

SEQ ID NO: 7624932 - DNA, 21 bp, Homo sapiens
atttcatggtgcttttaagaa

SEQ ID NO: 7624933 - DNA, 22 bp, Homo sapiens
atttcatggtacatcgtgactt

SEQ ID NO: 7624934 - DNA, 22 bp, Homo sapiens
atttcatgcagaaggaagttgg

SEQ ID NO: 7624935 - DNA, 22 bp, Homo sapiens
atttcatggacatctttggagg

SEQ ID NO: 7624936 - DNA, 16 bp, Homo sapiens
atttcatgggcagtga

SEQ ID NO: 7624937 - DNA, 22 bp, Homo sapiens
atttcatggcagactttaaccc

SEQ ID NO: 7624938 - DNA, 22 bp, Homo sapiens
atttcatggcagactttaaccc

SEQ ID NO: 7624939 - DNA, 22 bp, Homo sapiens
atttcatgagttattatagtgg

SEQ ID NO: 7624940 - DNA, 22 bp, Homo sapiens
atttcatgagctaatggatctc

SEQ ID NO: 7624941 - DNA, 22 bp, Homo sapiens
atttcatgagttattatagtgg

SEQ ID NO: 7624942 - DNA, 22 bp, Homo sapiens
atttcatgagttattatagtgg

SEQ ID NO: 7624943 - DNA, 22 bp, Homo sapiens
atttcatgaaacattccccttg

SEQ ID NO: 7624944 - DNA, 22 bp, Homo sapiens
atttcatgaatgctgctgttga

SEQ ID NO: 7624945 - DNA, 22 bp, Homo sapiens
atttcatgaatgctgctgttga

SEQ ID NO: 7624946 - DNA, 22 bp, Homo sapiens
atttcatgaattccagaagctt

SEQ ID NO: 7624947 - DNA, 22 bp, Homo sapiens
atttcatctctggaacataact

SEQ ID NO: 7624948 - DNA, 22 bp, Homo sapiens
atttccttcggacagtttgggt

SEQ ID NO: 7624949 - DNA, 22 bp, Homo sapiens
atttccttcccagatttggttc

SEQ ID NO: 7624950 - DNA, 22 bp, Homo sapiens
atttccttcccagatttggttc

SEQ ID NO: 7624951 - DNA, 22 bp, Homo sapiens
atttccttcccagatttggttc

SEQ ID NO: 7624952 - DNA, 22 bp, Homo sapiens
atttccttcccagatttggttc

SEQ ID NO: 7624953 - DNA, 22 bp, Homo sapiens
atttccttcccagatttggttc

SEQ ID NO: 7624954 - DNA, 22 bp, Homo sapiens
atttcctagggtagatgtcaca

SEQ ID NO: 7624955 - DNA, 22 bp, Homo sapiens
atttccttcatcagcctatcct

SEQ ID NO: 7624956 - DNA, 22 bp, Homo sapiens
atttcctagggtagatgtcaca

SEQ ID NO: 7624957 - DNA, 22 bp, Homo sapiens
atttcctagcctctcttgcagt

SEQ ID NO: 7624958 - DNA, 22 bp, Homo sapiens
atttcctagggtagatgtcaca

SEQ ID NO: 7624959 - DNA, 22 bp, Homo sapiens
atttcctagcctctcttgcagt

SEQ ID NO: 7624960 - DNA, 22 bp, Homo sapiens
atttcatgtgaagaagagataa

SEQ ID NO: 7624961 - DNA, 22 bp, Homo sapiens
atttcatgtgaagaagagataa

SEQ ID NO: 7624962 - DNA, 22 bp, Homo sapiens
atttcatgtgaagaagagataa

SEQ ID NO: 7624963 - DNA, 22 bp, Homo sapiens
atttcatgtgaagaagagataa

SEQ ID NO: 7624964 - DNA, 22 bp, Homo sapiens
atttcatgtgaagaagagataa

SEQ ID NO: 7624965 - DNA, 21 bp, Homo sapiens
atttcatggtgcttttaagaa

SEQ ID NO: 7624966 - DNA, 22 bp, Homo sapiens
atttcatgtaaatggaatgata

SEQ ID NO: 7624967 - DNA, 22 bp, Homo sapiens
atttcctttgcaaagactgtgc

SEQ ID NO: 7624968 - DNA, 16 bp, Homo sapiens
atttccttgtgagttt

SEQ ID NO: 7624969 - DNA, 16 bp, Homo sapiens
atttccttgtgagttt

SEQ ID NO: 7624970 - DNA, 22 bp, Homo sapiens
atttcctttgcaaagactgtgc

SEQ ID NO: 7624971 - DNA, 22 bp, Homo sapiens
atttcctttgcaaagactgtgc

SEQ ID NO: 7624972 - DNA, 16 bp, Homo sapiens
atttccttgtgagttt

SEQ ID NO: 7624973 - DNA, 22 bp, Homo sapiens
atttccttgcaagtttctgtaa

SEQ ID NO: 7624974 - DNA, 22 bp, Homo sapiens
atttccttgcaagtttctgtaa

SEQ ID NO: 7624975 - DNA, 22 bp, Homo sapiens
atttccttgcaagtttctgtaa

SEQ ID NO: 7624976 - DNA, 22 bp, Homo sapiens
atttccttgcaagtttctgtaa

SEQ ID NO: 7624977 - DNA, 22 bp, Homo sapiens
atttccttgcaacttaggcatg

SEQ ID NO: 7624978 - DNA, 22 bp, Homo sapiens
atttccttgcaacttaggcatg

SEQ ID NO: 7624979 - DNA, 22 bp, Homo sapiens
atttccttgcaacttaggcatg

SEQ ID NO: 7624980 - DNA, 22 bp, Homo sapiens
atttccttcccagatttggttc

SEQ ID NO: 7624981 - DNA, 22 bp, Homo sapiens
atttccttgcaacttaggcatg

SEQ ID NO: 7624982 - DNA, 22 bp, Homo sapiens
atttccttgcaacttaggcatg

SEQ ID NO: 7624983 - DNA, 22 bp, Homo sapiens
atttccttcggacagtttgggt

SEQ ID NO: 7624984 - DNA, 22 bp, Homo sapiens
atttccttcggacagtttgggt

SEQ ID NO: 7624985 - DNA, 22 bp, Homo sapiens
atttccttcggacagtttgggt

SEQ ID NO: 7624986 - DNA, 22 bp, Homo sapiens
atttccttgcaagtttctgtaa

SEQ ID NO: 7624987 - DNA, 22 bp, Homo sapiens
atttccttgcaagtttctgtaa

SEQ ID NO: 7624988 - DNA, 22 bp, Homo sapiens
atttccttgcaagtttctgtaa

SEQ ID NO: 7624989 - DNA, 22 bp, Homo sapiens
atttccttgcaagtttctgtaa

SEQ ID NO: 7624990 - DNA, 22 bp, Homo sapiens
atttccttgcaagtttctgtaa

SEQ ID NO: 7624991 - DNA, 22 bp, Homo sapiens
atttccttgcaagtttctgtaa

SEQ ID NO: 7624992 - DNA, 22 bp, Homo sapiens
atttctaaagagggtggtttgg

SEQ ID NO: 7624993 - DNA, 22 bp, Homo sapiens
atttctaaagagggtggtttgg

SEQ ID NO: 7624994 - DNA, 22 bp, Homo sapiens
atttctaaagagggtggtttgg

SEQ ID NO: 7624995 - DNA, 22 bp, Homo sapiens
atttctaaagagggtggtttgg

SEQ ID NO: 7624996 - DNA, 22 bp, Homo sapiens
atttctacagtacacatgcatt

SEQ ID NO: 7624997 - DNA, 22 bp, Homo sapiens
atttctacagtacacatgcatt

SEQ ID NO: 7624998 - DNA, 22 bp, Homo sapiens
atttcctttgcaaagactgtgc

SEQ ID NO: 7624999 - DNA, 22 bp, Homo sapiens
atttcgttcagtccttactgtg

SEQ ID NO: 7625000 - DNA, 22 bp, Homo sapiens
atttcctttgcaaagactgtgc

SEQ ID NO: 7625001 - DNA, 18 bp, Homo sapiens
atttctactactataaag

SEQ ID NO: 7625002 - DNA, 22 bp, Homo sapiens
atttctactgtgagaaacatga

SEQ ID NO: 7625003 - DNA, 22 bp, Homo sapiens
atttctactgtgagaaacatga

SEQ ID NO: 7625004 - DNA, 22 bp, Homo sapiens
atttctacagtacacatgcatt

SEQ ID NO: 7625005 - DNA, 18 bp, Homo sapiens
atttctactactataaag

SEQ ID NO: 7625006 - DNA, 18 bp, Homo sapiens
atttctactactataaag

SEQ ID NO: 7625007 - DNA, 22 bp, Homo sapiens
atttctataggaggacagtatt

SEQ ID NO: 7625008 - DNA, 22 bp, Homo sapiens
atttctataggaggacagtatt

SEQ ID NO: 7625009 - DNA, 22 bp, Homo sapiens
atttctaggttcacatgtgttt

SEQ ID NO: 7625010 - DNA, 22 bp, Homo sapiens
atttctataggaggacagtatt

SEQ ID NO: 7625011 - DNA, 22 bp, Homo sapiens
atttctataggaggacagtatt

SEQ ID NO: 7625012 - DNA, 22 bp, Homo sapiens
atttctcaaaggaatagagtga

SEQ ID NO: 7625013 - DNA, 22 bp, Homo sapiens
atttctcaaaggaatagagtga

SEQ ID NO: 7625014 - DNA, 22 bp, Homo sapiens
atttctagcagggcaggaaaga

SEQ ID NO: 7625015 - DNA, 22 bp, Homo sapiens
atttctagacttagaactctta

SEQ ID NO: 7625016 - DNA, 22 bp, Homo sapiens
atttctactgtgagaaacatga

SEQ ID NO: 7625017 - DNA, 22 bp, Homo sapiens
atttaatttacatttgacagag

SEQ ID NO: 7625018 - DNA, 22 bp, Homo sapiens
atttaattgttcttctggctat

SEQ ID NO: 7625019 - DNA, 22 bp, Homo sapiens
atttaatttacatttgacagag

SEQ ID NO: 7625020 - DNA, 22 bp, Homo sapiens
atttaatttacatttgacagag

SEQ ID NO: 7625021 - DNA, 22 bp, Homo sapiens
atttaatttacatttgacagag

SEQ ID NO: 7625022 - DNA, 22 bp, Homo sapiens
atttaatttacatttgacagag

SEQ ID NO: 7625023 - DNA, 22 bp, Homo sapiens
atttaatttacatttgacagag

SEQ ID NO: 7625024 - DNA, 22 bp, Homo sapiens
atttaatttacatttgacagag

SEQ ID NO: 7625025 - DNA, 22 bp, Homo sapiens
atttaatttacatttgacagag

SEQ ID NO: 7625026 - DNA, 22 bp, Homo sapiens
atttaatttacatttgacagag

SEQ ID NO: 7625027 - DNA, 22 bp, Homo sapiens
atttaatgtcgagctattgtag

SEQ ID NO: 7625028 - DNA, 22 bp, Homo sapiens
atttaatgtcgagctattgtag

SEQ ID NO: 7625029 - DNA, 22 bp, Homo sapiens
atttaattaatcatggtgaatt

SEQ ID NO: 7625030 - DNA, 22 bp, Homo sapiens
atttaattaatcatggtgaatt

SEQ ID NO: 7625031 - DNA, 22 bp, Homo sapiens
atttaattaatcatggtgaatt

SEQ ID NO: 7625032 - DNA, 22 bp, Homo sapiens
atttaattgttcttctggctat

SEQ ID NO: 7625033 - DNA, 22 bp, Homo sapiens
atttaattaatcatggtgaatt

SEQ ID NO: 7625034 - DNA, 22 bp, Homo sapiens
atttaattaatcatggtgaatt

SEQ ID NO: 7625035 - DNA, 22 bp, Homo sapiens
attggcaatagagaataaattg

SEQ ID NO: 7625036 - DNA, 22 bp, Homo sapiens
attggcaagtgaatttaacagc

SEQ ID NO: 7625037 - DNA, 22 bp, Homo sapiens
attggcaagtgaatttaacagc

SEQ ID NO: 7625038 - DNA, 22 bp, Homo sapiens
attggcaatgtcccggctgctg

SEQ ID NO: 7625039 - DNA, 21 bp, Homo sapiens
attggcagatctctggattgt

SEQ ID NO: 7625040 - DNA, 22 bp, Homo sapiens
attggcagccagacccagttct

SEQ ID NO: 7625041 - DNA, 22 bp, Homo sapiens
attggcagaaacagcagggcca

SEQ ID NO: 7625042 - DNA, 22 bp, Homo sapiens
attggcagagctttacaggcta

SEQ ID NO: 7625043 - DNA, 22 bp, Homo sapiens
attggcagagctttacaggcta

SEQ ID NO: 7625044 - DNA, 22 bp, Homo sapiens
attggcactgcacatgattgct

SEQ ID NO: 7625045 - DNA, 22 bp, Homo sapiens
attggcactgcacatgattgct

SEQ ID NO: 7625046 - DNA, 22 bp, Homo sapiens
atttaatgtcgagctattgtag

SEQ ID NO: 7625047 - DNA, 22 bp, Homo sapiens
atttaatgtcgagctattgtag

SEQ ID NO: 7625048 - DNA, 22 bp, Homo sapiens
atttaatgtcgagctattgtag

SEQ ID NO: 7625049 - DNA, 22 bp, Homo sapiens
atttaaattttctgatggagag

SEQ ID NO: 7625050 - DNA, 22 bp, Homo sapiens
attggcagccagacccagttct

SEQ ID NO: 7625051 - DNA, 22 bp, Homo sapiens
atttaaattttctgatggagag

SEQ ID NO: 7625052 - DNA, 22 bp, Homo sapiens
atttaaattttctgatggagag

SEQ ID NO: 7625053 - DNA, 22 bp, Homo sapiens
atttaaattttctgatggagag

SEQ ID NO: 7625054 - DNA, 22 bp, Homo sapiens
atttaaattttctgatggagag

SEQ ID NO: 7625055 - DNA, 22 bp, Homo sapiens
atttaatttggagagagaaacc

SEQ ID NO: 7625056 - DNA, 22 bp, Homo sapiens
atttaatttggagagagaaacc

SEQ ID NO: 7625057 - DNA, 22 bp, Homo sapiens
atttaatttggagagagaaacc

SEQ ID NO: 7625058 - DNA, 22 bp, Homo sapiens
atttaatttatagatgtggata

SEQ ID NO: 7625059 - DNA, 22 bp, Homo sapiens
atttaatttatagatgtggata

SEQ ID NO: 7625060 - DNA, 22 bp, Homo sapiens
atttaatttggagagagaaacc

SEQ ID NO: 7625061 - DNA, 22 bp, Homo sapiens
atttaatttggagagagaaacc

SEQ ID NO: 7625062 - DNA, 22 bp, Homo sapiens
atttaatttggagagagaaacc

SEQ ID NO: 7625063 - DNA, 22 bp, Homo sapiens
atttaatttgtgtctttagctg

SEQ ID NO: 7625064 - DNA, 22 bp, Homo sapiens
atttaatttgtgtctttagctg

SEQ ID NO: 7625065 - DNA, 22 bp, Homo sapiens
atttaatttggagagagaaacc

SEQ ID NO: 7625066 - DNA, 22 bp, Homo sapiens
atttaatttgtgtctttagctg

SEQ ID NO: 7625067 - DNA, 22 bp, Homo sapiens
atttaatttgtgtctttagctg

SEQ ID NO: 7625068 - DNA, 22 bp, Homo sapiens
atttaattttctcaacagtgct

SEQ ID NO: 7625069 - DNA, 22 bp, Homo sapiens
atttaattttctcaacagtgct

SEQ ID NO: 7625070 - DNA, 22 bp, Homo sapiens
atttaattttctcaacagtgct

SEQ ID NO: 7625071 - DNA, 22 bp, Homo sapiens
atttaattttctcaacagtgct

SEQ ID NO: 7625072 - DNA, 22 bp, Homo sapiens
atttaattttctcaacagtgct

SEQ ID NO: 7625073 - DNA, 22 bp, Homo sapiens
atttaatttgtgtctttagctg

SEQ ID NO: 7625074 - DNA, 22 bp, Homo sapiens
atttaattttctcaacagtgct

SEQ ID NO: 7625075 - DNA, 22 bp, Homo sapiens
atttaattttctcaacagtgct

SEQ ID NO: 7625076 - DNA, 22 bp, Homo sapiens
atttaattttctcaacagtgct

SEQ ID NO: 7625077 - DNA, 21 bp, Homo sapiens
atttacaaaacagtcccttcc

SEQ ID NO: 7625078 - DNA, 21 bp, Homo sapiens
atttacaaaacagtcccttcc

SEQ ID NO: 7625079 - DNA, 22 bp, Homo sapiens
atttaattttctcaacagtgct

SEQ ID NO: 7625080 - DNA, 22 bp, Homo sapiens
atttaattttctcaacagtgct

SEQ ID NO: 7625081 - DNA, 21 bp, Homo sapiens
atttacaaaacagtcccttcc

SEQ ID NO: 7625082 - DNA, 21 bp, Homo sapiens
atttacaaaacagtcccttcc

SEQ ID NO: 7625083 - DNA, 21 bp, Homo sapiens
atttacaaaacagtcccttcc

SEQ ID NO: 7625084 - DNA, 21 bp, Homo sapiens
atttacaaaacagtcccttcc

SEQ ID NO: 7625085 - DNA, 21 bp, Homo sapiens
atttacaaaacagtcccttcc

SEQ ID NO: 7625086 - DNA, 21 bp, Homo sapiens
atttacaaaacagtcccttcc

SEQ ID NO: 7625087 - DNA, 22 bp, Homo sapiens
attggaaatactgagagataaa

SEQ ID NO: 7625088 - DNA, 22 bp, Homo sapiens
attggaaatactgagagataaa

SEQ ID NO: 7625089 - DNA, 22 bp, Homo sapiens
attggaaatactgagagataaa

SEQ ID NO: 7625090 - DNA, 22 bp, Homo sapiens
attggaaatacagtagaaaaat

SEQ ID NO: 7625091 - DNA, 22 bp, Homo sapiens
attggaaatacagtagaaaaat

SEQ ID NO: 7625092 - DNA, 22 bp, Homo sapiens
attggaaagttcttaagggata

SEQ ID NO: 7625093 - DNA, 22 bp, Homo sapiens
attggaaagtgtctagtgtggt

SEQ ID NO: 7625094 - DNA, 22 bp, Homo sapiens
attggaaagtgtctagtgtggt

SEQ ID NO: 7625095 - DNA, 21 bp, Homo sapiens
attggaaaaggtagttggctt

SEQ ID NO: 7625096 - DNA, 22 bp, Homo sapiens
attggaaataggccttgtacag

SEQ ID NO: 7625097 - DNA, 22 bp, Homo sapiens
attggaaatactgagagataaa

SEQ ID NO: 7625098 - DNA, 22 bp, Homo sapiens
attggaaatgctacaagttaga

SEQ ID NO: 7625099 - DNA, 22 bp, Homo sapiens
attggaaatgctacaagttaga

SEQ ID NO: 7625100 - DNA, 22 bp, Homo sapiens
attggactgcagcacaaaagcc

SEQ ID NO: 7625101 - DNA, 22 bp, Homo sapiens
attggacttagaaataaagtta

SEQ ID NO: 7625102 - DNA, 22 bp, Homo sapiens
attggagaaatggggctttagg

SEQ ID NO: 7625103 - DNA, 22 bp, Homo sapiens
attggcaaggctgcggtgtctg

SEQ ID NO: 7625104 - DNA, 22 bp, Homo sapiens
attggagtggtggttacatgag

SEQ ID NO: 7625105 - DNA, 22 bp, Homo sapiens
attggagacagatgggctccag

SEQ ID NO: 7625106 - DNA, 22 bp, Homo sapiens
attggagaacagacttaaaaat

SEQ ID NO: 7625107 - DNA, 22 bp, Homo sapiens
attgcttttcagacaatgaggc

SEQ ID NO: 7625108 - DNA, 22 bp, Homo sapiens
attgcttttccttaacacatgc

SEQ ID NO: 7625109 - DNA, 22 bp, Homo sapiens
attgcttttccttaacacatgc

SEQ ID NO: 7625110 - DNA, 22 bp, Homo sapiens
attgcttttccttaacacatgc

SEQ ID NO: 7625111 - DNA, 22 bp, Homo sapiens
attgcttttccttaacacatgc

SEQ ID NO: 7625112 - DNA, 22 bp, Homo sapiens
attgcttttccttaacacatgc

SEQ ID NO: 7625113 - DNA, 22 bp, Homo sapiens
attgcttttccttaacacatgc

SEQ ID NO: 7625114 - DNA, 18 bp, Homo sapiens
attgcttttgtaccaacc

SEQ ID NO: 7625115 - DNA, 18 bp, Homo sapiens
attgcttttgtaccaacc

SEQ ID NO: 7625116 - DNA, 18 bp, Homo sapiens
attgcttttgtaccaacc

SEQ ID NO: 7625117 - DNA, 22 bp, Homo sapiens
attgcttttgagctagaatttt

SEQ ID NO: 7625118 - DNA, 22 bp, Homo sapiens
attgcttttgagctagaatttt

SEQ ID NO: 7625119 - DNA, 22 bp, Homo sapiens
attgcttttgagctagaatttt

SEQ ID NO: 7625120 - DNA, 22 bp, Homo sapiens
attgcttttgagctagaatttt

SEQ ID NO: 7625121 - DNA, 22 bp, Homo sapiens
attgcttgaattaccatgtaat

SEQ ID NO: 7625122 - DNA, 22 bp, Homo sapiens
attgcttcccacaaagatgtat

SEQ ID NO: 7625123 - DNA, 22 bp, Homo sapiens
attgctttagaaagaaaaatat

SEQ ID NO: 7625124 - DNA, 22 bp, Homo sapiens
attgctttagaaagaaaaatat

SEQ ID NO: 7625125 - DNA, 22 bp, Homo sapiens
attgctttagaaagaaaaatat

SEQ ID NO: 7625126 - DNA, 22 bp, Homo sapiens
attgcttcaactgttcaatggg

SEQ ID NO: 7625127 - DNA, 22 bp, Homo sapiens
attgcttcaactgttcaatggg

SEQ ID NO: 7625128 - DNA, 22 bp, Homo sapiens
attgcttttagtgaaattatat

SEQ ID NO: 7625129 - DNA, 22 bp, Homo sapiens
attgcttttagtgaaattatat

SEQ ID NO: 7625130 - DNA, 22 bp, Homo sapiens
attgcttttagtgaaattatat

SEQ ID NO: 7625131 - DNA, 22 bp, Homo sapiens
attgcttttagtgaaattatat

SEQ ID NO: 7625132 - DNA, 22 bp, Homo sapiens
attgctttctttggggaactgt

SEQ ID NO: 7625133 - DNA, 22 bp, Homo sapiens
attgctttctttggggaactgt

SEQ ID NO: 7625134 - DNA, 22 bp, Homo sapiens
attgctttgtacatgcctagca

SEQ ID NO: 7625135 - DNA, 22 bp, Homo sapiens
attgcttttaagcaccacctaa

SEQ ID NO: 7625136 - DNA, 22 bp, Homo sapiens
attgcttttaagcaccacctaa

SEQ ID NO: 7625137 - DNA, 22 bp, Homo sapiens
gccaggagggaaaggacaattt

SEQ ID NO: 7625138 - DNA, 22 bp, Homo sapiens
gccaggagggaaaggacaattt

SEQ ID NO: 7625139 - DNA, 22 bp, Homo sapiens
gccaggagggaaaggacaattt

SEQ ID NO: 7625140 - DNA, 22 bp, Homo sapiens
gccaggagggaaaggacaattt

SEQ ID NO: 7625141 - DNA, 22 bp, Homo sapiens
gccaggaggcttaactggacag

SEQ ID NO: 7625142 - DNA, 22 bp, Homo sapiens
gccaggaggcttaactggacag

SEQ ID NO: 7625143 - DNA, 22 bp, Homo sapiens
gccaggagggaaaggacaattt

SEQ ID NO: 7625144 - DNA, 22 bp, Homo sapiens
gccaggaggcttaactggacag

SEQ ID NO: 7625145 - DNA, 22 bp, Homo sapiens
gccaggaggcttaactggacag

SEQ ID NO: 7625146 - DNA, 22 bp, Homo sapiens
gccaggagggaaaggacaattt

SEQ ID NO: 7625147 - DNA, 19 bp, Homo sapiens
gccaggagggctctggctg

SEQ ID NO: 7625148 - DNA, 22 bp, Homo sapiens
gccaggagggaaaggacaattt

SEQ ID NO: 7625149 - DNA, 19 bp, Homo sapiens
gccaggagggctctggctg

SEQ ID NO: 7625150 - DNA, 19 bp, Homo sapiens
gccaggagggctctggctg

SEQ ID NO: 7625151 - DNA, 19 bp, Homo sapiens
gccaggagggctctggctg

SEQ ID NO: 7625152 - DNA, 22 bp, Homo sapiens
gccaggaggggagagtgtgtca

SEQ ID NO: 7625153 - DNA, 22 bp, Homo sapiens
gccaggaggggagagtgtgtca

SEQ ID NO: 7625154 - DNA, 19 bp, Homo sapiens
gccaggagggctctggctg

SEQ ID NO: 7625155 - DNA, 19 bp, Homo sapiens
gccaggagggctctggctg

SEQ ID NO: 7625156 - DNA, 19 bp, Homo sapiens
gccaggagggctctggctg

SEQ ID NO: 7625157 - DNA, 22 bp, Homo sapiens
gccaggaggcttaactggacag

SEQ ID NO: 7625158 - DNA, 22 bp, Homo sapiens
gccaggaggcttaactggacag

SEQ ID NO: 7625159 - DNA, 22 bp, Homo sapiens
gccaggaggctgctgtgtaggc

SEQ ID NO: 7625160 - DNA, 22 bp, Homo sapiens
gccaggaggcttaactggacag

SEQ ID NO: 7625161 - DNA, 22 bp, Homo sapiens
gccaggaggcttaactggacag

SEQ ID NO: 7625162 - DNA, 22 bp, Homo sapiens
gccagctggctgcaggtcccag

SEQ ID NO: 7625163 - DNA, 22 bp, Homo sapiens
gccagctggctgcaggtcccag

SEQ ID NO: 7625164 - DNA, 22 bp, Homo sapiens
gccagctggctgcaggtcccag

SEQ ID NO: 7625165 - DNA, 22 bp, Homo sapiens
gccagctggctgcaggtcccag

SEQ ID NO: 7625166 - DNA, 22 bp, Homo sapiens
atttacagaagcatgtaatagc

SEQ ID NO: 7625167 - DNA, 22 bp, Homo sapiens
atttacagaagcatgtaatagc

SEQ ID NO: 7625168 - DNA, 22 bp, Homo sapiens
gccagctggagtgagagtgggc

SEQ ID NO: 7625169 - DNA, 22 bp, Homo sapiens
gccagctggagtgagagtgggc

SEQ ID NO: 7625170 - DNA, 22 bp, Homo sapiens
atttacagaagcatgtaatagc

SEQ ID NO: 7625171 - DNA, 22 bp, Homo sapiens
atttacagaagcatgtaatagc

SEQ ID NO: 7625172 - DNA, 22 bp, Homo sapiens
atttacagaagcatgtaatagc

SEQ ID NO: 7625173 - DNA, 22 bp, Homo sapiens
atttacagaagcatgtaatagc

SEQ ID NO: 7625174 - DNA, 22 bp, Homo sapiens
atttacagaaacttaatcatag

SEQ ID NO: 7625175 - DNA, 22 bp, Homo sapiens
atttacagaaacttaatcatag

SEQ ID NO: 7625176 - DNA, 22 bp, Homo sapiens
atttacagaaacttaatcatag

SEQ ID NO: 7625177 - DNA, 22 bp, Homo sapiens
atttacagaaacttaatcatag

SEQ ID NO: 7625178 - DNA, 22 bp, Homo sapiens
atttacacttggtttactagag

SEQ ID NO: 7625179 - DNA, 22 bp, Homo sapiens
atttacacttggtttactagag

SEQ ID NO: 7625180 - DNA, 22 bp, Homo sapiens
atttacacttggtttactagag

SEQ ID NO: 7625181 - DNA, 22 bp, Homo sapiens
atttacacttggtttactagag

SEQ ID NO: 7625182 - DNA, 22 bp, Homo sapiens
atttacagaaacttaatcatag

SEQ ID NO: 7625183 - DNA, 22 bp, Homo sapiens
atttacagaaacttaatcatag

SEQ ID NO: 7625184 - DNA, 22 bp, Homo sapiens
atttacagaaacttaatcatag

SEQ ID NO: 7625185 - DNA, 22 bp, Homo sapiens
atttacagaagcatgtaatagc

SEQ ID NO: 7625186 - DNA, 22 bp, Homo sapiens
atttacagaagcatgtaatagc

SEQ ID NO: 7625187 - DNA, 22 bp, Homo sapiens
atttacagaaacttaatcatag

SEQ ID NO: 7625188 - DNA, 22 bp, Homo sapiens
atttacagaaacttaatcatag

SEQ ID NO: 7625189 - DNA, 22 bp, Homo sapiens
atttacagaaacttaatcatag

SEQ ID NO: 7625190 - DNA, 22 bp, Homo sapiens
atttacactggttctcagagct

SEQ ID NO: 7625191 - DNA, 22 bp, Homo sapiens
atttacacttggtttactagag

SEQ ID NO: 7625192 - DNA, 22 bp, Homo sapiens
atttacacttggtttactagag

SEQ ID NO: 7625193 - DNA, 22 bp, Homo sapiens
atttacactggttctcagagct

SEQ ID NO: 7625194 - DNA, 22 bp, Homo sapiens
atttacactaaaggaaggagga

SEQ ID NO: 7625195 - DNA, 22 bp, Homo sapiens
atttacactggttctcagagct

SEQ ID NO: 7625196 - DNA, 22 bp, Homo sapiens
atttacactaaaggaaggagga

SEQ ID NO: 7625197 - DNA, 22 bp, Homo sapiens
atttacaccttcttcgattctc

SEQ ID NO: 7625198 - DNA, 22 bp, Homo sapiens
atttacaccttcttcgattctc

SEQ ID NO: 7625199 - DNA, 22 bp, Homo sapiens
atttacaccttcttcgattctc

SEQ ID NO: 7625200 - DNA, 22 bp, Homo sapiens
atttacaccttcttcgattctc

SEQ ID NO: 7625201 - DNA, 22 bp, Homo sapiens
atttacactaaaggaaggagga

SEQ ID NO: 7625202 - DNA, 22 bp, Homo sapiens
atttacactaaaggaaggagga

SEQ ID NO: 7625203 - DNA, 22 bp, Homo sapiens
atttacacattcataagatttc

SEQ ID NO: 7625204 - DNA, 22 bp, Homo sapiens
atttacacattcataagatttc

SEQ ID NO: 7625205 - DNA, 22 bp, Homo sapiens
atttacacattcataagatttc

SEQ ID NO: 7625206 - DNA, 21 bp, Homo sapiens
atttacaaaacagtcccttcc

SEQ ID NO: 7625207 - DNA, 22 bp, Homo sapiens
atttacacattcataagatttc

SEQ ID NO: 7625208 - DNA, 22 bp, Homo sapiens
atttacacattcataagatttc

SEQ ID NO: 7625209 - DNA, 22 bp, Homo sapiens
atttacacattcataagatttc

SEQ ID NO: 7625210 - DNA, 22 bp, Homo sapiens
gccaggaggtcagcccctcaac

SEQ ID NO: 7625211 - DNA, 22 bp, Homo sapiens
gccaggaggtcagcccctcaac

SEQ ID NO: 7625212 - DNA, 22 bp, Homo sapiens
gccaggaggtcagcccctcaac

SEQ ID NO: 7625213 - DNA, 22 bp, Homo sapiens
gccaggaggtcagcccctcaac

SEQ ID NO: 7625214 - DNA, 22 bp, Homo sapiens
gccaggaggtcagcccctcaac

SEQ ID NO: 7625215 - DNA, 22 bp, Homo sapiens
gccaggaggtcagcccctcaac

SEQ ID NO: 7625216 - DNA, 17 bp, Homo sapiens
gccaggaggtttgagct

SEQ ID NO: 7625217 - DNA, 17 bp, Homo sapiens
gccaggaggtttgagct

SEQ ID NO: 7625218 - DNA, 22 bp, Homo sapiens
gccaggaggtcagcccctcaac

SEQ ID NO: 7625219 - DNA, 17 bp, Homo sapiens
gccaggaggtttgagct

SEQ ID NO: 7625220 - DNA, 17 bp, Homo sapiens
gccaggaggtttgagct

SEQ ID NO: 7625221 - DNA, 21 bp, Homo sapiens
gccaggagtagattacattta

SEQ ID NO: 7625222 - DNA, 21 bp, Homo sapiens
gccaggagtagattacattta

SEQ ID NO: 7625223 - DNA, 21 bp, Homo sapiens
gccaggagtagattacattta

SEQ ID NO: 7625224 - DNA, 20 bp, Homo sapiens
gccaggagggtgtgatgagc

SEQ ID NO: 7625225 - DNA, 20 bp, Homo sapiens
gccaggagggtgtgatgagc

SEQ ID NO: 7625226 - DNA, 22 bp, Homo sapiens
gccaggaggggagagtgtgtca

SEQ ID NO: 7625227 - DNA, 22 bp, Homo sapiens
gccaggaggggagagtgtgtca

SEQ ID NO: 7625228 - DNA, 22 bp, Homo sapiens
gccaggaggggagagtgtgtca

SEQ ID NO: 7625229 - DNA, 20 bp, Homo sapiens
gccaggagggtgtgatgagc

SEQ ID NO: 7625230 - DNA, 20 bp, Homo sapiens
gccaggagggtgtgatgagc

SEQ ID NO: 7625231 - DNA, 20 bp, Homo sapiens
gccaggagggtgtgatgagc

SEQ ID NO: 7625232 - DNA, 22 bp, Homo sapiens
gccaggaggggagagtgtgtca

SEQ ID NO: 7625233 - DNA, 20 bp, Homo sapiens
gccaggagggtgtgatgagc

SEQ ID NO: 7625234 - DNA, 22 bp, Homo sapiens
gccaggagtgtcccactcattt

SEQ ID NO: 7625235 - DNA, 22 bp, Homo sapiens
gccaggagtgtcccactcattt

SEQ ID NO: 7625236 - DNA, 23 bp, Homo sapiens
gccaggagtgggtagactaatgc

SEQ ID NO: 7625237 - DNA, 22 bp, Homo sapiens
gccaggagtgtcccactcattt

SEQ ID NO: 7625238 - DNA, 23 bp, Homo sapiens
gccaggagtgggtagactaatgc

SEQ ID NO: 7625239 - DNA, 23 bp, Homo sapiens
gccaggagtgggtagactaatgc

SEQ ID NO: 7625240 - DNA, 23 bp, Homo sapiens
gccaggagtgggtagactaatgc

SEQ ID NO: 7625241 - DNA, 22 bp, Homo sapiens
gccaggagtgtgtggctatgtt

SEQ ID NO: 7625242 - DNA, 22 bp, Homo sapiens
gccaggagtgtgtggctatgtt

SEQ ID NO: 7625243 - DNA, 22 bp, Homo sapiens
gccaggagtgtgtggctatgtt

SEQ ID NO: 7625244 - DNA, 22 bp, Homo sapiens
gccaggagtgtgtggctatgtt

SEQ ID NO: 7625245 - DNA, 22 bp, Homo sapiens
gccaggagtgtcccactcattt

SEQ ID NO: 7625246 - DNA, 22 bp, Homo sapiens
gccaggagtgtgtggctatgtt

SEQ ID NO: 7625247 - DNA, 22 bp, Homo sapiens
atttactcgtgtctccagtgct

SEQ ID NO: 7625248 - DNA, 22 bp, Homo sapiens
atttactcgtgtctccagtgct

SEQ ID NO: 7625249 - DNA, 22 bp, Homo sapiens
atttactctggctggaatacaa

SEQ ID NO: 7625250 - DNA, 22 bp, Homo sapiens
gccaggagtgtcccactcattt

SEQ ID NO: 7625251 - DNA, 22 bp, Homo sapiens
atttactactgctatctagaag

SEQ ID NO: 7625252 - DNA, 22 bp, Homo sapiens
gccaggagtgtgtggctatgtt

SEQ ID NO: 7625253 - DNA, 22 bp, Homo sapiens
gccaggagtgtgtggctatgtt

SEQ ID NO: 7625254 - DNA, 19 bp, Homo sapiens
atttactgcctaaaatctc

SEQ ID NO: 7625255 - DNA, 19 bp, Homo sapiens
atttactgcctaaaatctc

SEQ ID NO: 7625256 - DNA, 22 bp, Homo sapiens
atttactgcttgacacattggt

SEQ ID NO: 7625257 - DNA, 22 bp, Homo sapiens
atttactgcttgacacattggt

SEQ ID NO: 7625258 - DNA, 22 bp, Homo sapiens
atttactgagcagctaccatgt

SEQ ID NO: 7625259 - DNA, 22 bp, Homo sapiens
atttactgagcagctaccatgt

SEQ ID NO: 7625260 - DNA, 22 bp, Homo sapiens
atttagaaattccaaaagtatt

SEQ ID NO: 7625261 - DNA, 22 bp, Homo sapiens
atttagaaattccaaaagtatt

SEQ ID NO: 7625262 - DNA, 22 bp, Homo sapiens
atttagaaattccaaaagtatt

SEQ ID NO: 7625263 - DNA, 22 bp, Homo sapiens
atttagaaattccaaaagtatt

SEQ ID NO: 7625264 - DNA, 22 bp, Homo sapiens
atttagaaattccaaaagtatt

SEQ ID NO: 7625265 - DNA, 22 bp, Homo sapiens
atttagaaattccaaaagtatt

SEQ ID NO: 7625266 - DNA, 22 bp, Homo sapiens
atttagaaattccaaaagtatt

SEQ ID NO: 7625267 - DNA, 22 bp, Homo sapiens
atttactgcttgacacattggt

SEQ ID NO: 7625268 - DNA, 22 bp, Homo sapiens
atttactggaaaaactatgagc

SEQ ID NO: 7625269 - DNA, 22 bp, Homo sapiens
atttactggaaaaactatgagc

SEQ ID NO: 7625270 - DNA, 22 bp, Homo sapiens
atttactttgctgagatccatc

SEQ ID NO: 7625271 - DNA, 22 bp, Homo sapiens
atttactggaaaaactatgagc

SEQ ID NO: 7625272 - DNA, 22 bp, Homo sapiens
atttagaaccccttccaacctg

SEQ ID NO: 7625273 - DNA, 22 bp, Homo sapiens
atttagaactttgtttgccaat

SEQ ID NO: 7625274 - DNA, 22 bp, Homo sapiens
atttagaaccccttccaacctg

SEQ ID NO: 7625275 - DNA, 22 bp, Homo sapiens
atttagaaccccttccaacctg

SEQ ID NO: 7625276 - DNA, 22 bp, Homo sapiens
atttagaaccccttccaacctg

SEQ ID NO: 7625277 - DNA, 22 bp, Homo sapiens
atttagaaattccaaaagtatt

SEQ ID NO: 7625278 - DNA, 22 bp, Homo sapiens
atttagaaattccaaaagtatt

SEQ ID NO: 7625279 - DNA, 22 bp, Homo sapiens
atttagaaattccaaaagtatt

SEQ ID NO: 7625280 - DNA, 22 bp, Homo sapiens
atttagaaattccaaaagtatt

SEQ ID NO: 7625281 - DNA, 22 bp, Homo sapiens
atttagaaattccaaaagtatt

SEQ ID NO: 7625282 - DNA, 22 bp, Homo sapiens
atttagaactttgtttgccaat

SEQ ID NO: 7625283 - DNA, 22 bp, Homo sapiens
atttagaactttgtttgccaat

SEQ ID NO: 7625284 - DNA, 22 bp, Homo sapiens
atttagaagctaatttttcaga

SEQ ID NO: 7625285 - DNA, 22 bp, Homo sapiens
atttagaactttgtttgccaat

SEQ ID NO: 7625286 - DNA, 22 bp, Homo sapiens
atttagaagctaatttttcaga

SEQ ID NO: 7625287 - DNA, 22 bp, Homo sapiens
atttagaagctaatttttcaga

SEQ ID NO: 7625288 - DNA, 22 bp, Homo sapiens
caaaaactgcaattacttttac

SEQ ID NO: 7625289 - DNA, 22 bp, Homo sapiens
caaaaactgcaattacttttac

SEQ ID NO: 7625290 - DNA, 22 bp, Homo sapiens
caaaaactgcaattacttttac

SEQ ID NO: 7625291 - DNA, 22 bp, Homo sapiens
caaaaactgcaattacttttac

SEQ ID NO: 7625292 - DNA, 22 bp, Homo sapiens
caaaaactgcaattacttttac

SEQ ID NO: 7625293 - DNA, 22 bp, Homo sapiens
caaaaagcttaggtaacaagcc

SEQ ID NO: 7625294 - DNA, 22 bp, Homo sapiens
caaaaagcttaggtaacaagcc

SEQ ID NO: 7625295 - DNA, 22 bp, Homo sapiens
caaaaagcttaggtaacaagcc

SEQ ID NO: 7625296 - DNA, 22 bp, Homo sapiens
caaaacattcagagagctcact

SEQ ID NO: 7625297 - DNA, 22 bp, Homo sapiens
caaaacattcagagagctcact

SEQ ID NO: 7625298 - DNA, 22 bp, Homo sapiens
caaaacattcagagagctcact

SEQ ID NO: 7625299 - DNA, 22 bp, Homo sapiens
caaaacattcagagagctcact

SEQ ID NO: 7625300 - DNA, 22 bp, Homo sapiens
caaaacattcagagagctcact

SEQ ID NO: 7625301 - DNA, 22 bp, Homo sapiens
caaaacattcagagagctcact

SEQ ID NO: 7625302 - DNA, 22 bp, Homo sapiens
caaaacattcagagagctcact

SEQ ID NO: 7625303 - DNA, 22 bp, Homo sapiens
caaaaagcttaggtaacaagcc

SEQ ID NO: 7625304 - DNA, 22 bp, Homo sapiens
caaaaagcttaggtaacaagcc

SEQ ID NO: 7625305 - DNA, 22 bp, Homo sapiens
caaaaagcttaggtaacaagcc

SEQ ID NO: 7625306 - DNA, 22 bp, Homo sapiens
caaaaaacacctgtgtgagtat

SEQ ID NO: 7625307 - DNA, 22 bp, Homo sapiens
caaaaaacacctgtgtgagtat

SEQ ID NO: 7625308 - DNA, 22 bp, Homo sapiens
caaaaaacacctgtgtgagtat

SEQ ID NO: 7625309 - DNA, 22 bp, Homo sapiens
caaaaaacacctgtgtgagtat

SEQ ID NO: 7625310 - DNA, 22 bp, Homo sapiens
caaaaaacacagatgtctgtgt

SEQ ID NO: 7625311 - DNA, 22 bp, Homo sapiens
caaaaaacacctgtgtgagtat

SEQ ID NO: 7625312 - DNA, 22 bp, Homo sapiens
caaaaaacacctgtgtgagtat

SEQ ID NO: 7625313 - DNA, 22 bp, Homo sapiens
caaaaaacacctgtgtgagtat

SEQ ID NO: 7625314 - DNA, 22 bp, Homo sapiens
caaaaaacacctgtgtgagtat

SEQ ID NO: 7625315 - DNA, 22 bp, Homo sapiens
caaaaaacacctgtgtgagtat

SEQ ID NO: 7625316 - DNA, 22 bp, Homo sapiens
attttttagaacctggcctgat

SEQ ID NO: 7625317 - DNA, 22 bp, Homo sapiens
gcctgtgctgttccctctgcca

SEQ ID NO: 7625318 - DNA, 22 bp, Homo sapiens
attttttagaacctggcctgat

SEQ ID NO: 7625319 - DNA, 22 bp, Homo sapiens
caaaaaacacagatgtctgtgt

SEQ ID NO: 7625320 - DNA, 22 bp, Homo sapiens
caaaaaacacagatgtctgtgt

SEQ ID NO: 7625321 - DNA, 22 bp, Homo sapiens
caaaaaacacagatgtctgtgt

SEQ ID NO: 7625322 - DNA, 22 bp, Homo sapiens
attttttagaacctggcctgat

SEQ ID NO: 7625323 - DNA, 22 bp, Homo sapiens
attttttagaacctggcctgat

SEQ ID NO: 7625324 - DNA, 22 bp, Homo sapiens
gcgagcagacccccatcttctc

SEQ ID NO: 7625325 - DNA, 22 bp, Homo sapiens
gcgagcagacagctgtcctgga

SEQ ID NO: 7625326 - DNA, 22 bp, Homo sapiens
gcgagcctctggagtcctctgg

SEQ ID NO: 7625327 - DNA, 22 bp, Homo sapiens
gcgagcctctggagtcctctgg

SEQ ID NO: 7625328 - DNA, 22 bp, Homo sapiens
gcgagcagacccccatcttctc

SEQ ID NO: 7625329 - DNA, 22 bp, Homo sapiens
gcgagcctctggagtcctctgg

SEQ ID NO: 7625330 - DNA, 22 bp, Homo sapiens
gcgagcctctggagtcctctgg

SEQ ID NO: 7625331 - DNA, 19 bp, Homo sapiens
gcgaggaagtcactgtggt

SEQ ID NO: 7625332 - DNA, 19 bp, Homo sapiens
gcgaggaagtcactgtggc

SEQ ID NO: 7625333 - DNA, 19 bp, Homo sapiens
gcgaggaagtcactgtggt

SEQ ID NO: 7625334 - DNA, 22 bp, Homo sapiens
gcgagcctctggagtcctctgg

SEQ ID NO: 7625335 - DNA, 22 bp, Homo sapiens
gcgagcctctggagtcctctgg

SEQ ID NO: 7625336 - DNA, 19 bp, Homo sapiens
gcgaggaagtcactgtggc

SEQ ID NO: 7625337 - DNA, 21 bp, Homo sapiens
caaaacttaggtgacttagga

SEQ ID NO: 7625338 - DNA, 21 bp, Homo sapiens
caaaacttaggtgacttagga

SEQ ID NO: 7625339 - DNA, 22 bp, Homo sapiens
caaaagaagctcttggggctag

SEQ ID NO: 7625340 - DNA, 22 bp, Homo sapiens
caaaagaagctcttggggctag

SEQ ID NO: 7625341 - DNA, 22 bp, Homo sapiens
caaaagaagctcttggggctag

SEQ ID NO: 7625342 - DNA, 22 bp, Homo sapiens
gcgagcagacagctgtcctgga

SEQ ID NO: 7625343 - DNA, 22 bp, Homo sapiens
caaaactgtctagagagagaag

SEQ ID NO: 7625344 - DNA, 22 bp, Homo sapiens
caaaactgtctagagagagaag

SEQ ID NO: 7625345 - DNA, 22 bp, Homo sapiens
caaaactgtctagagagagaag

SEQ ID NO: 7625346 - DNA, 22 bp, Homo sapiens
caaaactatcaggctcaaagct

SEQ ID NO: 7625347 - DNA, 22 bp, Homo sapiens
caaaactatcaggctcaaagct

SEQ ID NO: 7625348 - DNA, 22 bp, Homo sapiens
caaaactatcaggctcaaagct

SEQ ID NO: 7625349 - DNA, 22 bp, Homo sapiens
caaaactatcaggctcaaagct

SEQ ID NO: 7625350 - DNA, 22 bp, Homo sapiens
caaaaccaagaacattcatttc

SEQ ID NO: 7625351 - DNA, 22 bp, Homo sapiens
caaaaccaagaacattcatttc

SEQ ID NO: 7625352 - DNA, 22 bp, Homo sapiens
caaaaccaagaacattcatttc

SEQ ID NO: 7625353 - DNA, 22 bp, Homo sapiens
caaaaccaagaacattcatttc

SEQ ID NO: 7625354 - DNA, 22 bp, Homo sapiens
caaaacctaaacagactgtcca

SEQ ID NO: 7625355 - DNA, 22 bp, Homo sapiens
caaaacctaaacagactgtcca

SEQ ID NO: 7625356 - DNA, 22 bp, Homo sapiens
caaaacattctctgcagcaggg

SEQ ID NO: 7625357 - DNA, 22 bp, Homo sapiens
caaaacattctctgcagcaggg

SEQ ID NO: 7625358 - DNA, 22 bp, Homo sapiens
caaaacattctctgcagcaggg

SEQ ID NO: 7625359 - DNA, 22 bp, Homo sapiens
caaaaccaagaacattcatttc

SEQ ID NO: 7625360 - DNA, 22 bp, Homo sapiens
caaaacattctctgcagcaggg

SEQ ID NO: 7625361 - DNA, 22 bp, Homo sapiens
caaaacattctctgcagcaggg

SEQ ID NO: 7625362 - DNA, 22 bp, Homo sapiens
caaaacattctctgcagcaggg

SEQ ID NO: 7625363 - DNA, 22 bp, Homo sapiens
caaaacattctctgcagcaggg

SEQ ID NO: 7625364 - DNA, 22 bp, Homo sapiens
caaaacattctctgcagcaggg

SEQ ID NO: 7625365 - DNA, 22 bp, Homo sapiens
caaaacattcagagagctcact

SEQ ID NO: 7625366 - DNA, 22 bp, Homo sapiens
caaaacattcagagagctcact

SEQ ID NO: 7625367 - DNA, 22 bp, Homo sapiens
caaaacattcagagagctcact

SEQ ID NO: 7625368 - DNA, 22 bp, Homo sapiens
gcctgtcctggatgctctgcaa

SEQ ID NO: 7625369 - DNA, 22 bp, Homo sapiens
gcctgtcctggatgctctgcaa

SEQ ID NO: 7625370 - DNA, 22 bp, Homo sapiens
gcctgtcctgctaatgacacgt

SEQ ID NO: 7625371 - DNA, 20 bp, Homo sapiens
gcctgtcctgagtgtcatgg

SEQ ID NO: 7625372 - DNA, 22 bp, Homo sapiens
gcctgtcctgctaatgacacgt

SEQ ID NO: 7625373 - DNA, 22 bp, Homo sapiens
gcctgtcctcccctgcgctgag

SEQ ID NO: 7625374 - DNA, 22 bp, Homo sapiens
gcctgtcctcccctgcgctgag

SEQ ID NO: 7625375 - DNA, 22 bp, Homo sapiens
gcctgtcctatacaggcggctg

SEQ ID NO: 7625376 - DNA, 22 bp, Homo sapiens
gcctgtcctcccctgcgctgag

SEQ ID NO: 7625377 - DNA, 22 bp, Homo sapiens
gcctgtctgcagggctgtcatt

SEQ ID NO: 7625378 - DNA, 22 bp, Homo sapiens
gcctgtccttgtgaggtcccag

SEQ ID NO: 7625379 - DNA, 22 bp, Homo sapiens
gcctgtccttgtgaggtcccag

SEQ ID NO: 7625380 - DNA, 23 bp, Homo sapiens
gcctgtgcctatgcccagctctg

SEQ ID NO: 7625381 - DNA, 23 bp, Homo sapiens
gcctgtgcctatgcccagctctg

SEQ ID NO: 7625382 - DNA, 23 bp, Homo sapiens
gcctgtgcctatgcccagctctg

SEQ ID NO: 7625383 - DNA, 23 bp, Homo sapiens
gcctgtgcctatgcccagctctg

SEQ ID NO: 7625384 - DNA, 22 bp, Homo sapiens
gcctgtgcatagcagcggactc

SEQ ID NO: 7625385 - DNA, 22 bp, Homo sapiens
gcctgtgcctcaattttctact

SEQ ID NO: 7625386 - DNA, 23 bp, Homo sapiens
gcctgtgcctatgcccagctctg

SEQ ID NO: 7625387 - DNA, 22 bp, Homo sapiens
gcctgtgcctcagcctgcagcc

SEQ ID NO: 7625388 - DNA, 22 bp, Homo sapiens
gcctgtgcctcagcctgcagcc

SEQ ID NO: 7625389 - DNA, 22 bp, Homo sapiens
gcctgtgcctcagcctgcagcc

SEQ ID NO: 7625390 - DNA, 22 bp, Homo sapiens
gcctgtgcctcagcctgcagcc

SEQ ID NO: 7625391 - DNA, 22 bp, Homo sapiens
gcctgtgactcgtcttgggcca

SEQ ID NO: 7625392 - DNA, 22 bp, Homo sapiens
gcctgtgacccctccatctgct

SEQ ID NO: 7625393 - DNA, 22 bp, Homo sapiens
gcctgtgcatagcagcggactc

SEQ ID NO: 7625394 - DNA, 22 bp, Homo sapiens
gcctgtgatgcccccataagta

SEQ ID NO: 7625395 - DNA, 22 bp, Homo sapiens
gcctgtgacccagggcccagga

SEQ ID NO: 7625396 - DNA, 22 bp, Homo sapiens
gcctgtctgcgtcacgcttatt

SEQ ID NO: 7625397 - DNA, 22 bp, Homo sapiens
gcctgtctgcagggctgtcatt

SEQ ID NO: 7625398 - DNA, 16 bp, Homo sapiens
gcctgggagggaacag

SEQ ID NO: 7625399 - DNA, 22 bp, Homo sapiens
gcctgggagggcagcagtgtgg

SEQ ID NO: 7625400 - DNA, 18 bp, Homo sapiens
gcctgggaggaggaaatg

SEQ ID NO: 7625401 - DNA, 22 bp, Homo sapiens
gcctgggagggcagcagtgtgg

SEQ ID NO: 7625402 - DNA, 22 bp, Homo sapiens
gcctgggagggcagcagtgtgg

SEQ ID NO: 7625403 - DNA, 22 bp, Homo sapiens
gcctgggagggcagcagtgtgg

SEQ ID NO: 7625404 - DNA, 22 bp, Homo sapiens
gcctgggagtgcacagtgaggt

SEQ ID NO: 7625405 - DNA, 22 bp, Homo sapiens
gcctgggagggcagcagtgtgg

SEQ ID NO: 7625406 - DNA, 22 bp, Homo sapiens
gcctgggagggcagcagtgtgg

SEQ ID NO: 7625407 - DNA, 22 bp, Homo sapiens
gcctgggagtgcacagtgaggt

SEQ ID NO: 7625408 - DNA, 22 bp, Homo sapiens
gcctgggagtgcacagtgaggt

SEQ ID NO: 7625409 - DNA, 22 bp, Homo sapiens
gcctgggagtgcacagtgaggt

SEQ ID NO: 7625410 - DNA, 22 bp, Homo sapiens
gcctgggagtgcacagtgaggt

SEQ ID NO: 7625411 - DNA, 23 bp, Homo sapiens
gcctgggagttgcgatctgcccg

SEQ ID NO: 7625412 - DNA, 23 bp, Homo sapiens
gcctgggagttgcgatctgcccg

SEQ ID NO: 7625413 - DNA, 22 bp, Homo sapiens
gcctgggagtgcacagtgaggt

SEQ ID NO: 7625414 - DNA, 22 bp, Homo sapiens
gcctgggatagaggcaatgcat

SEQ ID NO: 7625415 - DNA, 22 bp, Homo sapiens
gcctgtccactaaacagccaag

SEQ ID NO: 7625416 - DNA, 23 bp, Homo sapiens
gcctgggagttgcgatctgcccg

SEQ ID NO: 7625417 - DNA, 23 bp, Homo sapiens
gcctgggagttgcgatctgcccg

SEQ ID NO: 7625418 - DNA, 22 bp, Homo sapiens
gcctgtcctatacaggcggctg

SEQ ID NO: 7625419 - DNA, 22 bp, Homo sapiens
gcctgtcccgcaccggagcccg

SEQ ID NO: 7625420 - DNA, 22 bp, Homo sapiens
gcctgtccccaggagagtccgg

SEQ ID NO: 7625421 - DNA, 22 bp, Homo sapiens
gcgagggcacgcggttgaaggc

SEQ ID NO: 7625422 - DNA, 22 bp, Homo sapiens
gcgagggcacgcggttgaaggc

SEQ ID NO: 7625423 - DNA, 22 bp, Homo sapiens
gcgagggcacgcggttgaaggc

SEQ ID NO: 7625424 - DNA, 22 bp, Homo sapiens
gcgaggaggggtgctgggcccc

SEQ ID NO: 7625425 - DNA, 22 bp, Homo sapiens
gcgaggaggggtgctgggcccc

SEQ ID NO: 7625426 - DNA, 22 bp, Homo sapiens
gcgaggcagccctcaggtgtta

SEQ ID NO: 7625427 - DNA, 22 bp, Homo sapiens
gcgaggcagccctcaggtgtta

SEQ ID NO: 7625428 - DNA, 22 bp, Homo sapiens
gcgaggctgggccctgcaggcg

SEQ ID NO: 7625429 - DNA, 22 bp, Homo sapiens
gcgaggaggggtgctgggcccc

SEQ ID NO: 7625430 - DNA, 22 bp, Homo sapiens
gcgaggtatgtggatggtgcca

SEQ ID NO: 7625431 - DNA, 22 bp, Homo sapiens
gcgagggcacgcggttgaaggc

SEQ ID NO: 7625432 - DNA, 22 bp, Homo sapiens
gcgagtgccgagagggcagggc

SEQ ID NO: 7625433 - DNA, 22 bp, Homo sapiens
gcgagtgccgagagggcagggc

SEQ ID NO: 7625434 - DNA, 22 bp, Homo sapiens
gcgagtgccgagagggcagggc

SEQ ID NO: 7625435 - DNA, 22 bp, Homo sapiens
gcgcaggagccgcggagggccg

SEQ ID NO: 7625436 - DNA, 22 bp, Homo sapiens
caaacattccgcttctcccagg

SEQ ID NO: 7625437 - DNA, 22 bp, Homo sapiens
caaacattccgcttctcccagg

SEQ ID NO: 7625438 - DNA, 22 bp, Homo sapiens
caaacattgcactttctgctat

SEQ ID NO: 7625439 - DNA, 22 bp, Homo sapiens
caaacattgcactttctgctat

SEQ ID NO: 7625440 - DNA, 22 bp, Homo sapiens
caaacattgcactttctgctat

SEQ ID NO: 7625441 - DNA, 22 bp, Homo sapiens
gcgcagctcagtgagggaactt

SEQ ID NO: 7625442 - DNA, 22 bp, Homo sapiens
gcgcagctcagtgagggaactt

SEQ ID NO: 7625443 - DNA, 22 bp, Homo sapiens
gcgcagctcagtgagggaactt

SEQ ID NO: 7625444 - DNA, 17 bp, Homo sapiens
gcgcagctcctggcgcg

SEQ ID NO: 7625445 - DNA, 22 bp, Homo sapiens
gcgcagagtagcagagtgctga

SEQ ID NO: 7625446 - DNA, 22 bp, Homo sapiens
gcgcagagccctcttctgtgga

SEQ ID NO: 7625447 - DNA, 22 bp, Homo sapiens
gcgcagagtagcagagtgctga

SEQ ID NO: 7625448 - DNA, 22 bp, Homo sapiens
gcgcagagtagcagagtgctga

SEQ ID NO: 7625449 - DNA, 22 bp, Homo sapiens
gcgcacacgcgtgtgactcatc

SEQ ID NO: 7625450 - DNA, 22 bp, Homo sapiens
gcgcaccacctccaggtggccg

SEQ ID NO: 7625451 - DNA, 22 bp, Homo sapiens
gcgcaccacctccaggtggccg

SEQ ID NO: 7625452 - DNA, 22 bp, Homo sapiens
gcgcaccacctccaggtggccg

SEQ ID NO: 7625453 - DNA, 22 bp, Homo sapiens
gcgcaccacctccaggtggccg

SEQ ID NO: 7625454 - DNA, 22 bp, Homo sapiens
gcgcacatgttcagatgtgtga

SEQ ID NO: 7625455 - DNA, 22 bp, Homo sapiens
caaacattgcactttctgctat

SEQ ID NO: 7625456 - DNA, 22 bp, Homo sapiens
caaacattgcactttctgctat

SEQ ID NO: 7625457 - DNA, 22 bp, Homo sapiens
caaacattgcactttctgctat

SEQ ID NO: 7625458 - DNA, 22 bp, Homo sapiens
caaacattgcactttctgctat

SEQ ID NO: 7625459 - DNA, 22 bp, Homo sapiens
caaaccattaagcatgttgagt

SEQ ID NO: 7625460 - DNA, 22 bp, Homo sapiens
caaaccattaagcatgttgagt

SEQ ID NO: 7625461 - DNA, 22 bp, Homo sapiens
caaaccatgacatgaagcgtga

SEQ ID NO: 7625462 - DNA, 22 bp, Homo sapiens
caaaccattaagcatgttgagt

SEQ ID NO: 7625463 - DNA, 22 bp, Homo sapiens
caaaccggaaagtgtgaggaca

SEQ ID NO: 7625464 - DNA, 22 bp, Homo sapiens
caaacctgactggggatgggcg

SEQ ID NO: 7625465 - DNA, 22 bp, Homo sapiens
caaacctgagaacatgtgctgt

SEQ ID NO: 7625466 - DNA, 22 bp, Homo sapiens
caaacctgctgctattttatcc

SEQ ID NO: 7625467 - DNA, 22 bp, Homo sapiens
caaacctgtccttttgtctcct

SEQ ID NO: 7625468 - DNA, 23 bp, Homo sapiens
caaacctgtttctctcacctgtc

SEQ ID NO: 7625469 - DNA, 22 bp, Homo sapiens
caaacctgttagaggtcatcgt

SEQ ID NO: 7625470 - DNA, 22 bp, Homo sapiens
caaacctgttagaggtcatcgt

SEQ ID NO: 7625471 - DNA, 22 bp, Homo sapiens
caaacctgttagaggtcatcgt

SEQ ID NO: 7625472 - DNA, 23 bp, Homo sapiens
caaacctgttctccccacatgca

SEQ ID NO: 7625473 - DNA, 23 bp, Homo sapiens
caaacctgttctccccacatgca

SEQ ID NO: 7625474 - DNA, 22 bp, Homo sapiens
caaaccttgtaaatgccaaact

SEQ ID NO: 7625475 - DNA, 22 bp, Homo sapiens
caaaccttgttccagtcaactc

SEQ ID NO: 7625476 - DNA, 22 bp, Homo sapiens
caaaccttgttccagtcaactc

SEQ ID NO: 7625477 - DNA, 22 bp, Homo sapiens
caaactattgttcacaagacaa

SEQ ID NO: 7625478 - DNA, 22 bp, Homo sapiens
caaaccttgttccagtcaactc

SEQ ID NO: 7625479 - DNA, 22 bp, Homo sapiens
caaactgaacacgaaagtcttt

SEQ ID NO: 7625480 - DNA, 22 bp, Homo sapiens
caaactgaacacgaaagtcttt

SEQ ID NO: 7625481 - DNA, 22 bp, Homo sapiens
caaactgagcatcagaaagttt

SEQ ID NO: 7625482 - DNA, 22 bp, Homo sapiens
caaactgagcatcagaaagttt

SEQ ID NO: 7625483 - DNA, 22 bp, Homo sapiens
caaactgccaatggtttttata

SEQ ID NO: 7625484 - DNA, 22 bp, Homo sapiens
caaactgccaatggtttttata

SEQ ID NO: 7625485 - DNA, 22 bp, Homo sapiens
caaactgtatgaccctaggccg

SEQ ID NO: 7625486 - DNA, 22 bp, Homo sapiens
caaactgagcatcagaaagttt

SEQ ID NO: 7625487 - DNA, 22 bp, Homo sapiens
caaactgcaacatgaagtgtcc

SEQ ID NO: 7625488 - DNA, 22 bp, Homo sapiens
caaactctgtaggacagttcaa

SEQ ID NO: 7625489 - DNA, 22 bp, Homo sapiens
caaactctgtaggacagttcaa

SEQ ID NO: 7625490 - DNA, 22 bp, Homo sapiens
caaactatttacaatggaatca

SEQ ID NO: 7625491 - DNA, 22 bp, Homo sapiens
caaactatttacaatggaatca

SEQ ID NO: 7625492 - DNA, 22 bp, Homo sapiens
caaactctcccactcactctga

SEQ ID NO: 7625493 - DNA, 22 bp, Homo sapiens
caaactctcccactcactctga

SEQ ID NO: 7625494 - DNA, 22 bp, Homo sapiens
caaactatttacaatggaatca

SEQ ID NO: 7625495 - DNA, 22 bp, Homo sapiens
caaactattgttcacaagacaa

SEQ ID NO: 7625496 - DNA, 22 bp, Homo sapiens
caaactatttacaatggaatca

SEQ ID NO: 7625497 - DNA, 22 bp, Homo sapiens
caaactattgttcacaagacaa

SEQ ID NO: 7625498 - DNA, 21 bp, Homo sapiens
caaacggatgcttagagaaat

SEQ ID NO: 7625499 - DNA, 22 bp, Homo sapiens
caaactattgttcacaagacaa

SEQ ID NO: 7625500 - DNA, 22 bp, Homo sapiens
caaactttcagttataacatga

SEQ ID NO: 7625501 - DNA, 22 bp, Homo sapiens
caaactttcagttataacatga

SEQ ID NO: 7625502 - DNA, 22 bp, Homo sapiens
caaacttttcctggaaaagatt

SEQ ID NO: 7625503 - DNA, 22 bp, Homo sapiens
caaacttttcctggaaaagatt

SEQ ID NO: 7625504 - DNA, 22 bp, Homo sapiens
caaactttgcaaaacttacagt

SEQ ID NO: 7625505 - DNA, 22 bp, Homo sapiens
caaacttggtggattagtacag

SEQ ID NO: 7625506 - DNA, 22 bp, Homo sapiens
caaacttacgtagtcttactac

SEQ ID NO: 7625507 - DNA, 22 bp, Homo sapiens
caaacttacgtagtcttactac

SEQ ID NO: 7625508 - DNA, 22 bp, Homo sapiens
caaacttacgtagtcttactac

SEQ ID NO: 7625509 - DNA, 22 bp, Homo sapiens
caaacttacgtagtcttactac

SEQ ID NO: 7625510 - DNA, 22 bp, Homo sapiens
caaactgttctctgtgggattc

SEQ ID NO: 7625511 - DNA, 22 bp, Homo sapiens
caaacttgtctatctaggaatc

SEQ ID NO: 7625512 - DNA, 22 bp, Homo sapiens
caaacttactgtgtttaaagag

SEQ ID NO: 7625513 - DNA, 22 bp, Homo sapiens
caaacttgtctatctaggaatc

SEQ ID NO: 7625514 - DNA, 22 bp, Homo sapiens
caaactttcagttataacatga

SEQ ID NO: 7625515 - DNA, 22 bp, Homo sapiens
caaactttcagttataacatga

SEQ ID NO: 7625516 - DNA, 22 bp, Homo sapiens
gctcagcttgggagcgcccggt

SEQ ID NO: 7625517 - DNA, 22 bp, Homo sapiens
caaacttttgaggagttcagga

SEQ ID NO: 7625518 - DNA, 22 bp, Homo sapiens
gctcaggaaacagcagggcttg

SEQ ID NO: 7625519 - DNA, 22 bp, Homo sapiens
gctcaggaaacagcagggcttg

SEQ ID NO: 7625520 - DNA, 22 bp, Homo sapiens
gctcaggaaaacagtctagtaa

SEQ ID NO: 7625521 - DNA, 22 bp, Homo sapiens
gctcaggaaatagtttagtgtt

SEQ ID NO: 7625522 - DNA, 22 bp, Homo sapiens
gctcaggaaacagcagggcttg

SEQ ID NO: 7625523 - DNA, 22 bp, Homo sapiens
gctcaggaaacagcagggcttg

SEQ ID NO: 7625524 - DNA, 22 bp, Homo sapiens
gctcaggaaggctcaaccagga

SEQ ID NO: 7625525 - DNA, 22 bp, Homo sapiens
gctcaggaaggctcaaccagga

SEQ ID NO: 7625526 - DNA, 22 bp, Homo sapiens
gctcaggaaggctcaaccagga

SEQ ID NO: 7625527 - DNA, 22 bp, Homo sapiens
gctcaggaaggctcaaccagga

SEQ ID NO: 7625528 - DNA, 22 bp, Homo sapiens
gctcaggaccgaggggtgggaa

SEQ ID NO: 7625529 - DNA, 22 bp, Homo sapiens
gctcaggaccgaggggtgggaa

SEQ ID NO: 7625530 - DNA, 22 bp, Homo sapiens
gctcaggacccaggtgtgacct

SEQ ID NO: 7625531 - DNA, 22 bp, Homo sapiens
gctcaggacccaggtgtgacct

SEQ ID NO: 7625532 - DNA, 22 bp, Homo sapiens
gctcaggcaggagtgcagtggc

SEQ ID NO: 7625533 - DNA, 22 bp, Homo sapiens
gctcaggcaggagtgcagtggc

SEQ ID NO: 7625534 - DNA, 22 bp, Homo sapiens
gctcaggcaggagtgcagtggc

SEQ ID NO: 7625535 - DNA, 22 bp, Homo sapiens
gctcaggcaaatttctggtgaa

SEQ ID NO: 7625536 - DNA, 22 bp, Homo sapiens
gctcaggcaggagtgcagtggc

SEQ ID NO: 7625537 - DNA, 22 bp, Homo sapiens
gctcaggcaggagtgcagtggc

SEQ ID NO: 7625538 - DNA, 22 bp, Homo sapiens
gctcaggcaaatttctggtgaa

SEQ ID NO: 7625539 - DNA, 22 bp, Homo sapiens
gctcaggcaggagtgcagtggc

SEQ ID NO: 7625540 - DNA, 22 bp, Homo sapiens
gctcaggcaccatatgatgtgt

SEQ ID NO: 7625541 - DNA, 22 bp, Homo sapiens
caaaggcacacatacctttctg

SEQ ID NO: 7625542 - DNA, 22 bp, Homo sapiens
caaaggcaggccccctgtgcag

SEQ ID NO: 7625543 - DNA, 22 bp, Homo sapiens
caaaggtattctcattttggaa

SEQ ID NO: 7625544 - DNA, 22 bp, Homo sapiens
caaaggtattctcattttggaa

SEQ ID NO: 7625545 - DNA, 22 bp, Homo sapiens
caaaggcacacatacctttctg

SEQ ID NO: 7625546 - DNA, 22 bp, Homo sapiens
caaaggcaatcttgttctctgg

SEQ ID NO: 7625547 - DNA, 22 bp, Homo sapiens
caaaggcaacatatacttgttt

SEQ ID NO: 7625548 - DNA, 22 bp, Homo sapiens
gctcaggcaaatttctggtgaa

SEQ ID NO: 7625549 - DNA, 22 bp, Homo sapiens
gctcaggcaaatttctggtgaa

SEQ ID NO: 7625550 - DNA, 22 bp, Homo sapiens
gctcaggatttcatccatgtgt

SEQ ID NO: 7625551 - DNA, 22 bp, Homo sapiens
gctcaggatcccaggggtgtgc

SEQ ID NO: 7625552 - DNA, 22 bp, Homo sapiens
gctcaggatcagccacctcttt

SEQ ID NO: 7625553 - DNA, 22 bp, Homo sapiens
gctcaggatcagccacctcttt

SEQ ID NO: 7625554 - DNA, 22 bp, Homo sapiens
gctcaggagctgacagcctcaa

SEQ ID NO: 7625555 - DNA, 22 bp, Homo sapiens
gctcaggagctgacagcctcaa

SEQ ID NO: 7625556 - DNA, 22 bp, Homo sapiens
gctcaggagctgacagcctcaa

SEQ ID NO: 7625557 - DNA, 22 bp, Homo sapiens
gcctgctgaagccagagtgtgt

SEQ ID NO: 7625558 - DNA, 22 bp, Homo sapiens
gcctgctgaacctcatgcagtc

SEQ ID NO: 7625559 - DNA, 22 bp, Homo sapiens
gcctgctgagggaagttgggca

SEQ ID NO: 7625560 - DNA, 22 bp, Homo sapiens
gcctgctgagggaagttgggca

SEQ ID NO: 7625561 - DNA, 22 bp, Homo sapiens
gcctgctgagggaagttgggca

SEQ ID NO: 7625562 - DNA, 22 bp, Homo sapiens
gcctgctgagggaagttgggca

SEQ ID NO: 7625563 - DNA, 22 bp, Homo sapiens
gcctgctgaagccagagtgtgt

SEQ ID NO: 7625564 - DNA, 22 bp, Homo sapiens
gcctgctgaagccagagtgtgt

SEQ ID NO: 7625565 - DNA, 22 bp, Homo sapiens
gcctgctgaacctcatgcagtc

SEQ ID NO: 7625566 - DNA, 22 bp, Homo sapiens
gcctgctgaacctcatgcagtc

SEQ ID NO: 7625567 - DNA, 22 bp, Homo sapiens
gcctgctgaacctcatgcagtc

SEQ ID NO: 7625568 - DNA, 22 bp, Homo sapiens
gcctgctgaacctcatgcagtc

SEQ ID NO: 7625569 - DNA, 22 bp, Homo sapiens
gcctgctgaacctcatgcagtc

SEQ ID NO: 7625570 - DNA, 22 bp, Homo sapiens
gcctgctgaacctcatgcagtc

SEQ ID NO: 7625571 - DNA, 22 bp, Homo sapiens
gcctgctgaacctcatgcagtc

SEQ ID NO: 7625572 - DNA, 22 bp, Homo sapiens
gcctgctgaacctcatgcagtc

SEQ ID NO: 7625573 - DNA, 22 bp, Homo sapiens
gcctgctctggaatccatgtaa

SEQ ID NO: 7625574 - DNA, 22 bp, Homo sapiens
gcctgctctggaatccatgtaa

SEQ ID NO: 7625575 - DNA, 22 bp, Homo sapiens
gcctctctctacccagtatgat

SEQ ID NO: 7625576 - DNA, 22 bp, Homo sapiens
gcctctctcgggcttgtagcgg

SEQ ID NO: 7625577 - DNA, 22 bp, Homo sapiens
gcctctctctacccagtatgat

SEQ ID NO: 7625578 - DNA, 22 bp, Homo sapiens
gcctctctctacccagtatgat

SEQ ID NO: 7625579 - DNA, 22 bp, Homo sapiens
gcctctctgggctgccgaggct

SEQ ID NO: 7625580 - DNA, 22 bp, Homo sapiens
gcctctctgggctgccgaggct

SEQ ID NO: 7625581 - DNA, 22 bp, Homo sapiens
gcctctctgggctgccgaggct

SEQ ID NO: 7625582 - DNA, 18 bp, Homo sapiens
gcctgcctagagcttgcc

SEQ ID NO: 7625583 - DNA, 18 bp, Homo sapiens
gcctgcctagagcttgcc

SEQ ID NO: 7625584 - DNA, 18 bp, Homo sapiens
gcctgcctagagcttgcc

SEQ ID NO: 7625585 - DNA, 18 bp, Homo sapiens
gcctgcctagagcttgcc

SEQ ID NO: 7625586 - DNA, 18 bp, Homo sapiens
gcctgcctagagcttgcc

SEQ ID NO: 7625587 - DNA, 18 bp, Homo sapiens
gcctgctctgctctcccc

SEQ ID NO: 7625588 - DNA, 18 bp, Homo sapiens
gcctgctctgctctcccc

SEQ ID NO: 7625589 - DNA, 22 bp, Homo sapiens
gcctgctggacattggccggcc

SEQ ID NO: 7625590 - DNA, 22 bp, Homo sapiens
gcctgctggacattggccggcc

SEQ ID NO: 7625591 - DNA, 22 bp, Homo sapiens
gcctgctggacattggccggcc

SEQ ID NO: 7625592 - DNA, 22 bp, Homo sapiens
gcctgctggacattggccggcc

SEQ ID NO: 7625593 - DNA, 22 bp, Homo sapiens
gcctgctggacattggccggcc

SEQ ID NO: 7625594 - DNA, 22 bp, Homo sapiens
gcctgctggaggagcctcaggg

SEQ ID NO: 7625595 - DNA, 22 bp, Homo sapiens
gcctgctggaggagcctcaggg

SEQ ID NO: 7625596 - DNA, 21 bp, Homo sapiens
gcctgctgcctgtggccggtc

SEQ ID NO: 7625597 - DNA, 21 bp, Homo sapiens
gcctgctgcctgtggccggtc

SEQ ID NO: 7625598 - DNA, 21 bp, Homo sapiens
gcctgctgcctgtggccggtc

SEQ ID NO: 7625599 - DNA, 22 bp, Homo sapiens
gcctgctgccagaggcaaacac

SEQ ID NO: 7625600 - DNA, 22 bp, Homo sapiens
gcctgctgccagaggcaaacac

SEQ ID NO: 7625601 - DNA, 21 bp, Homo sapiens
gcctgctgcctgtggccggtc

SEQ ID NO: 7625602 - DNA, 21 bp, Homo sapiens
gcctgctgcctgtggccggtc

SEQ ID NO: 7625603 - DNA, 22 bp, Homo sapiens
gcctgctgccaccctggctccg

SEQ ID NO: 7625604 - DNA, 22 bp, Homo sapiens
gcctgctgccaccctggctccg

SEQ ID NO: 7625605 - DNA, 22 bp, Homo sapiens
gcctgctgccaccctggctccg

SEQ ID NO: 7625606 - DNA, 22 bp, Homo sapiens
gcctgctgccaccctggctccg

SEQ ID NO: 7625607 - DNA, 22 bp, Homo sapiens
gcctgctgccaccctggctccg

SEQ ID NO: 7625608 - DNA, 22 bp, Homo sapiens
gcctgctgccaccctggctccg

SEQ ID NO: 7625609 - DNA, 22 bp, Homo sapiens
gcctgctgcatccaggctattg

SEQ ID NO: 7625610 - DNA, 22 bp, Homo sapiens
gcctgctgcatccaggctattg

SEQ ID NO: 7625611 - DNA, 22 bp, Homo sapiens
gcctgctgcatccaggctattg

SEQ ID NO: 7625612 - DNA, 22 bp, Homo sapiens
gcctgctggatgtggccaggcc

SEQ ID NO: 7625613 - DNA, 22 bp, Homo sapiens
gcctgctggatgtggccaggcc

SEQ ID NO: 7625614 - DNA, 22 bp, Homo sapiens
gcctgctggatgtggccaggcc

SEQ ID NO: 7625615 - DNA, 22 bp, Homo sapiens
gcctgctggatgtggccaggcc

SEQ ID NO: 7625616 - DNA, 22 bp, Homo sapiens
gcctgctggctggaaattctcc

SEQ ID NO: 7625617 - DNA, 22 bp, Homo sapiens
gcctgctggctggaaattctcc

SEQ ID NO: 7625618 - DNA, 22 bp, Homo sapiens
gcctgctggctgtccattgcag

SEQ ID NO: 7625619 - DNA, 22 bp, Homo sapiens
gcctgctggctgtccattgcag

SEQ ID NO: 7625620 - DNA, 22 bp, Homo sapiens
gcctgctggctgtccattgcag

SEQ ID NO: 7625621 - DNA, 22 bp, Homo sapiens
gcctgctggaggagcctcaggg

SEQ ID NO: 7625622 - DNA, 22 bp, Homo sapiens
gcctgctggaggagcctcaggg

SEQ ID NO: 7625623 - DNA, 22 bp, Homo sapiens
gcctgctggaggagcctcaggg

SEQ ID NO: 7625624 - DNA, 22 bp, Homo sapiens
gcctgctggaggagcctcaggg

SEQ ID NO: 7625625 - DNA, 22 bp, Homo sapiens
gcctgctggaggagcctcaggg

SEQ ID NO: 7625626 - DNA, 22 bp, Homo sapiens
gcctgctggaggagcctcaggg

SEQ ID NO: 7625627 - DNA, 22 bp, Homo sapiens
gcctgctggatcaagcttatgc

SEQ ID NO: 7625628 - DNA, 22 bp, Homo sapiens
gcctgctggatcaagcttatgc

SEQ ID NO: 7625629 - DNA, 22 bp, Homo sapiens
gcctgctggatgtggccaggcc

SEQ ID NO: 7625630 - DNA, 22 bp, Homo sapiens
gcctgctggatgtggccaggcc

SEQ ID NO: 7625631 - DNA, 22 bp, Homo sapiens
gcctgctggatgtggccaggcc

SEQ ID NO: 7625632 - DNA, 22 bp, Homo sapiens
gcctgctggatcaagcttatgc

SEQ ID NO: 7625633 - DNA, 22 bp, Homo sapiens
gcctgctgggagacacccccag

SEQ ID NO: 7625634 - DNA, 22 bp, Homo sapiens
gcctgctgggagacacccccag

SEQ ID NO: 7625635 - DNA, 22 bp, Homo sapiens
gcctggagctactggacactga

SEQ ID NO: 7625636 - DNA, 22 bp, Homo sapiens
gcctggagctactggacactga

SEQ ID NO: 7625637 - DNA, 22 bp, Homo sapiens
gcctggagctactggacactga

SEQ ID NO: 7625638 - DNA, 22 bp, Homo sapiens
gcctggagctactggacactga

SEQ ID NO: 7625639 - DNA, 22 bp, Homo sapiens
gcctggagctactggacactga

SEQ ID NO: 7625640 - DNA, 22 bp, Homo sapiens
gcctggagctactggacactga

SEQ ID NO: 7625641 - DNA, 22 bp, Homo sapiens
gcctggagctcatgtgggcatt

SEQ ID NO: 7625642 - DNA, 22 bp, Homo sapiens
gcctggagctactggacactga

SEQ ID NO: 7625643 - DNA, 22 bp, Homo sapiens
gcctggagctcatgtgggcatt

SEQ ID NO: 7625644 - DNA, 22 bp, Homo sapiens
gcctggagctcatgtgggcatt

SEQ ID NO: 7625645 - DNA, 22 bp, Homo sapiens
gcctggagctcatgtgggcatt

SEQ ID NO: 7625646 - DNA, 22 bp, Homo sapiens
gcctggagctcggctgagggcg

SEQ ID NO: 7625647 - DNA, 22 bp, Homo sapiens
gcctggagctctccacttgggg

SEQ ID NO: 7625648 - DNA, 22 bp, Homo sapiens
gcctggagctctccacttgggg

SEQ ID NO: 7625649 - DNA, 22 bp, Homo sapiens
gcctggagctctccacttgggg

SEQ ID NO: 7625650 - DNA, 22 bp, Homo sapiens
gcctggagctcggctgagggcg

SEQ ID NO: 7625651 - DNA, 22 bp, Homo sapiens
gcctggagctcggctgagggcg

SEQ ID NO: 7625652 - DNA, 22 bp, Homo sapiens
gcctggagctcatgtgggcatt

SEQ ID NO: 7625653 - DNA, 22 bp, Homo sapiens
gcctggagctcatgtgggcatt

SEQ ID NO: 7625654 - DNA, 22 bp, Homo sapiens
gcctggagctcatgtgggcatt

SEQ ID NO: 7625655 - DNA, 22 bp, Homo sapiens
gcctggagctcggctgagggcg

SEQ ID NO: 7625656 - DNA, 22 bp, Homo sapiens
gcctggagctcggctgagggcg

SEQ ID NO: 7625657 - DNA, 22 bp, Homo sapiens
gcctggagctcatgtgggcatt

SEQ ID NO: 7625658 - DNA, 22 bp, Homo sapiens
gcctggagctcggctgagggcg

SEQ ID NO: 7625659 - DNA, 22 bp, Homo sapiens
gcctggctgaggtggggaggca

SEQ ID NO: 7625660 - DNA, 22 bp, Homo sapiens
gcctgggagagggatagtgcag

SEQ ID NO: 7625661 - DNA, 22 bp, Homo sapiens
gcctggctgaggtggggaggca

SEQ ID NO: 7625662 - DNA, 22 bp, Homo sapiens
gcctggctgaggcctctgctaa

SEQ ID NO: 7625663 - DNA, 22 bp, Homo sapiens
gcctggctgaggtggggaggca

SEQ ID NO: 7625664 - DNA, 22 bp, Homo sapiens
gcctggctgaggtggggaggca

SEQ ID NO: 7625665 - DNA, 22 bp, Homo sapiens
gcctggctgaggtggggaggca

SEQ ID NO: 7625666 - DNA, 22 bp, Homo sapiens
gcctggctgaggcctctgctaa

SEQ ID NO: 7625667 - DNA, 22 bp, Homo sapiens
gcctggctgaggcctctgctaa

SEQ ID NO: 7625668 - DNA, 22 bp, Homo sapiens
gcctggaggaatgtagctgagg

SEQ ID NO: 7625669 - DNA, 22 bp, Homo sapiens
gcctggctctgagtttctctcc

SEQ ID NO: 7625670 - DNA, 22 bp, Homo sapiens
gcctggctgaggcctctgctaa

SEQ ID NO: 7625671 - DNA, 22 bp, Homo sapiens
gcctggagctctccacttgggg

SEQ ID NO: 7625672 - DNA, 22 bp, Homo sapiens
gcctggagctctccacttgggg

SEQ ID NO: 7625673 - DNA, 22 bp, Homo sapiens
gcctgggagatgcgttgtggcc

SEQ ID NO: 7625674 - DNA, 22 bp, Homo sapiens
gcctgggagagggatagtgcag

SEQ ID NO: 7625675 - DNA, 22 bp, Homo sapiens
gcctgggagagggatagtgcag

SEQ ID NO: 7625676 - DNA, 22 bp, Homo sapiens
gcctgggagagggatagtgcag

SEQ ID NO: 7625677 - DNA, 22 bp, Homo sapiens
gcctgggagagggatagtgcag

SEQ ID NO: 7625678 - DNA, 22 bp, Homo sapiens
gcctgggagatgcgttgtggcc

SEQ ID NO: 7625679 - DNA, 22 bp, Homo sapiens
gcctgggagattaattaggaag

SEQ ID NO: 7625680 - DNA, 22 bp, Homo sapiens
gcctgggagattaattaggaag

SEQ ID NO: 7625681 - DNA, 22 bp, Homo sapiens
gcctgggagcacatcggggtcc

SEQ ID NO: 7625682 - DNA, 22 bp, Homo sapiens
gcctgggagcacatcggggtcc

SEQ ID NO: 7625683 - DNA, 22 bp, Homo sapiens
gcctgggagcacatcggggtcc

SEQ ID NO: 7625684 - DNA, 22 bp, Homo sapiens
gcctgggagcacatcggggtcc

SEQ ID NO: 7625685 - DNA, 18 bp, Homo sapiens
gcctgggaggaggaaatg

SEQ ID NO: 7625686 - DNA, 18 bp, Homo sapiens
gcctgggaggaggaaatg

SEQ ID NO: 7625687 - DNA, 22 bp, Homo sapiens
gcctgggagcacatcggggtcc

SEQ ID NO: 7625688 - DNA, 22 bp, Homo sapiens
gcctgggagcacatcggggtcc

SEQ ID NO: 7625689 - DNA, 22 bp, Homo sapiens
atttctcagtgtacattatgtt

SEQ ID NO: 7625690 - DNA, 22 bp, Homo sapiens
atttctcagtgtacattatgtt

SEQ ID NO: 7625691 - DNA, 22 bp, Homo sapiens
atttctcagtgtacattatgtt

SEQ ID NO: 7625692 - DNA, 22 bp, Homo sapiens
atttctcagtgaaatgacaggc

SEQ ID NO: 7625693 - DNA, 22 bp, Homo sapiens
atttctcagtgaaatgacaggc

SEQ ID NO: 7625694 - DNA, 22 bp, Homo sapiens
atttctcagtgaaatgacaggc

SEQ ID NO: 7625695 - DNA, 22 bp, Homo sapiens
atttctcagtgaaatgacaggc

SEQ ID NO: 7625696 - DNA, 21 bp, Homo sapiens
gcctcaccatgtcaagccagg

SEQ ID NO: 7625697 - DNA, 22 bp, Homo sapiens
atttctcagtgtacattatgtt

SEQ ID NO: 7625698 - DNA, 22 bp, Homo sapiens
atttctcagtgtacattatgtt

SEQ ID NO: 7625699 - DNA, 22 bp, Homo sapiens
atttctcagtgaaatgacaggc

SEQ ID NO: 7625700 - DNA, 22 bp, Homo sapiens
atttctcagtgaaatgacaggc

SEQ ID NO: 7625701 - DNA, 22 bp, Homo sapiens
atttctcagtgaaatgacaggc

SEQ ID NO: 7625702 - DNA, 22 bp, Homo sapiens
atttctcagtaggtgcacagtg

SEQ ID NO: 7625703 - DNA, 22 bp, Homo sapiens
atttctcagtaggtgcacagtg

SEQ ID NO: 7625704 - DNA, 22 bp, Homo sapiens
atttctcagtaggtgcacagtg

SEQ ID NO: 7625705 - DNA, 22 bp, Homo sapiens
atttctcagtaggtgcacagtg

SEQ ID NO: 7625706 - DNA, 22 bp, Homo sapiens
atttctcagtgaaatgacaggc

SEQ ID NO: 7625707 - DNA, 22 bp, Homo sapiens
atttctcagtgaaatgacaggc

SEQ ID NO: 7625708 - DNA, 22 bp, Homo sapiens
gcctccagcccacgcaggcctg

SEQ ID NO: 7625709 - DNA, 22 bp, Homo sapiens
gcctccagcccacgcaggcctg

SEQ ID NO: 7625710 - DNA, 22 bp, Homo sapiens
gcctccagcccacgcaggcctg

SEQ ID NO: 7625711 - DNA, 21 bp, Homo sapiens
gcctccagccagatggcctcc

SEQ ID NO: 7625712 - DNA, 21 bp, Homo sapiens
gcctccagccagatggcctcc

SEQ ID NO: 7625713 - DNA, 22 bp, Homo sapiens
gcctccagcccacgcaggcctg

SEQ ID NO: 7625714 - DNA, 22 bp, Homo sapiens
gcctccagcccacgcaggcctg

SEQ ID NO: 7625715 - DNA, 22 bp, Homo sapiens
gcctccagcccacgcaggcctg

SEQ ID NO: 7625716 - DNA, 22 bp, Homo sapiens
gcctccagcccacgcaggcctg

SEQ ID NO: 7625717 - DNA, 21 bp, Homo sapiens
gcctcaccatgtcaagccagg

SEQ ID NO: 7625718 - DNA, 21 bp, Homo sapiens
gcctcaccatgtcaagccagg

SEQ ID NO: 7625719 - DNA, 22 bp, Homo sapiens
gcctccacttttgctggcttct

SEQ ID NO: 7625720 - DNA, 22 bp, Homo sapiens
gcctccacttttgctggcttct

SEQ ID NO: 7625721 - DNA, 21 bp, Homo sapiens
gcctccagccagatggcctcc

SEQ ID NO: 7625722 - DNA, 21 bp, Homo sapiens
gcctccagccagatggcctcc

SEQ ID NO: 7625723 - DNA, 21 bp, Homo sapiens
gcctccagccagatggcctcc

SEQ ID NO: 7625724 - DNA, 22 bp, Homo sapiens
atttctcaaccaggtcaaaaag

SEQ ID NO: 7625725 - DNA, 22 bp, Homo sapiens
atttctcaaccaggtcaaaaag

SEQ ID NO: 7625726 - DNA, 22 bp, Homo sapiens
atttctcaaccaggtcaaaaag

SEQ ID NO: 7625727 - DNA, 22 bp, Homo sapiens
atttctcaaaggaatagagtga

SEQ ID NO: 7625728 - DNA, 22 bp, Homo sapiens
atttctcaaccaggtcaaaaag

SEQ ID NO: 7625729 - DNA, 22 bp, Homo sapiens
atttctcacaaagttgcttatc

SEQ ID NO: 7625730 - DNA, 22 bp, Homo sapiens
atttctcaaccaggtcaaaaag

SEQ ID NO: 7625731 - DNA, 22 bp, Homo sapiens
atttctcaagtaaatgagtcat

SEQ ID NO: 7625732 - DNA, 22 bp, Homo sapiens
atttctcaagtaaatgagtcat

SEQ ID NO: 7625733 - DNA, 22 bp, Homo sapiens
atttctcacagtggaatctctg

SEQ ID NO: 7625734 - DNA, 22 bp, Homo sapiens
atttctcaccctacctcactcc

SEQ ID NO: 7625735 - DNA, 22 bp, Homo sapiens
atttctcaccctacctcactcc

SEQ ID NO: 7625736 - DNA, 22 bp, Homo sapiens
atttctcacaaagttgcttatc

SEQ ID NO: 7625737 - DNA, 22 bp, Homo sapiens
atttctcactcacagtccatgt

SEQ ID NO: 7625738 - DNA, 22 bp, Homo sapiens
atttctcactgagcagataaaa

SEQ ID NO: 7625739 - DNA, 22 bp, Homo sapiens
atttctcactgagcagataaaa

SEQ ID NO: 7625740 - DNA, 22 bp, Homo sapiens
atttctcactgagcagataaaa

SEQ ID NO: 7625741 - DNA, 22 bp, Homo sapiens
atttctcactcacagtccatgt

SEQ ID NO: 7625742 - DNA, 22 bp, Homo sapiens
atttctcagtaatctcagcaat

SEQ ID NO: 7625743 - DNA, 22 bp, Homo sapiens
atttctcagggtccaggtccca

SEQ ID NO: 7625744 - DNA, 22 bp, Homo sapiens
atttctcagtaatctcagcaat

SEQ ID NO: 7625745 - DNA, 22 bp, Homo sapiens
atttctcagtaatctcagcaat

SEQ ID NO: 7625746 - DNA, 22 bp, Homo sapiens
atttctcagcacttcctatctc

SEQ ID NO: 7625747 - DNA, 22 bp, Homo sapiens
atttctcaggactccatgggcg

SEQ ID NO: 7625748 - DNA, 22 bp, Homo sapiens
atttctcaggactccatgggcg

SEQ ID NO: 7625749 - DNA, 22 bp, Homo sapiens
atttctcagggctgaggaggag

SEQ ID NO: 7625750 - DNA, 22 bp, Homo sapiens
atttctcagcacttcctatctc

SEQ ID NO: 7625751 - DNA, 22 bp, Homo sapiens
atttctcagcacttcctatctc

SEQ ID NO: 7625752 - DNA, 22 bp, Homo sapiens
atttctcagaccagagaggtgt

SEQ ID NO: 7625753 - DNA, 22 bp, Homo sapiens
atttctcactgagcagataaaa

SEQ ID NO: 7625754 - DNA, 22 bp, Homo sapiens
atttctcagaccagagaggtgt

SEQ ID NO: 7625755 - DNA, 22 bp, Homo sapiens
atttctcagaccagagaggtgt

SEQ ID NO: 7625756 - DNA, 22 bp, Homo sapiens
atttctcactgagcagataaaa

SEQ ID NO: 7625757 - DNA, 22 bp, Homo sapiens
atttctcactgagcagataaaa

SEQ ID NO: 7625758 - DNA, 22 bp, Homo sapiens
atttctcactgagcagataaaa

SEQ ID NO: 7625759 - DNA, 22 bp, Homo sapiens
atttctcactgagcagataaaa

SEQ ID NO: 7625760 - DNA, 22 bp, Homo sapiens
gcctctctccttggcttgcagt

SEQ ID NO: 7625761 - DNA, 22 bp, Homo sapiens
gcctctctccttggcttgcagt

SEQ ID NO: 7625762 - DNA, 22 bp, Homo sapiens
gcctctctccttggcttgcagt

SEQ ID NO: 7625763 - DNA, 22 bp, Homo sapiens
gcctctcctggagaaggcaggg

SEQ ID NO: 7625764 - DNA, 22 bp, Homo sapiens
gcctctcctggagaaggcaggg

SEQ ID NO: 7625765 - DNA, 22 bp, Homo sapiens
gcctctctccttggcttgcagt

SEQ ID NO: 7625766 - DNA, 22 bp, Homo sapiens
gcctctctccttggcttgcagt

SEQ ID NO: 7625767 - DNA, 22 bp, Homo sapiens
gcctctctcgggcttgtagcgg

SEQ ID NO: 7625768 - DNA, 22 bp, Homo sapiens
gcctctctccttggcttgcagt

SEQ ID NO: 7625769 - DNA, 22 bp, Homo sapiens
gcctctctcgggcttgtagcgg

SEQ ID NO: 7625770 - DNA, 22 bp, Homo sapiens
gcctctctcgggcttgtagcgg

SEQ ID NO: 7625771 - DNA, 22 bp, Homo sapiens
gcctctccgagccactgcctct

SEQ ID NO: 7625772 - DNA, 22 bp, Homo sapiens
gcctctccgagccactgcctct

SEQ ID NO: 7625773 - DNA, 22 bp, Homo sapiens
gcctctccgagccactgcctct

SEQ ID NO: 7625774 - DNA, 22 bp, Homo sapiens
gcctctcctcttaataccatta

SEQ ID NO: 7625775 - DNA, 22 bp, Homo sapiens
gcctctcctggagaaggcaggg

SEQ ID NO: 7625776 - DNA, 21 bp, Homo sapiens
gcctctccaaatcctgccttc

SEQ ID NO: 7625777 - DNA, 21 bp, Homo sapiens
gcctctccaaatcctgccttc

SEQ ID NO: 7625778 - DNA, 21 bp, Homo sapiens
gcctctccaaatcctgccttc

SEQ ID NO: 7625779 - DNA, 22 bp, Homo sapiens
gcctctccgagccactgcctct

SEQ ID NO: 7625780 - DNA, 22 bp, Homo sapiens
gcctctccgagccactgcctct

SEQ ID NO: 7625781 - DNA, 22 bp, Homo sapiens
gcctctccgagccactgcctct

SEQ ID NO: 7625782 - DNA, 22 bp, Homo sapiens
gcctctccgagccactgcctct

SEQ ID NO: 7625783 - DNA, 22 bp, Homo sapiens
gcctctccgagccactgcctct

SEQ ID NO: 7625784 - DNA, 21 bp, Homo sapiens
gcctctccaaatcctgccttc

SEQ ID NO: 7625785 - DNA, 21 bp, Homo sapiens
gcctctccaaatcctgccttc

SEQ ID NO: 7625786 - DNA, 21 bp, Homo sapiens
gcctctccaaatcctgccttc

SEQ ID NO: 7625787 - DNA, 22 bp, Homo sapiens
gcctccccaggggtgtcatgag

SEQ ID NO: 7625788 - DNA, 22 bp, Homo sapiens
gcctcgaggctgagaaggcaca

SEQ ID NO: 7625789 - DNA, 22 bp, Homo sapiens
gcctccccaggggtgtcatgag

SEQ ID NO: 7625790 - DNA, 21 bp, Homo sapiens
gcctctccaaatcctgccttc

SEQ ID NO: 7625791 - DNA, 21 bp, Homo sapiens
gcctctccaaatcctgccttc

SEQ ID NO: 7625792 - DNA, 22 bp, Homo sapiens
gcctccccaaagtgctgacagc

SEQ ID NO: 7625793 - DNA, 22 bp, Homo sapiens
gcctccccaaagtgctgacagc

SEQ ID NO: 7625794 - DNA, 22 bp, Homo sapiens
gcctccccaaagtgctgacagc

SEQ ID NO: 7625795 - DNA, 22 bp, Homo sapiens
gcctccccaaagtgctgacagc

SEQ ID NO: 7625796 - DNA, 22 bp, Homo sapiens
gcctccccaaagtgctgacagc

SEQ ID NO: 7625797 - DNA, 22 bp, Homo sapiens
gcctccccaaagtgctgacagc

SEQ ID NO: 7625798 - DNA, 22 bp, Homo sapiens
gcctccccaagcagcagggatt

SEQ ID NO: 7625799 - DNA, 22 bp, Homo sapiens
gcctccccaaagtgctgacagc

SEQ ID NO: 7625800 - DNA, 22 bp, Homo sapiens
gcctccccaaagtgctgacagc

SEQ ID NO: 7625801 - DNA, 22 bp, Homo sapiens
gcctccccaaagtgctgacagc

SEQ ID NO: 7625802 - DNA, 22 bp, Homo sapiens
gcctccccaggggtgtcatgag

SEQ ID NO: 7625803 - DNA, 22 bp, Homo sapiens
gcctccccaagcagcagggatt

SEQ ID NO: 7625804 - DNA, 22 bp, Homo sapiens
gcctccccaagcagcagggatt

SEQ ID NO: 7625805 - DNA, 22 bp, Homo sapiens
gcctccccaagcagcagggatt

SEQ ID NO: 7625806 - DNA, 22 bp, Homo sapiens
gcctccccaagcagcagggatt

SEQ ID NO: 7625807 - DNA, 22 bp, Homo sapiens
gcctccccaagcagcagggatt

SEQ ID NO: 7625808 - DNA, 22 bp, Homo sapiens
gcctccccaagcagcagggatt

SEQ ID NO: 7625809 - DNA, 22 bp, Homo sapiens
gcctccccaagcagcagggatt

SEQ ID NO: 7625810 - DNA, 22 bp, Homo sapiens
gcctccccaagcagcagggatt

SEQ ID NO: 7625811 - DNA, 22 bp, Homo sapiens
gcctccccaagcagcagggatt

SEQ ID NO: 7625812 - DNA, 22 bp, Homo sapiens
gcctccccaagcagcagggatt

SEQ ID NO: 7625813 - DNA, 22 bp, Homo sapiens
gcctccagggatgattccttcc

SEQ ID NO: 7625814 - DNA, 22 bp, Homo sapiens
gcctccagggtagaggaggaag

SEQ ID NO: 7625815 - DNA, 22 bp, Homo sapiens
gcctccagggtagaggaggaag

SEQ ID NO: 7625816 - DNA, 22 bp, Homo sapiens
gcctccagctggggcatttcag

SEQ ID NO: 7625817 - DNA, 22 bp, Homo sapiens
gcctccagctggggcatttcag

SEQ ID NO: 7625818 - DNA, 22 bp, Homo sapiens
gcctccagtttttttctgaact

SEQ ID NO: 7625819 - DNA, 22 bp, Homo sapiens
gcctccagtttttttctgaact

SEQ ID NO: 7625820 - DNA, 22 bp, Homo sapiens
gcctccagtttttttctgaact

SEQ ID NO: 7625821 - DNA, 22 bp, Homo sapiens
gcctccagggtagaggaggaag

SEQ ID NO: 7625822 - DNA, 22 bp, Homo sapiens
gcctccagggtagaggaggaag

SEQ ID NO: 7625823 - DNA, 22 bp, Homo sapiens
gcctccagggtagaggaggaag

SEQ ID NO: 7625824 - DNA, 22 bp, Homo sapiens
gcctccagtttttttctgaact

SEQ ID NO: 7625825 - DNA, 22 bp, Homo sapiens
gcctccagtttttttctgaact

SEQ ID NO: 7625826 - DNA, 22 bp, Homo sapiens
gcctccatgtgtcctgagtcgc

SEQ ID NO: 7625827 - DNA, 22 bp, Homo sapiens
gcctccatgtgtcctgagtcgc

SEQ ID NO: 7625828 - DNA, 22 bp, Homo sapiens
gcctccatgtgtcctgagtcgc

SEQ ID NO: 7625829 - DNA, 22 bp, Homo sapiens
gcctccattgaaagctgtctat

SEQ ID NO: 7625830 - DNA, 22 bp, Homo sapiens
atgtctttctcatacaagccca

SEQ ID NO: 7625831 - DNA, 22 bp, Homo sapiens
atgtctttcttgtgtcccaaga

SEQ ID NO: 7625832 - DNA, 22 bp, Homo sapiens
atgtctttcttatggtctgttg

SEQ ID NO: 7625833 - DNA, 22 bp, Homo sapiens
atgtctttctcacagccagttc

SEQ ID NO: 7625834 - DNA, 22 bp, Homo sapiens
atgtctttctagttaagagcta

SEQ ID NO: 7625835 - DNA, 22 bp, Homo sapiens
atgtctttctagttaagagcta

SEQ ID NO: 7625836 - DNA, 22 bp, Homo sapiens
atgtctttctcacagccagttc

SEQ ID NO: 7625837 - DNA, 22 bp, Homo sapiens
atgtctttctcacagccagttc

SEQ ID NO: 7625838 - DNA, 22 bp, Homo sapiens
atgtctttgccatagttcatat

SEQ ID NO: 7625839 - DNA, 22 bp, Homo sapiens
atgtctttgccatagttcatat

SEQ ID NO: 7625840 - DNA, 22 bp, Homo sapiens
atgtctttgccatagttcatat

SEQ ID NO: 7625841 - DNA, 22 bp, Homo sapiens
atgtctttgccatagttcatat

SEQ ID NO: 7625842 - DNA, 22 bp, Homo sapiens
atgtctttcttatggtctgttg

SEQ ID NO: 7625843 - DNA, 22 bp, Homo sapiens
atgtctttgccatagttcatat

SEQ ID NO: 7625844 - DNA, 22 bp, Homo sapiens
atgtctttggctttgacatggc

SEQ ID NO: 7625845 - DNA, 22 bp, Homo sapiens
atgtctttggctttgacatggc

SEQ ID NO: 7625846 - DNA, 22 bp, Homo sapiens
atgtctttgctgtgtgctgggc

SEQ ID NO: 7625847 - DNA, 22 bp, Homo sapiens
atgtctttgctgtgtgctgggc

SEQ ID NO: 7625848 - DNA, 22 bp, Homo sapiens
atgtctttggctttgacatggc

SEQ ID NO: 7625849 - DNA, 22 bp, Homo sapiens
atgtctttggctttgacatggc

SEQ ID NO: 7625850 - DNA, 22 bp, Homo sapiens
atgtcttttatgattacgggat

SEQ ID NO: 7625851 - DNA, 22 bp, Homo sapiens
atgtcttttatggagatgtcat

SEQ ID NO: 7625852 - DNA, 22 bp, Homo sapiens
atgtcttttatggagatgtcat

SEQ ID NO: 7625853 - DNA, 22 bp, Homo sapiens
atgtgaaaaatttcttattaca

SEQ ID NO: 7625854 - DNA, 22 bp, Homo sapiens
atgtgaaaatccaatggcagca

SEQ ID NO: 7625855 - DNA, 22 bp, Homo sapiens
atgtgaaaaatttcttattaca

SEQ ID NO: 7625856 - DNA, 22 bp, Homo sapiens
atgtgaaaaatttcttattaca

SEQ ID NO: 7625857 - DNA, 22 bp, Homo sapiens
atgtgaaaaatttcttattaca

SEQ ID NO: 7625858 - DNA, 22 bp, Homo sapiens
atgtgaaaaatttcttattaca

SEQ ID NO: 7625859 - DNA, 22 bp, Homo sapiens
atgtcttttatggagatgtcat

SEQ ID NO: 7625860 - DNA, 22 bp, Homo sapiens
gaggctgctgagagccctgttt

SEQ ID NO: 7625861 - DNA, 22 bp, Homo sapiens
gaggctgctgagagccctgttt

SEQ ID NO: 7625862 - DNA, 22 bp, Homo sapiens
gaggctgctgccatcattaggt

SEQ ID NO: 7625863 - DNA, 22 bp, Homo sapiens
gaggctgctgccatcattaggt

SEQ ID NO: 7625864 - DNA, 22 bp, Homo sapiens
gaggctgctgttagccctgggc

SEQ ID NO: 7625865 - DNA, 22 bp, Homo sapiens
gaggctgctgttagccctgggc

SEQ ID NO: 7625866 - DNA, 22 bp, Homo sapiens
gaggctgctgttagccctgggc

SEQ ID NO: 7625867 - DNA, 22 bp, Homo sapiens
gaggctgctgagagccctgttt

SEQ ID NO: 7625868 - DNA, 22 bp, Homo sapiens
gaggctgctgagagccctgttt

SEQ ID NO: 7625869 - DNA, 22 bp, Homo sapiens
gaggctgctgagagccctgttt

SEQ ID NO: 7625870 - DNA, 22 bp, Homo sapiens
gaggctgctgagagccctgttt

SEQ ID NO: 7625871 - DNA, 22 bp, Homo sapiens
gaggctgcggggaggagcctgc

SEQ ID NO: 7625872 - DNA, 22 bp, Homo sapiens
gaggctgcggggaggagcctgc

SEQ ID NO: 7625873 - DNA, 22 bp, Homo sapiens
gaggctgcggggaggagcctgc

SEQ ID NO: 7625874 - DNA, 20 bp, Homo sapiens
gaggctgcggactgctggac

SEQ ID NO: 7625875 - DNA, 22 bp, Homo sapiens
gaggctgcggggaggagcctgc

SEQ ID NO: 7625876 - DNA, 22 bp, Homo sapiens
gaggctgcggggaggagcctgc

SEQ ID NO: 7625877 - DNA, 20 bp, Homo sapiens
gaggctgcggactgctggac

SEQ ID NO: 7625878 - DNA, 22 bp, Homo sapiens
gaggctgccccttcctcagctg

SEQ ID NO: 7625879 - DNA, 22 bp, Homo sapiens
atgtgaaacgcaatgggatcat

SEQ ID NO: 7625880 - DNA, 22 bp, Homo sapiens
gaggctgccccttcctcagctg

SEQ ID NO: 7625881 - DNA, 21 bp, Homo sapiens
atgtgaaaccttccacgctga

SEQ ID NO: 7625882 - DNA, 22 bp, Homo sapiens
atgtgaaacctgtgagtagagt

SEQ ID NO: 7625883 - DNA, 22 bp, Homo sapiens
atgtgaaaatccaatggcagca

SEQ ID NO: 7625884 - DNA, 22 bp, Homo sapiens
gaggctgccccttcctcagctg

SEQ ID NO: 7625885 - DNA, 20 bp, Homo sapiens
gaggctgcggactgctggac

SEQ ID NO: 7625886 - DNA, 20 bp, Homo sapiens
gaggctgcggactgctggac

SEQ ID NO: 7625887 - DNA, 20 bp, Homo sapiens
gaggctgcggactgctggac

SEQ ID NO: 7625888 - DNA, 20 bp, Homo sapiens
gaggctgcggactgctggac

SEQ ID NO: 7625889 - DNA, 22 bp, Homo sapiens
gaggcctgggagcctgtcctcc

SEQ ID NO: 7625890 - DNA, 22 bp, Homo sapiens
gaggcctgggagcctgtcctcc

SEQ ID NO: 7625891 - DNA, 22 bp, Homo sapiens
gaggcctgggagcctgtcctcc

SEQ ID NO: 7625892 - DNA, 22 bp, Homo sapiens
gaggcctgggagcctgtcctcc

SEQ ID NO: 7625893 - DNA, 22 bp, Homo sapiens
gaggcctgggagaactgttttt

SEQ ID NO: 7625894 - DNA, 22 bp, Homo sapiens
gaggcctgggagaactgttttt

SEQ ID NO: 7625895 - DNA, 22 bp, Homo sapiens
gaggcctggctgtcagtcccca

SEQ ID NO: 7625896 - DNA, 22 bp, Homo sapiens
gaggcctggctgtcagtcccca

SEQ ID NO: 7625897 - DNA, 22 bp, Homo sapiens
gaggcctggctgtcagtcccca

SEQ ID NO: 7625898 - DNA, 22 bp, Homo sapiens
gaggcctggctgtcagtcccca

SEQ ID NO: 7625899 - DNA, 22 bp, Homo sapiens
gaggcctggctgtcagtcccca

SEQ ID NO: 7625900 - DNA, 22 bp, Homo sapiens
gaggcctggctgggaggaggtg

SEQ ID NO: 7625901 - DNA, 22 bp, Homo sapiens
gaggcctggctgggaggaggtg

SEQ ID NO: 7625902 - DNA, 22 bp, Homo sapiens
gaggcctggctgggaggaggtg

SEQ ID NO: 7625903 - DNA, 22 bp, Homo sapiens
gaggcctggctgggaggaggtg

SEQ ID NO: 7625904 - DNA, 22 bp, Homo sapiens
gaggcctggctgggaggaggtg

SEQ ID NO: 7625905 - DNA, 22 bp, Homo sapiens
gaggccagggtaccatcaacat

SEQ ID NO: 7625906 - DNA, 22 bp, Homo sapiens
gaggcctggagccgcctaggcg

SEQ ID NO: 7625907 - DNA, 22 bp, Homo sapiens
gaggccagggtaccatcaacat

SEQ ID NO: 7625908 - DNA, 23 bp, Homo sapiens
gaggcctggccctgccacatctc

SEQ ID NO: 7625909 - DNA, 22 bp, Homo sapiens
gaggcctggagccgcctaggcg

SEQ ID NO: 7625910 - DNA, 22 bp, Homo sapiens
gaggcctggctctgccctcctg

SEQ ID NO: 7625911 - DNA, 22 bp, Homo sapiens
gaggcctggctctgccctcctg

SEQ ID NO: 7625912 - DNA, 22 bp, Homo sapiens
gaggcctggctctgccctcctg

SEQ ID NO: 7625913 - DNA, 22 bp, Homo sapiens
gaggcctggctctgccctcctg

SEQ ID NO: 7625914 - DNA, 23 bp, Homo sapiens
gaggcctggccctgccacatctc

SEQ ID NO: 7625915 - DNA, 23 bp, Homo sapiens
gaggcctggccctgccacatctc

SEQ ID NO: 7625916 - DNA, 22 bp, Homo sapiens
gaggcctggctctgccctcctg

SEQ ID NO: 7625917 - DNA, 22 bp, Homo sapiens
gaggcctgggttacctactcgt

SEQ ID NO: 7625918 - DNA, 22 bp, Homo sapiens
gaggcctgggttacctactcgt

SEQ ID NO: 7625919 - DNA, 22 bp, Homo sapiens
gaggcctgggttacctactcgt

SEQ ID NO: 7625920 - DNA, 22 bp, Homo sapiens
gaggcctgggttacctactcgt

SEQ ID NO: 7625921 - DNA, 22 bp, Homo sapiens
atgtctgctttccttttaatca

SEQ ID NO: 7625922 - DNA, 22 bp, Homo sapiens
atgtctggaggtcatctggtta

SEQ ID NO: 7625923 - DNA, 22 bp, Homo sapiens
gaggcctgggcaagggggtctg

SEQ ID NO: 7625924 - DNA, 22 bp, Homo sapiens
gaggcctgggcaagggggtctg

SEQ ID NO: 7625925 - DNA, 22 bp, Homo sapiens
gaggcctgggcaagggggtctg

SEQ ID NO: 7625926 - DNA, 22 bp, Homo sapiens
gaggcctgggcaagggggtctg

SEQ ID NO: 7625927 - DNA, 22 bp, Homo sapiens
gaggcctgggagcctgtcctcc

SEQ ID NO: 7625928 - DNA, 22 bp, Homo sapiens
gaggcctgggagcctgtcctcc

SEQ ID NO: 7625929 - DNA, 22 bp, Homo sapiens
gaggcctgggagcctgtcctcc

SEQ ID NO: 7625930 - DNA, 22 bp, Homo sapiens
atgtctttataaatgtataatg

SEQ ID NO: 7625931 - DNA, 22 bp, Homo sapiens
atgtctttataaatgtataatg

SEQ ID NO: 7625932 - DNA, 22 bp, Homo sapiens
atgtctttaaacttgagttgtt

SEQ ID NO: 7625933 - DNA, 22 bp, Homo sapiens
atgtctttataaatgtataatg

SEQ ID NO: 7625934 - DNA, 22 bp, Homo sapiens
atgtctttataaatgtataatg

SEQ ID NO: 7625935 - DNA, 22 bp, Homo sapiens
atgtctttcgcatcagtagcta

SEQ ID NO: 7625936 - DNA, 22 bp, Homo sapiens
atgtctttcgcatcagtagcta

SEQ ID NO: 7625937 - DNA, 22 bp, Homo sapiens
atgtctttctagttaagagcta

SEQ ID NO: 7625938 - DNA, 22 bp, Homo sapiens
atgtctttctagttaagagcta

SEQ ID NO: 7625939 - DNA, 22 bp, Homo sapiens
atgtctttattaatatcatgcc

SEQ ID NO: 7625940 - DNA, 22 bp, Homo sapiens
atgtctttattaatatcatgcc

SEQ ID NO: 7625941 - DNA, 22 bp, Homo sapiens
atgtctttcaaattctgcctag

SEQ ID NO: 7625942 - DNA, 22 bp, Homo sapiens
atgtctttcaaattctgcctag

SEQ ID NO: 7625943 - DNA, 22 bp, Homo sapiens
gaggggagacagggaaatcagt

SEQ ID NO: 7625944 - DNA, 22 bp, Homo sapiens
gaggggagacagggaaatcagt

SEQ ID NO: 7625945 - DNA, 22 bp, Homo sapiens
gaggggagacagggaaatcagt

SEQ ID NO: 7625946 - DNA, 22 bp, Homo sapiens
gaggggagacagggaaatcagt

SEQ ID NO: 7625947 - DNA, 22 bp, Homo sapiens
gaggggagacagggaaatcagt

SEQ ID NO: 7625948 - DNA, 22 bp, Homo sapiens
gaggggagacagggaaatcagt

SEQ ID NO: 7625949 - DNA, 22 bp, Homo sapiens
gaggggagacagggaaatcagt

SEQ ID NO: 7625950 - DNA, 22 bp, Homo sapiens
gaggggagacagggaaatcagt

SEQ ID NO: 7625951 - DNA, 22 bp, Homo sapiens
gaggggagacagggaaatcagt

SEQ ID NO: 7625952 - DNA, 22 bp, Homo sapiens
gaggggagaaggcactaaccag

SEQ ID NO: 7625953 - DNA, 22 bp, Homo sapiens
gaggggagaaggcactaaccag

SEQ ID NO: 7625954 - DNA, 22 bp, Homo sapiens
gaggggagaggcttatggatca

SEQ ID NO: 7625955 - DNA, 22 bp, Homo sapiens
gaggggagaggcttatggatca

SEQ ID NO: 7625956 - DNA, 22 bp, Homo sapiens
gaggggagaggcttatggatca

SEQ ID NO: 7625957 - DNA, 22 bp, Homo sapiens
gaggggagaggcttatggatca

SEQ ID NO: 7625958 - DNA, 16 bp, Homo sapiens
gaggggagcagtaggc

SEQ ID NO: 7625959 - DNA, 22 bp, Homo sapiens
gaggggagaggcttatggatca

SEQ ID NO: 7625960 - DNA, 22 bp, Homo sapiens
gaggggagacagggaaatcagt

SEQ ID NO: 7625961 - DNA, 22 bp, Homo sapiens
gaggggagaggcttatggatca

SEQ ID NO: 7625962 - DNA, 22 bp, Homo sapiens
gaggggagacagggaaatcagt

SEQ ID NO: 7625963 - DNA, 16 bp, Homo sapiens
gaggggagcagtaggc

SEQ ID NO: 7625964 - DNA, 22 bp, Homo sapiens
gaggggagcatgatctagattg

SEQ ID NO: 7625965 - DNA, 16 bp, Homo sapiens
gaggggagcagtaggc

SEQ ID NO: 7625966 - DNA, 22 bp, Homo sapiens
gaggggagcatgatctagattg

SEQ ID NO: 7625967 - DNA, 22 bp, Homo sapiens
gaggggagcatgatctagattg

SEQ ID NO: 7625968 - DNA, 16 bp, Homo sapiens
gaggggagcagtaggc

SEQ ID NO: 7625969 - DNA, 16 bp, Homo sapiens
gaggggagcagtaggc

SEQ ID NO: 7625970 - DNA, 22 bp, Homo sapiens
gaggggagcatgatctagattg

SEQ ID NO: 7625971 - DNA, 22 bp, Homo sapiens
gaggggagcatgatctagattg

SEQ ID NO: 7625972 - DNA, 22 bp, Homo sapiens
gaggggagcccccatcctccag

SEQ ID NO: 7625973 - DNA, 22 bp, Homo sapiens
gaggggagcccccatcctccag

SEQ ID NO: 7625974 - DNA, 22 bp, Homo sapiens
gaggggagcccccatcctccag

SEQ ID NO: 7625975 - DNA, 22 bp, Homo sapiens
atgtgtcttctgtgggtttgaa

SEQ ID NO: 7625976 - DNA, 22 bp, Homo sapiens
atgtgtcttgagggggatggag

SEQ ID NO: 7625977 - DNA, 22 bp, Homo sapiens
atgtgtcttctgtgggtttgaa

SEQ ID NO: 7625978 - DNA, 22 bp, Homo sapiens
gaggggagcccccatcctccag

SEQ ID NO: 7625979 - DNA, 22 bp, Homo sapiens
gaggggagcccccatcctccag

SEQ ID NO: 7625980 - DNA, 22 bp, Homo sapiens
atgtgtgtatgtgcctatatct

SEQ ID NO: 7625981 - DNA, 22 bp, Homo sapiens
atgtgtgtatgtgcctatatct

SEQ ID NO: 7625982 - DNA, 22 bp, Homo sapiens
atgtgtgtgatgggcgccgcca

SEQ ID NO: 7625983 - DNA, 22 bp, Homo sapiens
atgtgtgtgatgggcgccgcca

SEQ ID NO: 7625984 - DNA, 22 bp, Homo sapiens
atgtgtgtgatgggcgccgcca

SEQ ID NO: 7625985 - DNA, 22 bp, Homo sapiens
atgtgtgtgcatttctctccct

SEQ ID NO: 7625986 - DNA, 22 bp, Homo sapiens
atgtgtgtgcatttctctccct

SEQ ID NO: 7625987 - DNA, 22 bp, Homo sapiens
atgtgtgtgcatttctctccct

SEQ ID NO: 7625988 - DNA, 22 bp, Homo sapiens
atgtgtgtgatgggcgccgcca

SEQ ID NO: 7625989 - DNA, 22 bp, Homo sapiens
atgtgtgtgatgggcgccgcca

SEQ ID NO: 7625990 - DNA, 22 bp, Homo sapiens
atgtgtgtatatatagtcattt

SEQ ID NO: 7625991 - DNA, 22 bp, Homo sapiens
atgtgtgtatatatagtcattt

SEQ ID NO: 7625992 - DNA, 22 bp, Homo sapiens
atgtgtgtatatatagtcattt

SEQ ID NO: 7625993 - DNA, 22 bp, Homo sapiens
atgtgtgtatatatagtcattt

SEQ ID NO: 7625994 - DNA, 22 bp, Homo sapiens
atgtgtgtatgtgcctatatct

SEQ ID NO: 7625995 - DNA, 22 bp, Homo sapiens
atgtgtgtatgtgcctatatct

SEQ ID NO: 7625996 - DNA, 22 bp, Homo sapiens
atgtgtgtatgtgcctatatct

SEQ ID NO: 7625997 - DNA, 22 bp, Homo sapiens
atgtgtgtatatatagtcattt

SEQ ID NO: 7625998 - DNA, 22 bp, Homo sapiens
atgtgtgtatatatagtcattt

SEQ ID NO: 7625999 - DNA, 22 bp, Homo sapiens
atgtgtcttgagggggatggag

SEQ ID NO: 7626000 - DNA, 22 bp, Homo sapiens
atgtgtcttgagggggatggag

SEQ ID NO: 7626001 - DNA, 22 bp, Homo sapiens
atgtgtcttgcggcagttggta

SEQ ID NO: 7626002 - DNA, 22 bp, Homo sapiens
atgtgtcttgcggcagttggta

SEQ ID NO: 7626003 - DNA, 22 bp, Homo sapiens
atgtgtcttgcggcagttggta

SEQ ID NO: 7626004 - DNA, 22 bp, Homo sapiens
atgtgtcttggagttttaatgt

SEQ ID NO: 7626005 - DNA, 22 bp, Homo sapiens
atgtgtgtatatatagtcattt

SEQ ID NO: 7626006 - DNA, 22 bp, Homo sapiens
atgtgtgtacacacgtgactct

SEQ ID NO: 7626007 - DNA, 22 bp, Homo sapiens
atgtgtgtatatatagtcattt

SEQ ID NO: 7626008 - DNA, 22 bp, Homo sapiens
atgtgtgtatatatagtcattt

SEQ ID NO: 7626009 - DNA, 22 bp, Homo sapiens
gaggggagaaggcactaaccag

SEQ ID NO: 7626010 - DNA, 22 bp, Homo sapiens
gaggggagaaggcactaaccag

SEQ ID NO: 7626011 - DNA, 22 bp, Homo sapiens
gaggggagaaggcactaaccag

SEQ ID NO: 7626012 - DNA, 22 bp, Homo sapiens
gaggggaagacttctggacagt

SEQ ID NO: 7626013 - DNA, 22 bp, Homo sapiens
gaggggaagacttctggacagt

SEQ ID NO: 7626014 - DNA, 22 bp, Homo sapiens
gaggggaagacttctggacagt

SEQ ID NO: 7626015 - DNA, 22 bp, Homo sapiens
atgtgtccattatcagttctgg

SEQ ID NO: 7626016 - DNA, 22 bp, Homo sapiens
gaggggaagacttctggacagt

SEQ ID NO: 7626017 - DNA, 22 bp, Homo sapiens
atgtgtcctgctgtgtcacaca

SEQ ID NO: 7626018 - DNA, 22 bp, Homo sapiens
atgtgtcattatccagaataac

SEQ ID NO: 7626019 - DNA, 22 bp, Homo sapiens
atgtgtcatttttctgtgcata

SEQ ID NO: 7626020 - DNA, 22 bp, Homo sapiens
atgtgtcatttttctgtgcata

SEQ ID NO: 7626021 - DNA, 22 bp, Homo sapiens
atgtgtccaaggccacaatagc

SEQ ID NO: 7626022 - DNA, 22 bp, Homo sapiens
atgtgtattttgtactattggg

SEQ ID NO: 7626023 - DNA, 22 bp, Homo sapiens
atgtgtattttgtactattggg

SEQ ID NO: 7626024 - DNA, 22 bp, Homo sapiens
atgtgtattttgtactattggg

SEQ ID NO: 7626025 - DNA, 22 bp, Homo sapiens
atgtgtcaattttcaaatgctt

SEQ ID NO: 7626026 - DNA, 22 bp, Homo sapiens
atgtgtattagttagtttaatg

SEQ ID NO: 7626027 - DNA, 22 bp, Homo sapiens
atgtgtattagttagtttaatg

SEQ ID NO: 7626028 - DNA, 22 bp, Homo sapiens
atgtgtattagttagtttaatg

SEQ ID NO: 7626029 - DNA, 22 bp, Homo sapiens
atgtgtattgagcacctactgc

SEQ ID NO: 7626030 - DNA, 22 bp, Homo sapiens
atgtgtatttatttggggctta

SEQ ID NO: 7626031 - DNA, 22 bp, Homo sapiens
atgtgtattgagcacctactgc

SEQ ID NO: 7626032 - DNA, 22 bp, Homo sapiens
gaggctgctttcctcctatcct

SEQ ID NO: 7626033 - DNA, 22 bp, Homo sapiens
gaggctgctttgatgacaggag

SEQ ID NO: 7626034 - DNA, 22 bp, Homo sapiens
gaggctgctttcctcctatcct

SEQ ID NO: 7626035 - DNA, 22 bp, Homo sapiens
gaggctgctgttagccctgggc

SEQ ID NO: 7626036 - DNA, 22 bp, Homo sapiens
gaggctgctgttagccctgggc

SEQ ID NO: 7626037 - DNA, 22 bp, Homo sapiens
gaggctgctgttagccctgggc

SEQ ID NO: 7626038 - DNA, 22 bp, Homo sapiens
gaggctgctttgatgacaggag

SEQ ID NO: 7626039 - DNA, 22 bp, Homo sapiens
gaggctgctttgatgacaggag

SEQ ID NO: 7626040 - DNA, 22 bp, Homo sapiens
gaggctgctttgatgacaggag

SEQ ID NO: 7626041 - DNA, 22 bp, Homo sapiens
atgtggctggtgactgccgtac

SEQ ID NO: 7626042 - DNA, 22 bp, Homo sapiens
atgtggcttggcagggaatatg

SEQ ID NO: 7626043 - DNA, 22 bp, Homo sapiens
atgtggcttagttaggtgcccc

SEQ ID NO: 7626044 - DNA, 22 bp, Homo sapiens
atgtggctgtcacagcataatg

SEQ ID NO: 7626045 - DNA, 22 bp, Homo sapiens
atgtggctgtcacagcataatg

SEQ ID NO: 7626046 - DNA, 22 bp, Homo sapiens
atgtgtatgtcttattcaaaga

SEQ ID NO: 7626047 - DNA, 22 bp, Homo sapiens
atgtgtatgcatgcactaagat

SEQ ID NO: 7626048 - DNA, 22 bp, Homo sapiens
atgtggcttttcctgggttcct

SEQ ID NO: 7626049 - DNA, 22 bp, Homo sapiens
atgtgtattaccctttcattcc

SEQ ID NO: 7626050 - DNA, 22 bp, Homo sapiens
atgtgtattaccctttcattcc

SEQ ID NO: 7626051 - DNA, 22 bp, Homo sapiens
atgtgtattacctcgattgtga

SEQ ID NO: 7626052 - DNA, 22 bp, Homo sapiens
atgtgtattaccctttcattcc

SEQ ID NO: 7626053 - DNA, 22 bp, Homo sapiens
atgtgtatgtcttattcaaaga

SEQ ID NO: 7626054 - DNA, 22 bp, Homo sapiens
atgtgtattaccctttcattcc

SEQ ID NO: 7626055 - DNA, 22 bp, Homo sapiens
atggtcaagatcctctagttta

SEQ ID NO: 7626056 - DNA, 22 bp, Homo sapiens
atggtcaaagataaagtgatct

SEQ ID NO: 7626057 - DNA, 22 bp, Homo sapiens
atggtcaaggagaaacctggga

SEQ ID NO: 7626058 - DNA, 21 bp, Homo sapiens
atggtcaattcattagaaaga

SEQ ID NO: 7626059 - DNA, 22 bp, Homo sapiens
atggtcacaccactgtactcca

SEQ ID NO: 7626060 - DNA, 22 bp, Homo sapiens
atggtattgcaacaactgtcat

SEQ ID NO: 7626061 - DNA, 22 bp, Homo sapiens
atggtattggagtaggacttgc

SEQ ID NO: 7626062 - DNA, 22 bp, Homo sapiens
atggtattaggaaatctgaatg

SEQ ID NO: 7626063 - DNA, 22 bp, Homo sapiens
atggtattcctttatgtagaag

SEQ ID NO: 7626064 - DNA, 22 bp, Homo sapiens
atggtattctctaactcagctt

SEQ ID NO: 7626065 - DNA, 22 bp, Homo sapiens
atggtattctctaactcagctt

SEQ ID NO: 7626066 - DNA, 22 bp, Homo sapiens
atggtattctcagcacctagca

SEQ ID NO: 7626067 - DNA, 21 bp, Homo sapiens
atggtaggtggagcaggtgat

SEQ ID NO: 7626068 - DNA, 21 bp, Homo sapiens
atggtaggtggagcaggtgat

SEQ ID NO: 7626069 - DNA, 21 bp, Homo sapiens
atggtaggtggagcaggtgat

SEQ ID NO: 7626070 - DNA, 22 bp, Homo sapiens
atggtagggaacttgtctattt

SEQ ID NO: 7626071 - DNA, 22 bp, Homo sapiens
atggtagggaacttgtctattt

SEQ ID NO: 7626072 - DNA, 22 bp, Homo sapiens
atggtaggtacaacagcaggca

SEQ ID NO: 7626073 - DNA, 22 bp, Homo sapiens
atggtactggggtcccggagtt

SEQ ID NO: 7626074 - DNA, 22 bp, Homo sapiens
atggtactggggtcccggagtt

SEQ ID NO: 7626075 - DNA, 22 bp, Homo sapiens
atggtacatataaggtgagctt

SEQ ID NO: 7626076 - DNA, 22 bp, Homo sapiens
atggtataggccattgggggca

SEQ ID NO: 7626077 - DNA, 22 bp, Homo sapiens
atggtattaagaacaattccaa

SEQ ID NO: 7626078 - DNA, 22 bp, Homo sapiens
atggtatagagccacatgtatt

SEQ ID NO: 7626079 - DNA, 22 bp, Homo sapiens
atggtatagagccacatgtatt

SEQ ID NO: 7626080 - DNA, 22 bp, Homo sapiens
atggtatacaattatggactgt

SEQ ID NO: 7626081 - DNA, 21 bp, Homo sapiens
atggtaggtggagcaggtgat

SEQ ID NO: 7626082 - DNA, 22 bp, Homo sapiens
atggtaaccagaagactatgac

SEQ ID NO: 7626083 - DNA, 22 bp, Homo sapiens
atggtaacagttgagtagaaac

SEQ ID NO: 7626084 - DNA, 22 bp, Homo sapiens
atggtaatgatttatgtaaatt

SEQ ID NO: 7626085 - DNA, 22 bp, Homo sapiens
atggtacaaaatgtataaagtc

SEQ ID NO: 7626086 - DNA, 22 bp, Homo sapiens
atggtacaaaatgtataaagtc

SEQ ID NO: 7626087 - DNA, 22 bp, Homo sapiens
atggtaatgatttatgtaaatt

SEQ ID NO: 7626088 - DNA, 22 bp, Homo sapiens
atggtacaatgtgtgtatcttt

SEQ ID NO: 7626089 - DNA, 22 bp, Homo sapiens
atggtacaatgtgtgtatcttt

SEQ ID NO: 7626090 - DNA, 22 bp, Homo sapiens
atggtacaatgtgtttgttagg

SEQ ID NO: 7626091 - DNA, 22 bp, Homo sapiens
atggtacaatgtgtttgttagg

SEQ ID NO: 7626092 - DNA, 22 bp, Homo sapiens
atggtacaatgatggatagtgg

SEQ ID NO: 7626093 - DNA, 22 bp, Homo sapiens
atggtacaaaatgtataaagtc

SEQ ID NO: 7626094 - DNA, 22 bp, Homo sapiens
atggtacaaaatgtataaagtc

SEQ ID NO: 7626095 - DNA, 19 bp, Homo sapiens
atggtacagtgtacacttg

SEQ ID NO: 7626096 - DNA, 14 bp, Homo sapiens
atggtacaggggct

SEQ ID NO: 7626097 - DNA, 19 bp, Homo sapiens
atggtacagtgtacacttg

SEQ ID NO: 7626098 - DNA, 22 bp, Homo sapiens
atggtacagtgcactgaatgga

SEQ ID NO: 7626099 - DNA, 19 bp, Homo sapiens
atggtacagtgtacacttg

SEQ ID NO: 7626100 - DNA, 19 bp, Homo sapiens
atggtacagtgtacacttg

SEQ ID NO: 7626101 - DNA, 22 bp, Homo sapiens
atggtacatagtttaaataagg

SEQ ID NO: 7626102 - DNA, 22 bp, Homo sapiens
atggtacatagtttaaataagg

SEQ ID NO: 7626103 - DNA, 22 bp, Homo sapiens
atggtacatagtttaaataagg

SEQ ID NO: 7626104 - DNA, 22 bp, Homo sapiens
atggtacagataatacatgctg

SEQ ID NO: 7626105 - DNA, 22 bp, Homo sapiens
atggtacagataatacatgctg

SEQ ID NO: 7626106 - DNA, 22 bp, Homo sapiens
atggtacaattttcatttgtgg

SEQ ID NO: 7626107 - DNA, 22 bp, Homo sapiens
atggggctctgcggctgctccc

SEQ ID NO: 7626108 - DNA, 22 bp, Homo sapiens
atggggctctgcggctgctccc

SEQ ID NO: 7626109 - DNA, 23 bp, Homo sapiens
atggggctcaacacttagtagct

SEQ ID NO: 7626110 - DNA, 22 bp, Homo sapiens
atggctggcactggcctgggtt

SEQ ID NO: 7626111 - DNA, 22 bp, Homo sapiens
atggctggcactggcctgggtt

SEQ ID NO: 7626112 - DNA, 22 bp, Homo sapiens
atggctggatttgatccatggg

SEQ ID NO: 7626113 - DNA, 22 bp, Homo sapiens
atggctggcactggcctgggtt

SEQ ID NO: 7626114 - DNA, 22 bp, Homo sapiens
atggctggatagttgaagctct

SEQ ID NO: 7626115 - DNA, 22 bp, Homo sapiens
atggctggatttgatccatggg

SEQ ID NO: 7626116 - DNA, 22 bp, Homo sapiens
atggctggatttgatccatggg

SEQ ID NO: 7626117 - DNA, 22 bp, Homo sapiens
atggctggatagttgaagctct

SEQ ID NO: 7626118 - DNA, 22 bp, Homo sapiens
atggctggaggccgggcttcct

SEQ ID NO: 7626119 - DNA, 22 bp, Homo sapiens
atggctggatagttgaagctct

SEQ ID NO: 7626120 - DNA, 22 bp, Homo sapiens
atggctggaagagtcgaagagt

SEQ ID NO: 7626121 - DNA, 22 bp, Homo sapiens
atggtaaacatttaacaactag

SEQ ID NO: 7626122 - DNA, 22 bp, Homo sapiens
atggtaaacatttaacaactag

SEQ ID NO: 7626123 - DNA, 22 bp, Homo sapiens
atggtaaattttaccttatgta

SEQ ID NO: 7626124 - DNA, 22 bp, Homo sapiens
atgggttcaagtgattctcctg

SEQ ID NO: 7626125 - DNA, 22 bp, Homo sapiens
atgggttcaagtgattctcctg

SEQ ID NO: 7626126 - DNA, 22 bp, Homo sapiens
atgggtttataggtggactttt

SEQ ID NO: 7626127 - DNA, 22 bp, Homo sapiens
atgggtttccctctgaaattat

SEQ ID NO: 7626128 - DNA, 22 bp, Homo sapiens
atggggctgttctctgccctgc

SEQ ID NO: 7626129 - DNA, 22 bp, Homo sapiens
atggggctgttctctgccctgc

SEQ ID NO: 7626130 - DNA, 22 bp, Homo sapiens
atgggttcaagtgattctcctg

SEQ ID NO: 7626131 - DNA, 22 bp, Homo sapiens
atgggttcaagtgattctcctg

SEQ ID NO: 7626132 - DNA, 22 bp, Homo sapiens
atggggctgaaacatggaagag

SEQ ID NO: 7626133 - DNA, 22 bp, Homo sapiens
atggggctgggattctcctcgg

SEQ ID NO: 7626134 - DNA, 22 bp, Homo sapiens
atgtacatctttataacaagct

SEQ ID NO: 7626135 - DNA, 22 bp, Homo sapiens
atgtacatctttataacaagct

SEQ ID NO: 7626136 - DNA, 22 bp, Homo sapiens
atgtacatctttataacaagct

SEQ ID NO: 7626137 - DNA, 22 bp, Homo sapiens
atgtacatctttataacaagct

SEQ ID NO: 7626138 - DNA, 22 bp, Homo sapiens
atgtacatctttataacaagct

SEQ ID NO: 7626139 - DNA, 22 bp, Homo sapiens
atgtacaattctccttggtagg

SEQ ID NO: 7626140 - DNA, 22 bp, Homo sapiens
atgtacaattctccttggtagg

SEQ ID NO: 7626141 - DNA, 22 bp, Homo sapiens
atgtacaattctccttggtagg

SEQ ID NO: 7626142 - DNA, 22 bp, Homo sapiens
gagctggggcagcttaggagtg

SEQ ID NO: 7626143 - DNA, 22 bp, Homo sapiens
gagctggggcagcttaggagtg

SEQ ID NO: 7626144 - DNA, 22 bp, Homo sapiens
gagctggggcagcttaggagtg

SEQ ID NO: 7626145 - DNA, 22 bp, Homo sapiens
gagctgggctggcttcctccct

SEQ ID NO: 7626146 - DNA, 22 bp, Homo sapiens
atgtacaatctatcacaagaag

SEQ ID NO: 7626147 - DNA, 22 bp, Homo sapiens
gagctggggcagcttaggagtg

SEQ ID NO: 7626148 - DNA, 22 bp, Homo sapiens
gagctggggcagcttaggagtg

SEQ ID NO: 7626149 - DNA, 22 bp, Homo sapiens
gagctgggctggcttcctccct

SEQ ID NO: 7626150 - DNA, 21 bp, Homo sapiens
gagctgggcgaggctccgggg

SEQ ID NO: 7626151 - DNA, 21 bp, Homo sapiens
gagctgggcgaggctccgggg

SEQ ID NO: 7626152 - DNA, 22 bp, Homo sapiens
gagctgggctggcttcctccct

SEQ ID NO: 7626153 - DNA, 22 bp, Homo sapiens
gagctgggctggcttcctccct

SEQ ID NO: 7626154 - DNA, 22 bp, Homo sapiens
gagctgggctggcttcctccct

SEQ ID NO: 7626155 - DNA, 21 bp, Homo sapiens
gagctgggcgaggctccgggg

SEQ ID NO: 7626156 - DNA, 21 bp, Homo sapiens
gagctgggcgaggctccgggg

SEQ ID NO: 7626157 - DNA, 21 bp, Homo sapiens
gagctgggcgaggctccgggg

SEQ ID NO: 7626158 - DNA, 21 bp, Homo sapiens
gagctgggcgaggctccgggg

SEQ ID NO: 7626159 - DNA, 21 bp, Homo sapiens
gagctgggcgaggctccgggg

SEQ ID NO: 7626160 - DNA, 21 bp, Homo sapiens
gagctgggcgaggctccgggg

SEQ ID NO: 7626161 - DNA, 21 bp, Homo sapiens
gagctgggcgaggctccgggg

SEQ ID NO: 7626162 - DNA, 21 bp, Homo sapiens
gagctgggcgaggctccgggg

SEQ ID NO: 7626163 - DNA, 22 bp, Homo sapiens
gagctgggcgagccggggaagt

SEQ ID NO: 7626164 - DNA, 22 bp, Homo sapiens
gagctgggcgagccggggaagt

SEQ ID NO: 7626165 - DNA, 22 bp, Homo sapiens
gagctgggcgagccggggaagt

SEQ ID NO: 7626166 - DNA, 22 bp, Homo sapiens
atggtcacaccactgtactcca

SEQ ID NO: 7626167 - DNA, 22 bp, Homo sapiens
atggtcacagagcttaattaat

SEQ ID NO: 7626168 - DNA, 22 bp, Homo sapiens
atggtcaccttgggagcctgct

SEQ ID NO: 7626169 - DNA, 22 bp, Homo sapiens
atggtcacatgaccctttccaa

SEQ ID NO: 7626170 - DNA, 22 bp, Homo sapiens
atggtcactttttgactgttca

SEQ ID NO: 7626171 - DNA, 23 bp, Homo sapiens
atggtcagaattttccagctgag

SEQ ID NO: 7626172 - DNA, 22 bp, Homo sapiens
atggtcaggcaaggagggctgg

SEQ ID NO: 7626173 - DNA, 22 bp, Homo sapiens
atggtcagggcaccctggcccc

SEQ ID NO: 7626174 - DNA, 22 bp, Homo sapiens
atggtccaagtcatctttgtgt

SEQ ID NO: 7626175 - DNA, 22 bp, Homo sapiens
atggtcataagaggagggccca

SEQ ID NO: 7626176 - DNA, 23 bp, Homo sapiens
atggtccagccagctgcacagga

SEQ ID NO: 7626177 - DNA, 22 bp, Homo sapiens
atggtcctttttgcctggatgc

SEQ ID NO: 7626178 - DNA, 17 bp, Homo sapiens
atggtctcactgagcaa

SEQ ID NO: 7626179 - DNA, 22 bp, Homo sapiens
gagctgggcctcagaacacagt

SEQ ID NO: 7626180 - DNA, 22 bp, Homo sapiens
gagctgggcctcagaacacagt

SEQ ID NO: 7626181 - DNA, 22 bp, Homo sapiens
gagctgggcctgcgagtgctgc

SEQ ID NO: 7626182 - DNA, 22 bp, Homo sapiens
gagctgggcgagccggggaagt

SEQ ID NO: 7626183 - DNA, 22 bp, Homo sapiens
gagctgggcgagccggggaagt

SEQ ID NO: 7626184 - DNA, 22 bp, Homo sapiens
gagctgggcctgcgagtgctgc

SEQ ID NO: 7626185 - DNA, 22 bp, Homo sapiens
gagctgggcctgcgagtgctgc

SEQ ID NO: 7626186 - DNA, 22 bp, Homo sapiens
gagctgggcctgcgagtgctgc

SEQ ID NO: 7626187 - DNA, 22 bp, Homo sapiens
gagctgggcctgcgagtgctgc

SEQ ID NO: 7626188 - DNA, 22 bp, Homo sapiens
gagctgggcctgcgagtgctgc

SEQ ID NO: 7626189 - DNA, 22 bp, Homo sapiens
gagctgggcctgcgagtgctgc

SEQ ID NO: 7626190 - DNA, 22 bp, Homo sapiens
gagctgggcctgcgagtgctgc

SEQ ID NO: 7626191 - DNA, 22 bp, Homo sapiens
gagctgggcctgcgagtgctgc

SEQ ID NO: 7626192 - DNA, 22 bp, Homo sapiens
gagctgggcctgcgagtgctgc

SEQ ID NO: 7626193 - DNA, 22 bp, Homo sapiens
gagctgggcctcagaacacagt

SEQ ID NO: 7626194 - DNA, 22 bp, Homo sapiens
gagctgggcctgcgagtgctgc

SEQ ID NO: 7626195 - DNA, 22 bp, Homo sapiens
gagctgggcctgcgagtgctgc

SEQ ID NO: 7626196 - DNA, 22 bp, Homo sapiens
gagctgggcctgcgagtgctgc

SEQ ID NO: 7626197 - DNA, 22 bp, Homo sapiens
gagctgggcctgcgagtgctgc

SEQ ID NO: 7626198 - DNA, 22 bp, Homo sapiens
gaggagctggctgtcgggaggc

SEQ ID NO: 7626199 - DNA, 22 bp, Homo sapiens
gaggagctggctgtcgggaggc

SEQ ID NO: 7626200 - DNA, 22 bp, Homo sapiens
gaggagctggctgtcgggaggc

SEQ ID NO: 7626201 - DNA, 22 bp, Homo sapiens
gaggagctggcgctatttatga

SEQ ID NO: 7626202 - DNA, 22 bp, Homo sapiens
gaggagctggctgtcgggaggc

SEQ ID NO: 7626203 - DNA, 22 bp, Homo sapiens
gaggagctggcgctatttatga

SEQ ID NO: 7626204 - DNA, 22 bp, Homo sapiens
gaggagctggcagcgtctccgc

SEQ ID NO: 7626205 - DNA, 22 bp, Homo sapiens
gaggagctggcagcgtctccgc

SEQ ID NO: 7626206 - DNA, 22 bp, Homo sapiens
gaggagctggcagcgtctccgc

SEQ ID NO: 7626207 - DNA, 22 bp, Homo sapiens
gaggagctgcccgtgtgtctgc

SEQ ID NO: 7626208 - DNA, 22 bp, Homo sapiens
gaggagctgcccgtgtgtctgc

SEQ ID NO: 7626209 - DNA, 22 bp, Homo sapiens
gaggagctgggaccctgtcatc

SEQ ID NO: 7626210 - DNA, 22 bp, Homo sapiens
gaggagctgggaccctgtcatc

SEQ ID NO: 7626211 - DNA, 22 bp, Homo sapiens
gaggagctgggaccctgtcatc

SEQ ID NO: 7626212 - DNA, 22 bp, Homo sapiens
gaggagctggctgtcgggaggc

SEQ ID NO: 7626213 - DNA, 22 bp, Homo sapiens
gaggagctggctgtcgggaggc

SEQ ID NO: 7626214 - DNA, 22 bp, Homo sapiens
gaggagctgggaccctgtcatc

SEQ ID NO: 7626215 - DNA, 22 bp, Homo sapiens
gaggagctgggctgagagggtc

SEQ ID NO: 7626216 - DNA, 22 bp, Homo sapiens
gaggagctgggctgagagggtc

SEQ ID NO: 7626217 - DNA, 22 bp, Homo sapiens
gaggagctgggctgagagggtc

SEQ ID NO: 7626218 - DNA, 22 bp, Homo sapiens
gaggagctgggctgagagggtc

SEQ ID NO: 7626219 - DNA, 22 bp, Homo sapiens
gaggagctgggaccctgtcatc

SEQ ID NO: 7626220 - DNA, 22 bp, Homo sapiens
gaggagctgggaccctgtcatc

SEQ ID NO: 7626221 - DNA, 22 bp, Homo sapiens
gaggagctgggctgagagggtc

SEQ ID NO: 7626222 - DNA, 22 bp, Homo sapiens
gaggagctgggctgagagggtc

SEQ ID NO: 7626223 - DNA, 22 bp, Homo sapiens
gaggagctgggtcagggagaca

SEQ ID NO: 7626224 - DNA, 22 bp, Homo sapiens
gaggagctgggtcagggagaca

SEQ ID NO: 7626225 - DNA, 23 bp, Homo sapiens
gaggccacattcccctgcttgag

SEQ ID NO: 7626226 - DNA, 22 bp, Homo sapiens
gaggccaccctatgggtcccag

SEQ ID NO: 7626227 - DNA, 22 bp, Homo sapiens
gaggccaccctatgggtcccag

SEQ ID NO: 7626228 - DNA, 22 bp, Homo sapiens
gaggccaccctatgggtcccag

SEQ ID NO: 7626229 - DNA, 22 bp, Homo sapiens
gaggccaccctatgggtcccag

SEQ ID NO: 7626230 - DNA, 22 bp, Homo sapiens
gaggccaggaggatctctctaa

SEQ ID NO: 7626231 - DNA, 22 bp, Homo sapiens
gaggccaggagtgctgtaagtt

SEQ ID NO: 7626232 - DNA, 22 bp, Homo sapiens
gaggccaggagtgctgtaagtt

SEQ ID NO: 7626233 - DNA, 22 bp, Homo sapiens
gaggccaggagtgctgtaagtt

SEQ ID NO: 7626234 - DNA, 22 bp, Homo sapiens
gaggccaggagtgctgtaagtt

SEQ ID NO: 7626235 - DNA, 22 bp, Homo sapiens
gaggccaggagtgctgtaagtt

SEQ ID NO: 7626236 - DNA, 22 bp, Homo sapiens
gaggccaggagtgctgtaagtt

SEQ ID NO: 7626237 - DNA, 22 bp, Homo sapiens
gaggccaggagtgctgtaagtt

SEQ ID NO: 7626238 - DNA, 22 bp, Homo sapiens
gaggccaggaggatctctctaa

SEQ ID NO: 7626239 - DNA, 22 bp, Homo sapiens
gaggccaggagtgctgtaagtt

SEQ ID NO: 7626240 - DNA, 22 bp, Homo sapiens
gaggccacggaagggagctgtg

SEQ ID NO: 7626241 - DNA, 22 bp, Homo sapiens
gaggccagggatgcaatgagag

SEQ ID NO: 7626242 - DNA, 22 bp, Homo sapiens
gaggccagggatgcaatgagag

SEQ ID NO: 7626243 - DNA, 22 bp, Homo sapiens
gaggccagggatgcaatgagag

SEQ ID NO: 7626244 - DNA, 22 bp, Homo sapiens
gaggccagggatgcaatgagag

SEQ ID NO: 7626245 - DNA, 22 bp, Homo sapiens
gaggccagggatgcaatgagag

SEQ ID NO: 7626246 - DNA, 22 bp, Homo sapiens
gaggccaggggagtcagcgtcc

SEQ ID NO: 7626247 - DNA, 22 bp, Homo sapiens
gaggccaggggagtcagcgtcc

SEQ ID NO: 7626248 - DNA, 22 bp, Homo sapiens
gaggccaggggagtcagcgtcc

SEQ ID NO: 7626249 - DNA, 22 bp, Homo sapiens
gaggccaggggcctggagatga

SEQ ID NO: 7626250 - DNA, 22 bp, Homo sapiens
gaggccaggggagtcagcgtcc

SEQ ID NO: 7626251 - DNA, 22 bp, Homo sapiens
gaggccaggggagtcagcgtcc

SEQ ID NO: 7626252 - DNA, 22 bp, Homo sapiens
gaggccaggggagtcagcgtcc

SEQ ID NO: 7626253 - DNA, 22 bp, Homo sapiens
gaggccaggggcctggagatga

SEQ ID NO: 7626254 - DNA, 22 bp, Homo sapiens
gaggccaggggcctggagatga

SEQ ID NO: 7626255 - DNA, 22 bp, Homo sapiens
gaggccaggggcctggagatga

SEQ ID NO: 7626256 - DNA, 22 bp, Homo sapiens
gaggccaggggcctggagatga

SEQ ID NO: 7626257 - DNA, 22 bp, Homo sapiens
gaggccaggggcctggagatga

SEQ ID NO: 7626258 - DNA, 22 bp, Homo sapiens
gaggccaggggcctggagatga

SEQ ID NO: 7626259 - DNA, 22 bp, Homo sapiens
gaggccagggtaccatcaacat

SEQ ID NO: 7626260 - DNA, 22 bp, Homo sapiens
gaggccaggggtcagcaattgg

SEQ ID NO: 7626261 - DNA, 22 bp, Homo sapiens
gaggccaggggtcagcaattgg

SEQ ID NO: 7626262 - DNA, 22 bp, Homo sapiens
gaggccaggggtcagcaattgg

SEQ ID NO: 7626263 - DNA, 22 bp, Homo sapiens
gaggccagggtaccatcaacat

SEQ ID NO: 7626264 - DNA, 22 bp, Homo sapiens
gaggccagggtaccatcaacat

SEQ ID NO: 7626265 - DNA, 22 bp, Homo sapiens
gaggccagggtaccatcaacat

SEQ ID NO: 7626266 - DNA, 22 bp, Homo sapiens
gaggccagggtaccatcaacat

SEQ ID NO: 7626267 - DNA, 19 bp, Homo sapiens
atgtacccagtgtcaatcc

SEQ ID NO: 7626268 - DNA, 19 bp, Homo sapiens
atgtacccagtgtcaatcc

SEQ ID NO: 7626269 - DNA, 22 bp, Homo sapiens
atgtacctctgcattcctgcct

SEQ ID NO: 7626270 - DNA, 22 bp, Homo sapiens
atgtactactacttgagtgagc

SEQ ID NO: 7626271 - DNA, 22 bp, Homo sapiens
atgtactatgcagtcaactgtt

SEQ ID NO: 7626272 - DNA, 22 bp, Homo sapiens
atgtactaaagaaatttgcagg

SEQ ID NO: 7626273 - DNA, 22 bp, Homo sapiens
atgtactaaagaaatttgcagg

SEQ ID NO: 7626274 - DNA, 19 bp, Homo sapiens
atgtacccagtgtcaatcc

SEQ ID NO: 7626275 - DNA, 22 bp, Homo sapiens
gaggagctcatgaaagcggtgt

SEQ ID NO: 7626276 - DNA, 22 bp, Homo sapiens
gaggagctcatgaaagcggtgt

SEQ ID NO: 7626277 - DNA, 22 bp, Homo sapiens
gaggagctcatgaaagcggtgt

SEQ ID NO: 7626278 - DNA, 22 bp, Homo sapiens
atgtagaaagttattgtcactg

SEQ ID NO: 7626279 - DNA, 22 bp, Homo sapiens
atgtagaaagttattttactct

SEQ ID NO: 7626280 - DNA, 22 bp, Homo sapiens
atgtagaaagttattttactct

SEQ ID NO: 7626281 - DNA, 19 bp, Homo sapiens
gaggagctatcggagacag

SEQ ID NO: 7626282 - DNA, 17 bp, Homo sapiens
gaggagctccagtaggt

SEQ ID NO: 7626283 - DNA, 22 bp, Homo sapiens
gaggagctcatgaaagcggtgt

SEQ ID NO: 7626284 - DNA, 17 bp, Homo sapiens
gaggagctccagtaggt

SEQ ID NO: 7626285 - DNA, 17 bp, Homo sapiens
gaggagctccagtaggt

SEQ ID NO: 7626286 - DNA, 22 bp, Homo sapiens
gaggagctgaggctgaggcctc

SEQ ID NO: 7626287 - DNA, 22 bp, Homo sapiens
gaggagctgaggctgaggcctc

SEQ ID NO: 7626288 - DNA, 22 bp, Homo sapiens
gaggagctgaggctgaggcctc

SEQ ID NO: 7626289 - DNA, 22 bp, Homo sapiens
gaggagctgatatttataatga

SEQ ID NO: 7626290 - DNA, 22 bp, Homo sapiens
gaggagctgatatttataatga

SEQ ID NO: 7626291 - DNA, 22 bp, Homo sapiens
gaggagctgaggctgaggcctc

SEQ ID NO: 7626292 - DNA, 22 bp, Homo sapiens
gaggagctgcagggggagtcta

SEQ ID NO: 7626293 - DNA, 22 bp, Homo sapiens
gaggagctgcagggggagtcta

SEQ ID NO: 7626294 - DNA, 22 bp, Homo sapiens
gaggagctgcagggggagtcta

SEQ ID NO: 7626295 - DNA, 22 bp, Homo sapiens
gaggagctgcagggggagtcta

SEQ ID NO: 7626296 - DNA, 22 bp, Homo sapiens
gaggagctgcagggggagtcta

SEQ ID NO: 7626297 - DNA, 22 bp, Homo sapiens
gaggagctgcagggggagtcta

SEQ ID NO: 7626298 - DNA, 22 bp, Homo sapiens
gaggagctctgctccatccttc

SEQ ID NO: 7626299 - DNA, 17 bp, Homo sapiens
gaggagctccagtaggt

SEQ ID NO: 7626300 - DNA, 22 bp, Homo sapiens
gaggagctctgctccatccttc

SEQ ID NO: 7626301 - DNA, 17 bp, Homo sapiens
gaggagctccagtaggt

SEQ ID NO: 7626302 - DNA, 22 bp, Homo sapiens
gaggagctctgctccatccttc

SEQ ID NO: 7626303 - DNA, 22 bp, Homo sapiens
gaggagctctgctccatccttc

SEQ ID NO: 7626304 - DNA, 22 bp, Homo sapiens
gaggagctgagccacgtcctgg

SEQ ID NO: 7626305 - DNA, 22 bp, Homo sapiens
gaggagctgagccacgtcctgg

SEQ ID NO: 7626306 - DNA, 22 bp, Homo sapiens
gaggagctgagccacgtcctgg

SEQ ID NO: 7626307 - DNA, 22 bp, Homo sapiens
gaggagctgaggctgaggcctc

SEQ ID NO: 7626308 - DNA, 22 bp, Homo sapiens
gaggagctgaggctgaggcctc

SEQ ID NO: 7626309 - DNA, 22 bp, Homo sapiens
gaggagctgaggctgaggcctc

SEQ ID NO: 7626310 - DNA, 22 bp, Homo sapiens
atgtacattcttctcaccgaag

SEQ ID NO: 7626311 - DNA, 22 bp, Homo sapiens
atgtacattcttctcaccgaag

SEQ ID NO: 7626312 - DNA, 22 bp, Homo sapiens
atgtacattctaagtatgtgta

SEQ ID NO: 7626313 - DNA, 22 bp, Homo sapiens
atgtacattctaagtatgtgta

SEQ ID NO: 7626314 - DNA, 22 bp, Homo sapiens
atgtacattctaagtatgtgta

SEQ ID NO: 7626315 - DNA, 21 bp, Homo sapiens
atgtacattcggcaacagata

SEQ ID NO: 7626316 - DNA, 18 bp, Homo sapiens
atgtacatgtactcacac

SEQ ID NO: 7626317 - DNA, 18 bp, Homo sapiens
atgtacatgtactcacac

SEQ ID NO: 7626318 - DNA, 18 bp, Homo sapiens
atgtacatgtactcacac

SEQ ID NO: 7626319 - DNA, 18 bp, Homo sapiens
atgtacatgtactcacac

SEQ ID NO: 7626320 - DNA, 18 bp, Homo sapiens
atgtacatgtactcacac

SEQ ID NO: 7626321 - DNA, 22 bp, Homo sapiens
atgtacatgtgaatttaggcaa

SEQ ID NO: 7626322 - DNA, 21 bp, Homo sapiens
atgtacattcggcaacagata

SEQ ID NO: 7626323 - DNA, 21 bp, Homo sapiens
atgtacattcggcaacagata

SEQ ID NO: 7626324 - DNA, 22 bp, Homo sapiens
atgtacattattcgagtgatgg

SEQ ID NO: 7626325 - DNA, 22 bp, Homo sapiens
atgtacatgtttaagtgaagga

SEQ ID NO: 7626326 - DNA, 22 bp, Homo sapiens
atgtacatgtttaagtgaagga

SEQ ID NO: 7626327 - DNA, 22 bp, Homo sapiens
atgtacatgtttaagtgaagga

SEQ ID NO: 7626328 - DNA, 22 bp, Homo sapiens
atgtacattattcgagtgatgg

SEQ ID NO: 7626329 - DNA, 22 bp, Homo sapiens
atgtacattattcgagtgatgg

SEQ ID NO: 7626330 - DNA, 22 bp, Homo sapiens
atgtacattttcctaatgtttt

SEQ ID NO: 7626331 - DNA, 22 bp, Homo sapiens
atgtacattttcctaatgtttt

SEQ ID NO: 7626332 - DNA, 22 bp, Homo sapiens
atgtacattttcctaatgtttt

SEQ ID NO: 7626333 - DNA, 22 bp, Homo sapiens
atgtacatttgtagtaatatca

SEQ ID NO: 7626334 - DNA, 22 bp, Homo sapiens
atgtacatttgtagtaatatca

SEQ ID NO: 7626335 - DNA, 19 bp, Homo sapiens
atgtacccagtgtcaatcc

SEQ ID NO: 7626336 - DNA, 22 bp, Homo sapiens
atgtaccagatgtatgttctca

SEQ ID NO: 7626337 - DNA, 22 bp, Homo sapiens
atgtacattttcctaatgtttt

SEQ ID NO: 7626338 - DNA, 22 bp, Homo sapiens
atgtaccagatgtatgttctca

SEQ ID NO: 7626339 - DNA, 22 bp, Homo sapiens
atgtaccagatgtatgttctca

SEQ ID NO: 7626340 - DNA, 22 bp, Homo sapiens
atgtacatttgtagtaatatca

SEQ ID NO: 7626341 - DNA, 22 bp, Homo sapiens
atgtacatttgtagtaatatca

SEQ ID NO: 7626342 - DNA, 22 bp, Homo sapiens
atgtacatttgtagtaatatca

SEQ ID NO: 7626343 - DNA, 22 bp, Homo sapiens
atgtacatttgtagtaatatca

SEQ ID NO: 7626344 - DNA, 18 bp, Homo sapiens
atgtacatttgctaaagc

SEQ ID NO: 7626345 - DNA, 18 bp, Homo sapiens
atgtacatttgctaaagc

SEQ ID NO: 7626346 - DNA, 18 bp, Homo sapiens
atgtacatttgctaaagc

SEQ ID NO: 7626347 - DNA, 18 bp, Homo sapiens
atgtacatttgctaaagc

SEQ ID NO: 7626348 - DNA, 22 bp, Homo sapiens
atgtacatttagatcatttctg

SEQ ID NO: 7626349 - DNA, 22 bp, Homo sapiens
atggcagcggagctggaaatga

SEQ ID NO: 7626350 - DNA, 22 bp, Homo sapiens
atggcagctggcttgggcacct

SEQ ID NO: 7626351 - DNA, 23 bp, Homo sapiens
gagaacagccacagagagctgtg

SEQ ID NO: 7626352 - DNA, 22 bp, Homo sapiens
atggcagcggagctggaaatga

SEQ ID NO: 7626353 - DNA, 22 bp, Homo sapiens
atggcagcggagctggaaatga

SEQ ID NO: 7626354 - DNA, 22 bp, Homo sapiens
atggcagctttgaatttcttga

SEQ ID NO: 7626355 - DNA, 22 bp, Homo sapiens
atggcagctttgaatttcttga

SEQ ID NO: 7626356 - DNA, 22 bp, Homo sapiens
atggcagctttcattgtccaca

SEQ ID NO: 7626357 - DNA, 22 bp, Homo sapiens
atggcagctttcattgtccaca

SEQ ID NO: 7626358 - DNA, 22 bp, Homo sapiens
atggcagctggcttgggcacct

SEQ ID NO: 7626359 - DNA, 22 bp, Homo sapiens
atggcagctggcttgggcacct

SEQ ID NO: 7626360 - DNA, 22 bp, Homo sapiens
atggcagctggcttgggcacct

SEQ ID NO: 7626361 - DNA, 22 bp, Homo sapiens
atggcaggatacccagtccggc

SEQ ID NO: 7626362 - DNA, 22 bp, Homo sapiens
atggcaggatacccagtccggc

SEQ ID NO: 7626363 - DNA, 22 bp, Homo sapiens
atggcaggatacccagtccggc

SEQ ID NO: 7626364 - DNA, 22 bp, Homo sapiens
atggcaggatacccagtccggc

SEQ ID NO: 7626365 - DNA, 22 bp, Homo sapiens
atggcaggatgagacaacaatt

SEQ ID NO: 7626366 - DNA, 22 bp, Homo sapiens
atggcaggcccaggtgttcatt

SEQ ID NO: 7626367 - DNA, 22 bp, Homo sapiens
atggcagggaccaagctgtcat

SEQ ID NO: 7626368 - DNA, 22 bp, Homo sapiens
atggcagggaccaagctgtcat

SEQ ID NO: 7626369 - DNA, 22 bp, Homo sapiens
atggcaggcccaggtgttcatt

SEQ ID NO: 7626370 - DNA, 22 bp, Homo sapiens
atggcagagggattgaacagct

SEQ ID NO: 7626371 - DNA, 22 bp, Homo sapiens
atggcagagggattgaacagct

SEQ ID NO: 7626372 - DNA, 23 bp, Homo sapiens
gagaacagccacagagagctgtg

SEQ ID NO: 7626373 - DNA, 23 bp, Homo sapiens
gagaacagccacagagagctgtg

SEQ ID NO: 7626374 - DNA, 22 bp, Homo sapiens
gagaacactaatggtttcttaa

SEQ ID NO: 7626375 - DNA, 22 bp, Homo sapiens
gagaacagatttttctgctgtc

SEQ ID NO: 7626376 - DNA, 22 bp, Homo sapiens
gagaacagatttttctgctgtc

SEQ ID NO: 7626377 - DNA, 22 bp, Homo sapiens
gagaacactaatggtttcttaa

SEQ ID NO: 7626378 - DNA, 22 bp, Homo sapiens
gagaacactaatggtttcttaa

SEQ ID NO: 7626379 - DNA, 22 bp, Homo sapiens
gagaacacgaggaggcccagcg

SEQ ID NO: 7626380 - DNA, 22 bp, Homo sapiens
gagaacacttatggattattct

SEQ ID NO: 7626381 - DNA, 22 bp, Homo sapiens
gagaacagaagcattcctaatt

SEQ ID NO: 7626382 - DNA, 22 bp, Homo sapiens
gagaacagaagcattcctaatt

SEQ ID NO: 7626383 - DNA, 22 bp, Homo sapiens
gagaacagagataattttactt

SEQ ID NO: 7626384 - DNA, 22 bp, Homo sapiens
gagaacagaagcattcctaatt

SEQ ID NO: 7626385 - DNA, 22 bp, Homo sapiens
gagaacagatttttctgctgtc

SEQ ID NO: 7626386 - DNA, 22 bp, Homo sapiens
gagaacagatttttctgctgtc

SEQ ID NO: 7626387 - DNA, 22 bp, Homo sapiens
atggcagggcagcctctcagag

SEQ ID NO: 7626388 - DNA, 22 bp, Homo sapiens
atggcagggcagcctctcagag

SEQ ID NO: 7626389 - DNA, 22 bp, Homo sapiens
atggcagggcagcctctcagag

SEQ ID NO: 7626390 - DNA, 22 bp, Homo sapiens
atggcagggcccttggctccca

SEQ ID NO: 7626391 - DNA, 22 bp, Homo sapiens
atggcagggcccttggctccca

SEQ ID NO: 7626392 - DNA, 22 bp, Homo sapiens
atggcagggcccttggctccca

SEQ ID NO: 7626393 - DNA, 22 bp, Homo sapiens
atggcagggaccaagctgtcat

SEQ ID NO: 7626394 - DNA, 22 bp, Homo sapiens
atggcagggaccaagctgtcat

SEQ ID NO: 7626395 - DNA, 22 bp, Homo sapiens
atggcagggactgtggcccttg

SEQ ID NO: 7626396 - DNA, 22 bp, Homo sapiens
atggcagggactgtggcccttg

SEQ ID NO: 7626397 - DNA, 22 bp, Homo sapiens
atggcagggcacagctctagtt

SEQ ID NO: 7626398 - DNA, 22 bp, Homo sapiens
atggcagggcacagctctagtt

SEQ ID NO: 7626399 - DNA, 22 bp, Homo sapiens
atggcagggactgtggcccttg

SEQ ID NO: 7626400 - DNA, 22 bp, Homo sapiens
atggcagggactgtggcccttg

SEQ ID NO: 7626401 - DNA, 22 bp, Homo sapiens
atggcagggactgtggcccttg

SEQ ID NO: 7626402 - DNA, 22 bp, Homo sapiens
atggcagtcagagacaggcaga

SEQ ID NO: 7626403 - DNA, 20 bp, Homo sapiens
atggcagtccgtgttcaggg

SEQ ID NO: 7626404 - DNA, 20 bp, Homo sapiens
atggcagtccgtgttcaggg

SEQ ID NO: 7626405 - DNA, 22 bp, Homo sapiens
atggcagtatttgtatcacaga

SEQ ID NO: 7626406 - DNA, 22 bp, Homo sapiens
atggcagtcagagacaggcaga

SEQ ID NO: 7626407 - DNA, 22 bp, Homo sapiens
atggcagtcagagacaggcaga

SEQ ID NO: 7626408 - DNA, 22 bp, Homo sapiens
atggcagtgacttgaagggtag

SEQ ID NO: 7626409 - DNA, 22 bp, Homo sapiens
atggcagtgacttgaagggtag

SEQ ID NO: 7626410 - DNA, 22 bp, Homo sapiens
atggcagtgataggctagtgat

SEQ ID NO: 7626411 - DNA, 22 bp, Homo sapiens
atggcagtgacttgaagggtag

SEQ ID NO: 7626412 - DNA, 22 bp, Homo sapiens
atggcagtggaatgggatgagt

SEQ ID NO: 7626413 - DNA, 22 bp, Homo sapiens
atggcagtgataggctagtgat

SEQ ID NO: 7626414 - DNA, 22 bp, Homo sapiens
atggcagtggaatgggatgagt

SEQ ID NO: 7626415 - DNA, 22 bp, Homo sapiens
atggcagtggaatgggatgagt

SEQ ID NO: 7626416 - DNA, 22 bp, Homo sapiens
atggcagtatttctgaaaggct

SEQ ID NO: 7626417 - DNA, 22 bp, Homo sapiens
atggcagtatttgtatcacaga

SEQ ID NO: 7626418 - DNA, 22 bp, Homo sapiens
atggcagtatttgtatcacaga

SEQ ID NO: 7626419 - DNA, 22 bp, Homo sapiens
atggcagtagaatgggggaaaa

SEQ ID NO: 7626420 - DNA, 22 bp, Homo sapiens
atggcagtatttcagtacagag

SEQ ID NO: 7626421 - DNA, 22 bp, Homo sapiens
atggcagtatttctgaaaggct

SEQ ID NO: 7626422 - DNA, 22 bp, Homo sapiens
atggcagtatttctgaaaggct

SEQ ID NO: 7626423 - DNA, 22 bp, Homo sapiens
atggcagtagaatgggggaaaa

SEQ ID NO: 7626424 - DNA, 22 bp, Homo sapiens
atggcagtacgttgaaaatttt

SEQ ID NO: 7626425 - DNA, 22 bp, Homo sapiens
atggcagggtctgtcttcagct

SEQ ID NO: 7626426 - DNA, 22 bp, Homo sapiens
atggcagggtctgtcttcagct

SEQ ID NO: 7626427 - DNA, 22 bp, Homo sapiens
atggcagggcccttggctccca

SEQ ID NO: 7626428 - DNA, 22 bp, Homo sapiens
atggcagggcccttggctccca

SEQ ID NO: 7626429 - DNA, 22 bp, Homo sapiens
gagagctgtgttcattctacca

SEQ ID NO: 7626430 - DNA, 22 bp, Homo sapiens
gagagctgtgttcattctacca

SEQ ID NO: 7626431 - DNA, 22 bp, Homo sapiens
gagagctgtggtttgaccaggc

SEQ ID NO: 7626432 - DNA, 22 bp, Homo sapiens
gagagctgtggtttgaccaggc

SEQ ID NO: 7626433 - DNA, 22 bp, Homo sapiens
gagagctgtggtttgaccaggc

SEQ ID NO: 7626434 - DNA, 22 bp, Homo sapiens
gagagctgtttatcttcttcaa

SEQ ID NO: 7626435 - DNA, 22 bp, Homo sapiens
gagagctgtttatcttcttcaa

SEQ ID NO: 7626436 - DNA, 22 bp, Homo sapiens
gagagctgtttatcttcttcaa

SEQ ID NO: 7626437 - DNA, 22 bp, Homo sapiens
gagagctgtgttcattctacca

SEQ ID NO: 7626438 - DNA, 22 bp, Homo sapiens
gagagctgtttatcttcttcaa

SEQ ID NO: 7626439 - DNA, 22 bp, Homo sapiens
gagagctgtttatcttcttcaa

SEQ ID NO: 7626440 - DNA, 22 bp, Homo sapiens
gagaggaaagaaccaatgaccc

SEQ ID NO: 7626441 - DNA, 22 bp, Homo sapiens
gagaggaaagaaccaatgaccc

SEQ ID NO: 7626442 - DNA, 22 bp, Homo sapiens
gagaggaaagaaccaatgaccc

SEQ ID NO: 7626443 - DNA, 22 bp, Homo sapiens
gagagctttcccattttgctta

SEQ ID NO: 7626444 - DNA, 22 bp, Homo sapiens
atggcatcgtcaccttttcagt

SEQ ID NO: 7626445 - DNA, 22 bp, Homo sapiens
atggcatcatctttcttcatta

SEQ ID NO: 7626446 - DNA, 22 bp, Homo sapiens
atggcagttttagaacttttca

SEQ ID NO: 7626447 - DNA, 22 bp, Homo sapiens
atggcagtttcactctgggatt

SEQ ID NO: 7626448 - DNA, 22 bp, Homo sapiens
atggcagtttcactctgggatt

SEQ ID NO: 7626449 - DNA, 22 bp, Homo sapiens
atggcagtttcactctgggatt

SEQ ID NO: 7626450 - DNA, 22 bp, Homo sapiens
atggcagtgtttcagtttttgg

SEQ ID NO: 7626451 - DNA, 22 bp, Homo sapiens
atggcagtgtttcagtttttgg

SEQ ID NO: 7626452 - DNA, 22 bp, Homo sapiens
atggcagttgtatgggctgtat

SEQ ID NO: 7626453 - DNA, 22 bp, Homo sapiens
atggcagttgtatgggctgtat

SEQ ID NO: 7626454 - DNA, 22 bp, Homo sapiens
atggcagttgcccagccaatcc

SEQ ID NO: 7626455 - DNA, 22 bp, Homo sapiens
atggcagttgcccagccaatcc

SEQ ID NO: 7626456 - DNA, 22 bp, Homo sapiens
gagagctgtccggctgagcagc

SEQ ID NO: 7626457 - DNA, 22 bp, Homo sapiens
gagagctgtccggctgagcagc

SEQ ID NO: 7626458 - DNA, 22 bp, Homo sapiens
atggcatctcaacttacaaaag

SEQ ID NO: 7626459 - DNA, 22 bp, Homo sapiens
gagagctgtccggctgagcagc

SEQ ID NO: 7626460 - DNA, 22 bp, Homo sapiens
gagagctgtggtttgaccaggc

SEQ ID NO: 7626461 - DNA, 22 bp, Homo sapiens
gagagctgtggtttgaccaggc

SEQ ID NO: 7626462 - DNA, 22 bp, Homo sapiens
gagagctgtggtttgaccaggc

SEQ ID NO: 7626463 - DNA, 22 bp, Homo sapiens
gagagctgtccggctgagcagc

SEQ ID NO: 7626464 - DNA, 22 bp, Homo sapiens
gagaggaactcccagtgcctgg

SEQ ID NO: 7626465 - DNA, 22 bp, Homo sapiens
gagaggaactcccagtgcctgg

SEQ ID NO: 7626466 - DNA, 22 bp, Homo sapiens
gagaggaactcccagtgcctgg

SEQ ID NO: 7626467 - DNA, 22 bp, Homo sapiens
gagaggaactcccagtgcctgg

SEQ ID NO: 7626468 - DNA, 22 bp, Homo sapiens
gagaggaactcccagtgcctgg

SEQ ID NO: 7626469 - DNA, 22 bp, Homo sapiens
gagaggaactcccagtgcctgg

SEQ ID NO: 7626470 - DNA, 22 bp, Homo sapiens
gagaggaactcccagtgcctgg

SEQ ID NO: 7626471 - DNA, 22 bp, Homo sapiens
gagaggaagccagggggtgttg

SEQ ID NO: 7626472 - DNA, 22 bp, Homo sapiens
gagaggaagccagggggtgttg

SEQ ID NO: 7626473 - DNA, 22 bp, Homo sapiens
gagaggaagccagggggtgttg

SEQ ID NO: 7626474 - DNA, 22 bp, Homo sapiens
gagaggaagccagggggtgttg

SEQ ID NO: 7626475 - DNA, 22 bp, Homo sapiens
gagaggaagccagggggtgttg

SEQ ID NO: 7626476 - DNA, 22 bp, Homo sapiens
gagaggaagccagggggtgttg

SEQ ID NO: 7626477 - DNA, 22 bp, Homo sapiens
gagaggaaagatatatacttct

SEQ ID NO: 7626478 - DNA, 22 bp, Homo sapiens
gagaggaaagatatatacttct

SEQ ID NO: 7626479 - DNA, 22 bp, Homo sapiens
gagaggaactcccagtgcctgg

SEQ ID NO: 7626480 - DNA, 22 bp, Homo sapiens
gagaggaactcccagtgcctgg

SEQ ID NO: 7626481 - DNA, 22 bp, Homo sapiens
gagaggaactcccagtgcctgg

SEQ ID NO: 7626482 - DNA, 22 bp, Homo sapiens
gagaggaaagatatatacttct

SEQ ID NO: 7626483 - DNA, 22 bp, Homo sapiens
gagaggaaagatatatacttct

SEQ ID NO: 7626484 - DNA, 22 bp, Homo sapiens
gagaggaaagatatatacttct

SEQ ID NO: 7626485 - DNA, 22 bp, Homo sapiens
gagaggaaagaaccaatgaccc

SEQ ID NO: 7626486 - DNA, 22 bp, Homo sapiens
atggccagtcaagcctctggct

SEQ ID NO: 7626487 - DNA, 22 bp, Homo sapiens
atggccagtctattcatggtta

SEQ ID NO: 7626488 - DNA, 22 bp, Homo sapiens
atggccagtctattcatggtta

SEQ ID NO: 7626489 - DNA, 22 bp, Homo sapiens
atggccagtctgttggacagca

SEQ ID NO: 7626490 - DNA, 22 bp, Homo sapiens
atggccagtctgttggacagca

SEQ ID NO: 7626491 - DNA, 22 bp, Homo sapiens
atggccagtctgactagtttcc

SEQ ID NO: 7626492 - DNA, 22 bp, Homo sapiens
atggccagtctgactagtttcc

SEQ ID NO: 7626493 - DNA, 22 bp, Homo sapiens
atggccagtctattcatggtta

SEQ ID NO: 7626494 - DNA, 22 bp, Homo sapiens
atggccagtctgttggacagca

SEQ ID NO: 7626495 - DNA, 22 bp, Homo sapiens
atggccagtctgttggacagca

SEQ ID NO: 7626496 - DNA, 22 bp, Homo sapiens
atggccagtctgttggacagca

SEQ ID NO: 7626497 - DNA, 22 bp, Homo sapiens
gagaggaagccttctgtacttg

SEQ ID NO: 7626498 - DNA, 22 bp, Homo sapiens
gagaggaagccttctgtacttg

SEQ ID NO: 7626499 - DNA, 22 bp, Homo sapiens
gagaggaagccttctgtacttg

SEQ ID NO: 7626500 - DNA, 22 bp, Homo sapiens
gagaggaagccttctgtacttg

SEQ ID NO: 7626501 - DNA, 22 bp, Homo sapiens
atggccagatgaaataatagag

SEQ ID NO: 7626502 - DNA, 21 bp, Homo sapiens
atggccagatctattaggtgg

SEQ ID NO: 7626503 - DNA, 22 bp, Homo sapiens
atggccagatgaaataatagag

SEQ ID NO: 7626504 - DNA, 22 bp, Homo sapiens
atggccagcaaggtagggcaat

SEQ ID NO: 7626505 - DNA, 22 bp, Homo sapiens
atggccagcaaggtagggcaat

SEQ ID NO: 7626506 - DNA, 22 bp, Homo sapiens
atggccagcaaggtagggcaat

SEQ ID NO: 7626507 - DNA, 22 bp, Homo sapiens
atggccagcaaggtagggcaat

SEQ ID NO: 7626508 - DNA, 22 bp, Homo sapiens
atggccagattatatggttttt

SEQ ID NO: 7626509 - DNA, 22 bp, Homo sapiens
gagccagctgagctgcactgtc

SEQ ID NO: 7626510 - DNA, 22 bp, Homo sapiens
gagccagctgagctgcactgtc

SEQ ID NO: 7626511 - DNA, 22 bp, Homo sapiens
gagccagctgagctgcactgtc

SEQ ID NO: 7626512 - DNA, 22 bp, Homo sapiens
gagccagctgagctgcactgtc

SEQ ID NO: 7626513 - DNA, 22 bp, Homo sapiens
gagccagctatgtagcaagagg

SEQ ID NO: 7626514 - DNA, 22 bp, Homo sapiens
gagccagctgagctgcactgtc

SEQ ID NO: 7626515 - DNA, 22 bp, Homo sapiens
gagccagctgagctgcactgtc

SEQ ID NO: 7626516 - DNA, 22 bp, Homo sapiens
gagccagctatgtagcaagagg

SEQ ID NO: 7626517 - DNA, 22 bp, Homo sapiens
gagccagctatgtagcaagagg

SEQ ID NO: 7626518 - DNA, 22 bp, Homo sapiens
gagccagcgccttgcctctggg

SEQ ID NO: 7626519 - DNA, 22 bp, Homo sapiens
gagccagcgccttgcctctggg

SEQ ID NO: 7626520 - DNA, 22 bp, Homo sapiens
gagccagcgccttgcctctggg

SEQ ID NO: 7626521 - DNA, 22 bp, Homo sapiens
gagccagctacatggtctgcaa

SEQ ID NO: 7626522 - DNA, 22 bp, Homo sapiens
gagccagctacatggtctgcaa

SEQ ID NO: 7626523 - DNA, 22 bp, Homo sapiens
gagccagctatgtagcaagagg

SEQ ID NO: 7626524 - DNA, 22 bp, Homo sapiens
gagccagctatgtagcaagagg

SEQ ID NO: 7626525 - DNA, 22 bp, Homo sapiens
gagccagctacatggtctgcaa

SEQ ID NO: 7626526 - DNA, 22 bp, Homo sapiens
gagccagctacatggtctgcaa

SEQ ID NO: 7626527 - DNA, 22 bp, Homo sapiens
gagccagctacatggtctgcaa

SEQ ID NO: 7626528 - DNA, 22 bp, Homo sapiens
gagccaggaagaaggccttact

SEQ ID NO: 7626529 - DNA, 22 bp, Homo sapiens
gagccaggagatacctaagggg

SEQ ID NO: 7626530 - DNA, 22 bp, Homo sapiens
gagccaggagatacctaagggg

SEQ ID NO: 7626531 - DNA, 22 bp, Homo sapiens
gagccaggagatacctaagggg

SEQ ID NO: 7626532 - DNA, 22 bp, Homo sapiens
gagccaggaagaaggccttact

SEQ ID NO: 7626533 - DNA, 22 bp, Homo sapiens
gagccaggaagaaggccttact

SEQ ID NO: 7626534 - DNA, 22 bp, Homo sapiens
gagccaggaagaaggccttact

SEQ ID NO: 7626535 - DNA, 22 bp, Homo sapiens
gagccaggaagaaggccttact

SEQ ID NO: 7626536 - DNA, 22 bp, Homo sapiens
gagccagctgagctgcactgtc

SEQ ID NO: 7626537 - DNA, 22 bp, Homo sapiens
gagccaggagatacctaagggg

SEQ ID NO: 7626538 - DNA, 22 bp, Homo sapiens
gagccaggagatacctaagggg

SEQ ID NO: 7626539 - DNA, 22 bp, Homo sapiens
gagccaggaggcagagactgca

SEQ ID NO: 7626540 - DNA, 22 bp, Homo sapiens
gagccaggaggcagagactgca

SEQ ID NO: 7626541 - DNA, 22 bp, Homo sapiens
gagccaggaggcagagactgca

SEQ ID NO: 7626542 - DNA, 22 bp, Homo sapiens
gagccaggaggcagagactgca

SEQ ID NO: 7626543 - DNA, 22 bp, Homo sapiens
gagccaggaggcagagactgca

SEQ ID NO: 7626544 - DNA, 22 bp, Homo sapiens
gagccaggaggcagagactgca

SEQ ID NO: 7626545 - DNA, 22 bp, Homo sapiens
gagccaggaggcagagactgca

SEQ ID NO: 7626546 - DNA, 22 bp, Homo sapiens
gagccaggaggcagagactgca

SEQ ID NO: 7626547 - DNA, 22 bp, Homo sapiens
gagccagggagggtctggtata

SEQ ID NO: 7626548 - DNA, 22 bp, Homo sapiens
gagccagggagggtctggtata

SEQ ID NO: 7626549 - DNA, 22 bp, Homo sapiens
gagccagggagggtctggtata

SEQ ID NO: 7626550 - DNA, 22 bp, Homo sapiens
gagccagggagggtctggtata

SEQ ID NO: 7626551 - DNA, 22 bp, Homo sapiens
atggctgcccacgttggtgctt

SEQ ID NO: 7626552 - DNA, 22 bp, Homo sapiens
atggctgcatcatcctggttga

SEQ ID NO: 7626553 - DNA, 22 bp, Homo sapiens
gagccagggctgtgagctgagc

SEQ ID NO: 7626554 - DNA, 22 bp, Homo sapiens
atggctgcccacgttggtgctt

SEQ ID NO: 7626555 - DNA, 22 bp, Homo sapiens
atggctgcccacgttggtgctt

SEQ ID NO: 7626556 - DNA, 22 bp, Homo sapiens
gagccaggcaccttctgtgttg

SEQ ID NO: 7626557 - DNA, 22 bp, Homo sapiens
gagccaggcaccttctgtgttg

SEQ ID NO: 7626558 - DNA, 22 bp, Homo sapiens
gagccaggcaccttctgtgttg

SEQ ID NO: 7626559 - DNA, 22 bp, Homo sapiens
gagccaggcaccttctgtgttg

SEQ ID NO: 7626560 - DNA, 22 bp, Homo sapiens
gagccaggcccgtacttgctgt

SEQ ID NO: 7626561 - DNA, 22 bp, Homo sapiens
gagccaggcccgtacttgctgt

SEQ ID NO: 7626562 - DNA, 22 bp, Homo sapiens
gagccaggcccgtacttgctgt

SEQ ID NO: 7626563 - DNA, 22 bp, Homo sapiens
gagccaggcccgtacttgctgt

SEQ ID NO: 7626564 - DNA, 22 bp, Homo sapiens
gagccaggcccgtacttgctgt

SEQ ID NO: 7626565 - DNA, 22 bp, Homo sapiens
atggctggaagagtcgaagagt

SEQ ID NO: 7626566 - DNA, 22 bp, Homo sapiens
atggctggaagagtcgaagagt

SEQ ID NO: 7626567 - DNA, 22 bp, Homo sapiens
atggctggaagagtcgaagagt

SEQ ID NO: 7626568 - DNA, 22 bp, Homo sapiens
atggctgctttcccttagcacc

SEQ ID NO: 7626569 - DNA, 22 bp, Homo sapiens
atggctgctttcccttagcacc

SEQ ID NO: 7626570 - DNA, 19 bp, Homo sapiens
atggctgctgattggggat

SEQ ID NO: 7626571 - DNA, 22 bp, Homo sapiens
atggctgctgccttcccctgct

SEQ ID NO: 7626572 - DNA, 19 bp, Homo sapiens
atggctgctgattggggat

SEQ ID NO: 7626573 - DNA, 22 bp, Homo sapiens
atggctgctctggatggagtcc

SEQ ID NO: 7626574 - DNA, 22 bp, Homo sapiens
atggctgctctggatggagtcc

SEQ ID NO: 7626575 - DNA, 22 bp, Homo sapiens
atggctgcctgggcgctggccg

SEQ ID NO: 7626576 - DNA, 22 bp, Homo sapiens
atggctgccttaattcttcagc

SEQ ID NO: 7626577 - DNA, 22 bp, Homo sapiens
atggctgcctgggcgctggccg

SEQ ID NO: 7626578 - DNA, 22 bp, Homo sapiens
atggctgcctgggcgctggccg

SEQ ID NO: 7626579 - DNA, 22 bp, Homo sapiens
atggctgcctagaggtgagatg

SEQ ID NO: 7626580 - DNA, 22 bp, Homo sapiens
atggctgcctagaggtgagatg

SEQ ID NO: 7626581 - DNA, 22 bp, Homo sapiens
atggctgccccaaattgttgct

SEQ ID NO: 7626582 - DNA, 19 bp, Homo sapiens
atggccagtttagaggttt

SEQ ID NO: 7626583 - DNA, 19 bp, Homo sapiens
atggccagtttagaggttt

SEQ ID NO: 7626584 - DNA, 22 bp, Homo sapiens
atggccagttagaaatcaaaaa

SEQ ID NO: 7626585 - DNA, 19 bp, Homo sapiens
atggccagtttagaggttt

SEQ ID NO: 7626586 - DNA, 19 bp, Homo sapiens
atggccagtttagaggttt

SEQ ID NO: 7626587 - DNA, 22 bp, Homo sapiens
atggccagtgtttccctcagtt

SEQ ID NO: 7626588 - DNA, 22 bp, Homo sapiens
atggccagtgtttccctcagtt

SEQ ID NO: 7626589 - DNA, 22 bp, Homo sapiens
atggccagtgtttccctcagtt

SEQ ID NO: 7626590 - DNA, 22 bp, Homo sapiens
atggccagtctgttggacagca

SEQ ID NO: 7626591 - DNA, 22 bp, Homo sapiens
atggccagtgttgagatcaggc

SEQ ID NO: 7626592 - DNA, 22 bp, Homo sapiens
atggccagtgttgagatcaggc

SEQ ID NO: 7626593 - DNA, 22 bp, Homo sapiens
atggccagtctgttggacagca

SEQ ID NO: 7626594 - DNA, 22 bp, Homo sapiens
atggccagtgttgagatcaggc

SEQ ID NO: 7626595 - DNA, 22 bp, Homo sapiens
atggccagtgtttccctcagtt

SEQ ID NO: 7626596 - DNA, 22 bp, Homo sapiens
atggccagtctgttggacagca

SEQ ID NO: 7626597 - DNA, 22 bp, Homo sapiens
atggccagtgttgagatcaggc

SEQ ID NO: 7626598 - DNA, 22 bp, Homo sapiens
atggcccaggcctcctgtggct

SEQ ID NO: 7626599 - DNA, 22 bp, Homo sapiens
atggcccaggccaggatccagc

SEQ ID NO: 7626600 - DNA, 22 bp, Homo sapiens
atggcccaggcaggctggtact

SEQ ID NO: 7626601 - DNA, 22 bp, Homo sapiens
atggcccagactcagactggtg

SEQ ID NO: 7626602 - DNA, 22 bp, Homo sapiens
atggcccaggcaggctggtact

SEQ ID NO: 7626603 - DNA, 22 bp, Homo sapiens
atggcccaggcaggctggtact

SEQ ID NO: 7626604 - DNA, 22 bp, Homo sapiens
atggcccaggccaggatccagc

SEQ ID NO: 7626605 - DNA, 22 bp, Homo sapiens
atggcccagactcagactggtg

SEQ ID NO: 7626606 - DNA, 22 bp, Homo sapiens
atggcccaagtgccctgacctg

SEQ ID NO: 7626607 - DNA, 22 bp, Homo sapiens
atggcccactctggtcccggca

SEQ ID NO: 7626608 - DNA, 22 bp, Homo sapiens
atggcccactctggtcccggca

SEQ ID NO: 7626609 - DNA, 22 bp, Homo sapiens
atggcccagaagtttggaaagg

SEQ ID NO: 7626610 - DNA, 22 bp, Homo sapiens
atggcccagactcagactggtg

SEQ ID NO: 7626611 - DNA, 22 bp, Homo sapiens
atggcccagaagtttggaaagg

SEQ ID NO: 7626612 - DNA, 22 bp, Homo sapiens
atggcccactctggtcccggca

SEQ ID NO: 7626613 - DNA, 22 bp, Homo sapiens
atggcccaaaacctcctccctc

SEQ ID NO: 7626614 - DNA, 22 bp, Homo sapiens
atggcccaaaacctcctccctc

SEQ ID NO: 7626615 - DNA, 22 bp, Homo sapiens
atggccatgccagtttacagcc

SEQ ID NO: 7626616 - DNA, 22 bp, Homo sapiens
atggccatgccagtttacagcc

SEQ ID NO: 7626617 - DNA, 22 bp, Homo sapiens
atggcccaaactgcaattactt

SEQ ID NO: 7626618 - DNA, 22 bp, Homo sapiens
atggcccaaaacctcctccctc

SEQ ID NO: 7626619 - DNA, 22 bp, Homo sapiens
atggcccaaaacctcctccctc

SEQ ID NO: 7626620 - DNA, 22 bp, Homo sapiens
atggcccaaactgcaattactt

SEQ ID NO: 7626621 - DNA, 22 bp, Homo sapiens
atggcccaagtgccctgacctg

SEQ ID NO: 7626622 - DNA, 22 bp, Homo sapiens
atggcccaagtgccctgacctg

SEQ ID NO: 7626623 - DNA, 22 bp, Homo sapiens
atggcccaaactgcaattactt

SEQ ID NO: 7626624 - DNA, 22 bp, Homo sapiens
atggcccaagtgccctgacctg

SEQ ID NO: 7626625 - DNA, 22 bp, Homo sapiens
atggccctgaccttgatgacct

SEQ ID NO: 7626626 - DNA, 22 bp, Homo sapiens
atggccctgccaggaggaacaa

SEQ ID NO: 7626627 - DNA, 22 bp, Homo sapiens
atggccctgctggtttgatcgt

SEQ ID NO: 7626628 - DNA, 22 bp, Homo sapiens
atggccctgctaccacttttct

SEQ ID NO: 7626629 - DNA, 22 bp, Homo sapiens
atggccctgccaggaggaacaa

SEQ ID NO: 7626630 - DNA, 22 bp, Homo sapiens
atggccctgctggtttgatcgt

SEQ ID NO: 7626631 - DNA, 22 bp, Homo sapiens
atggccctggcccagaccccac

SEQ ID NO: 7626632 - DNA, 22 bp, Homo sapiens
atggccctggaaagagcttgag

SEQ ID NO: 7626633 - DNA, 22 bp, Homo sapiens
atggccctggaaagagcttgag

SEQ ID NO: 7626634 - DNA, 22 bp, Homo sapiens
atggccctggaaagagcttgag

SEQ ID NO: 7626635 - DNA, 22 bp, Homo sapiens
atggccctatcacctttgcttc

SEQ ID NO: 7626636 - DNA, 22 bp, Homo sapiens
atggccctaatgagttggtgtt

SEQ ID NO: 7626637 - DNA, 22 bp, Homo sapiens
atggccctatcacctttgcttc

SEQ ID NO: 7626638 - DNA, 22 bp, Homo sapiens
atggccctaatgagttggtgtt

SEQ ID NO: 7626639 - DNA, 22 bp, Homo sapiens
atggcccaggccaggatccagc

SEQ ID NO: 7626640 - DNA, 22 bp, Homo sapiens
atggccctgaccttgatgacct

SEQ ID NO: 7626641 - DNA, 22 bp, Homo sapiens
atggccctctccttaggtcagc

SEQ ID NO: 7626642 - DNA, 22 bp, Homo sapiens
atggccctcagtccttccttgg

SEQ ID NO: 7626643 - DNA, 22 bp, Homo sapiens
atggccctcagtccttccttgg

SEQ ID NO: 7626644 - DNA, 22 bp, Homo sapiens
atggccctcagtccttccttgg

SEQ ID NO: 7626645 - DNA, 22 bp, Homo sapiens
atggccctatcacctttgcttc

SEQ ID NO: 7626646 - DNA, 22 bp, Homo sapiens
atggcccaggcctcctgtggct

SEQ ID NO: 7626647 - DNA, 22 bp, Homo sapiens
atggccctctccttaggtcagc

SEQ ID NO: 7626648 - DNA, 22 bp, Homo sapiens
gagcagtgactggagcatgaga

SEQ ID NO: 7626649 - DNA, 22 bp, Homo sapiens
gagcagtgactggagcatgaga

SEQ ID NO: 7626650 - DNA, 22 bp, Homo sapiens
gagccagcctccgcctctctcc

SEQ ID NO: 7626651 - DNA, 22 bp, Homo sapiens
gagccagcctccgcctctctcc

SEQ ID NO: 7626652 - DNA, 22 bp, Homo sapiens
gagccagcctccgcctctctcc

SEQ ID NO: 7626653 - DNA, 22 bp, Homo sapiens
gagccagcctccgcctctctcc

SEQ ID NO: 7626654 - DNA, 22 bp, Homo sapiens
gagccagcctccgcctctctcc

SEQ ID NO: 7626655 - DNA, 22 bp, Homo sapiens
gagcagtgactggagcatgaga

SEQ ID NO: 7626656 - DNA, 22 bp, Homo sapiens
gagccagccttcttctgaggtc

SEQ ID NO: 7626657 - DNA, 22 bp, Homo sapiens
gagccagccttcttctgaggtc

SEQ ID NO: 7626658 - DNA, 22 bp, Homo sapiens
gagccagccttcttctgaggtc

SEQ ID NO: 7626659 - DNA, 22 bp, Homo sapiens
gagccagccttcttctgaggtc

SEQ ID NO: 7626660 - DNA, 22 bp, Homo sapiens
gagccagccttcttctgaggtc

SEQ ID NO: 7626661 - DNA, 22 bp, Homo sapiens
gagccagccttcttctgaggtc

SEQ ID NO: 7626662 - DNA, 22 bp, Homo sapiens
gagccagcgccttgcctctggg

SEQ ID NO: 7626663 - DNA, 22 bp, Homo sapiens
gagccagcgccttgcctctggg

SEQ ID NO: 7626664 - DNA, 22 bp, Homo sapiens
gacagaggcaagaccagaagcc

SEQ ID NO: 7626665 - DNA, 22 bp, Homo sapiens
gacagaggctggagcacctcct

SEQ ID NO: 7626666 - DNA, 22 bp, Homo sapiens
gacagaggctggagcacctcct

SEQ ID NO: 7626667 - DNA, 22 bp, Homo sapiens
gacactgagaaatattcagaca

SEQ ID NO: 7626668 - DNA, 22 bp, Homo sapiens
gacactgaggcatgcagagccg

SEQ ID NO: 7626669 - DNA, 22 bp, Homo sapiens
gacactgcacttggggcccaca

SEQ ID NO: 7626670 - DNA, 22 bp, Homo sapiens
gacagaggcaagaccagaagcc

SEQ ID NO: 7626671 - DNA, 22 bp, Homo sapiens
gacagagggttccaaaattgat

SEQ ID NO: 7626672 - DNA, 22 bp, Homo sapiens
gacagagggttccaaaattgat

SEQ ID NO: 7626673 - DNA, 22 bp, Homo sapiens
gacagaggtgtccttgagtcca

SEQ ID NO: 7626674 - DNA, 22 bp, Homo sapiens
gacagaggctggagcacctcct

SEQ ID NO: 7626675 - DNA, 23 bp, Homo sapiens
gacagagtgagaccttgtcttac

SEQ ID NO: 7626676 - DNA, 23 bp, Homo sapiens
gacagagtgagaccttgtcttac

SEQ ID NO: 7626677 - DNA, 22 bp, Homo sapiens
gacagaggtgtccttgagtcca

SEQ ID NO: 7626678 - DNA, 23 bp, Homo sapiens
gacagagtgagaccttgtcttac

SEQ ID NO: 7626679 - DNA, 22 bp, Homo sapiens
gacagatgagggagtattctca

SEQ ID NO: 7626680 - DNA, 22 bp, Homo sapiens
gacagatggtcagtgttgaagt

SEQ ID NO: 7626681 - DNA, 22 bp, Homo sapiens
gacagagtgcagggctagaaga

SEQ ID NO: 7626682 - DNA, 22 bp, Homo sapiens
gacagagttgttgatgtatgct

SEQ ID NO: 7626683 - DNA, 23 bp, Homo sapiens
gacagagtgagaccttgtcttac

SEQ ID NO: 7626684 - DNA, 23 bp, Homo sapiens
gacagagtgagaccttgtcttac

SEQ ID NO: 7626685 - DNA, 23 bp, Homo sapiens
gacagagtgagaccttgtcttac

SEQ ID NO: 7626686 - DNA, 23 bp, Homo sapiens
gacagagtgagaccttgtcttac

SEQ ID NO: 7626687 - DNA, 23 bp, Homo sapiens
gacagagtgagaccttgtcttac

SEQ ID NO: 7626688 - DNA, 23 bp, Homo sapiens
gacagagtgagaccttgtcttac

SEQ ID NO: 7626689 - DNA, 23 bp, Homo sapiens
gacagagtgagaccttgtcttac

SEQ ID NO: 7626690 - DNA, 23 bp, Homo sapiens
gacagagtgagaccttgtcttac

SEQ ID NO: 7626691 - DNA, 22 bp, Homo sapiens
atgccactgcgctccagcctgg

SEQ ID NO: 7626692 - DNA, 22 bp, Homo sapiens
atgccactgcacttcagcttgg

SEQ ID NO: 7626693 - DNA, 22 bp, Homo sapiens
atgccactgcgctccagcctgg

SEQ ID NO: 7626694 - DNA, 22 bp, Homo sapiens
atgccactgcgctccagcctgg

SEQ ID NO: 7626695 - DNA, 22 bp, Homo sapiens
atgccactgcacttcagcttgg

SEQ ID NO: 7626696 - DNA, 22 bp, Homo sapiens
atgccactgcacttcagcttgg

SEQ ID NO: 7626697 - DNA, 22 bp, Homo sapiens
atgccactgcacttcagcttgg

SEQ ID NO: 7626698 - DNA, 22 bp, Homo sapiens
atgccactgcgctccagcctgg

SEQ ID NO: 7626699 - DNA, 22 bp, Homo sapiens
atgccactgcgctccagcctgg

SEQ ID NO: 7626700 - DNA, 22 bp, Homo sapiens
atgccactgcgctccagcctgg

SEQ ID NO: 7626701 - DNA, 22 bp, Homo sapiens
atgccactgcgctccagcctgg

SEQ ID NO: 7626702 - DNA, 22 bp, Homo sapiens
atgccactgcgctccagcctgg

SEQ ID NO: 7626703 - DNA, 22 bp, Homo sapiens
atgccactgcgctccagcctgg

SEQ ID NO: 7626704 - DNA, 22 bp, Homo sapiens
atgccactgcgctccagcctgg

SEQ ID NO: 7626705 - DNA, 22 bp, Homo sapiens
atgccactgcgctccagcctgg

SEQ ID NO: 7626706 - DNA, 22 bp, Homo sapiens
gacagatgtgggtgacagcagc

SEQ ID NO: 7626707 - DNA, 22 bp, Homo sapiens
gacagatgtgggtgacagcagc

SEQ ID NO: 7626708 - DNA, 22 bp, Homo sapiens
gacagatgtgggtgacagcagc

SEQ ID NO: 7626709 - DNA, 22 bp, Homo sapiens
gacagatgtgggtgacagcagc

SEQ ID NO: 7626710 - DNA, 22 bp, Homo sapiens
gacagcaaagcagagccaaggc

SEQ ID NO: 7626711 - DNA, 22 bp, Homo sapiens
gacagcaaagcagagccaaggc

SEQ ID NO: 7626712 - DNA, 22 bp, Homo sapiens
gacagcaaagcagagccaaggc

SEQ ID NO: 7626713 - DNA, 22 bp, Homo sapiens
gacagcaaagcagagccaaggc

SEQ ID NO: 7626714 - DNA, 22 bp, Homo sapiens
gacagatgtgggtgacagcagc

SEQ ID NO: 7626715 - DNA, 22 bp, Homo sapiens
gacagcaacactcaattctgca

SEQ ID NO: 7626716 - DNA, 22 bp, Homo sapiens
gacagcaacactcaattctgca

SEQ ID NO: 7626717 - DNA, 22 bp, Homo sapiens
gacagcaacacatgcttagtgc

SEQ ID NO: 7626718 - DNA, 22 bp, Homo sapiens
gacagcaacacatgcttagtgc

SEQ ID NO: 7626719 - DNA, 22 bp, Homo sapiens
gacagcaacctcatgagaaact

SEQ ID NO: 7626720 - DNA, 22 bp, Homo sapiens
atgccactgcacttcagcttgg

SEQ ID NO: 7626721 - DNA, 22 bp, Homo sapiens
gacagcaacctcatgagaaact

SEQ ID NO: 7626722 - DNA, 22 bp, Homo sapiens
atggaaaaggctgatttcatta

SEQ ID NO: 7626723 - DNA, 22 bp, Homo sapiens
atggaaaaggctgatttcatta

SEQ ID NO: 7626724 - DNA, 22 bp, Homo sapiens
atggaaaaggctgatttcatta

SEQ ID NO: 7626725 - DNA, 21 bp, Homo sapiens
atggaaaaacaggtagagcat

SEQ ID NO: 7626726 - DNA, 22 bp, Homo sapiens
atggaaaaggctgatttcatta

SEQ ID NO: 7626727 - DNA, 22 bp, Homo sapiens
atgccacttcattccagcctcg

SEQ ID NO: 7626728 - DNA, 22 bp, Homo sapiens
atgccacttcattccagcctcg

SEQ ID NO: 7626729 - DNA, 22 bp, Homo sapiens
atgccacttcattccagcctcg

SEQ ID NO: 7626730 - DNA, 22 bp, Homo sapiens
atgccacttcattccagcctcg

SEQ ID NO: 7626731 - DNA, 22 bp, Homo sapiens
atgccacttcattccagcctcg

SEQ ID NO: 7626732 - DNA, 22 bp, Homo sapiens
atgccacttcattccagcctcg

SEQ ID NO: 7626733 - DNA, 22 bp, Homo sapiens
atggaaaaggctgatttcatta

SEQ ID NO: 7626734 - DNA, 22 bp, Homo sapiens
atggaaatgatggaacattaaa

SEQ ID NO: 7626735 - DNA, 22 bp, Homo sapiens
atggaaatgatggaacattaaa

SEQ ID NO: 7626736 - DNA, 22 bp, Homo sapiens
atggaaatggagggtgctagaa

SEQ ID NO: 7626737 - DNA, 22 bp, Homo sapiens
atggaaatgatggaacattaaa

SEQ ID NO: 7626738 - DNA, 22 bp, Homo sapiens
atgccactgcgctctagcctgg

SEQ ID NO: 7626739 - DNA, 22 bp, Homo sapiens
atgccactgcgctccagcctgg

SEQ ID NO: 7626740 - DNA, 22 bp, Homo sapiens
atgccactgcgctctagcctgg

SEQ ID NO: 7626741 - DNA, 22 bp, Homo sapiens
atgccactgcgctctagcctgg

SEQ ID NO: 7626742 - DNA, 22 bp, Homo sapiens
atgccactgcgctctagcctgg

SEQ ID NO: 7626743 - DNA, 22 bp, Homo sapiens
atgccactgcgctctagcctgg

SEQ ID NO: 7626744 - DNA, 22 bp, Homo sapiens
atgccactgcgctccagcctgg

SEQ ID NO: 7626745 - DNA, 22 bp, Homo sapiens
atgccactgcgctccagcctgg

SEQ ID NO: 7626746 - DNA, 22 bp, Homo sapiens
atgccactgcgctccagcctgg

SEQ ID NO: 7626747 - DNA, 22 bp, Homo sapiens
atgccactgcgctccagcctgg

SEQ ID NO: 7626748 - DNA, 22 bp, Homo sapiens
atgccactgcgctccagcctgg

SEQ ID NO: 7626749 - DNA, 22 bp, Homo sapiens
atgccactgcgctctagcctgg

SEQ ID NO: 7626750 - DNA, 22 bp, Homo sapiens
atgccactgcgctctagcctgg

SEQ ID NO: 7626751 - DNA, 22 bp, Homo sapiens
atgccacttcattccagcctcg

SEQ ID NO: 7626752 - DNA, 22 bp, Homo sapiens
atgccacttcattccagcctcg

SEQ ID NO: 7626753 - DNA, 22 bp, Homo sapiens
atgccactgcgctctagcctgg

SEQ ID NO: 7626754 - DNA, 22 bp, Homo sapiens
atgccactgcgctctagcctgg

SEQ ID NO: 7626755 - DNA, 22 bp, Homo sapiens
atgccactgcgctctagcctgg

SEQ ID NO: 7626756 - DNA, 21 bp, Homo sapiens
atggaaattggcaaatgctac

SEQ ID NO: 7626757 - DNA, 21 bp, Homo sapiens
atggaaattggcaaatgctac

SEQ ID NO: 7626758 - DNA, 21 bp, Homo sapiens
atggaaattggcaaatgctac

SEQ ID NO: 7626759 - DNA, 21 bp, Homo sapiens
atggaaattggcaaatgctac

SEQ ID NO: 7626760 - DNA, 21 bp, Homo sapiens
atggaaattggcaaatgctac

SEQ ID NO: 7626761 - DNA, 22 bp, Homo sapiens
atggaacagattaaagtgaggg

SEQ ID NO: 7626762 - DNA, 22 bp, Homo sapiens
atggaacagattaaagtgaggg

SEQ ID NO: 7626763 - DNA, 22 bp, Homo sapiens
atggaacagacagctgagacaa

SEQ ID NO: 7626764 - DNA, 22 bp, Homo sapiens
atggaacagacagctgagacaa

SEQ ID NO: 7626765 - DNA, 22 bp, Homo sapiens
atggaacaagaactcagattta

SEQ ID NO: 7626766 - DNA, 22 bp, Homo sapiens
atggaacaagaactcagattta

SEQ ID NO: 7626767 - DNA, 22 bp, Homo sapiens
atggaacaagaactcagattta

SEQ ID NO: 7626768 - DNA, 22 bp, Homo sapiens
atggaacaagaactcagattta

SEQ ID NO: 7626769 - DNA, 22 bp, Homo sapiens
atggaagaaagagacaatttga

SEQ ID NO: 7626770 - DNA, 22 bp, Homo sapiens
atggaactgatcaggagtgcca

SEQ ID NO: 7626771 - DNA, 22 bp, Homo sapiens
atggaactgctaataatagttg

SEQ ID NO: 7626772 - DNA, 22 bp, Homo sapiens
atggaactgatcaggagtgcca

SEQ ID NO: 7626773 - DNA, 22 bp, Homo sapiens
atggaacatgaattaatatggt

SEQ ID NO: 7626774 - DNA, 22 bp, Homo sapiens
atggaactgagcttgccaaact

SEQ ID NO: 7626775 - DNA, 22 bp, Homo sapiens
atggaacatgaattaatatggt

SEQ ID NO: 7626776 - DNA, 22 bp, Homo sapiens
atggaacatgaattaatatggt

SEQ ID NO: 7626777 - DNA, 22 bp, Homo sapiens
atggaacatcaggttaagaaat

SEQ ID NO: 7626778 - DNA, 22 bp, Homo sapiens
atggaacaggctcagagatgct

SEQ ID NO: 7626779 - DNA, 22 bp, Homo sapiens
atggaacatcaggttaagaaat

SEQ ID NO: 7626780 - DNA, 22 bp, Homo sapiens
atggaaatgttaagtcagtccg

SEQ ID NO: 7626781 - DNA, 22 bp, Homo sapiens
atggaaatgtaacttctgattc

SEQ ID NO: 7626782 - DNA, 22 bp, Homo sapiens
atggaaatgtaacttctgattc

SEQ ID NO: 7626783 - DNA, 22 bp, Homo sapiens
atggaaatgtaacttctgattc

SEQ ID NO: 7626784 - DNA, 22 bp, Homo sapiens
atggaaatggagggtgctagaa

SEQ ID NO: 7626785 - DNA, 22 bp, Homo sapiens
atggaaatggagtgtgcttgct

SEQ ID NO: 7626786 - DNA, 22 bp, Homo sapiens
atggaaatggagtgtgcttgct

SEQ ID NO: 7626787 - DNA, 22 bp, Homo sapiens
atggaaatggagtgtgcttgct

SEQ ID NO: 7626788 - DNA, 22 bp, Homo sapiens
atggaaatggagtgtgcttgct

SEQ ID NO: 7626789 - DNA, 22 bp, Homo sapiens
atggaaatggagtgtgcttgct

SEQ ID NO: 7626790 - DNA, 22 bp, Homo sapiens
atggaaatgttccatatattga

SEQ ID NO: 7626791 - DNA, 22 bp, Homo sapiens
atggaaatgttaagtcagtccg

SEQ ID NO: 7626792 - DNA, 22 bp, Homo sapiens
atggaaatgttccatatattga

SEQ ID NO: 7626793 - DNA, 22 bp, Homo sapiens
atggactagccataagagaact

SEQ ID NO: 7626794 - DNA, 22 bp, Homo sapiens
atggactagccataagagaact

SEQ ID NO: 7626795 - DNA, 22 bp, Homo sapiens
atggactcactaattcctccac

SEQ ID NO: 7626796 - DNA, 22 bp, Homo sapiens
atggaccagagcctcattctgt

SEQ ID NO: 7626797 - DNA, 22 bp, Homo sapiens
atggacatttgagttatttcca

SEQ ID NO: 7626798 - DNA, 22 bp, Homo sapiens
atggactaggaaagataaagat

SEQ ID NO: 7626799 - DNA, 22 bp, Homo sapiens
atggactagccataagagaact

SEQ ID NO: 7626800 - DNA, 22 bp, Homo sapiens
atggactgggaggtcatcttct

SEQ ID NO: 7626801 - DNA, 22 bp, Homo sapiens
atggacttaagagtcagaagct

SEQ ID NO: 7626802 - DNA, 22 bp, Homo sapiens
atggaatgtgaacatgatggca

SEQ ID NO: 7626803 - DNA, 22 bp, Homo sapiens
atggaatgtgaacatgatggca

SEQ ID NO: 7626804 - DNA, 22 bp, Homo sapiens
atggaatgggaagcagagccat

SEQ ID NO: 7626805 - DNA, 22 bp, Homo sapiens
atggaatgggaagcagagccat

SEQ ID NO: 7626806 - DNA, 22 bp, Homo sapiens
atggacagtgtgtctgtttcca

SEQ ID NO: 7626807 - DNA, 22 bp, Homo sapiens
atggacagtgtgtctgtttcca

SEQ ID NO: 7626808 - DNA, 22 bp, Homo sapiens
atggacagtgtgtctgtttcca

SEQ ID NO: 7626809 - DNA, 22 bp, Homo sapiens
atggacatttgagttatttcca

SEQ ID NO: 7626810 - DNA, 22 bp, Homo sapiens
atggacagtgtgaagcagatag

SEQ ID NO: 7626811 - DNA, 22 bp, Homo sapiens
atggacagtgtgaagcagatag

SEQ ID NO: 7626812 - DNA, 22 bp, Homo sapiens
atggaatgtttatacacagttg

SEQ ID NO: 7626813 - DNA, 22 bp, Homo sapiens
atggaatgtttatacacagttg

SEQ ID NO: 7626814 - DNA, 22 bp, Homo sapiens
atggaatggcctgtcataatct

SEQ ID NO: 7626815 - DNA, 22 bp, Homo sapiens
atggaatgctccctggggacat

SEQ ID NO: 7626816 - DNA, 22 bp, Homo sapiens
atggaatgctccctggggacat

SEQ ID NO: 7626817 - DNA, 22 bp, Homo sapiens
atggaatggcctgtcataatct

SEQ ID NO: 7626818 - DNA, 22 bp, Homo sapiens
atggaatgggaagagtgtgtga

SEQ ID NO: 7626819 - DNA, 22 bp, Homo sapiens
atggaatgggaagagtgtgtga

SEQ ID NO: 7626820 - DNA, 22 bp, Homo sapiens
atggaatggctccctgccccag

SEQ ID NO: 7626821 - DNA, 22 bp, Homo sapiens
atggaatgggaagagtgtgtga

SEQ ID NO: 7626822 - DNA, 22 bp, Homo sapiens
atggaatgccaagttcactgct

SEQ ID NO: 7626823 - DNA, 22 bp, Homo sapiens
atggaatgcggtagtatgtgca

SEQ ID NO: 7626824 - DNA, 22 bp, Homo sapiens
atggaatgcggtagtatgtgca

SEQ ID NO: 7626825 - DNA, 22 bp, Homo sapiens
atggaatatttgacacataggg

SEQ ID NO: 7626826 - DNA, 22 bp, Homo sapiens
atggaatgaaaaacacatgcaa

SEQ ID NO: 7626827 - DNA, 22 bp, Homo sapiens
atggaatgaaaaacacatgcaa

SEQ ID NO: 7626828 - DNA, 22 bp, Homo sapiens
atggaatatttgacacataggg

SEQ ID NO: 7626829 - DNA, 22 bp, Homo sapiens
atggaatgccaagttcactgct

SEQ ID NO: 7626830 - DNA, 22 bp, Homo sapiens
atggaatatagtcttatatctc

SEQ ID NO: 7626831 - DNA, 22 bp, Homo sapiens
atggaataggctgctctttaaa

SEQ ID NO: 7626832 - DNA, 22 bp, Homo sapiens
atggaataggctgctctttaaa

SEQ ID NO: 7626833 - DNA, 22 bp, Homo sapiens
atggaatatagtcttatatctc

SEQ ID NO: 7626834 - DNA, 22 bp, Homo sapiens
atggaatatagtcttatatctc

SEQ ID NO: 7626835 - DNA, 22 bp, Homo sapiens
atggaatatagtcttatatctc

SEQ ID NO: 7626836 - DNA, 22 bp, Homo sapiens
atggaataggctgctctttaaa

SEQ ID NO: 7626837 - DNA, 22 bp, Homo sapiens
atggaataattgtttcacagaa

SEQ ID NO: 7626838 - DNA, 22 bp, Homo sapiens
atggaagttggaaccattcata

SEQ ID NO: 7626839 - DNA, 22 bp, Homo sapiens
atggaataattgtttcacagaa

SEQ ID NO: 7626840 - DNA, 22 bp, Homo sapiens
atggaagttggaaccattcata

SEQ ID NO: 7626841 - DNA, 22 bp, Homo sapiens
atggaataattgtttcacagaa

SEQ ID NO: 7626842 - DNA, 22 bp, Homo sapiens
atggaagttggaaccattcata

SEQ ID NO: 7626843 - DNA, 22 bp, Homo sapiens
atggaagtgcaacttgctcatc

SEQ ID NO: 7626844 - DNA, 22 bp, Homo sapiens
atggaagttggaaccattcata

SEQ ID NO: 7626845 - DNA, 22 bp, Homo sapiens
atggaaggctttatgactcaaa

SEQ ID NO: 7626846 - DNA, 22 bp, Homo sapiens
atggaagggacagaagggcaag

SEQ ID NO: 7626847 - DNA, 22 bp, Homo sapiens
atggaagggacagaagggcaag

SEQ ID NO: 7626848 - DNA, 22 bp, Homo sapiens
atggaagggacagaagggcaag

SEQ ID NO: 7626849 - DNA, 22 bp, Homo sapiens
atggaaggtcctacagagcgca

SEQ ID NO: 7626850 - DNA, 22 bp, Homo sapiens
atggaagggacagaagggcaag

SEQ ID NO: 7626851 - DNA, 22 bp, Homo sapiens
atggaaggtcctacagagcgca

SEQ ID NO: 7626852 - DNA, 22 bp, Homo sapiens
atggaaggtcctacagagcgca

SEQ ID NO: 7626853 - DNA, 22 bp, Homo sapiens
atggaaggtcctacagagcgca

SEQ ID NO: 7626854 - DNA, 22 bp, Homo sapiens
atggaaggtcctacagagcgca

SEQ ID NO: 7626855 - DNA, 22 bp, Homo sapiens
atggaagtgcaacttgctcatc

SEQ ID NO: 7626856 - DNA, 22 bp, Homo sapiens
atggaagtgcaacttgctcatc

SEQ ID NO: 7626857 - DNA, 23 bp, Homo sapiens
atggaagtcactgttttcttgtc

SEQ ID NO: 7626858 - DNA, 22 bp, Homo sapiens
atggaagcagaccggaggaata

SEQ ID NO: 7626859 - DNA, 22 bp, Homo sapiens
atggaagctgaaaaagacacgg

SEQ ID NO: 7626860 - DNA, 22 bp, Homo sapiens
atggaagctgaaaaagacacgg

SEQ ID NO: 7626861 - DNA, 22 bp, Homo sapiens
atggaagcagacaggtaattcc

SEQ ID NO: 7626862 - DNA, 22 bp, Homo sapiens
atggaagagtccccatggatga

SEQ ID NO: 7626863 - DNA, 22 bp, Homo sapiens
atggaagagtccccatggatga

SEQ ID NO: 7626864 - DNA, 20 bp, Homo sapiens
atggaagctgctcttctcct

SEQ ID NO: 7626865 - DNA, 19 bp, Homo sapiens
atggaagctgggatcaatg

SEQ ID NO: 7626866 - DNA, 22 bp, Homo sapiens
atggaaggctttatgactcaaa

SEQ ID NO: 7626867 - DNA, 22 bp, Homo sapiens
atggaaggctttatgactcaaa

SEQ ID NO: 7626868 - DNA, 22 bp, Homo sapiens
atggaaggctttatgactcaaa

SEQ ID NO: 7626869 - DNA, 22 bp, Homo sapiens
atggaagaaagagacaatttga

SEQ ID NO: 7626870 - DNA, 22 bp, Homo sapiens
atggaagaacgctcagggttac

SEQ ID NO: 7626871 - DNA, 22 bp, Homo sapiens
atggaagacagataaggcagaa

SEQ ID NO: 7626872 - DNA, 22 bp, Homo sapiens
atggaagaacgctcagggttac

SEQ ID NO: 7626873 - DNA, 22 bp, Homo sapiens
atggaagaacgctcagggttac

SEQ ID NO: 7626874 - DNA, 22 bp, Homo sapiens
atggaagacagataaggcagaa

SEQ ID NO: 7626875 - DNA, 22 bp, Homo sapiens
atggaagacagataaggcagaa

SEQ ID NO: 7626876 - DNA, 22 bp, Homo sapiens
atggaagaacgctcagggttac

SEQ ID NO: 7626877 - DNA, 22 bp, Homo sapiens
atggaagacagataaggcagaa

SEQ ID NO: 7626878 - DNA, 22 bp, Homo sapiens
atggaagacagataaggcagaa

SEQ ID NO: 7626879 - DNA, 22 bp, Homo sapiens
atggaagactaacagaaacatg

SEQ ID NO: 7626880 - DNA, 22 bp, Homo sapiens
atggaagactaacagaaacatg

SEQ ID NO: 7626881 - DNA, 22 bp, Homo sapiens
atggaagactaacagaaacatg

SEQ ID NO: 7626882 - DNA, 22 bp, Homo sapiens
atggaagactaacagaaacatg

SEQ ID NO: 7626883 - DNA, 22 bp, Homo sapiens
atggaagagtccccatggatga

SEQ ID NO: 7626884 - DNA, 22 bp, Homo sapiens
atggaagagtccccatggatga

SEQ ID NO: 7626885 - DNA, 22 bp, Homo sapiens
atggaagagtccccatggatga

SEQ ID NO: 7626886 - DNA, 22 bp, Homo sapiens
atggaagagtccccatggatga

SEQ ID NO: 7626887 - DNA, 22 bp, Homo sapiens
atggaagactaacagaaacatg

SEQ ID NO: 7626888 - DNA, 22 bp, Homo sapiens
gagaaaggtactattccctcca

SEQ ID NO: 7626889 - DNA, 22 bp, Homo sapiens
gagaaaggtactattccctcca

SEQ ID NO: 7626890 - DNA, 22 bp, Homo sapiens
gagaaaggtactattccctcca

SEQ ID NO: 7626891 - DNA, 22 bp, Homo sapiens
gagaaaggtactattccctcca

SEQ ID NO: 7626892 - DNA, 18 bp, Homo sapiens
gagaaagtttgggcagaa

SEQ ID NO: 7626893 - DNA, 22 bp, Homo sapiens
gagaaagggataatttgaagag

SEQ ID NO: 7626894 - DNA, 22 bp, Homo sapiens
gagaaagggataatttgaagag

SEQ ID NO: 7626895 - DNA, 22 bp, Homo sapiens
gagaaagggataatttgaagag

SEQ ID NO: 7626896 - DNA, 20 bp, Homo sapiens
atggaggaagggcaagagaa

SEQ ID NO: 7626897 - DNA, 22 bp, Homo sapiens
gagaaatagattcatggtagat

SEQ ID NO: 7626898 - DNA, 22 bp, Homo sapiens
gagaaatagattcatggtagat

SEQ ID NO: 7626899 - DNA, 22 bp, Homo sapiens
gagaaataggcaatggtatcta

SEQ ID NO: 7626900 - DNA, 22 bp, Homo sapiens
gagaaatagattcatggtagat

SEQ ID NO: 7626901 - DNA, 22 bp, Homo sapiens
gagaaatagattcatggtagat

SEQ ID NO: 7626902 - DNA, 18 bp, Homo sapiens
gagaaagtttgggcagaa

SEQ ID NO: 7626903 - DNA, 18 bp, Homo sapiens
gagaaagtttgggcagaa

SEQ ID NO: 7626904 - DNA, 22 bp, Homo sapiens
gagaaataggcaatggtatcta

SEQ ID NO: 7626905 - DNA, 22 bp, Homo sapiens
gagaaataggcaatggtatcta

SEQ ID NO: 7626906 - DNA, 22 bp, Homo sapiens
gagaaatatggctcagttccac

SEQ ID NO: 7626907 - DNA, 22 bp, Homo sapiens
gagaaatatggctcagttccac

SEQ ID NO: 7626908 - DNA, 22 bp, Homo sapiens
gagaaatgagtgattcactttt

SEQ ID NO: 7626909 - DNA, 22 bp, Homo sapiens
gagaaatatggctcagttccac

SEQ ID NO: 7626910 - DNA, 22 bp, Homo sapiens
gagaaatgagtgattcactttt

SEQ ID NO: 7626911 - DNA, 22 bp, Homo sapiens
gagaaatgagtgattcactttt

SEQ ID NO: 7626912 - DNA, 22 bp, Homo sapiens
gagaaatgagtgattcactttt

SEQ ID NO: 7626913 - DNA, 22 bp, Homo sapiens
gagaaatatggctcagttccac

SEQ ID NO: 7626914 - DNA, 22 bp, Homo sapiens
gagaaatgcatgcatgtcatca

SEQ ID NO: 7626915 - DNA, 22 bp, Homo sapiens
gagaaatgcatgcatgtcatca

SEQ ID NO: 7626916 - DNA, 22 bp, Homo sapiens
gagaaatgcatgcatgtcatca

SEQ ID NO: 7626917 - DNA, 22 bp, Homo sapiens
gagaaatgcatgcatgtcatca

SEQ ID NO: 7626918 - DNA, 22 bp, Homo sapiens
gagaaatgcatgcatgtcatca

SEQ ID NO: 7626919 - DNA, 22 bp, Homo sapiens
gagaaatgcatgcatgtcatca

SEQ ID NO: 7626920 - DNA, 22 bp, Homo sapiens
gagaaatgctagcttaggaatc

SEQ ID NO: 7626921 - DNA, 22 bp, Homo sapiens
gagaaatgctagcttaggaatc

SEQ ID NO: 7626922 - DNA, 22 bp, Homo sapiens
gagaaatgctagcttaggaatc

SEQ ID NO: 7626923 - DNA, 22 bp, Homo sapiens
gagaacacgaggaggcccagcg

SEQ ID NO: 7626924 - DNA, 22 bp, Homo sapiens
gagaacacatgcagactgggta

SEQ ID NO: 7626925 - DNA, 22 bp, Homo sapiens
gagaaattttgagtggctttct

SEQ ID NO: 7626926 - DNA, 22 bp, Homo sapiens
gagaaattttgagtggctttct

SEQ ID NO: 7626927 - DNA, 22 bp, Homo sapiens
gagaaattttgagtggctttct

SEQ ID NO: 7626928 - DNA, 22 bp, Homo sapiens
gagaacaaggaagagtcggcag

SEQ ID NO: 7626929 - DNA, 22 bp, Homo sapiens
gagaacaaggaagagtcggcag

SEQ ID NO: 7626930 - DNA, 22 bp, Homo sapiens
atggagagagaaggcttgctgt

SEQ ID NO: 7626931 - DNA, 22 bp, Homo sapiens
atggagagagaaggcttgctgt

SEQ ID NO: 7626932 - DNA, 22 bp, Homo sapiens
atggagagagaaggcttgctgt

SEQ ID NO: 7626933 - DNA, 22 bp, Homo sapiens
atggagagtgaaagtctctcta

SEQ ID NO: 7626934 - DNA, 22 bp, Homo sapiens
atggagagtgaaagtctctcta

SEQ ID NO: 7626935 - DNA, 22 bp, Homo sapiens
atggagagtgaaagtctctcta

SEQ ID NO: 7626936 - DNA, 22 bp, Homo sapiens
atggagcaaatggggctgcagg

SEQ ID NO: 7626937 - DNA, 22 bp, Homo sapiens
atggagcaacagacctatcaca

SEQ ID NO: 7626938 - DNA, 22 bp, Homo sapiens
atggagcacacgccatcacata

SEQ ID NO: 7626939 - DNA, 22 bp, Homo sapiens
atggagcaaatggggctgcagg

SEQ ID NO: 7626940 - DNA, 22 bp, Homo sapiens
atggagcaaatggggctgcagg

SEQ ID NO: 7626941 - DNA, 22 bp, Homo sapiens
atggagcaaatggggctgcagg

SEQ ID NO: 7626942 - DNA, 22 bp, Homo sapiens
atggagcaaatggggctgcagg

SEQ ID NO: 7626943 - DNA, 22 bp, Homo sapiens
atggagagttcacttctaagtt

SEQ ID NO: 7626944 - DNA, 22 bp, Homo sapiens
atggagagttcacttctaagtt

SEQ ID NO: 7626945 - DNA, 22 bp, Homo sapiens
atggagagttcacttctaagtt

SEQ ID NO: 7626946 - DNA, 22 bp, Homo sapiens
atggagagtgaaagtctctcta

SEQ ID NO: 7626947 - DNA, 22 bp, Homo sapiens
atggagagtgaaagtctctcta

SEQ ID NO: 7626948 - DNA, 22 bp, Homo sapiens
atggagcagcagaaggggcttg

SEQ ID NO: 7626949 - DNA, 22 bp, Homo sapiens
atggagcagcagaaggggcttg

SEQ ID NO: 7626950 - DNA, 22 bp, Homo sapiens
atggagcagcagaaggggcttg

SEQ ID NO: 7626951 - DNA, 22 bp, Homo sapiens
atggagcagcagaaggggcttg

SEQ ID NO: 7626952 - DNA, 22 bp, Homo sapiens
atggagccattcctgaagactt

SEQ ID NO: 7626953 - DNA, 22 bp, Homo sapiens
atggagccattcctgaagactt

SEQ ID NO: 7626954 - DNA, 22 bp, Homo sapiens
atggagccattcctgaagactt

SEQ ID NO: 7626955 - DNA, 21 bp, Homo sapiens
atggagcctaagagtggaggt

SEQ ID NO: 7626956 - DNA, 21 bp, Homo sapiens
atggagcctaagagtggaggt

SEQ ID NO: 7626957 - DNA, 22 bp, Homo sapiens
atggagctaaattgtaatcata

SEQ ID NO: 7626958 - DNA, 22 bp, Homo sapiens
atggagctctgatatatcaatt

SEQ ID NO: 7626959 - DNA, 22 bp, Homo sapiens
atggagctctgatatatcaatt

SEQ ID NO: 7626960 - DNA, 20 bp, Homo sapiens
atggaggaagggcaagagaa

SEQ ID NO: 7626961 - DNA, 20 bp, Homo sapiens
atggaggaagggcaagagaa

SEQ ID NO: 7626962 - DNA, 20 bp, Homo sapiens
atggaggaagggcaagagaa

SEQ ID NO: 7626963 - DNA, 20 bp, Homo sapiens
atggaggaagggcaagagaa

SEQ ID NO: 7626964 - DNA, 22 bp, Homo sapiens
atggagctgtgtgaatattcat

SEQ ID NO: 7626965 - DNA, 22 bp, Homo sapiens
atggagctgtgtgaatattcat

SEQ ID NO: 7626966 - DNA, 22 bp, Homo sapiens
atggagctgtagggagcagtgg

SEQ ID NO: 7626967 - DNA, 22 bp, Homo sapiens
atgaaaagttcgatctagaagg

SEQ ID NO: 7626968 - DNA, 22 bp, Homo sapiens
atgaaaagggagtgatatttgt

SEQ ID NO: 7626969 - DNA, 22 bp, Homo sapiens
cttgtggcaggtggatggtgcc

SEQ ID NO: 7626970 - DNA, 22 bp, Homo sapiens
cttgtggagtgcctgctgcagt

SEQ ID NO: 7626971 - DNA, 22 bp, Homo sapiens
atgaaaagttcgatctagaagg

SEQ ID NO: 7626972 - DNA, 22 bp, Homo sapiens
atgaaaagttcgatctagaagg

SEQ ID NO: 7626973 - DNA, 22 bp, Homo sapiens
atgaaaagttcgatctagaagg

SEQ ID NO: 7626974 - DNA, 22 bp, Homo sapiens
atgaaaagggagtgatatttgt

SEQ ID NO: 7626975 - DNA, 22 bp, Homo sapiens
atgaaaagggagtgatatttgt

SEQ ID NO: 7626976 - DNA, 22 bp, Homo sapiens
atgaaaagggagtgatatttgt

SEQ ID NO: 7626977 - DNA, 22 bp, Homo sapiens
atgaaaagcataaacgctgaag

SEQ ID NO: 7626978 - DNA, 22 bp, Homo sapiens
atgaaaagcataaacgctgaag

SEQ ID NO: 7626979 - DNA, 22 bp, Homo sapiens
atgaaaagcataaacgctgaag

SEQ ID NO: 7626980 - DNA, 22 bp, Homo sapiens
cttgtgtggtctggtcttgcta

SEQ ID NO: 7626981 - DNA, 22 bp, Homo sapiens
cttgtgtagtgctccacagtga

SEQ ID NO: 7626982 - DNA, 22 bp, Homo sapiens
cttgtgtggtctggtcttgcta

SEQ ID NO: 7626983 - DNA, 22 bp, Homo sapiens
cttgtggcccatggcttcctgc

SEQ ID NO: 7626984 - DNA, 22 bp, Homo sapiens
cttgtggcccatggcttcctgc

SEQ ID NO: 7626985 - DNA, 22 bp, Homo sapiens
cttgtggccaatgtttgttata

SEQ ID NO: 7626986 - DNA, 22 bp, Homo sapiens
cttgtggcaggtggatggtgcc

SEQ ID NO: 7626987 - DNA, 22 bp, Homo sapiens
cttgtggcaggtggatggtgcc

SEQ ID NO: 7626988 - DNA, 22 bp, Homo sapiens
cttgtggagtgcctgctgcagt

SEQ ID NO: 7626989 - DNA, 22 bp, Homo sapiens
cttgtggccaatgtttgttata

SEQ ID NO: 7626990 - DNA, 17 bp, Homo sapiens
cttgtggccagttttta

SEQ ID NO: 7626991 - DNA, 17 bp, Homo sapiens
cttgtggccagttttta

SEQ ID NO: 7626992 - DNA, 22 bp, Homo sapiens
cttgttatctgaaccaaaatta

SEQ ID NO: 7626993 - DNA, 22 bp, Homo sapiens
cttgttattggaaatgtcatgc

SEQ ID NO: 7626994 - DNA, 22 bp, Homo sapiens
cttgttcatctgcataccaagt

SEQ ID NO: 7626995 - DNA, 22 bp, Homo sapiens
cttgttatctccgtgtccttgt

SEQ ID NO: 7626996 - DNA, 22 bp, Homo sapiens
cttgttatctccgtgtccttgt

SEQ ID NO: 7626997 - DNA, 22 bp, Homo sapiens
cttgttatctccgtgtccttgt

SEQ ID NO: 7626998 - DNA, 22 bp, Homo sapiens
cttgttattggaaatgtcatgc

SEQ ID NO: 7626999 - DNA, 22 bp, Homo sapiens
cttgttattggaaatgtcatgc

SEQ ID NO: 7627000 - DNA, 22 bp, Homo sapiens
cttgttatctgaaccaaaatta

SEQ ID NO: 7627001 - DNA, 22 bp, Homo sapiens
cttgtgttgtacattctatggg

SEQ ID NO: 7627002 - DNA, 22 bp, Homo sapiens
cttgtgttgtacattctatggg

SEQ ID NO: 7627003 - DNA, 22 bp, Homo sapiens
cttgttaaaatgccgattctga

SEQ ID NO: 7627004 - DNA, 22 bp, Homo sapiens
cttgttaaaatgcagattccaa

SEQ ID NO: 7627005 - DNA, 22 bp, Homo sapiens
cttgttaaattatataagcaga

SEQ ID NO: 7627006 - DNA, 22 bp, Homo sapiens
cttgttaaattatataagcaga

SEQ ID NO: 7627007 - DNA, 22 bp, Homo sapiens
cttgttaaattatataagcaga

SEQ ID NO: 7627008 - DNA, 23 bp, Homo sapiens
cttgttataagaagactgtctgg

SEQ ID NO: 7627009 - DNA, 22 bp, Homo sapiens
cttgttaaattatataagcaga

SEQ ID NO: 7627010 - DNA, 20 bp, Homo sapiens
cttgttaaatatgcaggtag

SEQ ID NO: 7627011 - DNA, 20 bp, Homo sapiens
cttgttaaatatgcaggtag

SEQ ID NO: 7627012 - DNA, 22 bp, Homo sapiens
cttgtttaagccgctgttaagc

SEQ ID NO: 7627013 - DNA, 22 bp, Homo sapiens
cttgtttaagccgctgttaagc

SEQ ID NO: 7627014 - DNA, 22 bp, Homo sapiens
cttgtttaaataagatagcagt

SEQ ID NO: 7627015 - DNA, 22 bp, Homo sapiens
cttgttgctaacatatgcttct

SEQ ID NO: 7627016 - DNA, 22 bp, Homo sapiens
cttgttgctgaattcaggattc

SEQ ID NO: 7627017 - DNA, 22 bp, Homo sapiens
cttgttgctgaattcaggattc

SEQ ID NO: 7627018 - DNA, 18 bp, Homo sapiens
cttgttcttctcttggcg

SEQ ID NO: 7627019 - DNA, 18 bp, Homo sapiens
cttgttcttctcttggcg

SEQ ID NO: 7627020 - DNA, 18 bp, Homo sapiens
cttgttcttctcttggcg

SEQ ID NO: 7627021 - DNA, 18 bp, Homo sapiens
cttgttcttctcttggcg

SEQ ID NO: 7627022 - DNA, 18 bp, Homo sapiens
cttgttcttctcttggcg

SEQ ID NO: 7627023 - DNA, 22 bp, Homo sapiens
cttgttctgtgcttcttacatt

SEQ ID NO: 7627024 - DNA, 22 bp, Homo sapiens
cttgttctgtgcttcttacatt

SEQ ID NO: 7627025 - DNA, 22 bp, Homo sapiens
cttgttctgtgcttcttacatt

SEQ ID NO: 7627026 - DNA, 21 bp, Homo sapiens
cttgttccaagcatgtctgag

SEQ ID NO: 7627027 - DNA, 18 bp, Homo sapiens
cttgttcttctcttggcg

SEQ ID NO: 7627028 - DNA, 18 bp, Homo sapiens
cttgttcttctcttggcg

SEQ ID NO: 7627029 - DNA, 18 bp, Homo sapiens
cttgttcttctcttggcg

SEQ ID NO: 7627030 - DNA, 22 bp, Homo sapiens
atgaaacatgagaaatggagag

SEQ ID NO: 7627031 - DNA, 22 bp, Homo sapiens
atgaaacatgagaaatggagag

SEQ ID NO: 7627032 - DNA, 22 bp, Homo sapiens
atgaaagtttgcattcctcagt

SEQ ID NO: 7627033 - DNA, 22 bp, Homo sapiens
cttgtttattatgcactgtaga

SEQ ID NO: 7627034 - DNA, 22 bp, Homo sapiens
cttgtttattatgcactgtaga

SEQ ID NO: 7627035 - DNA, 23 bp, Homo sapiens
atgaaacatcacaatggtaccat

SEQ ID NO: 7627036 - DNA, 23 bp, Homo sapiens
atgaaacatcacaatggtaccat

SEQ ID NO: 7627037 - DNA, 22 bp, Homo sapiens
atgaaatatcttgaagaaattc

SEQ ID NO: 7627038 - DNA, 22 bp, Homo sapiens
atgaaatatcttgaagaaattc

SEQ ID NO: 7627039 - DNA, 22 bp, Homo sapiens
atgaaatatcttgaagaaattc

SEQ ID NO: 7627040 - DNA, 22 bp, Homo sapiens
atgaaatatcttgaagaaattc

SEQ ID NO: 7627041 - DNA, 22 bp, Homo sapiens
atgaaatatcttgaagaaattc

SEQ ID NO: 7627042 - DNA, 22 bp, Homo sapiens
atgaaatatcttgaagaaattc

SEQ ID NO: 7627043 - DNA, 22 bp, Homo sapiens
atgaaatatcttgaagaaattc

SEQ ID NO: 7627044 - DNA, 22 bp, Homo sapiens
atgaaatatcttgaagaaattc

SEQ ID NO: 7627045 - DNA, 22 bp, Homo sapiens
atgaaatatcttgaagaaattc

SEQ ID NO: 7627046 - DNA, 22 bp, Homo sapiens
atgaaataaatacccacacata

SEQ ID NO: 7627047 - DNA, 22 bp, Homo sapiens
atgaaataaatacccacacata

SEQ ID NO: 7627048 - DNA, 22 bp, Homo sapiens
atgaaataaatacccacacata

SEQ ID NO: 7627049 - DNA, 22 bp, Homo sapiens
atgaaataaatacccacacata

SEQ ID NO: 7627050 - DNA, 22 bp, Homo sapiens
atgaaataaatacccacacata

SEQ ID NO: 7627051 - DNA, 22 bp, Homo sapiens
atgaaataaatacccacacata

SEQ ID NO: 7627052 - DNA, 22 bp, Homo sapiens
atgaaaacggaccagagctatt

SEQ ID NO: 7627053 - DNA, 22 bp, Homo sapiens
atgaaaacggaccagagctatt

SEQ ID NO: 7627054 - DNA, 22 bp, Homo sapiens
atgaaaacggaccagagctatt

SEQ ID NO: 7627055 - DNA, 22 bp, Homo sapiens
atgaaaacggaccagagctatt

SEQ ID NO: 7627056 - DNA, 22 bp, Homo sapiens
atgaaaacggaccagagctatt

SEQ ID NO: 7627057 - DNA, 22 bp, Homo sapiens
atgaaaacggaccagagctatt

SEQ ID NO: 7627058 - DNA, 22 bp, Homo sapiens
atgaaaacggaccagagctatt

SEQ ID NO: 7627059 - DNA, 22 bp, Homo sapiens
atgaaaactttagcctcattag

SEQ ID NO: 7627060 - DNA, 22 bp, Homo sapiens
atgaaaactttagcctcattag

SEQ ID NO: 7627061 - DNA, 22 bp, Homo sapiens
atgaaaactttagcctcattag

SEQ ID NO: 7627062 - DNA, 22 bp, Homo sapiens
atgaaaactttagcctcattag

SEQ ID NO: 7627063 - DNA, 22 bp, Homo sapiens
atcttttttgtcttggtcactg

SEQ ID NO: 7627064 - DNA, 22 bp, Homo sapiens
atcttttttgtcttggtcactg

SEQ ID NO: 7627065 - DNA, 22 bp, Homo sapiens
atgaaaacagcctcctgtgata

SEQ ID NO: 7627066 - DNA, 22 bp, Homo sapiens
atcttttttgtcttggtcactg

SEQ ID NO: 7627067 - DNA, 22 bp, Homo sapiens
atcttttttgtcttggtcactg

SEQ ID NO: 7627068 - DNA, 22 bp, Homo sapiens
atcttttttgtcttggtcactg

SEQ ID NO: 7627069 - DNA, 22 bp, Homo sapiens
atcttttttgtcttggtcactg

SEQ ID NO: 7627070 - DNA, 22 bp, Homo sapiens
atctttttgacatggtgatggt

SEQ ID NO: 7627071 - DNA, 22 bp, Homo sapiens
atctttttgacatggtgatggt

SEQ ID NO: 7627072 - DNA, 22 bp, Homo sapiens
atctttttactaacactgctta

SEQ ID NO: 7627073 - DNA, 22 bp, Homo sapiens
atctttttactaacactgctta

SEQ ID NO: 7627074 - DNA, 22 bp, Homo sapiens
atctttttactaacactgctta

SEQ ID NO: 7627075 - DNA, 22 bp, Homo sapiens
atctttttactaacactgctta

SEQ ID NO: 7627076 - DNA, 22 bp, Homo sapiens
atctttttactaacactgctta

SEQ ID NO: 7627077 - DNA, 22 bp, Homo sapiens
atctttttactaacactgctta

SEQ ID NO: 7627078 - DNA, 22 bp, Homo sapiens
atctttttactaacactgctta

SEQ ID NO: 7627079 - DNA, 22 bp, Homo sapiens
atctttttactaacactgctta

SEQ ID NO: 7627080 - DNA, 22 bp, Homo sapiens
atctttttactaacactgctta

SEQ ID NO: 7627081 - DNA, 22 bp, Homo sapiens
atctttttgacatggtgatggt

SEQ ID NO: 7627082 - DNA, 22 bp, Homo sapiens
atctttttgacatggtgatggt

SEQ ID NO: 7627083 - DNA, 22 bp, Homo sapiens
atctttttgacatggtgatggt

SEQ ID NO: 7627084 - DNA, 22 bp, Homo sapiens
atctttttatctgtttggaaca

SEQ ID NO: 7627085 - DNA, 22 bp, Homo sapiens
atctttttatctgtttggaaca

SEQ ID NO: 7627086 - DNA, 22 bp, Homo sapiens
atctttttatctgtttggaaca

SEQ ID NO: 7627087 - DNA, 22 bp, Homo sapiens
atctttttatctgtttggaaca

SEQ ID NO: 7627088 - DNA, 22 bp, Homo sapiens
atctttttatctgtttggaaca

SEQ ID NO: 7627089 - DNA, 22 bp, Homo sapiens
atctttttatctgtttggaaca

SEQ ID NO: 7627090 - DNA, 22 bp, Homo sapiens
atctttttatctgtttggaaca

SEQ ID NO: 7627091 - DNA, 22 bp, Homo sapiens
atctttgtttgtctctgaggtg

SEQ ID NO: 7627092 - DNA, 22 bp, Homo sapiens
atctttgttttgatgcagatct

SEQ ID NO: 7627093 - DNA, 22 bp, Homo sapiens
atcttttacattactgcccaga

SEQ ID NO: 7627094 - DNA, 22 bp, Homo sapiens
atctttgggcaatgatgaggga

SEQ ID NO: 7627095 - DNA, 22 bp, Homo sapiens
atctttgttgctctcatttctg

SEQ ID NO: 7627096 - DNA, 22 bp, Homo sapiens
atctttgttgctctcatttctg

SEQ ID NO: 7627097 - DNA, 22 bp, Homo sapiens
atctttgggatcctgatttact

SEQ ID NO: 7627098 - DNA, 22 bp, Homo sapiens
atcttttatgagcgttctgaca

SEQ ID NO: 7627099 - DNA, 22 bp, Homo sapiens
atcttttactacaaatcaggtg

SEQ ID NO: 7627100 - DNA, 22 bp, Homo sapiens
atcttttactacaaatcaggtg

SEQ ID NO: 7627101 - DNA, 22 bp, Homo sapiens
atcttttactacaaatcaggtg

SEQ ID NO: 7627102 - DNA, 22 bp, Homo sapiens
atcttttatgagcgttctgaca

SEQ ID NO: 7627103 - DNA, 22 bp, Homo sapiens
atcttttctgtttgctatgtct

SEQ ID NO: 7627104 - DNA, 22 bp, Homo sapiens
atcttttctgtttgctatgtct

SEQ ID NO: 7627105 - DNA, 22 bp, Homo sapiens
atcttggactacagaagagagg

SEQ ID NO: 7627106 - DNA, 22 bp, Homo sapiens
atcttggattgactggctctgc

SEQ ID NO: 7627107 - DNA, 22 bp, Homo sapiens
atcttggattggagaaagaagt

SEQ ID NO: 7627108 - DNA, 22 bp, Homo sapiens
atctttgggcaatgatgaggga

SEQ ID NO: 7627109 - DNA, 22 bp, Homo sapiens
atcttgctgctacaaagtgccc

SEQ ID NO: 7627110 - DNA, 22 bp, Homo sapiens
atcttgcttccttttaattacc

SEQ ID NO: 7627111 - DNA, 22 bp, Homo sapiens
atcttgcttccttttaattacc

SEQ ID NO: 7627112 - DNA, 22 bp, Homo sapiens
atcttgctgctacaaagtgccc

SEQ ID NO: 7627113 - DNA, 22 bp, Homo sapiens
atcttgcttgctgggcattttc

SEQ ID NO: 7627114 - DNA, 22 bp, Homo sapiens
atcttggactacagaagagagg

SEQ ID NO: 7627115 - DNA, 22 bp, Homo sapiens
atcttggactacagaagagagg

SEQ ID NO: 7627116 - DNA, 22 bp, Homo sapiens
atcttgatcaaggctatcatga

SEQ ID NO: 7627117 - DNA, 22 bp, Homo sapiens
atcttgaatgaatgactcttta

SEQ ID NO: 7627118 - DNA, 22 bp, Homo sapiens
atcttgatcaaggctatcatga

SEQ ID NO: 7627119 - DNA, 22 bp, Homo sapiens
atcttgatcaaggctatcatga

SEQ ID NO: 7627120 - DNA, 22 bp, Homo sapiens
atcttgattccattatctttgt

SEQ ID NO: 7627121 - DNA, 22 bp, Homo sapiens
atcttgattccattatctttgt

SEQ ID NO: 7627122 - DNA, 22 bp, Homo sapiens
atcttgattccattatctttgt

SEQ ID NO: 7627123 - DNA, 22 bp, Homo sapiens
atcttgcatttgctaaaatgca

SEQ ID NO: 7627124 - DNA, 22 bp, Homo sapiens
atcttgcactcctttctcctag

SEQ ID NO: 7627125 - DNA, 22 bp, Homo sapiens
atcttgcactcctttctcctag

SEQ ID NO: 7627126 - DNA, 22 bp, Homo sapiens
atcttgcaatgacctatttagg

SEQ ID NO: 7627127 - DNA, 22 bp, Homo sapiens
atcttgcaatgacctatttagg

SEQ ID NO: 7627128 - DNA, 22 bp, Homo sapiens
atgaaatatttcagagcagagt

SEQ ID NO: 7627129 - DNA, 22 bp, Homo sapiens
atgaaatatttcagagcagagt

SEQ ID NO: 7627130 - DNA, 22 bp, Homo sapiens
atgaaatatttcagagcagagt

SEQ ID NO: 7627131 - DNA, 22 bp, Homo sapiens
atgaaatatttcagagcagagt

SEQ ID NO: 7627132 - DNA, 22 bp, Homo sapiens
atgaaatgaagttggcctggct

SEQ ID NO: 7627133 - DNA, 22 bp, Homo sapiens
atgaaatattctttggtaagaa

SEQ ID NO: 7627134 - DNA, 22 bp, Homo sapiens
atgaaatattctttggtaagaa

SEQ ID NO: 7627135 - DNA, 22 bp, Homo sapiens
atgaaatattctttggtaagaa

SEQ ID NO: 7627136 - DNA, 22 bp, Homo sapiens
atgaaatattctttggtaagaa

SEQ ID NO: 7627137 - DNA, 22 bp, Homo sapiens
atgaaatatcttgaagaaattc

SEQ ID NO: 7627138 - DNA, 22 bp, Homo sapiens
atgaaatatcttgaagaaattc

SEQ ID NO: 7627139 - DNA, 22 bp, Homo sapiens
atgaaatgagtcaatgcgacta

SEQ ID NO: 7627140 - DNA, 22 bp, Homo sapiens
atgaaatgaagttggcctggct

SEQ ID NO: 7627141 - DNA, 22 bp, Homo sapiens
atgaaatgagtcaatgcgacta

SEQ ID NO: 7627142 - DNA, 23 bp, Homo sapiens
atgaaatgatactttattcactg

SEQ ID NO: 7627143 - DNA, 23 bp, Homo sapiens
atgaaatgatactttattcactg

SEQ ID NO: 7627144 - DNA, 23 bp, Homo sapiens
atgaaatgatactttattcactg

SEQ ID NO: 7627145 - DNA, 23 bp, Homo sapiens
atgaaatgatactttattcactg

SEQ ID NO: 7627146 - DNA, 22 bp, Homo sapiens
atgaaatgattgaaatctttac

SEQ ID NO: 7627147 - DNA, 22 bp, Homo sapiens
atgaaatgattgaaatctttac

SEQ ID NO: 7627148 - DNA, 22 bp, Homo sapiens
atgaaatgattgaaatctttac

SEQ ID NO: 7627149 - DNA, 22 bp, Homo sapiens
atgaaatatcttgaagaaattc

SEQ ID NO: 7627150 - DNA, 22 bp, Homo sapiens
atgaaatatcttgaagaaattc

SEQ ID NO: 7627151 - DNA, 22 bp, Homo sapiens
atgaaatatcttgaagaaattc

SEQ ID NO: 7627152 - DNA, 22 bp, Homo sapiens
atgaaatatcttgaagaaattc

SEQ ID NO: 7627153 - DNA, 22 bp, Homo sapiens
atgaaatatcttgaagaaattc

SEQ ID NO: 7627154 - DNA, 22 bp, Homo sapiens
atgaaatatcttgaagaaattc

SEQ ID NO: 7627155 - DNA, 22 bp, Homo sapiens
atgaaatatcttgaagaaattc

SEQ ID NO: 7627156 - DNA, 22 bp, Homo sapiens
atgaaatatcttgaagaaattc

SEQ ID NO: 7627157 - DNA, 22 bp, Homo sapiens
atgaaatatcttgaagaaattc

SEQ ID NO: 7627158 - DNA, 22 bp, Homo sapiens
atgaaatatcttgaagaaattc

SEQ ID NO: 7627159 - DNA, 22 bp, Homo sapiens
atgaaatatcttgaagaaattc

SEQ ID NO: 7627160 - DNA, 22 bp, Homo sapiens
atgaaatatcttgaagaaattc

SEQ ID NO: 7627161 - DNA, 22 bp, Homo sapiens
atgaaatatcttgaagaaattc

SEQ ID NO: 7627162 - DNA, 22 bp, Homo sapiens
atgaaatatcttgaagaaattc

SEQ ID NO: 7627163 - DNA, 22 bp, Homo sapiens
atgaaatgtgaatgcttttcat

SEQ ID NO: 7627164 - DNA, 22 bp, Homo sapiens
atgaaatgtctggatctttttc

SEQ ID NO: 7627165 - DNA, 22 bp, Homo sapiens
atgaaatgtctggatctttttc

SEQ ID NO: 7627166 - DNA, 22 bp, Homo sapiens
atgaaatgtctggatctttttc

SEQ ID NO: 7627167 - DNA, 22 bp, Homo sapiens
atgaaatgtctggatctttttc

SEQ ID NO: 7627168 - DNA, 22 bp, Homo sapiens
atgaaatgtgaatgcttttcat

SEQ ID NO: 7627169 - DNA, 22 bp, Homo sapiens
atgaaatgtgaatgcttttcat

SEQ ID NO: 7627170 - DNA, 22 bp, Homo sapiens
atgaaatgtgaatgcttttcat

SEQ ID NO: 7627171 - DNA, 22 bp, Homo sapiens
atgaaatgtctggatctttttc

SEQ ID NO: 7627172 - DNA, 22 bp, Homo sapiens
atgaaatgtctggatctttttc

SEQ ID NO: 7627173 - DNA, 22 bp, Homo sapiens
atgaaatgtattcagatatgta

SEQ ID NO: 7627174 - DNA, 22 bp, Homo sapiens
atgaaatgtattcagatatgta

SEQ ID NO: 7627175 - DNA, 22 bp, Homo sapiens
atgaaatgtattcagatatgta

SEQ ID NO: 7627176 - DNA, 22 bp, Homo sapiens
atgaaatgtattcagatatgta

SEQ ID NO: 7627177 - DNA, 22 bp, Homo sapiens
atgaaatgtattcagatatgta

SEQ ID NO: 7627178 - DNA, 22 bp, Homo sapiens
atgaaatgtatgagtctgggtt

SEQ ID NO: 7627179 - DNA, 22 bp, Homo sapiens
atgaaatgtattcagatatgta

SEQ ID NO: 7627180 - DNA, 22 bp, Homo sapiens
atgaaatgtatgagtctgggtt

SEQ ID NO: 7627181 - DNA, 22 bp, Homo sapiens
atgaaatgtatgagtctgggtt

SEQ ID NO: 7627182 - DNA, 22 bp, Homo sapiens
atgaaatgtatgagtctgggtt

SEQ ID NO: 7627183 - DNA, 22 bp, Homo sapiens
atgaaatgtaagtagagagttt

SEQ ID NO: 7627184 - DNA, 22 bp, Homo sapiens
atgaaatgtaagtagagagttt

SEQ ID NO: 7627185 - DNA, 22 bp, Homo sapiens
atgaaatgtaagtagagagttt

SEQ ID NO: 7627186 - DNA, 22 bp, Homo sapiens
atgaaatgtaagtagagagttt

SEQ ID NO: 7627187 - DNA, 22 bp, Homo sapiens
atgaaatgtatgagtctgggtt

SEQ ID NO: 7627188 - DNA, 22 bp, Homo sapiens
atgaaatggtggttttccattt

SEQ ID NO: 7627189 - DNA, 22 bp, Homo sapiens
atgaaatggtggttttccattt

SEQ ID NO: 7627190 - DNA, 22 bp, Homo sapiens
atgaaatggtggttttccattt

SEQ ID NO: 7627191 - DNA, 22 bp, Homo sapiens
atgaaatggtggttttccattt

SEQ ID NO: 7627192 - DNA, 22 bp, Homo sapiens
atgaaatggtggttttccattt

SEQ ID NO: 7627193 - DNA, 23 bp, Homo sapiens
atgaaatgctggctcagggaggt

SEQ ID NO: 7627194 - DNA, 23 bp, Homo sapiens
atgaaatgctggctcagggaggt

SEQ ID NO: 7627195 - DNA, 23 bp, Homo sapiens
atgaaatgctggctcagggaggt

SEQ ID NO: 7627196 - DNA, 23 bp, Homo sapiens
atgaaatgctggctcagggaggt

SEQ ID NO: 7627197 - DNA, 23 bp, Homo sapiens
atgaaatgctggctcagggaggt

SEQ ID NO: 7627198 - DNA, 23 bp, Homo sapiens
atgaaatgctggctcagggaggt

SEQ ID NO: 7627199 - DNA, 22 bp, Homo sapiens
atgaaatgctgagaggtgcttc

SEQ ID NO: 7627200 - DNA, 22 bp, Homo sapiens
atgaaatgctgagaggtgcttc

SEQ ID NO: 7627201 - DNA, 22 bp, Homo sapiens
atgaaatgctgagaggtgcttc

SEQ ID NO: 7627202 - DNA, 22 bp, Homo sapiens
atgaaatgctgagaggtgcttc

SEQ ID NO: 7627203 - DNA, 22 bp, Homo sapiens
atgaaatgctgagaggtgcttc

SEQ ID NO: 7627204 - DNA, 22 bp, Homo sapiens
atgaaatgctgagaggtgcttc

SEQ ID NO: 7627205 - DNA, 22 bp, Homo sapiens
atgaaatgattgaaatctttac

SEQ ID NO: 7627206 - DNA, 22 bp, Homo sapiens
atgaaatgattgaaatctttac

SEQ ID NO: 7627207 - DNA, 22 bp, Homo sapiens
atgaaatgattgaaatctttac

SEQ ID NO: 7627208 - DNA, 22 bp, Homo sapiens
atgaaatgattgaaatctttac

SEQ ID NO: 7627209 - DNA, 22 bp, Homo sapiens
atgaaatgattgaaatctttac

SEQ ID NO: 7627210 - DNA, 22 bp, Homo sapiens
atgaaatgctattttggctaga

SEQ ID NO: 7627211 - DNA, 19 bp, Homo sapiens
cttttcaagccatcagttt

SEQ ID NO: 7627212 - DNA, 22 bp, Homo sapiens
cttttcagagctgagatcaccg

SEQ ID NO: 7627213 - DNA, 22 bp, Homo sapiens
cttttcagagctgagatcaccg

SEQ ID NO: 7627214 - DNA, 22 bp, Homo sapiens
cttttcagagctgagatcaccg

SEQ ID NO: 7627215 - DNA, 19 bp, Homo sapiens
cttttcatcaacagccaat

SEQ ID NO: 7627216 - DNA, 19 bp, Homo sapiens
cttttcatcaacagccaat

SEQ ID NO: 7627217 - DNA, 19 bp, Homo sapiens
cttttcatcaacagccaat

SEQ ID NO: 7627218 - DNA, 22 bp, Homo sapiens
cttttcaggctacattatggga

SEQ ID NO: 7627219 - DNA, 22 bp, Homo sapiens
cttttcaggctacattatggga

SEQ ID NO: 7627220 - DNA, 19 bp, Homo sapiens
cttttcaagccatcagttt

SEQ ID NO: 7627221 - DNA, 19 bp, Homo sapiens
cttttcaagccatcagttt

SEQ ID NO: 7627222 - DNA, 19 bp, Homo sapiens
cttttcaagccatcagttt

SEQ ID NO: 7627223 - DNA, 22 bp, Homo sapiens
cttttcaaacgctgatgtcagt

SEQ ID NO: 7627224 - DNA, 22 bp, Homo sapiens
cttttcaaacgctgatgtcagt

SEQ ID NO: 7627225 - DNA, 22 bp, Homo sapiens
cttttcaaacgctgatgtcagt

SEQ ID NO: 7627226 - DNA, 22 bp, Homo sapiens
cttttcaaacgctgatgtcagt

SEQ ID NO: 7627227 - DNA, 22 bp, Homo sapiens
cttttcaaacgctgatgtcagt

SEQ ID NO: 7627228 - DNA, 22 bp, Homo sapiens
cttttcaaacgctgatgtcagt

SEQ ID NO: 7627229 - DNA, 22 bp, Homo sapiens
cttttcatgagtctgttatggg

SEQ ID NO: 7627230 - DNA, 22 bp, Homo sapiens
cttttcatgagtctgttatggg

SEQ ID NO: 7627231 - DNA, 22 bp, Homo sapiens
cttttcatgagtctgttatggg

SEQ ID NO: 7627232 - DNA, 22 bp, Homo sapiens
cttttcatgagtctgttatggg

SEQ ID NO: 7627233 - DNA, 22 bp, Homo sapiens
cttttcatgagtctgttatggg

SEQ ID NO: 7627234 - DNA, 19 bp, Homo sapiens
cttttcatcaacagccaat

SEQ ID NO: 7627235 - DNA, 19 bp, Homo sapiens
cttttcatcaacagccaat

SEQ ID NO: 7627236 - DNA, 22 bp, Homo sapiens
cttttcatgccagcccatcaca

SEQ ID NO: 7627237 - DNA, 22 bp, Homo sapiens
cttttcatgagtctgttatggg

SEQ ID NO: 7627238 - DNA, 22 bp, Homo sapiens
cttttcatgagtctgttatggg

SEQ ID NO: 7627239 - DNA, 22 bp, Homo sapiens
cttttcatgagtctgttatggg

SEQ ID NO: 7627240 - DNA, 22 bp, Homo sapiens
cttttcatgagtctgttatggg

SEQ ID NO: 7627241 - DNA, 22 bp, Homo sapiens
atgaagactaatgtgaatggga

SEQ ID NO: 7627242 - DNA, 22 bp, Homo sapiens
cttttcattgtttgtacatgca

SEQ ID NO: 7627243 - DNA, 23 bp, Homo sapiens
cttttcattgccttagcgcagag

SEQ ID NO: 7627244 - DNA, 23 bp, Homo sapiens
cttttcattgccttagcgcagag

SEQ ID NO: 7627245 - DNA, 23 bp, Homo sapiens
cttttcattgccttagcgcagag

SEQ ID NO: 7627246 - DNA, 22 bp, Homo sapiens
cttttcatgccagcccatcaca

SEQ ID NO: 7627247 - DNA, 22 bp, Homo sapiens
cttttcatgccagcccatcaca

SEQ ID NO: 7627248 - DNA, 22 bp, Homo sapiens
atgaaattaatcaacacataca

SEQ ID NO: 7627249 - DNA, 22 bp, Homo sapiens
atgaaattaatcaacacataca

SEQ ID NO: 7627250 - DNA, 22 bp, Homo sapiens
ctttggtctgtccatcctgcct

SEQ ID NO: 7627251 - DNA, 22 bp, Homo sapiens
atgaaatgttggtcccaatcgc

SEQ ID NO: 7627252 - DNA, 22 bp, Homo sapiens
atgaaatgtgaatgcttttcat

SEQ ID NO: 7627253 - DNA, 22 bp, Homo sapiens
atgaaatgttggtcccaatcgc

SEQ ID NO: 7627254 - DNA, 22 bp, Homo sapiens
atgaaattaatcaacacataca

SEQ ID NO: 7627255 - DNA, 22 bp, Homo sapiens
atgaaattaatcaacacataca

SEQ ID NO: 7627256 - DNA, 22 bp, Homo sapiens
atgaaattaatcaacacataca

SEQ ID NO: 7627257 - DNA, 22 bp, Homo sapiens
ctttggtgttcattaaacatgg

SEQ ID NO: 7627258 - DNA, 22 bp, Homo sapiens
ctttggtgtcatgtttctgcgg

SEQ ID NO: 7627259 - DNA, 22 bp, Homo sapiens
ctttggtggaggggtgcaggca

SEQ ID NO: 7627260 - DNA, 22 bp, Homo sapiens
ctttggtggaggggtgcaggca

SEQ ID NO: 7627261 - DNA, 22 bp, Homo sapiens
cttttacatttgttgaagagta

SEQ ID NO: 7627262 - DNA, 22 bp, Homo sapiens
cttttacatttgttgaagagta

SEQ ID NO: 7627263 - DNA, 20 bp, Homo sapiens
ctttggtgggggtagcccag

SEQ ID NO: 7627264 - DNA, 20 bp, Homo sapiens
ctttggtgggggtagcccag

SEQ ID NO: 7627265 - DNA, 20 bp, Homo sapiens
ctttggtgggggtagcccag

SEQ ID NO: 7627266 - DNA, 22 bp, Homo sapiens
ctttggtgtcatgtttctgcgg

SEQ ID NO: 7627267 - DNA, 22 bp, Homo sapiens
cttttattttgaattaagggct

SEQ ID NO: 7627268 - DNA, 22 bp, Homo sapiens
cttttattttgaattaagggct

SEQ ID NO: 7627269 - DNA, 22 bp, Homo sapiens
cttttattttgaattaagggct

SEQ ID NO: 7627270 - DNA, 22 bp, Homo sapiens
cttttattttgaattaagggct

SEQ ID NO: 7627271 - DNA, 22 bp, Homo sapiens
cttttagtattctgatttgcca

SEQ ID NO: 7627272 - DNA, 22 bp, Homo sapiens
cttttattttgaattaagggct

SEQ ID NO: 7627273 - DNA, 22 bp, Homo sapiens
cttttactgtgaaaagaaactg

SEQ ID NO: 7627274 - DNA, 22 bp, Homo sapiens
cttttagctgtttccatggcaa

SEQ ID NO: 7627275 - DNA, 22 bp, Homo sapiens
cttttagctgcaagtgttcaca

SEQ ID NO: 7627276 - DNA, 22 bp, Homo sapiens
cttttattttgaattaagggct

SEQ ID NO: 7627277 - DNA, 22 bp, Homo sapiens
cttttattttgaattaagggct

SEQ ID NO: 7627278 - DNA, 22 bp, Homo sapiens
cttttattttgaattaagggct

SEQ ID NO: 7627279 - DNA, 22 bp, Homo sapiens
cttttattttgaattaagggct

SEQ ID NO: 7627280 - DNA, 22 bp, Homo sapiens
cttttattttgaattaagggct

SEQ ID NO: 7627281 - DNA, 22 bp, Homo sapiens
atctacatgttgatttaaagaa

SEQ ID NO: 7627282 - DNA, 22 bp, Homo sapiens
atctacattctcaccaatgttt

SEQ ID NO: 7627283 - DNA, 22 bp, Homo sapiens
atctacattctcaccaatgttt

SEQ ID NO: 7627284 - DNA, 22 bp, Homo sapiens
atctagaaaaggtgactaaaat

SEQ ID NO: 7627285 - DNA, 22 bp, Homo sapiens
atctagaaaaggtgactaaaat

SEQ ID NO: 7627286 - DNA, 22 bp, Homo sapiens
atctagaaaaggtgactaaaat

SEQ ID NO: 7627287 - DNA, 23 bp, Homo sapiens
atctagaaacctgatgactctgt

SEQ ID NO: 7627288 - DNA, 22 bp, Homo sapiens
atctacataaaacgaatacata

SEQ ID NO: 7627289 - DNA, 22 bp, Homo sapiens
atctacataaaacgaatacata

SEQ ID NO: 7627290 - DNA, 22 bp, Homo sapiens
atctacataaaacgaatacata

SEQ ID NO: 7627291 - DNA, 22 bp, Homo sapiens
atctacaggctgaggtgggagg

SEQ ID NO: 7627292 - DNA, 22 bp, Homo sapiens
atctacataaaacgaatacata

SEQ ID NO: 7627293 - DNA, 22 bp, Homo sapiens
atctacaggctgaggtgggagg

SEQ ID NO: 7627294 - DNA, 22 bp, Homo sapiens
atctacagtgcacaggacagcc

SEQ ID NO: 7627295 - DNA, 22 bp, Homo sapiens
atctacagtgcacaggacagcc

SEQ ID NO: 7627296 - DNA, 22 bp, Homo sapiens
atctacagtgcacaggacagcc

SEQ ID NO: 7627297 - DNA, 22 bp, Homo sapiens
atctacagccagtctggtttgt

SEQ ID NO: 7627298 - DNA, 22 bp, Homo sapiens
atctacagctgtctgcacagta

SEQ ID NO: 7627299 - DNA, 22 bp, Homo sapiens
atctacagctgtctgcacagta

SEQ ID NO: 7627300 - DNA, 22 bp, Homo sapiens
atctacagccagtctggtttgt

SEQ ID NO: 7627301 - DNA, 22 bp, Homo sapiens
atctacagcagtgccaggtagc

SEQ ID NO: 7627302 - DNA, 19 bp, Homo sapiens
atctacaattattctcagt

SEQ ID NO: 7627303 - DNA, 22 bp, Homo sapiens
atctacactataacagaatgct

SEQ ID NO: 7627304 - DNA, 22 bp, Homo sapiens
atctacagcagtgccaggtagc

SEQ ID NO: 7627305 - DNA, 22 bp, Homo sapiens
atctacagcagtgccaggtagc

SEQ ID NO: 7627306 - DNA, 22 bp, Homo sapiens
atctacaggatagtttaatatt

SEQ ID NO: 7627307 - DNA, 22 bp, Homo sapiens
atctacaggatagtttaatatt

SEQ ID NO: 7627308 - DNA, 22 bp, Homo sapiens
atctacaggatagtttaatatt

SEQ ID NO: 7627309 - DNA, 22 bp, Homo sapiens
atctacaggatagtttaatatt

SEQ ID NO: 7627310 - DNA, 22 bp, Homo sapiens
atctacaggattttacagagtt

SEQ ID NO: 7627311 - DNA, 22 bp, Homo sapiens
atctacaggattttacagagtt

SEQ ID NO: 7627312 - DNA, 22 bp, Homo sapiens
atctacaggattttacagagtt

SEQ ID NO: 7627313 - DNA, 22 bp, Homo sapiens
atctacaggaagagaaagggcc

SEQ ID NO: 7627314 - DNA, 22 bp, Homo sapiens
atctacaggattttacagagtt

SEQ ID NO: 7627315 - DNA, 22 bp, Homo sapiens
atctacaggattttacagagtt

SEQ ID NO: 7627316 - DNA, 22 bp, Homo sapiens
atctacaggattttacagagtt

SEQ ID NO: 7627317 - DNA, 22 bp, Homo sapiens
atctagaacaattattgtcaca

SEQ ID NO: 7627318 - DNA, 22 bp, Homo sapiens
atctagaaagtgttgaagatca

SEQ ID NO: 7627319 - DNA, 22 bp, Homo sapiens
atctagaacaattattgtcaca

SEQ ID NO: 7627320 - DNA, 22 bp, Homo sapiens
atctagaaagtgttgaagatca

SEQ ID NO: 7627321 - DNA, 22 bp, Homo sapiens
atctagaaagtgttgaagatca

SEQ ID NO: 7627322 - DNA, 22 bp, Homo sapiens
atctagaaagccaggggcctgc

SEQ ID NO: 7627323 - DNA, 23 bp, Homo sapiens
atctagaaacctgatgactctgt

SEQ ID NO: 7627324 - DNA, 22 bp, Homo sapiens
atctagaaagccaggggcctgc

SEQ ID NO: 7627325 - DNA, 23 bp, Homo sapiens
atctagaaacctgatgactctgt

SEQ ID NO: 7627326 - DNA, 22 bp, Homo sapiens
atctagaagcctgagccaagat

SEQ ID NO: 7627327 - DNA, 22 bp, Homo sapiens
atctagaacttaaagtcagtca

SEQ ID NO: 7627328 - DNA, 22 bp, Homo sapiens
atctagaagtggcatgaattac

SEQ ID NO: 7627329 - DNA, 22 bp, Homo sapiens
atctagaagcctgagccaagat

SEQ ID NO: 7627330 - DNA, 22 bp, Homo sapiens
atctagaagtggcatgaattac

SEQ ID NO: 7627331 - DNA, 22 bp, Homo sapiens
atctagaagtggcatgaattac

SEQ ID NO: 7627332 - DNA, 22 bp, Homo sapiens
atctagaagtggcatgaattac

SEQ ID NO: 7627333 - DNA, 22 bp, Homo sapiens
atctagaagtcatggctttctt

SEQ ID NO: 7627334 - DNA, 22 bp, Homo sapiens
atctagaagtcatggctttctt

SEQ ID NO: 7627335 - DNA, 19 bp, Homo sapiens
atctagattattgagaagg

SEQ ID NO: 7627336 - DNA, 22 bp, Homo sapiens
atctagattaggtataagagct

SEQ ID NO: 7627337 - DNA, 22 bp, Homo sapiens
atctagcagtgttataattgga

SEQ ID NO: 7627338 - DNA, 19 bp, Homo sapiens
atctagattattgagaagg

SEQ ID NO: 7627339 - DNA, 22 bp, Homo sapiens
atctagcaccaaactagctttt

SEQ ID NO: 7627340 - DNA, 22 bp, Homo sapiens
atctaggatttgaatgcacagt

SEQ ID NO: 7627341 - DNA, 22 bp, Homo sapiens
atctaggatttgaatgcacagt

SEQ ID NO: 7627342 - DNA, 22 bp, Homo sapiens
atctagaggcaatgaaggaggt

SEQ ID NO: 7627343 - DNA, 22 bp, Homo sapiens
atctagaggcaatgaaggaggt

SEQ ID NO: 7627344 - DNA, 22 bp, Homo sapiens
atctagattaggtataagagct

SEQ ID NO: 7627345 - DNA, 22 bp, Homo sapiens
atctagattaggtataagagct

SEQ ID NO: 7627346 - DNA, 22 bp, Homo sapiens
atctagaggagggctgctggat

SEQ ID NO: 7627347 - DNA, 21 bp, Homo sapiens
atctagaatctctctccccac

SEQ ID NO: 7627348 - DNA, 22 bp, Homo sapiens
atctagaagtggcatgaattac

SEQ ID NO: 7627349 - DNA, 22 bp, Homo sapiens
atctagaagtggcatgaattac

SEQ ID NO: 7627350 - DNA, 22 bp, Homo sapiens
atctatgtgcctttgtatagaa

SEQ ID NO: 7627351 - DNA, 22 bp, Homo sapiens
atctattatgctgagaaactgt

SEQ ID NO: 7627352 - DNA, 22 bp, Homo sapiens
atctatgtgcctttgtatagaa

SEQ ID NO: 7627353 - DNA, 22 bp, Homo sapiens
atctatgtgggaatcataatag

SEQ ID NO: 7627354 - DNA, 22 bp, Homo sapiens
cttgagtcatataaagacagag

SEQ ID NO: 7627355 - DNA, 22 bp, Homo sapiens
cttgagtcatataaagacagag

SEQ ID NO: 7627356 - DNA, 22 bp, Homo sapiens
atctattatgctgagaaactgt

SEQ ID NO: 7627357 - DNA, 22 bp, Homo sapiens
cttgagtattttaatccataat

SEQ ID NO: 7627358 - DNA, 22 bp, Homo sapiens
atctattatgctgagaaactgt

SEQ ID NO: 7627359 - DNA, 22 bp, Homo sapiens
atctatcacctttaggtttgtt

SEQ ID NO: 7627360 - DNA, 22 bp, Homo sapiens
atctatcaaaaccagagggttt

SEQ ID NO: 7627361 - DNA, 22 bp, Homo sapiens
atctatatcatggggtaaggta

SEQ ID NO: 7627362 - DNA, 19 bp, Homo sapiens
atctagattattgagaagg

SEQ ID NO: 7627363 - DNA, 22 bp, Homo sapiens
atctatacccatcatgatttaa

SEQ ID NO: 7627364 - DNA, 22 bp, Homo sapiens
atctatacccatcatgatttaa

SEQ ID NO: 7627365 - DNA, 22 bp, Homo sapiens
atctagggtgtaggtcactgat

SEQ ID NO: 7627366 - DNA, 22 bp, Homo sapiens
atctatacccatcatgatttaa

SEQ ID NO: 7627367 - DNA, 22 bp, Homo sapiens
atctaggatttgaatgcacagt

SEQ ID NO: 7627368 - DNA, 22 bp, Homo sapiens
atctaggtttggaagatagagt

SEQ ID NO: 7627369 - DNA, 22 bp, Homo sapiens
cttgatattttaaacatacagt

SEQ ID NO: 7627370 - DNA, 22 bp, Homo sapiens
cttgatcattcactggctctgt

SEQ ID NO: 7627371 - DNA, 22 bp, Homo sapiens
cttgatcattcactggctctgt

SEQ ID NO: 7627372 - DNA, 22 bp, Homo sapiens
cttgatctacatagtgaaaccc

SEQ ID NO: 7627373 - DNA, 22 bp, Homo sapiens
cttgatcctaggatggaaggga

SEQ ID NO: 7627374 - DNA, 23 bp, Homo sapiens
cttgcctggcctctctgcccaga

SEQ ID NO: 7627375 - DNA, 22 bp, Homo sapiens
cttgcctgctggagcagggctc

SEQ ID NO: 7627376 - DNA, 22 bp, Homo sapiens
cttgatctacatagtgaaaccc

SEQ ID NO: 7627377 - DNA, 22 bp, Homo sapiens
cttgatctacatagtgaaaccc

SEQ ID NO: 7627378 - DNA, 22 bp, Homo sapiens
cttgatctacatagtgaaaccc

SEQ ID NO: 7627379 - DNA, 22 bp, Homo sapiens
cttgcctgggactgaggcattt

SEQ ID NO: 7627380 - DNA, 22 bp, Homo sapiens
cttgcctgtggctagttggctc

SEQ ID NO: 7627381 - DNA, 19 bp, Homo sapiens
cttgcctgttcctacagct

SEQ ID NO: 7627382 - DNA, 19 bp, Homo sapiens
cttgcctgttcctacagct

SEQ ID NO: 7627383 - DNA, 19 bp, Homo sapiens
cttgcctgttcctacagct

SEQ ID NO: 7627384 - DNA, 22 bp, Homo sapiens
cttgccttctctggggtggcag

SEQ ID NO: 7627385 - DNA, 22 bp, Homo sapiens
cttgccttctgttcctatagaa

SEQ ID NO: 7627386 - DNA, 22 bp, Homo sapiens
cttgccttcagtgtccctttgc

SEQ ID NO: 7627387 - DNA, 22 bp, Homo sapiens
cttgccttcagtccatcagtca

SEQ ID NO: 7627388 - DNA, 22 bp, Homo sapiens
cttgccttcagtgtccctttgc

SEQ ID NO: 7627389 - DNA, 22 bp, Homo sapiens
cttgccttcagtccatcagtca

SEQ ID NO: 7627390 - DNA, 22 bp, Homo sapiens
cttgccttcagtccatcagtca

SEQ ID NO: 7627391 - DNA, 22 bp, Homo sapiens
cttgccttctgttcctatagaa

SEQ ID NO: 7627392 - DNA, 22 bp, Homo sapiens
cttgccttctgttcctatagaa

SEQ ID NO: 7627393 - DNA, 22 bp, Homo sapiens
cttgccttctgttcctatagaa

SEQ ID NO: 7627394 - DNA, 22 bp, Homo sapiens
cttgccttcttttcctatagaa

SEQ ID NO: 7627395 - DNA, 22 bp, Homo sapiens
cttgccttcttttcctatagaa

SEQ ID NO: 7627396 - DNA, 22 bp, Homo sapiens
cttgccttcttttcctatagaa

SEQ ID NO: 7627397 - DNA, 22 bp, Homo sapiens
cttgccttcttttcctatagaa

SEQ ID NO: 7627398 - DNA, 22 bp, Homo sapiens
cttgcctttgtcttcaaaggct

SEQ ID NO: 7627399 - DNA, 22 bp, Homo sapiens
cttgcctttgtcttcaaaggct

SEQ ID NO: 7627400 - DNA, 22 bp, Homo sapiens
cttgcctttgtcttcaaaggct

SEQ ID NO: 7627401 - DNA, 22 bp, Homo sapiens
cttgcctttgtcttcaaaggct

SEQ ID NO: 7627402 - DNA, 22 bp, Homo sapiens
cttgcctttgtcttcaaaggct

SEQ ID NO: 7627403 - DNA, 22 bp, Homo sapiens
cttgcctttgtcttcaaaggct

SEQ ID NO: 7627404 - DNA, 22 bp, Homo sapiens
cttgcctttgtcttcaaaggct

SEQ ID NO: 7627405 - DNA, 22 bp, Homo sapiens
cttgcctttgtcttcaaaggct

SEQ ID NO: 7627406 - DNA, 22 bp, Homo sapiens
cttgctcacagtacctggcttg

SEQ ID NO: 7627407 - DNA, 22 bp, Homo sapiens
cttgctcacagtacctggcttg

SEQ ID NO: 7627408 - DNA, 22 bp, Homo sapiens
cttgcctttgtcttcaaaggct

SEQ ID NO: 7627409 - DNA, 22 bp, Homo sapiens
cttgctctgggaagaaaaagtc

SEQ ID NO: 7627410 - DNA, 22 bp, Homo sapiens
cttgctcattaagtagctcaca

SEQ ID NO: 7627411 - DNA, 22 bp, Homo sapiens
cttgctctagatgttcagagct

SEQ ID NO: 7627412 - DNA, 22 bp, Homo sapiens
cttgctctagatgttcagagct

SEQ ID NO: 7627413 - DNA, 22 bp, Homo sapiens
cttgctgagataaatgctgtct

SEQ ID NO: 7627414 - DNA, 22 bp, Homo sapiens
cttgctggagcggagcgggtgt

SEQ ID NO: 7627415 - DNA, 22 bp, Homo sapiens
cttgctggaaactctctctgcc

SEQ ID NO: 7627416 - DNA, 22 bp, Homo sapiens
cttgctggaaactctctctgcc

SEQ ID NO: 7627417 - DNA, 22 bp, Homo sapiens
cttgctggaaactctctctgcc

SEQ ID NO: 7627418 - DNA, 22 bp, Homo sapiens
cttgctggaaactctctctgcc

SEQ ID NO: 7627419 - DNA, 22 bp, Homo sapiens
cttgctggaaactctctctgcc

SEQ ID NO: 7627420 - DNA, 22 bp, Homo sapiens
cttgctgctgcatctgagcatg

SEQ ID NO: 7627421 - DNA, 22 bp, Homo sapiens
cttgctgctgcatctgagcatg

SEQ ID NO: 7627422 - DNA, 22 bp, Homo sapiens
atcttctcaagcagcatcctgt

SEQ ID NO: 7627423 - DNA, 22 bp, Homo sapiens
atcttctatagatattctgaag

SEQ ID NO: 7627424 - DNA, 22 bp, Homo sapiens
atcttctatagatattctgaag

SEQ ID NO: 7627425 - DNA, 22 bp, Homo sapiens
atcttctgatttatggagcaat

SEQ ID NO: 7627426 - DNA, 22 bp, Homo sapiens
atcttctcatgtgtaatgaggt

SEQ ID NO: 7627427 - DNA, 22 bp, Homo sapiens
cttgtacaagtcagtgctgggg

SEQ ID NO: 7627428 - DNA, 22 bp, Homo sapiens
cttgtacaagtcagtgctgggg

SEQ ID NO: 7627429 - DNA, 22 bp, Homo sapiens
cttgtaaatgcagattctgatt

SEQ ID NO: 7627430 - DNA, 22 bp, Homo sapiens
cttgtaactcctatttactatg

SEQ ID NO: 7627431 - DNA, 22 bp, Homo sapiens
cttgtaactcctatttactatg

SEQ ID NO: 7627432 - DNA, 22 bp, Homo sapiens
cttgtaatagataggatcaaat

SEQ ID NO: 7627433 - DNA, 22 bp, Homo sapiens
atcttcctttgccatgggatag

SEQ ID NO: 7627434 - DNA, 22 bp, Homo sapiens
atcttcctttgccatgggatag

SEQ ID NO: 7627435 - DNA, 22 bp, Homo sapiens
cttgtacactcagtacttctag

SEQ ID NO: 7627436 - DNA, 22 bp, Homo sapiens
cttgtacactcagtacttctag

SEQ ID NO: 7627437 - DNA, 22 bp, Homo sapiens
cttgtacaagtcagtgctgggg

SEQ ID NO: 7627438 - DNA, 22 bp, Homo sapiens
cttgtacactcagtacttctag

SEQ ID NO: 7627439 - DNA, 22 bp, Homo sapiens
cttgtacactcagtacttctag

SEQ ID NO: 7627440 - DNA, 22 bp, Homo sapiens
atcttgaaatactttctagaat

SEQ ID NO: 7627441 - DNA, 22 bp, Homo sapiens
atcttgaaatactttctagaat

SEQ ID NO: 7627442 - DNA, 22 bp, Homo sapiens
atcttgaaatactttctagaat

SEQ ID NO: 7627443 - DNA, 22 bp, Homo sapiens
atcttgaaaagcagcatggcct

SEQ ID NO: 7627444 - DNA, 22 bp, Homo sapiens
atcttgaaggttctaccataca

SEQ ID NO: 7627445 - DNA, 22 bp, Homo sapiens
atcttgaaatactttctagaat

SEQ ID NO: 7627446 - DNA, 22 bp, Homo sapiens
atcttgaaggttctaccataca

SEQ ID NO: 7627447 - DNA, 22 bp, Homo sapiens
atcttgaatgaatgactcttta

SEQ ID NO: 7627448 - DNA, 22 bp, Homo sapiens
atcttgaatgaatgactcttta

SEQ ID NO: 7627449 - DNA, 22 bp, Homo sapiens
atcttgaaggttctaccataca

SEQ ID NO: 7627450 - DNA, 22 bp, Homo sapiens
atcttgaaggttctaccataca

SEQ ID NO: 7627451 - DNA, 22 bp, Homo sapiens
atcttctgggcagtgaaaattg

SEQ ID NO: 7627452 - DNA, 22 bp, Homo sapiens
atcttctgggcagtgaaaattg

SEQ ID NO: 7627453 - DNA, 22 bp, Homo sapiens
atcttcttcaaggatctggagc

SEQ ID NO: 7627454 - DNA, 22 bp, Homo sapiens
atcttctggtcaaatttttgca

SEQ ID NO: 7627455 - DNA, 22 bp, Homo sapiens
atcttcttcaaggatctggagc

SEQ ID NO: 7627456 - DNA, 22 bp, Homo sapiens
atcttcttcaaggatctggagc

SEQ ID NO: 7627457 - DNA, 22 bp, Homo sapiens
atcttcttcaaggatctggagc

SEQ ID NO: 7627458 - DNA, 20 bp, Homo sapiens
atcttcttggccagcttgct

SEQ ID NO: 7627459 - DNA, 20 bp, Homo sapiens
atcttcttggccagcttgct

SEQ ID NO: 7627460 - DNA, 20 bp, Homo sapiens
atcttcttggccagcttgct

SEQ ID NO: 7627461 - DNA, 22 bp, Homo sapiens
cttgtaaatgcagattctgatt

SEQ ID NO: 7627462 - DNA, 22 bp, Homo sapiens
cttgtaaatgcagattctgatt

SEQ ID NO: 7627463 - DNA, 19 bp, Homo sapiens
cttgtaaagggctgtttct

SEQ ID NO: 7627464 - DNA, 19 bp, Homo sapiens
cttgtaaagggctgtttct

SEQ ID NO: 7627465 - DNA, 19 bp, Homo sapiens
cttgtaaagggctgtttct

SEQ ID NO: 7627466 - DNA, 22 bp, Homo sapiens
cttgtaaatgcagattctgatt

SEQ ID NO: 7627467 - DNA, 22 bp, Homo sapiens
cttgtaaatgcagattctgatt

SEQ ID NO: 7627468 - DNA, 22 bp, Homo sapiens
cttgtaaatgcagattctgatt

SEQ ID NO: 7627469 - DNA, 22 bp, Homo sapiens
cttgtaaatgcagattctgatt

SEQ ID NO: 7627470 - DNA, 22 bp, Homo sapiens
cttgtaaatgcagattctgatt

SEQ ID NO: 7627471 - DNA, 22 bp, Homo sapiens
cttgtaaatgcagattctgatt

SEQ ID NO: 7627472 - DNA, 22 bp, Homo sapiens
cttgtaaaaggtacattatgct

SEQ ID NO: 7627473 - DNA, 22 bp, Homo sapiens
cttgtaaaaggtacattatgct

SEQ ID NO: 7627474 - DNA, 22 bp, Homo sapiens
cttgtaaaaggtacattatgct

SEQ ID NO: 7627475 - DNA, 22 bp, Homo sapiens
cttggtttacctaaacaatagg

SEQ ID NO: 7627476 - DNA, 19 bp, Homo sapiens
cttggttatggtatgatgc

SEQ ID NO: 7627477 - DNA, 19 bp, Homo sapiens
cttggttatggtatgatgc

SEQ ID NO: 7627478 - DNA, 22 bp, Homo sapiens
cttgtaaacttgagcagggcat

SEQ ID NO: 7627479 - DNA, 22 bp, Homo sapiens
cttgtaaaatatccagttaagg

SEQ ID NO: 7627480 - DNA, 16 bp, Homo sapiens
cttggtgttggcagag

SEQ ID NO: 7627481 - DNA, 16 bp, Homo sapiens
cttggtgttggcagag

SEQ ID NO: 7627482 - DNA, 22 bp, Homo sapiens
cttggttatactccaggaacca

SEQ ID NO: 7627483 - DNA, 20 bp, Homo sapiens
cttggtggctctgggaagtg

SEQ ID NO: 7627484 - DNA, 20 bp, Homo sapiens
cttggtggctctgggaagtg

SEQ ID NO: 7627485 - DNA, 22 bp, Homo sapiens
cttggtgcccagcaggtggctg

SEQ ID NO: 7627486 - DNA, 22 bp, Homo sapiens
cttggtgccacagcagcttgcg

SEQ ID NO: 7627487 - DNA, 22 bp, Homo sapiens
cttggtcttgggagcagggaca

SEQ ID NO: 7627488 - DNA, 22 bp, Homo sapiens
cttggtgagactcccacccacc

SEQ ID NO: 7627489 - DNA, 22 bp, Homo sapiens
cttggtgagactcccacccacc

SEQ ID NO: 7627490 - DNA, 22 bp, Homo sapiens
cttggtgcattactcaatctgt

SEQ ID NO: 7627491 - DNA, 22 bp, Homo sapiens
cttggtctactagagaaaaaga

SEQ ID NO: 7627492 - DNA, 22 bp, Homo sapiens
cttggtctagtgagtgagcata

SEQ ID NO: 7627493 - DNA, 22 bp, Homo sapiens
cttggcccagttgccaaggaaa

SEQ ID NO: 7627494 - DNA, 22 bp, Homo sapiens
cttggcccagttgccaaggaaa

SEQ ID NO: 7627495 - DNA, 22 bp, Homo sapiens
cttggcccagttgccaaggaaa

SEQ ID NO: 7627496 - DNA, 22 bp, Homo sapiens
cttggcccggagccccatgaag

SEQ ID NO: 7627497 - DNA, 21 bp, Homo sapiens
cttggcctctagctagagctg

SEQ ID NO: 7627498 - DNA, 22 bp, Homo sapiens
cttggcctcttctcagggtggg

SEQ ID NO: 7627499 - DNA, 22 bp, Homo sapiens
cttggccagacagggagctcca

SEQ ID NO: 7627500 - DNA, 22 bp, Homo sapiens
cttggccagacagggagctcca

SEQ ID NO: 7627501 - DNA, 22 bp, Homo sapiens
cttggccagacagggagctcca

SEQ ID NO: 7627502 - DNA, 22 bp, Homo sapiens
cttggccagacagggagctcca

SEQ ID NO: 7627503 - DNA, 22 bp, Homo sapiens
cttggcattgtgttgatagaag

SEQ ID NO: 7627504 - DNA, 22 bp, Homo sapiens
cttggcattttgctctgatatg

SEQ ID NO: 7627505 - DNA, 19 bp, Homo sapiens
cttggcatctgtgaagtga

SEQ ID NO: 7627506 - DNA, 22 bp, Homo sapiens
cttggcatgcagcaggcactca

SEQ ID NO: 7627507 - DNA, 19 bp, Homo sapiens
cttggcatctgtgaagtga

SEQ ID NO: 7627508 - DNA, 22 bp, Homo sapiens
cttggcatgcagcaggcactca

SEQ ID NO: 7627509 - DNA, 22 bp, Homo sapiens
cttggcatgcagcaggcactca

SEQ ID NO: 7627510 - DNA, 22 bp, Homo sapiens
cttgctggctggcaacctgggc

SEQ ID NO: 7627511 - DNA, 22 bp, Homo sapiens
cttgctggggtaagtctgtgct

SEQ ID NO: 7627512 - DNA, 22 bp, Homo sapiens
cttgctggggtaagtctgtgct

SEQ ID NO: 7627513 - DNA, 22 bp, Homo sapiens
cttgctggctggcaacctgggc

SEQ ID NO: 7627514 - DNA, 22 bp, Homo sapiens
cttggcagagggctgggctcag

SEQ ID NO: 7627515 - DNA, 22 bp, Homo sapiens
cttgctggctggcaacctgggc

SEQ ID NO: 7627516 - DNA, 22 bp, Homo sapiens
cttgctggcagtcactgttgcg

SEQ ID NO: 7627517 - DNA, 22 bp, Homo sapiens
cttgctggagcggagcgggtgt

SEQ ID NO: 7627518 - DNA, 22 bp, Homo sapiens
cttgctggcagtcactgttgcg

SEQ ID NO: 7627519 - DNA, 22 bp, Homo sapiens
cttgctggagcggagcgggtgt

SEQ ID NO: 7627520 - DNA, 22 bp, Homo sapiens
cttggcagctacacaggtaaga

SEQ ID NO: 7627521 - DNA, 22 bp, Homo sapiens
cttggcagctacacaggtaaga

SEQ ID NO: 7627522 - DNA, 22 bp, Homo sapiens
cttggcagcttttggaggagcc

SEQ ID NO: 7627523 - DNA, 22 bp, Homo sapiens
cttggcagggtggaggatgcag

SEQ ID NO: 7627524 - DNA, 22 bp, Homo sapiens
cttggcagcttttggaggagcc

SEQ ID NO: 7627525 - DNA, 22 bp, Homo sapiens
cttggcagtttcggaaggatga

SEQ ID NO: 7627526 - DNA, 22 bp, Homo sapiens
cttggctccaatcccagctctg

SEQ ID NO: 7627527 - DNA, 22 bp, Homo sapiens
cttggctccaatcccagctctg

SEQ ID NO: 7627528 - DNA, 22 bp, Homo sapiens
cttggctccaatcccagctctg

SEQ ID NO: 7627529 - DNA, 22 bp, Homo sapiens
cttggcctgtggctcaagaatt

SEQ ID NO: 7627530 - DNA, 22 bp, Homo sapiens
cttggcctgtggctcaagaatt

SEQ ID NO: 7627531 - DNA, 22 bp, Homo sapiens
cttggcctgggccgcagccact

SEQ ID NO: 7627532 - DNA, 22 bp, Homo sapiens
cttggctcgtacccggggcagg

SEQ ID NO: 7627533 - DNA, 22 bp, Homo sapiens
cttggctctgtgttgatgggac

SEQ ID NO: 7627534 - DNA, 22 bp, Homo sapiens
cttggctccaatcccagctctg

SEQ ID NO: 7627535 - DNA, 22 bp, Homo sapiens
cttggctccaatcccagctctg

SEQ ID NO: 7627536 - DNA, 22 bp, Homo sapiens
cttggctccaatcccagctctg

SEQ ID NO: 7627537 - DNA, 22 bp, Homo sapiens
cttggctccttcacagggagat

SEQ ID NO: 7627538 - DNA, 22 bp, Homo sapiens
cttggcctgacatgtggcaggg

SEQ ID NO: 7627539 - DNA, 22 bp, Homo sapiens
cttggcctgacatgtggcaggg

SEQ ID NO: 7627540 - DNA, 22 bp, Homo sapiens
cttggcctcttctcagggtggg

SEQ ID NO: 7627541 - DNA, 22 bp, Homo sapiens
cttggcctgcaggcagcagcgc

SEQ ID NO: 7627542 - DNA, 22 bp, Homo sapiens
cttggcctgcaggcagcagcgc

SEQ ID NO: 7627543 - DNA, 22 bp, Homo sapiens
cttggcctgcaggcagcagcgc

SEQ ID NO: 7627544 - DNA, 22 bp, Homo sapiens
cttggcctgggccgcagccact

SEQ ID NO: 7627545 - DNA, 22 bp, Homo sapiens
cttggcctgcccagccagaagg

SEQ ID NO: 7627546 - DNA, 22 bp, Homo sapiens
cttggcctgcccagccagaagg

SEQ ID NO: 7627547 - DNA, 22 bp, Homo sapiens
cttggtaaaactgtcttaaatt

SEQ ID NO: 7627548 - DNA, 22 bp, Homo sapiens
cttggctgaactccaggatgca

SEQ ID NO: 7627549 - DNA, 22 bp, Homo sapiens
cttggctgaactccaggatgca

SEQ ID NO: 7627550 - DNA, 22 bp, Homo sapiens
cttggctcgtacccggggcagg

SEQ ID NO: 7627551 - DNA, 22 bp, Homo sapiens
cttggctctgtgttgatgggac

SEQ ID NO: 7627552 - DNA, 22 bp, Homo sapiens
cttggctctgtgttgatgggac

SEQ ID NO: 7627553 - DNA, 22 bp, Homo sapiens
cttgggtgtgaccttggcattg

SEQ ID NO: 7627554 - DNA, 22 bp, Homo sapiens
cttgggtgtgaccttggcattg

SEQ ID NO: 7627555 - DNA, 22 bp, Homo sapiens
cttgggtgttttaaaactagat

SEQ ID NO: 7627556 - DNA, 22 bp, Homo sapiens
cttggtcatttcttgtcctgtt

SEQ ID NO: 7627557 - DNA, 22 bp, Homo sapiens
cttggtcatgcaagatatcgat

SEQ ID NO: 7627558 - DNA, 22 bp, Homo sapiens
cttggtcatttggggctgctat

SEQ ID NO: 7627559 - DNA, 22 bp, Homo sapiens
cttggtccgagggcgcctaggc

SEQ ID NO: 7627560 - DNA, 22 bp, Homo sapiens
cttggtcatgcaagatatcgat

SEQ ID NO: 7627561 - DNA, 22 bp, Homo sapiens
cttggtcacagttcccaacatt

SEQ ID NO: 7627562 - DNA, 22 bp, Homo sapiens
cttggtcatcgataattgaatc

SEQ ID NO: 7627563 - DNA, 22 bp, Homo sapiens
gaaagcaatttgtgtaatctgt

SEQ ID NO: 7627564 - DNA, 22 bp, Homo sapiens
gaaagcaatttgtgtaatctgt

SEQ ID NO: 7627565 - DNA, 22 bp, Homo sapiens
gaaagcaagttgactgcagaat

SEQ ID NO: 7627566 - DNA, 22 bp, Homo sapiens
gaaagcaagttgactgcagaat

SEQ ID NO: 7627567 - DNA, 21 bp, Homo sapiens
gaaagcacagaaaggactctt

SEQ ID NO: 7627568 - DNA, 21 bp, Homo sapiens
gaaagcacagaaaggactctt

SEQ ID NO: 7627569 - DNA, 22 bp, Homo sapiens
gaaagcaatttgtgtaatctgt

SEQ ID NO: 7627570 - DNA, 22 bp, Homo sapiens
gaaagcaatttgtgtaatctgt

SEQ ID NO: 7627571 - DNA, 22 bp, Homo sapiens
gaaagcaatttgtgtaatctgt

SEQ ID NO: 7627572 - DNA, 22 bp, Homo sapiens
gaaagcaatttgtgtaatctgt

SEQ ID NO: 7627573 - DNA, 22 bp, Homo sapiens
gaaagcaatttgtgtaatctgt

SEQ ID NO: 7627574 - DNA, 22 bp, Homo sapiens
gaaagcaagttgactgcagaat

SEQ ID NO: 7627575 - DNA, 19 bp, Homo sapiens
gaaagatttcagttgagga

SEQ ID NO: 7627576 - DNA, 22 bp, Homo sapiens
gaaagcaagttgactgcagaat

SEQ ID NO: 7627577 - DNA, 22 bp, Homo sapiens
gaaagcaagttgactgcagaat

SEQ ID NO: 7627578 - DNA, 22 bp, Homo sapiens
gaaagcaagttgactgcagaat

SEQ ID NO: 7627579 - DNA, 18 bp, Homo sapiens
gaaagatgaacttttttc

SEQ ID NO: 7627580 - DNA, 19 bp, Homo sapiens
gaaagatttcagttgagga

SEQ ID NO: 7627581 - DNA, 20 bp, Homo sapiens
gaaagattgtaagaggcaga

SEQ ID NO: 7627582 - DNA, 22 bp, Homo sapiens
gaaagcacgatagtagcaaaag

SEQ ID NO: 7627583 - DNA, 22 bp, Homo sapiens
gaaagcacgatagtagcaaaag

SEQ ID NO: 7627584 - DNA, 22 bp, Homo sapiens
gaaagcactaaaagagaatcct

SEQ ID NO: 7627585 - DNA, 22 bp, Homo sapiens
gaaagcacgatagtagcaaaag

SEQ ID NO: 7627586 - DNA, 22 bp, Homo sapiens
gaaagcacagttctgaccatgt

SEQ ID NO: 7627587 - DNA, 22 bp, Homo sapiens
gaaagcacccaagatttccttc

SEQ ID NO: 7627588 - DNA, 22 bp, Homo sapiens
gaaagcacatactataaatcac

SEQ ID NO: 7627589 - DNA, 22 bp, Homo sapiens
gaaagcacagttctgaccatgt

SEQ ID NO: 7627590 - DNA, 22 bp, Homo sapiens
gaaagcacagttctgaccatgt

SEQ ID NO: 7627591 - DNA, 22 bp, Homo sapiens
gaaagcacagttctgaccatgt

SEQ ID NO: 7627592 - DNA, 22 bp, Homo sapiens
gaaagcacagttctgaccatgt

SEQ ID NO: 7627593 - DNA, 22 bp, Homo sapiens
gaaagcacagttcatgagacaa

SEQ ID NO: 7627594 - DNA, 22 bp, Homo sapiens
gaaagcacagttcatgagacaa

SEQ ID NO: 7627595 - DNA, 22 bp, Homo sapiens
gaaagcacagttcatgagacaa

SEQ ID NO: 7627596 - DNA, 22 bp, Homo sapiens
gaaagcacagttcatgagacaa

SEQ ID NO: 7627597 - DNA, 21 bp, Homo sapiens
gaaagcacagaaaggactctt

SEQ ID NO: 7627598 - DNA, 21 bp, Homo sapiens
gaaagcacagaaaggactctt

SEQ ID NO: 7627599 - DNA, 22 bp, Homo sapiens
gaaagcacaggctcaggaacag

SEQ ID NO: 7627600 - DNA, 22 bp, Homo sapiens
gaaagcacaggctcaggaacag

SEQ ID NO: 7627601 - DNA, 22 bp, Homo sapiens
gaaagcacaggctcaggaacag

SEQ ID NO: 7627602 - DNA, 22 bp, Homo sapiens
atgaggcagctggctttctccc

SEQ ID NO: 7627603 - DNA, 22 bp, Homo sapiens
atgaggcaggaaaggcgtatct

SEQ ID NO: 7627604 - DNA, 22 bp, Homo sapiens
atgaggcagctggctttctccc

SEQ ID NO: 7627605 - DNA, 22 bp, Homo sapiens
atgaggcagctgctggagaacg

SEQ ID NO: 7627606 - DNA, 22 bp, Homo sapiens
atgaggcagctgctggagaacg

SEQ ID NO: 7627607 - DNA, 22 bp, Homo sapiens
atgaggcagctgacagctgttc

SEQ ID NO: 7627608 - DNA, 22 bp, Homo sapiens
atgaggcagctgctggagaacg

SEQ ID NO: 7627609 - DNA, 22 bp, Homo sapiens
atgaggcagctgctggagaacg

SEQ ID NO: 7627610 - DNA, 22 bp, Homo sapiens
atgaggcagctgctggagaacg

SEQ ID NO: 7627611 - DNA, 22 bp, Homo sapiens
atgaggcaggagtgcagtggca

SEQ ID NO: 7627612 - DNA, 22 bp, Homo sapiens
atgaggcaggagtgcagtggca

SEQ ID NO: 7627613 - DNA, 22 bp, Homo sapiens
atgaggcaggagtgcagtggca

SEQ ID NO: 7627614 - DNA, 22 bp, Homo sapiens
atgaggcaggaaaggcgtatct

SEQ ID NO: 7627615 - DNA, 22 bp, Homo sapiens
atgaggcaggagcggggaccct

SEQ ID NO: 7627616 - DNA, 22 bp, Homo sapiens
atgaggcaggagcggggaccct

SEQ ID NO: 7627617 - DNA, 22 bp, Homo sapiens
atgaggcaggagcggggaccct

SEQ ID NO: 7627618 - DNA, 22 bp, Homo sapiens
atgaggcaggagcggggaccct

SEQ ID NO: 7627619 - DNA, 22 bp, Homo sapiens
atgaggcagctggctttctccc

SEQ ID NO: 7627620 - DNA, 22 bp, Homo sapiens
atgaggcaggatattaactttt

SEQ ID NO: 7627621 - DNA, 22 bp, Homo sapiens
atgaggcaggattaagctatca

SEQ ID NO: 7627622 - DNA, 22 bp, Homo sapiens
atgaggcaggatattaactttt

SEQ ID NO: 7627623 - DNA, 22 bp, Homo sapiens
atgaggcaggatattaactttt

SEQ ID NO: 7627624 - DNA, 22 bp, Homo sapiens
atgaggcaggagtgcagtggca

SEQ ID NO: 7627625 - DNA, 22 bp, Homo sapiens
atgaggcaggtggaggctgcca

SEQ ID NO: 7627626 - DNA, 22 bp, Homo sapiens
atgaggcaggtggaggctgcca

SEQ ID NO: 7627627 - DNA, 22 bp, Homo sapiens
atgaggcaggattaagctatca

SEQ ID NO: 7627628 - DNA, 22 bp, Homo sapiens
atgaggcaggtggaggctgcca

SEQ ID NO: 7627629 - DNA, 22 bp, Homo sapiens
atgaggcaggtggaggctgcca

SEQ ID NO: 7627630 - DNA, 22 bp, Homo sapiens
atgaggcaggtggaggctgcca

SEQ ID NO: 7627631 - DNA, 22 bp, Homo sapiens
atgaggcagtacacacaaagcc

SEQ ID NO: 7627632 - DNA, 22 bp, Homo sapiens
atgaggcagtacacacaaagcc

SEQ ID NO: 7627633 - DNA, 22 bp, Homo sapiens
atgaggcagtacacacaaagcc

SEQ ID NO: 7627634 - DNA, 22 bp, Homo sapiens
atgaggcaggtggaggctgcca

SEQ ID NO: 7627635 - DNA, 18 bp, Homo sapiens
gaaagatgaacttttttc

SEQ ID NO: 7627636 - DNA, 22 bp, Homo sapiens
atgaggcagtctggcctgaggg

SEQ ID NO: 7627637 - DNA, 22 bp, Homo sapiens
atgaggcagtacacacaaagcc

SEQ ID NO: 7627638 - DNA, 22 bp, Homo sapiens
atgaagatacaggcagggccat

SEQ ID NO: 7627639 - DNA, 22 bp, Homo sapiens
atgaagatattcttgttttctg

SEQ ID NO: 7627640 - DNA, 22 bp, Homo sapiens
atgaagatattcttgttttctg

SEQ ID NO: 7627641 - DNA, 21 bp, Homo sapiens
atgaagatgacaatttgagag

SEQ ID NO: 7627642 - DNA, 22 bp, Homo sapiens
atgaagatggttcaactggcct

SEQ ID NO: 7627643 - DNA, 22 bp, Homo sapiens
atgaagatggttcaactggcct

SEQ ID NO: 7627644 - DNA, 22 bp, Homo sapiens
atgaagatgtgaaggctggatt

SEQ ID NO: 7627645 - DNA, 22 bp, Homo sapiens
atgaagatgtgaaggctggatt

SEQ ID NO: 7627646 - DNA, 22 bp, Homo sapiens
atgaagataagaccaggctgga

SEQ ID NO: 7627647 - DNA, 22 bp, Homo sapiens
atgaagataatagcattggttg

SEQ ID NO: 7627648 - DNA, 22 bp, Homo sapiens
atgaagataatagcattggttg

SEQ ID NO: 7627649 - DNA, 22 bp, Homo sapiens
atgaagactatttgaaggtgcc

SEQ ID NO: 7627650 - DNA, 22 bp, Homo sapiens
atgaagagtaagaggacctttt

SEQ ID NO: 7627651 - DNA, 22 bp, Homo sapiens
atgaagagttctgttttggaca

SEQ ID NO: 7627652 - DNA, 22 bp, Homo sapiens
atgaagataagaccaggctgga

SEQ ID NO: 7627653 - DNA, 22 bp, Homo sapiens
atgaagagttctgttttggaca

SEQ ID NO: 7627654 - DNA, 22 bp, Homo sapiens
atgaagattctatttatcactt

SEQ ID NO: 7627655 - DNA, 22 bp, Homo sapiens
atgaagattctatttatcactt

SEQ ID NO: 7627656 - DNA, 19 bp, Homo sapiens
atgaagattggtaaattca

SEQ ID NO: 7627657 - DNA, 19 bp, Homo sapiens
atgaagattggtaaattca

SEQ ID NO: 7627658 - DNA, 22 bp, Homo sapiens
atgaagatttataattgccttt

SEQ ID NO: 7627659 - DNA, 22 bp, Homo sapiens
atgaagcaacagccctcctatt

SEQ ID NO: 7627660 - DNA, 22 bp, Homo sapiens
atgaagatttcccagagacatg

SEQ ID NO: 7627661 - DNA, 22 bp, Homo sapiens
atgaagatttcccagagacatg

SEQ ID NO: 7627662 - DNA, 22 bp, Homo sapiens
atgaagatttcccagagacatg

SEQ ID NO: 7627663 - DNA, 22 bp, Homo sapiens
atgaagcagaatttcccactct

SEQ ID NO: 7627664 - DNA, 22 bp, Homo sapiens
atgaagcagaatttcccactct

SEQ ID NO: 7627665 - DNA, 22 bp, Homo sapiens
atgaagcagactcaggtggtgc

SEQ ID NO: 7627666 - DNA, 22 bp, Homo sapiens
atgaagcagaatttcccactct

SEQ ID NO: 7627667 - DNA, 21 bp, Homo sapiens
atgaagcaagggtcacacgtg

SEQ ID NO: 7627668 - DNA, 22 bp, Homo sapiens
atgaagcaattagaaacttgaa

SEQ ID NO: 7627669 - DNA, 22 bp, Homo sapiens
atgaagcaattagaaacttgaa

SEQ ID NO: 7627670 - DNA, 22 bp, Homo sapiens
atgaagcaacagccctcctatt

SEQ ID NO: 7627671 - DNA, 22 bp, Homo sapiens
atgaagcaacagccctcctatt

SEQ ID NO: 7627672 - DNA, 21 bp, Homo sapiens
atgaagcaagggtcacacgtg

SEQ ID NO: 7627673 - DNA, 22 bp, Homo sapiens
atgaggcagcccttcccttctc

SEQ ID NO: 7627674 - DNA, 22 bp, Homo sapiens
atgaggcagcccttcccttctc

SEQ ID NO: 7627675 - DNA, 22 bp, Homo sapiens
atgaggcagctgacagctgttc

SEQ ID NO: 7627676 - DNA, 22 bp, Homo sapiens
atgaggcagctgacagctgttc

SEQ ID NO: 7627677 - DNA, 22 bp, Homo sapiens
atgaggcagcacatgggattgt

SEQ ID NO: 7627678 - DNA, 22 bp, Homo sapiens
atgaggcagcacatgggattgt

SEQ ID NO: 7627679 - DNA, 22 bp, Homo sapiens
atgaggcagcccttcccttctc

SEQ ID NO: 7627680 - DNA, 22 bp, Homo sapiens
atgaggcagcacatgggattgt

SEQ ID NO: 7627681 - DNA, 22 bp, Homo sapiens
atgaggcagatgttgcatgagg

SEQ ID NO: 7627682 - DNA, 22 bp, Homo sapiens
atgaggcagagggctgtgccag

SEQ ID NO: 7627683 - DNA, 22 bp, Homo sapiens
atgaggcagagggctgtgccag

SEQ ID NO: 7627684 - DNA, 22 bp, Homo sapiens
atgaggcagagggctgtgccag

SEQ ID NO: 7627685 - DNA, 22 bp, Homo sapiens
atgaggaacagacttgctggat

SEQ ID NO: 7627686 - DNA, 19 bp, Homo sapiens
atgaggaactgaggctcag

SEQ ID NO: 7627687 - DNA, 22 bp, Homo sapiens
atgaggcagatgttgcatgagg

SEQ ID NO: 7627688 - DNA, 22 bp, Homo sapiens
atgaggcagatgttgcatgagg

SEQ ID NO: 7627689 - DNA, 22 bp, Homo sapiens
atgaggcagatgttgcatgagg

SEQ ID NO: 7627690 - DNA, 22 bp, Homo sapiens
atgaagcagcctcttccctctg

SEQ ID NO: 7627691 - DNA, 22 bp, Homo sapiens
atgaagcagatttattactcac

SEQ ID NO: 7627692 - DNA, 22 bp, Homo sapiens
atgaagcagatttattactcac

SEQ ID NO: 7627693 - DNA, 22 bp, Homo sapiens
atgaagcagcctcttccctctg

SEQ ID NO: 7627694 - DNA, 22 bp, Homo sapiens
atgaagcagcgttgtagagtga

SEQ ID NO: 7627695 - DNA, 22 bp, Homo sapiens
atgaagcagcctcttccctctg

SEQ ID NO: 7627696 - DNA, 22 bp, Homo sapiens
atgaagcagcctcttccctctg

SEQ ID NO: 7627697 - DNA, 22 bp, Homo sapiens
atgaagcagatttattactcac

SEQ ID NO: 7627698 - DNA, 22 bp, Homo sapiens
atgaagcagatttattactcac

SEQ ID NO: 7627699 - DNA, 22 bp, Homo sapiens
atgaagcagatttattactcac

SEQ ID NO: 7627700 - DNA, 22 bp, Homo sapiens
atgaagcagatttattactcac

SEQ ID NO: 7627701 - DNA, 22 bp, Homo sapiens
atgaagcagaatttcccactct

SEQ ID NO: 7627702 - DNA, 22 bp, Homo sapiens
atgaagcagaatttcccactct

SEQ ID NO: 7627703 - DNA, 22 bp, Homo sapiens
atgaagcagactcaggtggtgc

SEQ ID NO: 7627704 - DNA, 22 bp, Homo sapiens
atgaagcagactcaggtggtgc

SEQ ID NO: 7627705 - DNA, 19 bp, Homo sapiens
atgaggaactgaggctcag

SEQ ID NO: 7627706 - DNA, 22 bp, Homo sapiens
atgaggaacagacttgctggat

SEQ ID NO: 7627707 - DNA, 19 bp, Homo sapiens
atgaggaactgaggctcag

SEQ ID NO: 7627708 - DNA, 22 bp, Homo sapiens
atgagcttggtccagcaggctt

SEQ ID NO: 7627709 - DNA, 22 bp, Homo sapiens
atgagcttccagacaaaggcat

SEQ ID NO: 7627710 - DNA, 22 bp, Homo sapiens
atgagcttcccagacaggatgg

SEQ ID NO: 7627711 - DNA, 22 bp, Homo sapiens
atgaagcagcgttgtagagtga

SEQ ID NO: 7627712 - DNA, 22 bp, Homo sapiens
atgaagcagcgttgtagagtga

SEQ ID NO: 7627713 - DNA, 22 bp, Homo sapiens
atgaagcagcgttgtagagtga

SEQ ID NO: 7627714 - DNA, 22 bp, Homo sapiens
atgaagcagcgttgtagagtga

SEQ ID NO: 7627715 - DNA, 22 bp, Homo sapiens
atgaggccagaccactctgcat

SEQ ID NO: 7627716 - DNA, 23 bp, Homo sapiens
atgaggtaaagatcagctttaaa

SEQ ID NO: 7627717 - DNA, 22 bp, Homo sapiens
atgaggccaccttctacatttc

SEQ ID NO: 7627718 - DNA, 22 bp, Homo sapiens
atgaggccaccttctacatttc

SEQ ID NO: 7627719 - DNA, 22 bp, Homo sapiens
atgaggccacagttatagattt

SEQ ID NO: 7627720 - DNA, 15 bp, Homo sapiens
atgaggcatttgggg

SEQ ID NO: 7627721 - DNA, 22 bp, Homo sapiens
atgaggccacagttatagattt

SEQ ID NO: 7627722 - DNA, 22 bp, Homo sapiens
gaaagcagtaaatgggtcccat

SEQ ID NO: 7627723 - DNA, 22 bp, Homo sapiens
gaaagcagtaaatgggtcccat

SEQ ID NO: 7627724 - DNA, 22 bp, Homo sapiens
gaaagcagtaaatgggtcccat

SEQ ID NO: 7627725 - DNA, 22 bp, Homo sapiens
gaaagcagtaaatgggtcccat

SEQ ID NO: 7627726 - DNA, 22 bp, Homo sapiens
gaaagcagctaagtcttatgat

SEQ ID NO: 7627727 - DNA, 22 bp, Homo sapiens
gaaagcagctaagtcttatgat

SEQ ID NO: 7627728 - DNA, 22 bp, Homo sapiens
gaaagcagctaagtcttatgat

SEQ ID NO: 7627729 - DNA, 22 bp, Homo sapiens
gaaagcagctaagtcttatgat

SEQ ID NO: 7627730 - DNA, 22 bp, Homo sapiens
gaaagcagctaagtcttatgat

SEQ ID NO: 7627731 - DNA, 22 bp, Homo sapiens
gaaagcagatgaaattgcaaca

SEQ ID NO: 7627732 - DNA, 22 bp, Homo sapiens
gaaagcagatgaaattgcaaca

SEQ ID NO: 7627733 - DNA, 22 bp, Homo sapiens
gaaagcagatgaaattgcaaca

SEQ ID NO: 7627734 - DNA, 22 bp, Homo sapiens
gaaagcactgtgagatcttgtt

SEQ ID NO: 7627735 - DNA, 22 bp, Homo sapiens
atgaggtactagtatatacgta

SEQ ID NO: 7627736 - DNA, 22 bp, Homo sapiens
atgaggtactagtatatacgta

SEQ ID NO: 7627737 - DNA, 22 bp, Homo sapiens
atgaggtaacagcttatcaaca

SEQ ID NO: 7627738 - DNA, 22 bp, Homo sapiens
atgaggtaacagcttatcaaca

SEQ ID NO: 7627739 - DNA, 22 bp, Homo sapiens
atgaggtaagcactgggcccaa

SEQ ID NO: 7627740 - DNA, 22 bp, Homo sapiens
atgaggtaatactttcagtcct

SEQ ID NO: 7627741 - DNA, 19 bp, Homo sapiens
atgaggtagcagctggtgc

SEQ ID NO: 7627742 - DNA, 19 bp, Homo sapiens
atgaggtagcagctggtgc

SEQ ID NO: 7627743 - DNA, 22 bp, Homo sapiens
atgaggtagtattagaaggaga

SEQ ID NO: 7627744 - DNA, 22 bp, Homo sapiens
atgaggtatctcatttcctgaa

SEQ ID NO: 7627745 - DNA, 22 bp, Homo sapiens
atgaggtattcgtaatatttcc

SEQ ID NO: 7627746 - DNA, 22 bp, Homo sapiens
atgaggtcacagtgtttggcat

SEQ ID NO: 7627747 - DNA, 22 bp, Homo sapiens
atgaggtattcgtaatatttcc

SEQ ID NO: 7627748 - DNA, 23 bp, Homo sapiens
atgaggtcagccataagacggaa

SEQ ID NO: 7627749 - DNA, 22 bp, Homo sapiens
atgaggtcatcctggagtaagg

SEQ ID NO: 7627750 - DNA, 22 bp, Homo sapiens
atgaggtcatcttgaagtaggg

SEQ ID NO: 7627751 - DNA, 17 bp, Homo sapiens
atgaggtcattaagata

SEQ ID NO: 7627752 - DNA, 22 bp, Homo sapiens
atgaggtcattcttggattaca

SEQ ID NO: 7627753 - DNA, 22 bp, Homo sapiens
atgaggtccagggaagttaaat

SEQ ID NO: 7627754 - DNA, 22 bp, Homo sapiens
atgaggtctggcaatcagaaac

SEQ ID NO: 7627755 - DNA, 22 bp, Homo sapiens
atgaggtcttattgcagtagtt

SEQ ID NO: 7627756 - DNA, 22 bp, Homo sapiens
atgaggtcttattgcagtagtt

SEQ ID NO: 7627757 - DNA, 22 bp, Homo sapiens
atgaggtgatggacatattaac

SEQ ID NO: 7627758 - DNA, 22 bp, Homo sapiens
atgaggtgatggacatattaac

SEQ ID NO: 7627759 - DNA, 22 bp, Homo sapiens
atgaggtgatggacatattaac

SEQ ID NO: 7627760 - DNA, 22 bp, Homo sapiens
atgaggtgggagaatcacttga

SEQ ID NO: 7627761 - DNA, 22 bp, Homo sapiens
atgagtaagaccataatttttg

SEQ ID NO: 7627762 - DNA, 22 bp, Homo sapiens
atgagtaaaaccactatttaca

SEQ ID NO: 7627763 - DNA, 22 bp, Homo sapiens
atgagtaaaaccactatttaca

SEQ ID NO: 7627764 - DNA, 22 bp, Homo sapiens
atgaggttttgattggcacagg

SEQ ID NO: 7627765 - DNA, 22 bp, Homo sapiens
atgagtcactcagcagaaaagg

SEQ ID NO: 7627766 - DNA, 20 bp, Homo sapiens
atgagtctacacactggctt

SEQ ID NO: 7627767 - DNA, 22 bp, Homo sapiens
atgagtaagtgaatctccaaag

SEQ ID NO: 7627768 - DNA, 22 bp, Homo sapiens
atgaggttcagtgtttatttcc

SEQ ID NO: 7627769 - DNA, 22 bp, Homo sapiens
atgaggtttaggttcctcctct

SEQ ID NO: 7627770 - DNA, 22 bp, Homo sapiens
atgaggttttactgccattttc

SEQ ID NO: 7627771 - DNA, 22 bp, Homo sapiens
atgaggtttgagcctcttgacc

SEQ ID NO: 7627772 - DNA, 22 bp, Homo sapiens
atgaggttttaagagcactagc

SEQ ID NO: 7627773 - DNA, 22 bp, Homo sapiens
atgaggtggtcttcagtaggtc

SEQ ID NO: 7627774 - DNA, 22 bp, Homo sapiens
atgaggtggtcttcagtaggtc

SEQ ID NO: 7627775 - DNA, 22 bp, Homo sapiens
atgaggtggtcttcagtaggtc

SEQ ID NO: 7627776 - DNA, 22 bp, Homo sapiens
atgaggttatatttaattcact

SEQ ID NO: 7627777 - DNA, 22 bp, Homo sapiens
atgaggtggtcttcagtaggtc

SEQ ID NO: 7627778 - DNA, 22 bp, Homo sapiens
atgaggtgttcgctggcctttt

SEQ ID NO: 7627779 - DNA, 22 bp, Homo sapiens
atgattcagcccaatttttcta

SEQ ID NO: 7627780 - DNA, 22 bp, Homo sapiens
atgattcagcccaatttttcta

SEQ ID NO: 7627781 - DNA, 22 bp, Homo sapiens
atgattcagcaattttatatct

SEQ ID NO: 7627782 - DNA, 22 bp, Homo sapiens
atgattcaagaaaataggatgg

SEQ ID NO: 7627783 - DNA, 22 bp, Homo sapiens
atgattcagcaattttatatct

SEQ ID NO: 7627784 - DNA, 20 bp, Homo sapiens
atgattttgcactaacttca

SEQ ID NO: 7627785 - DNA, 20 bp, Homo sapiens
atgattttgcactaacttca

SEQ ID NO: 7627786 - DNA, 20 bp, Homo sapiens
atgattttgcactaacttca

SEQ ID NO: 7627787 - DNA, 22 bp, Homo sapiens
atgatacacctaggagtgggag

SEQ ID NO: 7627788 - DNA, 22 bp, Homo sapiens
atgatttttcagcagaggatct

SEQ ID NO: 7627789 - DNA, 22 bp, Homo sapiens
atgatttttcagcagaggatct

SEQ ID NO: 7627790 - DNA, 22 bp, Homo sapiens
atgattttttctaacacagtcg

SEQ ID NO: 7627791 - DNA, 22 bp, Homo sapiens
atgattttttctaacacagtcg

SEQ ID NO: 7627792 - DNA, 22 bp, Homo sapiens
atgattttttctaacacagtcg

SEQ ID NO: 7627793 - DNA, 20 bp, Homo sapiens
atgattttgcactaacttca

SEQ ID NO: 7627794 - DNA, 22 bp, Homo sapiens
atgatttttcagcagaggatct

SEQ ID NO: 7627795 - DNA, 22 bp, Homo sapiens
atgcaaaagtaactgtgatttt

SEQ ID NO: 7627796 - DNA, 22 bp, Homo sapiens
atgcaaaagtaactgtgatttt

SEQ ID NO: 7627797 - DNA, 22 bp, Homo sapiens
atgcaaaagtaattgcaatttt

SEQ ID NO: 7627798 - DNA, 22 bp, Homo sapiens
atgcaaaagtaattgcaatttt

SEQ ID NO: 7627799 - DNA, 22 bp, Homo sapiens
atgcaaaagtaattgcaatttt

SEQ ID NO: 7627800 - DNA, 22 bp, Homo sapiens
atgcaaaagtaattgcaatttt

SEQ ID NO: 7627801 - DNA, 22 bp, Homo sapiens
atgcaaaagtaactgtgatttt

SEQ ID NO: 7627802 - DNA, 22 bp, Homo sapiens
atgcaaaagtaactgtgatttt

SEQ ID NO: 7627803 - DNA, 22 bp, Homo sapiens
atgcaaaagtaactgtgatttt

SEQ ID NO: 7627804 - DNA, 22 bp, Homo sapiens
atgcaaaagtaactgtgatttt

SEQ ID NO: 7627805 - DNA, 22 bp, Homo sapiens
atgcaaaagtaactgtgatttt

SEQ ID NO: 7627806 - DNA, 22 bp, Homo sapiens
atgcaaaaactgcacttacgct

SEQ ID NO: 7627807 - DNA, 22 bp, Homo sapiens
atgcaaaaactgcacttacgct

SEQ ID NO: 7627808 - DNA, 22 bp, Homo sapiens
atgcaaaaactgcacttacgct

SEQ ID NO: 7627809 - DNA, 22 bp, Homo sapiens
atgattttttctaacacagtcg

SEQ ID NO: 7627810 - DNA, 22 bp, Homo sapiens
atgcaaaagactatttgttgct

SEQ ID NO: 7627811 - DNA, 22 bp, Homo sapiens
atgcaaaagactatttgttgct

SEQ ID NO: 7627812 - DNA, 22 bp, Homo sapiens
atgcaaaagactatttgttgct

SEQ ID NO: 7627813 - DNA, 22 bp, Homo sapiens
atgcaaaagactatttgttgct

SEQ ID NO: 7627814 - DNA, 22 bp, Homo sapiens
atgcaaaaactgcacttacgct

SEQ ID NO: 7627815 - DNA, 22 bp, Homo sapiens
atgcaaaaactgcacttacgct

SEQ ID NO: 7627816 - DNA, 22 bp, Homo sapiens
atgatacaagcaaaactaatca

SEQ ID NO: 7627817 - DNA, 22 bp, Homo sapiens
atgatacaagcaaaactaatca

SEQ ID NO: 7627818 - DNA, 22 bp, Homo sapiens
atgatacaagcaaaactaatca

SEQ ID NO: 7627819 - DNA, 22 bp, Homo sapiens
atgatacaagcaaaactaatca

SEQ ID NO: 7627820 - DNA, 22 bp, Homo sapiens
atgatacaagcaaaactaatca

SEQ ID NO: 7627821 - DNA, 22 bp, Homo sapiens
atgatacacctaggagtgggag

SEQ ID NO: 7627822 - DNA, 22 bp, Homo sapiens
atgatacaagcaaaactaatca

SEQ ID NO: 7627823 - DNA, 22 bp, Homo sapiens
atgatacaagcaaaactaatca

SEQ ID NO: 7627824 - DNA, 22 bp, Homo sapiens
atgattcaagaaaataggatgg

SEQ ID NO: 7627825 - DNA, 22 bp, Homo sapiens
atgattcaagaaaataggatgg

SEQ ID NO: 7627826 - DNA, 19 bp, Homo sapiens
atgatacaggtgaaaattg

SEQ ID NO: 7627827 - DNA, 20 bp, Homo sapiens
atgagtttaaacattcagag

SEQ ID NO: 7627828 - DNA, 20 bp, Homo sapiens
atgagtttaaacattcagag

SEQ ID NO: 7627829 - DNA, 20 bp, Homo sapiens
atgagtttaaacattcagag

SEQ ID NO: 7627830 - DNA, 22 bp, Homo sapiens
atgataagccatgtcgtggtca

SEQ ID NO: 7627831 - DNA, 23 bp, Homo sapiens
atgataatgccattaactttgat

SEQ ID NO: 7627832 - DNA, 23 bp, Homo sapiens
atgataatgccattaactttgat

SEQ ID NO: 7627833 - DNA, 22 bp, Homo sapiens
atgataagaacacagtatgggg

SEQ ID NO: 7627834 - DNA, 22 bp, Homo sapiens
atgagttttgggggatgttaga

SEQ ID NO: 7627835 - DNA, 22 bp, Homo sapiens
atgagttgaagctacaagaggc

SEQ ID NO: 7627836 - DNA, 22 bp, Homo sapiens
atgagttcattgcatttgacag

SEQ ID NO: 7627837 - DNA, 22 bp, Homo sapiens
atgagttcccaggtgatttgtg

SEQ ID NO: 7627838 - DNA, 22 bp, Homo sapiens
atgagttaggggcctgagtgga

SEQ ID NO: 7627839 - DNA, 22 bp, Homo sapiens
atgagtgttgctcattgcagaa

SEQ ID NO: 7627840 - DNA, 22 bp, Homo sapiens
atgagtgtttagaaaacactgg

SEQ ID NO: 7627841 - DNA, 22 bp, Homo sapiens
atgagtgtgaagttagctcagt

SEQ ID NO: 7627842 - DNA, 22 bp, Homo sapiens
atgagtgtgaagttagctcagt

SEQ ID NO: 7627843 - DNA, 22 bp, Homo sapiens
atgagtgatgggtacattggct

SEQ ID NO: 7627844 - DNA, 22 bp, Homo sapiens
atgagtgatgggtacattggct

SEQ ID NO: 7627845 - DNA, 22 bp, Homo sapiens
atgagtgatacagcaagctctc

SEQ ID NO: 7627846 - DNA, 22 bp, Homo sapiens
atgagtgatacagcaagctctc

SEQ ID NO: 7627847 - DNA, 22 bp, Homo sapiens
atgcagctgagggtagtggagc

SEQ ID NO: 7627848 - DNA, 22 bp, Homo sapiens
atgcagctgctcttcctctatt

SEQ ID NO: 7627849 - DNA, 22 bp, Homo sapiens
atgcagctgctcttcctctatt

SEQ ID NO: 7627850 - DNA, 22 bp, Homo sapiens
atgcagctgagggtagtggagc

SEQ ID NO: 7627851 - DNA, 22 bp, Homo sapiens
atgcagctgagggtagtggagc

SEQ ID NO: 7627852 - DNA, 22 bp, Homo sapiens
atgcagctgacattttcatgtt

SEQ ID NO: 7627853 - DNA, 22 bp, Homo sapiens
atgcagctgacattttcatgtt

SEQ ID NO: 7627854 - DNA, 22 bp, Homo sapiens
atgcagctgacattttcatgtt

SEQ ID NO: 7627855 - DNA, 22 bp, Homo sapiens
atgcagctgacattttcatgtt

SEQ ID NO: 7627856 - DNA, 22 bp, Homo sapiens
atgcagctatttgagcatgtca

SEQ ID NO: 7627857 - DNA, 22 bp, Homo sapiens
atgcagctatttgagcatgtca

SEQ ID NO: 7627858 - DNA, 22 bp, Homo sapiens
atgcagctatttgagcatgtca

SEQ ID NO: 7627859 - DNA, 22 bp, Homo sapiens
atgcagctatttgagcatgtca

SEQ ID NO: 7627860 - DNA, 22 bp, Homo sapiens
atgcagctcatttgtttaaaag

SEQ ID NO: 7627861 - DNA, 22 bp, Homo sapiens
atgcagctcatttgtttaaaag

SEQ ID NO: 7627862 - DNA, 19 bp, Homo sapiens
atgcagctcctgcctcctt

SEQ ID NO: 7627863 - DNA, 19 bp, Homo sapiens
atgcagctcctgcctcctt

SEQ ID NO: 7627864 - DNA, 19 bp, Homo sapiens
atgcagctcctgcctcctt

SEQ ID NO: 7627865 - DNA, 22 bp, Homo sapiens
atgcagccccctggtgcccggg

SEQ ID NO: 7627866 - DNA, 22 bp, Homo sapiens
atgcagctagattttccagtgt

SEQ ID NO: 7627867 - DNA, 22 bp, Homo sapiens
atgcagctagattttccagtgt

SEQ ID NO: 7627868 - DNA, 22 bp, Homo sapiens
atgcagctagattttccagtgt

SEQ ID NO: 7627869 - DNA, 22 bp, Homo sapiens
atgcagcagtttacaaagcaat

SEQ ID NO: 7627870 - DNA, 22 bp, Homo sapiens
atgcagcagtttacaaagcaat

SEQ ID NO: 7627871 - DNA, 20 bp, Homo sapiens
atgcagcattgttgtggcaa

SEQ ID NO: 7627872 - DNA, 22 bp, Homo sapiens
atgcagcagtttacaaagcaat

SEQ ID NO: 7627873 - DNA, 22 bp, Homo sapiens
atgcagcagctacttgggaagg

SEQ ID NO: 7627874 - DNA, 22 bp, Homo sapiens
atgcagcagtttacaaagcaat

SEQ ID NO: 7627875 - DNA, 22 bp, Homo sapiens
atgcagcagctacttgggaagg

SEQ ID NO: 7627876 - DNA, 22 bp, Homo sapiens
atgcagcagctacttgggaagg

SEQ ID NO: 7627877 - DNA, 20 bp, Homo sapiens
atgcagctggagttggggtg

SEQ ID NO: 7627878 - DNA, 20 bp, Homo sapiens
atgcagctggagttggggtg

SEQ ID NO: 7627879 - DNA, 20 bp, Homo sapiens
atgcagctggagttggggtg

SEQ ID NO: 7627880 - DNA, 22 bp, Homo sapiens
atgcagctgtcagggagaacat

SEQ ID NO: 7627881 - DNA, 22 bp, Homo sapiens
atgcagctgtcagggagaacat

SEQ ID NO: 7627882 - DNA, 22 bp, Homo sapiens
atgcagctgtcagggagaacat

SEQ ID NO: 7627883 - DNA, 22 bp, Homo sapiens
atgcagctgctcttcctctatt

SEQ ID NO: 7627884 - DNA, 22 bp, Homo sapiens
atgcagctgctgacagctttca

SEQ ID NO: 7627885 - DNA, 22 bp, Homo sapiens
atgcagctgctgacagctttca

SEQ ID NO: 7627886 - DNA, 22 bp, Homo sapiens
atgcagctgctgacagctttca

SEQ ID NO: 7627887 - DNA, 22 bp, Homo sapiens
atgcagcttcaggattatgatg

SEQ ID NO: 7627888 - DNA, 22 bp, Homo sapiens
atgcagcttcaggattatgatg

SEQ ID NO: 7627889 - DNA, 22 bp, Homo sapiens
atgcagcttcaggattatgatg

SEQ ID NO: 7627890 - DNA, 22 bp, Homo sapiens
atgcagcttcaggattatgatg

SEQ ID NO: 7627891 - DNA, 22 bp, Homo sapiens
atgcagctgtgggcaagaaatg

SEQ ID NO: 7627892 - DNA, 22 bp, Homo sapiens
atgcagctgtgggcaagaaatg

SEQ ID NO: 7627893 - DNA, 23 bp, Homo sapiens
atgcaggacttataaggtaaggt

SEQ ID NO: 7627894 - DNA, 22 bp, Homo sapiens
atgcaggaagtcggggagcggg

SEQ ID NO: 7627895 - DNA, 23 bp, Homo sapiens
atgcaggacttataaggtaaggt

SEQ ID NO: 7627896 - DNA, 22 bp, Homo sapiens
atgcaggacataagcatcgaca

SEQ ID NO: 7627897 - DNA, 22 bp, Homo sapiens
atgcatatgcatggacactcag

SEQ ID NO: 7627898 - DNA, 22 bp, Homo sapiens
atgcatatgcatggacactcag

SEQ ID NO: 7627899 - DNA, 22 bp, Homo sapiens
atgcaggaagagccctggagct

SEQ ID NO: 7627900 - DNA, 22 bp, Homo sapiens
atgcaggaagagccctggagct

SEQ ID NO: 7627901 - DNA, 22 bp, Homo sapiens
atgcaggaagagccctggagct

SEQ ID NO: 7627902 - DNA, 22 bp, Homo sapiens
atgcagcttccatattttgctg

SEQ ID NO: 7627903 - DNA, 22 bp, Homo sapiens
atgcagcttccatattttgctg

SEQ ID NO: 7627904 - DNA, 22 bp, Homo sapiens
atgcaggaagtcggggagcggg

SEQ ID NO: 7627905 - DNA, 22 bp, Homo sapiens
atgcaggaagtcggggagcggg

SEQ ID NO: 7627906 - DNA, 22 bp, Homo sapiens
atgcaggacataagcatcgaca

SEQ ID NO: 7627907 - DNA, 22 bp, Homo sapiens
atgcaggacataagcatcgaca

SEQ ID NO: 7627908 - DNA, 22 bp, Homo sapiens
atgcatgcttcttatagtactt

SEQ ID NO: 7627909 - DNA, 22 bp, Homo sapiens
atgcatgcttcttatagtactt

SEQ ID NO: 7627910 - DNA, 22 bp, Homo sapiens
atgcatgcattgtttatcatgg

SEQ ID NO: 7627911 - DNA, 22 bp, Homo sapiens
atgcatgcatgtaccccacctt

SEQ ID NO: 7627912 - DNA, 22 bp, Homo sapiens
atgcatgcatccacaagttaaa

SEQ ID NO: 7627913 - DNA, 22 bp, Homo sapiens
atgcatgcatgagtgtgtacct

SEQ ID NO: 7627914 - DNA, 20 bp, Homo sapiens
atgcatgcatgcacatgcac

SEQ ID NO: 7627915 - DNA, 22 bp, Homo sapiens
atgcatgcatgagtgtgtacct

SEQ ID NO: 7627916 - DNA, 22 bp, Homo sapiens
atgcatgcacacactgcattgc

SEQ ID NO: 7627917 - DNA, 22 bp, Homo sapiens
atgcatgcagggaagacagtag

SEQ ID NO: 7627918 - DNA, 20 bp, Homo sapiens
atgcatgcatgcacatgcac

SEQ ID NO: 7627919 - DNA, 22 bp, Homo sapiens
atgcatgcatgagtgtgtacct

SEQ ID NO: 7627920 - DNA, 22 bp, Homo sapiens
atgcatgcacacactgcattgc

SEQ ID NO: 7627921 - DNA, 22 bp, Homo sapiens
atgcatgaaagaatccaagcct

SEQ ID NO: 7627922 - DNA, 22 bp, Homo sapiens
atgcatgagctttgtgatcctg

SEQ ID NO: 7627923 - DNA, 22 bp, Homo sapiens
atgcatgagaatatcccatgct

SEQ ID NO: 7627924 - DNA, 22 bp, Homo sapiens
atgcatcttatcaaaaattata

SEQ ID NO: 7627925 - DNA, 22 bp, Homo sapiens
atgcatgatgaacttgctttca

SEQ ID NO: 7627926 - DNA, 22 bp, Homo sapiens
atgcatgatcctgagcaaccca

SEQ ID NO: 7627927 - DNA, 22 bp, Homo sapiens
atgcatgcaagtgcacatatgc

SEQ ID NO: 7627928 - DNA, 22 bp, Homo sapiens
atgcatgcaagtgcacatatgc

SEQ ID NO: 7627929 - DNA, 22 bp, Homo sapiens
atgcatgagtcactcagtgcag

SEQ ID NO: 7627930 - DNA, 22 bp, Homo sapiens
atgcatgagctttgtgatcctg

SEQ ID NO: 7627931 - DNA, 22 bp, Homo sapiens
atgcatgatcctgagcaaccca

SEQ ID NO: 7627932 - DNA, 22 bp, Homo sapiens
atgcatatgccgtagaataagt

SEQ ID NO: 7627933 - DNA, 22 bp, Homo sapiens
atgcatatgccgtagaataagt

SEQ ID NO: 7627934 - DNA, 22 bp, Homo sapiens
atgcatatgcatggacactcag

SEQ ID NO: 7627935 - DNA, 22 bp, Homo sapiens
atgcatatgccgtagaataagt

SEQ ID NO: 7627936 - DNA, 22 bp, Homo sapiens
atgcatatgccgtagaataagt

SEQ ID NO: 7627937 - DNA, 22 bp, Homo sapiens
atgcatatgccgtagaataagt

SEQ ID NO: 7627938 - DNA, 22 bp, Homo sapiens
atgcatcatggaaaactcagtt

SEQ ID NO: 7627939 - DNA, 22 bp, Homo sapiens
atgcatcatggaaaactcagtt

SEQ ID NO: 7627940 - DNA, 22 bp, Homo sapiens
atgcatctatgacttagacatt

SEQ ID NO: 7627941 - DNA, 22 bp, Homo sapiens
atgcatcttatcaaaaattata

SEQ ID NO: 7627942 - DNA, 22 bp, Homo sapiens
atgcattctggaaagtagcaat

SEQ ID NO: 7627943 - DNA, 22 bp, Homo sapiens
atgcattctgtagagcatttat

SEQ ID NO: 7627944 - DNA, 22 bp, Homo sapiens
atgcattgaggatgacatgagt

SEQ ID NO: 7627945 - DNA, 22 bp, Homo sapiens
atgcattgctgctttcaaaaca

SEQ ID NO: 7627946 - DNA, 22 bp, Homo sapiens
atgcattgctcaacagaataca

SEQ ID NO: 7627947 - DNA, 22 bp, Homo sapiens
atgcattgaggatgacatgagt

SEQ ID NO: 7627948 - DNA, 22 bp, Homo sapiens
atgcattgcttgagggtaggaa

SEQ ID NO: 7627949 - DNA, 22 bp, Homo sapiens
atgcattgtaacgatgtgcaca

SEQ ID NO: 7627950 - DNA, 22 bp, Homo sapiens
atgcattggtcagggtcttagg

SEQ ID NO: 7627951 - DNA, 22 bp, Homo sapiens
atgcattggataagaaccccat

SEQ ID NO: 7627952 - DNA, 22 bp, Homo sapiens
atgcattgtaacgatgtgcaca

SEQ ID NO: 7627953 - DNA, 22 bp, Homo sapiens
atgcattgtcaggcaatttcat

SEQ ID NO: 7627954 - DNA, 22 bp, Homo sapiens
atgcattgtatgaaaggaaata

SEQ ID NO: 7627955 - DNA, 22 bp, Homo sapiens
atgcattgtctggtttcatttt

SEQ ID NO: 7627956 - DNA, 22 bp, Homo sapiens
atgcatttgacgggatatattt

SEQ ID NO: 7627957 - DNA, 22 bp, Homo sapiens
atgcatttgacgggatatattt

SEQ ID NO: 7627958 - DNA, 22 bp, Homo sapiens
atgcatttgacgggatatattt

SEQ ID NO: 7627959 - DNA, 22 bp, Homo sapiens
atgcatttatgtgtgtacattg

SEQ ID NO: 7627960 - DNA, 22 bp, Homo sapiens
atgcatttgacgggatatattt

SEQ ID NO: 7627961 - DNA, 22 bp, Homo sapiens
gacactgaagtcactaagcagg

SEQ ID NO: 7627962 - DNA, 22 bp, Homo sapiens
gacactctttcctcttctggaa

SEQ ID NO: 7627963 - DNA, 22 bp, Homo sapiens
gacactctttcctcttctggaa

SEQ ID NO: 7627964 - DNA, 22 bp, Homo sapiens
gacactctttcctcttctggaa

SEQ ID NO: 7627965 - DNA, 22 bp, Homo sapiens
gacactgaccccaagctgtcct

SEQ ID NO: 7627966 - DNA, 22 bp, Homo sapiens
gacactgaccccaagctgtcct

SEQ ID NO: 7627967 - DNA, 22 bp, Homo sapiens
atgcatttatgtgtgtacattg

SEQ ID NO: 7627968 - DNA, 22 bp, Homo sapiens
atgcatttatgtgtgtacattg

SEQ ID NO: 7627969 - DNA, 22 bp, Homo sapiens
atgcatttatgtgtgtacattg

SEQ ID NO: 7627970 - DNA, 22 bp, Homo sapiens
atgcatttatgtgtgtacattg

SEQ ID NO: 7627971 - DNA, 22 bp, Homo sapiens
atgcatttatgtgtgtacattg

SEQ ID NO: 7627972 - DNA, 19 bp, Homo sapiens
atgcattgtttgaagttga

SEQ ID NO: 7627973 - DNA, 19 bp, Homo sapiens
atgcattgtttgaagttga

SEQ ID NO: 7627974 - DNA, 20 bp, Homo sapiens
atgcattgtgattctgtttt

SEQ ID NO: 7627975 - DNA, 22 bp, Homo sapiens
atgcatgtattatctagatgag

SEQ ID NO: 7627976 - DNA, 22 bp, Homo sapiens
atgcatgtatatattacactca

SEQ ID NO: 7627977 - DNA, 22 bp, Homo sapiens
atgcatgtattatctagatgag

SEQ ID NO: 7627978 - DNA, 22 bp, Homo sapiens
atgcatgtaggctaaggtgtgt

SEQ ID NO: 7627979 - DNA, 22 bp, Homo sapiens
atgcatgtaacagtgttatgaa

SEQ ID NO: 7627980 - DNA, 22 bp, Homo sapiens
atgcatgtaacagtgttatgaa

SEQ ID NO: 7627981 - DNA, 21 bp, Homo sapiens
atgcatggatttcagtgagag

SEQ ID NO: 7627982 - DNA, 22 bp, Homo sapiens
atgcatgctggaaatacgttca

SEQ ID NO: 7627983 - DNA, 20 bp, Homo sapiens
atgcatgcatgcacatgcac

SEQ ID NO: 7627984 - DNA, 22 bp, Homo sapiens
atgcatgcttcttatagtactt

SEQ ID NO: 7627985 - DNA, 22 bp, Homo sapiens
atgcatgtattcatgtgtgaca

SEQ ID NO: 7627986 - DNA, 22 bp, Homo sapiens
atgcatggtctgaagtcaacct

SEQ ID NO: 7627987 - DNA, 22 bp, Homo sapiens
atgcatgtctgccagttgctta

SEQ ID NO: 7627988 - DNA, 22 bp, Homo sapiens
atgcatgtcagctgtgcccatg

SEQ ID NO: 7627989 - DNA, 22 bp, Homo sapiens
atgcatgtgcatacatgcacag

SEQ ID NO: 7627990 - DNA, 22 bp, Homo sapiens
atgcatgtgcatacatgcacag

SEQ ID NO: 7627991 - DNA, 22 bp, Homo sapiens
atgcatgtgcatggctctatct

SEQ ID NO: 7627992 - DNA, 22 bp, Homo sapiens
atgcatgtgtgagagcaagagg

SEQ ID NO: 7627993 - DNA, 22 bp, Homo sapiens
atgcatgtgtgaattatttgac

SEQ ID NO: 7627994 - DNA, 22 bp, Homo sapiens
atgcatgtgtgaattatttgac

SEQ ID NO: 7627995 - DNA, 22 bp, Homo sapiens
atgcatgtgtgaattatttgac

SEQ ID NO: 7627996 - DNA, 22 bp, Homo sapiens
atgcatgtgtgtagcatcagca

SEQ ID NO: 7627997 - DNA, 22 bp, Homo sapiens
atgcatgtgtgagagcaagagg

SEQ ID NO: 7627998 - DNA, 21 bp, Homo sapiens
atgcatgttacagtatatgcc

SEQ ID NO: 7627999 - DNA, 21 bp, Homo sapiens
atgcatgttccataaagtggg

SEQ ID NO: 7628000 - DNA, 22 bp, Homo sapiens
atgcatgttaagcctgactgga

SEQ ID NO: 7628001 - DNA, 22 bp, Homo sapiens
atgcatgttaagctcttaaaat

SEQ ID NO: 7628002 - DNA, 22 bp, Homo sapiens
atgcattcagcggaatgcttag

SEQ ID NO: 7628003 - DNA, 22 bp, Homo sapiens
atgcattatcaattgatgtagg

SEQ ID NO: 7628004 - DNA, 22 bp, Homo sapiens
atgcatgtttatagggtgcttc

SEQ ID NO: 7628005 - DNA, 22 bp, Homo sapiens
atgcatgtttatagggtgcttc

SEQ ID NO: 7628006 - DNA, 22 bp, Homo sapiens
atgcatgtttaaggggcatgca

SEQ ID NO: 7628007 - DNA, 22 bp, Homo sapiens
atgcatgttgcttggcccactc

SEQ ID NO: 7628008 - DNA, 21 bp, Homo sapiens
atgcatgttccataaagtggg

SEQ ID NO: 7628009 - DNA, 22 bp, Homo sapiens
atgcaaataaagcaactataca

SEQ ID NO: 7628010 - DNA, 22 bp, Homo sapiens
atgcaaataaagcaactataca

SEQ ID NO: 7628011 - DNA, 22 bp, Homo sapiens
atgcaaataaagcaactataca

SEQ ID NO: 7628012 - DNA, 22 bp, Homo sapiens
atgcaaataaagcaactataca

SEQ ID NO: 7628013 - DNA, 22 bp, Homo sapiens
atgcaaataaacagtctagttg

SEQ ID NO: 7628014 - DNA, 22 bp, Homo sapiens
atgcaaataaacagtctagttg

SEQ ID NO: 7628015 - DNA, 22 bp, Homo sapiens
atgcaaataaacagtctagttg

SEQ ID NO: 7628016 - DNA, 22 bp, Homo sapiens
atgcaaataaacagtctagttg

SEQ ID NO: 7628017 - DNA, 22 bp, Homo sapiens
atgcaaataaagcaactataca

SEQ ID NO: 7628018 - DNA, 22 bp, Homo sapiens
atgcaaataagtgcaggcgtgg

SEQ ID NO: 7628019 - DNA, 22 bp, Homo sapiens
atgcaaagcacacacagaatcc

SEQ ID NO: 7628020 - DNA, 22 bp, Homo sapiens
atgcaaagcaccacactaagat

SEQ ID NO: 7628021 - DNA, 22 bp, Homo sapiens
atgcaaagcaccacactaagat

SEQ ID NO: 7628022 - DNA, 22 bp, Homo sapiens
atgcaaagcaccacactaagat

SEQ ID NO: 7628023 - DNA, 22 bp, Homo sapiens
atgcaaagcacacacagaatcc

SEQ ID NO: 7628024 - DNA, 22 bp, Homo sapiens
atgcaaagcacacacagaatcc

SEQ ID NO: 7628025 - DNA, 22 bp, Homo sapiens
atgcaaagcacacacagaatcc

SEQ ID NO: 7628026 - DNA, 23 bp, Homo sapiens
atgcaaagtgctgtcatgtagac

SEQ ID NO: 7628027 - DNA, 23 bp, Homo sapiens
atgcaaagtgctgtcatgtagac

SEQ ID NO: 7628028 - DNA, 23 bp, Homo sapiens
atgcaaagtgctgtcatgtagac

SEQ ID NO: 7628029 - DNA, 22 bp, Homo sapiens
atgcaaagcaccacactaagat

SEQ ID NO: 7628030 - DNA, 22 bp, Homo sapiens
atgcaaagcaccacactaagat

SEQ ID NO: 7628031 - DNA, 22 bp, Homo sapiens
atgcaaatcttaagtatgtgtg

SEQ ID NO: 7628032 - DNA, 22 bp, Homo sapiens
atgcaaatcttaagtatgtgtg

SEQ ID NO: 7628033 - DNA, 22 bp, Homo sapiens
atgcaaatcttaagtatgtgtg

SEQ ID NO: 7628034 - DNA, 22 bp, Homo sapiens
atgcaaatcttaagtatgtgtg

SEQ ID NO: 7628035 - DNA, 22 bp, Homo sapiens
atgcaaatgaacatgttgctag

SEQ ID NO: 7628036 - DNA, 22 bp, Homo sapiens
atgcaaatgaacatgttgctag

SEQ ID NO: 7628037 - DNA, 22 bp, Homo sapiens
atgcacagtaatgagctggttg

SEQ ID NO: 7628038 - DNA, 22 bp, Homo sapiens
atgcacagtacaaactggaaac

SEQ ID NO: 7628039 - DNA, 22 bp, Homo sapiens
atgcacagtacaaactggaaac

SEQ ID NO: 7628040 - DNA, 22 bp, Homo sapiens
atgcacagtacaaactggaaac

SEQ ID NO: 7628041 - DNA, 22 bp, Homo sapiens
atgcacagtacaaactggaaac

SEQ ID NO: 7628042 - DNA, 22 bp, Homo sapiens
atgcacagtatgtagggtctat

SEQ ID NO: 7628043 - DNA, 22 bp, Homo sapiens
atgcaaatattaatggtatgac

SEQ ID NO: 7628044 - DNA, 19 bp, Homo sapiens
atgcaaatagatttggaat

SEQ ID NO: 7628045 - DNA, 19 bp, Homo sapiens
atgcaaatagatttggaat

SEQ ID NO: 7628046 - DNA, 22 bp, Homo sapiens
atgcaaataagtgcaggcgtgg

SEQ ID NO: 7628047 - DNA, 22 bp, Homo sapiens
atgcaaataagtgcaggcgtgg

SEQ ID NO: 7628048 - DNA, 20 bp, Homo sapiens
atgcaaatcccaaaatcagg

SEQ ID NO: 7628049 - DNA, 20 bp, Homo sapiens
atgcaaatcccaaaatcagg

SEQ ID NO: 7628050 - DNA, 20 bp, Homo sapiens
atgcaaatcccaaaatcagg

SEQ ID NO: 7628051 - DNA, 22 bp, Homo sapiens
atgcaaatattaatggtatgac

SEQ ID NO: 7628052 - DNA, 20 bp, Homo sapiens
atgcaaatcccaaaatcagg

SEQ ID NO: 7628053 - DNA, 20 bp, Homo sapiens
atgcaaatcccaaaatcagg

SEQ ID NO: 7628054 - DNA, 22 bp, Homo sapiens
atgcaaaataaggcagaaacat

SEQ ID NO: 7628055 - DNA, 22 bp, Homo sapiens
atgcaaaataaggcagaaacat

SEQ ID NO: 7628056 - DNA, 22 bp, Homo sapiens
atgcaaaataaggcagaaacat

SEQ ID NO: 7628057 - DNA, 22 bp, Homo sapiens
atgcaaaagtagttgcagtttt

SEQ ID NO: 7628058 - DNA, 22 bp, Homo sapiens
atgcaaaagtagttgcagtttt

SEQ ID NO: 7628059 - DNA, 22 bp, Homo sapiens
atgcaaaataaggcagaaacat

SEQ ID NO: 7628060 - DNA, 22 bp, Homo sapiens
atgcaaaataaggcagaaacat

SEQ ID NO: 7628061 - DNA, 22 bp, Homo sapiens
atgcaaaataaggcagaaacat

SEQ ID NO: 7628062 - DNA, 22 bp, Homo sapiens
atgcaaaataaggcagaaacat

SEQ ID NO: 7628063 - DNA, 22 bp, Homo sapiens
atgcaaaataaggcagaaacat

SEQ ID NO: 7628064 - DNA, 22 bp, Homo sapiens
atgcaaaataaggcagaaacat

SEQ ID NO: 7628065 - DNA, 22 bp, Homo sapiens
atgcaaaagtaattgcaatttt

SEQ ID NO: 7628066 - DNA, 22 bp, Homo sapiens
atgcaaaagtagttgcagtttt

SEQ ID NO: 7628067 - DNA, 22 bp, Homo sapiens
atgcaaaagtaattgcaatttt

SEQ ID NO: 7628068 - DNA, 22 bp, Homo sapiens
atgcaaaagtagttgcagtttt

SEQ ID NO: 7628069 - DNA, 22 bp, Homo sapiens
atgcaaaagtaattgcaatttt

SEQ ID NO: 7628070 - DNA, 22 bp, Homo sapiens
atgcaaaagtaattgcaatttt

SEQ ID NO: 7628071 - DNA, 22 bp, Homo sapiens
atgcaaaagtaattgcaatttt

SEQ ID NO: 7628072 - DNA, 22 bp, Homo sapiens
atgcaaacatgtttcctctaag

SEQ ID NO: 7628073 - DNA, 22 bp, Homo sapiens
atgcaaacatgaagagaaagag

SEQ ID NO: 7628074 - DNA, 22 bp, Homo sapiens
atgcaaacaagagctaggtctg

SEQ ID NO: 7628075 - DNA, 22 bp, Homo sapiens
atgcaaacatgaagagaaagag

SEQ ID NO: 7628076 - DNA, 22 bp, Homo sapiens
atgcaaacatgtttcctctaag

SEQ ID NO: 7628077 - DNA, 22 bp, Homo sapiens
atgcaaacattcgcttgtctct

SEQ ID NO: 7628078 - DNA, 22 bp, Homo sapiens
atgcaaagcacacacagaatcc

SEQ ID NO: 7628079 - DNA, 22 bp, Homo sapiens
atgcaaagcacacacagaatcc

SEQ ID NO: 7628080 - DNA, 20 bp, Homo sapiens
atgcaaactcacaaaatacc

SEQ ID NO: 7628081 - DNA, 20 bp, Homo sapiens
atgcaaactcacaaaatacc

SEQ ID NO: 7628082 - DNA, 20 bp, Homo sapiens
atgcaaactcacaaaatacc

SEQ ID NO: 7628083 - DNA, 22 bp, Homo sapiens
atgcaaacatgtttcctctaag

SEQ ID NO: 7628084 - DNA, 22 bp, Homo sapiens
atgcaaacattcgcttgtctct

SEQ ID NO: 7628085 - DNA, 20 bp, Homo sapiens
atgcaaaccctgctttgtgg

SEQ ID NO: 7628086 - DNA, 22 bp, Homo sapiens
atgcaaaattaccattctgttc

SEQ ID NO: 7628087 - DNA, 22 bp, Homo sapiens
atgcaaaattaccattctgttc

SEQ ID NO: 7628088 - DNA, 22 bp, Homo sapiens
atgcaaaattaccattctgttc

SEQ ID NO: 7628089 - DNA, 22 bp, Homo sapiens
atgcaaaattaccattctgttc

SEQ ID NO: 7628090 - DNA, 22 bp, Homo sapiens
atgcaaaattaccattctgttc

SEQ ID NO: 7628091 - DNA, 22 bp, Homo sapiens
atgcaaaataaggcagaaacat

SEQ ID NO: 7628092 - DNA, 22 bp, Homo sapiens
atgcaaaattaccattctgttc

SEQ ID NO: 7628093 - DNA, 22 bp, Homo sapiens
atgcaaaattaccattctgttc

SEQ ID NO: 7628094 - DNA, 22 bp, Homo sapiens
atgcaaaattaccattctgttc

SEQ ID NO: 7628095 - DNA, 22 bp, Homo sapiens
atgcagataagaatcaggtttg

SEQ ID NO: 7628096 - DNA, 22 bp, Homo sapiens
atgcagatctgtgaaaggaata

SEQ ID NO: 7628097 - DNA, 22 bp, Homo sapiens
atgcagatatgcaaactgtagt

SEQ ID NO: 7628098 - DNA, 22 bp, Homo sapiens
atgcagatggtggatggagaaa

SEQ ID NO: 7628099 - DNA, 22 bp, Homo sapiens
atgcagatgggtgccaaagtct

SEQ ID NO: 7628100 - DNA, 22 bp, Homo sapiens
atgcagatgggtgccaaagtct

SEQ ID NO: 7628101 - DNA, 22 bp, Homo sapiens
atgcagatgttcctactgtgtt

SEQ ID NO: 7628102 - DNA, 22 bp, Homo sapiens
atgcagatggtggatggagaaa

SEQ ID NO: 7628103 - DNA, 22 bp, Homo sapiens
atgcagatttctttgctgcacc

SEQ ID NO: 7628104 - DNA, 22 bp, Homo sapiens
atgcagatgtttggttcattgt

SEQ ID NO: 7628105 - DNA, 22 bp, Homo sapiens
atgcagatgtttggttcattgt

SEQ ID NO: 7628106 - DNA, 22 bp, Homo sapiens
atgcagatgttcctactgtgtt

SEQ ID NO: 7628107 - DNA, 22 bp, Homo sapiens
atgcagatttaattagtatagg

SEQ ID NO: 7628108 - DNA, 18 bp, Homo sapiens
atgcagcaatcagaaata

SEQ ID NO: 7628109 - DNA, 18 bp, Homo sapiens
atgcagcaatcagaaata

SEQ ID NO: 7628110 - DNA, 22 bp, Homo sapiens
atgcagcactgatctttagcca

SEQ ID NO: 7628111 - DNA, 22 bp, Homo sapiens
atgcagcactgatctttagcca

SEQ ID NO: 7628112 - DNA, 22 bp, Homo sapiens
atgcagcagccccttgaggtgc

SEQ ID NO: 7628113 - DNA, 22 bp, Homo sapiens
atgcagcagccccttgaggtgc

SEQ ID NO: 7628114 - DNA, 23 bp, Homo sapiens
atgcagagaataacaaatgccat

SEQ ID NO: 7628115 - DNA, 23 bp, Homo sapiens
atgcagagaataacaaatgccat

SEQ ID NO: 7628116 - DNA, 21 bp, Homo sapiens
atgcagagaactccagggaag

SEQ ID NO: 7628117 - DNA, 22 bp, Homo sapiens
atgcagaattgctaagtatctg

SEQ ID NO: 7628118 - DNA, 22 bp, Homo sapiens
atgcagacatgggagagttgag

SEQ ID NO: 7628119 - DNA, 22 bp, Homo sapiens
atgcagaattgctaagtatctg

SEQ ID NO: 7628120 - DNA, 22 bp, Homo sapiens
atgcagaattgctaagtatctg

SEQ ID NO: 7628121 - DNA, 22 bp, Homo sapiens
atgcagaattgctaagtatctg

SEQ ID NO: 7628122 - DNA, 22 bp, Homo sapiens
atgcagagcttccagtggcctg

SEQ ID NO: 7628123 - DNA, 22 bp, Homo sapiens
atgcagagcttccagtggcctg

SEQ ID NO: 7628124 - DNA, 22 bp, Homo sapiens
atgcagagacagatgtggcatg

SEQ ID NO: 7628125 - DNA, 22 bp, Homo sapiens
atgcagagcttccagtggcctg

SEQ ID NO: 7628126 - DNA, 22 bp, Homo sapiens
atgcagagacagatgtggcatg

SEQ ID NO: 7628127 - DNA, 19 bp, Homo sapiens
atgcagagaatggcagtag

SEQ ID NO: 7628128 - DNA, 19 bp, Homo sapiens
atgcagagaatggcagtag

SEQ ID NO: 7628129 - DNA, 22 bp, Homo sapiens
atgcagagacagatgtggcatg

SEQ ID NO: 7628130 - DNA, 19 bp, Homo sapiens
atgcagagaatggcagtag

SEQ ID NO: 7628131 - DNA, 22 bp, Homo sapiens
atgcagaagcagaacttacaca

SEQ ID NO: 7628132 - DNA, 22 bp, Homo sapiens
atgcagaagcagaacttacaca

SEQ ID NO: 7628133 - DNA, 22 bp, Homo sapiens
atgcagaagactgaaaagctga

SEQ ID NO: 7628134 - DNA, 22 bp, Homo sapiens
atgcagaagcagaacttacaca

SEQ ID NO: 7628135 - DNA, 22 bp, Homo sapiens
atgcagaaggagccatgcttgc

SEQ ID NO: 7628136 - DNA, 22 bp, Homo sapiens
atgcagaaggagccatgcttgc

SEQ ID NO: 7628137 - DNA, 22 bp, Homo sapiens
atgcagaagcagaacttacaca

SEQ ID NO: 7628138 - DNA, 22 bp, Homo sapiens
atgcagaagactgaaaagctga

SEQ ID NO: 7628139 - DNA, 22 bp, Homo sapiens
atgcagaagaaaccatggcttc

SEQ ID NO: 7628140 - DNA, 22 bp, Homo sapiens
atgcagaagactgaaaagctga

SEQ ID NO: 7628141 - DNA, 22 bp, Homo sapiens
atgcagaagcagaacttacaca

SEQ ID NO: 7628142 - DNA, 22 bp, Homo sapiens
atgcagaagactgaaaagctga

SEQ ID NO: 7628143 - DNA, 22 bp, Homo sapiens
atgcagaatgagttcacgatct

SEQ ID NO: 7628144 - DNA, 22 bp, Homo sapiens
atgcagaatgagttcacgatct

SEQ ID NO: 7628145 - DNA, 22 bp, Homo sapiens
atgcagaatgagttcacgatct

SEQ ID NO: 7628146 - DNA, 22 bp, Homo sapiens
atgcagaatcttgagaaaaatt

SEQ ID NO: 7628147 - DNA, 22 bp, Homo sapiens
atgcagaatcttgagaaaaatt

SEQ ID NO: 7628148 - DNA, 22 bp, Homo sapiens
atgcagaaggagccatgcttgc

SEQ ID NO: 7628149 - DNA, 22 bp, Homo sapiens
atgcagaaggagccatgcttgc

SEQ ID NO: 7628150 - DNA, 22 bp, Homo sapiens
atgcagaaggagccatgcttgc

SEQ ID NO: 7628151 - DNA, 22 bp, Homo sapiens
atgcagaaggagccatgcttgc

SEQ ID NO: 7628152 - DNA, 22 bp, Homo sapiens
atgcagaaagcggcaaacaggt

SEQ ID NO: 7628153 - DNA, 22 bp, Homo sapiens
atgcagaaagcggcaaacaggt

SEQ ID NO: 7628154 - DNA, 22 bp, Homo sapiens
atgcagaacgtttgtgaaactt

SEQ ID NO: 7628155 - DNA, 22 bp, Homo sapiens
atgcagaagaaaccatggcttc

SEQ ID NO: 7628156 - DNA, 22 bp, Homo sapiens
atgcagaagaaaccatggcttc

SEQ ID NO: 7628157 - DNA, 22 bp, Homo sapiens
atgcagaacgtttgtgaaactt

SEQ ID NO: 7628158 - DNA, 22 bp, Homo sapiens
atgcagaacgtttgtgaaactt

SEQ ID NO: 7628159 - DNA, 22 bp, Homo sapiens
atgcagaaagagaatgtaatgt

SEQ ID NO: 7628160 - DNA, 22 bp, Homo sapiens
atgcagaaagagaatgtaatgt

SEQ ID NO: 7628161 - DNA, 22 bp, Homo sapiens
atgcagaaagcggcaaacaggt

SEQ ID NO: 7628162 - DNA, 22 bp, Homo sapiens
atgcactttctagagattctga

SEQ ID NO: 7628163 - DNA, 22 bp, Homo sapiens
atgcacttgcgtgtttgcaaat

SEQ ID NO: 7628164 - DNA, 22 bp, Homo sapiens
atgcacttcaagcatctctctg

SEQ ID NO: 7628165 - DNA, 22 bp, Homo sapiens
atgcacttcaagcatctctctg

SEQ ID NO: 7628166 - DNA, 19 bp, Homo sapiens
atgcacagtcatttgtaag

SEQ ID NO: 7628167 - DNA, 22 bp, Homo sapiens
atgcacagtatgtagggtctat

SEQ ID NO: 7628168 - DNA, 22 bp, Homo sapiens
atgcacagtatgtagggtctat

SEQ ID NO: 7628169 - DNA, 22 bp, Homo sapiens
ggaaaactgtatttgaataact

SEQ ID NO: 7628170 - DNA, 22 bp, Homo sapiens
cacaaagttggacaacgcaccc

SEQ ID NO: 7628171 - DNA, 22 bp, Homo sapiens
cacaaagtgttagatgccactc

SEQ ID NO: 7628172 - DNA, 22 bp, Homo sapiens
cacaaagtgttagatgccactc

SEQ ID NO: 7628173 - DNA, 21 bp, Homo sapiens
ggaaaactttccttgtctgaa

SEQ ID NO: 7628174 - DNA, 22 bp, Homo sapiens
ggaaaagaaagggactgattgg

SEQ ID NO: 7628175 - DNA, 22 bp, Homo sapiens
ggaaaagaaagggactgattgg

SEQ ID NO: 7628176 - DNA, 22 bp, Homo sapiens
ggaaaagaaagggactgattgg

SEQ ID NO: 7628177 - DNA, 22 bp, Homo sapiens
ggaaaactgtatttgaataact

SEQ ID NO: 7628178 - DNA, 22 bp, Homo sapiens
cacaaagtgttagatgccactc

SEQ ID NO: 7628179 - DNA, 22 bp, Homo sapiens
cacaaagtgttagatgccactc

SEQ ID NO: 7628180 - DNA, 22 bp, Homo sapiens
cacaaagtgggtggaaaactaa

SEQ ID NO: 7628181 - DNA, 22 bp, Homo sapiens
cacaaagtgggtggaaaactaa

SEQ ID NO: 7628182 - DNA, 22 bp, Homo sapiens
cacaaagtgggtggaaaactaa

SEQ ID NO: 7628183 - DNA, 22 bp, Homo sapiens
cacaaagtgggtggaaaactaa

SEQ ID NO: 7628184 - DNA, 22 bp, Homo sapiens
cacaaagtggcaggagaggaga

SEQ ID NO: 7628185 - DNA, 22 bp, Homo sapiens
cacaaagtataacttgatggaa

SEQ ID NO: 7628186 - DNA, 22 bp, Homo sapiens
cacaaagtataacttgatggaa

SEQ ID NO: 7628187 - DNA, 22 bp, Homo sapiens
cacaaagtggcaggagaggaga

SEQ ID NO: 7628188 - DNA, 22 bp, Homo sapiens
cacaaagtctgcagctgctgta

SEQ ID NO: 7628189 - DNA, 22 bp, Homo sapiens
ggaaaagacagaattctagaat

SEQ ID NO: 7628190 - DNA, 22 bp, Homo sapiens
ggaaaagacagaattctagaat

SEQ ID NO: 7628191 - DNA, 22 bp, Homo sapiens
ggaaaagacagaattctagaat

SEQ ID NO: 7628192 - DNA, 22 bp, Homo sapiens
ggaaaagacagaattctagaat

SEQ ID NO: 7628193 - DNA, 22 bp, Homo sapiens
ggaaaagacagaattctagaat

SEQ ID NO: 7628194 - DNA, 22 bp, Homo sapiens
ggaaaagacagaattctagaat

SEQ ID NO: 7628195 - DNA, 22 bp, Homo sapiens
ggaaaagaattgcagtgaagta

SEQ ID NO: 7628196 - DNA, 22 bp, Homo sapiens
ggaaaagaattgcagtgaagta

SEQ ID NO: 7628197 - DNA, 22 bp, Homo sapiens
ggaaaagaattgcagtgaagta

SEQ ID NO: 7628198 - DNA, 22 bp, Homo sapiens
ggaaaagaattgcagtgaagta

SEQ ID NO: 7628199 - DNA, 22 bp, Homo sapiens
ggaaaagaattgcagtgaagta

SEQ ID NO: 7628200 - DNA, 22 bp, Homo sapiens
ggaaaagaattgcagtgaagta

SEQ ID NO: 7628201 - DNA, 22 bp, Homo sapiens
ggaaaagaattgcagtgaagta

SEQ ID NO: 7628202 - DNA, 17 bp, Homo sapiens
ggaaaagaagagtagga

SEQ ID NO: 7628203 - DNA, 17 bp, Homo sapiens
ggaaaagaagagtagga

SEQ ID NO: 7628204 - DNA, 17 bp, Homo sapiens
ggaaaagaagagtagga

SEQ ID NO: 7628205 - DNA, 17 bp, Homo sapiens
ggaaaagaagagtagga

SEQ ID NO: 7628206 - DNA, 22 bp, Homo sapiens
ggaaaagaaagggactgattgg

SEQ ID NO: 7628207 - DNA, 22 bp, Homo sapiens
ggaaaagaaagggactgattgg

SEQ ID NO: 7628208 - DNA, 17 bp, Homo sapiens
ggaaaagaagagtagga

SEQ ID NO: 7628209 - DNA, 17 bp, Homo sapiens
ggaaaagaagagtagga

SEQ ID NO: 7628210 - DNA, 17 bp, Homo sapiens
ggaaaagaagagtagga

SEQ ID NO: 7628211 - DNA, 22 bp, Homo sapiens
ggaaaagaaagggactgattgg

SEQ ID NO: 7628212 - DNA, 22 bp, Homo sapiens
ggaaaagaaagggactgattgg

SEQ ID NO: 7628213 - DNA, 22 bp, Homo sapiens
cacaaaatctttctcgattatt

SEQ ID NO: 7628214 - DNA, 22 bp, Homo sapiens
cacaaaatctttctcgattatt

SEQ ID NO: 7628215 - DNA, 22 bp, Homo sapiens
cacaaaatctttctcgattatt

SEQ ID NO: 7628216 - DNA, 22 bp, Homo sapiens
cacaaaatctttctcgattatt

SEQ ID NO: 7628217 - DNA, 22 bp, Homo sapiens
cacaaaatctttctcgattatt

SEQ ID NO: 7628218 - DNA, 22 bp, Homo sapiens
cacaaaatctttctcgattatt

SEQ ID NO: 7628219 - DNA, 22 bp, Homo sapiens
cacaaaatctttctcgattatt

SEQ ID NO: 7628220 - DNA, 22 bp, Homo sapiens
cacaaaatctttctcgattatt

SEQ ID NO: 7628221 - DNA, 22 bp, Homo sapiens
cacaaaatctttctcgattatt

SEQ ID NO: 7628222 - DNA, 22 bp, Homo sapiens
cacaaaatctttctcgattatt

SEQ ID NO: 7628223 - DNA, 22 bp, Homo sapiens
cacaaaatatcaagcactttta

SEQ ID NO: 7628224 - DNA, 22 bp, Homo sapiens
cacaaaatatcaagcactttta

SEQ ID NO: 7628225 - DNA, 22 bp, Homo sapiens
cacaaaatatcaagcactttta

SEQ ID NO: 7628226 - DNA, 22 bp, Homo sapiens
cacaaaatatcaagcactttta

SEQ ID NO: 7628227 - DNA, 22 bp, Homo sapiens
cacaaaatatcaagcactttta

SEQ ID NO: 7628228 - DNA, 22 bp, Homo sapiens
cacaaaatatcaagcactttta

SEQ ID NO: 7628229 - DNA, 22 bp, Homo sapiens
cacaaaatatcaagcactttta

SEQ ID NO: 7628230 - DNA, 22 bp, Homo sapiens
cacaaaatatcaagcactttta

SEQ ID NO: 7628231 - DNA, 22 bp, Homo sapiens
cacaaaatatcaagcactttta

SEQ ID NO: 7628232 - DNA, 22 bp, Homo sapiens
cacaaaatatcaagcactttta

SEQ ID NO: 7628233 - DNA, 22 bp, Homo sapiens
cacaaaatatcaagcactttta

SEQ ID NO: 7628234 - DNA, 22 bp, Homo sapiens
cacaaagccctccctgcgccag

SEQ ID NO: 7628235 - DNA, 22 bp, Homo sapiens
cacaaacctgccagccctgccc

SEQ ID NO: 7628236 - DNA, 22 bp, Homo sapiens
cacaaacctgccagccctgccc

SEQ ID NO: 7628237 - DNA, 22 bp, Homo sapiens
cacaaaccttctgcagcctgta

SEQ ID NO: 7628238 - DNA, 22 bp, Homo sapiens
cacaaaccttctgcagcctgta

SEQ ID NO: 7628239 - DNA, 22 bp, Homo sapiens
cacaaacatcaatcctgttttc

SEQ ID NO: 7628240 - DNA, 22 bp, Homo sapiens
cacaaacatcaatcctgttttc

SEQ ID NO: 7628241 - DNA, 22 bp, Homo sapiens
cacaaacatcaatcctgttttc

SEQ ID NO: 7628242 - DNA, 22 bp, Homo sapiens
cacaaacatcaatcctgttttc

SEQ ID NO: 7628243 - DNA, 22 bp, Homo sapiens
cacaaacatcaatcctgttttc

SEQ ID NO: 7628244 - DNA, 22 bp, Homo sapiens
cacaaacatcaatcctgttttc

SEQ ID NO: 7628245 - DNA, 22 bp, Homo sapiens
cacaaaggagaatgtcagcata

SEQ ID NO: 7628246 - DNA, 22 bp, Homo sapiens
cacaaaggagaatgtcagcata

SEQ ID NO: 7628247 - DNA, 22 bp, Homo sapiens
cacaaagccctccctgcgccag

SEQ ID NO: 7628248 - DNA, 23 bp, Homo sapiens
cacaaaggttccattctctcacc

SEQ ID NO: 7628249 - DNA, 23 bp, Homo sapiens
cacaaaggttccattctctcacc

SEQ ID NO: 7628250 - DNA, 22 bp, Homo sapiens
cacaaaggtaactggagtattt

SEQ ID NO: 7628251 - DNA, 22 bp, Homo sapiens
cacaatgcagcatgtaaatgca

SEQ ID NO: 7628252 - DNA, 22 bp, Homo sapiens
cacaatgatttggttcaaaaat

SEQ ID NO: 7628253 - DNA, 22 bp, Homo sapiens
cacaatgatttggttcaaaaat

SEQ ID NO: 7628254 - DNA, 22 bp, Homo sapiens
cacaatgatttggttcaaaaat

SEQ ID NO: 7628255 - DNA, 22 bp, Homo sapiens
cacaatcataatgtatgtacat

SEQ ID NO: 7628256 - DNA, 22 bp, Homo sapiens
cacaatctcaactgccttttag

SEQ ID NO: 7628257 - DNA, 22 bp, Homo sapiens
cacaatactatttttaggtctt

SEQ ID NO: 7628258 - DNA, 18 bp, Homo sapiens
cacaatagacaccgataa

SEQ ID NO: 7628259 - DNA, 22 bp, Homo sapiens
cacaatattggccgggctggtc

SEQ ID NO: 7628260 - DNA, 22 bp, Homo sapiens
cacaataaatgtttgctgatga

SEQ ID NO: 7628261 - DNA, 22 bp, Homo sapiens
cacaataaatgtttgctgatga

SEQ ID NO: 7628262 - DNA, 22 bp, Homo sapiens
cacaagtgaaccatgtgtcctt

SEQ ID NO: 7628263 - DNA, 22 bp, Homo sapiens
cacaagtggctggggaaaggga

SEQ ID NO: 7628264 - DNA, 22 bp, Homo sapiens
cacaagtggctggggaaaggga

SEQ ID NO: 7628265 - DNA, 22 bp, Homo sapiens
cacaagtttgggtcactcagct

SEQ ID NO: 7628266 - DNA, 22 bp, Homo sapiens
cacaagtcattttcagcaggct

SEQ ID NO: 7628267 - DNA, 22 bp, Homo sapiens
cacaagtcattttcagcaggct

SEQ ID NO: 7628268 - DNA, 22 bp, Homo sapiens
cacaagtcattttcagcaggct

SEQ ID NO: 7628269 - DNA, 22 bp, Homo sapiens
cacaattagcagctctttattt

SEQ ID NO: 7628270 - DNA, 22 bp, Homo sapiens
cacaattagcagctctttattt

SEQ ID NO: 7628271 - DNA, 22 bp, Homo sapiens
cacaattagcagctctttattt

SEQ ID NO: 7628272 - DNA, 22 bp, Homo sapiens
cacaattacttttgcaccaaca

SEQ ID NO: 7628273 - DNA, 22 bp, Homo sapiens
cacaattacttttgcaccaaca

SEQ ID NO: 7628274 - DNA, 22 bp, Homo sapiens
cacaatgtggtttgtcatcttt

SEQ ID NO: 7628275 - DNA, 22 bp, Homo sapiens
cacaatgtggtttgtcatcttt

SEQ ID NO: 7628276 - DNA, 22 bp, Homo sapiens
cacaatgtggtttgtcatcttt

SEQ ID NO: 7628277 - DNA, 21 bp, Homo sapiens
cacaatgttggccaggttggt

SEQ ID NO: 7628278 - DNA, 21 bp, Homo sapiens
cacaatgttggccaggttggt

SEQ ID NO: 7628279 - DNA, 22 bp, Homo sapiens
cacaatgtgttgggttaagttt

SEQ ID NO: 7628280 - DNA, 22 bp, Homo sapiens
cacaatgtatatgtatatcaaa

SEQ ID NO: 7628281 - DNA, 22 bp, Homo sapiens
cacaatgtatatgtatatcaaa

SEQ ID NO: 7628282 - DNA, 22 bp, Homo sapiens
cacaatgtctggtaggccactt

SEQ ID NO: 7628283 - DNA, 22 bp, Homo sapiens
cacaatgtctggtaggccactt

SEQ ID NO: 7628284 - DNA, 22 bp, Homo sapiens
cacaatgcgtacatatatcaaa

SEQ ID NO: 7628285 - DNA, 22 bp, Homo sapiens
cacaatgcagcatgtaaatgca

SEQ ID NO: 7628286 - DNA, 22 bp, Homo sapiens
cacaatgcagcatgtaaatgca

SEQ ID NO: 7628287 - DNA, 22 bp, Homo sapiens
cacaatgcgtacatatatcaaa

SEQ ID NO: 7628288 - DNA, 22 bp, Homo sapiens
cacaatgtaagagtttgttcat

SEQ ID NO: 7628289 - DNA, 22 bp, Homo sapiens
cacaatgtatatgtatatcaaa

SEQ ID NO: 7628290 - DNA, 17 bp, Homo sapiens
ggaaaaggatgatacag

SEQ ID NO: 7628291 - DNA, 22 bp, Homo sapiens
ggaaaaggccacagggacacat

SEQ ID NO: 7628292 - DNA, 22 bp, Homo sapiens
ggaaaaggccacagggacacat

SEQ ID NO: 7628293 - DNA, 22 bp, Homo sapiens
ggaaaaggccacagggacacat

SEQ ID NO: 7628294 - DNA, 20 bp, Homo sapiens
ggaaaagtactcctccttaa

SEQ ID NO: 7628295 - DNA, 20 bp, Homo sapiens
ggaaaagtactcctccttaa

SEQ ID NO: 7628296 - DNA, 18 bp, Homo sapiens
ggaaaaggagtgtctagc

SEQ ID NO: 7628297 - DNA, 22 bp, Homo sapiens
ggaaaagacaggttaactgtga

SEQ ID NO: 7628298 - DNA, 22 bp, Homo sapiens
ggaaaagacaggttaactgtga

SEQ ID NO: 7628299 - DNA, 22 bp, Homo sapiens
ggaaaagacagaattctagaat

SEQ ID NO: 7628300 - DNA, 22 bp, Homo sapiens
ggaaaagacagaattctagaat

SEQ ID NO: 7628301 - DNA, 22 bp, Homo sapiens
ggaaaagacaggttaactgtga

SEQ ID NO: 7628302 - DNA, 22 bp, Homo sapiens
ggaaaagacaggttaactgtga

SEQ ID NO: 7628303 - DNA, 22 bp, Homo sapiens
ggaaaagacaggttaactgtga

SEQ ID NO: 7628304 - DNA, 22 bp, Homo sapiens
ggaaaagacaggttaactgtga

SEQ ID NO: 7628305 - DNA, 22 bp, Homo sapiens
ggaaaatactgattcatgccat

SEQ ID NO: 7628306 - DNA, 22 bp, Homo sapiens
ggaaaatactgattcatgccat

SEQ ID NO: 7628307 - DNA, 22 bp, Homo sapiens
ggaaaatactgattcatgccat

SEQ ID NO: 7628308 - DNA, 22 bp, Homo sapiens
ggaaaagtgttaaggtgttgat

SEQ ID NO: 7628309 - DNA, 22 bp, Homo sapiens
ggaaaatactgattcatgccat

SEQ ID NO: 7628310 - DNA, 22 bp, Homo sapiens
ggaaaatgggaacctgaagcca

SEQ ID NO: 7628311 - DNA, 21 bp, Homo sapiens
ggaaaattcagagtgcaattt

SEQ ID NO: 7628312 - DNA, 21 bp, Homo sapiens
ggaaaattcagagtgcaattt

SEQ ID NO: 7628313 - DNA, 22 bp, Homo sapiens
cacaactttaggaaccacattc

SEQ ID NO: 7628314 - DNA, 22 bp, Homo sapiens
cacaagggctttgtaggctttg

SEQ ID NO: 7628315 - DNA, 22 bp, Homo sapiens
cacaagggctttgtaggctttg

SEQ ID NO: 7628316 - DNA, 22 bp, Homo sapiens
cacaaggttctgtaaaatcaaa

SEQ ID NO: 7628317 - DNA, 22 bp, Homo sapiens
cacaaggttctgtaaaatcaaa

SEQ ID NO: 7628318 - DNA, 22 bp, Homo sapiens
cacacattgaattcattcttgt

SEQ ID NO: 7628319 - DNA, 22 bp, Homo sapiens
cacacattgaattcattcttgt

SEQ ID NO: 7628320 - DNA, 22 bp, Homo sapiens
cacacattgaattcattcttgt

SEQ ID NO: 7628321 - DNA, 22 bp, Homo sapiens
cacacattgaattcattcttgt

SEQ ID NO: 7628322 - DNA, 22 bp, Homo sapiens
cacacattgagcagctgtttgt

SEQ ID NO: 7628323 - DNA, 22 bp, Homo sapiens
cacacattgagcagctgtttgt

SEQ ID NO: 7628324 - DNA, 22 bp, Homo sapiens
cacacattccaaaatcaagggt

SEQ ID NO: 7628325 - DNA, 22 bp, Homo sapiens
cacacattcaccatgactgaaa

SEQ ID NO: 7628326 - DNA, 22 bp, Homo sapiens
cacacattagagccaatgtcag

SEQ ID NO: 7628327 - DNA, 22 bp, Homo sapiens
cacacattcaccatgactgaaa

SEQ ID NO: 7628328 - DNA, 22 bp, Homo sapiens
cacacatttcagatgctacaat

SEQ ID NO: 7628329 - DNA, 22 bp, Homo sapiens
cacacatttcagatgctacaat

SEQ ID NO: 7628330 - DNA, 21 bp, Homo sapiens
cacaccaaacaggaacaggga

SEQ ID NO: 7628331 - DNA, 22 bp, Homo sapiens
cacacattggttttactccttt

SEQ ID NO: 7628332 - DNA, 22 bp, Homo sapiens
cacacattggttttactccttt

SEQ ID NO: 7628333 - DNA, 22 bp, Homo sapiens
cacacatttcagatgctacaat

SEQ ID NO: 7628334 - DNA, 22 bp, Homo sapiens
cacacattggttttactccttt

SEQ ID NO: 7628335 - DNA, 22 bp, Homo sapiens
cacacatttcagatgctacaat

SEQ ID NO: 7628336 - DNA, 22 bp, Homo sapiens
cacacatttcagatgctacaat

SEQ ID NO: 7628337 - DNA, 22 bp, Homo sapiens
cacacatttcagatgctacaat

SEQ ID NO: 7628338 - DNA, 21 bp, Homo sapiens
cacaccaggcatgtcttgagc

SEQ ID NO: 7628339 - DNA, 21 bp, Homo sapiens
cacaccaggcatgtcttgagc

SEQ ID NO: 7628340 - DNA, 21 bp, Homo sapiens
cacaccaggcatgtcttgagc

SEQ ID NO: 7628341 - DNA, 21 bp, Homo sapiens
cacaccaggcatgtcttgagc

SEQ ID NO: 7628342 - DNA, 22 bp, Homo sapiens
cacaccagcatggtctcagtgt

SEQ ID NO: 7628343 - DNA, 23 bp, Homo sapiens
cacaccaggagccgtctgggcca

SEQ ID NO: 7628344 - DNA, 23 bp, Homo sapiens
cacaccaggagccgtctgggcca

SEQ ID NO: 7628345 - DNA, 22 bp, Homo sapiens
cacaccagaggttacctgcaaa

SEQ ID NO: 7628346 - DNA, 22 bp, Homo sapiens
cacaccagaggttacctgcaaa

SEQ ID NO: 7628347 - DNA, 22 bp, Homo sapiens
cacaccagaggttacctgcaaa

SEQ ID NO: 7628348 - DNA, 22 bp, Homo sapiens
cacaccagaggttacctgcaaa

SEQ ID NO: 7628349 - DNA, 22 bp, Homo sapiens
cacaccaaagtatttggtattt

SEQ ID NO: 7628350 - DNA, 21 bp, Homo sapiens
cacaccaaacaggaacaggga

SEQ ID NO: 7628351 - DNA, 22 bp, Homo sapiens
cacacctcacacctcgcatgct

SEQ ID NO: 7628352 - DNA, 22 bp, Homo sapiens
cacacctgcctgccgtgtgctg

SEQ ID NO: 7628353 - DNA, 22 bp, Homo sapiens
cacacctcacacctcgcatgct

SEQ ID NO: 7628354 - DNA, 22 bp, Homo sapiens
cacacctgtaatcctagcactt

SEQ ID NO: 7628355 - DNA, 22 bp, Homo sapiens
cacacctgtaatcctagcactt

SEQ ID NO: 7628356 - DNA, 22 bp, Homo sapiens
cacacctgtaataccagctact

SEQ ID NO: 7628357 - DNA, 22 bp, Homo sapiens
cacacctgtaataccagctact

SEQ ID NO: 7628358 - DNA, 22 bp, Homo sapiens
cacacctgtaataccagctact

SEQ ID NO: 7628359 - DNA, 22 bp, Homo sapiens
cacaccttaggcctgagcgctt

SEQ ID NO: 7628360 - DNA, 23 bp, Homo sapiens
cacacctgttaagaagagtgcct

SEQ ID NO: 7628361 - DNA, 22 bp, Homo sapiens
cacacgagccctggagccagca

SEQ ID NO: 7628362 - DNA, 22 bp, Homo sapiens
cacacgagccctggagccagca

SEQ ID NO: 7628363 - DNA, 22 bp, Homo sapiens
cacacgtgtgagagctgtggca

SEQ ID NO: 7628364 - DNA, 22 bp, Homo sapiens
cacactaatttttcaagagttt

SEQ ID NO: 7628365 - DNA, 22 bp, Homo sapiens
cacactaatttttcaagagttt

SEQ ID NO: 7628366 - DNA, 23 bp, Homo sapiens
cacacctgttaagaagagtgcct

SEQ ID NO: 7628367 - DNA, 23 bp, Homo sapiens
cacacctgttaagaagagtgcct

SEQ ID NO: 7628368 - DNA, 23 bp, Homo sapiens
cacacctgttaagaagagtgcct

SEQ ID NO: 7628369 - DNA, 22 bp, Homo sapiens
cacacctgtaatcctagcactt

SEQ ID NO: 7628370 - DNA, 22 bp, Homo sapiens
cacacctgtgagtctcggcttg

SEQ ID NO: 7628371 - DNA, 22 bp, Homo sapiens
cacacctgtgagtctcggcttg

SEQ ID NO: 7628372 - DNA, 22 bp, Homo sapiens
cacacctgtgagtctcggcttg

SEQ ID NO: 7628373 - DNA, 22 bp, Homo sapiens
cacacccaaatttctctctcag

SEQ ID NO: 7628374 - DNA, 22 bp, Homo sapiens
cacacccaaatttctctctcag

SEQ ID NO: 7628375 - DNA, 22 bp, Homo sapiens
cacacccaaattctaacagtag

SEQ ID NO: 7628376 - DNA, 22 bp, Homo sapiens
cacacccaaatttctctctcag

SEQ ID NO: 7628377 - DNA, 21 bp, Homo sapiens
cacaccaggcatgtcttgagc

SEQ ID NO: 7628378 - DNA, 22 bp, Homo sapiens
cacacccaaattctaacagtag

SEQ ID NO: 7628379 - DNA, 22 bp, Homo sapiens
cacacccaaattctaacagtag

SEQ ID NO: 7628380 - DNA, 23 bp, Homo sapiens
cacacccatcactaagagctcct

SEQ ID NO: 7628381 - DNA, 23 bp, Homo sapiens
cacacccatcactaagagctcct

SEQ ID NO: 7628382 - DNA, 22 bp, Homo sapiens
cacacccaaatttctctctcag

SEQ ID NO: 7628383 - DNA, 23 bp, Homo sapiens
cacacccatcactaagagctcct

SEQ ID NO: 7628384 - DNA, 23 bp, Homo sapiens
cacacccatcactaagagctcct

SEQ ID NO: 7628385 - DNA, 22 bp, Homo sapiens
cacacccaaatttctctctcag

SEQ ID NO: 7628386 - DNA, 22 bp, Homo sapiens
cacacccaaatttctctctcag

SEQ ID NO: 7628387 - DNA, 19 bp, Homo sapiens
cacacccatgcttgccaag

SEQ ID NO: 7628388 - DNA, 22 bp, Homo sapiens
cacacccttgctaacacttgtt

SEQ ID NO: 7628389 - DNA, 22 bp, Homo sapiens
cacaccctcgtgctccctcccg

SEQ ID NO: 7628390 - DNA, 19 bp, Homo sapiens
cacacccatgcttgccaag

SEQ ID NO: 7628391 - DNA, 19 bp, Homo sapiens
cacacccatgcttgccaag

SEQ ID NO: 7628392 - DNA, 19 bp, Homo sapiens
cacacccatgcttgccaag

SEQ ID NO: 7628393 - DNA, 19 bp, Homo sapiens
cacacccatgcttgccaag

SEQ ID NO: 7628394 - DNA, 23 bp, Homo sapiens
cacacccatcactaagagctcct

SEQ ID NO: 7628395 - DNA, 19 bp, Homo sapiens
cacaattatgagacactta

SEQ ID NO: 7628396 - DNA, 22 bp, Homo sapiens
cacaattatagaagaaagcata

SEQ ID NO: 7628397 - DNA, 19 bp, Homo sapiens
cacaattatgagacactta

SEQ ID NO: 7628398 - DNA, 19 bp, Homo sapiens
cacaattatgagacactta

SEQ ID NO: 7628399 - DNA, 19 bp, Homo sapiens
cacaattatgagacactta

SEQ ID NO: 7628400 - DNA, 19 bp, Homo sapiens
cacaattatgagacactta

SEQ ID NO: 7628401 - DNA, 22 bp, Homo sapiens
cacaattagcagctctttattt

SEQ ID NO: 7628402 - DNA, 22 bp, Homo sapiens
cacaattagcagctctttattt

SEQ ID NO: 7628403 - DNA, 22 bp, Homo sapiens
cacaattagcagctctttattt

SEQ ID NO: 7628404 - DNA, 22 bp, Homo sapiens
cacaattatagaagaaagcata

SEQ ID NO: 7628405 - DNA, 22 bp, Homo sapiens
cacaattatagaagaaagcata

SEQ ID NO: 7628406 - DNA, 22 bp, Homo sapiens
cacaattatagaagaaagcata

SEQ ID NO: 7628407 - DNA, 19 bp, Homo sapiens
cacaattatgagacactta

SEQ ID NO: 7628408 - DNA, 19 bp, Homo sapiens
cacaattatgagacactta

SEQ ID NO: 7628409 - DNA, 22 bp, Homo sapiens
cacaattattatctctttctac

SEQ ID NO: 7628410 - DNA, 22 bp, Homo sapiens
cacaattattatctctttctac

SEQ ID NO: 7628411 - DNA, 22 bp, Homo sapiens
cacaattattatctctttctac

SEQ ID NO: 7628412 - DNA, 22 bp, Homo sapiens
cacaattattatctctttctac

SEQ ID NO: 7628413 - DNA, 22 bp, Homo sapiens
cacaattattatctctttctac

SEQ ID NO: 7628414 - DNA, 22 bp, Homo sapiens
cacaattccatggcattctttg

SEQ ID NO: 7628415 - DNA, 22 bp, Homo sapiens
cacaattccatggcattctttg

SEQ ID NO: 7628416 - DNA, 22 bp, Homo sapiens
cacaattccatggcattctttg

SEQ ID NO: 7628417 - DNA, 22 bp, Homo sapiens
cacaattctatcagaaagcaga

SEQ ID NO: 7628418 - DNA, 22 bp, Homo sapiens
cacaattctatcagaaagcaga

SEQ ID NO: 7628419 - DNA, 22 bp, Homo sapiens
cacaatttccaagtcatgttat

SEQ ID NO: 7628420 - DNA, 22 bp, Homo sapiens
cacaatttccaagtcatgttat

SEQ ID NO: 7628421 - DNA, 22 bp, Homo sapiens
cacaatttcagttgcatgcaac

SEQ ID NO: 7628422 - DNA, 22 bp, Homo sapiens
cacaatttcagttgcatgcaac

SEQ ID NO: 7628423 - DNA, 22 bp, Homo sapiens
cacaatttcagttgcatgcaac

SEQ ID NO: 7628424 - DNA, 22 bp, Homo sapiens
cacaatttccaagtcatgttat

SEQ ID NO: 7628425 - DNA, 22 bp, Homo sapiens
cacaatttccaagtcatgttat

SEQ ID NO: 7628426 - DNA, 18 bp, Homo sapiens
cacaatttacagatgaca

SEQ ID NO: 7628427 - DNA, 18 bp, Homo sapiens
cacaatttacagatgaca

SEQ ID NO: 7628428 - DNA, 18 bp, Homo sapiens
cacaatttacagatgaca

SEQ ID NO: 7628429 - DNA, 18 bp, Homo sapiens
cacaatttacagatgaca

SEQ ID NO: 7628430 - DNA, 18 bp, Homo sapiens
cacaatttacagatgaca

SEQ ID NO: 7628431 - DNA, 18 bp, Homo sapiens
cacaatttacagatgaca

SEQ ID NO: 7628432 - DNA, 22 bp, Homo sapiens
cacacattaatatcaaaggctc

SEQ ID NO: 7628433 - DNA, 22 bp, Homo sapiens
cacacattagagccaatgtcag

SEQ ID NO: 7628434 - DNA, 22 bp, Homo sapiens
cacacattagagccaatgtcag

SEQ ID NO: 7628435 - DNA, 22 bp, Homo sapiens
cacacatcaacctagacattgt

SEQ ID NO: 7628436 - DNA, 22 bp, Homo sapiens
cacacatcaacctagacattgt

SEQ ID NO: 7628437 - DNA, 22 bp, Homo sapiens
cacacatcaacctagacattgt

SEQ ID NO: 7628438 - DNA, 22 bp, Homo sapiens
cacacattaatatcaaaggctc

SEQ ID NO: 7628439 - DNA, 22 bp, Homo sapiens
cacacattaatatcaaaggctc

SEQ ID NO: 7628440 - DNA, 22 bp, Homo sapiens
cacaatttgttttatcagtatt

SEQ ID NO: 7628441 - DNA, 22 bp, Homo sapiens
cacaatttgttttatcagtatt

SEQ ID NO: 7628442 - DNA, 22 bp, Homo sapiens
cacaatttgttttatcagtatt

SEQ ID NO: 7628443 - DNA, 22 bp, Homo sapiens
cacaatttgttttatcagtatt

SEQ ID NO: 7628444 - DNA, 22 bp, Homo sapiens
cacaatttgttttatcagtatt

SEQ ID NO: 7628445 - DNA, 22 bp, Homo sapiens
cacacatattgtccctagtgtg

SEQ ID NO: 7628446 - DNA, 22 bp, Homo sapiens
cacacatattgtccctagtgtg

SEQ ID NO: 7628447 - DNA, 22 bp, Homo sapiens
cacacatattgtccctagtgtg

SEQ ID NO: 7628448 - DNA, 22 bp, Homo sapiens
cacaatttggtgctaaagaaag

SEQ ID NO: 7628449 - DNA, 22 bp, Homo sapiens
cacaatttggtgctaaagaaag

SEQ ID NO: 7628450 - DNA, 22 bp, Homo sapiens
cacaatttggtgctaaagaaag

SEQ ID NO: 7628451 - DNA, 22 bp, Homo sapiens
cacaatttggtgctaaagaaag

SEQ ID NO: 7628452 - DNA, 22 bp, Homo sapiens
cacaatttggggtgcccactgt

SEQ ID NO: 7628453 - DNA, 22 bp, Homo sapiens
cacaatttggtgctaaagaaag

SEQ ID NO: 7628454 - DNA, 22 bp, Homo sapiens
cacaatttggacttcactggtt

SEQ ID NO: 7628455 - DNA, 22 bp, Homo sapiens
cacaatttccttgcttcacttt

SEQ ID NO: 7628456 - DNA, 22 bp, Homo sapiens
cacaatttccttgcttcacttt

SEQ ID NO: 7628457 - DNA, 22 bp, Homo sapiens
gcttctccagaccttcatcccc

SEQ ID NO: 7628458 - DNA, 15 bp, Homo sapiens
gcttctccagatgac

SEQ ID NO: 7628459 - DNA, 22 bp, Homo sapiens
gcttctccagaccttcatcccc

SEQ ID NO: 7628460 - DNA, 22 bp, Homo sapiens
gcttctccagaccttcatcccc

SEQ ID NO: 7628461 - DNA, 22 bp, Homo sapiens
gcttctccctacagatgtcagt

SEQ ID NO: 7628462 - DNA, 22 bp, Homo sapiens
gcttctccctacagatgtcagt

SEQ ID NO: 7628463 - DNA, 22 bp, Homo sapiens
gcttctccctacagatgtcagt

SEQ ID NO: 7628464 - DNA, 22 bp, Homo sapiens
gcttctccctacagatgtcagt

SEQ ID NO: 7628465 - DNA, 22 bp, Homo sapiens
gcttctcctcccgctcccaggc

SEQ ID NO: 7628466 - DNA, 22 bp, Homo sapiens
gcttctcctcccgctcccaggc

SEQ ID NO: 7628467 - DNA, 22 bp, Homo sapiens
gcttctcctcccgctcccaggc

SEQ ID NO: 7628468 - DNA, 22 bp, Homo sapiens
gcttctcctcccgctcccaggc

SEQ ID NO: 7628469 - DNA, 22 bp, Homo sapiens
gcttctcgggcctgatgtcgtc

SEQ ID NO: 7628470 - DNA, 22 bp, Homo sapiens
gcttctctcaggagcatcagcc

SEQ ID NO: 7628471 - DNA, 22 bp, Homo sapiens
gcttctcttaatgcctggcttt

SEQ ID NO: 7628472 - DNA, 22 bp, Homo sapiens
gcttctcttaatgcctggcttt

SEQ ID NO: 7628473 - DNA, 22 bp, Homo sapiens
gcttctcttaatgcctggcttt

SEQ ID NO: 7628474 - DNA, 22 bp, Homo sapiens
gcttctctggctggtctgccac

SEQ ID NO: 7628475 - DNA, 22 bp, Homo sapiens
gcttctctggctggtctgccac

SEQ ID NO: 7628476 - DNA, 22 bp, Homo sapiens
gcttctctcaggagcatcagcc

SEQ ID NO: 7628477 - DNA, 22 bp, Homo sapiens
gcttctctcaggagcatcagcc

SEQ ID NO: 7628478 - DNA, 22 bp, Homo sapiens
gcttctctcaggagcatcagcc

SEQ ID NO: 7628479 - DNA, 22 bp, Homo sapiens
gcttctctcaggagcatcagcc

SEQ ID NO: 7628480 - DNA, 22 bp, Homo sapiens
gcttctctctcagactgcaagc

SEQ ID NO: 7628481 - DNA, 22 bp, Homo sapiens
gctgtggcctggcgcagagctg

SEQ ID NO: 7628482 - DNA, 22 bp, Homo sapiens
gctgtggcctggcgcagagctg

SEQ ID NO: 7628483 - DNA, 22 bp, Homo sapiens
gcttccaggggctgtgggctga

SEQ ID NO: 7628484 - DNA, 22 bp, Homo sapiens
gcttccaggggctgtgggctga

SEQ ID NO: 7628485 - DNA, 22 bp, Homo sapiens
gcttccaggggctgtgggctga

SEQ ID NO: 7628486 - DNA, 22 bp, Homo sapiens
gcttccaggtcattctcaccct

SEQ ID NO: 7628487 - DNA, 22 bp, Homo sapiens
gcttccaggtcattctcaccct

SEQ ID NO: 7628488 - DNA, 22 bp, Homo sapiens
gcttccagggtgggggatgttt

SEQ ID NO: 7628489 - DNA, 22 bp, Homo sapiens
gcttccaggggtgctttgaagg

SEQ ID NO: 7628490 - DNA, 22 bp, Homo sapiens
gcttccagggtgggggatgttt

SEQ ID NO: 7628491 - DNA, 22 bp, Homo sapiens
gcttccagggtgggggatgttt

SEQ ID NO: 7628492 - DNA, 22 bp, Homo sapiens
gcttccagggtgggggatgttt

SEQ ID NO: 7628493 - DNA, 22 bp, Homo sapiens
gcttctccagaccttcatcccc

SEQ ID NO: 7628494 - DNA, 22 bp, Homo sapiens
gcttctcatgtttatttttaca

SEQ ID NO: 7628495 - DNA, 18 bp, Homo sapiens
gcttctcatttctaagca

SEQ ID NO: 7628496 - DNA, 20 bp, Homo sapiens
gcttctcagggcttctctga

SEQ ID NO: 7628497 - DNA, 22 bp, Homo sapiens
gcttctcatgtttatttttaca

SEQ ID NO: 7628498 - DNA, 22 bp, Homo sapiens
gctgtggcctccagcactcccc

SEQ ID NO: 7628499 - DNA, 20 bp, Homo sapiens
gctgtggccgtgccagactc

SEQ ID NO: 7628500 - DNA, 20 bp, Homo sapiens
gctgtggccgtgccagactc

SEQ ID NO: 7628501 - DNA, 22 bp, Homo sapiens
gctgtggcctagtttgttatat

SEQ ID NO: 7628502 - DNA, 22 bp, Homo sapiens
gctgtggccgggcccaggccgc

SEQ ID NO: 7628503 - DNA, 22 bp, Homo sapiens
gctgtggcccttggcatctgcg

SEQ ID NO: 7628504 - DNA, 22 bp, Homo sapiens
gctgtggcccttggcatctgcg

SEQ ID NO: 7628505 - DNA, 22 bp, Homo sapiens
gctgtggcccttggcatctgcg

SEQ ID NO: 7628506 - DNA, 22 bp, Homo sapiens
gctgtggcccttggcatctgcg

SEQ ID NO: 7628507 - DNA, 22 bp, Homo sapiens
gctgtggccgggcccaggccgc

SEQ ID NO: 7628508 - DNA, 22 bp, Homo sapiens
gctgtggccgtcagggaaatgg

SEQ ID NO: 7628509 - DNA, 22 bp, Homo sapiens
gctgtggccgtcagggaaatgg

SEQ ID NO: 7628510 - DNA, 22 bp, Homo sapiens
cacaaaagtaggaggcaggcgg

SEQ ID NO: 7628511 - DNA, 22 bp, Homo sapiens
cacaaaatatcaagcactttta

SEQ ID NO: 7628512 - DNA, 22 bp, Homo sapiens
cacaaaagtaggaggcaggcgg

SEQ ID NO: 7628513 - DNA, 22 bp, Homo sapiens
cacaaaagtaggaggcaggcgg

SEQ ID NO: 7628514 - DNA, 22 bp, Homo sapiens
caatttctctttatatctcaca

SEQ ID NO: 7628515 - DNA, 22 bp, Homo sapiens
gcttgggatatgctgatgtaaa

SEQ ID NO: 7628516 - DNA, 17 bp, Homo sapiens
gcttgggctgcctgttg

SEQ ID NO: 7628517 - DNA, 17 bp, Homo sapiens
gcttgggctgcctgttg

SEQ ID NO: 7628518 - DNA, 17 bp, Homo sapiens
gcttgggctgcctgttg

SEQ ID NO: 7628519 - DNA, 22 bp, Homo sapiens
caatttctcgaactctaatcca

SEQ ID NO: 7628520 - DNA, 19 bp, Homo sapiens
gcttgggagagggagctaa

SEQ ID NO: 7628521 - DNA, 19 bp, Homo sapiens
gcttgggagagggagctaa

SEQ ID NO: 7628522 - DNA, 22 bp, Homo sapiens
gcttggctttgtcttgttcact

SEQ ID NO: 7628523 - DNA, 22 bp, Homo sapiens
gcttggctttactagggggaca

SEQ ID NO: 7628524 - DNA, 22 bp, Homo sapiens
gcttggcttgggctcagaggcc

SEQ ID NO: 7628525 - DNA, 22 bp, Homo sapiens
gcttggctgtgttcaagggcgg

SEQ ID NO: 7628526 - DNA, 22 bp, Homo sapiens
gcttggcttgggctcagaggcc

SEQ ID NO: 7628527 - DNA, 22 bp, Homo sapiens
gcttggctgtgagctttgctgt

SEQ ID NO: 7628528 - DNA, 22 bp, Homo sapiens
gcttggctggagaaagttacct

SEQ ID NO: 7628529 - DNA, 22 bp, Homo sapiens
gcttggctggagaaagttacct

SEQ ID NO: 7628530 - DNA, 22 bp, Homo sapiens
gcttgggaaactggggaaacca

SEQ ID NO: 7628531 - DNA, 22 bp, Homo sapiens
gcttgggaagggccctgtgtac

SEQ ID NO: 7628532 - DNA, 19 bp, Homo sapiens
gcttgggagagggagctaa

SEQ ID NO: 7628533 - DNA, 22 bp, Homo sapiens
gcttgggagaggcttcctcttt

SEQ ID NO: 7628534 - DNA, 22 bp, Homo sapiens
gcttggccagcagccgggatgc

SEQ ID NO: 7628535 - DNA, 22 bp, Homo sapiens
gcttggccagcagccgggatgc

SEQ ID NO: 7628536 - DNA, 22 bp, Homo sapiens
gcttggccagcagccgggatgc

SEQ ID NO: 7628537 - DNA, 22 bp, Homo sapiens
gcttggctcctggctcacaggt

SEQ ID NO: 7628538 - DNA, 22 bp, Homo sapiens
gcttggcccattgatcagctgg

SEQ ID NO: 7628539 - DNA, 22 bp, Homo sapiens
gcttggcccattgatcagctgg

SEQ ID NO: 7628540 - DNA, 22 bp, Homo sapiens
gcttggcccattgatcagctgg

SEQ ID NO: 7628541 - DNA, 22 bp, Homo sapiens
gcttggccagcagccgggatgc

SEQ ID NO: 7628542 - DNA, 22 bp, Homo sapiens
gcttggccagcagccgggatgc

SEQ ID NO: 7628543 - DNA, 22 bp, Homo sapiens
gcttggccagcagccgggatgc

SEQ ID NO: 7628544 - DNA, 22 bp, Homo sapiens
gcttggctggaaataggttgag

SEQ ID NO: 7628545 - DNA, 22 bp, Homo sapiens
gcttggctggaaataggttgag

SEQ ID NO: 7628546 - DNA, 22 bp, Homo sapiens
gcttggctggaaataggttgag

SEQ ID NO: 7628547 - DNA, 22 bp, Homo sapiens
gcttggctgcctttggatgttg

SEQ ID NO: 7628548 - DNA, 22 bp, Homo sapiens
gcttggctgcctttggatgttg

SEQ ID NO: 7628549 - DNA, 18 bp, Homo sapiens
gcttggctgcagagagag

SEQ ID NO: 7628550 - DNA, 18 bp, Homo sapiens
gcttggctgcagagagag

SEQ ID NO: 7628551 - DNA, 22 bp, Homo sapiens
gcttggctctaagacacctatt

SEQ ID NO: 7628552 - DNA, 22 bp, Homo sapiens
gcttggctctaagacacctatt

SEQ ID NO: 7628553 - DNA, 22 bp, Homo sapiens
gcttggctcctggctcacaggt

SEQ ID NO: 7628554 - DNA, 22 bp, Homo sapiens
gcttggctcctggctcacaggt

SEQ ID NO: 7628555 - DNA, 22 bp, Homo sapiens
gcttggctcctggctcacaggt

SEQ ID NO: 7628556 - DNA, 22 bp, Homo sapiens
gcttggccaacatggtgaaacc

SEQ ID NO: 7628557 - DNA, 22 bp, Homo sapiens
gcttggccagcagccgggatgc

SEQ ID NO: 7628558 - DNA, 22 bp, Homo sapiens
gcttggcatttgctgggagctg

SEQ ID NO: 7628559 - DNA, 22 bp, Homo sapiens
gcttggcatttgctgggagctg

SEQ ID NO: 7628560 - DNA, 22 bp, Homo sapiens
gcttggcatttgctgggagctg

SEQ ID NO: 7628561 - DNA, 22 bp, Homo sapiens
gcttggcatttgctgggagctg

SEQ ID NO: 7628562 - DNA, 22 bp, Homo sapiens
gcttggcagtgggtcctgcctt

SEQ ID NO: 7628563 - DNA, 22 bp, Homo sapiens
gcttggcagtgggtcctgcctt

SEQ ID NO: 7628564 - DNA, 20 bp, Homo sapiens
gcttggcataggccacttga

SEQ ID NO: 7628565 - DNA, 22 bp, Homo sapiens
gcttggcatacacttagtgcgt

SEQ ID NO: 7628566 - DNA, 22 bp, Homo sapiens
gcttggcatatacttagtgcat

SEQ ID NO: 7628567 - DNA, 22 bp, Homo sapiens
gcttggcattgaccattatcat

SEQ ID NO: 7628568 - DNA, 22 bp, Homo sapiens
gcttggcattggtttctctaag

SEQ ID NO: 7628569 - DNA, 22 bp, Homo sapiens
gcttctgaggaaggctcagcct

SEQ ID NO: 7628570 - DNA, 22 bp, Homo sapiens
gcttctgaggaaggctcagcct

SEQ ID NO: 7628571 - DNA, 22 bp, Homo sapiens
gcttctctttctcccctggcgg

SEQ ID NO: 7628572 - DNA, 22 bp, Homo sapiens
gcttctctttctcccctggcgg

SEQ ID NO: 7628573 - DNA, 22 bp, Homo sapiens
gcttctctttctcccctggcgg

SEQ ID NO: 7628574 - DNA, 22 bp, Homo sapiens
gcttctcttaatgcctggcttt

SEQ ID NO: 7628575 - DNA, 22 bp, Homo sapiens
gcttctcttaatgcctggcttt

SEQ ID NO: 7628576 - DNA, 22 bp, Homo sapiens
gcttctcttgtccaagggcagg

SEQ ID NO: 7628577 - DNA, 22 bp, Homo sapiens
caaggcagctattgtctccata

SEQ ID NO: 7628578 - DNA, 22 bp, Homo sapiens
caaggcagctgtagggatttgg

SEQ ID NO: 7628579 - DNA, 22 bp, Homo sapiens
caaggcagctgtagggatttgg

SEQ ID NO: 7628580 - DNA, 22 bp, Homo sapiens
caaggcagctgtagggatttgg

SEQ ID NO: 7628581 - DNA, 22 bp, Homo sapiens
caaggcagctattgtctccata

SEQ ID NO: 7628582 - DNA, 22 bp, Homo sapiens
gctgtaaataagcttacttgaa

SEQ ID NO: 7628583 - DNA, 22 bp, Homo sapiens
caaggcagcgttcctttctgga

SEQ ID NO: 7628584 - DNA, 22 bp, Homo sapiens
caaggcagcgttcctttctgga

SEQ ID NO: 7628585 - DNA, 22 bp, Homo sapiens
caaggcagctattgtctccata

SEQ ID NO: 7628586 - DNA, 22 bp, Homo sapiens
caaggcagcgttcctttctgga

SEQ ID NO: 7628587 - DNA, 22 bp, Homo sapiens
caaggcagctattgtctccata

SEQ ID NO: 7628588 - DNA, 22 bp, Homo sapiens
caaggcagctattgtctccata

SEQ ID NO: 7628589 - DNA, 22 bp, Homo sapiens
caaggcagctattgtctccata

SEQ ID NO: 7628590 - DNA, 22 bp, Homo sapiens
caaggcagctattgtctccata

SEQ ID NO: 7628591 - DNA, 22 bp, Homo sapiens
gctgtctcgcctgacactggct

SEQ ID NO: 7628592 - DNA, 22 bp, Homo sapiens
gctgtctcgcctgacactggct

SEQ ID NO: 7628593 - DNA, 21 bp, Homo sapiens
gctgtctcctccttgcaccag

SEQ ID NO: 7628594 - DNA, 22 bp, Homo sapiens
gctgtctccccgcacccgaccg

SEQ ID NO: 7628595 - DNA, 22 bp, Homo sapiens
caaggcagctgtagggatttgg

SEQ ID NO: 7628596 - DNA, 22 bp, Homo sapiens
gctgtctccccgcacccgaccg

SEQ ID NO: 7628597 - DNA, 21 bp, Homo sapiens
gctgtctcctccttgcaccag

SEQ ID NO: 7628598 - DNA, 21 bp, Homo sapiens
gctgtctcctccttgcaccag

SEQ ID NO: 7628599 - DNA, 22 bp, Homo sapiens
gctgtacaaattccacaagaga

SEQ ID NO: 7628600 - DNA, 22 bp, Homo sapiens
gctgtacaaattccacaagaga

SEQ ID NO: 7628601 - DNA, 22 bp, Homo sapiens
gctgtacaaattccacaagaga

SEQ ID NO: 7628602 - DNA, 22 bp, Homo sapiens
gctgtacaaggcctctgccatc

SEQ ID NO: 7628603 - DNA, 22 bp, Homo sapiens
gctgtacaaggcctctgccatc

SEQ ID NO: 7628604 - DNA, 22 bp, Homo sapiens
gctgtacaaggcctctgccatc

SEQ ID NO: 7628605 - DNA, 23 bp, Homo sapiens
gctgtacaggaaccagtttggag

SEQ ID NO: 7628606 - DNA, 22 bp, Homo sapiens
gctgtacaaattccacaagaga

SEQ ID NO: 7628607 - DNA, 22 bp, Homo sapiens
gctgtctcatgggtgctagtcc

SEQ ID NO: 7628608 - DNA, 22 bp, Homo sapiens
gctgtctccatagctgtgtgtc

SEQ ID NO: 7628609 - DNA, 22 bp, Homo sapiens
gctgtctccatagctgtgtgtc

SEQ ID NO: 7628610 - DNA, 20 bp, Homo sapiens
caaggcagaccagagtgagt

SEQ ID NO: 7628611 - DNA, 20 bp, Homo sapiens
caaggcagaccagagtgagt

SEQ ID NO: 7628612 - DNA, 20 bp, Homo sapiens
caaggcagaccagagtgagt

SEQ ID NO: 7628613 - DNA, 20 bp, Homo sapiens
caaggcagaccagagtgagt

SEQ ID NO: 7628614 - DNA, 20 bp, Homo sapiens
caaggcagaccagagtgagt

SEQ ID NO: 7628615 - DNA, 20 bp, Homo sapiens
caaggcagaccagagtgagt

SEQ ID NO: 7628616 - DNA, 20 bp, Homo sapiens
caaggcagaccagagtgagt

SEQ ID NO: 7628617 - DNA, 20 bp, Homo sapiens
caaggcagaccagagtgagt

SEQ ID NO: 7628618 - DNA, 22 bp, Homo sapiens
caaggcagcccgctgaaccaca

SEQ ID NO: 7628619 - DNA, 22 bp, Homo sapiens
caaggcagcgttcctttctgga

SEQ ID NO: 7628620 - DNA, 22 bp, Homo sapiens
caaggcagcgttcctttctgga

SEQ ID NO: 7628621 - DNA, 22 bp, Homo sapiens
caaggcagcgttcctttctgga

SEQ ID NO: 7628622 - DNA, 22 bp, Homo sapiens
caaggcagcccgctgaaccaca

SEQ ID NO: 7628623 - DNA, 22 bp, Homo sapiens
caaggcagcccgctgaaccaca

SEQ ID NO: 7628624 - DNA, 22 bp, Homo sapiens
caaggcagcccgctgaaccaca

SEQ ID NO: 7628625 - DNA, 22 bp, Homo sapiens
caaggcagcccgctgaaccaca

SEQ ID NO: 7628626 - DNA, 22 bp, Homo sapiens
caaggcagaattcagactcagg

SEQ ID NO: 7628627 - DNA, 22 bp, Homo sapiens
caaggcagaattcagactcagg

SEQ ID NO: 7628628 - DNA, 22 bp, Homo sapiens
caaggcagaattcagactcagg

SEQ ID NO: 7628629 - DNA, 22 bp, Homo sapiens
caaggaggaagatgcaggggac

SEQ ID NO: 7628630 - DNA, 22 bp, Homo sapiens
caaggcaatctcatggcttctt

SEQ ID NO: 7628631 - DNA, 20 bp, Homo sapiens
caaggcagaccagagtgagt

SEQ ID NO: 7628632 - DNA, 22 bp, Homo sapiens
caaggcagaattcagactcagg

SEQ ID NO: 7628633 - DNA, 20 bp, Homo sapiens
caaggcagaccagagtgagt

SEQ ID NO: 7628634 - DNA, 22 bp, Homo sapiens
caaggcagaattcagactcagg

SEQ ID NO: 7628635 - DNA, 22 bp, Homo sapiens
caaggcagaattcagactcagg

SEQ ID NO: 7628636 - DNA, 22 bp, Homo sapiens
caaggcaatctcatggcttctt

SEQ ID NO: 7628637 - DNA, 22 bp, Homo sapiens
caaggattttgattgtttgaaa

SEQ ID NO: 7628638 - DNA, 22 bp, Homo sapiens
caaggattttgattgtttgaaa

SEQ ID NO: 7628639 - DNA, 22 bp, Homo sapiens
caaggatttcactggaaagcct

SEQ ID NO: 7628640 - DNA, 22 bp, Homo sapiens
caaggattaatagaatgaatca

SEQ ID NO: 7628641 - DNA, 22 bp, Homo sapiens
caaggattctcactagactaga

SEQ ID NO: 7628642 - DNA, 22 bp, Homo sapiens
caaggatctcagctcactccct

SEQ ID NO: 7628643 - DNA, 22 bp, Homo sapiens
caaggattaatagaatgaatca

SEQ ID NO: 7628644 - DNA, 22 bp, Homo sapiens
caaggaggcagtgggacttgaa

SEQ ID NO: 7628645 - DNA, 22 bp, Homo sapiens
gctgtgctgtttccacctctct

SEQ ID NO: 7628646 - DNA, 22 bp, Homo sapiens
gctgtctgctgggtcgctcagg

SEQ ID NO: 7628647 - DNA, 22 bp, Homo sapiens
gctgtgctgcgggaggattccg

SEQ ID NO: 7628648 - DNA, 22 bp, Homo sapiens
gctgtgctgcgggaggattccg

SEQ ID NO: 7628649 - DNA, 22 bp, Homo sapiens
gctgtgctgcgggaggattccg

SEQ ID NO: 7628650 - DNA, 22 bp, Homo sapiens
gctgtgctggaaggggacctgc

SEQ ID NO: 7628651 - DNA, 22 bp, Homo sapiens
gctgtctgccgcaggctgccac

SEQ ID NO: 7628652 - DNA, 22 bp, Homo sapiens
gctgtctgccgcaggctgccac

SEQ ID NO: 7628653 - DNA, 22 bp, Homo sapiens
gctgtgctgattcattccctgc

SEQ ID NO: 7628654 - DNA, 22 bp, Homo sapiens
gctgtggagtacagagctggtt

SEQ ID NO: 7628655 - DNA, 22 bp, Homo sapiens
gctgtggagtacagagctggtt

SEQ ID NO: 7628656 - DNA, 18 bp, Homo sapiens
gctgtggaagtctttata

SEQ ID NO: 7628657 - DNA, 22 bp, Homo sapiens
gctgtggaaatgcctaacatga

SEQ ID NO: 7628658 - DNA, 22 bp, Homo sapiens
gctgtgcttgggaagaatctct

SEQ ID NO: 7628659 - DNA, 22 bp, Homo sapiens
gctgtgcttgcatgagtgtctg

SEQ ID NO: 7628660 - DNA, 22 bp, Homo sapiens
gctgtgcttgcatgagtgtctg

SEQ ID NO: 7628661 - DNA, 22 bp, Homo sapiens
gctgtgcttgcatgagtgtctg

SEQ ID NO: 7628662 - DNA, 22 bp, Homo sapiens
gctgtgcttgcatgagtgtctg

SEQ ID NO: 7628663 - DNA, 22 bp, Homo sapiens
gctgtgcttgggaagaatctct

SEQ ID NO: 7628664 - DNA, 22 bp, Homo sapiens
gctgtggcaatgtttataatta

SEQ ID NO: 7628665 - DNA, 20 bp, Homo sapiens
gctgtggcaagtgctcactg

SEQ ID NO: 7628666 - DNA, 20 bp, Homo sapiens
gctgtggcaagtgctcactg

SEQ ID NO: 7628667 - DNA, 20 bp, Homo sapiens
gctgtggcaagtgctcactg

SEQ ID NO: 7628668 - DNA, 20 bp, Homo sapiens
gctgtggcaagtgctcactg

SEQ ID NO: 7628669 - DNA, 20 bp, Homo sapiens
gctgtggcaagtgctcactg

SEQ ID NO: 7628670 - DNA, 22 bp, Homo sapiens
gctgtggcccttggcatctgcg

SEQ ID NO: 7628671 - DNA, 22 bp, Homo sapiens
gctgtggcccttggcatctgcg

SEQ ID NO: 7628672 - DNA, 22 bp, Homo sapiens
gctgtggcccttggcatctgcg

SEQ ID NO: 7628673 - DNA, 20 bp, Homo sapiens
gctgtggcaaagctttgtgt

SEQ ID NO: 7628674 - DNA, 20 bp, Homo sapiens
gctgtggcaaagctttgtgt

SEQ ID NO: 7628675 - DNA, 20 bp, Homo sapiens
gctgtggcaaagctttgtgt

SEQ ID NO: 7628676 - DNA, 20 bp, Homo sapiens
gctgtggcaaagctttgtgt

SEQ ID NO: 7628677 - DNA, 20 bp, Homo sapiens
gctgtggcaaagctttgtgt

SEQ ID NO: 7628678 - DNA, 22 bp, Homo sapiens
gctgtggatgctatggatcatc

SEQ ID NO: 7628679 - DNA, 22 bp, Homo sapiens
gctgtggagtacagagctggtt

SEQ ID NO: 7628680 - DNA, 22 bp, Homo sapiens
gctgtggagtacagagctggtt

SEQ ID NO: 7628681 - DNA, 22 bp, Homo sapiens
gctgtctgcaagccaggaaatg

SEQ ID NO: 7628682 - DNA, 22 bp, Homo sapiens
gctgtctgcatctctagagctt

SEQ ID NO: 7628683 - DNA, 22 bp, Homo sapiens
gctgtctgccgcaggctgccac

SEQ ID NO: 7628684 - DNA, 22 bp, Homo sapiens
gctgtctgcatctctagagctt

SEQ ID NO: 7628685 - DNA, 22 bp, Homo sapiens
gctgtctgccgcaggctgccac

SEQ ID NO: 7628686 - DNA, 22 bp, Homo sapiens
gctgtctgcatctctagagctt

SEQ ID NO: 7628687 - DNA, 22 bp, Homo sapiens
gctgtctgcatctctagagctt

SEQ ID NO: 7628688 - DNA, 22 bp, Homo sapiens
gctgtctgagtaagagaatcct

SEQ ID NO: 7628689 - DNA, 18 bp, Homo sapiens
gctgtctgaggtctgagg

SEQ ID NO: 7628690 - DNA, 22 bp, Homo sapiens
gctgtctgagtaagagaatcct

SEQ ID NO: 7628691 - DNA, 19 bp, Homo sapiens
gctgtctgatgctgaggtc

SEQ ID NO: 7628692 - DNA, 19 bp, Homo sapiens
gctgtctgatgctgaggtc

SEQ ID NO: 7628693 - DNA, 19 bp, Homo sapiens
gctgtctgatgctgaggtc

SEQ ID NO: 7628694 - DNA, 19 bp, Homo sapiens
gctgtctgatgctgaggtc

SEQ ID NO: 7628695 - DNA, 19 bp, Homo sapiens
gctgtctgatgctgaggtc

SEQ ID NO: 7628696 - DNA, 19 bp, Homo sapiens
gctgtctgatgctgaggtc

SEQ ID NO: 7628697 - DNA, 19 bp, Homo sapiens
gctgtctgatgctgaggtc

SEQ ID NO: 7628698 - DNA, 22 bp, Homo sapiens
gctgtctcggggctttctcctg

SEQ ID NO: 7628699 - DNA, 22 bp, Homo sapiens
gctgtctcggggctttctcctg

SEQ ID NO: 7628700 - DNA, 22 bp, Homo sapiens
gctgtctcggggctttctcctg

SEQ ID NO: 7628701 - DNA, 22 bp, Homo sapiens
gctgtctcgcctgacactggct

SEQ ID NO: 7628702 - DNA, 22 bp, Homo sapiens
gctgtctcgcctgacactggct

SEQ ID NO: 7628703 - DNA, 20 bp, Homo sapiens
gctgtctgacagttcccaga

SEQ ID NO: 7628704 - DNA, 21 bp, Homo sapiens
gctgtctctggctcctgggaa

SEQ ID NO: 7628705 - DNA, 21 bp, Homo sapiens
gctgtctctggctcctgggaa

SEQ ID NO: 7628706 - DNA, 21 bp, Homo sapiens
gctgtctctggctcctgggaa

SEQ ID NO: 7628707 - DNA, 22 bp, Homo sapiens
gctgtctgagaacatggtggaa

SEQ ID NO: 7628708 - DNA, 22 bp, Homo sapiens
gctgtctgagaacatggtggaa

SEQ ID NO: 7628709 - DNA, 20 bp, Homo sapiens
gctgtctgacagttcccaga

SEQ ID NO: 7628710 - DNA, 20 bp, Homo sapiens
gctgtctgacagttcccaga

SEQ ID NO: 7628711 - DNA, 22 bp, Homo sapiens
gctgtctgagaacatggtggaa

SEQ ID NO: 7628712 - DNA, 22 bp, Homo sapiens
caagagctgcaaatagcgtgac

SEQ ID NO: 7628713 - DNA, 22 bp, Homo sapiens
caagagctgaggctggagaggt

SEQ ID NO: 7628714 - DNA, 22 bp, Homo sapiens
caagagctgcaaatagcgtgac

SEQ ID NO: 7628715 - DNA, 22 bp, Homo sapiens
caagagctgaggctggagaggt

SEQ ID NO: 7628716 - DNA, 22 bp, Homo sapiens
caagagctgaggctggagaggt

SEQ ID NO: 7628717 - DNA, 22 bp, Homo sapiens
caagagctgaggctggagaggt

SEQ ID NO: 7628718 - DNA, 22 bp, Homo sapiens
caagacaatgggtaagtgtaac

SEQ ID NO: 7628719 - DNA, 22 bp, Homo sapiens
caagagctcaccggagagcatt

SEQ ID NO: 7628720 - DNA, 22 bp, Homo sapiens
caagagctcaccggagagcatt

SEQ ID NO: 7628721 - DNA, 22 bp, Homo sapiens
caagagctcccagacctgggca

SEQ ID NO: 7628722 - DNA, 22 bp, Homo sapiens
caagagctcccagacctgggca

SEQ ID NO: 7628723 - DNA, 22 bp, Homo sapiens
caagagctcagaaacccttgct

SEQ ID NO: 7628724 - DNA, 22 bp, Homo sapiens
caagagctgaggctggagaggt

SEQ ID NO: 7628725 - DNA, 22 bp, Homo sapiens
caagacaatgggtaagtgtaac

SEQ ID NO: 7628726 - DNA, 22 bp, Homo sapiens
caagacaatgggtaagtgtaac

SEQ ID NO: 7628727 - DNA, 22 bp, Homo sapiens
caagacaatgggtaagtgtaac

SEQ ID NO: 7628728 - DNA, 22 bp, Homo sapiens
caagacaatgggtaagtgtaac

SEQ ID NO: 7628729 - DNA, 22 bp, Homo sapiens
gctgctggccccacatgctcca

SEQ ID NO: 7628730 - DNA, 22 bp, Homo sapiens
caagacaagatctaagcatgct

SEQ ID NO: 7628731 - DNA, 22 bp, Homo sapiens
caagacaagatctaagcatgct

SEQ ID NO: 7628732 - DNA, 22 bp, Homo sapiens
gctgctggccccacatgctcca

SEQ ID NO: 7628733 - DNA, 22 bp, Homo sapiens
gctgctggccccacatgctcca

SEQ ID NO: 7628734 - DNA, 22 bp, Homo sapiens
gctgctggcactggagtgagcc

SEQ ID NO: 7628735 - DNA, 22 bp, Homo sapiens
gctgctggcactggagtgagcc

SEQ ID NO: 7628736 - DNA, 22 bp, Homo sapiens
gctgctggcatctagggggtgg

SEQ ID NO: 7628737 - DNA, 22 bp, Homo sapiens
gctgctggcatctagggggtgg

SEQ ID NO: 7628738 - DNA, 22 bp, Homo sapiens
gctgctggcatctagggggtgg

SEQ ID NO: 7628739 - DNA, 22 bp, Homo sapiens
gctgctggcatctagggggtgg

SEQ ID NO: 7628740 - DNA, 22 bp, Homo sapiens
gctgctggccccacatgctcca

SEQ ID NO: 7628741 - DNA, 22 bp, Homo sapiens
gctgctggccccacatgctcca

SEQ ID NO: 7628742 - DNA, 22 bp, Homo sapiens
gctgctggccccacatgctcca

SEQ ID NO: 7628743 - DNA, 22 bp, Homo sapiens
gctgctggcatctagggggtgg

SEQ ID NO: 7628744 - DNA, 22 bp, Homo sapiens
gctgctggcatctagggggtgg

SEQ ID NO: 7628745 - DNA, 22 bp, Homo sapiens
gctgctggccccacatgctcca

SEQ ID NO: 7628746 - DNA, 22 bp, Homo sapiens
gctgccttttaaagcctcgctt

SEQ ID NO: 7628747 - DNA, 22 bp, Homo sapiens
gctgccttttaaagcctcgctt

SEQ ID NO: 7628748 - DNA, 22 bp, Homo sapiens
gctgcctttgtgagccaagggg

SEQ ID NO: 7628749 - DNA, 22 bp, Homo sapiens
gctgccttttgctcctcccacc

SEQ ID NO: 7628750 - DNA, 22 bp, Homo sapiens
gctgccttttaaagcctcgctt

SEQ ID NO: 7628751 - DNA, 22 bp, Homo sapiens
gctgccttttgctcctcccacc

SEQ ID NO: 7628752 - DNA, 22 bp, Homo sapiens
gctgctggaagcatgcgatgaa

SEQ ID NO: 7628753 - DNA, 22 bp, Homo sapiens
gctgctggaagcatgcgatgaa

SEQ ID NO: 7628754 - DNA, 22 bp, Homo sapiens
gctgctggagagcgagactgtt

SEQ ID NO: 7628755 - DNA, 22 bp, Homo sapiens
gctgctggagagcgagactgtt

SEQ ID NO: 7628756 - DNA, 22 bp, Homo sapiens
gctgctggagagcgagactgtt

SEQ ID NO: 7628757 - DNA, 22 bp, Homo sapiens
gctgctggagagcgagactgtt

SEQ ID NO: 7628758 - DNA, 22 bp, Homo sapiens
gctgctggagagcgagactgtt

SEQ ID NO: 7628759 - DNA, 22 bp, Homo sapiens
gctgctggagagcgagactgtt

SEQ ID NO: 7628760 - DNA, 22 bp, Homo sapiens
gctgctggagagcgagactgtt

SEQ ID NO: 7628761 - DNA, 22 bp, Homo sapiens
gctgctggagagcgagactgtt

SEQ ID NO: 7628762 - DNA, 22 bp, Homo sapiens
gctgctggagctttgcagaagg

SEQ ID NO: 7628763 - DNA, 22 bp, Homo sapiens
gctgctggagctttgcagaagg

SEQ ID NO: 7628764 - DNA, 22 bp, Homo sapiens
gctgctggagctttgcagaagg

SEQ ID NO: 7628765 - DNA, 22 bp, Homo sapiens
gctgctggagctttgcagaagg

SEQ ID NO: 7628766 - DNA, 22 bp, Homo sapiens
gctgctggagctttgcagaagg

SEQ ID NO: 7628767 - DNA, 22 bp, Homo sapiens
gctgctggagctttgcagaagg

SEQ ID NO: 7628768 - DNA, 22 bp, Homo sapiens
gctgctggagagcgagactgtt

SEQ ID NO: 7628769 - DNA, 22 bp, Homo sapiens
gctgctggagagcgagactgtt

SEQ ID NO: 7628770 - DNA, 22 bp, Homo sapiens
gctgctggatgcgcttgatggt

SEQ ID NO: 7628771 - DNA, 22 bp, Homo sapiens
gctgctggatgcgcttgatggt

SEQ ID NO: 7628772 - DNA, 22 bp, Homo sapiens
gctgctggatgcgcttgatggt

SEQ ID NO: 7628773 - DNA, 22 bp, Homo sapiens
gctgctggagctttgcagaagg

SEQ ID NO: 7628774 - DNA, 22 bp, Homo sapiens
gctgctggatgcgcttgatggt

SEQ ID NO: 7628775 - DNA, 22 bp, Homo sapiens
gctgctggatgcgcttgatggt

SEQ ID NO: 7628776 - DNA, 22 bp, Homo sapiens
gctgctggatgcgcttgatggt

SEQ ID NO: 7628777 - DNA, 22 bp, Homo sapiens
gctgctggagctttgcagaagg

SEQ ID NO: 7628778 - DNA, 22 bp, Homo sapiens
gctgctggagctttgcagaagg

SEQ ID NO: 7628779 - DNA, 22 bp, Homo sapiens
gctgctggatgcgcttgatggt

SEQ ID NO: 7628780 - DNA, 22 bp, Homo sapiens
gctgctggagctttgcagaagg

SEQ ID NO: 7628781 - DNA, 22 bp, Homo sapiens
gctgctggcactggagtgagcc

SEQ ID NO: 7628782 - DNA, 22 bp, Homo sapiens
gctgctggcactggagtgagcc

SEQ ID NO: 7628783 - DNA, 22 bp, Homo sapiens
gctgctggcactggagtgagcc

SEQ ID NO: 7628784 - DNA, 22 bp, Homo sapiens
gctgctggcactggagtgagcc

SEQ ID NO: 7628785 - DNA, 22 bp, Homo sapiens
gctgctggcactggagtgagcc

SEQ ID NO: 7628786 - DNA, 22 bp, Homo sapiens
gctgctggcactggagtgagcc

SEQ ID NO: 7628787 - DNA, 22 bp, Homo sapiens
gctgctggcactggagtgagcc

SEQ ID NO: 7628788 - DNA, 22 bp, Homo sapiens
gctgctggcactggagtgagcc

SEQ ID NO: 7628789 - DNA, 22 bp, Homo sapiens
gctgctggcactggagtgagcc

SEQ ID NO: 7628790 - DNA, 22 bp, Homo sapiens
caacctctatcggtcaggaagc

SEQ ID NO: 7628791 - DNA, 22 bp, Homo sapiens
caacctcatagaaagaaaatgt

SEQ ID NO: 7628792 - DNA, 22 bp, Homo sapiens
caacctctgtaatgttctagga

SEQ ID NO: 7628793 - DNA, 22 bp, Homo sapiens
caacctctggaaagtatggaca

SEQ ID NO: 7628794 - DNA, 22 bp, Homo sapiens
caacctctggaaagtatggaca

SEQ ID NO: 7628795 - DNA, 22 bp, Homo sapiens
caacctctatcggtcaggaagc

SEQ ID NO: 7628796 - DNA, 22 bp, Homo sapiens
caacctcatagaaagaaaatgt

SEQ ID NO: 7628797 - DNA, 22 bp, Homo sapiens
caacctcatagaaagaaaatgt

SEQ ID NO: 7628798 - DNA, 22 bp, Homo sapiens
caaccccactacacgttggaga

SEQ ID NO: 7628799 - DNA, 22 bp, Homo sapiens
caaccccactacacgttggaga

SEQ ID NO: 7628800 - DNA, 22 bp, Homo sapiens
caacctctttgggccttggttt

SEQ ID NO: 7628801 - DNA, 22 bp, Homo sapiens
caacctctgtaatgttctagga

SEQ ID NO: 7628802 - DNA, 22 bp, Homo sapiens
caacctgaattctgctttggca

SEQ ID NO: 7628803 - DNA, 22 bp, Homo sapiens
caacctgaattctgctttggca

SEQ ID NO: 7628804 - DNA, 22 bp, Homo sapiens
caacctgacaagactatgagta

SEQ ID NO: 7628805 - DNA, 22 bp, Homo sapiens
caacctgacaagactatgagta

SEQ ID NO: 7628806 - DNA, 22 bp, Homo sapiens
caacctgacaaggttaatgaat

SEQ ID NO: 7628807 - DNA, 22 bp, Homo sapiens
caacctgacaaggttaatgaat

SEQ ID NO: 7628808 - DNA, 22 bp, Homo sapiens
caacctgacaaggttaatgaat

SEQ ID NO: 7628809 - DNA, 22 bp, Homo sapiens
caacctgagactccaggcacct

SEQ ID NO: 7628810 - DNA, 22 bp, Homo sapiens
caacctgagactccaggcacct

SEQ ID NO: 7628811 - DNA, 22 bp, Homo sapiens
caacctgagactccaggcacct

SEQ ID NO: 7628812 - DNA, 21 bp, Homo sapiens
caacctgagctgaacccgtgc

SEQ ID NO: 7628813 - DNA, 21 bp, Homo sapiens
caacctgagctgaacccgtgc

SEQ ID NO: 7628814 - DNA, 22 bp, Homo sapiens
caacctgatgaattgaatttaa

SEQ ID NO: 7628815 - DNA, 22 bp, Homo sapiens
caacctgatgaattgaatttaa

SEQ ID NO: 7628816 - DNA, 22 bp, Homo sapiens
gctgccttccaaagagttttat

SEQ ID NO: 7628817 - DNA, 22 bp, Homo sapiens
gctgccttccataatgtacgta

SEQ ID NO: 7628818 - DNA, 22 bp, Homo sapiens
gctgccttccataatgtacgta

SEQ ID NO: 7628819 - DNA, 22 bp, Homo sapiens
gctgcctgccttgcctggagga

SEQ ID NO: 7628820 - DNA, 22 bp, Homo sapiens
gctgcctgccttgcctggagga

SEQ ID NO: 7628821 - DNA, 22 bp, Homo sapiens
caacggctctggcttccaggcg

SEQ ID NO: 7628822 - DNA, 22 bp, Homo sapiens
caacctgatgtgcatgccacgg

SEQ ID NO: 7628823 - DNA, 22 bp, Homo sapiens
caacctgatgtgcatgccacgg

SEQ ID NO: 7628824 - DNA, 22 bp, Homo sapiens
caactaatatagggcatgagaa

SEQ ID NO: 7628825 - DNA, 22 bp, Homo sapiens
caactaatcctttgaaaagaag

SEQ ID NO: 7628826 - DNA, 22 bp, Homo sapiens
caactaatcctttgaaaagaag

SEQ ID NO: 7628827 - DNA, 22 bp, Homo sapiens
caactaatcctttgaaaagaag

SEQ ID NO: 7628828 - DNA, 22 bp, Homo sapiens
caactacaggaaaagtcattca

SEQ ID NO: 7628829 - DNA, 22 bp, Homo sapiens
caactacaggaaaagtcattca

SEQ ID NO: 7628830 - DNA, 22 bp, Homo sapiens
caactacaggaaaagtcattca

SEQ ID NO: 7628831 - DNA, 22 bp, Homo sapiens
caactacaggaaaagtcattca

SEQ ID NO: 7628832 - DNA, 22 bp, Homo sapiens
caactacatccacactttgtta

SEQ ID NO: 7628833 - DNA, 22 bp, Homo sapiens
gctgcctgccttgcctggagga

SEQ ID NO: 7628834 - DNA, 22 bp, Homo sapiens
gctgccttgaacttggcctggg

SEQ ID NO: 7628835 - DNA, 22 bp, Homo sapiens
gctgccttgaacttggcctggg

SEQ ID NO: 7628836 - DNA, 22 bp, Homo sapiens
gctgccttgccaggggcagaaa

SEQ ID NO: 7628837 - DNA, 22 bp, Homo sapiens
gctgccttgccaggggcagaaa

SEQ ID NO: 7628838 - DNA, 22 bp, Homo sapiens
gctgccttgccctcttcccata

SEQ ID NO: 7628839 - DNA, 22 bp, Homo sapiens
gctgccttgccctcttcccata

SEQ ID NO: 7628840 - DNA, 20 bp, Homo sapiens
gctgccttggatggctacac

SEQ ID NO: 7628841 - DNA, 22 bp, Homo sapiens
gctgccttgcttactccactgc

SEQ ID NO: 7628842 - DNA, 20 bp, Homo sapiens
gctgccttggatggctacac

SEQ ID NO: 7628843 - DNA, 22 bp, Homo sapiens
gctgccttgccctcttcccata

SEQ ID NO: 7628844 - DNA, 22 bp, Homo sapiens
gctgccttgcttactccactgc

SEQ ID NO: 7628845 - DNA, 22 bp, Homo sapiens
gctgcctttagggggtgctcag

SEQ ID NO: 7628846 - DNA, 22 bp, Homo sapiens
gctgcctttgtgagccaagggg

SEQ ID NO: 7628847 - DNA, 22 bp, Homo sapiens
gctgcctttagggggtgctcag

SEQ ID NO: 7628848 - DNA, 22 bp, Homo sapiens
gctgcctttagggggtgctcag

SEQ ID NO: 7628849 - DNA, 20 bp, Homo sapiens
gctgccttgtcctgcttggt

SEQ ID NO: 7628850 - DNA, 20 bp, Homo sapiens
gctgccttgtcctgcttggt

SEQ ID NO: 7628851 - DNA, 20 bp, Homo sapiens
gctgccttgtcctgcttggt

SEQ ID NO: 7628852 - DNA, 22 bp, Homo sapiens
gctgccttggtagtgaccatct

SEQ ID NO: 7628853 - DNA, 22 bp, Homo sapiens
gctgccttggtagtgaccatct

SEQ ID NO: 7628854 - DNA, 22 bp, Homo sapiens
gctgccttcccggaatgtcatc

SEQ ID NO: 7628855 - DNA, 22 bp, Homo sapiens
gctgccttcccggaatgtcatc

SEQ ID NO: 7628856 - DNA, 22 bp, Homo sapiens
gctgccttcccaggcctttgct

SEQ ID NO: 7628857 - DNA, 22 bp, Homo sapiens
gctgccttccctgttctttcag

SEQ ID NO: 7628858 - DNA, 22 bp, Homo sapiens
gctgccttcccggaatgtcatc

SEQ ID NO: 7628859 - DNA, 22 bp, Homo sapiens
gctgccttccctgttctttcag

SEQ ID NO: 7628860 - DNA, 22 bp, Homo sapiens
gctgccttcccaggcctttgct

SEQ ID NO: 7628861 - DNA, 18 bp, Homo sapiens
gctgccttcccagtcaag

SEQ ID NO: 7628862 - DNA, 22 bp, Homo sapiens
gctgccttcccaggcctttgct

SEQ ID NO: 7628863 - DNA, 18 bp, Homo sapiens
gctgccttcccagtcaag

SEQ ID NO: 7628864 - DNA, 22 bp, Homo sapiens
gctgccttctggaggaagtgaa

SEQ ID NO: 7628865 - DNA, 22 bp, Homo sapiens
gctgccttctgagaagttaaat

SEQ ID NO: 7628866 - DNA, 22 bp, Homo sapiens
gctgccttcttctgactctatt

SEQ ID NO: 7628867 - DNA, 22 bp, Homo sapiens
gctgccttctggaggaagtgaa

SEQ ID NO: 7628868 - DNA, 22 bp, Homo sapiens
gctgccttgaacatcctaagta

SEQ ID NO: 7628869 - DNA, 22 bp, Homo sapiens
gctgccttgaacttggcctggg

SEQ ID NO: 7628870 - DNA, 22 bp, Homo sapiens
gctgccttgaacttggcctggg

SEQ ID NO: 7628871 - DNA, 22 bp, Homo sapiens
gctgccttgaacatcctaagta

SEQ ID NO: 7628872 - DNA, 22 bp, Homo sapiens
gctgccttgaacatcctaagta

SEQ ID NO: 7628873 - DNA, 22 bp, Homo sapiens
gctgccttgaacatcctaagta

SEQ ID NO: 7628874 - DNA, 22 bp, Homo sapiens
caagatatcaatgacatagtat

SEQ ID NO: 7628875 - DNA, 22 bp, Homo sapiens
caagatatcaatgacatagtat

SEQ ID NO: 7628876 - DNA, 22 bp, Homo sapiens
caagatactcagaaaggcattg

SEQ ID NO: 7628877 - DNA, 22 bp, Homo sapiens
caagatactcagaaaggcattg

SEQ ID NO: 7628878 - DNA, 22 bp, Homo sapiens
caagatatgtgttgttagctct

SEQ ID NO: 7628879 - DNA, 22 bp, Homo sapiens
caagatatgtcctgttactaag

SEQ ID NO: 7628880 - DNA, 22 bp, Homo sapiens
caagatatgtcctgttactaag

SEQ ID NO: 7628881 - DNA, 22 bp, Homo sapiens
caagatatgtcctgttactaag

SEQ ID NO: 7628882 - DNA, 22 bp, Homo sapiens
caagatatcaatgacatagtat

SEQ ID NO: 7628883 - DNA, 22 bp, Homo sapiens
caagatcacacaggtaacaagt

SEQ ID NO: 7628884 - DNA, 22 bp, Homo sapiens
caagatcacacaggtaacaagt

SEQ ID NO: 7628885 - DNA, 22 bp, Homo sapiens
caagatcacacaggtaacaagt

SEQ ID NO: 7628886 - DNA, 22 bp, Homo sapiens
caagatcagggtgccagaatgg

SEQ ID NO: 7628887 - DNA, 22 bp, Homo sapiens
caagatcagggtgccagaatgg

SEQ ID NO: 7628888 - DNA, 22 bp, Homo sapiens
caagatcaaggtgtcagcaggt

SEQ ID NO: 7628889 - DNA, 22 bp, Homo sapiens
caagatcaaggtatcagcagat

SEQ ID NO: 7628890 - DNA, 22 bp, Homo sapiens
caagatcaaggtatcagcagat

SEQ ID NO: 7628891 - DNA, 22 bp, Homo sapiens
caagatcaaggtgtcagcaggt

SEQ ID NO: 7628892 - DNA, 22 bp, Homo sapiens
caagatcaagtgtagtatcaaa

SEQ ID NO: 7628893 - DNA, 22 bp, Homo sapiens
caagatcaagtgtagtatcaaa

SEQ ID NO: 7628894 - DNA, 22 bp, Homo sapiens
caagatcaagtgtagtatcaaa

SEQ ID NO: 7628895 - DNA, 22 bp, Homo sapiens
caagatgaaattgtgatatttt

SEQ ID NO: 7628896 - DNA, 22 bp, Homo sapiens
caagatgacaaggctggaggct

SEQ ID NO: 7628897 - DNA, 22 bp, Homo sapiens
caagatgaatgatgaagtgtgt

SEQ ID NO: 7628898 - DNA, 22 bp, Homo sapiens
caagatgaagtgaagattagaa

SEQ ID NO: 7628899 - DNA, 22 bp, Homo sapiens
caagatgactttgggggattaa

SEQ ID NO: 7628900 - DNA, 22 bp, Homo sapiens
caagatgatccctgaaggcagc

SEQ ID NO: 7628901 - DNA, 21 bp, Homo sapiens
caagatctcggcttgcttcct

SEQ ID NO: 7628902 - DNA, 22 bp, Homo sapiens
caagatcagggtgccagaatgg

SEQ ID NO: 7628903 - DNA, 22 bp, Homo sapiens
caagatgaaattgtgatatttt

SEQ ID NO: 7628904 - DNA, 22 bp, Homo sapiens
caagatgaaattgtgatatttt

SEQ ID NO: 7628905 - DNA, 22 bp, Homo sapiens
caagatgaaattgtgatatttt

SEQ ID NO: 7628906 - DNA, 22 bp, Homo sapiens
caagatgaaactacagggagga

SEQ ID NO: 7628907 - DNA, 22 bp, Homo sapiens
caagatgaaactacagggagga

SEQ ID NO: 7628908 - DNA, 22 bp, Homo sapiens
caagataaaatcagcattccaa

SEQ ID NO: 7628909 - DNA, 22 bp, Homo sapiens
caagataaaatcagcattccaa

SEQ ID NO: 7628910 - DNA, 22 bp, Homo sapiens
caagataatttattctgagttt

SEQ ID NO: 7628911 - DNA, 22 bp, Homo sapiens
caagataagatcatttacacta

SEQ ID NO: 7628912 - DNA, 22 bp, Homo sapiens
caagataatttattctgagttt

SEQ ID NO: 7628913 - DNA, 22 bp, Homo sapiens
caagataaagccaccagaagct

SEQ ID NO: 7628914 - DNA, 22 bp, Homo sapiens
caagataaagccaccagaagct

SEQ ID NO: 7628915 - DNA, 22 bp, Homo sapiens
caagaggctaaactgggctatt

SEQ ID NO: 7628916 - DNA, 22 bp, Homo sapiens
caagagggaacctaagatgtat

SEQ ID NO: 7628917 - DNA, 22 bp, Homo sapiens
caagagggaacctaagatgtat

SEQ ID NO: 7628918 - DNA, 22 bp, Homo sapiens
caagagtgaaactctgtctcaa

SEQ ID NO: 7628919 - DNA, 22 bp, Homo sapiens
caagagtgaaactctgtctcaa

SEQ ID NO: 7628920 - DNA, 22 bp, Homo sapiens
caagaggcaaattgtctagaag

SEQ ID NO: 7628921 - DNA, 22 bp, Homo sapiens
caagaggcaaattgtctagaag

SEQ ID NO: 7628922 - DNA, 22 bp, Homo sapiens
caagaggctaaactgggctatt

SEQ ID NO: 7628923 - DNA, 22 bp, Homo sapiens
caagaggctaaactgggctatt

SEQ ID NO: 7628924 - DNA, 22 bp, Homo sapiens
caagaggattattaataaataa

SEQ ID NO: 7628925 - DNA, 22 bp, Homo sapiens
caagaggctaaactgggctatt

SEQ ID NO: 7628926 - DNA, 22 bp, Homo sapiens
caagagctggagaggcagtcta

SEQ ID NO: 7628927 - DNA, 18 bp, Homo sapiens
caagagctgctcctggcc

SEQ ID NO: 7628928 - DNA, 22 bp, Homo sapiens
caagagctgggtggcaagctag

SEQ ID NO: 7628929 - DNA, 22 bp, Homo sapiens
caagagctgggtggcaagctag

SEQ ID NO: 7628930 - DNA, 22 bp, Homo sapiens
caagagcttctgctcttcatgg

SEQ ID NO: 7628931 - DNA, 22 bp, Homo sapiens
caagaggagcaggcaggtgtgc

SEQ ID NO: 7628932 - DNA, 22 bp, Homo sapiens
caagaggagcaggcaggtgtgc

SEQ ID NO: 7628933 - DNA, 22 bp, Homo sapiens
caagagctttagaaatgctcat

SEQ ID NO: 7628934 - DNA, 22 bp, Homo sapiens
caagagctttagaaatgctcat

SEQ ID NO: 7628935 - DNA, 22 bp, Homo sapiens
caagaggagcaggcaggtgtgc

SEQ ID NO: 7628936 - DNA, 22 bp, Homo sapiens
caagaggcaaattgtctagaag

SEQ ID NO: 7628937 - DNA, 22 bp, Homo sapiens
caagaggagcaggcaggtgtgc

SEQ ID NO: 7628938 - DNA, 22 bp, Homo sapiens
caagaggagcaggcaggtgtgc

SEQ ID NO: 7628939 - DNA, 22 bp, Homo sapiens
caaggaggaagatgcaggggac

SEQ ID NO: 7628940 - DNA, 22 bp, Homo sapiens
caaggaggcagtgggacttgaa

SEQ ID NO: 7628941 - DNA, 22 bp, Homo sapiens
caaggaggcagtgggacttgaa

SEQ ID NO: 7628942 - DNA, 22 bp, Homo sapiens
caaggaggcagtgggacttgaa

SEQ ID NO: 7628943 - DNA, 22 bp, Homo sapiens
caaggaggaagatgcaggggac

SEQ ID NO: 7628944 - DNA, 22 bp, Homo sapiens
caaggaggaagatgcaggggac

SEQ ID NO: 7628945 - DNA, 22 bp, Homo sapiens
caaggaggaagatgcaggggac

SEQ ID NO: 7628946 - DNA, 22 bp, Homo sapiens
caaggagataaaatgttgagct

SEQ ID NO: 7628947 - DNA, 22 bp, Homo sapiens
caaggagataaaatgttgagct

SEQ ID NO: 7628948 - DNA, 22 bp, Homo sapiens
caaggagagtaattgaatgaga

SEQ ID NO: 7628949 - DNA, 22 bp, Homo sapiens
caaggagagtaattgaatgaga

SEQ ID NO: 7628950 - DNA, 22 bp, Homo sapiens
caaggacactgatgttcatcct

SEQ ID NO: 7628951 - DNA, 22 bp, Homo sapiens
caaggacactgatgttcatcct

SEQ ID NO: 7628952 - DNA, 22 bp, Homo sapiens
caaggacactgatgttcatcct

SEQ ID NO: 7628953 - DNA, 22 bp, Homo sapiens
caaggacactgatgttcatcct

SEQ ID NO: 7628954 - DNA, 22 bp, Homo sapiens
caaggacactgatgttcatcct

SEQ ID NO: 7628955 - DNA, 22 bp, Homo sapiens
caaggacagcgtcaggtgcaac

SEQ ID NO: 7628956 - DNA, 22 bp, Homo sapiens
caaggacagcgtcaggtgcaac

SEQ ID NO: 7628957 - DNA, 22 bp, Homo sapiens
caaggacagcgtcaggtgcaac

SEQ ID NO: 7628958 - DNA, 22 bp, Homo sapiens
caaggacagcgtcaggtgcaac

SEQ ID NO: 7628959 - DNA, 22 bp, Homo sapiens
caaggagaaaacggcttctgaa

SEQ ID NO: 7628960 - DNA, 22 bp, Homo sapiens
caaggagaaaacggcttctgaa

SEQ ID NO: 7628961 - DNA, 21 bp, Homo sapiens
caaggacaggttgcagggcaa

SEQ ID NO: 7628962 - DNA, 21 bp, Homo sapiens
caaggacaggttgcagggcaa

SEQ ID NO: 7628963 - DNA, 21 bp, Homo sapiens
caaggacaggttgcagggcaa

SEQ ID NO: 7628964 - DNA, 22 bp, Homo sapiens
caaggacagcgtcaggtgcaac

SEQ ID NO: 7628965 - DNA, 21 bp, Homo sapiens
caaggacaggttgcagggcaa

SEQ ID NO: 7628966 - DNA, 21 bp, Homo sapiens
caaggacaggttgcagggcaa

SEQ ID NO: 7628967 - DNA, 21 bp, Homo sapiens
caaggacaggttgcagggcaa

SEQ ID NO: 7628968 - DNA, 21 bp, Homo sapiens
caaggacaggttgcagggcaa

SEQ ID NO: 7628969 - DNA, 21 bp, Homo sapiens
caaggacaggttgcagggcaa

SEQ ID NO: 7628970 - DNA, 22 bp, Homo sapiens
caaggaatcccatttctaactc

SEQ ID NO: 7628971 - DNA, 22 bp, Homo sapiens
caaggaatatttaagaacgtca

SEQ ID NO: 7628972 - DNA, 22 bp, Homo sapiens
caaggaatatttaagaacgtca

SEQ ID NO: 7628973 - DNA, 22 bp, Homo sapiens
caaggaagttttaggagaggaa

SEQ ID NO: 7628974 - DNA, 21 bp, Homo sapiens
caagctgcctgagggtggttg

SEQ ID NO: 7628975 - DNA, 22 bp, Homo sapiens
caagctgcttattctctgctct

SEQ ID NO: 7628976 - DNA, 22 bp, Homo sapiens
caagctgcttattctctgctct

SEQ ID NO: 7628977 - DNA, 22 bp, Homo sapiens
caaggaagttttaggagaggaa

SEQ ID NO: 7628978 - DNA, 22 bp, Homo sapiens
caaggacactccctgctgggca

SEQ ID NO: 7628979 - DNA, 22 bp, Homo sapiens
caaggacactgagctttgtaaa

SEQ ID NO: 7628980 - DNA, 22 bp, Homo sapiens
caaggacaacttcatattgtgg

SEQ ID NO: 7628981 - DNA, 22 bp, Homo sapiens
caaggacaacttcatattgtgg

SEQ ID NO: 7628982 - DNA, 22 bp, Homo sapiens
caaggacaacttcatattgtgg

SEQ ID NO: 7628983 - DNA, 22 bp, Homo sapiens
caaggacactccctgctgggca

SEQ ID NO: 7628984 - DNA, 22 bp, Homo sapiens
caaggacactccctgctgggca

SEQ ID NO: 7628985 - DNA, 22 bp, Homo sapiens
caaggacactccctgctgggca

SEQ ID NO: 7628986 - DNA, 22 bp, Homo sapiens
caaggacactccctgctgggca

SEQ ID NO: 7628987 - DNA, 22 bp, Homo sapiens
caagatggagaagcagcaaggg

SEQ ID NO: 7628988 - DNA, 22 bp, Homo sapiens
caagatggagaagcagcaaggg

SEQ ID NO: 7628989 - DNA, 22 bp, Homo sapiens
caagatgggtgttgtgatggtt

SEQ ID NO: 7628990 - DNA, 22 bp, Homo sapiens
caagatgcccctggtagggatc

SEQ ID NO: 7628991 - DNA, 22 bp, Homo sapiens
caagatggacataaggagagaa

SEQ ID NO: 7628992 - DNA, 22 bp, Homo sapiens
caagatggacataaggagagaa

SEQ ID NO: 7628993 - DNA, 22 bp, Homo sapiens
caagatgatccctgaaggcagc

SEQ ID NO: 7628994 - DNA, 22 bp, Homo sapiens
caagatgcccctggtagggatc

SEQ ID NO: 7628995 - DNA, 22 bp, Homo sapiens
caagatgtgcctaatcagacct

SEQ ID NO: 7628996 - DNA, 22 bp, Homo sapiens
caagatgtggtgggctgagttt

SEQ ID NO: 7628997 - DNA, 22 bp, Homo sapiens
caagctgccaccagaagagcat

SEQ ID NO: 7628998 - DNA, 22 bp, Homo sapiens
caagattactatccactgctgg

SEQ ID NO: 7628999 - DNA, 22 bp, Homo sapiens
caagattactatccactgctgg

SEQ ID NO: 7629000 - DNA, 22 bp, Homo sapiens
caacactgattatggctgagct

SEQ ID NO: 7629001 - DNA, 22 bp, Homo sapiens
caacactgacaatggactgatt

SEQ ID NO: 7629002 - DNA, 19 bp, Homo sapiens
caacagtactggtttgtcc

SEQ ID NO: 7629003 - DNA, 22 bp, Homo sapiens
caacactgattatggctgagct

SEQ ID NO: 7629004 - DNA, 22 bp, Homo sapiens
caacactgattatggctgagct

SEQ ID NO: 7629005 - DNA, 22 bp, Homo sapiens
caacactgattatggctgagct

SEQ ID NO: 7629006 - DNA, 22 bp, Homo sapiens
caacagtatagcttttgactgc

SEQ ID NO: 7629007 - DNA, 22 bp, Homo sapiens
caacagtatagcttttgactgc

SEQ ID NO: 7629008 - DNA, 22 bp, Homo sapiens
caacagtatagcttttgactgc

SEQ ID NO: 7629009 - DNA, 19 bp, Homo sapiens
caacagtactggtttgtcc

SEQ ID NO: 7629010 - DNA, 22 bp, Homo sapiens
caacagtgattctgcatgagga

SEQ ID NO: 7629011 - DNA, 22 bp, Homo sapiens
caacagtgattctgcatgagga

SEQ ID NO: 7629012 - DNA, 22 bp, Homo sapiens
caacagtctctatagctccttg

SEQ ID NO: 7629013 - DNA, 19 bp, Homo sapiens
gctgcattcatggtgagtg

SEQ ID NO: 7629014 - DNA, 22 bp, Homo sapiens
gctgcatggagggtgcccagga

SEQ ID NO: 7629015 - DNA, 19 bp, Homo sapiens
gctgcattcatggtgagtg

SEQ ID NO: 7629016 - DNA, 22 bp, Homo sapiens
gctgccaagggaagcgcagtgc

SEQ ID NO: 7629017 - DNA, 22 bp, Homo sapiens
gctgccacattttcaggactaa

SEQ ID NO: 7629018 - DNA, 23 bp, Homo sapiens
gctgccacagggctcaggcaggt

SEQ ID NO: 7629019 - DNA, 23 bp, Homo sapiens
gctgccacagggctcaggcaggt

SEQ ID NO: 7629020 - DNA, 23 bp, Homo sapiens
gctgccacagggctcaggcaggt

SEQ ID NO: 7629021 - DNA, 23 bp, Homo sapiens
gctgccacagggctcaggcaggt

SEQ ID NO: 7629022 - DNA, 21 bp, Homo sapiens
gctgccaccgcgtgctccagg

SEQ ID NO: 7629023 - DNA, 21 bp, Homo sapiens
gctgccaccgcgtgctccagg

SEQ ID NO: 7629024 - DNA, 22 bp, Homo sapiens
gctgccacattttcaggactaa

SEQ ID NO: 7629025 - DNA, 22 bp, Homo sapiens
gctgccacattttcaggactaa

SEQ ID NO: 7629026 - DNA, 22 bp, Homo sapiens
gctgccaccgtggagatgagtg

SEQ ID NO: 7629027 - DNA, 21 bp, Homo sapiens
gctgccaccgcgtgctccagg

SEQ ID NO: 7629028 - DNA, 21 bp, Homo sapiens
gctgccaccgcgtgctccagg

SEQ ID NO: 7629029 - DNA, 21 bp, Homo sapiens
gctgccaccgcgtgctccagg

SEQ ID NO: 7629030 - DNA, 22 bp, Homo sapiens
gctgcagtgagccaagatcgtg

SEQ ID NO: 7629031 - DNA, 22 bp, Homo sapiens
gctgcagtgagccaagatcgtg

SEQ ID NO: 7629032 - DNA, 22 bp, Homo sapiens
gctgcagtgagccaagatcgtg

SEQ ID NO: 7629033 - DNA, 22 bp, Homo sapiens
gctgcagtgttggacctcaggg

SEQ ID NO: 7629034 - DNA, 22 bp, Homo sapiens
gctgcagtgttggacctcaggg

SEQ ID NO: 7629035 - DNA, 22 bp, Homo sapiens
gctgcatgacagacaggcctgg

SEQ ID NO: 7629036 - DNA, 22 bp, Homo sapiens
gctgcatggagggtgcccagga

SEQ ID NO: 7629037 - DNA, 22 bp, Homo sapiens
gctgcatgacagacaggcctgg

SEQ ID NO: 7629038 - DNA, 22 bp, Homo sapiens
gctgcagtgagccaagatcgtg

SEQ ID NO: 7629039 - DNA, 22 bp, Homo sapiens
gctgcagtgagccaagatcgtg

SEQ ID NO: 7629040 - DNA, 22 bp, Homo sapiens
gctgcagtgagccaagatcgtg

SEQ ID NO: 7629041 - DNA, 22 bp, Homo sapiens
gctgcagtgagccaagatcgtg

SEQ ID NO: 7629042 - DNA, 22 bp, Homo sapiens
gctgcagtgagccaagatcgtg

SEQ ID NO: 7629043 - DNA, 22 bp, Homo sapiens
gctgcagtgagccaagatcgtg

SEQ ID NO: 7629044 - DNA, 22 bp, Homo sapiens
gctgcagtgagccaagatcgtg

SEQ ID NO: 7629045 - DNA, 17 bp, Homo sapiens
gctgcagcggtaggcag

SEQ ID NO: 7629046 - DNA, 17 bp, Homo sapiens
gctgcagcggtaggcag

SEQ ID NO: 7629047 - DNA, 22 bp, Homo sapiens
gctgcaggtttgtctagtctgg

SEQ ID NO: 7629048 - DNA, 22 bp, Homo sapiens
gctgcaggtttgtctagtctgg

SEQ ID NO: 7629049 - DNA, 22 bp, Homo sapiens
gctgcagccctgcggatcactt

SEQ ID NO: 7629050 - DNA, 22 bp, Homo sapiens
gctgcagccctgcggatcactt

SEQ ID NO: 7629051 - DNA, 22 bp, Homo sapiens
gctgcagccctgcggatcactt

SEQ ID NO: 7629052 - DNA, 22 bp, Homo sapiens
gctgcagccttcttgccattaa

SEQ ID NO: 7629053 - DNA, 22 bp, Homo sapiens
gctgcagccctgcggatcactt

SEQ ID NO: 7629054 - DNA, 22 bp, Homo sapiens
gctgcagcctttgggaaggaca

SEQ ID NO: 7629055 - DNA, 22 bp, Homo sapiens
gctgcagcctttgggaaggaca

SEQ ID NO: 7629056 - DNA, 22 bp, Homo sapiens
gctgcagcctttgggaaggaca

SEQ ID NO: 7629057 - DNA, 22 bp, Homo sapiens
gctgcagcctttgggaaggaca

SEQ ID NO: 7629058 - DNA, 22 bp, Homo sapiens
gctgcagccttcttgccattaa

SEQ ID NO: 7629059 - DNA, 17 bp, Homo sapiens
gctgcagcggtaggcag

SEQ ID NO: 7629060 - DNA, 17 bp, Homo sapiens
gctgcagcggtaggcag

SEQ ID NO: 7629061 - DNA, 22 bp, Homo sapiens
gctgcagcctttgggaaggaca

SEQ ID NO: 7629062 - DNA, 22 bp, Homo sapiens
caacatattttccaagagtgaa

SEQ ID NO: 7629063 - DNA, 22 bp, Homo sapiens
caacatattttccaagagtgaa

SEQ ID NO: 7629064 - DNA, 22 bp, Homo sapiens
caacatattgtgggatgagaga

SEQ ID NO: 7629065 - DNA, 22 bp, Homo sapiens
caacatatgctttcatgaggta

SEQ ID NO: 7629066 - DNA, 22 bp, Homo sapiens
caacatatgctttcatgaggta

SEQ ID NO: 7629067 - DNA, 22 bp, Homo sapiens
caacatcagtcctcatgagaca

SEQ ID NO: 7629068 - DNA, 22 bp, Homo sapiens
caacatcagtcctcatgagaca

SEQ ID NO: 7629069 - DNA, 22 bp, Homo sapiens
caacatcagtcctcatgagaca

SEQ ID NO: 7629070 - DNA, 22 bp, Homo sapiens
caacatcagtcctcatgagaca

SEQ ID NO: 7629071 - DNA, 22 bp, Homo sapiens
caacatatgattttgtatataa

SEQ ID NO: 7629072 - DNA, 22 bp, Homo sapiens
caacatatgattttgtatataa

SEQ ID NO: 7629073 - DNA, 22 bp, Homo sapiens
caacatatataaggatttacta

SEQ ID NO: 7629074 - DNA, 22 bp, Homo sapiens
caacatatgattttgtatataa

SEQ ID NO: 7629075 - DNA, 22 bp, Homo sapiens
caacatatgattttgtatataa

SEQ ID NO: 7629076 - DNA, 22 bp, Homo sapiens
caacatatgattttgtatataa

SEQ ID NO: 7629077 - DNA, 22 bp, Homo sapiens
caacagtgttgcaatctgaaaa

SEQ ID NO: 7629078 - DNA, 22 bp, Homo sapiens
caacagtgattctgcatgagga

SEQ ID NO: 7629079 - DNA, 22 bp, Homo sapiens
caacagttcagttgagctcaac

SEQ ID NO: 7629080 - DNA, 22 bp, Homo sapiens
caacagttcagttgagctcaac

SEQ ID NO: 7629081 - DNA, 22 bp, Homo sapiens
caacagtgttgcaatctgaaaa

SEQ ID NO: 7629082 - DNA, 22 bp, Homo sapiens
caacagttcagttgagctcaac

SEQ ID NO: 7629083 - DNA, 22 bp, Homo sapiens
caacagttcagttgagctcaac

SEQ ID NO: 7629084 - DNA, 22 bp, Homo sapiens
caacagttctcatagcagattc

SEQ ID NO: 7629085 - DNA, 22 bp, Homo sapiens
caacagttcctccatcctctct

SEQ ID NO: 7629086 - DNA, 22 bp, Homo sapiens
caacagttctcatagcagattc

SEQ ID NO: 7629087 - DNA, 22 bp, Homo sapiens
caacagtttatagtgttatctt

SEQ ID NO: 7629088 - DNA, 19 bp, Homo sapiens
caacagttgcaacactgtc

SEQ ID NO: 7629089 - DNA, 22 bp, Homo sapiens
caacatataatatttgagttct

SEQ ID NO: 7629090 - DNA, 22 bp, Homo sapiens
caacagtttatagtgttatctt

SEQ ID NO: 7629091 - DNA, 22 bp, Homo sapiens
caacagtttatagtgttatctt

SEQ ID NO: 7629092 - DNA, 22 bp, Homo sapiens
caacagtttatagtgttatctt

SEQ ID NO: 7629093 - DNA, 22 bp, Homo sapiens
caacatataatatttgagttct

SEQ ID NO: 7629094 - DNA, 22 bp, Homo sapiens
caacatttgtgatgagcaaact

SEQ ID NO: 7629095 - DNA, 22 bp, Homo sapiens
caacatttgtgatgagcaaact

SEQ ID NO: 7629096 - DNA, 22 bp, Homo sapiens
caacatttgtgatgagcaaact

SEQ ID NO: 7629097 - DNA, 22 bp, Homo sapiens
caacatttgagtaaagaaatgg

SEQ ID NO: 7629098 - DNA, 22 bp, Homo sapiens
caacatttgtgatgagcaaact

SEQ ID NO: 7629099 - DNA, 22 bp, Homo sapiens
caacattttcatggccagggag

SEQ ID NO: 7629100 - DNA, 22 bp, Homo sapiens
caaccagtagctgagttcaaaa

SEQ ID NO: 7629101 - DNA, 22 bp, Homo sapiens
caaccagtagctgagttcaaaa

SEQ ID NO: 7629102 - DNA, 22 bp, Homo sapiens
caacccaaaagcgtttccattt

SEQ ID NO: 7629103 - DNA, 19 bp, Homo sapiens
caaccatgaactgtggtgt

SEQ ID NO: 7629104 - DNA, 22 bp, Homo sapiens
caacccaaggttagttggtctt

SEQ ID NO: 7629105 - DNA, 22 bp, Homo sapiens
caaccccactacacgttggaga

SEQ ID NO: 7629106 - DNA, 22 bp, Homo sapiens
caacatttgagtaaagaaatgg

SEQ ID NO: 7629107 - DNA, 22 bp, Homo sapiens
caacatttgagtaaagaaatgg

SEQ ID NO: 7629108 - DNA, 22 bp, Homo sapiens
caacatttcaaggtctttagga

SEQ ID NO: 7629109 - DNA, 22 bp, Homo sapiens
caacatttcaaggtctttagga

SEQ ID NO: 7629110 - DNA, 22 bp, Homo sapiens
caacatttgagtaaagaaatgg

SEQ ID NO: 7629111 - DNA, 22 bp, Homo sapiens
caacatttgagtaaagaaatgg

SEQ ID NO: 7629112 - DNA, 22 bp, Homo sapiens
caacatttgagtaaagaaatgg

SEQ ID NO: 7629113 - DNA, 22 bp, Homo sapiens
caacatttgagtaaagaaatgg

SEQ ID NO: 7629114 - DNA, 22 bp, Homo sapiens
caacatttcaaggtctttagga

SEQ ID NO: 7629115 - DNA, 22 bp, Homo sapiens
caacatttcaaggtctttagga

SEQ ID NO: 7629116 - DNA, 22 bp, Homo sapiens
caacattcaaccaacatttatg

SEQ ID NO: 7629117 - DNA, 22 bp, Homo sapiens
caacattcttatcactataagc

SEQ ID NO: 7629118 - DNA, 22 bp, Homo sapiens
caacattcttatcactataagc

SEQ ID NO: 7629119 - DNA, 22 bp, Homo sapiens
caacattatatagccacatgcc

SEQ ID NO: 7629120 - DNA, 22 bp, Homo sapiens
caacattatatagccacatgcc

SEQ ID NO: 7629121 - DNA, 22 bp, Homo sapiens
caacattatatagccacatgcc

SEQ ID NO: 7629122 - DNA, 22 bp, Homo sapiens
caacattcaaccaacatttatg

SEQ ID NO: 7629123 - DNA, 22 bp, Homo sapiens
caacattcaaccaacatttatg

SEQ ID NO: 7629124 - DNA, 22 bp, Homo sapiens
caacattcaaccaacatttatg

SEQ ID NO: 7629125 - DNA, 22 bp, Homo sapiens
caacattatatagccacatgcc

SEQ ID NO: 7629126 - DNA, 22 bp, Homo sapiens
caacatgccagacattagtttg

SEQ ID NO: 7629127 - DNA, 22 bp, Homo sapiens
caacatggtaaaaccccgtctc

SEQ ID NO: 7629128 - DNA, 22 bp, Homo sapiens
caacatggtgaaaccccgtctc

SEQ ID NO: 7629129 - DNA, 22 bp, Homo sapiens
caacatgtgttagacaatagac

SEQ ID NO: 7629130 - DNA, 22 bp, Homo sapiens
caacatgtgttagacaatagac

SEQ ID NO: 7629131 - DNA, 22 bp, Homo sapiens
caacatgccagacattagtttg

SEQ ID NO: 7629132 - DNA, 22 bp, Homo sapiens
caacatggcgaaaccccatctc

SEQ ID NO: 7629133 - DNA, 22 bp, Homo sapiens
caacatctttgtgtatgtgaga

SEQ ID NO: 7629134 - DNA, 20 bp, Homo sapiens
caacatgagcaagtgaactg

SEQ ID NO: 7629135 - DNA, 22 bp, Homo sapiens
caacatctgtatcattagtaca

SEQ ID NO: 7629136 - DNA, 22 bp, Homo sapiens
caaaggttatgaaccacttgta

SEQ ID NO: 7629137 - DNA, 22 bp, Homo sapiens
caaaggttggaaatgtttacca

SEQ ID NO: 7629138 - DNA, 22 bp, Homo sapiens
caaaggttgttgagagtgcagg

SEQ ID NO: 7629139 - DNA, 22 bp, Homo sapiens
caaaggttatgaaccacttgta
